United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 177

SEQ ID NO: 7387899 - DNA, 22 bp, Homo sapiens
ttcatgtttcaattgttaatgt

SEQ ID NO: 7387900 - DNA, 22 bp, Homo sapiens
ttcatggtattggagtatgagg

SEQ ID NO: 7387901 - DNA, 22 bp, Homo sapiens
ttcagtgagtgaatgaatgaat

SEQ ID NO: 7387902 - DNA, 22 bp, Homo sapiens
ttcagtgctaaaaagtctcaag

SEQ ID NO: 7387903 - DNA, 22 bp, Homo sapiens
ttcatgcactatttcttctagc

SEQ ID NO: 7387904 - DNA, 22 bp, Homo sapiens
ttctagtgtccttggacttgct

SEQ ID NO: 7387905 - DNA, 22 bp, Homo sapiens
ttctcttttagaggctccatga

SEQ ID NO: 7387906 - DNA, 22 bp, Homo sapiens
ttctagttttgccacaggatac

SEQ ID NO: 7387907 - DNA, 22 bp, Homo sapiens
ttctgaatcctcgaaacatagc

SEQ ID NO: 7387908 - DNA, 22 bp, Homo sapiens
ttctgaatcctcgaaacatagc

SEQ ID NO: 7387909 - DNA, 22 bp, Homo sapiens
ttctgaagggctaagtgtctat

SEQ ID NO: 7387910 - DNA, 22 bp, Homo sapiens
ttctgaatttctgtgtatctta

SEQ ID NO: 7387911 - DNA, 22 bp, Homo sapiens
ttctgaattcatgagatttggg

SEQ ID NO: 7387912 - DNA, 22 bp, Homo sapiens
ttctgaatggcaagcattaggc

SEQ ID NO: 7387913 - DNA, 22 bp, Homo sapiens
ttctgaatgatagtcttgaact

SEQ ID NO: 7387914 - DNA, 22 bp, Homo sapiens
ttctgagagtaaacatagcctg

SEQ ID NO: 7387915 - DNA, 21 bp, Homo sapiens
ttctgccttcccctagctggg

SEQ ID NO: 7387916 - DNA, 22 bp, Homo sapiens
ttctgctatacttatgaataca

SEQ ID NO: 7387917 - DNA, 22 bp, Homo sapiens
ttctgctccaccacttccagca

SEQ ID NO: 7387918 - DNA, 22 bp, Homo sapiens
ttctgcctgccccagagaggcc

SEQ ID NO: 7387919 - DNA, 22 bp, Homo sapiens
ttctgctccaccacttccagca

SEQ ID NO: 7387920 - DNA, 21 bp, Homo sapiens
ttctgctccagctcctctggg

SEQ ID NO: 7387921 - DNA, 20 bp, Homo sapiens
ttctgcttttgcttagggac

SEQ ID NO: 7387922 - DNA, 22 bp, Homo sapiens
ttctgggcagagctggagctgc

SEQ ID NO: 7387923 - DNA, 22 bp, Homo sapiens
ttctgctttggttccatggatg

SEQ ID NO: 7387924 - DNA, 22 bp, Homo sapiens
ttctgcttttattgccagagtt

SEQ ID NO: 7387925 - DNA, 22 bp, Homo sapiens
ttctgcttttagctaaactata

SEQ ID NO: 7387926 - DNA, 22 bp, Homo sapiens
ttctgcttcactggcctggagg

SEQ ID NO: 7387927 - DNA, 22 bp, Homo sapiens
ttctgcttctgtgtgtcccagg

SEQ ID NO: 7387928 - DNA, 20 bp, Homo sapiens
ttctgcttgcaaatatcaag

SEQ ID NO: 7387929 - DNA, 22 bp, Homo sapiens
ttctgcttggttcttggtatga

SEQ ID NO: 7387930 - DNA, 21 bp, Homo sapiens
ttcttcttggactgttttggc

SEQ ID NO: 7387931 - DNA, 22 bp, Homo sapiens
ttcttgaaggggatataaatag

SEQ ID NO: 7387932 - DNA, 22 bp, Homo sapiens
ttcttgaatagggattgataaa

SEQ ID NO: 7387933 - DNA, 22 bp, Homo sapiens
ttcttgaatagggattgataaa

SEQ ID NO: 7387934 - DNA, 22 bp, Homo sapiens
ttcttctttcctataattaatt

SEQ ID NO: 7387935 - DNA, 22 bp, Homo sapiens
ttcttgaaaatagccatgtaca

SEQ ID NO: 7387936 - DNA, 22 bp, Homo sapiens
ttcttctttcctataattaatt

SEQ ID NO: 7387937 - DNA, 22 bp, Homo sapiens
ttcttctttccaattacatggt

SEQ ID NO: 7387938 - DNA, 22 bp, Homo sapiens
ttcttctttcctataattaatt

SEQ ID NO: 7387939 - DNA, 22 bp, Homo sapiens
ttctttaaaatagtgagaaaga

SEQ ID NO: 7387940 - DNA, 22 bp, Homo sapiens
ttctttaaaatagtgagaaaga

SEQ ID NO: 7387941 - DNA, 22 bp, Homo sapiens
ttctttatcagttactcatagg

SEQ ID NO: 7387942 - DNA, 22 bp, Homo sapiens
ttctgttctttatttaccatat

SEQ ID NO: 7387943 - DNA, 22 bp, Homo sapiens
ttctgtttactcagaaatacaa

SEQ ID NO: 7387944 - DNA, 22 bp, Homo sapiens
ttctgttccctaggacctgggg

SEQ ID NO: 7387945 - DNA, 22 bp, Homo sapiens
ttctgttctgatacttgtttct

SEQ ID NO: 7387946 - DNA, 22 bp, Homo sapiens
ttctgtttactcagaaatacaa

SEQ ID NO: 7387947 - DNA, 22 bp, Homo sapiens
ttcttacactcttaaaaatcat

SEQ ID NO: 7387948 - DNA, 22 bp, Homo sapiens
ttctgttttgcacagacttgaa

SEQ ID NO: 7387949 - DNA, 22 bp, Homo sapiens
ttctgttttagaaataagtagt

SEQ ID NO: 7387950 - DNA, 22 bp, Homo sapiens
ttctgttttagaaataagtagt

SEQ ID NO: 7387951 - DNA, 22 bp, Homo sapiens
ttctgtttgccatatatagtag

SEQ ID NO: 7387952 - DNA, 22 bp, Homo sapiens
ttctggtatgggaaatttcaag

SEQ ID NO: 7387953 - DNA, 23 bp, Homo sapiens
ttctgggctgtggaagcctcggg

SEQ ID NO: 7387954 - DNA, 22 bp, Homo sapiens
ttctgggcccaaccctagagtg

SEQ ID NO: 7387955 - DNA, 22 bp, Homo sapiens
ttgaatgcataaatgtactctg

SEQ ID NO: 7387956 - DNA, 22 bp, Homo sapiens
ttgaatgcatctttgagctcct

SEQ ID NO: 7387957 - DNA, 22 bp, Homo sapiens
ttgaatgccaatatctccttct

SEQ ID NO: 7387958 - DNA, 22 bp, Homo sapiens
ttgaagattctttttgttagta

SEQ ID NO: 7387959 - DNA, 22 bp, Homo sapiens
ttgaagctctaacttccaatac

SEQ ID NO: 7387960 - DNA, 22 bp, Homo sapiens
ttgaatgaattctacttccaga

SEQ ID NO: 7387961 - DNA, 22 bp, Homo sapiens
ttgaatgaataaaagagtaagg

SEQ ID NO: 7387962 - DNA, 22 bp, Homo sapiens
ttgagcccaggaggcctgggtg

SEQ ID NO: 7387963 - DNA, 22 bp, Homo sapiens
ttgagcccaggaggcctgggtg

SEQ ID NO: 7387964 - DNA, 19 bp, Homo sapiens
ttgagcagtgcttagcacc

SEQ ID NO: 7387965 - DNA, 22 bp, Homo sapiens
ttgagcaattaggaaataaaga

SEQ ID NO: 7387966 - DNA, 22 bp, Homo sapiens
ttgagcaattaggaaataaaga

SEQ ID NO: 7387967 - DNA, 22 bp, Homo sapiens
ttgagcaaaggagtaaaatgca

SEQ ID NO: 7387968 - DNA, 22 bp, Homo sapiens
ttctttcagaacacaagtgatt

SEQ ID NO: 7387969 - DNA, 22 bp, Homo sapiens
ttctttcaatagctggcatatg

SEQ ID NO: 7387970 - DNA, 23 bp, Homo sapiens
ttctttcaagaagttcacagtgc

SEQ ID NO: 7387971 - DNA, 22 bp, Homo sapiens
ttctttattgagacttcattgt

SEQ ID NO: 7387972 - DNA, 22 bp, Homo sapiens
ttctttatgttaatgaatctat

SEQ ID NO: 7387973 - DNA, 22 bp, Homo sapiens
ttgaagagacgatttttccacc

SEQ ID NO: 7387974 - DNA, 22 bp, Homo sapiens
ttgaagagtcgcttaacctgtg

SEQ ID NO: 7387975 - DNA, 22 bp, Homo sapiens
ttgaagatctttgcattgcagg

SEQ ID NO: 7387976 - DNA, 22 bp, Homo sapiens
ttgaagatggtagcaatttcct

SEQ ID NO: 7387977 - DNA, 19 bp, Homo sapiens
ttgaagaataaaaacacat

SEQ ID NO: 7387978 - DNA, 22 bp, Homo sapiens
ttgaagaagtaattttaagtct

SEQ ID NO: 7387979 - DNA, 21 bp, Homo sapiens
ttctttccccagaggactaaa

SEQ ID NO: 7387980 - DNA, 22 bp, Homo sapiens
ttgagtggttcctcagttgact

SEQ ID NO: 7387981 - DNA, 22 bp, Homo sapiens
ttgatcatctaagagtaatagt

SEQ ID NO: 7387982 - DNA, 22 bp, Homo sapiens
ttgatgaaggtagatttgaaat

SEQ ID NO: 7387983 - DNA, 22 bp, Homo sapiens
ttgatgaattgctagattgcta

SEQ ID NO: 7387984 - DNA, 22 bp, Homo sapiens
ttgatcttcatcgaaatattgt

SEQ ID NO: 7387985 - DNA, 22 bp, Homo sapiens
ttgatgtaaaagccttggtggc

SEQ ID NO: 7387986 - DNA, 22 bp, Homo sapiens
ttgatgtaaactttgatttcat

SEQ ID NO: 7387987 - DNA, 22 bp, Homo sapiens
ttgatgtaaagatagtttctgt

SEQ ID NO: 7387988 - DNA, 22 bp, Homo sapiens
ttgattcagtaaagctaaattt

SEQ ID NO: 7387989 - DNA, 22 bp, Homo sapiens
ttgattctgatcctttgctagc

SEQ ID NO: 7387990 - DNA, 22 bp, Homo sapiens
ttgattctgggctcatttcttt

SEQ ID NO: 7387991 - DNA, 22 bp, Homo sapiens
ttgatgtacagaattgttcaca

SEQ ID NO: 7387992 - DNA, 22 bp, Homo sapiens
ttgatgtagggattcctgtaaa

SEQ ID NO: 7387993 - DNA, 22 bp, Homo sapiens
ttgatgtaggtttatctattgt

SEQ ID NO: 7387994 - DNA, 22 bp, Homo sapiens
ttgcaaatgtgaataattacac

SEQ ID NO: 7387995 - DNA, 22 bp, Homo sapiens
ttgcaaatgtggttagggcttt

SEQ ID NO: 7387996 - DNA, 20 bp, Homo sapiens
ttgcaaatatctattgattg

SEQ ID NO: 7387997 - DNA, 22 bp, Homo sapiens
ttgcaaataaacaagtatacat

SEQ ID NO: 7387998 - DNA, 22 bp, Homo sapiens
ttgattttgcctgatctgagag

SEQ ID NO: 7387999 - DNA, 22 bp, Homo sapiens
ttgattttcaattcattgacaa

SEQ ID NO: 7388000 - DNA, 22 bp, Homo sapiens
ttgcaaagagtcatgtaagtca

SEQ ID NO: 7388001 - DNA, 22 bp, Homo sapiens
ttgattggcagatggcttgaca

SEQ ID NO: 7388002 - DNA, 22 bp, Homo sapiens
ttaattttctcatctgtgaaat

SEQ ID NO: 7388003 - DNA, 22 bp, Homo sapiens
ttaattttctcatctgtgaaat

SEQ ID NO: 7388004 - DNA, 21 bp, Homo sapiens
ttaatttattcatgatagcta

SEQ ID NO: 7388005 - DNA, 22 bp, Homo sapiens
ttaattttaacctgtttgtgtc

SEQ ID NO: 7388006 - DNA, 22 bp, Homo sapiens
ttaatttttatgtatagtgtgt

SEQ ID NO: 7388007 - DNA, 22 bp, Homo sapiens
ttaattttctcatctgtgaaat

SEQ ID NO: 7388008 - DNA, 22 bp, Homo sapiens
ttaattttgatgaggttcagtt

SEQ ID NO: 7388009 - DNA, 22 bp, Homo sapiens
ttacacaacagtgcatcagcag

SEQ ID NO: 7388010 - DNA, 22 bp, Homo sapiens
ttacacaaagctccccaaatag

SEQ ID NO: 7388011 - DNA, 22 bp, Homo sapiens
ttacaaacaagatcttattctt

SEQ ID NO: 7388012 - DNA, 22 bp, Homo sapiens
ttacacattgcagatcaaaatg

SEQ ID NO: 7388013 - DNA, 22 bp, Homo sapiens
ttacacattgcagatcaaaatg

SEQ ID NO: 7388014 - DNA, 22 bp, Homo sapiens
ttacacattaacaggcagctaa

SEQ ID NO: 7388015 - DNA, 21 bp, Homo sapiens
ttacacactgcttctagaatg

SEQ ID NO: 7388016 - DNA, 22 bp, Homo sapiens
ttacagtaacattttcagtctg

SEQ ID NO: 7388017 - DNA, 22 bp, Homo sapiens
ttacatcattgagacatacata

SEQ ID NO: 7388018 - DNA, 22 bp, Homo sapiens
ttacatattatccaaaactgct

SEQ ID NO: 7388019 - DNA, 22 bp, Homo sapiens
ttacatattgtctattgttcaa

SEQ ID NO: 7388020 - DNA, 22 bp, Homo sapiens
ttacatattatccaaaactgct

SEQ ID NO: 7388021 - DNA, 22 bp, Homo sapiens
ttacattttggggtaaggataa

SEQ ID NO: 7388022 - DNA, 22 bp, Homo sapiens
ttaccaaatcccgtgcacattc

SEQ ID NO: 7388023 - DNA, 19 bp, Homo sapiens
ttactcattctaaatgggc

SEQ ID NO: 7388024 - DNA, 22 bp, Homo sapiens
ttactgggaatgttatggagaa

SEQ ID NO: 7388025 - DNA, 22 bp, Homo sapiens
ttactgatacacataagaattt

SEQ ID NO: 7388026 - DNA, 22 bp, Homo sapiens
ttactgtttttaactaattgtg

SEQ ID NO: 7388027 - DNA, 22 bp, Homo sapiens
ttagagaagctgtaattattca

SEQ ID NO: 7388028 - DNA, 22 bp, Homo sapiens
ttagagaagttttacttaagaa

SEQ ID NO: 7388029 - DNA, 22 bp, Homo sapiens
ttagagaaccaatgaatagtct

SEQ ID NO: 7388030 - DNA, 22 bp, Homo sapiens
ttagagaagctgtaattattca

SEQ ID NO: 7388031 - DNA, 22 bp, Homo sapiens
ttagagaaccaatgaatagtct

SEQ ID NO: 7388032 - DNA, 22 bp, Homo sapiens
ttagacattaaatgccatttaa

SEQ ID NO: 7388033 - DNA, 21 bp, Homo sapiens
ttagaagtaattttctccagc

SEQ ID NO: 7388034 - DNA, 22 bp, Homo sapiens
ttagaagtaaggtcagatttct

SEQ ID NO: 7388035 - DNA, 22 bp, Homo sapiens
ttagaaacaaaatagttatttg

SEQ ID NO: 7388036 - DNA, 22 bp, Homo sapiens
ttagaaacaaaatagttatttg

SEQ ID NO: 7388037 - DNA, 19 bp, Homo sapiens
ttagaaactgttgacactg

SEQ ID NO: 7388038 - DNA, 22 bp, Homo sapiens
ttagaaagaactttagatatca

SEQ ID NO: 7388039 - DNA, 22 bp, Homo sapiens
ttagaaactttggaggatagat

SEQ ID NO: 7388040 - DNA, 21 bp, Homo sapiens
ttagaaagctcactacagtta

SEQ ID NO: 7388041 - DNA, 22 bp, Homo sapiens
ttactttatctcctagattcca

SEQ ID NO: 7388042 - DNA, 22 bp, Homo sapiens
tgtttttatctctgtgtacaac

SEQ ID NO: 7388043 - DNA, 22 bp, Homo sapiens
ttaaagcatcacactattaatt

SEQ ID NO: 7388044 - DNA, 22 bp, Homo sapiens
tgtttttaaaatgtcctggtta

SEQ ID NO: 7388045 - DNA, 22 bp, Homo sapiens
tgtttttaaataatgatagaaa

SEQ ID NO: 7388046 - DNA, 22 bp, Homo sapiens
ttaaatattatgttgtctgcaa

SEQ ID NO: 7388047 - DNA, 22 bp, Homo sapiens
ttaaatagtaggtctattttgg

SEQ ID NO: 7388048 - DNA, 22 bp, Homo sapiens
ttaaagcccagcatatactagg

SEQ ID NO: 7388049 - DNA, 17 bp, Homo sapiens
tgttttctgctaccttt

SEQ ID NO: 7388050 - DNA, 22 bp, Homo sapiens
tgttttctgggtggaaggtact

SEQ ID NO: 7388051 - DNA, 22 bp, Homo sapiens
tgttttgtgcacttctatagca

SEQ ID NO: 7388052 - DNA, 22 bp, Homo sapiens
ttaacaatagagtttcttcagg

SEQ ID NO: 7388053 - DNA, 22 bp, Homo sapiens
ttaaattaggactctagttctg

SEQ ID NO: 7388054 - DNA, 22 bp, Homo sapiens
ttaaattaggactctagttctg

SEQ ID NO: 7388055 - DNA, 22 bp, Homo sapiens
ttaaattaggactctagttctg

SEQ ID NO: 7388056 - DNA, 22 bp, Homo sapiens
ttaaattagtcaagcttctctg

SEQ ID NO: 7388057 - DNA, 22 bp, Homo sapiens
ttaaatgtttaatctaacttga

SEQ ID NO: 7388058 - DNA, 22 bp, Homo sapiens
ttaaatgtttaatctaacttga

SEQ ID NO: 7388059 - DNA, 22 bp, Homo sapiens
ttaaatgaacgagatatgcaac

SEQ ID NO: 7388060 - DNA, 22 bp, Homo sapiens
ttaaatgatgcatatcatttag

SEQ ID NO: 7388061 - DNA, 22 bp, Homo sapiens
ttaaatgatgcatatcatttag

SEQ ID NO: 7388062 - DNA, 22 bp, Homo sapiens
ttaaatggagggggaaatacgt

SEQ ID NO: 7388063 - DNA, 22 bp, Homo sapiens
ttaaatgagatgttcagatatt

SEQ ID NO: 7388064 - DNA, 22 bp, Homo sapiens
ttaagtaacttgtccaaatgag

SEQ ID NO: 7388065 - DNA, 22 bp, Homo sapiens
ttaagttttaaagctagagtct

SEQ ID NO: 7388066 - DNA, 22 bp, Homo sapiens
ttaaggcaactgggtccaagat

SEQ ID NO: 7388067 - DNA, 22 bp, Homo sapiens
ttaaggaattacgaaaatattt

SEQ ID NO: 7388068 - DNA, 22 bp, Homo sapiens
ttaaggaattacgaaaatattt

SEQ ID NO: 7388069 - DNA, 22 bp, Homo sapiens
ttaattaattagttaagcatgt

SEQ ID NO: 7388070 - DNA, 22 bp, Homo sapiens
ttaataaacaggtgcagctgaa

SEQ ID NO: 7388071 - DNA, 22 bp, Homo sapiens
ttaatttatacataatcacagg

SEQ ID NO: 7388072 - DNA, 22 bp, Homo sapiens
ttaatttatacataatcacagg

SEQ ID NO: 7388073 - DNA, 22 bp, Homo sapiens
ttaatttatacataatcacagg

SEQ ID NO: 7388074 - DNA, 22 bp, Homo sapiens
ttaattgagccagaaagtatct

SEQ ID NO: 7388075 - DNA, 22 bp, Homo sapiens
ttaattgatataaagaacttca

SEQ ID NO: 7388076 - DNA, 22 bp, Homo sapiens
ttaattctgcctttcatgtaac

SEQ ID NO: 7388077 - DNA, 22 bp, Homo sapiens
ttaattgagccagaaagtatct

SEQ ID NO: 7388078 - DNA, 22 bp, Homo sapiens
ttaattctgcctttcatgtaac

SEQ ID NO: 7388079 - DNA, 22 bp, Homo sapiens
ttaacgaattgtgcataattcc

SEQ ID NO: 7388080 - DNA, 22 bp, Homo sapiens
ttaactattaccactctaggtt

SEQ ID NO: 7388081 - DNA, 22 bp, Homo sapiens
ttaactctccctccttacatcc

SEQ ID NO: 7388082 - DNA, 22 bp, Homo sapiens
ttaacattgtccttagcagatt

SEQ ID NO: 7388083 - DNA, 22 bp, Homo sapiens
ttaacattgtccttagcagatt

SEQ ID NO: 7388084 - DNA, 22 bp, Homo sapiens
ttaacatacatcatgaacaatg

SEQ ID NO: 7388085 - DNA, 22 bp, Homo sapiens
ttaacatacatcatgaacaatg

SEQ ID NO: 7388086 - DNA, 22 bp, Homo sapiens
ttaacactcctaactacagtct

SEQ ID NO: 7388087 - DNA, 22 bp, Homo sapiens
ttaacagacatatatatttgta

SEQ ID NO: 7388088 - DNA, 20 bp, Homo sapiens
ttaagaaaagcacatcctgc

SEQ ID NO: 7388089 - DNA, 22 bp, Homo sapiens
ttaagacacatttctcagacgg

SEQ ID NO: 7388090 - DNA, 22 bp, Homo sapiens
ttaagaagtgagtagaagtaat

SEQ ID NO: 7388091 - DNA, 22 bp, Homo sapiens
ttaagaaggtactcaaagatct

SEQ ID NO: 7388092 - DNA, 22 bp, Homo sapiens
ttaagaaggctgtttgctagac

SEQ ID NO: 7388093 - DNA, 22 bp, Homo sapiens
ttaaggaatattcatgaagttt

SEQ ID NO: 7388094 - DNA, 22 bp, Homo sapiens
ttaaggaacaattctacacacc

SEQ ID NO: 7388095 - DNA, 22 bp, Homo sapiens
ttaaggaaagccaaaatgaatt

SEQ ID NO: 7388096 - DNA, 22 bp, Homo sapiens
tgtgtttctgagaatcccacct

SEQ ID NO: 7388097 - DNA, 22 bp, Homo sapiens
tgtgttctggaaagctcactga

SEQ ID NO: 7388098 - DNA, 22 bp, Homo sapiens
tgtgttcaagattagttctagt

SEQ ID NO: 7388099 - DNA, 23 bp, Homo sapiens
tgttattccaggttaatgtactt

SEQ ID NO: 7388100 - DNA, 22 bp, Homo sapiens
tgttattgtcgctgcactggga

SEQ ID NO: 7388101 - DNA, 22 bp, Homo sapiens
tgttatttatctgagcatttat

SEQ ID NO: 7388102 - DNA, 22 bp, Homo sapiens
tgttatttatctgagcatttat

SEQ ID NO: 7388103 - DNA, 22 bp, Homo sapiens
tgttatttatctgagcatttat

SEQ ID NO: 7388104 - DNA, 22 bp, Homo sapiens
tgttatttgggaaagttgtaca

SEQ ID NO: 7388105 - DNA, 22 bp, Homo sapiens
tgttatgagtcctcatatacta

SEQ ID NO: 7388106 - DNA, 22 bp, Homo sapiens
tgttcacaggggagccatttat

SEQ ID NO: 7388107 - DNA, 21 bp, Homo sapiens
tgttcaaacgtacacatttct

SEQ ID NO: 7388108 - DNA, 22 bp, Homo sapiens
tgttcctgaatgcctggctggc

SEQ ID NO: 7388109 - DNA, 22 bp, Homo sapiens
tgttcctgacggccaaagaggt

SEQ ID NO: 7388110 - DNA, 22 bp, Homo sapiens
tgttcctggaaagccaggtggg

SEQ ID NO: 7388111 - DNA, 22 bp, Homo sapiens
tgttcctgtactgctgtggctt

SEQ ID NO: 7388112 - DNA, 22 bp, Homo sapiens
tgttcctggttcctgcatgatg

SEQ ID NO: 7388113 - DNA, 22 bp, Homo sapiens
tgttcctggttcctgcatgatg

SEQ ID NO: 7388114 - DNA, 22 bp, Homo sapiens
tgttttctcttgaaaagcagtc

SEQ ID NO: 7388115 - DNA, 22 bp, Homo sapiens
tgttttcagtcatatagcaggt

SEQ ID NO: 7388116 - DNA, 22 bp, Homo sapiens
tgtttcactaagcagaaatata

SEQ ID NO: 7388117 - DNA, 22 bp, Homo sapiens
tgtttcactgaaagccttacta

SEQ ID NO: 7388118 - DNA, 22 bp, Homo sapiens
tgtttcacttaaaaccactgct

SEQ ID NO: 7388119 - DNA, 17 bp, Homo sapiens
tgtttcacttggggaaa

SEQ ID NO: 7388120 - DNA, 22 bp, Homo sapiens
tgtttcaactgttaagatatgc

SEQ ID NO: 7388121 - DNA, 22 bp, Homo sapiens
tgtttccagaatgtagctgctt

SEQ ID NO: 7388122 - DNA, 22 bp, Homo sapiens
tgtttccaaagtcttttcttaa

SEQ ID NO: 7388123 - DNA, 22 bp, Homo sapiens
tgtttaataattctatgatagt

SEQ ID NO: 7388124 - DNA, 22 bp, Homo sapiens
tgttctgtgcatctagccagta

SEQ ID NO: 7388125 - DNA, 22 bp, Homo sapiens
tgttctcttccacggcgctcgg

SEQ ID NO: 7388126 - DNA, 22 bp, Homo sapiens
tgttctctctggctgccagtac

SEQ ID NO: 7388127 - DNA, 22 bp, Homo sapiens
tgttctgcaatgctgcctcctt

SEQ ID NO: 7388128 - DNA, 22 bp, Homo sapiens
tgttctcactggatgcttcaca

SEQ ID NO: 7388129 - DNA, 22 bp, Homo sapiens
tgttctcactggatgcttcaca

SEQ ID NO: 7388130 - DNA, 22 bp, Homo sapiens
tgttctaagtgttttgttcatg

SEQ ID NO: 7388131 - DNA, 22 bp, Homo sapiens
tgttctaaatttgcatggtcca

SEQ ID NO: 7388132 - DNA, 21 bp, Homo sapiens
tgttcctgttctctaggatcc

SEQ ID NO: 7388133 - DNA, 22 bp, Homo sapiens
tgttcctgtttctgcgtagttt

SEQ ID NO: 7388134 - DNA, 22 bp, Homo sapiens
tgtgtaaaatctgattaatact

SEQ ID NO: 7388135 - DNA, 22 bp, Homo sapiens
tgtggtggtaatgagccagatg

SEQ ID NO: 7388136 - DNA, 22 bp, Homo sapiens
tgtgtcagcacagtatcaatta

SEQ ID NO: 7388137 - DNA, 22 bp, Homo sapiens
tgtggggactttcaaagccaat

SEQ ID NO: 7388138 - DNA, 19 bp, Homo sapiens
tgtggggagtcagggggct

SEQ ID NO: 7388139 - DNA, 22 bp, Homo sapiens
tgtggggaggctgcagtgctgc

SEQ ID NO: 7388140 - DNA, 22 bp, Homo sapiens
tgtggcctgattttgcatctct

SEQ ID NO: 7388141 - DNA, 22 bp, Homo sapiens
tgtgtctgttttgctcaccatt

SEQ ID NO: 7388142 - DNA, 22 bp, Homo sapiens
tgtgtctgttttgctcaccatt

SEQ ID NO: 7388143 - DNA, 22 bp, Homo sapiens
tgtgtgaactctctgatgtaca

SEQ ID NO: 7388144 - DNA, 22 bp, Homo sapiens
tgtggccagggggccatgtccc

SEQ ID NO: 7388145 - DNA, 22 bp, Homo sapiens
tgtggcagaactgggactcaaa

SEQ ID NO: 7388146 - DNA, 22 bp, Homo sapiens
tgtggcagagtaaggacccagt

SEQ ID NO: 7388147 - DNA, 22 bp, Homo sapiens
tgtggactttagtaggtgagag

SEQ ID NO: 7388148 - DNA, 22 bp, Homo sapiens
tgtggactgtgctgccacagtg

SEQ ID NO: 7388149 - DNA, 22 bp, Homo sapiens
tgtggactcgcatggctgaggc

SEQ ID NO: 7388150 - DNA, 22 bp, Homo sapiens
tgtggacatactaggcctaggc

SEQ ID NO: 7388151 - DNA, 22 bp, Homo sapiens
tgtggacatactaggcctaggc

SEQ ID NO: 7388152 - DNA, 22 bp, Homo sapiens
tcccctcctgcctttgcggtgg

SEQ ID NO: 7388153 - DNA, 22 bp, Homo sapiens
tcccctgcagcgcctgcttcta

SEQ ID NO: 7388154 - DNA, 22 bp, Homo sapiens
tccccctcattacctcattcaa

SEQ ID NO: 7388155 - DNA, 22 bp, Homo sapiens
tccccctcctgtggttttctgc

SEQ ID NO: 7388156 - DNA, 22 bp, Homo sapiens
tcccctcctctcctgatatggg

SEQ ID NO: 7388157 - DNA, 22 bp, Homo sapiens
tcccctcccttccaacagagct

SEQ ID NO: 7388158 - DNA, 22 bp, Homo sapiens
tcccctcccttccaacagagct

SEQ ID NO: 7388159 - DNA, 22 bp, Homo sapiens
tcccctccaactccaactatgg

SEQ ID NO: 7388160 - DNA, 21 bp, Homo sapiens
tcccctcacttgtcttctgag

SEQ ID NO: 7388161 - DNA, 22 bp, Homo sapiens
tcccccaggctggagtgcagtg

SEQ ID NO: 7388162 - DNA, 22 bp, Homo sapiens
tccccagggtccctgcttccat

SEQ ID NO: 7388163 - DNA, 22 bp, Homo sapiens
tccccaggtcctgtcggctcct

SEQ ID NO: 7388164 - DNA, 22 bp, Homo sapiens
tccccaggtcctgtcggctcct

SEQ ID NO: 7388165 - DNA, 22 bp, Homo sapiens
tccccagtaagcctgcactgtg

SEQ ID NO: 7388166 - DNA, 22 bp, Homo sapiens
tccccaggtcctgtcggctcct

SEQ ID NO: 7388167 - DNA, 22 bp, Homo sapiens
ttttgaaagagtcctgctacag

SEQ ID NO: 7388168 - DNA, 22 bp, Homo sapiens
ttttgaaagggtgatttggctt

SEQ ID NO: 7388169 - DNA, 22 bp, Homo sapiens
ttttggaatttatacagtaatg

SEQ ID NO: 7388170 - DNA, 22 bp, Homo sapiens
ttttgatatcatgatgaacaga

SEQ ID NO: 7388171 - DNA, 22 bp, Homo sapiens
ttttgcaaagtacattatcagg

SEQ ID NO: 7388172 - DNA, 22 bp, Homo sapiens
ttttctaaaagaagtcactgat

SEQ ID NO: 7388173 - DNA, 23 bp, Homo sapiens
ttttcctttggacaggctgtatt

SEQ ID NO: 7388174 - DNA, 22 bp, Homo sapiens
ttttctaacatctagtaatttg

SEQ ID NO: 7388175 - DNA, 22 bp, Homo sapiens
ttttctaaaatatccaggacag

SEQ ID NO: 7388176 - DNA, 22 bp, Homo sapiens
ttttctaactttacactcgaaa

SEQ ID NO: 7388177 - DNA, 22 bp, Homo sapiens
ttttctaacatctagtaatttg

SEQ ID NO: 7388178 - DNA, 22 bp, Homo sapiens
ttttctaatttagttaccctcc

SEQ ID NO: 7388179 - DNA, 22 bp, Homo sapiens
ttttctaagggaaacgtcctcc

SEQ ID NO: 7388180 - DNA, 22 bp, Homo sapiens
ttttgaaagagtcctgctacag

SEQ ID NO: 7388181 - DNA, 19 bp, Homo sapiens
ttttccttctcctcttaat

SEQ ID NO: 7388182 - DNA, 20 bp, Homo sapiens
ttttccttctgagtatgttg

SEQ ID NO: 7388183 - DNA, 22 bp, Homo sapiens
ttttatgaagataattttctga

SEQ ID NO: 7388184 - DNA, 22 bp, Homo sapiens
ttttccttctgatactccattt

SEQ ID NO: 7388185 - DNA, 20 bp, Homo sapiens
ttttccttgttgccgctgct

SEQ ID NO: 7388186 - DNA, 22 bp, Homo sapiens
ttttcctttgaaaggtgagggc

SEQ ID NO: 7388187 - DNA, 22 bp, Homo sapiens
ttttcctttcatcaggacaaag

SEQ ID NO: 7388188 - DNA, 22 bp, Homo sapiens
ttttcctttgattcccagatgt

SEQ ID NO: 7388189 - DNA, 22 bp, Homo sapiens
ttttcctttggaagatgcatat

SEQ ID NO: 7388190 - DNA, 22 bp, Homo sapiens
tttttgggtccaggctgtatct

SEQ ID NO: 7388191 - DNA, 22 bp, Homo sapiens
tttttgcaccaacctaatagaa

SEQ ID NO: 7388192 - DNA, 22 bp, Homo sapiens
tttttgaaggctgatgtgatta

SEQ ID NO: 7388193 - DNA, 22 bp, Homo sapiens
tttttgaaggctgatgtgatta

SEQ ID NO: 7388194 - DNA, 22 bp, Homo sapiens
tttttctagaccttaaaggcca

SEQ ID NO: 7388195 - DNA, 22 bp, Homo sapiens
tttggagatagggcctagcaat

SEQ ID NO: 7388196 - DNA, 22 bp, Homo sapiens
tttggagagcagctaggccctt

SEQ ID NO: 7388197 - DNA, 22 bp, Homo sapiens
tttggagaaatggctgatcaaa

SEQ ID NO: 7388198 - DNA, 22 bp, Homo sapiens
tttggaagggaaccaaaacatg

SEQ ID NO: 7388199 - DNA, 22 bp, Homo sapiens
tttgcagtcaaatttgctaaat

SEQ ID NO: 7388200 - DNA, 22 bp, Homo sapiens
tttgatttactggatattctca

SEQ ID NO: 7388201 - DNA, 22 bp, Homo sapiens
tttgcaaatacagaggtcttgc

SEQ ID NO: 7388202 - DNA, 22 bp, Homo sapiens
tttctttccatacatattgcta

SEQ ID NO: 7388203 - DNA, 22 bp, Homo sapiens
tttgcagagtgcagaagcatct

SEQ ID NO: 7388204 - DNA, 22 bp, Homo sapiens
tttgcacacacaataacaaatg

SEQ ID NO: 7388205 - DNA, 22 bp, Homo sapiens
tttgcaaatgctctgcagagct

SEQ ID NO: 7388206 - DNA, 22 bp, Homo sapiens
tttgcaaattcttgtctagcct

SEQ ID NO: 7388207 - DNA, 22 bp, Homo sapiens
tttgcaaggcagcaggtgcagt

SEQ ID NO: 7388208 - DNA, 22 bp, Homo sapiens
tttgtagcagcatgatttataa

SEQ ID NO: 7388209 - DNA, 22 bp, Homo sapiens
tttgtagagaatgttaagcact

SEQ ID NO: 7388210 - DNA, 22 bp, Homo sapiens
tttgtagagaatgttaagcact

SEQ ID NO: 7388211 - DNA, 22 bp, Homo sapiens
tttgttcagctctcattgatta

SEQ ID NO: 7388212 - DNA, 22 bp, Homo sapiens
tttgtcaaagatcagatgcttt

SEQ ID NO: 7388213 - DNA, 22 bp, Homo sapiens
tttgtttacaaaaataagcagt

SEQ ID NO: 7388214 - DNA, 22 bp, Homo sapiens
tttgtttactcattcattgatg

SEQ ID NO: 7388215 - DNA, 22 bp, Homo sapiens
tttgttcttagtatctgtgtgc

SEQ ID NO: 7388216 - DNA, 22 bp, Homo sapiens
ttttataaagagagtcagttgg

SEQ ID NO: 7388217 - DNA, 22 bp, Homo sapiens
ttttatacttaagacagagttt

SEQ ID NO: 7388218 - DNA, 22 bp, Homo sapiens
ttttatcaatcattaagacatt

SEQ ID NO: 7388219 - DNA, 22 bp, Homo sapiens
tttgtttagatggtaaatcagt

SEQ ID NO: 7388220 - DNA, 22 bp, Homo sapiens
tttgtttagatggtaaatcagt

SEQ ID NO: 7388221 - DNA, 22 bp, Homo sapiens
tttgttttcaatgtgtcattca

SEQ ID NO: 7388222 - DNA, 22 bp, Homo sapiens
tttgttttctgtaggcctttcc

SEQ ID NO: 7388223 - DNA, 22 bp, Homo sapiens
tttctaagtgtattgagcttgg

SEQ ID NO: 7388224 - DNA, 22 bp, Homo sapiens
tttctaagtgtgtttcatagga

SEQ ID NO: 7388225 - DNA, 22 bp, Homo sapiens
tttctaagtgaacattcaagtt

SEQ ID NO: 7388226 - DNA, 22 bp, Homo sapiens
tttctaagtctgagggagtata

SEQ ID NO: 7388227 - DNA, 22 bp, Homo sapiens
tttctaagtaaacacagcatac

SEQ ID NO: 7388228 - DNA, 22 bp, Homo sapiens
tttctaagtaaacacagcatac

SEQ ID NO: 7388229 - DNA, 22 bp, Homo sapiens
tttctaatctgattctcctacc

SEQ ID NO: 7388230 - DNA, 22 bp, Homo sapiens
tttctaatctttagttacaaaa

SEQ ID NO: 7388231 - DNA, 22 bp, Homo sapiens
tttctaatgttctcagggattg

SEQ ID NO: 7388232 - DNA, 22 bp, Homo sapiens
tttctaaggtgaggtagaaaat

SEQ ID NO: 7388233 - DNA, 22 bp, Homo sapiens
tttctcatagtcatgcctctta

SEQ ID NO: 7388234 - DNA, 22 bp, Homo sapiens
tttctcatggaacatagctcct

SEQ ID NO: 7388235 - DNA, 22 bp, Homo sapiens
tttctcatggaacatagctcct

SEQ ID NO: 7388236 - DNA, 22 bp, Homo sapiens
tttctcatggaacatagctcct

SEQ ID NO: 7388237 - DNA, 22 bp, Homo sapiens
tttctcatggacccttcatgat

SEQ ID NO: 7388238 - DNA, 22 bp, Homo sapiens
tttctcctaactcaaatttaag

SEQ ID NO: 7388239 - DNA, 22 bp, Homo sapiens
tttctagaaaccaagatattgt

SEQ ID NO: 7388240 - DNA, 22 bp, Homo sapiens
tttctagaaagttcatgtgttt

SEQ ID NO: 7388241 - DNA, 22 bp, Homo sapiens
tttctagaaagttcatgtgttt

SEQ ID NO: 7388242 - DNA, 22 bp, Homo sapiens
tttctagaaatagagatagagt

SEQ ID NO: 7388243 - DNA, 22 bp, Homo sapiens
tttctattgtaagtctcctata

SEQ ID NO: 7388244 - DNA, 22 bp, Homo sapiens
tttctcagtgcagtttctacgt

SEQ ID NO: 7388245 - DNA, 21 bp, Homo sapiens
tttctcataaaatactcatta

SEQ ID NO: 7388246 - DNA, 22 bp, Homo sapiens
tttctcagcgttcttagggctc

SEQ ID NO: 7388247 - DNA, 22 bp, Homo sapiens
tttcaaagagttgtaaattact

SEQ ID NO: 7388248 - DNA, 22 bp, Homo sapiens
tttcagaggaaatctcattgag

SEQ ID NO: 7388249 - DNA, 22 bp, Homo sapiens
tttcagagctgagatgccacag

SEQ ID NO: 7388250 - DNA, 20 bp, Homo sapiens
tttcagagtgtctttccatt

SEQ ID NO: 7388251 - DNA, 22 bp, Homo sapiens
tttcagagtcagctcctctcta

SEQ ID NO: 7388252 - DNA, 22 bp, Homo sapiens
tttcagaggtatgctgcttatc

SEQ ID NO: 7388253 - DNA, 22 bp, Homo sapiens
tttcagaggtgcttggaatgct

SEQ ID NO: 7388254 - DNA, 22 bp, Homo sapiens
tttcagatggtatatacagtag

SEQ ID NO: 7388255 - DNA, 20 bp, Homo sapiens
tttcagatttacagaaatgt

SEQ ID NO: 7388256 - DNA, 22 bp, Homo sapiens
tttcagatcattttttaagtac

SEQ ID NO: 7388257 - DNA, 22 bp, Homo sapiens
tttcagagttggggaaaagcag

SEQ ID NO: 7388258 - DNA, 22 bp, Homo sapiens
tttcagagttgtcttcttgacc

SEQ ID NO: 7388259 - DNA, 22 bp, Homo sapiens
tttcagatcactttcaggaaag

SEQ ID NO: 7388260 - DNA, 22 bp, Homo sapiens
tttccaaaggctaaactcagtt

SEQ ID NO: 7388261 - DNA, 22 bp, Homo sapiens
tttccaaaggaggaaccagttt

SEQ ID NO: 7388262 - DNA, 22 bp, Homo sapiens
tttccaaaggaggaaccagttt

SEQ ID NO: 7388263 - DNA, 22 bp, Homo sapiens
tttccaaaggtggcaggaacaa

SEQ ID NO: 7388264 - DNA, 22 bp, Homo sapiens
tttccaaaggtggcaggaacaa

SEQ ID NO: 7388265 - DNA, 22 bp, Homo sapiens
tttccaaaggtggcaggaacaa

SEQ ID NO: 7388266 - DNA, 22 bp, Homo sapiens
tttccaaataaggtcacactca

SEQ ID NO: 7388267 - DNA, 22 bp, Homo sapiens
tttccaaagttgccataagctt

SEQ ID NO: 7388268 - DNA, 22 bp, Homo sapiens
tttccaaaatgaatctaatgca

SEQ ID NO: 7388269 - DNA, 22 bp, Homo sapiens
tttccaaagctgagttgagcaa

SEQ ID NO: 7388270 - DNA, 22 bp, Homo sapiens
tttccaaaatgaatctaatgca

SEQ ID NO: 7388271 - DNA, 22 bp, Homo sapiens
tttcattttggttatgccataa

SEQ ID NO: 7388272 - DNA, 22 bp, Homo sapiens
tttcatttcatagaattgtgtt

SEQ ID NO: 7388273 - DNA, 22 bp, Homo sapiens
tttcatttcatagaattgtgtt

SEQ ID NO: 7388274 - DNA, 22 bp, Homo sapiens
tttcagtggaccacagtttgat

SEQ ID NO: 7388275 - DNA, 22 bp, Homo sapiens
tttcattgccataaggtgggat

SEQ ID NO: 7388276 - DNA, 22 bp, Homo sapiens
tttcagtggcatcgattaccct

SEQ ID NO: 7388277 - DNA, 22 bp, Homo sapiens
tttcattgtcatctatcttaga

SEQ ID NO: 7388278 - DNA, 23 bp, Homo sapiens
tttctgaagttgagatggacttt

SEQ ID NO: 7388279 - DNA, 22 bp, Homo sapiens
tttctgaagtcttctaacagat

SEQ ID NO: 7388280 - DNA, 23 bp, Homo sapiens
tttctgaagttgagatggacttt

SEQ ID NO: 7388281 - DNA, 22 bp, Homo sapiens
tttctgaaggttaaggaattag

SEQ ID NO: 7388282 - DNA, 22 bp, Homo sapiens
tttctgaagggcagcagactct

SEQ ID NO: 7388283 - DNA, 22 bp, Homo sapiens
tttctgaataactctatgatat

SEQ ID NO: 7388284 - DNA, 22 bp, Homo sapiens
tttctgaataactctatgatat

SEQ ID NO: 7388285 - DNA, 18 bp, Homo sapiens
tttctgaatgtctatttc

SEQ ID NO: 7388286 - DNA, 18 bp, Homo sapiens
tttctgaatgtctatttc

SEQ ID NO: 7388287 - DNA, 22 bp, Homo sapiens
tttctgaattcctaggatgttg

SEQ ID NO: 7388288 - DNA, 22 bp, Homo sapiens
tttctgaatttactcaaggtca

SEQ ID NO: 7388289 - DNA, 22 bp, Homo sapiens
tttctgaatttactcaaggtca

SEQ ID NO: 7388290 - DNA, 22 bp, Homo sapiens
tttctgcatgcatttaattaaa

SEQ ID NO: 7388291 - DNA, 22 bp, Homo sapiens
tttctgataattttgtgaaatc

SEQ ID NO: 7388292 - DNA, 22 bp, Homo sapiens
tttctgagaaattaaacacttt

SEQ ID NO: 7388293 - DNA, 20 bp, Homo sapiens
tttctgtagctcagtattca

SEQ ID NO: 7388294 - DNA, 22 bp, Homo sapiens
tttctgctttcagagtgagaca

SEQ ID NO: 7388295 - DNA, 22 bp, Homo sapiens
tttctggaaccacaaaagtatg

SEQ ID NO: 7388296 - DNA, 22 bp, Homo sapiens
tttctgaaaactgaagtagtgc

SEQ ID NO: 7388297 - DNA, 22 bp, Homo sapiens
tttctgaaacatggtctttgta

SEQ ID NO: 7388298 - DNA, 22 bp, Homo sapiens
tttctgaacaaagccattatca

SEQ ID NO: 7388299 - DNA, 22 bp, Homo sapiens
tttctgaaatgctggctttgga

SEQ ID NO: 7388300 - DNA, 22 bp, Homo sapiens
tttctgaagggcagcagactct

SEQ ID NO: 7388301 - DNA, 21 bp, Homo sapiens
tttctgaaggcaacatctatc

SEQ ID NO: 7388302 - DNA, 22 bp, Homo sapiens
tttctgaacttggtactggagc

SEQ ID NO: 7388303 - DNA, 22 bp, Homo sapiens
tttctgaagatacagctttgct

SEQ ID NO: 7388304 - DNA, 22 bp, Homo sapiens
tttctgaagatacagctttgct

SEQ ID NO: 7388305 - DNA, 22 bp, Homo sapiens
tttctgaaaactgaagtagtgc

SEQ ID NO: 7388306 - DNA, 22 bp, Homo sapiens
tttctctttgacaggaatcaga

SEQ ID NO: 7388307 - DNA, 22 bp, Homo sapiens
tttctcctctccagagtgcagt

SEQ ID NO: 7388308 - DNA, 22 bp, Homo sapiens
tttctgttgtacttaaactagg

SEQ ID NO: 7388309 - DNA, 22 bp, Homo sapiens
tttctgttgtacttaaactagg

SEQ ID NO: 7388310 - DNA, 19 bp, Homo sapiens
tttctgttagaaggataca

SEQ ID NO: 7388311 - DNA, 22 bp, Homo sapiens
tttcttcatagaccttgtcttg

SEQ ID NO: 7388312 - DNA, 22 bp, Homo sapiens
tttcttcattgatgtcaggtgg

SEQ ID NO: 7388313 - DNA, 23 bp, Homo sapiens
tttcttcagaagccttgcgaggc

SEQ ID NO: 7388314 - DNA, 22 bp, Homo sapiens
tttcttcagagagagctttccc

SEQ ID NO: 7388315 - DNA, 22 bp, Homo sapiens
tttcttcagagagagctttccc

SEQ ID NO: 7388316 - DNA, 22 bp, Homo sapiens
tttcttcagcaggtttgtgaga

SEQ ID NO: 7388317 - DNA, 22 bp, Homo sapiens
tttcttatggggtagtccttta

SEQ ID NO: 7388318 - DNA, 22 bp, Homo sapiens
tttcttcaattgctaacaagga

SEQ ID NO: 7388319 - DNA, 22 bp, Homo sapiens
tttcttctcatccctgaaatca

SEQ ID NO: 7388320 - DNA, 22 bp, Homo sapiens
tttcttctcacccaggacagag

SEQ ID NO: 7388321 - DNA, 22 bp, Homo sapiens
tttcttcctatgtatcttgctg

SEQ ID NO: 7388322 - DNA, 22 bp, Homo sapiens
tttcttctaagatttcaaacta

SEQ ID NO: 7388323 - DNA, 22 bp, Homo sapiens
tttcttctaggactaataagag

SEQ ID NO: 7388324 - DNA, 22 bp, Homo sapiens
tttcttctgagatcagggagaa

SEQ ID NO: 7388325 - DNA, 22 bp, Homo sapiens
tttctttatcctcctttgcaca

SEQ ID NO: 7388326 - DNA, 22 bp, Homo sapiens
tttctttaattctcacagcaat

SEQ ID NO: 7388327 - DNA, 22 bp, Homo sapiens
tttctttatcatagcatctttg

SEQ ID NO: 7388328 - DNA, 22 bp, Homo sapiens
tttctttaaaggaactctgttt

SEQ ID NO: 7388329 - DNA, 22 bp, Homo sapiens
tttataattatctctactctta

SEQ ID NO: 7388330 - DNA, 22 bp, Homo sapiens
tttatataacagagactgctat

SEQ ID NO: 7388331 - DNA, 20 bp, Homo sapiens
tttatagtgatcaatttata

SEQ ID NO: 7388332 - DNA, 22 bp, Homo sapiens
tttatagttatatacagatgtt

SEQ ID NO: 7388333 - DNA, 22 bp, Homo sapiens
tttatagtagcatgatttatag

SEQ ID NO: 7388334 - DNA, 22 bp, Homo sapiens
tttatagtagcatgatttataa

SEQ ID NO: 7388335 - DNA, 22 bp, Homo sapiens
tttatgtttgcattttcaaaga

SEQ ID NO: 7388336 - DNA, 22 bp, Homo sapiens
tttatttgtcttgccatttagt

SEQ ID NO: 7388337 - DNA, 22 bp, Homo sapiens
tttatttggcatccagggagaa

SEQ ID NO: 7388338 - DNA, 22 bp, Homo sapiens
tttcaaaagcgtacgtagtgaa

SEQ ID NO: 7388339 - DNA, 22 bp, Homo sapiens
tttcaaacatatcttcattact

SEQ ID NO: 7388340 - DNA, 22 bp, Homo sapiens
tttattacaccaggttaactca

SEQ ID NO: 7388341 - DNA, 22 bp, Homo sapiens
tttattagattatcaaagaggt

SEQ ID NO: 7388342 - DNA, 22 bp, Homo sapiens
tttattatgatggacaccttcg

SEQ ID NO: 7388343 - DNA, 22 bp, Homo sapiens
tttactaacaccatacatgctg

SEQ ID NO: 7388344 - DNA, 22 bp, Homo sapiens
tttactaagcccagttatatgc

SEQ ID NO: 7388345 - DNA, 22 bp, Homo sapiens
tttactaagcccagttatatgc

SEQ ID NO: 7388346 - DNA, 22 bp, Homo sapiens
tttactaccattctgatcagtg

SEQ ID NO: 7388347 - DNA, 22 bp, Homo sapiens
tttacgactgctaaatgcctgc

SEQ ID NO: 7388348 - DNA, 22 bp, Homo sapiens
tttacctagtataatgcaacct

SEQ ID NO: 7388349 - DNA, 22 bp, Homo sapiens
tttacaacctcatattctgatg

SEQ ID NO: 7388350 - DNA, 22 bp, Homo sapiens
tttacttgatatggagctgagg

SEQ ID NO: 7388351 - DNA, 22 bp, Homo sapiens
tttactgaactgctagtacagg

SEQ ID NO: 7388352 - DNA, 22 bp, Homo sapiens
tttagttattgttacagtatga

SEQ ID NO: 7388353 - DNA, 22 bp, Homo sapiens
tttagaaattgcagagtgggtg

SEQ ID NO: 7388354 - DNA, 22 bp, Homo sapiens
tttagaaattcatctatggcct

SEQ ID NO: 7388355 - DNA, 23 bp, Homo sapiens
tttaaaagttgtaatgtaggctt

SEQ ID NO: 7388356 - DNA, 22 bp, Homo sapiens
tttaaaagttatcatctgtcca

SEQ ID NO: 7388357 - DNA, 23 bp, Homo sapiens
ttgtttttagaggtggcatgaga

SEQ ID NO: 7388358 - DNA, 22 bp, Homo sapiens
ttgtttttatgaacatccagga

SEQ ID NO: 7388359 - DNA, 22 bp, Homo sapiens
ttgtttttaaacatgtgactga

SEQ ID NO: 7388360 - DNA, 22 bp, Homo sapiens
tttaaaatcagatgggagttgg

SEQ ID NO: 7388361 - DNA, 22 bp, Homo sapiens
tttaattttcctcttcctggag

SEQ ID NO: 7388362 - DNA, 22 bp, Homo sapiens
tttaattttcctggtaggcctg

SEQ ID NO: 7388363 - DNA, 22 bp, Homo sapiens
tttaattttctgggcccagcag

SEQ ID NO: 7388364 - DNA, 22 bp, Homo sapiens
tttaattttcctcttcctggag

SEQ ID NO: 7388365 - DNA, 22 bp, Homo sapiens
tttaatttgtatttctagaggg

SEQ ID NO: 7388366 - DNA, 21 bp, Homo sapiens
tttaatttgcatgtatgacgc

SEQ ID NO: 7388367 - DNA, 22 bp, Homo sapiens
tttaattgcatttaaagatgga

SEQ ID NO: 7388368 - DNA, 22 bp, Homo sapiens
tttaattgttgtgggtacatag

SEQ ID NO: 7388369 - DNA, 22 bp, Homo sapiens
tttaatttgaaatgagtaaccc

SEQ ID NO: 7388370 - DNA, 22 bp, Homo sapiens
ttgtttgtaaggctcttagaat

SEQ ID NO: 7388371 - DNA, 22 bp, Homo sapiens
ttgtttcttcatttagaagctt

SEQ ID NO: 7388372 - DNA, 22 bp, Homo sapiens
ttgttttaacgactcagcttgt

SEQ ID NO: 7388373 - DNA, 22 bp, Homo sapiens
ttgttttagtaggtacactgag

SEQ ID NO: 7388374 - DNA, 22 bp, Homo sapiens
ttgttttattctgcaatttccc

SEQ ID NO: 7388375 - DNA, 22 bp, Homo sapiens
ttgttataaagactaaatatgt

SEQ ID NO: 7388376 - DNA, 22 bp, Homo sapiens
ttgtttaaagaacttctgactt

SEQ ID NO: 7388377 - DNA, 22 bp, Homo sapiens
ttggttttgggatgtacaaagg

SEQ ID NO: 7388378 - DNA, 22 bp, Homo sapiens
ttgtcgggcttacgcagggcca

SEQ ID NO: 7388379 - DNA, 22 bp, Homo sapiens
ttgtctatacatcaataatgat

SEQ ID NO: 7388380 - DNA, 22 bp, Homo sapiens
ttgtctaatgagctccacttca

SEQ ID NO: 7388381 - DNA, 20 bp, Homo sapiens
ttggttgagccagggcctgg

SEQ ID NO: 7388382 - DNA, 22 bp, Homo sapiens
ttggggtgttggatggagcaag

SEQ ID NO: 7388383 - DNA, 22 bp, Homo sapiens
ttggtgtacatctccccttcat

SEQ ID NO: 7388384 - DNA, 22 bp, Homo sapiens
ttggtgggagagatgagggttg

SEQ ID NO: 7388385 - DNA, 18 bp, Homo sapiens
ttggggtgaggccaggaa

SEQ ID NO: 7388386 - DNA, 22 bp, Homo sapiens
cacctgggtcattgctggtgtt

SEQ ID NO: 7388387 - DNA, 22 bp, Homo sapiens
ggccgtgctccaaagtcatcgt

SEQ ID NO: 7388388 - DNA, 22 bp, Homo sapiens
ggccgtgctccaaagtcatcgt

SEQ ID NO: 7388389 - DNA, 22 bp, Homo sapiens
cacctgggtcattgctggtgtt

SEQ ID NO: 7388390 - DNA, 22 bp, Homo sapiens
cacctgggtcattgctggtgtt

SEQ ID NO: 7388391 - DNA, 22 bp, Homo sapiens
cacctgggtcattgctggtgtt

SEQ ID NO: 7388392 - DNA, 22 bp, Homo sapiens
cacctgggtcattgctggtgtt

SEQ ID NO: 7388393 - DNA, 22 bp, Homo sapiens
ggccgtgctccaaagtcatcgt

SEQ ID NO: 7388394 - DNA, 19 bp, Homo sapiens
ggccggtagacacaaagtg

SEQ ID NO: 7388395 - DNA, 22 bp, Homo sapiens
ggccggtgtcatggcttggtct

SEQ ID NO: 7388396 - DNA, 22 bp, Homo sapiens
ggccggggcctgctcgcctgtg

SEQ ID NO: 7388397 - DNA, 22 bp, Homo sapiens
ggccggggcctccccgcgtcgc

SEQ ID NO: 7388398 - DNA, 21 bp, Homo sapiens
cacctgtgagactctcagacc

SEQ ID NO: 7388399 - DNA, 22 bp, Homo sapiens
cacctgttagctctaattttct

SEQ ID NO: 7388400 - DNA, 22 bp, Homo sapiens
cacctgttagctctaattttct

SEQ ID NO: 7388401 - DNA, 22 bp, Homo sapiens
cacctgttcattacccatccca

SEQ ID NO: 7388402 - DNA, 22 bp, Homo sapiens
cacctgttgtttattcatctct

SEQ ID NO: 7388403 - DNA, 22 bp, Homo sapiens
cacctgtccacgcagtctgcct

SEQ ID NO: 7388404 - DNA, 22 bp, Homo sapiens
cacctgtccacgcagtctgcct

SEQ ID NO: 7388405 - DNA, 22 bp, Homo sapiens
cacctgtacagggccgggctgg

SEQ ID NO: 7388406 - DNA, 22 bp, Homo sapiens
cacctgggtcattgctggtgtt

SEQ ID NO: 7388407 - DNA, 22 bp, Homo sapiens
cacctgtacagggccgggctgg

SEQ ID NO: 7388408 - DNA, 22 bp, Homo sapiens
cacctgtaatcccagcacttca

SEQ ID NO: 7388409 - DNA, 20 bp, Homo sapiens
ggccggggagctctccaggg

SEQ ID NO: 7388410 - DNA, 22 bp, Homo sapiens
ggccggggcctccccgcgtcgc

SEQ ID NO: 7388411 - DNA, 22 bp, Homo sapiens
ggccggggcctccccgcgtcgc

SEQ ID NO: 7388412 - DNA, 22 bp, Homo sapiens
ggccggcctttgcgagcattct

SEQ ID NO: 7388413 - DNA, 20 bp, Homo sapiens
ggccggggagctctccaggg

SEQ ID NO: 7388414 - DNA, 20 bp, Homo sapiens
ggccggggagctctccaggg

SEQ ID NO: 7388415 - DNA, 22 bp, Homo sapiens
ggccggcttactgggtagggtg

SEQ ID NO: 7388416 - DNA, 22 bp, Homo sapiens
ggccggctgccgtagggctcag

SEQ ID NO: 7388417 - DNA, 22 bp, Homo sapiens
ggccgggcaggtctcagccagc

SEQ ID NO: 7388418 - DNA, 22 bp, Homo sapiens
ggccggcttactgggtagggtg

SEQ ID NO: 7388419 - DNA, 22 bp, Homo sapiens
ggccgcggattttcccgctggc

SEQ ID NO: 7388420 - DNA, 19 bp, Homo sapiens
ggccgcggcccgcagtggg

SEQ ID NO: 7388421 - DNA, 22 bp, Homo sapiens
ggccgctctccggtgtggatct

SEQ ID NO: 7388422 - DNA, 22 bp, Homo sapiens
ggccgctctccggtgtggatct

SEQ ID NO: 7388423 - DNA, 21 bp, Homo sapiens
ggccgccgccttgtgctctgc

SEQ ID NO: 7388424 - DNA, 21 bp, Homo sapiens
ggccgccgccttgtgctctgc

SEQ ID NO: 7388425 - DNA, 21 bp, Homo sapiens
ggccgccgccttgtgctctgc

SEQ ID NO: 7388426 - DNA, 22 bp, Homo sapiens
ggccctgttagagctcccacaa

SEQ ID NO: 7388427 - DNA, 21 bp, Homo sapiens
ggccgccgccttgtgctctgc

SEQ ID NO: 7388428 - DNA, 22 bp, Homo sapiens
cacgaggccatctccttctgga

SEQ ID NO: 7388429 - DNA, 22 bp, Homo sapiens
cacgaatggaagggtcttggct

SEQ ID NO: 7388430 - DNA, 22 bp, Homo sapiens
cacgagggcacacgtgggaggg

SEQ ID NO: 7388431 - DNA, 22 bp, Homo sapiens
cacgagggcacacgtgggaggg

SEQ ID NO: 7388432 - DNA, 22 bp, Homo sapiens
cacgagggcacacgtgggaggg

SEQ ID NO: 7388433 - DNA, 22 bp, Homo sapiens
cacgattactgtgtgaaagtga

SEQ ID NO: 7388434 - DNA, 22 bp, Homo sapiens
cacgatggagtcctatggggca

SEQ ID NO: 7388435 - DNA, 22 bp, Homo sapiens
cacgagtaacacattaacatgg

SEQ ID NO: 7388436 - DNA, 22 bp, Homo sapiens
cacgcacgctgggtggaggcgc

SEQ ID NO: 7388437 - DNA, 22 bp, Homo sapiens
cacgcacgctgggtggaggcgc

SEQ ID NO: 7388438 - DNA, 22 bp, Homo sapiens
cacgcacgctgggtggaggcgc

SEQ ID NO: 7388439 - DNA, 22 bp, Homo sapiens
ggcctctctccagtcagtgcag

SEQ ID NO: 7388440 - DNA, 22 bp, Homo sapiens
caccttgagggggaaaataatc

SEQ ID NO: 7388441 - DNA, 22 bp, Homo sapiens
caccttgcattcttttaattta

SEQ ID NO: 7388442 - DNA, 22 bp, Homo sapiens
caccttccatctccttggctag

SEQ ID NO: 7388443 - DNA, 22 bp, Homo sapiens
caccttcagaatgctccaggca

SEQ ID NO: 7388444 - DNA, 22 bp, Homo sapiens
caccttccatctccttggctag

SEQ ID NO: 7388445 - DNA, 22 bp, Homo sapiens
caccttactccctctggatgcc

SEQ ID NO: 7388446 - DNA, 22 bp, Homo sapiens
caccttactccctctggatgcc

SEQ ID NO: 7388447 - DNA, 22 bp, Homo sapiens
cacctgttcattacccatccca

SEQ ID NO: 7388448 - DNA, 22 bp, Homo sapiens
cacctgttgtttattcatctct

SEQ ID NO: 7388449 - DNA, 21 bp, Homo sapiens
caccttatagataaaattaga

SEQ ID NO: 7388450 - DNA, 22 bp, Homo sapiens
caccttttgtgtctgcgtttgt

SEQ ID NO: 7388451 - DNA, 22 bp, Homo sapiens
cacctttgcaaaccaaatctga

SEQ ID NO: 7388452 - DNA, 22 bp, Homo sapiens
cacgaatggaagggtcttggct

SEQ ID NO: 7388453 - DNA, 22 bp, Homo sapiens
caccttttgtgtctgcgtttgt

SEQ ID NO: 7388454 - DNA, 22 bp, Homo sapiens
caccttgtggcccagtcaggtt

SEQ ID NO: 7388455 - DNA, 22 bp, Homo sapiens
cacctttaatgagcaccagccg

SEQ ID NO: 7388456 - DNA, 22 bp, Homo sapiens
cacctttaatgagcaccagccg

SEQ ID NO: 7388457 - DNA, 22 bp, Homo sapiens
cacctttaatgagcaccagccg

SEQ ID NO: 7388458 - DNA, 22 bp, Homo sapiens
cacctttgaccttgcagcgcac

SEQ ID NO: 7388459 - DNA, 22 bp, Homo sapiens
ggccactgccctggctacaccg

SEQ ID NO: 7388460 - DNA, 22 bp, Homo sapiens
ggccactgccctggctacaccg

SEQ ID NO: 7388461 - DNA, 22 bp, Homo sapiens
ggccactgacctacatctgggg

SEQ ID NO: 7388462 - DNA, 22 bp, Homo sapiens
ggccactgacctacatctgggg

SEQ ID NO: 7388463 - DNA, 22 bp, Homo sapiens
ggccactgacctacatctgggg

SEQ ID NO: 7388464 - DNA, 22 bp, Homo sapiens
ggccactgacctacatctgggg

SEQ ID NO: 7388465 - DNA, 23 bp, Homo sapiens
ggccactgaattttctgcatctt

SEQ ID NO: 7388466 - DNA, 23 bp, Homo sapiens
ggccactgaattttctgcatctt

SEQ ID NO: 7388467 - DNA, 22 bp, Homo sapiens
ggccactgcctccgccatggct

SEQ ID NO: 7388468 - DNA, 22 bp, Homo sapiens
ggccactgcctccgccatggct

SEQ ID NO: 7388469 - DNA, 22 bp, Homo sapiens
ggccactgccctggctacaccg

SEQ ID NO: 7388470 - DNA, 22 bp, Homo sapiens
ggccactgccctggctacaccg

SEQ ID NO: 7388471 - DNA, 22 bp, Homo sapiens
ggccactgccctggctacaccg

SEQ ID NO: 7388472 - DNA, 22 bp, Homo sapiens
ggccactgccctggctacaccg

SEQ ID NO: 7388473 - DNA, 22 bp, Homo sapiens
ggccactgcctccgccatggct

SEQ ID NO: 7388474 - DNA, 22 bp, Homo sapiens
ggccactgcctccgccatggct

SEQ ID NO: 7388475 - DNA, 22 bp, Homo sapiens
ggccactgctgctctggtggag

SEQ ID NO: 7388476 - DNA, 22 bp, Homo sapiens
ggccactgctgctctggtggag

SEQ ID NO: 7388477 - DNA, 22 bp, Homo sapiens
ggccactgctgctctggtggag

SEQ ID NO: 7388478 - DNA, 22 bp, Homo sapiens
ggccactgtttcctgggcagtt

SEQ ID NO: 7388479 - DNA, 22 bp, Homo sapiens
ggccactgtcctctagcccaga

SEQ ID NO: 7388480 - DNA, 22 bp, Homo sapiens
ggccactggccaggatctaaga

SEQ ID NO: 7388481 - DNA, 22 bp, Homo sapiens
ggccactgtcctctagcccaga

SEQ ID NO: 7388482 - DNA, 22 bp, Homo sapiens
ggccactgctctccagcctggg

SEQ ID NO: 7388483 - DNA, 22 bp, Homo sapiens
ggccactgctctccagcctggg

SEQ ID NO: 7388484 - DNA, 22 bp, Homo sapiens
ggccactgctctccagcctggg

SEQ ID NO: 7388485 - DNA, 22 bp, Homo sapiens
ggccactgctctccagcctggg

SEQ ID NO: 7388486 - DNA, 22 bp, Homo sapiens
ggccactgcctccgccatggct

SEQ ID NO: 7388487 - DNA, 22 bp, Homo sapiens
ggccctgtcctggctgtctccg

SEQ ID NO: 7388488 - DNA, 22 bp, Homo sapiens
ggccctgtcctggctgtctccg

SEQ ID NO: 7388489 - DNA, 22 bp, Homo sapiens
ggccctgtcctggctgtctccg

SEQ ID NO: 7388490 - DNA, 22 bp, Homo sapiens
ggccctgtccctggccgtctgt

SEQ ID NO: 7388491 - DNA, 22 bp, Homo sapiens
ggccctgtccctggccgtctgt

SEQ ID NO: 7388492 - DNA, 22 bp, Homo sapiens
ggccctgtccctggccgtctgt

SEQ ID NO: 7388493 - DNA, 22 bp, Homo sapiens
ggccctgtccccttcagttttg

SEQ ID NO: 7388494 - DNA, 22 bp, Homo sapiens
ggccctgtctgtctgcccagct

SEQ ID NO: 7388495 - DNA, 22 bp, Homo sapiens
ggccctgtctgtctgcccagct

SEQ ID NO: 7388496 - DNA, 22 bp, Homo sapiens
ggccctgtgatggatgtattag

SEQ ID NO: 7388497 - DNA, 22 bp, Homo sapiens
ggccctgtcctggctgtctccg

SEQ ID NO: 7388498 - DNA, 22 bp, Homo sapiens
ggccccaggtagaagatataga

SEQ ID NO: 7388499 - DNA, 22 bp, Homo sapiens
ggccccaggtagaagatataga

SEQ ID NO: 7388500 - DNA, 22 bp, Homo sapiens
ggccccaggtagaagatataga

SEQ ID NO: 7388501 - DNA, 22 bp, Homo sapiens
ggccccagggattaggccaacc

SEQ ID NO: 7388502 - DNA, 22 bp, Homo sapiens
ggccactgtttcctgggcagtt

SEQ ID NO: 7388503 - DNA, 22 bp, Homo sapiens
ggccccagggattaggccaacc

SEQ ID NO: 7388504 - DNA, 19 bp, Homo sapiens
ggccctgtaggatgtgagt

SEQ ID NO: 7388505 - DNA, 19 bp, Homo sapiens
ggccctgtaggatgtgagt

SEQ ID NO: 7388506 - DNA, 22 bp, Homo sapiens
ggccctgtgatggatgtattag

SEQ ID NO: 7388507 - DNA, 22 bp, Homo sapiens
ggccctgtgatggatgtattag

SEQ ID NO: 7388508 - DNA, 22 bp, Homo sapiens
ggccctgtggttttgcaaagtc

SEQ ID NO: 7388509 - DNA, 22 bp, Homo sapiens
ggccctgtggttttgcaaagtc

SEQ ID NO: 7388510 - DNA, 22 bp, Homo sapiens
ggccctgtctgtctgcccagct

SEQ ID NO: 7388511 - DNA, 22 bp, Homo sapiens
ggccctgtggttttgcaaagtc

SEQ ID NO: 7388512 - DNA, 22 bp, Homo sapiens
ggccctgttagagctcccacaa

SEQ ID NO: 7388513 - DNA, 22 bp, Homo sapiens
ggccctgttagagctcccacaa

SEQ ID NO: 7388514 - DNA, 22 bp, Homo sapiens
ggccctgttccacgtggggtgt

SEQ ID NO: 7388515 - DNA, 22 bp, Homo sapiens
ggccctgttccacgtggggtgt

SEQ ID NO: 7388516 - DNA, 22 bp, Homo sapiens
ggcccttcctcttgtgctggca

SEQ ID NO: 7388517 - DNA, 22 bp, Homo sapiens
ggcccttgcagcaggcgctggc

SEQ ID NO: 7388518 - DNA, 22 bp, Homo sapiens
ggcccttgcagcaggcgctggc

SEQ ID NO: 7388519 - DNA, 22 bp, Homo sapiens
ggcccttgcagcaggcgctggc

SEQ ID NO: 7388520 - DNA, 22 bp, Homo sapiens
ggcccttggagcctccacagtg

SEQ ID NO: 7388521 - DNA, 22 bp, Homo sapiens
ggcccttggagcctccacagtg

SEQ ID NO: 7388522 - DNA, 22 bp, Homo sapiens
ggccgccctttccacggtttct

SEQ ID NO: 7388523 - DNA, 22 bp, Homo sapiens
ggccgccctttccacggtttct

SEQ ID NO: 7388524 - DNA, 22 bp, Homo sapiens
ggccgccctttccacggtttct

SEQ ID NO: 7388525 - DNA, 22 bp, Homo sapiens
ggcatttgagccattggcctgt

SEQ ID NO: 7388526 - DNA, 22 bp, Homo sapiens
ggcatttgagccattggcctgt

SEQ ID NO: 7388527 - DNA, 22 bp, Homo sapiens
ggcatttgagccattggcctgt

SEQ ID NO: 7388528 - DNA, 22 bp, Homo sapiens
ggcatttgactcagtgactggg

SEQ ID NO: 7388529 - DNA, 22 bp, Homo sapiens
ggcatttagttttcatattctg

SEQ ID NO: 7388530 - DNA, 22 bp, Homo sapiens
ggcatttaggcagataacagac

SEQ ID NO: 7388531 - DNA, 22 bp, Homo sapiens
ggcatttaggcagataacagac

SEQ ID NO: 7388532 - DNA, 22 bp, Homo sapiens
ggcattatctgagcacgtaata

SEQ ID NO: 7388533 - DNA, 22 bp, Homo sapiens
ggcattgatgggagatggtgga

SEQ ID NO: 7388534 - DNA, 22 bp, Homo sapiens
ggcattctaggccaaaatcagg

SEQ ID NO: 7388535 - DNA, 22 bp, Homo sapiens
ggcattgttctaggtggttgga

SEQ ID NO: 7388536 - DNA, 18 bp, Homo sapiens
ggcattgtttattagtta

SEQ ID NO: 7388537 - DNA, 22 bp, Homo sapiens
ggcattgcatgacacgcagctg

SEQ ID NO: 7388538 - DNA, 22 bp, Homo sapiens
ggcattgtaaaggattcataga

SEQ ID NO: 7388539 - DNA, 22 bp, Homo sapiens
ggcattgtaaaggattcataga

SEQ ID NO: 7388540 - DNA, 22 bp, Homo sapiens
ggcattgtggtgtgtgcttcct

SEQ ID NO: 7388541 - DNA, 22 bp, Homo sapiens
ggcatcaggagcttcttcaggt

SEQ ID NO: 7388542 - DNA, 22 bp, Homo sapiens
ggcatcaggagcttcttcaggt

SEQ ID NO: 7388543 - DNA, 22 bp, Homo sapiens
ggcatcaggagcttcttcaggt

SEQ ID NO: 7388544 - DNA, 22 bp, Homo sapiens
ggcatcaggatctgtcttgctt

SEQ ID NO: 7388545 - DNA, 22 bp, Homo sapiens
ggcatcaggagcttcttcaggt

SEQ ID NO: 7388546 - DNA, 22 bp, Homo sapiens
ggcatcaggatctgtcttgctt

SEQ ID NO: 7388547 - DNA, 22 bp, Homo sapiens
ggcatcaggatctgtcttgctt

SEQ ID NO: 7388548 - DNA, 22 bp, Homo sapiens
ggcattaggtgaatgctcagca

SEQ ID NO: 7388549 - DNA, 22 bp, Homo sapiens
ggcattaggtgaatgctcagca

SEQ ID NO: 7388550 - DNA, 17 bp, Homo sapiens
ggcatttgtcaggcaga

SEQ ID NO: 7388551 - DNA, 21 bp, Homo sapiens
ggcatttgccaaagtgatcct

SEQ ID NO: 7388552 - DNA, 22 bp, Homo sapiens
ggcatttttgacaaagagcaat

SEQ ID NO: 7388553 - DNA, 22 bp, Homo sapiens
ggcatttttgacaaagagcaat

SEQ ID NO: 7388554 - DNA, 17 bp, Homo sapiens
ggcatttgtcaggcaga

SEQ ID NO: 7388555 - DNA, 22 bp, Homo sapiens
ggcatttttgacaaagagcaat

SEQ ID NO: 7388556 - DNA, 22 bp, Homo sapiens
ggccaaaagcataatcctcaca

SEQ ID NO: 7388557 - DNA, 22 bp, Homo sapiens
ggccaaatcctccatggtggct

SEQ ID NO: 7388558 - DNA, 22 bp, Homo sapiens
ggccaaaagcataatcctcaca

SEQ ID NO: 7388559 - DNA, 22 bp, Homo sapiens
ggcatttttgacaaagagcaat

SEQ ID NO: 7388560 - DNA, 22 bp, Homo sapiens
ggccaagatggaaggagagatg

SEQ ID NO: 7388561 - DNA, 22 bp, Homo sapiens
ggccaagatggaaggagagatg

SEQ ID NO: 7388562 - DNA, 22 bp, Homo sapiens
ggccaagaatgataggctcagt

SEQ ID NO: 7388563 - DNA, 22 bp, Homo sapiens
ggccaagatcccattatacaaa

SEQ ID NO: 7388564 - DNA, 21 bp, Homo sapiens
ggccaacatggtctcatctct

SEQ ID NO: 7388565 - DNA, 21 bp, Homo sapiens
ggccaacatggtctcatctct

SEQ ID NO: 7388566 - DNA, 22 bp, Homo sapiens
ggccaaatttatttgcagctgg

SEQ ID NO: 7388567 - DNA, 23 bp, Homo sapiens
ggccactgaattttctgcatctt

SEQ ID NO: 7388568 - DNA, 22 bp, Homo sapiens
ggccactcggccacccctgccg

SEQ ID NO: 7388569 - DNA, 23 bp, Homo sapiens
ggccactgaattttctgcatctt

SEQ ID NO: 7388570 - DNA, 23 bp, Homo sapiens
ggccactgaattttctgcatctt

SEQ ID NO: 7388571 - DNA, 19 bp, Homo sapiens
ggccactcctggtgactgg

SEQ ID NO: 7388572 - DNA, 22 bp, Homo sapiens
ggccactccgctgctactggaa

SEQ ID NO: 7388573 - DNA, 22 bp, Homo sapiens
ggccactcggccacccctgccg

SEQ ID NO: 7388574 - DNA, 22 bp, Homo sapiens
ggccactccgctgctactggaa

SEQ ID NO: 7388575 - DNA, 21 bp, Homo sapiens
ggccacgttaacactggactt

SEQ ID NO: 7388576 - DNA, 22 bp, Homo sapiens
ggccactatttattaacaggat

SEQ ID NO: 7388577 - DNA, 22 bp, Homo sapiens
ggccaaggatggtggctctggt

SEQ ID NO: 7388578 - DNA, 22 bp, Homo sapiens
ggccaaggatggtggctctggt

SEQ ID NO: 7388579 - DNA, 22 bp, Homo sapiens
ggccaaggatggtggctctggt

SEQ ID NO: 7388580 - DNA, 22 bp, Homo sapiens
ggccaaggatggtggctctggt

SEQ ID NO: 7388581 - DNA, 22 bp, Homo sapiens
ggccaaggatggtggctctggt

SEQ ID NO: 7388582 - DNA, 22 bp, Homo sapiens
ggccaaggatggtggctctggt

SEQ ID NO: 7388583 - DNA, 22 bp, Homo sapiens
ggccaccttcctgtggtctctg

SEQ ID NO: 7388584 - DNA, 22 bp, Homo sapiens
ggcagggcaggaaagtcaggaa

SEQ ID NO: 7388585 - DNA, 22 bp, Homo sapiens
ggcagggcaggaaagtcaggaa

SEQ ID NO: 7388586 - DNA, 22 bp, Homo sapiens
ggcagggcaggaaagtcaggaa

SEQ ID NO: 7388587 - DNA, 22 bp, Homo sapiens
ggcagggcaggaaagtcaggaa

SEQ ID NO: 7388588 - DNA, 22 bp, Homo sapiens
ggcagggcaggaaagtcaggaa

SEQ ID NO: 7388589 - DNA, 22 bp, Homo sapiens
ggcagggcaggaaagtcaggaa

SEQ ID NO: 7388590 - DNA, 22 bp, Homo sapiens
ggcagggcaggaaagtcaggaa

SEQ ID NO: 7388591 - DNA, 22 bp, Homo sapiens
ggcagggcaggaaagtcaggaa

SEQ ID NO: 7388592 - DNA, 22 bp, Homo sapiens
ggcagggcaggaaagtcaggaa

SEQ ID NO: 7388593 - DNA, 22 bp, Homo sapiens
ggcagggcaggaaagtcaggaa

SEQ ID NO: 7388594 - DNA, 22 bp, Homo sapiens
ggcagggcaggaaagtcaggaa

SEQ ID NO: 7388595 - DNA, 22 bp, Homo sapiens
ggcagggcaggaaagtcaggaa

SEQ ID NO: 7388596 - DNA, 22 bp, Homo sapiens
ggcagggcaggaaagtcaggaa

SEQ ID NO: 7388597 - DNA, 22 bp, Homo sapiens
ggcagggcaggaaagtcaggaa

SEQ ID NO: 7388598 - DNA, 22 bp, Homo sapiens
ggcagggcaggaaagtcaggaa

SEQ ID NO: 7388599 - DNA, 22 bp, Homo sapiens
ggcagggcaggaaagtcaggaa

SEQ ID NO: 7388600 - DNA, 22 bp, Homo sapiens
ggcagggcagcgctgattaggg

SEQ ID NO: 7388601 - DNA, 22 bp, Homo sapiens
ggcagggcagcgctgattaggg

SEQ ID NO: 7388602 - DNA, 22 bp, Homo sapiens
ggcagggcagcgctgattaggg

SEQ ID NO: 7388603 - DNA, 22 bp, Homo sapiens
ggcagggcagcgctgattaggg

SEQ ID NO: 7388604 - DNA, 22 bp, Homo sapiens
ggcagggcagcgctgattaggg

SEQ ID NO: 7388605 - DNA, 22 bp, Homo sapiens
ggcagggcagcgctgattaggg

SEQ ID NO: 7388606 - DNA, 22 bp, Homo sapiens
ggcagggcagcgctgattaggg

SEQ ID NO: 7388607 - DNA, 20 bp, Homo sapiens
ggcagggagggatactgagg

SEQ ID NO: 7388608 - DNA, 22 bp, Homo sapiens
ggcagggagtggagactcccta

SEQ ID NO: 7388609 - DNA, 22 bp, Homo sapiens
ggcagggagtggagactcccta

SEQ ID NO: 7388610 - DNA, 22 bp, Homo sapiens
ggcagggagtggagactcccta

SEQ ID NO: 7388611 - DNA, 22 bp, Homo sapiens
ggcagggagtggagactcccta

SEQ ID NO: 7388612 - DNA, 22 bp, Homo sapiens
ggcagggagtggagactcccta

SEQ ID NO: 7388613 - DNA, 22 bp, Homo sapiens
ggcagggagtggagactcccta

SEQ ID NO: 7388614 - DNA, 22 bp, Homo sapiens
ggcagggagtggagactcccta

SEQ ID NO: 7388615 - DNA, 22 bp, Homo sapiens
ggcagggagtggagactcccta

SEQ ID NO: 7388616 - DNA, 22 bp, Homo sapiens
ggcaggtgccttctgtgctagc

SEQ ID NO: 7388617 - DNA, 22 bp, Homo sapiens
ggcaggtgcccagagagcacga

SEQ ID NO: 7388618 - DNA, 22 bp, Homo sapiens
ggcaggtgcccagagagcacga

SEQ ID NO: 7388619 - DNA, 22 bp, Homo sapiens
ggcaggtgcccagagagcacga

SEQ ID NO: 7388620 - DNA, 22 bp, Homo sapiens
ggcaggtgcccagagagcacga

SEQ ID NO: 7388621 - DNA, 22 bp, Homo sapiens
ggcaggtgcccagagagcacga

SEQ ID NO: 7388622 - DNA, 22 bp, Homo sapiens
ggcaggtgcccagagagcacga

SEQ ID NO: 7388623 - DNA, 22 bp, Homo sapiens
ggcaggtgccagttggcttggg

SEQ ID NO: 7388624 - DNA, 22 bp, Homo sapiens
ggcaggtgccagttggcttggg

SEQ ID NO: 7388625 - DNA, 22 bp, Homo sapiens
ggcaggtgccagttggcttggg

SEQ ID NO: 7388626 - DNA, 22 bp, Homo sapiens
ggcaggtgccagttggcttggg

SEQ ID NO: 7388627 - DNA, 22 bp, Homo sapiens
ggcaggtgccagttggcttggg

SEQ ID NO: 7388628 - DNA, 22 bp, Homo sapiens
ggcaggtgcacctgagccatct

SEQ ID NO: 7388629 - DNA, 22 bp, Homo sapiens
ggcaggtgcacctgagccatct

SEQ ID NO: 7388630 - DNA, 22 bp, Homo sapiens
ggcaggtgcacctgagccatct

SEQ ID NO: 7388631 - DNA, 22 bp, Homo sapiens
ggcaggtgcacctgagccatct

SEQ ID NO: 7388632 - DNA, 22 bp, Homo sapiens
ggcaggtgcacctgagccatct

SEQ ID NO: 7388633 - DNA, 22 bp, Homo sapiens
ggcaggtgcacctgagccatct

SEQ ID NO: 7388634 - DNA, 22 bp, Homo sapiens
ggcaggtgcacctgagccatct

SEQ ID NO: 7388635 - DNA, 22 bp, Homo sapiens
ggcaggtgcacctgagccatct

SEQ ID NO: 7388636 - DNA, 22 bp, Homo sapiens
ggcaggtgatctagagtcaata

SEQ ID NO: 7388637 - DNA, 22 bp, Homo sapiens
ggcaggtgatctagagtcaata

SEQ ID NO: 7388638 - DNA, 22 bp, Homo sapiens
ggcaggtgatctagagtcaata

SEQ ID NO: 7388639 - DNA, 22 bp, Homo sapiens
ggcaggtgcacctgagccatct

SEQ ID NO: 7388640 - DNA, 22 bp, Homo sapiens
ggcaggtgatctagagtcaata

SEQ ID NO: 7388641 - DNA, 22 bp, Homo sapiens
ggcaggtgatctagagtcaata

SEQ ID NO: 7388642 - DNA, 22 bp, Homo sapiens
ggcaggtgatctagagtcaata

SEQ ID NO: 7388643 - DNA, 22 bp, Homo sapiens
cacatttagaggttagcatggt

SEQ ID NO: 7388644 - DNA, 22 bp, Homo sapiens
cacatttagaggttagcatggt

SEQ ID NO: 7388645 - DNA, 22 bp, Homo sapiens
cacatttagaggttagcatggt

SEQ ID NO: 7388646 - DNA, 22 bp, Homo sapiens
cacatttagaggttagcatggt

SEQ ID NO: 7388647 - DNA, 22 bp, Homo sapiens
cacatttagaggttagcatggt

SEQ ID NO: 7388648 - DNA, 22 bp, Homo sapiens
cacatttagaggttagcatggt

SEQ ID NO: 7388649 - DNA, 22 bp, Homo sapiens
cacatttagaggttagcatggt

SEQ ID NO: 7388650 - DNA, 22 bp, Homo sapiens
cacatttacttttatcccttgg

SEQ ID NO: 7388651 - DNA, 22 bp, Homo sapiens
cacatttacatataaaactttc

SEQ ID NO: 7388652 - DNA, 18 bp, Homo sapiens
cacatttacctggctccc

SEQ ID NO: 7388653 - DNA, 22 bp, Homo sapiens
cacatttacttttatcccttgg

SEQ ID NO: 7388654 - DNA, 22 bp, Homo sapiens
cacatttagaggttagcatggt

SEQ ID NO: 7388655 - DNA, 22 bp, Homo sapiens
cacatttagaggttagcatggt

SEQ ID NO: 7388656 - DNA, 22 bp, Homo sapiens
cacatttaggttcctatagcca

SEQ ID NO: 7388657 - DNA, 22 bp, Homo sapiens
cacatttaggaggtggggaagc

SEQ ID NO: 7388658 - DNA, 22 bp, Homo sapiens
cacatttaggttcctatagcca

SEQ ID NO: 7388659 - DNA, 22 bp, Homo sapiens
cacatttaggttcctatagcca

SEQ ID NO: 7388660 - DNA, 22 bp, Homo sapiens
cacatttaggttcctatagcca

SEQ ID NO: 7388661 - DNA, 22 bp, Homo sapiens
cacatttaggttcctatagcca

SEQ ID NO: 7388662 - DNA, 22 bp, Homo sapiens
cacatttatgggctgggaggca

SEQ ID NO: 7388663 - DNA, 22 bp, Homo sapiens
cacatttatctgttctttctag

SEQ ID NO: 7388664 - DNA, 22 bp, Homo sapiens
cacatttatctctctccggtga

SEQ ID NO: 7388665 - DNA, 22 bp, Homo sapiens
cacatttatctgttctttctag

SEQ ID NO: 7388666 - DNA, 22 bp, Homo sapiens
cacatttatctgttctttctag

SEQ ID NO: 7388667 - DNA, 22 bp, Homo sapiens
cacatatacctcttcttgagtt

SEQ ID NO: 7388668 - DNA, 22 bp, Homo sapiens
cacatataccagccgcggtacg

SEQ ID NO: 7388669 - DNA, 22 bp, Homo sapiens
cacatatacctcttcttgagtt

SEQ ID NO: 7388670 - DNA, 22 bp, Homo sapiens
cacatatacctcttcttgagtt

SEQ ID NO: 7388671 - DNA, 22 bp, Homo sapiens
cacatataacctagacaaggcc

SEQ ID NO: 7388672 - DNA, 22 bp, Homo sapiens
cacatagataggcagaagaaca

SEQ ID NO: 7388673 - DNA, 22 bp, Homo sapiens
cacatagataggcagaagaaca

SEQ ID NO: 7388674 - DNA, 22 bp, Homo sapiens
cacatagataggcagaagaaca

SEQ ID NO: 7388675 - DNA, 22 bp, Homo sapiens
cacatagaaaacttagcaggga

SEQ ID NO: 7388676 - DNA, 22 bp, Homo sapiens
cacatagaaaacttagcaggga

SEQ ID NO: 7388677 - DNA, 22 bp, Homo sapiens
cacatagaaaacttagcaggga

SEQ ID NO: 7388678 - DNA, 22 bp, Homo sapiens
cacatacttgtgtgtacatatg

SEQ ID NO: 7388679 - DNA, 22 bp, Homo sapiens
cacatacttgtgtgtacatatg

SEQ ID NO: 7388680 - DNA, 22 bp, Homo sapiens
cacatatatgaaatgaggaatt

SEQ ID NO: 7388681 - DNA, 22 bp, Homo sapiens
cacatatatgaaatgaggaatt

SEQ ID NO: 7388682 - DNA, 22 bp, Homo sapiens
cacatatatgaaatgaggaatt

SEQ ID NO: 7388683 - DNA, 22 bp, Homo sapiens
cacattcttgagttacagtcta

SEQ ID NO: 7388684 - DNA, 22 bp, Homo sapiens
cacattcttgagttacagtcta

SEQ ID NO: 7388685 - DNA, 22 bp, Homo sapiens
cacattcttgagttacagtcta

SEQ ID NO: 7388686 - DNA, 22 bp, Homo sapiens
cacattctgtgaagctgatttt

SEQ ID NO: 7388687 - DNA, 23 bp, Homo sapiens
cacatatagcagccactaaggtc

SEQ ID NO: 7388688 - DNA, 22 bp, Homo sapiens
cacatatatgaaatgaggaatt

SEQ ID NO: 7388689 - DNA, 22 bp, Homo sapiens
cacatatacctcttcttgagtt

SEQ ID NO: 7388690 - DNA, 23 bp, Homo sapiens
cacatatagcagccactaaggtc

SEQ ID NO: 7388691 - DNA, 22 bp, Homo sapiens
cacatatacctcttcttgagtt

SEQ ID NO: 7388692 - DNA, 22 bp, Homo sapiens
cacattctttcacagttctgaa

SEQ ID NO: 7388693 - DNA, 22 bp, Homo sapiens
cacattctttcacagttctgaa

SEQ ID NO: 7388694 - DNA, 22 bp, Homo sapiens
cacattctttcacagttctgaa

SEQ ID NO: 7388695 - DNA, 22 bp, Homo sapiens
cacattctttcacagttctgaa

SEQ ID NO: 7388696 - DNA, 22 bp, Homo sapiens
cacattcttggtcaccttgtgg

SEQ ID NO: 7388697 - DNA, 22 bp, Homo sapiens
cacattcttggtcaccttgtgg

SEQ ID NO: 7388698 - DNA, 22 bp, Homo sapiens
cacattcttgagttacagtcta

SEQ ID NO: 7388699 - DNA, 22 bp, Homo sapiens
cacattcttgagttacagtcta

SEQ ID NO: 7388700 - DNA, 22 bp, Homo sapiens
cacattctttcacagttctgaa

SEQ ID NO: 7388701 - DNA, 22 bp, Homo sapiens
cacatttaattggtttagggtg

SEQ ID NO: 7388702 - DNA, 22 bp, Homo sapiens
cacatttaattggtttagggtg

SEQ ID NO: 7388703 - DNA, 22 bp, Homo sapiens
cacatttacatataaaactttc

SEQ ID NO: 7388704 - DNA, 22 bp, Homo sapiens
cacatttacatataaaactttc

SEQ ID NO: 7388705 - DNA, 18 bp, Homo sapiens
cacatttacctggctccc

SEQ ID NO: 7388706 - DNA, 22 bp, Homo sapiens
cacatttacatataaaactttc

SEQ ID NO: 7388707 - DNA, 22 bp, Homo sapiens
cacatttacatataaaactttc

SEQ ID NO: 7388708 - DNA, 22 bp, Homo sapiens
cacatttacatataaaactttc

SEQ ID NO: 7388709 - DNA, 22 bp, Homo sapiens
cacatttctaggaaattaaatg

SEQ ID NO: 7388710 - DNA, 22 bp, Homo sapiens
cacatttctaggaaattaaatg

SEQ ID NO: 7388711 - DNA, 22 bp, Homo sapiens
cacatttctaggaaattaaatg

SEQ ID NO: 7388712 - DNA, 22 bp, Homo sapiens
cacatttccttggcctttaatt

SEQ ID NO: 7388713 - DNA, 22 bp, Homo sapiens
cacatttatttgaggctaattg

SEQ ID NO: 7388714 - DNA, 22 bp, Homo sapiens
cacatttatttgaggctaattg

SEQ ID NO: 7388715 - DNA, 22 bp, Homo sapiens
cacatttcattggcttacgtaa

SEQ ID NO: 7388716 - DNA, 22 bp, Homo sapiens
cacatttcattggcttacgtaa

SEQ ID NO: 7388717 - DNA, 22 bp, Homo sapiens
ggcaggcaggagctctgtctcc

SEQ ID NO: 7388718 - DNA, 20 bp, Homo sapiens
ggcaggcaggaggtttccag

SEQ ID NO: 7388719 - DNA, 22 bp, Homo sapiens
ggcaggcaggagctctgtctcc

SEQ ID NO: 7388720 - DNA, 22 bp, Homo sapiens
ggcaggcaggagctctgtctcc

SEQ ID NO: 7388721 - DNA, 22 bp, Homo sapiens
ggcaggcaggagcgtgcttggg

SEQ ID NO: 7388722 - DNA, 22 bp, Homo sapiens
ggcaggcaggagcgtgcttggg

SEQ ID NO: 7388723 - DNA, 22 bp, Homo sapiens
ggcaggcaggagcgtgcttggg

SEQ ID NO: 7388724 - DNA, 22 bp, Homo sapiens
ggcaggcaggagcgtgcttggg

SEQ ID NO: 7388725 - DNA, 22 bp, Homo sapiens
ggcaggcaggagctctgtctcc

SEQ ID NO: 7388726 - DNA, 22 bp, Homo sapiens
ggcaggcatcatcagttgatca

SEQ ID NO: 7388727 - DNA, 22 bp, Homo sapiens
ggcaggcagtgtggtgtgaaac

SEQ ID NO: 7388728 - DNA, 22 bp, Homo sapiens
ggcaggcatcatcagttgatca

SEQ ID NO: 7388729 - DNA, 22 bp, Homo sapiens
ggcaggcagtgtggtgtgaaac

SEQ ID NO: 7388730 - DNA, 22 bp, Homo sapiens
ggcaggcagtgtggtgtgaaac

SEQ ID NO: 7388731 - DNA, 22 bp, Homo sapiens
ggcaggcagtgtggtgtgaaac

SEQ ID NO: 7388732 - DNA, 22 bp, Homo sapiens
ggcaggcagtgtggtgtgaaac

SEQ ID NO: 7388733 - DNA, 22 bp, Homo sapiens
ggcaggcaggtcttcatggccc

SEQ ID NO: 7388734 - DNA, 22 bp, Homo sapiens
ggcaggcaggtcttcatggccc

SEQ ID NO: 7388735 - DNA, 22 bp, Homo sapiens
ggcaggcaggtcttcatggccc

SEQ ID NO: 7388736 - DNA, 22 bp, Homo sapiens
ggcaggcaggtcttcatggccc

SEQ ID NO: 7388737 - DNA, 22 bp, Homo sapiens
ggcaggcaggtcttcatggccc

SEQ ID NO: 7388738 - DNA, 22 bp, Homo sapiens
ggcaggcaggtcttcatggccc

SEQ ID NO: 7388739 - DNA, 20 bp, Homo sapiens
ggcaggcaggaggtttccag

SEQ ID NO: 7388740 - DNA, 22 bp, Homo sapiens
ggcaggcaggtcttcatggccc

SEQ ID NO: 7388741 - DNA, 22 bp, Homo sapiens
ggcaggcatggggtctgccatt

SEQ ID NO: 7388742 - DNA, 22 bp, Homo sapiens
ggcaggcatggggtctgccatt

SEQ ID NO: 7388743 - DNA, 22 bp, Homo sapiens
ggcagggagagcatgctgataa

SEQ ID NO: 7388744 - DNA, 22 bp, Homo sapiens
ggcagggagagcatgctgataa

SEQ ID NO: 7388745 - DNA, 22 bp, Homo sapiens
ggcagggagagcatgctgataa

SEQ ID NO: 7388746 - DNA, 20 bp, Homo sapiens
ggcagggagggatactgagg

SEQ ID NO: 7388747 - DNA, 22 bp, Homo sapiens
ggcagggaggaggtgaaagtga

SEQ ID NO: 7388748 - DNA, 22 bp, Homo sapiens
ggcagggaggaggtgaaagtga

SEQ ID NO: 7388749 - DNA, 22 bp, Homo sapiens
ggcagggaggaggtgaaagtga

SEQ ID NO: 7388750 - DNA, 22 bp, Homo sapiens
ggcagggaggaggtgaaagtga

SEQ ID NO: 7388751 - DNA, 22 bp, Homo sapiens
ggcagggaggaggtgaaagtga

SEQ ID NO: 7388752 - DNA, 22 bp, Homo sapiens
ggcagggaggaggtgaaagtga

SEQ ID NO: 7388753 - DNA, 22 bp, Homo sapiens
ggcaggcatggggtctgccatt

SEQ ID NO: 7388754 - DNA, 22 bp, Homo sapiens
ggcaggcatggccactccctag

SEQ ID NO: 7388755 - DNA, 22 bp, Homo sapiens
ggcaggcatggccactccctag

SEQ ID NO: 7388756 - DNA, 22 bp, Homo sapiens
ggcaggcatggccactccctag

SEQ ID NO: 7388757 - DNA, 22 bp, Homo sapiens
ggcaggcatggccactccctag

SEQ ID NO: 7388758 - DNA, 22 bp, Homo sapiens
ggcaggcatggggtctgccatt

SEQ ID NO: 7388759 - DNA, 22 bp, Homo sapiens
ggcaggcatggggtctgccatt

SEQ ID NO: 7388760 - DNA, 22 bp, Homo sapiens
ggcaggcatggggtctgccatt

SEQ ID NO: 7388761 - DNA, 22 bp, Homo sapiens
ggcaggcatggccactccctag

SEQ ID NO: 7388762 - DNA, 22 bp, Homo sapiens
ggcaggcatggccactccctag

SEQ ID NO: 7388763 - DNA, 22 bp, Homo sapiens
ggcaggcatggggtctgccatt

SEQ ID NO: 7388764 - DNA, 22 bp, Homo sapiens
ggcaggcatcatgtggtcatta

SEQ ID NO: 7388765 - DNA, 22 bp, Homo sapiens
ggcaggcatggccactccctag

SEQ ID NO: 7388766 - DNA, 22 bp, Homo sapiens
ggcaggcatcatgtggtcatta

SEQ ID NO: 7388767 - DNA, 22 bp, Homo sapiens
ggcaggcatcatgtggtcatta

SEQ ID NO: 7388768 - DNA, 22 bp, Homo sapiens
ggcaggcatcatgtggtcatta

SEQ ID NO: 7388769 - DNA, 22 bp, Homo sapiens
ggcaggcatcatcagttgatca

SEQ ID NO: 7388770 - DNA, 22 bp, Homo sapiens
ggcaggcatcatcagttgatca

SEQ ID NO: 7388771 - DNA, 22 bp, Homo sapiens
ggcaggcatcatgtggtcatta

SEQ ID NO: 7388772 - DNA, 22 bp, Homo sapiens
cacagggaaccaaggctgggcc

SEQ ID NO: 7388773 - DNA, 22 bp, Homo sapiens
cacagggaaccaaggctgggcc

SEQ ID NO: 7388774 - DNA, 22 bp, Homo sapiens
cacagggaaccaaggctgggcc

SEQ ID NO: 7388775 - DNA, 22 bp, Homo sapiens
cacagggaacaactagaacaaa

SEQ ID NO: 7388776 - DNA, 22 bp, Homo sapiens
cacagggaaccaaggctgggcc

SEQ ID NO: 7388777 - DNA, 22 bp, Homo sapiens
cacaggcttttttggctgatgt

SEQ ID NO: 7388778 - DNA, 22 bp, Homo sapiens
cacaggcttttttggctgatgt

SEQ ID NO: 7388779 - DNA, 22 bp, Homo sapiens
cacagggaacaactagaacaaa

SEQ ID NO: 7388780 - DNA, 22 bp, Homo sapiens
cacagggaacaactagaacaaa

SEQ ID NO: 7388781 - DNA, 22 bp, Homo sapiens
cacagggaaccaaggctgggcc

SEQ ID NO: 7388782 - DNA, 22 bp, Homo sapiens
cacagggaaccaaggctgggcc

SEQ ID NO: 7388783 - DNA, 22 bp, Homo sapiens
cacagggaaccaaggctgggcc

SEQ ID NO: 7388784 - DNA, 22 bp, Homo sapiens
cacagggaaccaaggctgggcc

SEQ ID NO: 7388785 - DNA, 22 bp, Homo sapiens
cacagggaaccaaggctgggcc

SEQ ID NO: 7388786 - DNA, 19 bp, Homo sapiens
cacagggagaccacatgtc

SEQ ID NO: 7388787 - DNA, 21 bp, Homo sapiens
ggaggtcccttctggtttcag

SEQ ID NO: 7388788 - DNA, 21 bp, Homo sapiens
ggaggtcccttctggtttcag

SEQ ID NO: 7388789 - DNA, 22 bp, Homo sapiens
ggaggtgacgaaaagaaattgt

SEQ ID NO: 7388790 - DNA, 22 bp, Homo sapiens
ggaggtgaggccgtagggtgtg

SEQ ID NO: 7388791 - DNA, 22 bp, Homo sapiens
ggaggtgaggccgtagggtgtg

SEQ ID NO: 7388792 - DNA, 22 bp, Homo sapiens
ggaggtgaggccgtagggtgtg

SEQ ID NO: 7388793 - DNA, 22 bp, Homo sapiens
ggaggtgaggccgtagggtgtg

SEQ ID NO: 7388794 - DNA, 22 bp, Homo sapiens
ggaggtgatcagagttttgagg

SEQ ID NO: 7388795 - DNA, 22 bp, Homo sapiens
ggaggtgaggccgtagggtgtg

SEQ ID NO: 7388796 - DNA, 22 bp, Homo sapiens
ggaggtgactggatcatgggca

SEQ ID NO: 7388797 - DNA, 22 bp, Homo sapiens
ggaggtgactggatcatgggca

SEQ ID NO: 7388798 - DNA, 22 bp, Homo sapiens
ggaggtgacgaaaagaaattgt

SEQ ID NO: 7388799 - DNA, 22 bp, Homo sapiens
ggaggtgactggatcatgggca

SEQ ID NO: 7388800 - DNA, 22 bp, Homo sapiens
ggaggtgactggatcatgggca

SEQ ID NO: 7388801 - DNA, 22 bp, Homo sapiens
ggaggtgactggatcatgggca

SEQ ID NO: 7388802 - DNA, 22 bp, Homo sapiens
ggaggtgaggccgtagggtgtg

SEQ ID NO: 7388803 - DNA, 22 bp, Homo sapiens
ggaggtgcagagtagggttggt

SEQ ID NO: 7388804 - DNA, 22 bp, Homo sapiens
ggaggtgcagagtagggttggt

SEQ ID NO: 7388805 - DNA, 22 bp, Homo sapiens
ggaggtgcagagtagggttggt

SEQ ID NO: 7388806 - DNA, 22 bp, Homo sapiens
ggaggtgcagagtagggttggt

SEQ ID NO: 7388807 - DNA, 22 bp, Homo sapiens
ggaggtgatcagagttttgagg

SEQ ID NO: 7388808 - DNA, 22 bp, Homo sapiens
ggaggtgctgatcccagtcaac

SEQ ID NO: 7388809 - DNA, 22 bp, Homo sapiens
ggaggtgctggcggccagctct

SEQ ID NO: 7388810 - DNA, 22 bp, Homo sapiens
ggaggtgcagagtagggttggt

SEQ ID NO: 7388811 - DNA, 22 bp, Homo sapiens
ggaggtgcagagtagggttggt

SEQ ID NO: 7388812 - DNA, 22 bp, Homo sapiens
ggaggtgctgatcccagtcaac

SEQ ID NO: 7388813 - DNA, 22 bp, Homo sapiens
ggaggtggaggttgcagtgagc

SEQ ID NO: 7388814 - DNA, 22 bp, Homo sapiens
ggaggtggaggttgcagtgagc

SEQ ID NO: 7388815 - DNA, 22 bp, Homo sapiens
ggaggtggaggttgcaatgagc

SEQ ID NO: 7388816 - DNA, 22 bp, Homo sapiens
ggaggtggaggttgcagtgagc

SEQ ID NO: 7388817 - DNA, 22 bp, Homo sapiens
ggaggtggaggttgcaatgagc

SEQ ID NO: 7388818 - DNA, 22 bp, Homo sapiens
ggaggtggaggttgcagtgagc

SEQ ID NO: 7388819 - DNA, 22 bp, Homo sapiens
ggaggtggaggttgcagtgagc

SEQ ID NO: 7388820 - DNA, 22 bp, Homo sapiens
ggaggtggaggttgcagtgagc

SEQ ID NO: 7388821 - DNA, 22 bp, Homo sapiens
ggaggtggaggttgcagtgagc

SEQ ID NO: 7388822 - DNA, 22 bp, Homo sapiens
ggaggtggaggttgcagtgagc

SEQ ID NO: 7388823 - DNA, 22 bp, Homo sapiens
ggaggtggaggttgcagtgagc

SEQ ID NO: 7388824 - DNA, 22 bp, Homo sapiens
ggaggtggaggttgcagtgagc

SEQ ID NO: 7388825 - DNA, 22 bp, Homo sapiens
cacagtgttccagagcagtggt

SEQ ID NO: 7388826 - DNA, 22 bp, Homo sapiens
cacagtgttccagagcagtggt

SEQ ID NO: 7388827 - DNA, 22 bp, Homo sapiens
cacagtgttccagagcagtggt

SEQ ID NO: 7388828 - DNA, 22 bp, Homo sapiens
cacagtttggttttgctgtaat

SEQ ID NO: 7388829 - DNA, 22 bp, Homo sapiens
cacagtttggttttgctgtaat

SEQ ID NO: 7388830 - DNA, 22 bp, Homo sapiens
cacagttttatcttatactgat

SEQ ID NO: 7388831 - DNA, 22 bp, Homo sapiens
cacagttttatcttatactgat

SEQ ID NO: 7388832 - DNA, 22 bp, Homo sapiens
ggaggtggagctggaagttcca

SEQ ID NO: 7388833 - DNA, 22 bp, Homo sapiens
ggaggtggagctggaagttcca

SEQ ID NO: 7388834 - DNA, 22 bp, Homo sapiens
ggaggtgcagagtagggttggt

SEQ ID NO: 7388835 - DNA, 22 bp, Homo sapiens
ggaggtggagctggaagttcca

SEQ ID NO: 7388836 - DNA, 22 bp, Homo sapiens
ggaggtggagctggaagttcca

SEQ ID NO: 7388837 - DNA, 22 bp, Homo sapiens
ggaggtggagctggaagttcca

SEQ ID NO: 7388838 - DNA, 22 bp, Homo sapiens
ggaggtgctgatcccagtcaac

SEQ ID NO: 7388839 - DNA, 22 bp, Homo sapiens
ggaggtgctggcggccagctct

SEQ ID NO: 7388840 - DNA, 22 bp, Homo sapiens
ggaggtgctggcggccagctct

SEQ ID NO: 7388841 - DNA, 22 bp, Homo sapiens
ggaggtgctggcggccagctct

SEQ ID NO: 7388842 - DNA, 22 bp, Homo sapiens
ggaggtggaggttgcaatgagc

SEQ ID NO: 7388843 - DNA, 22 bp, Homo sapiens
ggaggtggaggttgcaatgagc

SEQ ID NO: 7388844 - DNA, 22 bp, Homo sapiens
ggaggtggaggttgcaatgagc

SEQ ID NO: 7388845 - DNA, 22 bp, Homo sapiens
ggaggtggaggttgcaatgagc

SEQ ID NO: 7388846 - DNA, 22 bp, Homo sapiens
ggaggtggagctggaagttcca

SEQ ID NO: 7388847 - DNA, 22 bp, Homo sapiens
ggaggtggagctggaagttcca

SEQ ID NO: 7388848 - DNA, 22 bp, Homo sapiens
ggaggtggaggttgcaatgagc

SEQ ID NO: 7388849 - DNA, 22 bp, Homo sapiens
ggaggtggaggttgcaatgagc

SEQ ID NO: 7388850 - DNA, 22 bp, Homo sapiens
ggaggtggaggttgcaatgagc

SEQ ID NO: 7388851 - DNA, 22 bp, Homo sapiens
ggaggtggaggttgcaatgagc

SEQ ID NO: 7388852 - DNA, 22 bp, Homo sapiens
ggaggtggaggttgcaatgagc

SEQ ID NO: 7388853 - DNA, 22 bp, Homo sapiens
cacagttttatcttatactgat

SEQ ID NO: 7388854 - DNA, 22 bp, Homo sapiens
cacagttttgcccagggcttct

SEQ ID NO: 7388855 - DNA, 22 bp, Homo sapiens
cacagttttgcccagggcttct

SEQ ID NO: 7388856 - DNA, 22 bp, Homo sapiens
cacagttttgtcttggtttcca

SEQ ID NO: 7388857 - DNA, 22 bp, Homo sapiens
cacagttttgtcttggtttcca

SEQ ID NO: 7388858 - DNA, 22 bp, Homo sapiens
cacataaatggtgccatgtttt

SEQ ID NO: 7388859 - DNA, 22 bp, Homo sapiens
cacagttttgtcttggtttcca

SEQ ID NO: 7388860 - DNA, 22 bp, Homo sapiens
cacataaatggtgccatgtttt

SEQ ID NO: 7388861 - DNA, 22 bp, Homo sapiens
cacataataaatgttcctgatg

SEQ ID NO: 7388862 - DNA, 22 bp, Homo sapiens
cacataagaaatgaatatgaga

SEQ ID NO: 7388863 - DNA, 22 bp, Homo sapiens
cacatacaatggtgttatttgg

SEQ ID NO: 7388864 - DNA, 22 bp, Homo sapiens
cacatacaatggtgttatttgg

SEQ ID NO: 7388865 - DNA, 22 bp, Homo sapiens
cacatacaatggtgttatttgg

SEQ ID NO: 7388866 - DNA, 22 bp, Homo sapiens
cacatacaatggtgttatttgg

SEQ ID NO: 7388867 - DNA, 22 bp, Homo sapiens
cacatacaatggtgttatttgg

SEQ ID NO: 7388868 - DNA, 22 bp, Homo sapiens
cacatacaaggcacactggagg

SEQ ID NO: 7388869 - DNA, 22 bp, Homo sapiens
cacatacaaggcacactggagg

SEQ ID NO: 7388870 - DNA, 22 bp, Homo sapiens
cacatacaaggcacactggagg

SEQ ID NO: 7388871 - DNA, 22 bp, Homo sapiens
cacatacaaggcacactggagg

SEQ ID NO: 7388872 - DNA, 22 bp, Homo sapiens
cacatacaaggcacactggagg

SEQ ID NO: 7388873 - DNA, 22 bp, Homo sapiens
cacatacaaggcacactggagg

SEQ ID NO: 7388874 - DNA, 22 bp, Homo sapiens
cacatacaaggcacactggagg

SEQ ID NO: 7388875 - DNA, 22 bp, Homo sapiens
cacataatacatgttccactta

SEQ ID NO: 7388876 - DNA, 22 bp, Homo sapiens
cacataatacatgttccactta

SEQ ID NO: 7388877 - DNA, 22 bp, Homo sapiens
cacataataaatgttcctgatg

SEQ ID NO: 7388878 - DNA, 22 bp, Homo sapiens
cacataataaatgttcctgatg

SEQ ID NO: 7388879 - DNA, 22 bp, Homo sapiens
cacataatcaccaagtcctttc

SEQ ID NO: 7388880 - DNA, 22 bp, Homo sapiens
cacatacaagccatggggggat

SEQ ID NO: 7388881 - DNA, 22 bp, Homo sapiens
cacatacaagccatggggggat

SEQ ID NO: 7388882 - DNA, 22 bp, Homo sapiens
cacataattgaacgtgatgagt

SEQ ID NO: 7388883 - DNA, 22 bp, Homo sapiens
cacatacaagccatggggggat

SEQ ID NO: 7388884 - DNA, 22 bp, Homo sapiens
cacatacttgtgtgtacatatg

SEQ ID NO: 7388885 - DNA, 22 bp, Homo sapiens
cacatacattcatgttactcta

SEQ ID NO: 7388886 - DNA, 22 bp, Homo sapiens
cacatacattcatgttactcta

SEQ ID NO: 7388887 - DNA, 22 bp, Homo sapiens
cacatacattcatgttactcta

SEQ ID NO: 7388888 - DNA, 22 bp, Homo sapiens
cacatacattcatgttactcta

SEQ ID NO: 7388889 - DNA, 22 bp, Homo sapiens
cacatacattcatgttactcta

SEQ ID NO: 7388890 - DNA, 22 bp, Homo sapiens
cacatacatgcacacctaaata

SEQ ID NO: 7388891 - DNA, 22 bp, Homo sapiens
cacatacatgcacacctaaata

SEQ ID NO: 7388892 - DNA, 22 bp, Homo sapiens
cacatacatgcacacctaaata

SEQ ID NO: 7388893 - DNA, 22 bp, Homo sapiens
cacatacatgcacacctaaata

SEQ ID NO: 7388894 - DNA, 22 bp, Homo sapiens
cacatacatacgtatgtataca

SEQ ID NO: 7388895 - DNA, 22 bp, Homo sapiens
cacatacatgcacacctaaata

SEQ ID NO: 7388896 - DNA, 22 bp, Homo sapiens
cacatacatgcacacctaaata

SEQ ID NO: 7388897 - DNA, 22 bp, Homo sapiens
cacatacatgcacacctaaata

SEQ ID NO: 7388898 - DNA, 22 bp, Homo sapiens
cacatacatgcacacctaaata

SEQ ID NO: 7388899 - DNA, 22 bp, Homo sapiens
cacatacattcatgttactcta

SEQ ID NO: 7388900 - DNA, 22 bp, Homo sapiens
cacatacattcatgttactcta

SEQ ID NO: 7388901 - DNA, 22 bp, Homo sapiens
cacatacatgcacacctaaata

SEQ ID NO: 7388902 - DNA, 22 bp, Homo sapiens
cacatacatgcacacctaaata

SEQ ID NO: 7388903 - DNA, 22 bp, Homo sapiens
cacatacatgcacacctaaata

SEQ ID NO: 7388904 - DNA, 22 bp, Homo sapiens
cacatacatgcacacctaaata

SEQ ID NO: 7388905 - DNA, 19 bp, Homo sapiens
cacatacagaaaagagtaa

SEQ ID NO: 7388906 - DNA, 19 bp, Homo sapiens
cacatacagaaaagagtaa

SEQ ID NO: 7388907 - DNA, 19 bp, Homo sapiens
cacatacagaaaagagtaa

SEQ ID NO: 7388908 - DNA, 19 bp, Homo sapiens
cacatacagaaaagagtaa

SEQ ID NO: 7388909 - DNA, 22 bp, Homo sapiens
cacatacaatggtgttatttgg

SEQ ID NO: 7388910 - DNA, 22 bp, Homo sapiens
cacatacaatggtgttatttgg

SEQ ID NO: 7388911 - DNA, 22 bp, Homo sapiens
cacatacaatggtgttatttgg

SEQ ID NO: 7388912 - DNA, 19 bp, Homo sapiens
cacatacagaaaagagtaa

SEQ ID NO: 7388913 - DNA, 19 bp, Homo sapiens
cacatacagaaaagagtaa

SEQ ID NO: 7388914 - DNA, 22 bp, Homo sapiens
cacatacatacgtatgtataca

SEQ ID NO: 7388915 - DNA, 22 bp, Homo sapiens
cacatacatacgtatgtataca

SEQ ID NO: 7388916 - DNA, 22 bp, Homo sapiens
cacatacatacgtatgtataca

SEQ ID NO: 7388917 - DNA, 19 bp, Homo sapiens
cacatacagaaaagagtaa

SEQ ID NO: 7388918 - DNA, 22 bp, Homo sapiens
cacatacatacgtatgtataca

SEQ ID NO: 7388919 - DNA, 22 bp, Homo sapiens
cacatacatacgtatgtataca

SEQ ID NO: 7388920 - DNA, 19 bp, Homo sapiens
cacatacagaaaagagtaa

SEQ ID NO: 7388921 - DNA, 22 bp, Homo sapiens
cacatacatacgtatgtataca

SEQ ID NO: 7388922 - DNA, 22 bp, Homo sapiens
cacatacatacgtatgtataca

SEQ ID NO: 7388923 - DNA, 22 bp, Homo sapiens
cacatacatacgtatgtataca

SEQ ID NO: 7388924 - DNA, 22 bp, Homo sapiens
cacatacatacgtatgtataca

SEQ ID NO: 7388925 - DNA, 22 bp, Homo sapiens
cacatacatacgtatgtataca

SEQ ID NO: 7388926 - DNA, 22 bp, Homo sapiens
cacatacatacgtatgtataca

SEQ ID NO: 7388927 - DNA, 22 bp, Homo sapiens
cacatacatacgtatgtataca

SEQ ID NO: 7388928 - DNA, 22 bp, Homo sapiens
cacatacatacgtatgtataca

SEQ ID NO: 7388929 - DNA, 22 bp, Homo sapiens
ggctccagggtacccctggatg

SEQ ID NO: 7388930 - DNA, 22 bp, Homo sapiens
ggctccagggtacccctggatg

SEQ ID NO: 7388931 - DNA, 22 bp, Homo sapiens
ggctccagggtacccctggatg

SEQ ID NO: 7388932 - DNA, 22 bp, Homo sapiens
ggctccagggtacccctggatg

SEQ ID NO: 7388933 - DNA, 22 bp, Homo sapiens
ggctccagggtacccctggatg

SEQ ID NO: 7388934 - DNA, 22 bp, Homo sapiens
ggctccagggtacccctggatg

SEQ ID NO: 7388935 - DNA, 22 bp, Homo sapiens
ggctccagggtacccctggatg

SEQ ID NO: 7388936 - DNA, 22 bp, Homo sapiens
ggctccagggtacccctggatg

SEQ ID NO: 7388937 - DNA, 22 bp, Homo sapiens
ggctcaggtttaaagtgcttta

SEQ ID NO: 7388938 - DNA, 22 bp, Homo sapiens
ggctcaggtttaaagtgcttta

SEQ ID NO: 7388939 - DNA, 22 bp, Homo sapiens
ggctcaggttgggtcacatgac

SEQ ID NO: 7388940 - DNA, 22 bp, Homo sapiens
ggctcaggttgggtcacatgac

SEQ ID NO: 7388941 - DNA, 22 bp, Homo sapiens
ggctcaggttaccagtccctcc

SEQ ID NO: 7388942 - DNA, 22 bp, Homo sapiens
ggctcaggttaccagtccctcc

SEQ ID NO: 7388943 - DNA, 22 bp, Homo sapiens
ggctcaggttaccagtccctcc

SEQ ID NO: 7388944 - DNA, 22 bp, Homo sapiens
ggctcaggttaccagtccctcc

SEQ ID NO: 7388945 - DNA, 22 bp, Homo sapiens
ggctcaggttaccagtccctcc

SEQ ID NO: 7388946 - DNA, 22 bp, Homo sapiens
ggctcaggttaccagtccctcc

SEQ ID NO: 7388947 - DNA, 22 bp, Homo sapiens
ggctcaggttgggtcacatgac

SEQ ID NO: 7388948 - DNA, 22 bp, Homo sapiens
ggctcaggttgggtcacatgac

SEQ ID NO: 7388949 - DNA, 22 bp, Homo sapiens
ggctcaggttgggtcacatgac

SEQ ID NO: 7388950 - DNA, 22 bp, Homo sapiens
ggctcaggttgggtcacatgac

SEQ ID NO: 7388951 - DNA, 22 bp, Homo sapiens
ggctccaggtgcatgccaggct

SEQ ID NO: 7388952 - DNA, 22 bp, Homo sapiens
ggctccaggtgcatgccaggct

SEQ ID NO: 7388953 - DNA, 22 bp, Homo sapiens
ggctccaggtgcatgccaggct

SEQ ID NO: 7388954 - DNA, 22 bp, Homo sapiens
ggctccaggtgcatgccaggct

SEQ ID NO: 7388955 - DNA, 22 bp, Homo sapiens
ggctccaggtgcatgccaggct

SEQ ID NO: 7388956 - DNA, 22 bp, Homo sapiens
ggctccaggtgcatgccaggct

SEQ ID NO: 7388957 - DNA, 22 bp, Homo sapiens
ggctccaggtacgtatgggagg

SEQ ID NO: 7388958 - DNA, 22 bp, Homo sapiens
ggctccaggtacgtatgggagg

SEQ ID NO: 7388959 - DNA, 22 bp, Homo sapiens
ggctccaggtacgtatgggagg

SEQ ID NO: 7388960 - DNA, 22 bp, Homo sapiens
ggctccaggtacgtatgggagg

SEQ ID NO: 7388961 - DNA, 22 bp, Homo sapiens
ggctccagggtctctccttgtg

SEQ ID NO: 7388962 - DNA, 22 bp, Homo sapiens
ggctccagggtctctccttgtg

SEQ ID NO: 7388963 - DNA, 22 bp, Homo sapiens
ggctccagggtctctccttgtg

SEQ ID NO: 7388964 - DNA, 22 bp, Homo sapiens
ggctccagggtctctccttgtg

SEQ ID NO: 7388965 - DNA, 22 bp, Homo sapiens
ggctccagggtctctccttgtg

SEQ ID NO: 7388966 - DNA, 22 bp, Homo sapiens
ggctccagggtctctccttgtg

SEQ ID NO: 7388967 - DNA, 22 bp, Homo sapiens
ggctccagggtctctccttgtg

SEQ ID NO: 7388968 - DNA, 22 bp, Homo sapiens
ggctccagggtctctccttgtg

SEQ ID NO: 7388969 - DNA, 22 bp, Homo sapiens
ggctccagggtacccctggatg

SEQ ID NO: 7388970 - DNA, 22 bp, Homo sapiens
ggctcaggttgggtcacatgac

SEQ ID NO: 7388971 - DNA, 22 bp, Homo sapiens
ggctctggtgagggtaggagat

SEQ ID NO: 7388972 - DNA, 22 bp, Homo sapiens
ggctctggtcagtgaggggcct

SEQ ID NO: 7388973 - DNA, 22 bp, Homo sapiens
ggctctggtcagtgaggggcct

SEQ ID NO: 7388974 - DNA, 22 bp, Homo sapiens
ggctctggtcagtgaggggcct

SEQ ID NO: 7388975 - DNA, 22 bp, Homo sapiens
ggctctggtcagtgaggggcct

SEQ ID NO: 7388976 - DNA, 22 bp, Homo sapiens
ggctctggtcagtgaggggcct

SEQ ID NO: 7388977 - DNA, 22 bp, Homo sapiens
ggctctgggttctgcaatgcgt

SEQ ID NO: 7388978 - DNA, 22 bp, Homo sapiens
ggctctggtcagtgaggggcct

SEQ ID NO: 7388979 - DNA, 22 bp, Homo sapiens
ggctctgggttctgcaatgcgt

SEQ ID NO: 7388980 - DNA, 20 bp, Homo sapiens
ggctctggaatctggtgggc

SEQ ID NO: 7388981 - DNA, 20 bp, Homo sapiens
ggctctggaatctggtgggc

SEQ ID NO: 7388982 - DNA, 22 bp, Homo sapiens
ggctctggaatgtgtagtcagg

SEQ ID NO: 7388983 - DNA, 22 bp, Homo sapiens
ggctctggaatgtgtagtcagg

SEQ ID NO: 7388984 - DNA, 22 bp, Homo sapiens
ggctctggaatgtgtagtcagg

SEQ ID NO: 7388985 - DNA, 22 bp, Homo sapiens
ggctctggaatgtgtagtcagg

SEQ ID NO: 7388986 - DNA, 22 bp, Homo sapiens
ggctctggaatgtgtagtcagg

SEQ ID NO: 7388987 - DNA, 22 bp, Homo sapiens
ggctctggtcagtgaggggcct

SEQ ID NO: 7388988 - DNA, 22 bp, Homo sapiens
ggctccaggtttaagggtatgt

SEQ ID NO: 7388989 - DNA, 18 bp, Homo sapiens
ggctccagtcttcagtgg

SEQ ID NO: 7388990 - DNA, 18 bp, Homo sapiens
ggctccagtcttcagtgg

SEQ ID NO: 7388991 - DNA, 18 bp, Homo sapiens
ggctccagtcttcagtgg

SEQ ID NO: 7388992 - DNA, 18 bp, Homo sapiens
ggctccagtcttcagtgg

SEQ ID NO: 7388993 - DNA, 22 bp, Homo sapiens
ggctccagtttccccttggggc

SEQ ID NO: 7388994 - DNA, 18 bp, Homo sapiens
ggctccagtcttcagtgg

SEQ ID NO: 7388995 - DNA, 22 bp, Homo sapiens
ggctccagtttccccttggggc

SEQ ID NO: 7388996 - DNA, 22 bp, Homo sapiens
ggctccagtttccccttggggc

SEQ ID NO: 7388997 - DNA, 22 bp, Homo sapiens
ggctccagtttccccttggggc

SEQ ID NO: 7388998 - DNA, 22 bp, Homo sapiens
ggctccagtttccccttggggc

SEQ ID NO: 7388999 - DNA, 22 bp, Homo sapiens
ggctccaggtgcatgccaggct

SEQ ID NO: 7389000 - DNA, 22 bp, Homo sapiens
ggctccaggtgcatgccaggct

SEQ ID NO: 7389001 - DNA, 22 bp, Homo sapiens
ggctccaggtttaagggtatgt

SEQ ID NO: 7389002 - DNA, 22 bp, Homo sapiens
ggctccaggtttaagggtatgt

SEQ ID NO: 7389003 - DNA, 22 bp, Homo sapiens
ggctccaggtttaagggtatgt

SEQ ID NO: 7389004 - DNA, 22 bp, Homo sapiens
ggctccaggtgcatgccaggct

SEQ ID NO: 7389005 - DNA, 22 bp, Homo sapiens
ggctccaggtgcatgccaggct

SEQ ID NO: 7389006 - DNA, 22 bp, Homo sapiens
ggctccaggtgcatgccaggct

SEQ ID NO: 7389007 - DNA, 22 bp, Homo sapiens
ggctgagcgtggctgccgtggg

SEQ ID NO: 7389008 - DNA, 22 bp, Homo sapiens
ggctgagcgtggctgccgtggg

SEQ ID NO: 7389009 - DNA, 19 bp, Homo sapiens
ggctgagcgccttggctgc

SEQ ID NO: 7389010 - DNA, 22 bp, Homo sapiens
ggctgagctcaggggcagcagg

SEQ ID NO: 7389011 - DNA, 22 bp, Homo sapiens
ggctgagctcaggggcagcagg

SEQ ID NO: 7389012 - DNA, 22 bp, Homo sapiens
ggctgagcgtggctgccgtggg

SEQ ID NO: 7389013 - DNA, 22 bp, Homo sapiens
ggctgagctcaggggcagcagg

SEQ ID NO: 7389014 - DNA, 19 bp, Homo sapiens
ggctgagcgccttggctgc

SEQ ID NO: 7389015 - DNA, 19 bp, Homo sapiens
ggctgagcgccttggctgc

SEQ ID NO: 7389016 - DNA, 19 bp, Homo sapiens
ggctgagcgccttggctgc

SEQ ID NO: 7389017 - DNA, 19 bp, Homo sapiens
ggctgagcgccttggctgc

SEQ ID NO: 7389018 - DNA, 22 bp, Homo sapiens
ggctgagcctggagcatctggt

SEQ ID NO: 7389019 - DNA, 22 bp, Homo sapiens
ggctgagcctggagcatctggt

SEQ ID NO: 7389020 - DNA, 22 bp, Homo sapiens
ggctgagcctggagcatctggt

SEQ ID NO: 7389021 - DNA, 22 bp, Homo sapiens
ggctgagcctggagcatctggt

SEQ ID NO: 7389022 - DNA, 22 bp, Homo sapiens
ggctgagccccctctgcgtagg

SEQ ID NO: 7389023 - DNA, 22 bp, Homo sapiens
ggctgagcctggagcatctggt

SEQ ID NO: 7389024 - DNA, 22 bp, Homo sapiens
ggctgaggcggcgatgcccttg

SEQ ID NO: 7389025 - DNA, 22 bp, Homo sapiens
ggctgaggcggcgatgcccttg

SEQ ID NO: 7389026 - DNA, 22 bp, Homo sapiens
ggctgaggcggcgatgcccttg

SEQ ID NO: 7389027 - DNA, 22 bp, Homo sapiens
ggctgaggcggcgatgcccttg

SEQ ID NO: 7389028 - DNA, 22 bp, Homo sapiens
ggctgaggcggcgatgcccttg

SEQ ID NO: 7389029 - DNA, 22 bp, Homo sapiens
ggctgaggcggcgatgcccttg

SEQ ID NO: 7389030 - DNA, 22 bp, Homo sapiens
ggctgaggcggcgatgcccttg

SEQ ID NO: 7389031 - DNA, 22 bp, Homo sapiens
ggctgaggcggcgatgcccttg

SEQ ID NO: 7389032 - DNA, 22 bp, Homo sapiens
ggctgaggctcatgccatcttg

SEQ ID NO: 7389033 - DNA, 22 bp, Homo sapiens
cactttaactcacatttcagct

SEQ ID NO: 7389034 - DNA, 22 bp, Homo sapiens
ggctgaggcggcgatgcccttg

SEQ ID NO: 7389035 - DNA, 22 bp, Homo sapiens
ggctgagcttttcatgatggtt

SEQ ID NO: 7389036 - DNA, 22 bp, Homo sapiens
ggctgagcttatatatgtgctg

SEQ ID NO: 7389037 - DNA, 22 bp, Homo sapiens
ggctgagcttatatatgtgctg

SEQ ID NO: 7389038 - DNA, 22 bp, Homo sapiens
ggctgagcttatatatgtgctg

SEQ ID NO: 7389039 - DNA, 22 bp, Homo sapiens
ggctgagcttatatatgtgctg

SEQ ID NO: 7389040 - DNA, 22 bp, Homo sapiens
ggctctggtgccctggctccca

SEQ ID NO: 7389041 - DNA, 22 bp, Homo sapiens
ggctctggtgccctggctccca

SEQ ID NO: 7389042 - DNA, 22 bp, Homo sapiens
ggctctggtgccctggctccca

SEQ ID NO: 7389043 - DNA, 22 bp, Homo sapiens
ggctctggtggcaattgactgg

SEQ ID NO: 7389044 - DNA, 22 bp, Homo sapiens
ggctctggtggcaattgactgg

SEQ ID NO: 7389045 - DNA, 22 bp, Homo sapiens
ggctctggtggcaattgactgg

SEQ ID NO: 7389046 - DNA, 22 bp, Homo sapiens
ggctctggtgggaaggttagat

SEQ ID NO: 7389047 - DNA, 22 bp, Homo sapiens
ggctctggtgggaaggttagat

SEQ ID NO: 7389048 - DNA, 22 bp, Homo sapiens
ggctctggtgggaaggttagat

SEQ ID NO: 7389049 - DNA, 22 bp, Homo sapiens
ggctgagccccctctgcgtagg

SEQ ID NO: 7389050 - DNA, 22 bp, Homo sapiens
ggctgagccccctctgcgtagg

SEQ ID NO: 7389051 - DNA, 22 bp, Homo sapiens
ggctgagccccctctgcgtagg

SEQ ID NO: 7389052 - DNA, 22 bp, Homo sapiens
ggctgagccccctctgcgtagg

SEQ ID NO: 7389053 - DNA, 22 bp, Homo sapiens
ggctctggtgggaaggttagat

SEQ ID NO: 7389054 - DNA, 22 bp, Homo sapiens
ggctctggtgggaaggttagat

SEQ ID NO: 7389055 - DNA, 22 bp, Homo sapiens
ggctctggtgtgaagcagcctc

SEQ ID NO: 7389056 - DNA, 22 bp, Homo sapiens
ggctctggtgtgaagcagcctc

SEQ ID NO: 7389057 - DNA, 22 bp, Homo sapiens
ggctctggtgccctggctccca

SEQ ID NO: 7389058 - DNA, 22 bp, Homo sapiens
ggctctggtgccctggctccca

SEQ ID NO: 7389059 - DNA, 22 bp, Homo sapiens
ggctctggtgccctggctccca

SEQ ID NO: 7389060 - DNA, 22 bp, Homo sapiens
ggctctggtgccctggctccca

SEQ ID NO: 7389061 - DNA, 22 bp, Homo sapiens
ggctctggtgagggtaggagat

SEQ ID NO: 7389062 - DNA, 22 bp, Homo sapiens
ggctctggtgagggtaggagat

SEQ ID NO: 7389063 - DNA, 22 bp, Homo sapiens
ggctctggtgccctggctccca

SEQ ID NO: 7389064 - DNA, 22 bp, Homo sapiens
ggctctggtgagggtaggagat

SEQ ID NO: 7389065 - DNA, 22 bp, Homo sapiens
ggctctggtgagggtaggagat

SEQ ID NO: 7389066 - DNA, 22 bp, Homo sapiens
ggctctggtgagggtaggagat

SEQ ID NO: 7389067 - DNA, 22 bp, Homo sapiens
ggctctggtgagggtaggagat

SEQ ID NO: 7389068 - DNA, 22 bp, Homo sapiens
ggctctggtcagtgaggggcct

SEQ ID NO: 7389069 - DNA, 22 bp, Homo sapiens
ggctctggtgagggtaggagat

SEQ ID NO: 7389070 - DNA, 22 bp, Homo sapiens
ggctctggtgagggtaggagat

SEQ ID NO: 7389071 - DNA, 22 bp, Homo sapiens
ggctctggtgagggtaggagat

SEQ ID NO: 7389072 - DNA, 22 bp, Homo sapiens
ggctctggtgagggtaggagat

SEQ ID NO: 7389073 - DNA, 19 bp, Homo sapiens
ggcctgaggccacagatcc

SEQ ID NO: 7389074 - DNA, 19 bp, Homo sapiens
ggcctgaggccacagatcc

SEQ ID NO: 7389075 - DNA, 19 bp, Homo sapiens
ggcctgaggccacagatcc

SEQ ID NO: 7389076 - DNA, 19 bp, Homo sapiens
ggcctgaggccacagatcc

SEQ ID NO: 7389077 - DNA, 19 bp, Homo sapiens
ggcctgaggccacagatcc

SEQ ID NO: 7389078 - DNA, 22 bp, Homo sapiens
ggcctgaggcaatagtcagaca

SEQ ID NO: 7389079 - DNA, 22 bp, Homo sapiens
ggcctgaggcaatagtcagaca

SEQ ID NO: 7389080 - DNA, 22 bp, Homo sapiens
ggcctgaggcaatagtcagaca

SEQ ID NO: 7389081 - DNA, 22 bp, Homo sapiens
ggcctgagcttgggcagcgtat

SEQ ID NO: 7389082 - DNA, 22 bp, Homo sapiens
ggcctgagcttgggcagcgtat

SEQ ID NO: 7389083 - DNA, 22 bp, Homo sapiens
ggcctgagcttgggcagcgtat

SEQ ID NO: 7389084 - DNA, 22 bp, Homo sapiens
ggcctgaggcaatagtcagaca

SEQ ID NO: 7389085 - DNA, 18 bp, Homo sapiens
ggcctgaggatttcagca

SEQ ID NO: 7389086 - DNA, 18 bp, Homo sapiens
ggcctgaggatttcagca

SEQ ID NO: 7389087 - DNA, 18 bp, Homo sapiens
ggcctgaggatttcagca

SEQ ID NO: 7389088 - DNA, 22 bp, Homo sapiens
ggcctgagcttgggcagcgtat

SEQ ID NO: 7389089 - DNA, 22 bp, Homo sapiens
ggcctgagctctggggaggcaa

SEQ ID NO: 7389090 - DNA, 22 bp, Homo sapiens
ggcctgagcttgggcagcgtat

SEQ ID NO: 7389091 - DNA, 22 bp, Homo sapiens
ggcctgagcttgggcagcgtat

SEQ ID NO: 7389092 - DNA, 22 bp, Homo sapiens
ggcctgagctctggggaggcaa

SEQ ID NO: 7389093 - DNA, 22 bp, Homo sapiens
ggcctgagctctggggaggcaa

SEQ ID NO: 7389094 - DNA, 22 bp, Homo sapiens
ggcctgagctctggggaggcaa

SEQ ID NO: 7389095 - DNA, 20 bp, Homo sapiens
ggcctgagcatggctggcag

SEQ ID NO: 7389096 - DNA, 20 bp, Homo sapiens
ggcctgagcatggctggcag

SEQ ID NO: 7389097 - DNA, 20 bp, Homo sapiens
ggcctgagcatggctggcag

SEQ ID NO: 7389098 - DNA, 20 bp, Homo sapiens
ggcctgagcatggctggcag

SEQ ID NO: 7389099 - DNA, 20 bp, Homo sapiens
ggcctgagcatggctggcag

SEQ ID NO: 7389100 - DNA, 22 bp, Homo sapiens
ggcctgagcagacagcatgatg

SEQ ID NO: 7389101 - DNA, 22 bp, Homo sapiens
ggcctgagcagacagcatgatg

SEQ ID NO: 7389102 - DNA, 22 bp, Homo sapiens
ggcctgagcagacagcatgatg

SEQ ID NO: 7389103 - DNA, 20 bp, Homo sapiens
ggcctgagcatggctggcag

SEQ ID NO: 7389104 - DNA, 20 bp, Homo sapiens
ggcctgagcatggctggcag

SEQ ID NO: 7389105 - DNA, 20 bp, Homo sapiens
ggcctgagcatggctggcag

SEQ ID NO: 7389106 - DNA, 22 bp, Homo sapiens
ggcctctctccctggcttgcag

SEQ ID NO: 7389107 - DNA, 21 bp, Homo sapiens
ggcctgagcacctgtccacct

SEQ ID NO: 7389108 - DNA, 22 bp, Homo sapiens
ggcctgagcagacagcatgatg

SEQ ID NO: 7389109 - DNA, 22 bp, Homo sapiens
ggcctgagcagacagcatgatg

SEQ ID NO: 7389110 - DNA, 22 bp, Homo sapiens
ggcctgagcagacagcatgatg

SEQ ID NO: 7389111 - DNA, 22 bp, Homo sapiens
ggcctgagcagacagcatgatg

SEQ ID NO: 7389112 - DNA, 22 bp, Homo sapiens
ggcctgaggccaccagcagccc

SEQ ID NO: 7389113 - DNA, 22 bp, Homo sapiens
ggcctgaggccaccagcagccc

SEQ ID NO: 7389114 - DNA, 22 bp, Homo sapiens
ggcctgaggccaccagcagccc

SEQ ID NO: 7389115 - DNA, 22 bp, Homo sapiens
ggcctgaggccaccagcagccc

SEQ ID NO: 7389116 - DNA, 22 bp, Homo sapiens
ggcctgaggccaccagcagccc

SEQ ID NO: 7389117 - DNA, 22 bp, Homo sapiens
ggcctgaggccaccagcagccc

SEQ ID NO: 7389118 - DNA, 22 bp, Homo sapiens
ggcctgaggccaccagcagccc

SEQ ID NO: 7389119 - DNA, 22 bp, Homo sapiens
ggcctgaggccaccagcagccc

SEQ ID NO: 7389120 - DNA, 19 bp, Homo sapiens
ggcctgaggccacagatcc

SEQ ID NO: 7389121 - DNA, 22 bp, Homo sapiens
ggcctgaggccaccagcagccc

SEQ ID NO: 7389122 - DNA, 22 bp, Homo sapiens
ggcctgaggcgtcccagctgtg

SEQ ID NO: 7389123 - DNA, 22 bp, Homo sapiens
ggcctgaggcgtcccagctgtg

SEQ ID NO: 7389124 - DNA, 22 bp, Homo sapiens
ggcctgaggcgtcccagctgtg

SEQ ID NO: 7389125 - DNA, 22 bp, Homo sapiens
ggcctgaggcgtcccagctgtg

SEQ ID NO: 7389126 - DNA, 22 bp, Homo sapiens
ggcctgaggcgtcccagctgtg

SEQ ID NO: 7389127 - DNA, 22 bp, Homo sapiens
ggcctgaggcgtcccagctgtg

SEQ ID NO: 7389128 - DNA, 22 bp, Homo sapiens
ggcctgggctccgggagttact

SEQ ID NO: 7389129 - DNA, 22 bp, Homo sapiens
ggcctgaggcgtcccagctgtg

SEQ ID NO: 7389130 - DNA, 22 bp, Homo sapiens
ggcctgggctccgggagttact

SEQ ID NO: 7389131 - DNA, 22 bp, Homo sapiens
ggcctgggctccgggagttact

SEQ ID NO: 7389132 - DNA, 22 bp, Homo sapiens
ggcctgtgagaatcaaggaaaa

SEQ ID NO: 7389133 - DNA, 22 bp, Homo sapiens
ggcctgtctcacccccgggtgc

SEQ ID NO: 7389134 - DNA, 22 bp, Homo sapiens
ggcctgtgcacatgtgcaggaa

SEQ ID NO: 7389135 - DNA, 22 bp, Homo sapiens
ggcctgtgcaagacagcacccc

SEQ ID NO: 7389136 - DNA, 22 bp, Homo sapiens
ggcctgtgcacatgtgcaggaa

SEQ ID NO: 7389137 - DNA, 22 bp, Homo sapiens
ggcctgtgagccttagtttata

SEQ ID NO: 7389138 - DNA, 22 bp, Homo sapiens
ggcctgtgcaagacagcacccc

SEQ ID NO: 7389139 - DNA, 22 bp, Homo sapiens
ggcctgtgagcccttgcatgta

SEQ ID NO: 7389140 - DNA, 22 bp, Homo sapiens
ggcctgtggtttctagtaggtt

SEQ ID NO: 7389141 - DNA, 22 bp, Homo sapiens
ggcctgtggtttctagtaggtt

SEQ ID NO: 7389142 - DNA, 22 bp, Homo sapiens
ggcctgtggtttctagtaggtt

SEQ ID NO: 7389143 - DNA, 22 bp, Homo sapiens
ggcctgtgggaggacagctggg

SEQ ID NO: 7389144 - DNA, 22 bp, Homo sapiens
ggcctgtgggaggacagctggg

SEQ ID NO: 7389145 - DNA, 22 bp, Homo sapiens
ggcctgtgggaggacagctggg

SEQ ID NO: 7389146 - DNA, 22 bp, Homo sapiens
ggcctgtgctgtcagccctagt

SEQ ID NO: 7389147 - DNA, 22 bp, Homo sapiens
ggcctgtgctgtcagccctagt

SEQ ID NO: 7389148 - DNA, 22 bp, Homo sapiens
ggcctgtgctgagaacctggct

SEQ ID NO: 7389149 - DNA, 22 bp, Homo sapiens
ggcctgtgctgagaacctggct

SEQ ID NO: 7389150 - DNA, 19 bp, Homo sapiens
ggcctgtgcagagcccgtc

SEQ ID NO: 7389151 - DNA, 19 bp, Homo sapiens
ggcctgtgcagagcccgtc

SEQ ID NO: 7389152 - DNA, 17 bp, Homo sapiens
ggcctgtgtggctgcag

SEQ ID NO: 7389153 - DNA, 22 bp, Homo sapiens
ggcctgtgtctgtgcctgtcct

SEQ ID NO: 7389154 - DNA, 17 bp, Homo sapiens
ggcctgtgtggctgcag

SEQ ID NO: 7389155 - DNA, 17 bp, Homo sapiens
ggcctgtgtggctgcag

SEQ ID NO: 7389156 - DNA, 17 bp, Homo sapiens
ggcctgtgtggctgcag

SEQ ID NO: 7389157 - DNA, 22 bp, Homo sapiens
ggctcaatgcaacttctgcctc

SEQ ID NO: 7389158 - DNA, 22 bp, Homo sapiens
ggctcaatgcaacttctgcctc

SEQ ID NO: 7389159 - DNA, 22 bp, Homo sapiens
ggcctgtgtctgtgcctgtcct

SEQ ID NO: 7389160 - DNA, 22 bp, Homo sapiens
ggcctgtgtctgtgcctgtcct

SEQ ID NO: 7389161 - DNA, 22 bp, Homo sapiens
ggcctgtgtcctccttgccctg

SEQ ID NO: 7389162 - DNA, 22 bp, Homo sapiens
ggcctgtgtcctccttgccctg

SEQ ID NO: 7389163 - DNA, 22 bp, Homo sapiens
ggctcagggaatgaggaagaat

SEQ ID NO: 7389164 - DNA, 22 bp, Homo sapiens
ggctcagggaatgaggaagaat

SEQ ID NO: 7389165 - DNA, 22 bp, Homo sapiens
ggctcaggctggagtgcagtgg

SEQ ID NO: 7389166 - DNA, 22 bp, Homo sapiens
ggctcaggctggagtgcagtgg

SEQ ID NO: 7389167 - DNA, 18 bp, Homo sapiens
ggctcaggctatcctaac

SEQ ID NO: 7389168 - DNA, 22 bp, Homo sapiens
ggctcaggctggagtgcagtgg

SEQ ID NO: 7389169 - DNA, 22 bp, Homo sapiens
ggctcaggctggagtgcagtgg

SEQ ID NO: 7389170 - DNA, 22 bp, Homo sapiens
ggctcaggctggagtgcagtgg

SEQ ID NO: 7389171 - DNA, 22 bp, Homo sapiens
ggctcaggcctgtaatcctagc

SEQ ID NO: 7389172 - DNA, 18 bp, Homo sapiens
ggctcaggctatcctaac

SEQ ID NO: 7389173 - DNA, 18 bp, Homo sapiens
ggctcaggctatcctaac

SEQ ID NO: 7389174 - DNA, 22 bp, Homo sapiens
ggctcaggctggagtgcagtgg

SEQ ID NO: 7389175 - DNA, 18 bp, Homo sapiens
ggctcaggctatcctaac

SEQ ID NO: 7389176 - DNA, 18 bp, Homo sapiens
ggctcaggctatcctaac

SEQ ID NO: 7389177 - DNA, 22 bp, Homo sapiens
ggctcacacatgactgggctct

SEQ ID NO: 7389178 - DNA, 22 bp, Homo sapiens
ggctcacacatgactgggctct

SEQ ID NO: 7389179 - DNA, 22 bp, Homo sapiens
ggctcacacatgactgggctct

SEQ ID NO: 7389180 - DNA, 22 bp, Homo sapiens
ggctcacaacagttttctgtaa

SEQ ID NO: 7389181 - DNA, 22 bp, Homo sapiens
ggctcacacatgactgggctct

SEQ ID NO: 7389182 - DNA, 22 bp, Homo sapiens
ggctcacacatgactgggctct

SEQ ID NO: 7389183 - DNA, 22 bp, Homo sapiens
ggctcagggaatgaggaagaat

SEQ ID NO: 7389184 - DNA, 22 bp, Homo sapiens
ggctcagggaatgaggaagaat

SEQ ID NO: 7389185 - DNA, 22 bp, Homo sapiens
ggctcagggaatgaggaagaat

SEQ ID NO: 7389186 - DNA, 22 bp, Homo sapiens
ggctcagggaatgaggaagaat

SEQ ID NO: 7389187 - DNA, 22 bp, Homo sapiens
ggctcagggaatgaggaagaat

SEQ ID NO: 7389188 - DNA, 19 bp, Homo sapiens
ggctcagggcgctgccgcc

SEQ ID NO: 7389189 - DNA, 19 bp, Homo sapiens
ggctcagggcgctgccgcc

SEQ ID NO: 7389190 - DNA, 19 bp, Homo sapiens
ggctcagggcgctgccgcc

SEQ ID NO: 7389191 - DNA, 22 bp, Homo sapiens
ggctcagggaatgaggaagaat

SEQ ID NO: 7389192 - DNA, 22 bp, Homo sapiens
ggctcaggggccaggcctgtcc

SEQ ID NO: 7389193 - DNA, 22 bp, Homo sapiens
ggctcaggggccaggcctgtcc

SEQ ID NO: 7389194 - DNA, 22 bp, Homo sapiens
ggctcaggggccaggcctgtcc

SEQ ID NO: 7389195 - DNA, 22 bp, Homo sapiens
ggctcaggggccaggcctgtcc

SEQ ID NO: 7389196 - DNA, 19 bp, Homo sapiens
ggctcagggcgctgccgcc

SEQ ID NO: 7389197 - DNA, 19 bp, Homo sapiens
ggctcagggcgctgccgcc

SEQ ID NO: 7389198 - DNA, 19 bp, Homo sapiens
ggctcagggcgctgccgcc

SEQ ID NO: 7389199 - DNA, 22 bp, Homo sapiens
ggctgccccagtgctcatggct

SEQ ID NO: 7389200 - DNA, 20 bp, Homo sapiens
ggctgcccactccagagtac

SEQ ID NO: 7389201 - DNA, 22 bp, Homo sapiens
ggctgccataacagagtaccac

SEQ ID NO: 7389202 - DNA, 20 bp, Homo sapiens
ggctgcccactccagagtac

SEQ ID NO: 7389203 - DNA, 20 bp, Homo sapiens
ggctgcccactccagagtac

SEQ ID NO: 7389204 - DNA, 22 bp, Homo sapiens
ggctgccataactgataccata

SEQ ID NO: 7389205 - DNA, 22 bp, Homo sapiens
ggctgccataactgataccata

SEQ ID NO: 7389206 - DNA, 22 bp, Homo sapiens
ggctgccataacagagtaccac

SEQ ID NO: 7389207 - DNA, 22 bp, Homo sapiens
ggctgccccatgggctgggctg

SEQ ID NO: 7389208 - DNA, 22 bp, Homo sapiens
ggctgccccatgggctgggctg

SEQ ID NO: 7389209 - DNA, 22 bp, Homo sapiens
ggctgccccatgggctgggctg

SEQ ID NO: 7389210 - DNA, 22 bp, Homo sapiens
ggctgccccagtgctcatggct

SEQ ID NO: 7389211 - DNA, 22 bp, Homo sapiens
ggctgccccagtgctcatggct

SEQ ID NO: 7389212 - DNA, 22 bp, Homo sapiens
ggctgccccagtgctcatggct

SEQ ID NO: 7389213 - DNA, 22 bp, Homo sapiens
ggctgccccagtgctcatggct

SEQ ID NO: 7389214 - DNA, 22 bp, Homo sapiens
ggctgccctagagctggcaagg

SEQ ID NO: 7389215 - DNA, 22 bp, Homo sapiens
ggctgccctagagctggcaagg

SEQ ID NO: 7389216 - DNA, 22 bp, Homo sapiens
ggctgccctagagctggcaagg

SEQ ID NO: 7389217 - DNA, 22 bp, Homo sapiens
ggctgccctagagctggcaagg

SEQ ID NO: 7389218 - DNA, 22 bp, Homo sapiens
ggctgccccatgggctgggctg

SEQ ID NO: 7389219 - DNA, 22 bp, Homo sapiens
ggctgccccatgggctgggctg

SEQ ID NO: 7389220 - DNA, 22 bp, Homo sapiens
ggctgccccatgggctgggctg

SEQ ID NO: 7389221 - DNA, 22 bp, Homo sapiens
cagaaaaggaagagctatgtaa

SEQ ID NO: 7389222 - DNA, 22 bp, Homo sapiens
cagaaaaggaagagctatgtaa

SEQ ID NO: 7389223 - DNA, 22 bp, Homo sapiens
cagaaaaggaagagctatgtaa

SEQ ID NO: 7389224 - DNA, 22 bp, Homo sapiens
cagaaaaggaagagctatgtaa

SEQ ID NO: 7389225 - DNA, 22 bp, Homo sapiens
cagaaaaggaagagctatgtaa

SEQ ID NO: 7389226 - DNA, 22 bp, Homo sapiens
cagaaaaggaagagctatgtaa

SEQ ID NO: 7389227 - DNA, 22 bp, Homo sapiens
cagaaaaggaagagctatgtaa

SEQ ID NO: 7389228 - DNA, 22 bp, Homo sapiens
cagaaaaggaagagctatgtaa

SEQ ID NO: 7389229 - DNA, 22 bp, Homo sapiens
cagaaaagggtgtttgttcagg

SEQ ID NO: 7389230 - DNA, 22 bp, Homo sapiens
cagaaaagggtgtttgttcagg

SEQ ID NO: 7389231 - DNA, 22 bp, Homo sapiens
cagaaaagggtgtttgttcagg

SEQ ID NO: 7389232 - DNA, 22 bp, Homo sapiens
cagaaaagggtgtttgttcagg

SEQ ID NO: 7389233 - DNA, 22 bp, Homo sapiens
cagaaaagggtgtttgttcagg

SEQ ID NO: 7389234 - DNA, 22 bp, Homo sapiens
cagaaaataaagtttctacgca

SEQ ID NO: 7389235 - DNA, 22 bp, Homo sapiens
cagaaaataaagtttctacgca

SEQ ID NO: 7389236 - DNA, 22 bp, Homo sapiens
cagaaaataaacatttgtggaa

SEQ ID NO: 7389237 - DNA, 22 bp, Homo sapiens
cagaaaataaagtttctacgca

SEQ ID NO: 7389238 - DNA, 22 bp, Homo sapiens
cagaaaataaagtttctacgca

SEQ ID NO: 7389239 - DNA, 22 bp, Homo sapiens
cagaaaataaagtttctacgca

SEQ ID NO: 7389240 - DNA, 22 bp, Homo sapiens
cagaaaataaacatttgtggaa

SEQ ID NO: 7389241 - DNA, 22 bp, Homo sapiens
cagaaaataaacatttgtggaa

SEQ ID NO: 7389242 - DNA, 22 bp, Homo sapiens
cagaaaataaacatttgtggaa

SEQ ID NO: 7389243 - DNA, 22 bp, Homo sapiens
cagaaaagggtgtttgttcagg

SEQ ID NO: 7389244 - DNA, 22 bp, Homo sapiens
cagaaaataaacatttgtggaa

SEQ ID NO: 7389245 - DNA, 21 bp, Homo sapiens
cactttaatggatatttgttt

SEQ ID NO: 7389246 - DNA, 21 bp, Homo sapiens
cactttaatggatatttgttt

SEQ ID NO: 7389247 - DNA, 21 bp, Homo sapiens
cactttaatggatatttgttt

SEQ ID NO: 7389248 - DNA, 22 bp, Homo sapiens
cactttaactcacatttcagct

SEQ ID NO: 7389249 - DNA, 22 bp, Homo sapiens
cactttggatgccactggtcta

SEQ ID NO: 7389250 - DNA, 22 bp, Homo sapiens
cactttacccttgttactcatg

SEQ ID NO: 7389251 - DNA, 22 bp, Homo sapiens
cactttgggtttatgtcaatca

SEQ ID NO: 7389252 - DNA, 22 bp, Homo sapiens
cactttggggtatgacaagttt

SEQ ID NO: 7389253 - DNA, 22 bp, Homo sapiens
cactttggggtatgacaagttt

SEQ ID NO: 7389254 - DNA, 22 bp, Homo sapiens
cactttggttcacctgagtttc

SEQ ID NO: 7389255 - DNA, 22 bp, Homo sapiens
cactttggtagctgttttggga

SEQ ID NO: 7389256 - DNA, 22 bp, Homo sapiens
cactttggtagctgttttggga

SEQ ID NO: 7389257 - DNA, 17 bp, Homo sapiens
cactttgttgctgtggg

SEQ ID NO: 7389258 - DNA, 22 bp, Homo sapiens
cactttgtttattgtgcagtta

SEQ ID NO: 7389259 - DNA, 22 bp, Homo sapiens
cacttttaaatgggtccgtgtt

SEQ ID NO: 7389260 - DNA, 22 bp, Homo sapiens
cacttttaaatgggtccgtgtt

SEQ ID NO: 7389261 - DNA, 22 bp, Homo sapiens
cacttttaacaggagaattccc

SEQ ID NO: 7389262 - DNA, 22 bp, Homo sapiens
cacttttaacaggagaattccc

SEQ ID NO: 7389263 - DNA, 22 bp, Homo sapiens
cacttttaacaggagaattccc

SEQ ID NO: 7389264 - DNA, 23 bp, Homo sapiens
cagaaaacccagagctcagtccc

SEQ ID NO: 7389265 - DNA, 22 bp, Homo sapiens
cagaaaacaaacctatcctgag

SEQ ID NO: 7389266 - DNA, 22 bp, Homo sapiens
cagaaaacaaacctatcctgag

SEQ ID NO: 7389267 - DNA, 22 bp, Homo sapiens
cagaaaacaaacctatcctgag

SEQ ID NO: 7389268 - DNA, 22 bp, Homo sapiens
cagaaaacaaacctatcctgag

SEQ ID NO: 7389269 - DNA, 22 bp, Homo sapiens
cagaaaacaaacctatcctgag

SEQ ID NO: 7389270 - DNA, 22 bp, Homo sapiens
cacttttaacaggagaattccc

SEQ ID NO: 7389271 - DNA, 22 bp, Homo sapiens
cacttttaacaggagaattccc

SEQ ID NO: 7389272 - DNA, 22 bp, Homo sapiens
cagaaaacctgactctagaact

SEQ ID NO: 7389273 - DNA, 22 bp, Homo sapiens
cagaaaacctgactctagaact

SEQ ID NO: 7389274 - DNA, 22 bp, Homo sapiens
cagaaaacctgactctagaact

SEQ ID NO: 7389275 - DNA, 22 bp, Homo sapiens
cagaaaacctgactctagaact

SEQ ID NO: 7389276 - DNA, 22 bp, Homo sapiens
cagaaaacctgactctagaact

SEQ ID NO: 7389277 - DNA, 22 bp, Homo sapiens
cagaaaacctgactctagaact

SEQ ID NO: 7389278 - DNA, 22 bp, Homo sapiens
cagaaaacctgactctagaact

SEQ ID NO: 7389279 - DNA, 22 bp, Homo sapiens
cagaaaacctgactctagaact

SEQ ID NO: 7389280 - DNA, 23 bp, Homo sapiens
cagaaaacccagagctcagtccc

SEQ ID NO: 7389281 - DNA, 23 bp, Homo sapiens
cagaaaacccagagctcagtccc

SEQ ID NO: 7389282 - DNA, 22 bp, Homo sapiens
ggctgcctaacccttaagtgtc

SEQ ID NO: 7389283 - DNA, 22 bp, Homo sapiens
ggctgcctaacccttaagtgtc

SEQ ID NO: 7389284 - DNA, 22 bp, Homo sapiens
ggctgcctaacccttaagtgtc

SEQ ID NO: 7389285 - DNA, 22 bp, Homo sapiens
ggctgcctactttcccagagtt

SEQ ID NO: 7389286 - DNA, 22 bp, Homo sapiens
ggctgcctactttcccagagtt

SEQ ID NO: 7389287 - DNA, 22 bp, Homo sapiens
ggctgccctgggaggcaagggt

SEQ ID NO: 7389288 - DNA, 22 bp, Homo sapiens
ggctgccctgggaggcaagggt

SEQ ID NO: 7389289 - DNA, 22 bp, Homo sapiens
ggctgccctgggaggcaagggt

SEQ ID NO: 7389290 - DNA, 22 bp, Homo sapiens
ggctgccctcgtctactgccca

SEQ ID NO: 7389291 - DNA, 22 bp, Homo sapiens
ggctgccctctgctgactgcaa

SEQ ID NO: 7389292 - DNA, 22 bp, Homo sapiens
ggctgccctctgctgactgcaa

SEQ ID NO: 7389293 - DNA, 22 bp, Homo sapiens
ggctgccctctgctgactgcaa

SEQ ID NO: 7389294 - DNA, 22 bp, Homo sapiens
ggctgccctcggggtcgcaggc

SEQ ID NO: 7389295 - DNA, 22 bp, Homo sapiens
ggctgccctcgtctactgccca

SEQ ID NO: 7389296 - DNA, 22 bp, Homo sapiens
ggctgccctcgtctactgccca

SEQ ID NO: 7389297 - DNA, 22 bp, Homo sapiens
ggctgccctcgtctactgccca

SEQ ID NO: 7389298 - DNA, 22 bp, Homo sapiens
ggctgccctcggggtcgcaggc

SEQ ID NO: 7389299 - DNA, 22 bp, Homo sapiens
ggctgccctcggggtcgcaggc

SEQ ID NO: 7389300 - DNA, 22 bp, Homo sapiens
ggctgccctcggggtcgcaggc

SEQ ID NO: 7389301 - DNA, 22 bp, Homo sapiens
ggctgccctcggggtcgcaggc

SEQ ID NO: 7389302 - DNA, 22 bp, Homo sapiens
ggctgccctcggggtcgcaggc

SEQ ID NO: 7389303 - DNA, 22 bp, Homo sapiens
ggctgccctcggggtcgcaggc

SEQ ID NO: 7389304 - DNA, 22 bp, Homo sapiens
ggctgcctagacttggaatttc

SEQ ID NO: 7389305 - DNA, 22 bp, Homo sapiens
ggctgcctagacttggaatttc

SEQ ID NO: 7389306 - DNA, 22 bp, Homo sapiens
ggctgcctatagaattattagt

SEQ ID NO: 7389307 - DNA, 22 bp, Homo sapiens
ggctgcctcaaagctcaagctc

SEQ ID NO: 7389308 - DNA, 22 bp, Homo sapiens
ggctgcctcaaagctcaagctc

SEQ ID NO: 7389309 - DNA, 22 bp, Homo sapiens
ggctgcctcaaagctcaagctc

SEQ ID NO: 7389310 - DNA, 22 bp, Homo sapiens
cagaaacaggcaacgtgtgcac

SEQ ID NO: 7389311 - DNA, 22 bp, Homo sapiens
ggctgcctagacttggaatttc

SEQ ID NO: 7389312 - DNA, 22 bp, Homo sapiens
ggctgcctactttcccagagtt

SEQ ID NO: 7389313 - DNA, 22 bp, Homo sapiens
ggctgcctactttcccagagtt

SEQ ID NO: 7389314 - DNA, 22 bp, Homo sapiens
ggctgcctactttcccagagtt

SEQ ID NO: 7389315 - DNA, 22 bp, Homo sapiens
cagaaagacctgggctcaagag

SEQ ID NO: 7389316 - DNA, 22 bp, Homo sapiens
cagaaagacctgggctcaagag

SEQ ID NO: 7389317 - DNA, 22 bp, Homo sapiens
cagaaacatgtataaagttgta

SEQ ID NO: 7389318 - DNA, 22 bp, Homo sapiens
cagaaacatgtataaagttgta

SEQ ID NO: 7389319 - DNA, 22 bp, Homo sapiens
cagaaacatgtataaagttgta

SEQ ID NO: 7389320 - DNA, 22 bp, Homo sapiens
cagaaacatgtataaagttgta

SEQ ID NO: 7389321 - DNA, 22 bp, Homo sapiens
cagaaacatgtataaagttgta

SEQ ID NO: 7389322 - DNA, 22 bp, Homo sapiens
cagaaacatgtataaagttgta

SEQ ID NO: 7389323 - DNA, 22 bp, Homo sapiens
cagaaacatgtataaagttgta

SEQ ID NO: 7389324 - DNA, 22 bp, Homo sapiens
cagaaacatgtataaagttgta

SEQ ID NO: 7389325 - DNA, 22 bp, Homo sapiens
cagaaacatgtataaagttgta

SEQ ID NO: 7389326 - DNA, 23 bp, Homo sapiens
cagaaagccctttccccacagta

SEQ ID NO: 7389327 - DNA, 22 bp, Homo sapiens
cagaaagccctatgtacagtgg

SEQ ID NO: 7389328 - DNA, 22 bp, Homo sapiens
cagaaagccctatgtacagtgg

SEQ ID NO: 7389329 - DNA, 23 bp, Homo sapiens
cagaaagccctttccccacagta

SEQ ID NO: 7389330 - DNA, 23 bp, Homo sapiens
cagaaagccctttccccacagta

SEQ ID NO: 7389331 - DNA, 22 bp, Homo sapiens
cagaaagccgacttacaatgga

SEQ ID NO: 7389332 - DNA, 22 bp, Homo sapiens
cagaaagccgacttacaatgga

SEQ ID NO: 7389333 - DNA, 23 bp, Homo sapiens
cagaaagccctttccccacagta

SEQ ID NO: 7389334 - DNA, 22 bp, Homo sapiens
cagaaagccgacttacaatgga

SEQ ID NO: 7389335 - DNA, 22 bp, Homo sapiens
cagaaagccgacttacaatgga

SEQ ID NO: 7389336 - DNA, 22 bp, Homo sapiens
cagaaagcgggatgcagcatgt

SEQ ID NO: 7389337 - DNA, 22 bp, Homo sapiens
cagaaagcgggatgcagcatgt

SEQ ID NO: 7389338 - DNA, 22 bp, Homo sapiens
cagaaagctctttcaatcttgc

SEQ ID NO: 7389339 - DNA, 22 bp, Homo sapiens
cagaaagcgggatgcagcatgt

SEQ ID NO: 7389340 - DNA, 22 bp, Homo sapiens
cagaaagcgggatgcagcatgt

SEQ ID NO: 7389341 - DNA, 22 bp, Homo sapiens
cagaaagcgggatgcagcatgt

SEQ ID NO: 7389342 - DNA, 22 bp, Homo sapiens
cagaaagccgacttacaatgga

SEQ ID NO: 7389343 - DNA, 22 bp, Homo sapiens
cagaaagccgacttacaatgga

SEQ ID NO: 7389344 - DNA, 22 bp, Homo sapiens
cagaaagccgacttacaatgga

SEQ ID NO: 7389345 - DNA, 22 bp, Homo sapiens
cagaaagcagagctgagccttt

SEQ ID NO: 7389346 - DNA, 22 bp, Homo sapiens
cagaaagcagttgtcaatgggc

SEQ ID NO: 7389347 - DNA, 22 bp, Homo sapiens
cagaaagcagagctgagccttt

SEQ ID NO: 7389348 - DNA, 22 bp, Homo sapiens
cagaaagcagagctgagccttt

SEQ ID NO: 7389349 - DNA, 22 bp, Homo sapiens
cagaaagcagagctgagccttt

SEQ ID NO: 7389350 - DNA, 22 bp, Homo sapiens
cagaaagcaagccattcactgt

SEQ ID NO: 7389351 - DNA, 22 bp, Homo sapiens
cagaaagcaagccattcactgt

SEQ ID NO: 7389352 - DNA, 22 bp, Homo sapiens
cagaaagcaagccattcactgt

SEQ ID NO: 7389353 - DNA, 22 bp, Homo sapiens
cagaaagccaactccaactgtc

SEQ ID NO: 7389354 - DNA, 22 bp, Homo sapiens
cagaaagccaactccaactgtc

SEQ ID NO: 7389355 - DNA, 22 bp, Homo sapiens
cagaaagccaactccaactgtc

SEQ ID NO: 7389356 - DNA, 22 bp, Homo sapiens
cagaaagccctatgtacagtgg

SEQ ID NO: 7389357 - DNA, 22 bp, Homo sapiens
cagaaagccctatgtacagtgg

SEQ ID NO: 7389358 - DNA, 22 bp, Homo sapiens
cagaaagccctatgtacagtgg

SEQ ID NO: 7389359 - DNA, 22 bp, Homo sapiens
cagaaagccctatgtacagtgg

SEQ ID NO: 7389360 - DNA, 22 bp, Homo sapiens
cagaaagccaactccaactgtc

SEQ ID NO: 7389361 - DNA, 20 bp, Homo sapiens
cagaaagcatgttccagggc

SEQ ID NO: 7389362 - DNA, 20 bp, Homo sapiens
cagaaagcatgttccagggc

SEQ ID NO: 7389363 - DNA, 22 bp, Homo sapiens
cagaaatagacaatggcagtgg

SEQ ID NO: 7389364 - DNA, 22 bp, Homo sapiens
cagaaatagacaatggcagtgg

SEQ ID NO: 7389365 - DNA, 22 bp, Homo sapiens
cagaaatagacaatggcagtgg

SEQ ID NO: 7389366 - DNA, 22 bp, Homo sapiens
cagaaatacccagcatttggag

SEQ ID NO: 7389367 - DNA, 22 bp, Homo sapiens
cagaaatacccagcatttggag

SEQ ID NO: 7389368 - DNA, 22 bp, Homo sapiens
ggctgggaggatgacttgctac

SEQ ID NO: 7389369 - DNA, 22 bp, Homo sapiens
ggctgggaggatgacttgctac

SEQ ID NO: 7389370 - DNA, 22 bp, Homo sapiens
ggctgggaggatgacttgctac

SEQ ID NO: 7389371 - DNA, 22 bp, Homo sapiens
cagaaataaagtggacagagta

SEQ ID NO: 7389372 - DNA, 22 bp, Homo sapiens
cagaaataaagtggacagagta

SEQ ID NO: 7389373 - DNA, 22 bp, Homo sapiens
cagaaataaagtggacagagta

SEQ ID NO: 7389374 - DNA, 22 bp, Homo sapiens
cagaaatacccagcatttggag

SEQ ID NO: 7389375 - DNA, 22 bp, Homo sapiens
cagaaatacccagcatttggag

SEQ ID NO: 7389376 - DNA, 22 bp, Homo sapiens
cagaaatacccagcatttggag

SEQ ID NO: 7389377 - DNA, 22 bp, Homo sapiens
cagaaataaagtggacagagta

SEQ ID NO: 7389378 - DNA, 22 bp, Homo sapiens
cagaaataaagtggacagagta

SEQ ID NO: 7389379 - DNA, 23 bp, Homo sapiens
cagaaataaactggtttgtagat

SEQ ID NO: 7389380 - DNA, 23 bp, Homo sapiens
cagaaataaactggtttgtagat

SEQ ID NO: 7389381 - DNA, 23 bp, Homo sapiens
cagaaataaactggtttgtagat

SEQ ID NO: 7389382 - DNA, 23 bp, Homo sapiens
cagaaataaactggtttgtagat

SEQ ID NO: 7389383 - DNA, 23 bp, Homo sapiens
cagaaataaactggtttgtagat

SEQ ID NO: 7389384 - DNA, 23 bp, Homo sapiens
cagaaataaactggtttgtagat

SEQ ID NO: 7389385 - DNA, 23 bp, Homo sapiens
cagaaataaactggtttgtagat

SEQ ID NO: 7389386 - DNA, 23 bp, Homo sapiens
cagaaataaactggtttgtagat

SEQ ID NO: 7389387 - DNA, 23 bp, Homo sapiens
cagaaataaactggtttgtagat

SEQ ID NO: 7389388 - DNA, 23 bp, Homo sapiens
cagaaataaactggtttgtagat

SEQ ID NO: 7389389 - DNA, 22 bp, Homo sapiens
cagaaataaacttctcacatcg

SEQ ID NO: 7389390 - DNA, 22 bp, Homo sapiens
cagaaataaacttctcacatcg

SEQ ID NO: 7389391 - DNA, 22 bp, Homo sapiens
cagaaataaacttctcacatcg

SEQ ID NO: 7389392 - DNA, 22 bp, Homo sapiens
cagaaataaacttctcacatcg

SEQ ID NO: 7389393 - DNA, 22 bp, Homo sapiens
cagaaataaacttctcacatcg

SEQ ID NO: 7389394 - DNA, 23 bp, Homo sapiens
cagaaataaactggtttgtagat

SEQ ID NO: 7389395 - DNA, 22 bp, Homo sapiens
cagaaataaacttctcacatcg

SEQ ID NO: 7389396 - DNA, 22 bp, Homo sapiens
cagaaataaacttctcacatcg

SEQ ID NO: 7389397 - DNA, 22 bp, Homo sapiens
cagaaataaacttctcacatcg

SEQ ID NO: 7389398 - DNA, 22 bp, Homo sapiens
cagaaataaacttctcacatcg

SEQ ID NO: 7389399 - DNA, 22 bp, Homo sapiens
cagaaataaacttctcacatcg

SEQ ID NO: 7389400 - DNA, 22 bp, Homo sapiens
cagaaaggacagagtgagggtg

SEQ ID NO: 7389401 - DNA, 22 bp, Homo sapiens
cagaaaggacagagtgagggtg

SEQ ID NO: 7389402 - DNA, 22 bp, Homo sapiens
cagaaagcttggtacaatatgc

SEQ ID NO: 7389403 - DNA, 22 bp, Homo sapiens
cagaaaggacagagtgagggtg

SEQ ID NO: 7389404 - DNA, 22 bp, Homo sapiens
cagaaaggacagagtgagggtg

SEQ ID NO: 7389405 - DNA, 22 bp, Homo sapiens
cagaaaggacagagtgagggtg

SEQ ID NO: 7389406 - DNA, 22 bp, Homo sapiens
cagaaaggacagagtgagggtg

SEQ ID NO: 7389407 - DNA, 22 bp, Homo sapiens
cagaaaggacagagtgagggtg

SEQ ID NO: 7389408 - DNA, 22 bp, Homo sapiens
cagaaaggacagagtgagggtg

SEQ ID NO: 7389409 - DNA, 22 bp, Homo sapiens
cagaaaggactttggttggctt

SEQ ID NO: 7389410 - DNA, 22 bp, Homo sapiens
cagaaaggactttggttggctt

SEQ ID NO: 7389411 - DNA, 22 bp, Homo sapiens
cagaaaggactttggttggctt

SEQ ID NO: 7389412 - DNA, 22 bp, Homo sapiens
cagaaaggactttggttggctt

SEQ ID NO: 7389413 - DNA, 22 bp, Homo sapiens
cagaaaggactttggttggctt

SEQ ID NO: 7389414 - DNA, 22 bp, Homo sapiens
cagaaaggactttggttggctt

SEQ ID NO: 7389415 - DNA, 22 bp, Homo sapiens
cagaaaggcacccactgggtct

SEQ ID NO: 7389416 - DNA, 22 bp, Homo sapiens
cagaaaggactttggttggctt

SEQ ID NO: 7389417 - DNA, 22 bp, Homo sapiens
cagaaagcttggtacaatatgc

SEQ ID NO: 7389418 - DNA, 22 bp, Homo sapiens
cagaaagcttaggcaagttgga

SEQ ID NO: 7389419 - DNA, 22 bp, Homo sapiens
cagaaagcttaggcaagttgga

SEQ ID NO: 7389420 - DNA, 22 bp, Homo sapiens
cagaaagcttggtacaatatgc

SEQ ID NO: 7389421 - DNA, 22 bp, Homo sapiens
cagaaagcttggtacaatatgc

SEQ ID NO: 7389422 - DNA, 22 bp, Homo sapiens
cagaaagcttggtacaatatgc

SEQ ID NO: 7389423 - DNA, 22 bp, Homo sapiens
cagaaagctctttcaatcttgc

SEQ ID NO: 7389424 - DNA, 22 bp, Homo sapiens
cagaaagctctttcaatcttgc

SEQ ID NO: 7389425 - DNA, 22 bp, Homo sapiens
cagaaagctctttcaatcttgc

SEQ ID NO: 7389426 - DNA, 22 bp, Homo sapiens
cagaaaggtatgtgtgcctttg

SEQ ID NO: 7389427 - DNA, 22 bp, Homo sapiens
cagaaaggtatgtgtgcctttg

SEQ ID NO: 7389428 - DNA, 22 bp, Homo sapiens
cagaaaggtatgtgtgcctttg

SEQ ID NO: 7389429 - DNA, 22 bp, Homo sapiens
cagaaaggcacccactgggtct

SEQ ID NO: 7389430 - DNA, 22 bp, Homo sapiens
cagaaaggcacccactgggtct

SEQ ID NO: 7389431 - DNA, 22 bp, Homo sapiens
cagaaaggcacccactgggtct

SEQ ID NO: 7389432 - DNA, 22 bp, Homo sapiens
cagaaagtgatttgctattcca

SEQ ID NO: 7389433 - DNA, 22 bp, Homo sapiens
cagaaagtgatttgctattcca

SEQ ID NO: 7389434 - DNA, 22 bp, Homo sapiens
cagaaagtgatttgctattcca

SEQ ID NO: 7389435 - DNA, 18 bp, Homo sapiens
cagaaagttatttactct

SEQ ID NO: 7389436 - DNA, 18 bp, Homo sapiens
cagaaagttatttactct

SEQ ID NO: 7389437 - DNA, 23 bp, Homo sapiens
cagaaagtttgagaagatacatc

SEQ ID NO: 7389438 - DNA, 18 bp, Homo sapiens
cagaaagttatttactct

SEQ ID NO: 7389439 - DNA, 18 bp, Homo sapiens
cagaaagttatttactct

SEQ ID NO: 7389440 - DNA, 18 bp, Homo sapiens
cagaaagttatttactct

SEQ ID NO: 7389441 - DNA, 18 bp, Homo sapiens
cagaaagttatttactct

SEQ ID NO: 7389442 - DNA, 23 bp, Homo sapiens
cagaaagtttgagaagatacatc

SEQ ID NO: 7389443 - DNA, 23 bp, Homo sapiens
cagaaagtttgagaagatacatc

SEQ ID NO: 7389444 - DNA, 23 bp, Homo sapiens
cagaaagtttgagaagatacatc

SEQ ID NO: 7389445 - DNA, 23 bp, Homo sapiens
cagaaagtttgagaagatacatc

SEQ ID NO: 7389446 - DNA, 23 bp, Homo sapiens
cagaaagtttgagaagatacatc

SEQ ID NO: 7389447 - DNA, 23 bp, Homo sapiens
cagaaagtttgagaagatacatc

SEQ ID NO: 7389448 - DNA, 22 bp, Homo sapiens
ggctgtcttgggagctcccccg

SEQ ID NO: 7389449 - DNA, 22 bp, Homo sapiens
ggctgtcttgggagctcccccg

SEQ ID NO: 7389450 - DNA, 22 bp, Homo sapiens
ggctgtctctgtgactgccacc

SEQ ID NO: 7389451 - DNA, 22 bp, Homo sapiens
ggctgtctctgtgactgccacc

SEQ ID NO: 7389452 - DNA, 22 bp, Homo sapiens
ggctgtctctgtgactgccacc

SEQ ID NO: 7389453 - DNA, 22 bp, Homo sapiens
ggctgtgaacactcttagcatc

SEQ ID NO: 7389454 - DNA, 22 bp, Homo sapiens
ggctgtgaacactcttagcatc

SEQ ID NO: 7389455 - DNA, 22 bp, Homo sapiens
ggctgtgaaccctggcagtgtg

SEQ ID NO: 7389456 - DNA, 22 bp, Homo sapiens
ggctgtgaaccctggcagtgtg

SEQ ID NO: 7389457 - DNA, 22 bp, Homo sapiens
ggctgtgaaccctggcagtgtg

SEQ ID NO: 7389458 - DNA, 22 bp, Homo sapiens
ggctgtgaaccctggcagtgtg

SEQ ID NO: 7389459 - DNA, 22 bp, Homo sapiens
ggctgtgaaccctggcagtgtg

SEQ ID NO: 7389460 - DNA, 22 bp, Homo sapiens
ggctgtgaagtagcaggggcag

SEQ ID NO: 7389461 - DNA, 22 bp, Homo sapiens
ggctgtgaagtagcaggggcag

SEQ ID NO: 7389462 - DNA, 22 bp, Homo sapiens
ggctgtgaagtagcaggggcag

SEQ ID NO: 7389463 - DNA, 22 bp, Homo sapiens
ggctgtgaagtagcaggggcag

SEQ ID NO: 7389464 - DNA, 22 bp, Homo sapiens
ggctgtgaagtagcaggggcag

SEQ ID NO: 7389465 - DNA, 22 bp, Homo sapiens
ggctgtttttatagagtccata

SEQ ID NO: 7389466 - DNA, 22 bp, Homo sapiens
ggctgtttttatagagtccata

SEQ ID NO: 7389467 - DNA, 22 bp, Homo sapiens
ggctgtgtttctgtttgacatt

SEQ ID NO: 7389468 - DNA, 22 bp, Homo sapiens
ggctgtgtttctgtttgacatt

SEQ ID NO: 7389469 - DNA, 22 bp, Homo sapiens
ggctgtgttccaagtgtcagga

SEQ ID NO: 7389470 - DNA, 22 bp, Homo sapiens
ggctgtgttccaagtgtcagga

SEQ ID NO: 7389471 - DNA, 22 bp, Homo sapiens
ggctgttcctctgagagctgat

SEQ ID NO: 7389472 - DNA, 22 bp, Homo sapiens
ggctgttcctctgagagctgat

SEQ ID NO: 7389473 - DNA, 17 bp, Homo sapiens
ggctgtttttaggctgt

SEQ ID NO: 7389474 - DNA, 22 bp, Homo sapiens
ggctgttgacagacataggttt

SEQ ID NO: 7389475 - DNA, 22 bp, Homo sapiens
ggctggtgttgagtgcctgtag

SEQ ID NO: 7389476 - DNA, 22 bp, Homo sapiens
ggctggtgttgagtgcctgtag

SEQ ID NO: 7389477 - DNA, 22 bp, Homo sapiens
ggctggtgttgagtgcctgtag

SEQ ID NO: 7389478 - DNA, 22 bp, Homo sapiens
ggctggtgttgagtgcctgtag

SEQ ID NO: 7389479 - DNA, 22 bp, Homo sapiens
ggctggtgttacagtcggcagc

SEQ ID NO: 7389480 - DNA, 22 bp, Homo sapiens
ggctggtgttacagtcggcagc

SEQ ID NO: 7389481 - DNA, 22 bp, Homo sapiens
ggctggtgttacagtcggcagc

SEQ ID NO: 7389482 - DNA, 22 bp, Homo sapiens
ggctggtgttacagtcggcagc

SEQ ID NO: 7389483 - DNA, 22 bp, Homo sapiens
ggctggtgttacagtcggcagc

SEQ ID NO: 7389484 - DNA, 22 bp, Homo sapiens
ggctggtgttacagtcggcagc

SEQ ID NO: 7389485 - DNA, 22 bp, Homo sapiens
ggctggtgttacagtcggcagc

SEQ ID NO: 7389486 - DNA, 22 bp, Homo sapiens
ggctggtgttacagtcggcagc

SEQ ID NO: 7389487 - DNA, 21 bp, Homo sapiens
ggctggtgtttagctgtgata

SEQ ID NO: 7389488 - DNA, 21 bp, Homo sapiens
ggctggtgtttagctgtgata

SEQ ID NO: 7389489 - DNA, 21 bp, Homo sapiens
ggctggtgtttagctgtgata

SEQ ID NO: 7389490 - DNA, 22 bp, Homo sapiens
ggctggttttcagttactgagt

SEQ ID NO: 7389491 - DNA, 22 bp, Homo sapiens
ggctggttcagctagtgctgtt

SEQ ID NO: 7389492 - DNA, 22 bp, Homo sapiens
ggctggtttgacaaactgacaa

SEQ ID NO: 7389493 - DNA, 22 bp, Homo sapiens
ggctggtttgacaaactgacaa

SEQ ID NO: 7389494 - DNA, 21 bp, Homo sapiens
ggctggtgtttagctgtgata

SEQ ID NO: 7389495 - DNA, 21 bp, Homo sapiens
ggctggtgtttagctgtgata

SEQ ID NO: 7389496 - DNA, 21 bp, Homo sapiens
ggctggtgtttagctgtgata

SEQ ID NO: 7389497 - DNA, 19 bp, Homo sapiens
ggctgtctcggcccagcca

SEQ ID NO: 7389498 - DNA, 22 bp, Homo sapiens
ggctgtccttggccaaggcact

SEQ ID NO: 7389499 - DNA, 20 bp, Homo sapiens
ggctgtcccgcggctgccgg

SEQ ID NO: 7389500 - DNA, 20 bp, Homo sapiens
ggctgtcccgcggctgccgg

SEQ ID NO: 7389501 - DNA, 22 bp, Homo sapiens
ggctgtccacctaccatgccgg

SEQ ID NO: 7389502 - DNA, 22 bp, Homo sapiens
ggctgtaggttggtgctggaca

SEQ ID NO: 7389503 - DNA, 22 bp, Homo sapiens
ggctgtagttacctgatgaaat

SEQ ID NO: 7389504 - DNA, 22 bp, Homo sapiens
ggctgtagtcagtgacatggta

SEQ ID NO: 7389505 - DNA, 22 bp, Homo sapiens
ggctgtcaattcataggtcaga

SEQ ID NO: 7389506 - DNA, 22 bp, Homo sapiens
ggctgtcaattcataggtcaga

SEQ ID NO: 7389507 - DNA, 22 bp, Homo sapiens
ggctgtcaattcataggtcaga

SEQ ID NO: 7389508 - DNA, 22 bp, Homo sapiens
ggctgtcagggtgagctggctt

SEQ ID NO: 7389509 - DNA, 22 bp, Homo sapiens
ggctgtcagggtgagctggctt

SEQ ID NO: 7389510 - DNA, 22 bp, Homo sapiens
ggctgtatatactgtatacagt

SEQ ID NO: 7389511 - DNA, 22 bp, Homo sapiens
cacacagctcaggggcactgcc

SEQ ID NO: 7389512 - DNA, 22 bp, Homo sapiens
cacacagctcaggggcactgcc

SEQ ID NO: 7389513 - DNA, 22 bp, Homo sapiens
cacacagctcaggggcactgcc

SEQ ID NO: 7389514 - DNA, 22 bp, Homo sapiens
cacacagctcaggggcactgcc

SEQ ID NO: 7389515 - DNA, 22 bp, Homo sapiens
cacacagctcaggggcactgcc

SEQ ID NO: 7389516 - DNA, 22 bp, Homo sapiens
cacacagctagtgacaggagaa

SEQ ID NO: 7389517 - DNA, 22 bp, Homo sapiens
cacacagctcaggggcactgcc

SEQ ID NO: 7389518 - DNA, 22 bp, Homo sapiens
cacacagctcaggggcactgcc

SEQ ID NO: 7389519 - DNA, 22 bp, Homo sapiens
cacacagctcaggggcactgcc

SEQ ID NO: 7389520 - DNA, 22 bp, Homo sapiens
cacacagctcaggggcactgcc

SEQ ID NO: 7389521 - DNA, 22 bp, Homo sapiens
cacacagctagtgacaggagaa

SEQ ID NO: 7389522 - DNA, 22 bp, Homo sapiens
cacacagctagtgacaggagaa

SEQ ID NO: 7389523 - DNA, 22 bp, Homo sapiens
cacacagctagtgacaggagaa

SEQ ID NO: 7389524 - DNA, 22 bp, Homo sapiens
cacacagctagtgacaggagaa

SEQ ID NO: 7389525 - DNA, 22 bp, Homo sapiens
cacacagcaacaagaatagcca

SEQ ID NO: 7389526 - DNA, 22 bp, Homo sapiens
cacacagcaacaagaatagcca

SEQ ID NO: 7389527 - DNA, 22 bp, Homo sapiens
cacacagctagtgacaggagaa

SEQ ID NO: 7389528 - DNA, 22 bp, Homo sapiens
cacacagctagtgacaggagaa

SEQ ID NO: 7389529 - DNA, 22 bp, Homo sapiens
cacacagctagtgacaggagaa

SEQ ID NO: 7389530 - DNA, 22 bp, Homo sapiens
cacacagctagtgacaggagaa

SEQ ID NO: 7389531 - DNA, 22 bp, Homo sapiens
cacacaggagagtgctggaggt

SEQ ID NO: 7389532 - DNA, 22 bp, Homo sapiens
ggaagggcaataaaatctcagg

SEQ ID NO: 7389533 - DNA, 22 bp, Homo sapiens
ggaagggcaataaaatctcagg

SEQ ID NO: 7389534 - DNA, 22 bp, Homo sapiens
ggaagggcctcgggcgtgggac

SEQ ID NO: 7389535 - DNA, 22 bp, Homo sapiens
cacacaggagagtgctggaggt

SEQ ID NO: 7389536 - DNA, 22 bp, Homo sapiens
ggaagggcctcgggcgtgggac

SEQ ID NO: 7389537 - DNA, 22 bp, Homo sapiens
ggaagggcctcgggcgtgggac

SEQ ID NO: 7389538 - DNA, 22 bp, Homo sapiens
ggaagggcctcgggcgtgggac

SEQ ID NO: 7389539 - DNA, 22 bp, Homo sapiens
ggaagggcctcgggcgtgggac

SEQ ID NO: 7389540 - DNA, 22 bp, Homo sapiens
ggaagggcctcgggcgtgggac

SEQ ID NO: 7389541 - DNA, 22 bp, Homo sapiens
ggaagggcaataaaatctcagg

SEQ ID NO: 7389542 - DNA, 22 bp, Homo sapiens
ggaagggcctcgggcgtgggac

SEQ ID NO: 7389543 - DNA, 22 bp, Homo sapiens
ggaagggcctcgggcgtgggac

SEQ ID NO: 7389544 - DNA, 22 bp, Homo sapiens
cacacaggagagtgctggaggt

SEQ ID NO: 7389545 - DNA, 22 bp, Homo sapiens
cacacaggagagtgctggaggt

SEQ ID NO: 7389546 - DNA, 22 bp, Homo sapiens
cacacaggagagtgctggaggt

SEQ ID NO: 7389547 - DNA, 22 bp, Homo sapiens
cacacaggaaaattggaattaa

SEQ ID NO: 7389548 - DNA, 22 bp, Homo sapiens
cacacaggaaaattggaattaa

SEQ ID NO: 7389549 - DNA, 22 bp, Homo sapiens
cacacaggaaaattggaattaa

SEQ ID NO: 7389550 - DNA, 21 bp, Homo sapiens
cacacagctgcccttaggtag

SEQ ID NO: 7389551 - DNA, 21 bp, Homo sapiens
cacacagctgcccttaggtag

SEQ ID NO: 7389552 - DNA, 21 bp, Homo sapiens
cacacagctgcccttaggtag

SEQ ID NO: 7389553 - DNA, 21 bp, Homo sapiens
cacacagctgcccttaggtag

SEQ ID NO: 7389554 - DNA, 22 bp, Homo sapiens
cacacagacagctctctgaaga

SEQ ID NO: 7389555 - DNA, 22 bp, Homo sapiens
cacacagacagctctctgaaga

SEQ ID NO: 7389556 - DNA, 22 bp, Homo sapiens
cacacagacagctctctgaaga

SEQ ID NO: 7389557 - DNA, 22 bp, Homo sapiens
cacacagacagctctctgaaga

SEQ ID NO: 7389558 - DNA, 22 bp, Homo sapiens
cacacagacagctctctgaaga

SEQ ID NO: 7389559 - DNA, 22 bp, Homo sapiens
cacaattttaatacacagtcaa

SEQ ID NO: 7389560 - DNA, 22 bp, Homo sapiens
cacaattttaatacacagtcaa

SEQ ID NO: 7389561 - DNA, 22 bp, Homo sapiens
cacaattttaatacacagtcaa

SEQ ID NO: 7389562 - DNA, 22 bp, Homo sapiens
cacaattttaatacacagtcaa

SEQ ID NO: 7389563 - DNA, 22 bp, Homo sapiens
cacaattttaatacacagtcaa

SEQ ID NO: 7389564 - DNA, 22 bp, Homo sapiens
cacaattttaatacacagtcaa

SEQ ID NO: 7389565 - DNA, 22 bp, Homo sapiens
caatgtttgtgatctactgact

SEQ ID NO: 7389566 - DNA, 22 bp, Homo sapiens
caatgttttcaactgacaagta

SEQ ID NO: 7389567 - DNA, 22 bp, Homo sapiens
caatgttttcaactgacaagta

SEQ ID NO: 7389568 - DNA, 22 bp, Homo sapiens
cacaatttgttttatcagtatt

SEQ ID NO: 7389569 - DNA, 22 bp, Homo sapiens
caatgttttcaactgacaagta

SEQ ID NO: 7389570 - DNA, 18 bp, Homo sapiens
caatgttttagatctcta

SEQ ID NO: 7389571 - DNA, 22 bp, Homo sapiens
cacacagcaacaagaatagcca

SEQ ID NO: 7389572 - DNA, 22 bp, Homo sapiens
cacacagcaacaagaatagcca

SEQ ID NO: 7389573 - DNA, 22 bp, Homo sapiens
cacacagatggtaagggaggga

SEQ ID NO: 7389574 - DNA, 22 bp, Homo sapiens
cacacagatggtaagggaggga

SEQ ID NO: 7389575 - DNA, 22 bp, Homo sapiens
cacacagatggtaagggaggga

SEQ ID NO: 7389576 - DNA, 22 bp, Homo sapiens
cacacagatggtaagggaggga

SEQ ID NO: 7389577 - DNA, 22 bp, Homo sapiens
cacacagatggtaagggaggga

SEQ ID NO: 7389578 - DNA, 15 bp, Homo sapiens
cacacagacagcttg

SEQ ID NO: 7389579 - DNA, 15 bp, Homo sapiens
cacacagacagcttg

SEQ ID NO: 7389580 - DNA, 22 bp, Homo sapiens
cacacagacagctctctgaaga

SEQ ID NO: 7389581 - DNA, 22 bp, Homo sapiens
cacacagacagctctctgaaga

SEQ ID NO: 7389582 - DNA, 22 bp, Homo sapiens
cacacagacagctctctgaaga

SEQ ID NO: 7389583 - DNA, 22 bp, Homo sapiens
cacacagacagctctctgaaga

SEQ ID NO: 7389584 - DNA, 22 bp, Homo sapiens
ggaaggggagctggaaagggta

SEQ ID NO: 7389585 - DNA, 22 bp, Homo sapiens
ggaaggggagctggaaagggta

SEQ ID NO: 7389586 - DNA, 22 bp, Homo sapiens
ggaaggggagctggaaagggta

SEQ ID NO: 7389587 - DNA, 22 bp, Homo sapiens
ggaaggggagctggaaagggta

SEQ ID NO: 7389588 - DNA, 22 bp, Homo sapiens
ggaaggggagctggaaagggta

SEQ ID NO: 7389589 - DNA, 22 bp, Homo sapiens
ggaaggggagctggaaagggta

SEQ ID NO: 7389590 - DNA, 22 bp, Homo sapiens
ggaaggggagctggaaagggta

SEQ ID NO: 7389591 - DNA, 20 bp, Homo sapiens
ggaaggggcaaagtgtgtga

SEQ ID NO: 7389592 - DNA, 20 bp, Homo sapiens
ggaaggggcaaagtgtgtga

SEQ ID NO: 7389593 - DNA, 20 bp, Homo sapiens
ggaaggggcaaagtgtgtga

SEQ ID NO: 7389594 - DNA, 20 bp, Homo sapiens
ggaaggggcaaagtgtgtga

SEQ ID NO: 7389595 - DNA, 20 bp, Homo sapiens
ggaaggggcaaagtgtgtga

SEQ ID NO: 7389596 - DNA, 20 bp, Homo sapiens
ggaaggggcaaagtgtgtga

SEQ ID NO: 7389597 - DNA, 20 bp, Homo sapiens
ggaaggggcaaagtgtgtga

SEQ ID NO: 7389598 - DNA, 20 bp, Homo sapiens
ggaaggggcaaagtgtgtga

SEQ ID NO: 7389599 - DNA, 22 bp, Homo sapiens
ggaaggggagctaaatctactg

SEQ ID NO: 7389600 - DNA, 22 bp, Homo sapiens
ggaaggggagctggaaagggta

SEQ ID NO: 7389601 - DNA, 22 bp, Homo sapiens
ggaaggggagctggaaagggta

SEQ ID NO: 7389602 - DNA, 22 bp, Homo sapiens
ggaaggggagctggaaagggta

SEQ ID NO: 7389603 - DNA, 22 bp, Homo sapiens
ggaaggggagctggaaagggta

SEQ ID NO: 7389604 - DNA, 22 bp, Homo sapiens
ggaaggggagctggaaagggta

SEQ ID NO: 7389605 - DNA, 22 bp, Homo sapiens
ggaaggggagctggaaagggta

SEQ ID NO: 7389606 - DNA, 22 bp, Homo sapiens
ggaaggggagctggaaagggta

SEQ ID NO: 7389607 - DNA, 22 bp, Homo sapiens
ggaaggggagctggaaagggta

SEQ ID NO: 7389608 - DNA, 22 bp, Homo sapiens
ggaaggggagctggaaagggta

SEQ ID NO: 7389609 - DNA, 22 bp, Homo sapiens
ggaaggggagctggaaagggta

SEQ ID NO: 7389610 - DNA, 22 bp, Homo sapiens
ggaaggggagctggaaagggta

SEQ ID NO: 7389611 - DNA, 21 bp, Homo sapiens
ggaagggctctgaggacggct

SEQ ID NO: 7389612 - DNA, 21 bp, Homo sapiens
ggaagggctctgaggacggct

SEQ ID NO: 7389613 - DNA, 22 bp, Homo sapiens
ggaaggggagctaaatctactg

SEQ ID NO: 7389614 - DNA, 22 bp, Homo sapiens
ggaaggggagctaaatctactg

SEQ ID NO: 7389615 - DNA, 21 bp, Homo sapiens
ggaagggctctgaggacggct

SEQ ID NO: 7389616 - DNA, 22 bp, Homo sapiens
ggaagggcctcgggcgtgggac

SEQ ID NO: 7389617 - DNA, 22 bp, Homo sapiens
ggaagggcctcgggcgtgggac

SEQ ID NO: 7389618 - DNA, 22 bp, Homo sapiens
ggaagggcggatagtataagtt

SEQ ID NO: 7389619 - DNA, 21 bp, Homo sapiens
ggaagggctctgaggacggct

SEQ ID NO: 7389620 - DNA, 21 bp, Homo sapiens
ggaagggctctgaggacggct

SEQ ID NO: 7389621 - DNA, 21 bp, Homo sapiens
ggaagggctctgaggacggct

SEQ ID NO: 7389622 - DNA, 22 bp, Homo sapiens
cacagaataaattggtatcaga

SEQ ID NO: 7389623 - DNA, 22 bp, Homo sapiens
cacagaataattcacatggctc

SEQ ID NO: 7389624 - DNA, 22 bp, Homo sapiens
cacagaataaattggtatcaga

SEQ ID NO: 7389625 - DNA, 22 bp, Homo sapiens
cacagaataattcacatggctc

SEQ ID NO: 7389626 - DNA, 22 bp, Homo sapiens
cacagaagtgtgtataactctt

SEQ ID NO: 7389627 - DNA, 22 bp, Homo sapiens
cacagaagtttcatagtctcga

SEQ ID NO: 7389628 - DNA, 22 bp, Homo sapiens
cacagaagtttcatagtctcga

SEQ ID NO: 7389629 - DNA, 22 bp, Homo sapiens
cacagaagtttcatagtctcga

SEQ ID NO: 7389630 - DNA, 21 bp, Homo sapiens
cacagaatatacattttagtt

SEQ ID NO: 7389631 - DNA, 21 bp, Homo sapiens
cacagaatatacattttagtt

SEQ ID NO: 7389632 - DNA, 22 bp, Homo sapiens
cacagaatctgtgactccaaga

SEQ ID NO: 7389633 - DNA, 22 bp, Homo sapiens
cacagaatctgtgactccaaga

SEQ ID NO: 7389634 - DNA, 22 bp, Homo sapiens
cacagaatcatattgtcagttt

SEQ ID NO: 7389635 - DNA, 22 bp, Homo sapiens
cacagaatcatattgtcagttt

SEQ ID NO: 7389636 - DNA, 22 bp, Homo sapiens
cacagaatcggccgatggtgct

SEQ ID NO: 7389637 - DNA, 22 bp, Homo sapiens
cacagaatctgtgactccaaga

SEQ ID NO: 7389638 - DNA, 22 bp, Homo sapiens
cacagaactggttaatagcaga

SEQ ID NO: 7389639 - DNA, 22 bp, Homo sapiens
cacagaactggttaatagcaga

SEQ ID NO: 7389640 - DNA, 22 bp, Homo sapiens
cacagaagaatcatgctgtgtt

SEQ ID NO: 7389641 - DNA, 22 bp, Homo sapiens
cacagaagtgtgtataactctt

SEQ ID NO: 7389642 - DNA, 22 bp, Homo sapiens
cacagaagaatcatgctgtgtt

SEQ ID NO: 7389643 - DNA, 22 bp, Homo sapiens
cacagaagaatcatgctgtgtt

SEQ ID NO: 7389644 - DNA, 22 bp, Homo sapiens
ggaaggggccttgagcaaactg

SEQ ID NO: 7389645 - DNA, 22 bp, Homo sapiens
ggaaggggccttgagcaaactg

SEQ ID NO: 7389646 - DNA, 22 bp, Homo sapiens
ggaaggggccttgagcaaactg

SEQ ID NO: 7389647 - DNA, 22 bp, Homo sapiens
cacactgtccccttctccccag

SEQ ID NO: 7389648 - DNA, 22 bp, Homo sapiens
ggaaggggccttgagcaaactg

SEQ ID NO: 7389649 - DNA, 22 bp, Homo sapiens
cacactgtctttcagaatggtt

SEQ ID NO: 7389650 - DNA, 22 bp, Homo sapiens
cacactgtctttatgagctgta

SEQ ID NO: 7389651 - DNA, 22 bp, Homo sapiens
ggaaggggccttgagcaaactg

SEQ ID NO: 7389652 - DNA, 22 bp, Homo sapiens
cacactgtccccttctccccag

SEQ ID NO: 7389653 - DNA, 22 bp, Homo sapiens
cacactgtctttatgagctgta

SEQ ID NO: 7389654 - DNA, 22 bp, Homo sapiens
ggactgggcatgggtgctctgc

SEQ ID NO: 7389655 - DNA, 22 bp, Homo sapiens
ggactgggccaggggttggact

SEQ ID NO: 7389656 - DNA, 22 bp, Homo sapiens
ggactgggccaggggttggact

SEQ ID NO: 7389657 - DNA, 22 bp, Homo sapiens
ggactgggccaggggttggact

SEQ ID NO: 7389658 - DNA, 22 bp, Homo sapiens
ggactgggcatgggtgctctgc

SEQ ID NO: 7389659 - DNA, 22 bp, Homo sapiens
ggactgggcatgggtgctctgc

SEQ ID NO: 7389660 - DNA, 22 bp, Homo sapiens
ggactgggcatgggtgctctgc

SEQ ID NO: 7389661 - DNA, 22 bp, Homo sapiens
ggactgggattctggatctgct

SEQ ID NO: 7389662 - DNA, 22 bp, Homo sapiens
ggactgggcatgggtgctctgc

SEQ ID NO: 7389663 - DNA, 22 bp, Homo sapiens
ggactgggattctggatctgct

SEQ ID NO: 7389664 - DNA, 22 bp, Homo sapiens
ggactgggattctggatctgct

SEQ ID NO: 7389665 - DNA, 22 bp, Homo sapiens
ggactgggattctggatctgct

SEQ ID NO: 7389666 - DNA, 22 bp, Homo sapiens
ggactgggattctggatctgct

SEQ ID NO: 7389667 - DNA, 22 bp, Homo sapiens
ggactgggattctggatctgct

SEQ ID NO: 7389668 - DNA, 22 bp, Homo sapiens
ggactgggattctggatctgct

SEQ ID NO: 7389669 - DNA, 22 bp, Homo sapiens
ggactgggattctggatctgct

SEQ ID NO: 7389670 - DNA, 22 bp, Homo sapiens
ggactgggccaggggttggact

SEQ ID NO: 7389671 - DNA, 22 bp, Homo sapiens
ggactgggccaggggttggact

SEQ ID NO: 7389672 - DNA, 22 bp, Homo sapiens
ggactgggccaggggttggact

SEQ ID NO: 7389673 - DNA, 17 bp, Homo sapiens
ggactgggcggggcagg

SEQ ID NO: 7389674 - DNA, 17 bp, Homo sapiens
ggactgggcggggcagg

SEQ ID NO: 7389675 - DNA, 17 bp, Homo sapiens
ggactgggcggggcagg

SEQ ID NO: 7389676 - DNA, 17 bp, Homo sapiens
ggactgggcggggcagg

SEQ ID NO: 7389677 - DNA, 17 bp, Homo sapiens
ggactgggcggggcagg

SEQ ID NO: 7389678 - DNA, 22 bp, Homo sapiens
ggactgggtaggagcccagggc

SEQ ID NO: 7389679 - DNA, 22 bp, Homo sapiens
cacagagagctacgtgcagcgt

SEQ ID NO: 7389680 - DNA, 22 bp, Homo sapiens
ggactgggtaggagcccagggc

SEQ ID NO: 7389681 - DNA, 22 bp, Homo sapiens
cacagagaccccttctggggcc

SEQ ID NO: 7389682 - DNA, 22 bp, Homo sapiens
cacagagaccccttctggggcc

SEQ ID NO: 7389683 - DNA, 22 bp, Homo sapiens
ggactggggccaacacctccct

SEQ ID NO: 7389684 - DNA, 22 bp, Homo sapiens
ggactggggccaacacctccct

SEQ ID NO: 7389685 - DNA, 22 bp, Homo sapiens
ggactgggtaggagcccagggc

SEQ ID NO: 7389686 - DNA, 22 bp, Homo sapiens
ggactgggtaggagcccagggc

SEQ ID NO: 7389687 - DNA, 22 bp, Homo sapiens
cacagaattaagggagaaatat

SEQ ID NO: 7389688 - DNA, 22 bp, Homo sapiens
cacagaattaagggagaaatat

SEQ ID NO: 7389689 - DNA, 22 bp, Homo sapiens
cacagaattaagggagaaatat

SEQ ID NO: 7389690 - DNA, 22 bp, Homo sapiens
cacagaattaagggagaaatat

SEQ ID NO: 7389691 - DNA, 22 bp, Homo sapiens
cacagaatggaccagttttaga

SEQ ID NO: 7389692 - DNA, 22 bp, Homo sapiens
cacagaattttctctttacaat

SEQ ID NO: 7389693 - DNA, 22 bp, Homo sapiens
cacagaattaagggagaaatat

SEQ ID NO: 7389694 - DNA, 22 bp, Homo sapiens
cacagactccccgccatagtgg

SEQ ID NO: 7389695 - DNA, 22 bp, Homo sapiens
cacagactccccgccatagtgg

SEQ ID NO: 7389696 - DNA, 20 bp, Homo sapiens
cacagactgtatgggcacca

SEQ ID NO: 7389697 - DNA, 20 bp, Homo sapiens
cacagactgtatgggcacca

SEQ ID NO: 7389698 - DNA, 20 bp, Homo sapiens
cacagactgtatgggcacca

SEQ ID NO: 7389699 - DNA, 20 bp, Homo sapiens
cacagactgtatgggcacca

SEQ ID NO: 7389700 - DNA, 22 bp, Homo sapiens
cacagactccccgccatagtgg

SEQ ID NO: 7389701 - DNA, 22 bp, Homo sapiens
cacagacccagaagggatgaag

SEQ ID NO: 7389702 - DNA, 22 bp, Homo sapiens
cacagacagtgtccctttgttg

SEQ ID NO: 7389703 - DNA, 22 bp, Homo sapiens
cacagacagtgtccctttgttg

SEQ ID NO: 7389704 - DNA, 22 bp, Homo sapiens
ggactgggagaatggaggcaag

SEQ ID NO: 7389705 - DNA, 22 bp, Homo sapiens
ggactgggagaatggaggcaag

SEQ ID NO: 7389706 - DNA, 22 bp, Homo sapiens
ggactgggagaatggaggcaag

SEQ ID NO: 7389707 - DNA, 22 bp, Homo sapiens
ggactgggagaatggaggcaag

SEQ ID NO: 7389708 - DNA, 22 bp, Homo sapiens
ggactgggagaatggaggcaag

SEQ ID NO: 7389709 - DNA, 22 bp, Homo sapiens
ggactgggagaatggaggcaag

SEQ ID NO: 7389710 - DNA, 22 bp, Homo sapiens
ggactgggagaatggaggcaag

SEQ ID NO: 7389711 - DNA, 22 bp, Homo sapiens
ggactgggagaatggaggcaag

SEQ ID NO: 7389712 - DNA, 22 bp, Homo sapiens
ggactgggagaatggaggcaag

SEQ ID NO: 7389713 - DNA, 22 bp, Homo sapiens
cacagagaaaatgttggtgctt

SEQ ID NO: 7389714 - DNA, 22 bp, Homo sapiens
ggactgggagaatggaggcaag

SEQ ID NO: 7389715 - DNA, 22 bp, Homo sapiens
ggactgggagaatggaggcaag

SEQ ID NO: 7389716 - DNA, 22 bp, Homo sapiens
ggactgggagaatggaggcaag

SEQ ID NO: 7389717 - DNA, 22 bp, Homo sapiens
cacagagaaaatgttggtgctt

SEQ ID NO: 7389718 - DNA, 22 bp, Homo sapiens
cacagagaaaatgttggtgctt

SEQ ID NO: 7389719 - DNA, 22 bp, Homo sapiens
cacagacttgagaagcacctta

SEQ ID NO: 7389720 - DNA, 22 bp, Homo sapiens
cacagacttgagaagcacctta

SEQ ID NO: 7389721 - DNA, 22 bp, Homo sapiens
cacagacttgagaagcacctta

SEQ ID NO: 7389722 - DNA, 20 bp, Homo sapiens
cacagactgtatgggcacca

SEQ ID NO: 7389723 - DNA, 20 bp, Homo sapiens
cacagactgtatgggcacca

SEQ ID NO: 7389724 - DNA, 22 bp, Homo sapiens
cacagacttgagaagcacctta

SEQ ID NO: 7389725 - DNA, 22 bp, Homo sapiens
cacagaggatgcccaagcgatc

SEQ ID NO: 7389726 - DNA, 22 bp, Homo sapiens
cacagaggatgcccaagcgatc

SEQ ID NO: 7389727 - DNA, 22 bp, Homo sapiens
cacagaggagtgcacactctct

SEQ ID NO: 7389728 - DNA, 22 bp, Homo sapiens
cacagaggatgcccaagcgatc

SEQ ID NO: 7389729 - DNA, 22 bp, Homo sapiens
cacagaggatgcccaagcgatc

SEQ ID NO: 7389730 - DNA, 22 bp, Homo sapiens
cacagaggatgcccaagcgatc

SEQ ID NO: 7389731 - DNA, 22 bp, Homo sapiens
cacagaggcaaccttctggggt

SEQ ID NO: 7389732 - DNA, 22 bp, Homo sapiens
cacagaggatttttagggcagt

SEQ ID NO: 7389733 - DNA, 22 bp, Homo sapiens
cacagaggatttttagggcagt

SEQ ID NO: 7389734 - DNA, 22 bp, Homo sapiens
cacagaggatttttagggcagt

SEQ ID NO: 7389735 - DNA, 22 bp, Homo sapiens
cacagaggatttttagggcagt

SEQ ID NO: 7389736 - DNA, 22 bp, Homo sapiens
cacagaggatttttagggcagt

SEQ ID NO: 7389737 - DNA, 22 bp, Homo sapiens
cacagaggatgcccaagcgatc

SEQ ID NO: 7389738 - DNA, 22 bp, Homo sapiens
cacagaggatttttagggcagt

SEQ ID NO: 7389739 - DNA, 22 bp, Homo sapiens
cacagaggatttttagggcagt

SEQ ID NO: 7389740 - DNA, 22 bp, Homo sapiens
cacagaggatttttagggcagt

SEQ ID NO: 7389741 - DNA, 22 bp, Homo sapiens
cacagaggctcaaagccaggtg

SEQ ID NO: 7389742 - DNA, 22 bp, Homo sapiens
cacagaggctcaaagccaggtg

SEQ ID NO: 7389743 - DNA, 22 bp, Homo sapiens
cacagaggctcaaagccaggtg

SEQ ID NO: 7389744 - DNA, 22 bp, Homo sapiens
cacagaggctcaaagccaggtg

SEQ ID NO: 7389745 - DNA, 22 bp, Homo sapiens
cacagaggctcaaagccaggtg

SEQ ID NO: 7389746 - DNA, 22 bp, Homo sapiens
cacagaggcggaaaattctgaa

SEQ ID NO: 7389747 - DNA, 22 bp, Homo sapiens
cacagaggcggaaaattctgaa

SEQ ID NO: 7389748 - DNA, 21 bp, Homo sapiens
cacagaggcgctgtatggctg

SEQ ID NO: 7389749 - DNA, 22 bp, Homo sapiens
cacagaggcggaaaattctgaa

SEQ ID NO: 7389750 - DNA, 21 bp, Homo sapiens
cacagaggcgctgtatggctg

SEQ ID NO: 7389751 - DNA, 21 bp, Homo sapiens
cacagaggcgctgtatggctg

SEQ ID NO: 7389752 - DNA, 21 bp, Homo sapiens
cacagaggcgctgtatggctg

SEQ ID NO: 7389753 - DNA, 21 bp, Homo sapiens
cacagaggcgctgtatggctg

SEQ ID NO: 7389754 - DNA, 21 bp, Homo sapiens
cacagaggcgctgtatggctg

SEQ ID NO: 7389755 - DNA, 22 bp, Homo sapiens
cacagaggcatgaccctgccct

SEQ ID NO: 7389756 - DNA, 22 bp, Homo sapiens
cacagaggcatgaccctgccct

SEQ ID NO: 7389757 - DNA, 22 bp, Homo sapiens
cacagaggcatgaccctgccct

SEQ ID NO: 7389758 - DNA, 22 bp, Homo sapiens
cacagaggcatgaccctgccct

SEQ ID NO: 7389759 - DNA, 22 bp, Homo sapiens
cacagaggcatgaccctgccct

SEQ ID NO: 7389760 - DNA, 22 bp, Homo sapiens
cacagagctgaacctgggtcat

SEQ ID NO: 7389761 - DNA, 22 bp, Homo sapiens
cacagagctgaacctgggtcat

SEQ ID NO: 7389762 - DNA, 22 bp, Homo sapiens
cacagagctgaacctgggtcat

SEQ ID NO: 7389763 - DNA, 22 bp, Homo sapiens
cacagagctgaacctgggtcat

SEQ ID NO: 7389764 - DNA, 22 bp, Homo sapiens
cacagagctgaacctgggtcat

SEQ ID NO: 7389765 - DNA, 22 bp, Homo sapiens
cacagagctgaacctgggtcat

SEQ ID NO: 7389766 - DNA, 22 bp, Homo sapiens
cacagagagctacgtgcagcgt

SEQ ID NO: 7389767 - DNA, 22 bp, Homo sapiens
cacagagagctacgtgcagcgt

SEQ ID NO: 7389768 - DNA, 22 bp, Homo sapiens
cacagagagctacgtgcagcgt

SEQ ID NO: 7389769 - DNA, 22 bp, Homo sapiens
cacagagagctacgtgcagcgt

SEQ ID NO: 7389770 - DNA, 22 bp, Homo sapiens
cacagagagctacgtgcagcgt

SEQ ID NO: 7389771 - DNA, 22 bp, Homo sapiens
cacagagctgaacctgggtcat

SEQ ID NO: 7389772 - DNA, 22 bp, Homo sapiens
cacagagctggaaaggctgggc

SEQ ID NO: 7389773 - DNA, 22 bp, Homo sapiens
cacagagctggaaaggctgggc

SEQ ID NO: 7389774 - DNA, 22 bp, Homo sapiens
cacagagctggaaaggctgggc

SEQ ID NO: 7389775 - DNA, 22 bp, Homo sapiens
cacagagctggaaaggctgggc

SEQ ID NO: 7389776 - DNA, 22 bp, Homo sapiens
cacagagctggaaaggctgggc

SEQ ID NO: 7389777 - DNA, 22 bp, Homo sapiens
cacagagctggaaaggctgggc

SEQ ID NO: 7389778 - DNA, 22 bp, Homo sapiens
cacagagctggaaaggctgggc

SEQ ID NO: 7389779 - DNA, 22 bp, Homo sapiens
cacagagctggaaaggctgggc

SEQ ID NO: 7389780 - DNA, 22 bp, Homo sapiens
cacagaggaaaggcagttggta

SEQ ID NO: 7389781 - DNA, 22 bp, Homo sapiens
cacagaggaaaggcagttggta

SEQ ID NO: 7389782 - DNA, 22 bp, Homo sapiens
cacagagctggaaaggctgggc

SEQ ID NO: 7389783 - DNA, 22 bp, Homo sapiens
cacagaggaaatgactttctta

SEQ ID NO: 7389784 - DNA, 22 bp, Homo sapiens
cacagaggaaaggcagttggta

SEQ ID NO: 7389785 - DNA, 22 bp, Homo sapiens
cacagaggaaaggcagttggta

SEQ ID NO: 7389786 - DNA, 22 bp, Homo sapiens
cacagaggaatgcatcagcaga

SEQ ID NO: 7389787 - DNA, 22 bp, Homo sapiens
cacagaggaatgcatcagcaga

SEQ ID NO: 7389788 - DNA, 22 bp, Homo sapiens
cacagaggaatgcatcagcaga

SEQ ID NO: 7389789 - DNA, 22 bp, Homo sapiens
cacagaggaaatgactttctta

SEQ ID NO: 7389790 - DNA, 22 bp, Homo sapiens
cacagaggaaatgactttctta

SEQ ID NO: 7389791 - DNA, 22 bp, Homo sapiens
cacagaggaaatgactttctta

SEQ ID NO: 7389792 - DNA, 22 bp, Homo sapiens
cacagaggagtgcacactctct

SEQ ID NO: 7389793 - DNA, 22 bp, Homo sapiens
cacagaggagtgcacactctct

SEQ ID NO: 7389794 - DNA, 22 bp, Homo sapiens
cacagaggactgtagcggggag

SEQ ID NO: 7389795 - DNA, 22 bp, Homo sapiens
cacagaggagtgcacactctct

SEQ ID NO: 7389796 - DNA, 22 bp, Homo sapiens
cacagaggagtgcacactctct

SEQ ID NO: 7389797 - DNA, 22 bp, Homo sapiens
cacagaggactgtagcggggag

SEQ ID NO: 7389798 - DNA, 22 bp, Homo sapiens
cacagaggactgtagcggggag

SEQ ID NO: 7389799 - DNA, 22 bp, Homo sapiens
cacagaggactgtagcggggag

SEQ ID NO: 7389800 - DNA, 22 bp, Homo sapiens
cacagaggactgtagcggggag

SEQ ID NO: 7389801 - DNA, 22 bp, Homo sapiens
cacagaggaatgcatcagcaga

SEQ ID NO: 7389802 - DNA, 22 bp, Homo sapiens
cacagaggactgtagcggggag

SEQ ID NO: 7389803 - DNA, 22 bp, Homo sapiens
ggagcctgacagtgcccagcat

SEQ ID NO: 7389804 - DNA, 22 bp, Homo sapiens
ggagcctgacagtgcccagcat

SEQ ID NO: 7389805 - DNA, 22 bp, Homo sapiens
ggagcctgacagtgcccagcat

SEQ ID NO: 7389806 - DNA, 22 bp, Homo sapiens
ggagcctgaaaagtctgcattt

SEQ ID NO: 7389807 - DNA, 22 bp, Homo sapiens
ggagcctgaaaagtctgcattt

SEQ ID NO: 7389808 - DNA, 22 bp, Homo sapiens
ggagcctattattagcatggca

SEQ ID NO: 7389809 - DNA, 23 bp, Homo sapiens
ggagcctccggtgtgtgagaggc

SEQ ID NO: 7389810 - DNA, 23 bp, Homo sapiens
ggagcctccggtgtgtgagaggc

SEQ ID NO: 7389811 - DNA, 22 bp, Homo sapiens
ggagcctgagcggcccagggcc

SEQ ID NO: 7389812 - DNA, 22 bp, Homo sapiens
ggagcctgacagtgcccagcat

SEQ ID NO: 7389813 - DNA, 22 bp, Homo sapiens
ggagcctgacagtgcccagcat

SEQ ID NO: 7389814 - DNA, 22 bp, Homo sapiens
ggagcctgacagtgcccagcat

SEQ ID NO: 7389815 - DNA, 22 bp, Homo sapiens
ggagcctgagcggcccagggcc

SEQ ID NO: 7389816 - DNA, 22 bp, Homo sapiens
ggagcctgagcggcccagggcc

SEQ ID NO: 7389817 - DNA, 22 bp, Homo sapiens
ggagcctgagggccctcttgga

SEQ ID NO: 7389818 - DNA, 22 bp, Homo sapiens
ggagcctgagggccctcttgga

SEQ ID NO: 7389819 - DNA, 23 bp, Homo sapiens
ggagctgctgttgggggagctgc

SEQ ID NO: 7389820 - DNA, 23 bp, Homo sapiens
ggagctgctgttgggggagctgc

SEQ ID NO: 7389821 - DNA, 23 bp, Homo sapiens
ggagctgctgttgggggagctgc

SEQ ID NO: 7389822 - DNA, 22 bp, Homo sapiens
ggagctgctcagagccagtccc

SEQ ID NO: 7389823 - DNA, 22 bp, Homo sapiens
ggagctgctccttcagccaagt

SEQ ID NO: 7389824 - DNA, 19 bp, Homo sapiens
ggagcctggagcacgtgcc

SEQ ID NO: 7389825 - DNA, 19 bp, Homo sapiens
ggagcctggagcacgtgcc

SEQ ID NO: 7389826 - DNA, 19 bp, Homo sapiens
ggagcctggagcacgtgcc

SEQ ID NO: 7389827 - DNA, 19 bp, Homo sapiens
ggagcctggagcacgtgcc

SEQ ID NO: 7389828 - DNA, 19 bp, Homo sapiens
ggagcctggagcacgtgcc

SEQ ID NO: 7389829 - DNA, 22 bp, Homo sapiens
ggagcctgcgggagctcccatt

SEQ ID NO: 7389830 - DNA, 22 bp, Homo sapiens
ggagcctgcgggagctcccatt

SEQ ID NO: 7389831 - DNA, 22 bp, Homo sapiens
ggagcctgcgggagctcccatt

SEQ ID NO: 7389832 - DNA, 22 bp, Homo sapiens
ggagcctgcgggagctcccatt

SEQ ID NO: 7389833 - DNA, 22 bp, Homo sapiens
ggagctgctttgatctgaagaa

SEQ ID NO: 7389834 - DNA, 22 bp, Homo sapiens
ggagctgctttgatctgaagaa

SEQ ID NO: 7389835 - DNA, 22 bp, Homo sapiens
ggagctgcttcttgctgtgggt

SEQ ID NO: 7389836 - DNA, 22 bp, Homo sapiens
ggagctgcttcttgctgtgggt

SEQ ID NO: 7389837 - DNA, 22 bp, Homo sapiens
ggagctgcttcttgctgtgggt

SEQ ID NO: 7389838 - DNA, 22 bp, Homo sapiens
ggagctggaatatattgaaacc

SEQ ID NO: 7389839 - DNA, 23 bp, Homo sapiens
ggagctggacccttacacctttc

SEQ ID NO: 7389840 - DNA, 23 bp, Homo sapiens
ggagctggacccttacacctttc

SEQ ID NO: 7389841 - DNA, 22 bp, Homo sapiens
ggagctggaatatattgaaacc

SEQ ID NO: 7389842 - DNA, 22 bp, Homo sapiens
ggagctgctttgatctgaagaa

SEQ ID NO: 7389843 - DNA, 22 bp, Homo sapiens
ggagctggagagctagcctagg

SEQ ID NO: 7389844 - DNA, 22 bp, Homo sapiens
ggagctggagagtacagagttt

SEQ ID NO: 7389845 - DNA, 22 bp, Homo sapiens
ggagctggagagtacagagttt

SEQ ID NO: 7389846 - DNA, 22 bp, Homo sapiens
ggagctggagagtacagagttt

SEQ ID NO: 7389847 - DNA, 22 bp, Homo sapiens
ggagctggagagctagcctagg

SEQ ID NO: 7389848 - DNA, 22 bp, Homo sapiens
ggagctggagagctagcctagg

SEQ ID NO: 7389849 - DNA, 22 bp, Homo sapiens
ggagctggagagctagcctagg

SEQ ID NO: 7389850 - DNA, 22 bp, Homo sapiens
ggagctggagagctagcctagg

SEQ ID NO: 7389851 - DNA, 23 bp, Homo sapiens
ggagctggacccttacacctttc

SEQ ID NO: 7389852 - DNA, 23 bp, Homo sapiens
ggagctggacccttacacctttc

SEQ ID NO: 7389853 - DNA, 23 bp, Homo sapiens
ggagctggacccttacacctttc

SEQ ID NO: 7389854 - DNA, 20 bp, Homo sapiens
ggagctggcatccagcctct

SEQ ID NO: 7389855 - DNA, 20 bp, Homo sapiens
ggagctggcatccagcctct

SEQ ID NO: 7389856 - DNA, 20 bp, Homo sapiens
ggagctggcatccagcctct

SEQ ID NO: 7389857 - DNA, 20 bp, Homo sapiens
ggagctggcatccagcctct

SEQ ID NO: 7389858 - DNA, 20 bp, Homo sapiens
ggagctggcatccagcctct

SEQ ID NO: 7389859 - DNA, 22 bp, Homo sapiens
ggagctggcagcgcaacccaga

SEQ ID NO: 7389860 - DNA, 22 bp, Homo sapiens
ggagctggcagcgcaacccaga

SEQ ID NO: 7389861 - DNA, 22 bp, Homo sapiens
ggagctggcagcgcaacccaga

SEQ ID NO: 7389862 - DNA, 22 bp, Homo sapiens
ggagctggcagcgcaacccaga

SEQ ID NO: 7389863 - DNA, 22 bp, Homo sapiens
ggagctggcagcgcaacccaga

SEQ ID NO: 7389864 - DNA, 22 bp, Homo sapiens
ggagctggcagcgcaacccaga

SEQ ID NO: 7389865 - DNA, 22 bp, Homo sapiens
ggagctggcagcgcaacccaga

SEQ ID NO: 7389866 - DNA, 22 bp, Homo sapiens
ggagctggcagcgcaacccaga

SEQ ID NO: 7389867 - DNA, 22 bp, Homo sapiens
ggagctggagagtacagagttt

SEQ ID NO: 7389868 - DNA, 22 bp, Homo sapiens
ggagctggagagtacagagttt

SEQ ID NO: 7389869 - DNA, 22 bp, Homo sapiens
ggagctggagagtacagagttt

SEQ ID NO: 7389870 - DNA, 22 bp, Homo sapiens
ggagctggagagtacagagttt

SEQ ID NO: 7389871 - DNA, 22 bp, Homo sapiens
ggagctggagagtacagagttt

SEQ ID NO: 7389872 - DNA, 22 bp, Homo sapiens
ggagctggagagtacagagttt

SEQ ID NO: 7389873 - DNA, 22 bp, Homo sapiens
ggagcaggcagggccgtgtctg

SEQ ID NO: 7389874 - DNA, 22 bp, Homo sapiens
ggagcaggcagggccgtgtctg

SEQ ID NO: 7389875 - DNA, 22 bp, Homo sapiens
cacagatttctggtcttcaccc

SEQ ID NO: 7389876 - DNA, 22 bp, Homo sapiens
ggagcaggcagggccgtgtctg

SEQ ID NO: 7389877 - DNA, 22 bp, Homo sapiens
ggagcaggcagggccgtgtctg

SEQ ID NO: 7389878 - DNA, 22 bp, Homo sapiens
cacagattatgagacgagatac

SEQ ID NO: 7389879 - DNA, 22 bp, Homo sapiens
cacagattatgagacgagatac

SEQ ID NO: 7389880 - DNA, 22 bp, Homo sapiens
cacagattatgagacgagatac

SEQ ID NO: 7389881 - DNA, 22 bp, Homo sapiens
cacagattatgagacgagatac

SEQ ID NO: 7389882 - DNA, 22 bp, Homo sapiens
cacagatttctggtcttcaccc

SEQ ID NO: 7389883 - DNA, 22 bp, Homo sapiens
cacagattatgagacgagatac

SEQ ID NO: 7389884 - DNA, 22 bp, Homo sapiens
cacagatttcctaagcatcaat

SEQ ID NO: 7389885 - DNA, 22 bp, Homo sapiens
cacagatttcctaagcatcaat

SEQ ID NO: 7389886 - DNA, 22 bp, Homo sapiens
cacagatttcctaagcatcaat

SEQ ID NO: 7389887 - DNA, 22 bp, Homo sapiens
ggagccctccatcccttgcggc

SEQ ID NO: 7389888 - DNA, 22 bp, Homo sapiens
ggagcaggcagggccgtgtctg

SEQ ID NO: 7389889 - DNA, 22 bp, Homo sapiens
ggagcaggcagggccgtgtctg

SEQ ID NO: 7389890 - DNA, 22 bp, Homo sapiens
ggagcaggcagggccgtgtctg

SEQ ID NO: 7389891 - DNA, 22 bp, Homo sapiens
ggagccctgccctaggcagctc

SEQ ID NO: 7389892 - DNA, 22 bp, Homo sapiens
ggagccctgccctaggcagctc

SEQ ID NO: 7389893 - DNA, 22 bp, Homo sapiens
ggagccctgccctaggcagctc

SEQ ID NO: 7389894 - DNA, 22 bp, Homo sapiens
ggagccctgaagcaagaaagta

SEQ ID NO: 7389895 - DNA, 19 bp, Homo sapiens
ggagccgccgcccttcatt

SEQ ID NO: 7389896 - DNA, 19 bp, Homo sapiens
ggagccgccgcccttcatt

SEQ ID NO: 7389897 - DNA, 19 bp, Homo sapiens
ggagccgccgcccttcatt

SEQ ID NO: 7389898 - DNA, 22 bp, Homo sapiens
ggagcccttggcacctagtagg

SEQ ID NO: 7389899 - DNA, 22 bp, Homo sapiens
ggagcccttggcacctagtagg

SEQ ID NO: 7389900 - DNA, 22 bp, Homo sapiens
ggagccggagggccactggcag

SEQ ID NO: 7389901 - DNA, 19 bp, Homo sapiens
ggagccgccgcccttcatt

SEQ ID NO: 7389902 - DNA, 19 bp, Homo sapiens
ggagccgccgcccttcatt

SEQ ID NO: 7389903 - DNA, 22 bp, Homo sapiens
ggagccctgctgacatgggtgt

SEQ ID NO: 7389904 - DNA, 22 bp, Homo sapiens
ggagccctgccctaggcagctc

SEQ ID NO: 7389905 - DNA, 22 bp, Homo sapiens
ggagccctgccctaggcagctc

SEQ ID NO: 7389906 - DNA, 23 bp, Homo sapiens
ggagccctgagctgtccccatgc

SEQ ID NO: 7389907 - DNA, 22 bp, Homo sapiens
ggagcccttctattccatggag

SEQ ID NO: 7389908 - DNA, 22 bp, Homo sapiens
ggagcccttctattccatggag

SEQ ID NO: 7389909 - DNA, 22 bp, Homo sapiens
ggagcccttctattccatggag

SEQ ID NO: 7389910 - DNA, 22 bp, Homo sapiens
ggagcccttgctgaccttccaa

SEQ ID NO: 7389911 - DNA, 22 bp, Homo sapiens
cacagatgaagtaaacaactct

SEQ ID NO: 7389912 - DNA, 19 bp, Homo sapiens
cacagatgattgacacata

SEQ ID NO: 7389913 - DNA, 19 bp, Homo sapiens
cacagatgattgacacata

SEQ ID NO: 7389914 - DNA, 19 bp, Homo sapiens
cacagatgattgacacata

SEQ ID NO: 7389915 - DNA, 19 bp, Homo sapiens
cacagatgattgacacata

SEQ ID NO: 7389916 - DNA, 20 bp, Homo sapiens
cacagatgggacaggaaagg

SEQ ID NO: 7389917 - DNA, 20 bp, Homo sapiens
cacagatgggacaggaaagg

SEQ ID NO: 7389918 - DNA, 22 bp, Homo sapiens
cacagatacctagtgaaacata

SEQ ID NO: 7389919 - DNA, 22 bp, Homo sapiens
cacagatagaccttatgagatt

SEQ ID NO: 7389920 - DNA, 22 bp, Homo sapiens
cacagatgaagtaaacaactct

SEQ ID NO: 7389921 - DNA, 22 bp, Homo sapiens
cacagatacctagtgaaacata

SEQ ID NO: 7389922 - DNA, 22 bp, Homo sapiens
cacagatacctagtgaaacata

SEQ ID NO: 7389923 - DNA, 22 bp, Homo sapiens
cacagataaggatgttaatttt

SEQ ID NO: 7389924 - DNA, 22 bp, Homo sapiens
cacagaggtgatagtggtcaag

SEQ ID NO: 7389925 - DNA, 22 bp, Homo sapiens
cacagaggtgatagtggtcaag

SEQ ID NO: 7389926 - DNA, 22 bp, Homo sapiens
cacagaggtgatagtggtcaag

SEQ ID NO: 7389927 - DNA, 22 bp, Homo sapiens
cacagaggtctgggcccagcag

SEQ ID NO: 7389928 - DNA, 22 bp, Homo sapiens
cacagaggtgatagtggtcaag

SEQ ID NO: 7389929 - DNA, 22 bp, Homo sapiens
cacagaggtctgggcccagcag

SEQ ID NO: 7389930 - DNA, 22 bp, Homo sapiens
cacagaggtctgggcccagcag

SEQ ID NO: 7389931 - DNA, 22 bp, Homo sapiens
cacagaggtctgggcccagcag

SEQ ID NO: 7389932 - DNA, 22 bp, Homo sapiens
cacagaggtctgggcccagcag

SEQ ID NO: 7389933 - DNA, 20 bp, Homo sapiens
cacagagtcttgcagcgttc

SEQ ID NO: 7389934 - DNA, 22 bp, Homo sapiens
cacagagtggaggcttggcctg

SEQ ID NO: 7389935 - DNA, 22 bp, Homo sapiens
cacagaggtgatagtggtcaag

SEQ ID NO: 7389936 - DNA, 22 bp, Homo sapiens
cacagaggtgatagtggtcaag

SEQ ID NO: 7389937 - DNA, 22 bp, Homo sapiens
cacagataaggatgttaatttt

SEQ ID NO: 7389938 - DNA, 22 bp, Homo sapiens
cacagagttgaatattgacatt

SEQ ID NO: 7389939 - DNA, 22 bp, Homo sapiens
cacagagttgaatattgacatt

SEQ ID NO: 7389940 - DNA, 22 bp, Homo sapiens
cacagagttgaatattgacatt

SEQ ID NO: 7389941 - DNA, 22 bp, Homo sapiens
cacaggcttgtcagcatgaggc

SEQ ID NO: 7389942 - DNA, 22 bp, Homo sapiens
cacaggcttgtcagcatgaggc

SEQ ID NO: 7389943 - DNA, 22 bp, Homo sapiens
cacaggcttgtcagcatgaggc

SEQ ID NO: 7389944 - DNA, 22 bp, Homo sapiens
cacaggcttgtcagcatgaggc

SEQ ID NO: 7389945 - DNA, 22 bp, Homo sapiens
cacaggcttgtcagcatgaggc

SEQ ID NO: 7389946 - DNA, 22 bp, Homo sapiens
cacaggcttgtcagcatgaggc

SEQ ID NO: 7389947 - DNA, 22 bp, Homo sapiens
cacaggcttgtcagcatgaggc

SEQ ID NO: 7389948 - DNA, 22 bp, Homo sapiens
cacaggcttgtcagcatgaggc

SEQ ID NO: 7389949 - DNA, 21 bp, Homo sapiens
cacaggcttctatacacaatg

SEQ ID NO: 7389950 - DNA, 22 bp, Homo sapiens
cacaggcttgtcagcatgaggc

SEQ ID NO: 7389951 - DNA, 22 bp, Homo sapiens
cacaggcttgtcagcatgaggc

SEQ ID NO: 7389952 - DNA, 22 bp, Homo sapiens
cacaggcttgtcagcatgaggc

SEQ ID NO: 7389953 - DNA, 22 bp, Homo sapiens
cacaggcttgtcagcatgaggc

SEQ ID NO: 7389954 - DNA, 22 bp, Homo sapiens
cacaggcttgtcagcatgaggc

SEQ ID NO: 7389955 - DNA, 22 bp, Homo sapiens
cacaggcttttctgacataggc

SEQ ID NO: 7389956 - DNA, 22 bp, Homo sapiens
cacaggcttttctgacataggc

SEQ ID NO: 7389957 - DNA, 22 bp, Homo sapiens
cacaggcttttctgacataggc

SEQ ID NO: 7389958 - DNA, 22 bp, Homo sapiens
cacaggcttttctgacataggc

SEQ ID NO: 7389959 - DNA, 22 bp, Homo sapiens
cacaggcttccagtccccagct

SEQ ID NO: 7389960 - DNA, 20 bp, Homo sapiens
cacaggcttacagtttagat

SEQ ID NO: 7389961 - DNA, 20 bp, Homo sapiens
cacaggcttacagtttagat

SEQ ID NO: 7389962 - DNA, 22 bp, Homo sapiens
cacaggcttccagtccccagct

SEQ ID NO: 7389963 - DNA, 22 bp, Homo sapiens
cacaggcttccagtccccagct

SEQ ID NO: 7389964 - DNA, 22 bp, Homo sapiens
cacaggcttccagtccccagct

SEQ ID NO: 7389965 - DNA, 21 bp, Homo sapiens
cacaggcttctatacacaatg

SEQ ID NO: 7389966 - DNA, 21 bp, Homo sapiens
cacaggcttctatacacaatg

SEQ ID NO: 7389967 - DNA, 22 bp, Homo sapiens
cacaggcttgtcagcatgaggc

SEQ ID NO: 7389968 - DNA, 20 bp, Homo sapiens
cacaggctatatgagagcca

SEQ ID NO: 7389969 - DNA, 20 bp, Homo sapiens
cacaggccttgtgagcagac

SEQ ID NO: 7389970 - DNA, 23 bp, Homo sapiens
cacaggctgcgcataagcttctc

SEQ ID NO: 7389971 - DNA, 22 bp, Homo sapiens
cacaggctgggaagcctaggcc

SEQ ID NO: 7389972 - DNA, 22 bp, Homo sapiens
cacaggctgggaagcctaggcc

SEQ ID NO: 7389973 - DNA, 22 bp, Homo sapiens
cacaggctgggaagcctaggcc

SEQ ID NO: 7389974 - DNA, 20 bp, Homo sapiens
cacaggctatatgagagcca

SEQ ID NO: 7389975 - DNA, 22 bp, Homo sapiens
cacaggctgggaagcctaggcc

SEQ ID NO: 7389976 - DNA, 22 bp, Homo sapiens
cacaggctgggaagcctaggcc

SEQ ID NO: 7389977 - DNA, 22 bp, Homo sapiens
ggaggccaaagtgtgggcggct

SEQ ID NO: 7389978 - DNA, 22 bp, Homo sapiens
ggaggcattatggggaagactt

SEQ ID NO: 7389979 - DNA, 22 bp, Homo sapiens
ggaggccaaagtgtgggcggct

SEQ ID NO: 7389980 - DNA, 22 bp, Homo sapiens
ggaggccaaagtgtgggcggct

SEQ ID NO: 7389981 - DNA, 22 bp, Homo sapiens
ggaggccaaagtgtgggcggct

SEQ ID NO: 7389982 - DNA, 22 bp, Homo sapiens
ggaggccaaagtgtgggcggct

SEQ ID NO: 7389983 - DNA, 22 bp, Homo sapiens
ggaggccaaggaggagcttgcc

SEQ ID NO: 7389984 - DNA, 22 bp, Homo sapiens
ggaggccaaagtgtgggcggct

SEQ ID NO: 7389985 - DNA, 22 bp, Homo sapiens
ggaggccaaagtgtgggcggct

SEQ ID NO: 7389986 - DNA, 22 bp, Homo sapiens
ggaggccaaggaggagcttgcc

SEQ ID NO: 7389987 - DNA, 22 bp, Homo sapiens
ggaggccaaggaggagcttgcc

SEQ ID NO: 7389988 - DNA, 22 bp, Homo sapiens
ggaggccaaggaggagcttgcc

SEQ ID NO: 7389989 - DNA, 22 bp, Homo sapiens
ggaggcaggaaagacaggttca

SEQ ID NO: 7389990 - DNA, 22 bp, Homo sapiens
ggaggcaggaaagacaggttca

SEQ ID NO: 7389991 - DNA, 22 bp, Homo sapiens
ggaggcaggaaagacaggttca

SEQ ID NO: 7389992 - DNA, 22 bp, Homo sapiens
ggaggcattatggggaagactt

SEQ ID NO: 7389993 - DNA, 22 bp, Homo sapiens
ggaggcattatggggaagactt

SEQ ID NO: 7389994 - DNA, 22 bp, Homo sapiens
ggaggcatctctgtggctgtct

SEQ ID NO: 7389995 - DNA, 22 bp, Homo sapiens
ggaggcaggaaagacaggttca

SEQ ID NO: 7389996 - DNA, 22 bp, Homo sapiens
ggaggcatctctgtggctgtct

SEQ ID NO: 7389997 - DNA, 22 bp, Homo sapiens
ggaggccaaggagggcggatca

SEQ ID NO: 7389998 - DNA, 22 bp, Homo sapiens
ggaggccaaggagggcggatca

SEQ ID NO: 7389999 - DNA, 22 bp, Homo sapiens
ggaggccaaggaggagcttgcc

SEQ ID NO: 7390000 - DNA, 22 bp, Homo sapiens
ggaggccaaggaggagcttgcc

SEQ ID NO: 7390001 - DNA, 22 bp, Homo sapiens
ggaggccaaggcaggcggatca

SEQ ID NO: 7390002 - DNA, 22 bp, Homo sapiens
ggaggccaaggagggcggatca

SEQ ID NO: 7390003 - DNA, 22 bp, Homo sapiens
ggaggccaaggagggcggatca

SEQ ID NO: 7390004 - DNA, 22 bp, Homo sapiens
ggaggccaaggaggagcttgcc

SEQ ID NO: 7390005 - DNA, 22 bp, Homo sapiens
ggaggccaaggaggagcttgcc

SEQ ID NO: 7390006 - DNA, 22 bp, Homo sapiens
ggaggccaaggaggagcttgcc

SEQ ID NO: 7390007 - DNA, 22 bp, Homo sapiens
ggaggccaaggaggagcttgcc

SEQ ID NO: 7390008 - DNA, 22 bp, Homo sapiens
ggaggccaaggcaggtggatca

SEQ ID NO: 7390009 - DNA, 22 bp, Homo sapiens
ggaggccaaggcaggcggatca

SEQ ID NO: 7390010 - DNA, 22 bp, Homo sapiens
ggaggccaaggcaggtggatca

SEQ ID NO: 7390011 - DNA, 22 bp, Homo sapiens
ggaggccaaggcaggcggatca

SEQ ID NO: 7390012 - DNA, 22 bp, Homo sapiens
ggaggccaaggcaggcggatca

SEQ ID NO: 7390013 - DNA, 20 bp, Homo sapiens
cacaggccttgtgagcagac

SEQ ID NO: 7390014 - DNA, 20 bp, Homo sapiens
cacaggctatatgagagcca

SEQ ID NO: 7390015 - DNA, 20 bp, Homo sapiens
cacaggctatatgagagcca

SEQ ID NO: 7390016 - DNA, 22 bp, Homo sapiens
ggaggcagaatagagtgtgggt

SEQ ID NO: 7390017 - DNA, 22 bp, Homo sapiens
ggaggcagaatagagtgtgggt

SEQ ID NO: 7390018 - DNA, 22 bp, Homo sapiens
ggaggcagaatagagtgtgggt

SEQ ID NO: 7390019 - DNA, 22 bp, Homo sapiens
ggaggcagaatagagtgtgggt

SEQ ID NO: 7390020 - DNA, 22 bp, Homo sapiens
cacaggagaaaggggaagctcg

SEQ ID NO: 7390021 - DNA, 22 bp, Homo sapiens
cacaggagaaaggggaagctcg

SEQ ID NO: 7390022 - DNA, 22 bp, Homo sapiens
cacaggagaaaggggaagctcg

SEQ ID NO: 7390023 - DNA, 22 bp, Homo sapiens
cacaggagaaaggggaagctcg

SEQ ID NO: 7390024 - DNA, 22 bp, Homo sapiens
cacaggagaaaggggaagctcg

SEQ ID NO: 7390025 - DNA, 22 bp, Homo sapiens
cacaggagaaaggggaagctcg

SEQ ID NO: 7390026 - DNA, 22 bp, Homo sapiens
ggaggcaggaaagacaggttca

SEQ ID NO: 7390027 - DNA, 22 bp, Homo sapiens
ggaggcaggaaagacaggttca

SEQ ID NO: 7390028 - DNA, 22 bp, Homo sapiens
ggaggcaggaaagacaggttca

SEQ ID NO: 7390029 - DNA, 22 bp, Homo sapiens
ggaggcaggaaagacaggttca

SEQ ID NO: 7390030 - DNA, 22 bp, Homo sapiens
ggaggcaggaaagacaggttca

SEQ ID NO: 7390031 - DNA, 22 bp, Homo sapiens
ggaggcagaatagagtgtgggt

SEQ ID NO: 7390032 - DNA, 22 bp, Homo sapiens
ggaggcagaatagagtgtgggt

SEQ ID NO: 7390033 - DNA, 22 bp, Homo sapiens
ggaggcagaatagagtgtgggt

SEQ ID NO: 7390034 - DNA, 22 bp, Homo sapiens
ggaggcagaatagagtgtgggt

SEQ ID NO: 7390035 - DNA, 22 bp, Homo sapiens
ggaggcagaatagagtgtgggt

SEQ ID NO: 7390036 - DNA, 22 bp, Homo sapiens
cacaggaatgaacagggaaaga

SEQ ID NO: 7390037 - DNA, 22 bp, Homo sapiens
cacaggaatgaacagggaaaga

SEQ ID NO: 7390038 - DNA, 22 bp, Homo sapiens
cacaggaatctgcattttgacc

SEQ ID NO: 7390039 - DNA, 22 bp, Homo sapiens
cacaggaatctgcattttgacc

SEQ ID NO: 7390040 - DNA, 22 bp, Homo sapiens
cacaggaattagcagcctaaaa

SEQ ID NO: 7390041 - DNA, 22 bp, Homo sapiens
cacaggaattagcagcctaaaa

SEQ ID NO: 7390042 - DNA, 22 bp, Homo sapiens
cacaggaattagcagcctaaaa

SEQ ID NO: 7390043 - DNA, 22 bp, Homo sapiens
cacaggaatgaacagggaaaga

SEQ ID NO: 7390044 - DNA, 22 bp, Homo sapiens
cacaggaatgaacagggaaaga

SEQ ID NO: 7390045 - DNA, 22 bp, Homo sapiens
cacaggaatgaacagggaaaga

SEQ ID NO: 7390046 - DNA, 22 bp, Homo sapiens
cacaggaattagcagcctaaaa

SEQ ID NO: 7390047 - DNA, 22 bp, Homo sapiens
cacaggaattagcagcctaaaa

SEQ ID NO: 7390048 - DNA, 22 bp, Homo sapiens
cacaggaattagcagcctaaaa

SEQ ID NO: 7390049 - DNA, 22 bp, Homo sapiens
cacaggaattagcagcctaaaa

SEQ ID NO: 7390050 - DNA, 22 bp, Homo sapiens
cacaggactcgactgcagacag

SEQ ID NO: 7390051 - DNA, 22 bp, Homo sapiens
cacaggactcgactgcagacag

SEQ ID NO: 7390052 - DNA, 22 bp, Homo sapiens
cacaggactcgactgcagacag

SEQ ID NO: 7390053 - DNA, 22 bp, Homo sapiens
cacaggactcgactgcagacag

SEQ ID NO: 7390054 - DNA, 18 bp, Homo sapiens
cacaggaaggggaatatc

SEQ ID NO: 7390055 - DNA, 18 bp, Homo sapiens
cacaggaaggggaatatc

SEQ ID NO: 7390056 - DNA, 18 bp, Homo sapiens
cacaggaaggggaatatc

SEQ ID NO: 7390057 - DNA, 22 bp, Homo sapiens
cacaggaagtggtcagtgccag

SEQ ID NO: 7390058 - DNA, 22 bp, Homo sapiens
cacaggaagtggtcagtgccag

SEQ ID NO: 7390059 - DNA, 22 bp, Homo sapiens
cacaggaagtggtcagtgccag

SEQ ID NO: 7390060 - DNA, 22 bp, Homo sapiens
cacaggaagtggtcagtgccag

SEQ ID NO: 7390061 - DNA, 22 bp, Homo sapiens
cacaggaagtggtcagtgccag

SEQ ID NO: 7390062 - DNA, 22 bp, Homo sapiens
cacaggaagtggtcagtgccag

SEQ ID NO: 7390063 - DNA, 22 bp, Homo sapiens
cacagctttgctttccttaata

SEQ ID NO: 7390064 - DNA, 22 bp, Homo sapiens
cacaggaaaaatgggtccttta

SEQ ID NO: 7390065 - DNA, 22 bp, Homo sapiens
cacaggaaggccttctcacaat

SEQ ID NO: 7390066 - DNA, 22 bp, Homo sapiens
cacaggaaggccttctcacaat

SEQ ID NO: 7390067 - DNA, 22 bp, Homo sapiens
cacagctttgctttccttaata

SEQ ID NO: 7390068 - DNA, 22 bp, Homo sapiens
cacagcttgtttagtgactcac

SEQ ID NO: 7390069 - DNA, 20 bp, Homo sapiens
ggagctggcatccagcctct

SEQ ID NO: 7390070 - DNA, 22 bp, Homo sapiens
cacaggaatcagcattaatggc

SEQ ID NO: 7390071 - DNA, 22 bp, Homo sapiens
cacaggaatcagcattaatggc

SEQ ID NO: 7390072 - DNA, 22 bp, Homo sapiens
cacaggaatcagcattaatggc

SEQ ID NO: 7390073 - DNA, 22 bp, Homo sapiens
cacaggaatcgtcacttagcgc

SEQ ID NO: 7390074 - DNA, 22 bp, Homo sapiens
cacaggaatcgtcacttagcgc

SEQ ID NO: 7390075 - DNA, 22 bp, Homo sapiens
cacaggaatcagcattaatggc

SEQ ID NO: 7390076 - DNA, 22 bp, Homo sapiens
cacaggaatctgcattttgacc

SEQ ID NO: 7390077 - DNA, 22 bp, Homo sapiens
cacaggaatctgcattttgacc

SEQ ID NO: 7390078 - DNA, 22 bp, Homo sapiens
cacaggaatcgtcacttagcgc

SEQ ID NO: 7390079 - DNA, 22 bp, Homo sapiens
cacaggaataagtcaaacttca

SEQ ID NO: 7390080 - DNA, 22 bp, Homo sapiens
cacaggaataagtcaaacttca

SEQ ID NO: 7390081 - DNA, 22 bp, Homo sapiens
cacaggaagtggtcagtgccag

SEQ ID NO: 7390082 - DNA, 22 bp, Homo sapiens
cacaggaataagtcaaacttca

SEQ ID NO: 7390083 - DNA, 22 bp, Homo sapiens
cacaggaagtggtcagtgccag

SEQ ID NO: 7390084 - DNA, 22 bp, Homo sapiens
cacaggaataagtcaaacttca

SEQ ID NO: 7390085 - DNA, 22 bp, Homo sapiens
cacaggaatataagtttgagtt

SEQ ID NO: 7390086 - DNA, 22 bp, Homo sapiens
cacaggaatataagtttgagtt

SEQ ID NO: 7390087 - DNA, 22 bp, Homo sapiens
cacaggaatataagtttgagtt

SEQ ID NO: 7390088 - DNA, 22 bp, Homo sapiens
cacaggaatataagtttgagtt

SEQ ID NO: 7390089 - DNA, 22 bp, Homo sapiens
cacaggaatataagtttgagtt

SEQ ID NO: 7390090 - DNA, 22 bp, Homo sapiens
gctggctgtatcacctggccag

SEQ ID NO: 7390091 - DNA, 22 bp, Homo sapiens
gctggctgtatcacctggccag

SEQ ID NO: 7390092 - DNA, 22 bp, Homo sapiens
gctggctggtccagcaggggct

SEQ ID NO: 7390093 - DNA, 22 bp, Homo sapiens
gctggctgtatcacctggccag

SEQ ID NO: 7390094 - DNA, 22 bp, Homo sapiens
gctggctgtatcacctggccag

SEQ ID NO: 7390095 - DNA, 22 bp, Homo sapiens
gctggctgtatcacctggccag

SEQ ID NO: 7390096 - DNA, 22 bp, Homo sapiens
gctggctgtatcacctggccag

SEQ ID NO: 7390097 - DNA, 22 bp, Homo sapiens
gctggctgtatcacctggccag

SEQ ID NO: 7390098 - DNA, 22 bp, Homo sapiens
gctggctgtatcacctggccag

SEQ ID NO: 7390099 - DNA, 22 bp, Homo sapiens
gctggctggtccagcaggggct

SEQ ID NO: 7390100 - DNA, 22 bp, Homo sapiens
gctggctggtccagcaggggct

SEQ ID NO: 7390101 - DNA, 22 bp, Homo sapiens
gctggctggtccagcaggggct

SEQ ID NO: 7390102 - DNA, 22 bp, Homo sapiens
gctggctggtccagcaggggct

SEQ ID NO: 7390103 - DNA, 22 bp, Homo sapiens
gctggctggtccagcaggggct

SEQ ID NO: 7390104 - DNA, 22 bp, Homo sapiens
gctggctgggtccctgagaggc

SEQ ID NO: 7390105 - DNA, 22 bp, Homo sapiens
gctggctgggtccctgagaggc

SEQ ID NO: 7390106 - DNA, 22 bp, Homo sapiens
gctggctggtccagcaggggct

SEQ ID NO: 7390107 - DNA, 22 bp, Homo sapiens
gctggctggtccagcaggggct

SEQ ID NO: 7390108 - DNA, 22 bp, Homo sapiens
gctggctggtccagcaggggct

SEQ ID NO: 7390109 - DNA, 22 bp, Homo sapiens
gctggctggtccagcaggggct

SEQ ID NO: 7390110 - DNA, 22 bp, Homo sapiens
gctggctgggtccctgagaggc

SEQ ID NO: 7390111 - DNA, 22 bp, Homo sapiens
gctggctgggtccctgagaggc

SEQ ID NO: 7390112 - DNA, 22 bp, Homo sapiens
gctggctgggtccctgagaggc

SEQ ID NO: 7390113 - DNA, 22 bp, Homo sapiens
gctggctgggtccctgagaggc

SEQ ID NO: 7390114 - DNA, 22 bp, Homo sapiens
gctggctggctgtgcaaaggca

SEQ ID NO: 7390115 - DNA, 22 bp, Homo sapiens
gctggctggctgtgcaaaggca

SEQ ID NO: 7390116 - DNA, 22 bp, Homo sapiens
gctggctggctgtgcaaaggca

SEQ ID NO: 7390117 - DNA, 22 bp, Homo sapiens
gctggctggctgtgcaaaggca

SEQ ID NO: 7390118 - DNA, 22 bp, Homo sapiens
gctggctggctgtgcaaaggca

SEQ ID NO: 7390119 - DNA, 22 bp, Homo sapiens
gctggctggctgtgcaaaggca

SEQ ID NO: 7390120 - DNA, 22 bp, Homo sapiens
gctggctggctgtgcaaaggca

SEQ ID NO: 7390121 - DNA, 22 bp, Homo sapiens
gctggctggctgtgcaaaggca

SEQ ID NO: 7390122 - DNA, 22 bp, Homo sapiens
caaggccttcttgggagagatt

SEQ ID NO: 7390123 - DNA, 22 bp, Homo sapiens
caaggccttcgtctcctagctt

SEQ ID NO: 7390124 - DNA, 20 bp, Homo sapiens
caaggcctggatctagttgc

SEQ ID NO: 7390125 - DNA, 22 bp, Homo sapiens
caaggccttcgtctcctagctt

SEQ ID NO: 7390126 - DNA, 22 bp, Homo sapiens
gctggctgggacagattccatt

SEQ ID NO: 7390127 - DNA, 22 bp, Homo sapiens
gctggctgggacagattccatt

SEQ ID NO: 7390128 - DNA, 22 bp, Homo sapiens
gctggctgggacagattccatt

SEQ ID NO: 7390129 - DNA, 22 bp, Homo sapiens
gctggctgggacagattccatt

SEQ ID NO: 7390130 - DNA, 22 bp, Homo sapiens
gctggctgggtccctgagaggc

SEQ ID NO: 7390131 - DNA, 22 bp, Homo sapiens
gctggctgggtccctgagaggc

SEQ ID NO: 7390132 - DNA, 22 bp, Homo sapiens
gctggctgggtccctgagaggc

SEQ ID NO: 7390133 - DNA, 22 bp, Homo sapiens
gctggctgggtccctgagaggc

SEQ ID NO: 7390134 - DNA, 22 bp, Homo sapiens
gctggctgggtccctgagaggc

SEQ ID NO: 7390135 - DNA, 22 bp, Homo sapiens
gctggctgggtccctgagaggc

SEQ ID NO: 7390136 - DNA, 22 bp, Homo sapiens
gctggctgggtccctgagaggc

SEQ ID NO: 7390137 - DNA, 22 bp, Homo sapiens
gctggctgggtccctgagaggc

SEQ ID NO: 7390138 - DNA, 22 bp, Homo sapiens
gctggctgggtccctgagaggc

SEQ ID NO: 7390139 - DNA, 21 bp, Homo sapiens
gctggctgtcccagggaagca

SEQ ID NO: 7390140 - DNA, 21 bp, Homo sapiens
gctggctgtcccagggaagca

SEQ ID NO: 7390141 - DNA, 21 bp, Homo sapiens
gctggctgtcccagggaagca

SEQ ID NO: 7390142 - DNA, 21 bp, Homo sapiens
gctggctgtcccagggaagca

SEQ ID NO: 7390143 - DNA, 21 bp, Homo sapiens
gctggctgtcccagggaagca

SEQ ID NO: 7390144 - DNA, 21 bp, Homo sapiens
gctggctgtcccagggaagca

SEQ ID NO: 7390145 - DNA, 22 bp, Homo sapiens
gctggctgtatcacctggccag

SEQ ID NO: 7390146 - DNA, 22 bp, Homo sapiens
gctggctgtatcacctggccag

SEQ ID NO: 7390147 - DNA, 22 bp, Homo sapiens
gctggctgtatcacctggccag

SEQ ID NO: 7390148 - DNA, 22 bp, Homo sapiens
gctggctgtatcacctggccag

SEQ ID NO: 7390149 - DNA, 22 bp, Homo sapiens
gctggctgtatcacctggccag

SEQ ID NO: 7390150 - DNA, 22 bp, Homo sapiens
caaggcttggagagaatgccat

SEQ ID NO: 7390151 - DNA, 20 bp, Homo sapiens
caaggcttctttgatggggt

SEQ ID NO: 7390152 - DNA, 22 bp, Homo sapiens
caaggcttgaattctgatgggt

SEQ ID NO: 7390153 - DNA, 22 bp, Homo sapiens
caaggcttggagagaatgccat

SEQ ID NO: 7390154 - DNA, 22 bp, Homo sapiens
caaggctttctcattatccttt

SEQ ID NO: 7390155 - DNA, 22 bp, Homo sapiens
caagggaagaggacagggacct

SEQ ID NO: 7390156 - DNA, 22 bp, Homo sapiens
caagggaagaggacagggacct

SEQ ID NO: 7390157 - DNA, 22 bp, Homo sapiens
caagggaagaggacagggacct

SEQ ID NO: 7390158 - DNA, 22 bp, Homo sapiens
caaggcttcacgtccccagtgc

SEQ ID NO: 7390159 - DNA, 22 bp, Homo sapiens
caaggcttcagtgtgacaaaac

SEQ ID NO: 7390160 - DNA, 21 bp, Homo sapiens
gctggctgtcccagggaagca

SEQ ID NO: 7390161 - DNA, 22 bp, Homo sapiens
caaggcttattttcctccttcc

SEQ ID NO: 7390162 - DNA, 22 bp, Homo sapiens
caaggcttcacgtccccagtgc

SEQ ID NO: 7390163 - DNA, 21 bp, Homo sapiens
gctggctgtcccagggaagca

SEQ ID NO: 7390164 - DNA, 21 bp, Homo sapiens
gctggctgtcccagggaagca

SEQ ID NO: 7390165 - DNA, 22 bp, Homo sapiens
caagggaagaggacagggacct

SEQ ID NO: 7390166 - DNA, 22 bp, Homo sapiens
caagggaagaggacagggacct

SEQ ID NO: 7390167 - DNA, 22 bp, Homo sapiens
caagggggcaggatcacacttg

SEQ ID NO: 7390168 - DNA, 22 bp, Homo sapiens
caaggggttcagaaagaggtga

SEQ ID NO: 7390169 - DNA, 22 bp, Homo sapiens
caagggtggtattgggagcata

SEQ ID NO: 7390170 - DNA, 22 bp, Homo sapiens
caagggtggtattgggagcata

SEQ ID NO: 7390171 - DNA, 22 bp, Homo sapiens
caagggtgaaggctcctccagg

SEQ ID NO: 7390172 - DNA, 22 bp, Homo sapiens
caagggtgaaggctcctccagg

SEQ ID NO: 7390173 - DNA, 19 bp, Homo sapiens
caagggtcatgacaggaac

SEQ ID NO: 7390174 - DNA, 22 bp, Homo sapiens
caagggtgaaggcagaggacat

SEQ ID NO: 7390175 - DNA, 19 bp, Homo sapiens
caagggtcatgacaggaac

SEQ ID NO: 7390176 - DNA, 22 bp, Homo sapiens
caagggtgaaggcagaggacat

SEQ ID NO: 7390177 - DNA, 22 bp, Homo sapiens
caagggttctgtgcctcctgct

SEQ ID NO: 7390178 - DNA, 22 bp, Homo sapiens
caagggttctgtgcctcctgct

SEQ ID NO: 7390179 - DNA, 22 bp, Homo sapiens
caagggtggtattgggagcata

SEQ ID NO: 7390180 - DNA, 22 bp, Homo sapiens
caagggtggtattgggagcata

SEQ ID NO: 7390181 - DNA, 22 bp, Homo sapiens
caagggtggtattgggagcata

SEQ ID NO: 7390182 - DNA, 22 bp, Homo sapiens
caagggtggtattgggagcata

SEQ ID NO: 7390183 - DNA, 19 bp, Homo sapiens
caagggttgggtctgtcat

SEQ ID NO: 7390184 - DNA, 19 bp, Homo sapiens
caagggttgggtctgtcat

SEQ ID NO: 7390185 - DNA, 20 bp, Homo sapiens
caagggtttgcattggcttt

SEQ ID NO: 7390186 - DNA, 20 bp, Homo sapiens
caagggtttgcattggcttt

SEQ ID NO: 7390187 - DNA, 20 bp, Homo sapiens
caagggtttgcattggcttt

SEQ ID NO: 7390188 - DNA, 20 bp, Homo sapiens
caagggtttgcattggcttt

SEQ ID NO: 7390189 - DNA, 22 bp, Homo sapiens
caaggcctaatcatactgctaa

SEQ ID NO: 7390190 - DNA, 22 bp, Homo sapiens
caaggcctaatcatactgctaa

SEQ ID NO: 7390191 - DNA, 22 bp, Homo sapiens
caaggccctgcaacctgacttg

SEQ ID NO: 7390192 - DNA, 22 bp, Homo sapiens
caaggccctgcaacctgacttg

SEQ ID NO: 7390193 - DNA, 22 bp, Homo sapiens
caaggccctgcaacctgacttg

SEQ ID NO: 7390194 - DNA, 22 bp, Homo sapiens
caaggccatgagcagcgagtgt

SEQ ID NO: 7390195 - DNA, 22 bp, Homo sapiens
caaggccatgagcagcgagtgt

SEQ ID NO: 7390196 - DNA, 22 bp, Homo sapiens
caaggccatgagcagcgagtgt

SEQ ID NO: 7390197 - DNA, 22 bp, Homo sapiens
caaggccatgagcagcgagtgt

SEQ ID NO: 7390198 - DNA, 22 bp, Homo sapiens
caaggccatattgcctgtatgt

SEQ ID NO: 7390199 - DNA, 22 bp, Homo sapiens
caaggccatattgcctgtatgt

SEQ ID NO: 7390200 - DNA, 22 bp, Homo sapiens
caaggcctgcctctggcagaaa

SEQ ID NO: 7390201 - DNA, 22 bp, Homo sapiens
caaggcctgcctctggcagaaa

SEQ ID NO: 7390202 - DNA, 22 bp, Homo sapiens
caaggcctgactgcttgtctaa

SEQ ID NO: 7390203 - DNA, 22 bp, Homo sapiens
caaggcctcctgggcccagaga

SEQ ID NO: 7390204 - DNA, 22 bp, Homo sapiens
caaggcctatgcacacctagga

SEQ ID NO: 7390205 - DNA, 22 bp, Homo sapiens
caaggcctatgcacacctagga

SEQ ID NO: 7390206 - DNA, 22 bp, Homo sapiens
caaggcctatgcacacctagga

SEQ ID NO: 7390207 - DNA, 22 bp, Homo sapiens
caaggccctgcaacctgacttg

SEQ ID NO: 7390208 - DNA, 22 bp, Homo sapiens
caaggccataagagatacaaaa

SEQ ID NO: 7390209 - DNA, 22 bp, Homo sapiens
caaggccataagagatacaaaa

SEQ ID NO: 7390210 - DNA, 22 bp, Homo sapiens
caaggccagtttctcctagtca

SEQ ID NO: 7390211 - DNA, 22 bp, Homo sapiens
caaggccataagagatacaaaa

SEQ ID NO: 7390212 - DNA, 22 bp, Homo sapiens
caaggccagtttctcctagtca

SEQ ID NO: 7390213 - DNA, 22 bp, Homo sapiens
caaggccagttcaccaagggca

SEQ ID NO: 7390214 - DNA, 22 bp, Homo sapiens
caaggccagttcaccaagggca

SEQ ID NO: 7390215 - DNA, 22 bp, Homo sapiens
caaggccagttcaccaagggca

SEQ ID NO: 7390216 - DNA, 22 bp, Homo sapiens
caaggccagttcaccaagggca

SEQ ID NO: 7390217 - DNA, 22 bp, Homo sapiens
caaggccagtccattttggaag

SEQ ID NO: 7390218 - DNA, 22 bp, Homo sapiens
caaggccagtccattttggaag

SEQ ID NO: 7390219 - DNA, 22 bp, Homo sapiens
caaggccagtccattttggaag

SEQ ID NO: 7390220 - DNA, 22 bp, Homo sapiens
caaggccagggaatttttctgg

SEQ ID NO: 7390221 - DNA, 22 bp, Homo sapiens
caaggccagggaatttttctgg

SEQ ID NO: 7390222 - DNA, 17 bp, Homo sapiens
caaggccagcatcttca

SEQ ID NO: 7390223 - DNA, 17 bp, Homo sapiens
caaggccagcatcttca

SEQ ID NO: 7390224 - DNA, 17 bp, Homo sapiens
caaggccagcatcttca

SEQ ID NO: 7390225 - DNA, 22 bp, Homo sapiens
caaggccagagccagcgataag

SEQ ID NO: 7390226 - DNA, 22 bp, Homo sapiens
caaggccagagccagcgataag

SEQ ID NO: 7390227 - DNA, 22 bp, Homo sapiens
caaggccagagccagcgataag

SEQ ID NO: 7390228 - DNA, 22 bp, Homo sapiens
caaggccactgctcaggtttcc

SEQ ID NO: 7390229 - DNA, 22 bp, Homo sapiens
caaggcaggaagcctgtcttat

SEQ ID NO: 7390230 - DNA, 22 bp, Homo sapiens
caaggcaggaagcctgtcttat

SEQ ID NO: 7390231 - DNA, 22 bp, Homo sapiens
caaggccaaggttttgtgaact

SEQ ID NO: 7390232 - DNA, 22 bp, Homo sapiens
caaggcagcttaatagaatttg

SEQ ID NO: 7390233 - DNA, 22 bp, Homo sapiens
caaggcaggaagcctgtcttat

SEQ ID NO: 7390234 - DNA, 19 bp, Homo sapiens
caaggccaccatttctccg

SEQ ID NO: 7390235 - DNA, 22 bp, Homo sapiens
caaggccaagtctctgtgaaga

SEQ ID NO: 7390236 - DNA, 22 bp, Homo sapiens
caaggccaagtctctgtgaaga

SEQ ID NO: 7390237 - DNA, 22 bp, Homo sapiens
caaggccaagtctctgtgaaga

SEQ ID NO: 7390238 - DNA, 22 bp, Homo sapiens
caaggccaagtctctgtgaaga

SEQ ID NO: 7390239 - DNA, 22 bp, Homo sapiens
caaggccaagtctctgtgaaga

SEQ ID NO: 7390240 - DNA, 22 bp, Homo sapiens
caaggccaaggttttgtgaact

SEQ ID NO: 7390241 - DNA, 22 bp, Homo sapiens
caaggccactgctcaggtttcc

SEQ ID NO: 7390242 - DNA, 22 bp, Homo sapiens
caaggccactccagagactggt

SEQ ID NO: 7390243 - DNA, 22 bp, Homo sapiens
caaggccacgttctgcatgcgg

SEQ ID NO: 7390244 - DNA, 22 bp, Homo sapiens
caaggccactccagagactggt

SEQ ID NO: 7390245 - DNA, 22 bp, Homo sapiens
caaggccactccagagactggt

SEQ ID NO: 7390246 - DNA, 22 bp, Homo sapiens
caaggccactccagagactggt

SEQ ID NO: 7390247 - DNA, 22 bp, Homo sapiens
caaggccactccagagactggt

SEQ ID NO: 7390248 - DNA, 22 bp, Homo sapiens
caaggccactccagagactggt

SEQ ID NO: 7390249 - DNA, 22 bp, Homo sapiens
caaggccacgttctgcatgcgg

SEQ ID NO: 7390250 - DNA, 19 bp, Homo sapiens
caaggccaccatttctccg

SEQ ID NO: 7390251 - DNA, 22 bp, Homo sapiens
caaggccactccagagactggt

SEQ ID NO: 7390252 - DNA, 22 bp, Homo sapiens
caaggccacgttctgcatgcgg

SEQ ID NO: 7390253 - DNA, 22 bp, Homo sapiens
gctggaggctggagtgcagtgg

SEQ ID NO: 7390254 - DNA, 22 bp, Homo sapiens
gctggaggcagttcagacacca

SEQ ID NO: 7390255 - DNA, 22 bp, Homo sapiens
gctggaggcagttcagacacca

SEQ ID NO: 7390256 - DNA, 22 bp, Homo sapiens
gctggaggcagttcagacacca

SEQ ID NO: 7390257 - DNA, 22 bp, Homo sapiens
gctggaggcagttcagacacca

SEQ ID NO: 7390258 - DNA, 22 bp, Homo sapiens
gctggaggcagttcagacacca

SEQ ID NO: 7390259 - DNA, 22 bp, Homo sapiens
gctggaggcagttcagacacca

SEQ ID NO: 7390260 - DNA, 22 bp, Homo sapiens
gctggaggcagttcagacacca

SEQ ID NO: 7390261 - DNA, 22 bp, Homo sapiens
caaggcaggaagcctgtcttat

SEQ ID NO: 7390262 - DNA, 22 bp, Homo sapiens
caaggcagcttaatagaatttg

SEQ ID NO: 7390263 - DNA, 22 bp, Homo sapiens
caaggcagcttaatagaatttg

SEQ ID NO: 7390264 - DNA, 22 bp, Homo sapiens
gctggaggctggagtgcagtgg

SEQ ID NO: 7390265 - DNA, 22 bp, Homo sapiens
gctggaggctggagtgcagtgg

SEQ ID NO: 7390266 - DNA, 22 bp, Homo sapiens
gctggaggctggagtgcagtgg

SEQ ID NO: 7390267 - DNA, 22 bp, Homo sapiens
caagatttaagagtcagccttg

SEQ ID NO: 7390268 - DNA, 22 bp, Homo sapiens
caagatttaagagtcagccttg

SEQ ID NO: 7390269 - DNA, 22 bp, Homo sapiens
caagattcagccctcctgacct

SEQ ID NO: 7390270 - DNA, 22 bp, Homo sapiens
caagattcattttgtccttgtc

SEQ ID NO: 7390271 - DNA, 22 bp, Homo sapiens
caagattctagttgaggttcaa

SEQ ID NO: 7390272 - DNA, 22 bp, Homo sapiens
caagcagccccaacatgaggat

SEQ ID NO: 7390273 - DNA, 22 bp, Homo sapiens
caagcagccccaacatgaggat

SEQ ID NO: 7390274 - DNA, 22 bp, Homo sapiens
caagcagccccaacatgaggat

SEQ ID NO: 7390275 - DNA, 22 bp, Homo sapiens
caagcagccccaacatgaggat

SEQ ID NO: 7390276 - DNA, 22 bp, Homo sapiens
caagcaggaggagaagtttctg

SEQ ID NO: 7390277 - DNA, 22 bp, Homo sapiens
caagcaggaggagaagtttctg

SEQ ID NO: 7390278 - DNA, 22 bp, Homo sapiens
caagcaggatgaagcccaggga

SEQ ID NO: 7390279 - DNA, 22 bp, Homo sapiens
caagcaggaggagaagtttctg

SEQ ID NO: 7390280 - DNA, 22 bp, Homo sapiens
caagcaggatgaagcccaggga

SEQ ID NO: 7390281 - DNA, 22 bp, Homo sapiens
caagcaggatgaagcccaggga

SEQ ID NO: 7390282 - DNA, 22 bp, Homo sapiens
caagcaggatgaagcccaggga

SEQ ID NO: 7390283 - DNA, 22 bp, Homo sapiens
caagcaggcctggctggaccgt

SEQ ID NO: 7390284 - DNA, 22 bp, Homo sapiens
caagcagggagcatcaagggag

SEQ ID NO: 7390285 - DNA, 22 bp, Homo sapiens
caagcaggcctggctggaccgt

SEQ ID NO: 7390286 - DNA, 22 bp, Homo sapiens
caagcaggcctggctggaccgt

SEQ ID NO: 7390287 - DNA, 22 bp, Homo sapiens
caagcagggagcatcaagggag

SEQ ID NO: 7390288 - DNA, 22 bp, Homo sapiens
caagcagggatactgcagggag

SEQ ID NO: 7390289 - DNA, 22 bp, Homo sapiens
caaatgtggtttctcagcattc

SEQ ID NO: 7390290 - DNA, 22 bp, Homo sapiens
caaatgtggtttctcagcattc

SEQ ID NO: 7390291 - DNA, 22 bp, Homo sapiens
caaatgtgtaaggaagtgttag

SEQ ID NO: 7390292 - DNA, 22 bp, Homo sapiens
caagattatcttcttcttgtta

SEQ ID NO: 7390293 - DNA, 22 bp, Homo sapiens
caaatgtgtaaggaagtgttag

SEQ ID NO: 7390294 - DNA, 22 bp, Homo sapiens
caagattatcttcttcttgtta

SEQ ID NO: 7390295 - DNA, 22 bp, Homo sapiens
caaatgtggtttctcagcattc

SEQ ID NO: 7390296 - DNA, 22 bp, Homo sapiens
caaatgtgacttttgggcttct

SEQ ID NO: 7390297 - DNA, 22 bp, Homo sapiens
caaatgtgacttttgggcttct

SEQ ID NO: 7390298 - DNA, 22 bp, Homo sapiens
caaatgtattctcacttcaggg

SEQ ID NO: 7390299 - DNA, 22 bp, Homo sapiens
caaatgtattctcacttcaggg

SEQ ID NO: 7390300 - DNA, 22 bp, Homo sapiens
caaatgtattctcacttcaggg

SEQ ID NO: 7390301 - DNA, 22 bp, Homo sapiens
caaatgtattctcacttcaggg

SEQ ID NO: 7390302 - DNA, 23 bp, Homo sapiens
caaatgtagtgtgtccacccctg

SEQ ID NO: 7390303 - DNA, 22 bp, Homo sapiens
caaatgtataaatgtactttct

SEQ ID NO: 7390304 - DNA, 22 bp, Homo sapiens
caaatgtataaatgtactttct

SEQ ID NO: 7390305 - DNA, 22 bp, Homo sapiens
caaatgtataaatgtactttct

SEQ ID NO: 7390306 - DNA, 22 bp, Homo sapiens
caaatgtaattgcggtttttgc

SEQ ID NO: 7390307 - DNA, 22 bp, Homo sapiens
caaatgtaattgcggtttttgc

SEQ ID NO: 7390308 - DNA, 22 bp, Homo sapiens
caaatgtatcagcccagggatt

SEQ ID NO: 7390309 - DNA, 22 bp, Homo sapiens
caaatgtatgttttcctatgta

SEQ ID NO: 7390310 - DNA, 22 bp, Homo sapiens
caaatgtataaatgtactttct

SEQ ID NO: 7390311 - DNA, 22 bp, Homo sapiens
caaatgtataaatgtactttct

SEQ ID NO: 7390312 - DNA, 22 bp, Homo sapiens
caaatgtatcagcccagggatt

SEQ ID NO: 7390313 - DNA, 22 bp, Homo sapiens
caaatgtaaattcttttgaagc

SEQ ID NO: 7390314 - DNA, 22 bp, Homo sapiens
caaatgtaaattcttttgaagc

SEQ ID NO: 7390315 - DNA, 22 bp, Homo sapiens
caaatggtcatttctcttttgt

SEQ ID NO: 7390316 - DNA, 22 bp, Homo sapiens
caaatgtaaattcttttgaagc

SEQ ID NO: 7390317 - DNA, 19 bp, Homo sapiens
caaatgggacaggaaggca

SEQ ID NO: 7390318 - DNA, 19 bp, Homo sapiens
caaatgggacaggaaggca

SEQ ID NO: 7390319 - DNA, 19 bp, Homo sapiens
caaatgggacaggaaggca

SEQ ID NO: 7390320 - DNA, 22 bp, Homo sapiens
caaatgtaataaggagtttccc

SEQ ID NO: 7390321 - DNA, 22 bp, Homo sapiens
caaatgtaaattcttttgaagc

SEQ ID NO: 7390322 - DNA, 22 bp, Homo sapiens
caaatgtaaattcttttgaagc

SEQ ID NO: 7390323 - DNA, 22 bp, Homo sapiens
caaatgtaatggcaggttttgc

SEQ ID NO: 7390324 - DNA, 22 bp, Homo sapiens
caaatgtaatggcaggttttgc

SEQ ID NO: 7390325 - DNA, 22 bp, Homo sapiens
caaatgtaatggcaggttttgc

SEQ ID NO: 7390326 - DNA, 22 bp, Homo sapiens
caagcatgtcttcttaagcaat

SEQ ID NO: 7390327 - DNA, 22 bp, Homo sapiens
caagcatactgtgagagtttta

SEQ ID NO: 7390328 - DNA, 22 bp, Homo sapiens
caagcatactgtgagagtttta

SEQ ID NO: 7390329 - DNA, 22 bp, Homo sapiens
caagcatgtcttcttaagcaat

SEQ ID NO: 7390330 - DNA, 22 bp, Homo sapiens
caagcatgtcttcttaagcaat

SEQ ID NO: 7390331 - DNA, 22 bp, Homo sapiens
caagcagggtttatgcatggag

SEQ ID NO: 7390332 - DNA, 22 bp, Homo sapiens
caagcagggatactgcagggag

SEQ ID NO: 7390333 - DNA, 22 bp, Homo sapiens
caagcagggatactgcagggag

SEQ ID NO: 7390334 - DNA, 22 bp, Homo sapiens
caagcagggatactgcagggag

SEQ ID NO: 7390335 - DNA, 22 bp, Homo sapiens
caagcagggatactgcagggag

SEQ ID NO: 7390336 - DNA, 22 bp, Homo sapiens
caagcagggagcatcaagggag

SEQ ID NO: 7390337 - DNA, 22 bp, Homo sapiens
caagcagggtttatgcatggag

SEQ ID NO: 7390338 - DNA, 22 bp, Homo sapiens
caagcaggtcctgaatctggtc

SEQ ID NO: 7390339 - DNA, 22 bp, Homo sapiens
caagcaggtttgctattttctt

SEQ ID NO: 7390340 - DNA, 22 bp, Homo sapiens
caagcaggtcctgaatctggtc

SEQ ID NO: 7390341 - DNA, 22 bp, Homo sapiens
caagcagtcagcctgaagactg

SEQ ID NO: 7390342 - DNA, 22 bp, Homo sapiens
caagccagtcagctcagtagat

SEQ ID NO: 7390343 - DNA, 22 bp, Homo sapiens
caagccagtgacagccagggaa

SEQ ID NO: 7390344 - DNA, 22 bp, Homo sapiens
caagccagtcagctcagtagat

SEQ ID NO: 7390345 - DNA, 22 bp, Homo sapiens
caagccaggtgaacataacaag

SEQ ID NO: 7390346 - DNA, 22 bp, Homo sapiens
caagccaggtgaacataacaag

SEQ ID NO: 7390347 - DNA, 20 bp, Homo sapiens
caagccaggccctgctgctg

SEQ ID NO: 7390348 - DNA, 22 bp, Homo sapiens
caagccagctcctgccacagag

SEQ ID NO: 7390349 - DNA, 22 bp, Homo sapiens
caagccagcttgatgacctgtc

SEQ ID NO: 7390350 - DNA, 22 bp, Homo sapiens
caagccagcttgatgacctgtc

SEQ ID NO: 7390351 - DNA, 22 bp, Homo sapiens
caagccagcttgatgacctgtc

SEQ ID NO: 7390352 - DNA, 22 bp, Homo sapiens
caagccagctcctgccacagag

SEQ ID NO: 7390353 - DNA, 22 bp, Homo sapiens
caagccagctcctgccacagag

SEQ ID NO: 7390354 - DNA, 22 bp, Homo sapiens
caagccagagagcaactgttct

SEQ ID NO: 7390355 - DNA, 22 bp, Homo sapiens
caagccagagagcaactgttct

SEQ ID NO: 7390356 - DNA, 22 bp, Homo sapiens
caagccagcagtttaatgactc

SEQ ID NO: 7390357 - DNA, 22 bp, Homo sapiens
gctggaggatggactggaagaa

SEQ ID NO: 7390358 - DNA, 22 bp, Homo sapiens
gctggaggatggactggaagaa

SEQ ID NO: 7390359 - DNA, 22 bp, Homo sapiens
gctggaggatggactggaagaa

SEQ ID NO: 7390360 - DNA, 22 bp, Homo sapiens
gctggaggatggactggaagaa

SEQ ID NO: 7390361 - DNA, 22 bp, Homo sapiens
gctggaggatcacttgagccca

SEQ ID NO: 7390362 - DNA, 22 bp, Homo sapiens
gctggaggatcacttgagccca

SEQ ID NO: 7390363 - DNA, 22 bp, Homo sapiens
gctggaggatggactggaagaa

SEQ ID NO: 7390364 - DNA, 22 bp, Homo sapiens
gctggaggatggactggaagaa

SEQ ID NO: 7390365 - DNA, 22 bp, Homo sapiens
gctggaggatggactggaagaa

SEQ ID NO: 7390366 - DNA, 22 bp, Homo sapiens
gctggaggatggactggaagaa

SEQ ID NO: 7390367 - DNA, 22 bp, Homo sapiens
caagccagtgacagccagggaa

SEQ ID NO: 7390368 - DNA, 22 bp, Homo sapiens
caagccagtgacagccagggaa

SEQ ID NO: 7390369 - DNA, 22 bp, Homo sapiens
caagccagtgacagccagggaa

SEQ ID NO: 7390370 - DNA, 22 bp, Homo sapiens
caagccagtgacagccagggaa

SEQ ID NO: 7390371 - DNA, 22 bp, Homo sapiens
caagccagtgatgtttgctgcc

SEQ ID NO: 7390372 - DNA, 22 bp, Homo sapiens
gctggaggaggaagtgtgaggg

SEQ ID NO: 7390373 - DNA, 22 bp, Homo sapiens
caagccagtttgtagttctctc

SEQ ID NO: 7390374 - DNA, 22 bp, Homo sapiens
caagccagtttgtagttctctc

SEQ ID NO: 7390375 - DNA, 22 bp, Homo sapiens
gctggaggatcacttgagccca

SEQ ID NO: 7390376 - DNA, 22 bp, Homo sapiens
gctggaggatcacttgagccca

SEQ ID NO: 7390377 - DNA, 22 bp, Homo sapiens
gctggaggaggaagtgtgaggg

SEQ ID NO: 7390378 - DNA, 22 bp, Homo sapiens
gctggaggaggaagtgtgaggg

SEQ ID NO: 7390379 - DNA, 22 bp, Homo sapiens
gctggaggaggaagtgtgaggg

SEQ ID NO: 7390380 - DNA, 22 bp, Homo sapiens
gctggaggaggaagtgtgaggg

SEQ ID NO: 7390381 - DNA, 22 bp, Homo sapiens
gctggaggaggaagtgtgaggg

SEQ ID NO: 7390382 - DNA, 21 bp, Homo sapiens
gctgttctttcagctggtctt

SEQ ID NO: 7390383 - DNA, 22 bp, Homo sapiens
gctgttctttcagcccagggct

SEQ ID NO: 7390384 - DNA, 22 bp, Homo sapiens
gctgttctttcagcccagggct

SEQ ID NO: 7390385 - DNA, 18 bp, Homo sapiens
gctgttcttcgcactggc

SEQ ID NO: 7390386 - DNA, 18 bp, Homo sapiens
gctgttcttcgcactggc

SEQ ID NO: 7390387 - DNA, 22 bp, Homo sapiens
gctgttctttcagcccagggct

SEQ ID NO: 7390388 - DNA, 22 bp, Homo sapiens
gctgttctttcagcccagggct

SEQ ID NO: 7390389 - DNA, 22 bp, Homo sapiens
gctgttctttggtcaaaggtat

SEQ ID NO: 7390390 - DNA, 22 bp, Homo sapiens
gctgttctttgcatctctggtg

SEQ ID NO: 7390391 - DNA, 22 bp, Homo sapiens
gctgttctttgcatctctggtg

SEQ ID NO: 7390392 - DNA, 21 bp, Homo sapiens
gctgttctttcagctggtctt

SEQ ID NO: 7390393 - DNA, 22 bp, Homo sapiens
caagtttaaggcactgataagt

SEQ ID NO: 7390394 - DNA, 20 bp, Homo sapiens
gctgttgccagtacagatgg

SEQ ID NO: 7390395 - DNA, 22 bp, Homo sapiens
caagtttaaggcactgataagt

SEQ ID NO: 7390396 - DNA, 22 bp, Homo sapiens
caagtttacaatgtgtatgtgt

SEQ ID NO: 7390397 - DNA, 22 bp, Homo sapiens
caagtttacaatgtgtatgtgt

SEQ ID NO: 7390398 - DNA, 22 bp, Homo sapiens
caagtttacaatgtgtatgtgt

SEQ ID NO: 7390399 - DNA, 21 bp, Homo sapiens
gctgttgcccgccgcctcttc

SEQ ID NO: 7390400 - DNA, 22 bp, Homo sapiens
gctgttctttggtcaaaggtat

SEQ ID NO: 7390401 - DNA, 22 bp, Homo sapiens
gctgttctttggtcaaaggtat

SEQ ID NO: 7390402 - DNA, 22 bp, Homo sapiens
gctgttgcaatcaaggccatgg

SEQ ID NO: 7390403 - DNA, 22 bp, Homo sapiens
gctgttctccgatgaccccgtg

SEQ ID NO: 7390404 - DNA, 22 bp, Homo sapiens
gctgttctaggagctgtgagca

SEQ ID NO: 7390405 - DNA, 22 bp, Homo sapiens
gctgttctaggagctgtgagca

SEQ ID NO: 7390406 - DNA, 22 bp, Homo sapiens
gctgttctaggagctgtgagca

SEQ ID NO: 7390407 - DNA, 22 bp, Homo sapiens
gctgttctagcttcagtttcgc

SEQ ID NO: 7390408 - DNA, 22 bp, Homo sapiens
gctgttctagcttcagtttcgc

SEQ ID NO: 7390409 - DNA, 19 bp, Homo sapiens
gctgttctgaccatcaccc

SEQ ID NO: 7390410 - DNA, 20 bp, Homo sapiens
gctgttctgaagcagaaggc

SEQ ID NO: 7390411 - DNA, 20 bp, Homo sapiens
gctgttctgaagcagaaggc

SEQ ID NO: 7390412 - DNA, 20 bp, Homo sapiens
gctgttctgaagcagaaggc

SEQ ID NO: 7390413 - DNA, 22 bp, Homo sapiens
gctgttctctgtaacatgcatt

SEQ ID NO: 7390414 - DNA, 22 bp, Homo sapiens
gctgttctaggagctgtgagca

SEQ ID NO: 7390415 - DNA, 22 bp, Homo sapiens
gctgttctctgtaacatgcatt

SEQ ID NO: 7390416 - DNA, 22 bp, Homo sapiens
gctgttctgtccccatgggtaa

SEQ ID NO: 7390417 - DNA, 22 bp, Homo sapiens
gctgttctgtccccatgggtaa

SEQ ID NO: 7390418 - DNA, 22 bp, Homo sapiens
gctgttctgtccccatgggtaa

SEQ ID NO: 7390419 - DNA, 22 bp, Homo sapiens
gctgttctgtccccatgggtaa

SEQ ID NO: 7390420 - DNA, 22 bp, Homo sapiens
gctgttctgcgtcccaggctgg

SEQ ID NO: 7390421 - DNA, 22 bp, Homo sapiens
gctgttctgcgtcccaggctgg

SEQ ID NO: 7390422 - DNA, 22 bp, Homo sapiens
gctgttctgcgtcccaggctgg

SEQ ID NO: 7390423 - DNA, 22 bp, Homo sapiens
gctgttctgcaccagacttcag

SEQ ID NO: 7390424 - DNA, 20 bp, Homo sapiens
gctgttctgaagcagaaggc

SEQ ID NO: 7390425 - DNA, 22 bp, Homo sapiens
gctgttctgcaccagacttcag

SEQ ID NO: 7390426 - DNA, 19 bp, Homo sapiens
gctgttctgaccatcaccc

SEQ ID NO: 7390427 - DNA, 19 bp, Homo sapiens
gctgttctgaccatcaccc

SEQ ID NO: 7390428 - DNA, 22 bp, Homo sapiens
caagtcaactcaaattgttatc

SEQ ID NO: 7390429 - DNA, 22 bp, Homo sapiens
caagtcaaagactagaactagt

SEQ ID NO: 7390430 - DNA, 22 bp, Homo sapiens
caagtcaactcaaattgttatc

SEQ ID NO: 7390431 - DNA, 22 bp, Homo sapiens
caagtatttgcggagttccacg

SEQ ID NO: 7390432 - DNA, 22 bp, Homo sapiens
caagtatttgcggagttccacg

SEQ ID NO: 7390433 - DNA, 22 bp, Homo sapiens
caagtattttaaggactagtgg

SEQ ID NO: 7390434 - DNA, 22 bp, Homo sapiens
caagtattttaaggactagtgg

SEQ ID NO: 7390435 - DNA, 22 bp, Homo sapiens
caagtcaaagactagaactagt

SEQ ID NO: 7390436 - DNA, 22 bp, Homo sapiens
caagtcaaagactagaactagt

SEQ ID NO: 7390437 - DNA, 22 bp, Homo sapiens
caagtcaatacctgtggacaaa

SEQ ID NO: 7390438 - DNA, 22 bp, Homo sapiens
caagtcaagcatgcccttattt

SEQ ID NO: 7390439 - DNA, 22 bp, Homo sapiens
caagtcaatgattataagagtc

SEQ ID NO: 7390440 - DNA, 22 bp, Homo sapiens
caagtcaatgattataagagtc

SEQ ID NO: 7390441 - DNA, 22 bp, Homo sapiens
caagtcaatgattataagagtc

SEQ ID NO: 7390442 - DNA, 22 bp, Homo sapiens
gctgtggcctggcgcagagctg

SEQ ID NO: 7390443 - DNA, 22 bp, Homo sapiens
gctgtggcggcagcagctggtg

SEQ ID NO: 7390444 - DNA, 22 bp, Homo sapiens
gctgtggcggcagcagctggtg

SEQ ID NO: 7390445 - DNA, 22 bp, Homo sapiens
gctgttcatagaaatggtctca

SEQ ID NO: 7390446 - DNA, 22 bp, Homo sapiens
gctgttcattagaaatagaatg

SEQ ID NO: 7390447 - DNA, 22 bp, Homo sapiens
gctgttcagggcactcatgggc

SEQ ID NO: 7390448 - DNA, 22 bp, Homo sapiens
gctgttcagatgcgattcagga

SEQ ID NO: 7390449 - DNA, 22 bp, Homo sapiens
gctgttcattagaaatagaatg

SEQ ID NO: 7390450 - DNA, 21 bp, Homo sapiens
gctgttcccaatcctgggctg

SEQ ID NO: 7390451 - DNA, 22 bp, Homo sapiens
gctgttcccttgtgcctctgtc

SEQ ID NO: 7390452 - DNA, 22 bp, Homo sapiens
gctgttcacggaggaggatggg

SEQ ID NO: 7390453 - DNA, 22 bp, Homo sapiens
gctgttcacagactctgctctg

SEQ ID NO: 7390454 - DNA, 22 bp, Homo sapiens
gctgtggcggcagcagctggtg

SEQ ID NO: 7390455 - DNA, 22 bp, Homo sapiens
gctgtgttttatgttaggttaa

SEQ ID NO: 7390456 - DNA, 19 bp, Homo sapiens
gctgttaaggaccctcgga

SEQ ID NO: 7390457 - DNA, 19 bp, Homo sapiens
gctgttaaggaccctcgga

SEQ ID NO: 7390458 - DNA, 22 bp, Homo sapiens
gctgttagtcagtggatgcccc

SEQ ID NO: 7390459 - DNA, 22 bp, Homo sapiens
caaggtgaacttgctgtacagc

SEQ ID NO: 7390460 - DNA, 22 bp, Homo sapiens
caaggtgaacttgctgtacagc

SEQ ID NO: 7390461 - DNA, 22 bp, Homo sapiens
caaggtgaacttgctgtacagc

SEQ ID NO: 7390462 - DNA, 22 bp, Homo sapiens
caaggtgccatgctgggcgggg

SEQ ID NO: 7390463 - DNA, 22 bp, Homo sapiens
caaggtgccatgctgggcgggg

SEQ ID NO: 7390464 - DNA, 22 bp, Homo sapiens
caaggtgccatgctgggcgggg

SEQ ID NO: 7390465 - DNA, 22 bp, Homo sapiens
caaggtgccatgctgggcgggg

SEQ ID NO: 7390466 - DNA, 22 bp, Homo sapiens
caaggtgccatgctgggcgggg

SEQ ID NO: 7390467 - DNA, 22 bp, Homo sapiens
caaggtgccatgctgggcgggg

SEQ ID NO: 7390468 - DNA, 22 bp, Homo sapiens
caaggtgcagctggctgtgtga

SEQ ID NO: 7390469 - DNA, 22 bp, Homo sapiens
caaggtgattgggatagctggt

SEQ ID NO: 7390470 - DNA, 22 bp, Homo sapiens
caaggtgcagctggctgtgtga

SEQ ID NO: 7390471 - DNA, 22 bp, Homo sapiens
caaggtcacataacttgtcaaa

SEQ ID NO: 7390472 - DNA, 22 bp, Homo sapiens
caaggtagagaaggatttgatt

SEQ ID NO: 7390473 - DNA, 20 bp, Homo sapiens
caagggtttgcattggcttt

SEQ ID NO: 7390474 - DNA, 22 bp, Homo sapiens
caaggtctggttcctctgggtg

SEQ ID NO: 7390475 - DNA, 22 bp, Homo sapiens
caaggtctggttcctctgggtg

SEQ ID NO: 7390476 - DNA, 22 bp, Homo sapiens
caaggtcacataacttgtcaaa

SEQ ID NO: 7390477 - DNA, 22 bp, Homo sapiens
caaggtcccagcccctcttggc

SEQ ID NO: 7390478 - DNA, 22 bp, Homo sapiens
caaggtcccagcccctcttggc

SEQ ID NO: 7390479 - DNA, 22 bp, Homo sapiens
caaggtcacataacttgtcaaa

SEQ ID NO: 7390480 - DNA, 22 bp, Homo sapiens
caaggtcacataacttgtcaaa

SEQ ID NO: 7390481 - DNA, 22 bp, Homo sapiens
caaggtgccatgctgggcgggg

SEQ ID NO: 7390482 - DNA, 22 bp, Homo sapiens
caaggtttacattgggctatca

SEQ ID NO: 7390483 - DNA, 22 bp, Homo sapiens
caaggttctatagcaaaatctg

SEQ ID NO: 7390484 - DNA, 22 bp, Homo sapiens
caaggtgccatgctgggcgggg

SEQ ID NO: 7390485 - DNA, 22 bp, Homo sapiens
caaggtgccatgctgggcgggg

SEQ ID NO: 7390486 - DNA, 22 bp, Homo sapiens
caaggtgccatgctgggcgggg

SEQ ID NO: 7390487 - DNA, 22 bp, Homo sapiens
caaggtttactttatgatccag

SEQ ID NO: 7390488 - DNA, 22 bp, Homo sapiens
caaggttctatagcaaaatctg

SEQ ID NO: 7390489 - DNA, 22 bp, Homo sapiens
caaggtttcgagttcccaacca

SEQ ID NO: 7390490 - DNA, 22 bp, Homo sapiens
caaggtttctatgctcaaagga

SEQ ID NO: 7390491 - DNA, 22 bp, Homo sapiens
caaggtttgaaaacgccatggc

SEQ ID NO: 7390492 - DNA, 22 bp, Homo sapiens
caaggttttgcttgtaagggaa

SEQ ID NO: 7390493 - DNA, 22 bp, Homo sapiens
caaggttttggaagattttcgt

SEQ ID NO: 7390494 - DNA, 22 bp, Homo sapiens
caagtaaagaatcacatttctt

SEQ ID NO: 7390495 - DNA, 22 bp, Homo sapiens
caagtaaagaatcacatttctt

SEQ ID NO: 7390496 - DNA, 22 bp, Homo sapiens
caagtaaatgtgaactggaagg

SEQ ID NO: 7390497 - DNA, 22 bp, Homo sapiens
caagtaaagaatcacatttctt

SEQ ID NO: 7390498 - DNA, 22 bp, Homo sapiens
caagtaaatgtgaactggaagg

SEQ ID NO: 7390499 - DNA, 22 bp, Homo sapiens
caagtaacttgattaaggtaag

SEQ ID NO: 7390500 - DNA, 22 bp, Homo sapiens
caagtaaacaatatgtgattca

SEQ ID NO: 7390501 - DNA, 22 bp, Homo sapiens
caagtaaacaatatgtgattca

SEQ ID NO: 7390502 - DNA, 22 bp, Homo sapiens
caagtaaacaatatgtgattca

SEQ ID NO: 7390503 - DNA, 22 bp, Homo sapiens
caagtacaaaatgatatttagt

SEQ ID NO: 7390504 - DNA, 22 bp, Homo sapiens
caagtacaaaatgatatttagt

SEQ ID NO: 7390505 - DNA, 22 bp, Homo sapiens
caagtacaaaatgatatttagt

SEQ ID NO: 7390506 - DNA, 22 bp, Homo sapiens
caagtacaaaatgatatttagt

SEQ ID NO: 7390507 - DNA, 22 bp, Homo sapiens
caagtacaaaatgatatttagt

SEQ ID NO: 7390508 - DNA, 22 bp, Homo sapiens
caagtacaaaatgatatttagt

SEQ ID NO: 7390509 - DNA, 22 bp, Homo sapiens
caagtacaaaatgatatttagt

SEQ ID NO: 7390510 - DNA, 22 bp, Homo sapiens
caagtacaaaatgatatttagt

SEQ ID NO: 7390511 - DNA, 22 bp, Homo sapiens
caagtaattctgcaagaaacca

SEQ ID NO: 7390512 - DNA, 22 bp, Homo sapiens
caagtaatggttttataatagt

SEQ ID NO: 7390513 - DNA, 22 bp, Homo sapiens
caagtaattctgcaagaaacca

SEQ ID NO: 7390514 - DNA, 22 bp, Homo sapiens
caagtaatggttttataatagt

SEQ ID NO: 7390515 - DNA, 22 bp, Homo sapiens
caagtaatggttttataatagt

SEQ ID NO: 7390516 - DNA, 22 bp, Homo sapiens
caagtaacttgattaaggtaag

SEQ ID NO: 7390517 - DNA, 22 bp, Homo sapiens
caagtatatttgaacatgtaaa

SEQ ID NO: 7390518 - DNA, 18 bp, Homo sapiens
caagtatagaattaggtt

SEQ ID NO: 7390519 - DNA, 18 bp, Homo sapiens
caagtatagaattaggtt

SEQ ID NO: 7390520 - DNA, 22 bp, Homo sapiens
caagtatatttgaacatgtaaa

SEQ ID NO: 7390521 - DNA, 22 bp, Homo sapiens
caagtatatttgaacatgtaaa

SEQ ID NO: 7390522 - DNA, 22 bp, Homo sapiens
caagtatgagaaagctattacc

SEQ ID NO: 7390523 - DNA, 22 bp, Homo sapiens
caagtattctgtaaaaagtcaa

SEQ ID NO: 7390524 - DNA, 22 bp, Homo sapiens
caagtatttcctgatggcctgt

SEQ ID NO: 7390525 - DNA, 22 bp, Homo sapiens
caagtagagattacagtgtgca

SEQ ID NO: 7390526 - DNA, 22 bp, Homo sapiens
caagtactttgaaaagttgaat

SEQ ID NO: 7390527 - DNA, 22 bp, Homo sapiens
caagtagaacagagctaccttg

SEQ ID NO: 7390528 - DNA, 22 bp, Homo sapiens
caagtagaaggatgtgattgta

SEQ ID NO: 7390529 - DNA, 22 bp, Homo sapiens
caagtacaatagctctggaact

SEQ ID NO: 7390530 - DNA, 22 bp, Homo sapiens
caagtactgtgatagctgaagt

SEQ ID NO: 7390531 - DNA, 22 bp, Homo sapiens
caagtactttgaaaagttgaat

SEQ ID NO: 7390532 - DNA, 22 bp, Homo sapiens
caagtacaatagctctggaact

SEQ ID NO: 7390533 - DNA, 22 bp, Homo sapiens
caagtacaagggtgtcagttta

SEQ ID NO: 7390534 - DNA, 22 bp, Homo sapiens
caagtacaagggtgtcagttta

SEQ ID NO: 7390535 - DNA, 22 bp, Homo sapiens
caagtacaatagctctggaact

SEQ ID NO: 7390536 - DNA, 22 bp, Homo sapiens
caagtacaatagctctggaact

SEQ ID NO: 7390537 - DNA, 22 bp, Homo sapiens
gctttgaagacttttccagggt

SEQ ID NO: 7390538 - DNA, 22 bp, Homo sapiens
gctttcttgctgcatggtggct

SEQ ID NO: 7390539 - DNA, 22 bp, Homo sapiens
gctttcttgctgcatggtggct

SEQ ID NO: 7390540 - DNA, 22 bp, Homo sapiens
gctttcttatttagaagatttg

SEQ ID NO: 7390541 - DNA, 22 bp, Homo sapiens
gctttcttcatactcaagcatc

SEQ ID NO: 7390542 - DNA, 21 bp, Homo sapiens
gctttgatgctgccttgctcc

SEQ ID NO: 7390543 - DNA, 22 bp, Homo sapiens
gctttgaagtctgtgtcttttg

SEQ ID NO: 7390544 - DNA, 22 bp, Homo sapiens
gctttgaagacttttccagggt

SEQ ID NO: 7390545 - DNA, 22 bp, Homo sapiens
gctttgattcttggcttatcag

SEQ ID NO: 7390546 - DNA, 22 bp, Homo sapiens
gctttgcacagtgctgtgttaa

SEQ ID NO: 7390547 - DNA, 22 bp, Homo sapiens
gctttgcccaagggccctaccc

SEQ ID NO: 7390548 - DNA, 22 bp, Homo sapiens
gctttgcctcttctccttccag

SEQ ID NO: 7390549 - DNA, 22 bp, Homo sapiens
gctttgcattgtttaatcagga

SEQ ID NO: 7390550 - DNA, 18 bp, Homo sapiens
gctttgcagaaatacaga

SEQ ID NO: 7390551 - DNA, 18 bp, Homo sapiens
gctttgcagaaatacaga

SEQ ID NO: 7390552 - DNA, 18 bp, Homo sapiens
gctttgcagaaatacaga

SEQ ID NO: 7390553 - DNA, 22 bp, Homo sapiens
gctttgcactccagctgtggcc

SEQ ID NO: 7390554 - DNA, 22 bp, Homo sapiens
caatgtatcaagaagcatcagt

SEQ ID NO: 7390555 - DNA, 22 bp, Homo sapiens
caatgtcaaggagaccaaaacg

SEQ ID NO: 7390556 - DNA, 22 bp, Homo sapiens
gctttgcctgtagcattggcct

SEQ ID NO: 7390557 - DNA, 22 bp, Homo sapiens
caatgtatcaagaagcatcagt

SEQ ID NO: 7390558 - DNA, 22 bp, Homo sapiens
caatgtatcaagaagcatcagt

SEQ ID NO: 7390559 - DNA, 22 bp, Homo sapiens
gctttgctagcactgcgcttcc

SEQ ID NO: 7390560 - DNA, 22 bp, Homo sapiens
gctttgctagcactgcgcttcc

SEQ ID NO: 7390561 - DNA, 22 bp, Homo sapiens
caatgtcaaggagaccaaaacg

SEQ ID NO: 7390562 - DNA, 22 bp, Homo sapiens
caatgtcagaattacagttgat

SEQ ID NO: 7390563 - DNA, 22 bp, Homo sapiens
caatgtctagtttcccaaatcc

SEQ ID NO: 7390564 - DNA, 22 bp, Homo sapiens
caatgtcatgattttccattag

SEQ ID NO: 7390565 - DNA, 22 bp, Homo sapiens
caatgtctgaccgttttgccca

SEQ ID NO: 7390566 - DNA, 21 bp, Homo sapiens
caatgtctgctctctgcctag

SEQ ID NO: 7390567 - DNA, 22 bp, Homo sapiens
caatgtctgaccgttttgccca

SEQ ID NO: 7390568 - DNA, 22 bp, Homo sapiens
caatgtcagtcaagcagcaaat

SEQ ID NO: 7390569 - DNA, 22 bp, Homo sapiens
caatgtcagagaagctcatatc

SEQ ID NO: 7390570 - DNA, 22 bp, Homo sapiens
caatgtcatgattttccattag

SEQ ID NO: 7390571 - DNA, 22 bp, Homo sapiens
caatgtgtgcttacaggccagt

SEQ ID NO: 7390572 - DNA, 22 bp, Homo sapiens
caatgtgtgcttacaggccagt

SEQ ID NO: 7390573 - DNA, 22 bp, Homo sapiens
caatgtgtcaggaaaagggcca

SEQ ID NO: 7390574 - DNA, 22 bp, Homo sapiens
caatgtgtgtgtttttctcaac

SEQ ID NO: 7390575 - DNA, 22 bp, Homo sapiens
caatgtgtttgcatattaaaat

SEQ ID NO: 7390576 - DNA, 22 bp, Homo sapiens
caatgtgtgtgtttttctcaac

SEQ ID NO: 7390577 - DNA, 21 bp, Homo sapiens
caatgtctgctctctgcctag

SEQ ID NO: 7390578 - DNA, 21 bp, Homo sapiens
caatgtctgctctctgcctag

SEQ ID NO: 7390579 - DNA, 21 bp, Homo sapiens
caatgtctgctctctgcctag

SEQ ID NO: 7390580 - DNA, 22 bp, Homo sapiens
caatgtctgggagacctgtgat

SEQ ID NO: 7390581 - DNA, 22 bp, Homo sapiens
caatgtctgggagacctgtgat

SEQ ID NO: 7390582 - DNA, 22 bp, Homo sapiens
caatgtcttctatagttactca

SEQ ID NO: 7390583 - DNA, 22 bp, Homo sapiens
caatgttccctgtactgctttt

SEQ ID NO: 7390584 - DNA, 22 bp, Homo sapiens
caatgttccctgtactgctttt

SEQ ID NO: 7390585 - DNA, 22 bp, Homo sapiens
caatgtgtttgcatattaaaat

SEQ ID NO: 7390586 - DNA, 22 bp, Homo sapiens
caatgtttgtgatctactgact

SEQ ID NO: 7390587 - DNA, 22 bp, Homo sapiens
caataaagaagatttttgcaat

SEQ ID NO: 7390588 - DNA, 22 bp, Homo sapiens
caataaagaagatttttgcaat

SEQ ID NO: 7390589 - DNA, 22 bp, Homo sapiens
caataaagaagatttttgcaat

SEQ ID NO: 7390590 - DNA, 22 bp, Homo sapiens
caataaagaagatttttgcaat

SEQ ID NO: 7390591 - DNA, 22 bp, Homo sapiens
caataaagaagatttttgcaat

SEQ ID NO: 7390592 - DNA, 22 bp, Homo sapiens
caataaagaagatttttgcaat

SEQ ID NO: 7390593 - DNA, 21 bp, Homo sapiens
caataaactgcacattgagac

SEQ ID NO: 7390594 - DNA, 22 bp, Homo sapiens
caataaagtggaggcccgggct

SEQ ID NO: 7390595 - DNA, 22 bp, Homo sapiens
caataaagtggaggcccgggct

SEQ ID NO: 7390596 - DNA, 22 bp, Homo sapiens
caataactagtaattattccgg

SEQ ID NO: 7390597 - DNA, 22 bp, Homo sapiens
caataactgctaaattccctgt

SEQ ID NO: 7390598 - DNA, 21 bp, Homo sapiens
caataaactgcacattgagac

SEQ ID NO: 7390599 - DNA, 21 bp, Homo sapiens
caataaactgcacattgagac

SEQ ID NO: 7390600 - DNA, 22 bp, Homo sapiens
caagttttgcatagttctgtat

SEQ ID NO: 7390601 - DNA, 22 bp, Homo sapiens
caagttttgcatagttctgtat

SEQ ID NO: 7390602 - DNA, 22 bp, Homo sapiens
caagttttgattttgcagtaaa

SEQ ID NO: 7390603 - DNA, 22 bp, Homo sapiens
caagttttgattttgcagtaaa

SEQ ID NO: 7390604 - DNA, 22 bp, Homo sapiens
caagttttgattttgcagtaaa

SEQ ID NO: 7390605 - DNA, 22 bp, Homo sapiens
caagttttgattttgcagtaaa

SEQ ID NO: 7390606 - DNA, 22 bp, Homo sapiens
caagttttgattttgcagtaaa

SEQ ID NO: 7390607 - DNA, 22 bp, Homo sapiens
caagttttgcatagttctgtat

SEQ ID NO: 7390608 - DNA, 22 bp, Homo sapiens
caagttttagcaagtggaaagg

SEQ ID NO: 7390609 - DNA, 22 bp, Homo sapiens
caagttttagaaatatctggat

SEQ ID NO: 7390610 - DNA, 22 bp, Homo sapiens
caagttttagaaatatctggat

SEQ ID NO: 7390611 - DNA, 22 bp, Homo sapiens
caagttttagaaatatctggat

SEQ ID NO: 7390612 - DNA, 22 bp, Homo sapiens
caagttttagaaatatctggat

SEQ ID NO: 7390613 - DNA, 22 bp, Homo sapiens
caagttttgattttgcagtaaa

SEQ ID NO: 7390614 - DNA, 22 bp, Homo sapiens
caagttttctgggttcagagca

SEQ ID NO: 7390615 - DNA, 22 bp, Homo sapiens
caagttttctgggttcagagca

SEQ ID NO: 7390616 - DNA, 22 bp, Homo sapiens
caagttttagcaagtggaaagg

SEQ ID NO: 7390617 - DNA, 22 bp, Homo sapiens
caagttttagcaagtggaaagg

SEQ ID NO: 7390618 - DNA, 22 bp, Homo sapiens
caagttttctgggttcagagca

SEQ ID NO: 7390619 - DNA, 22 bp, Homo sapiens
caagttttctgggttcagagca

SEQ ID NO: 7390620 - DNA, 22 bp, Homo sapiens
caagttttctgggttcagagca

SEQ ID NO: 7390621 - DNA, 22 bp, Homo sapiens
caagtttacaatgtgtatgtgt

SEQ ID NO: 7390622 - DNA, 22 bp, Homo sapiens
caagtttactactacctgtgtg

SEQ ID NO: 7390623 - DNA, 22 bp, Homo sapiens
caagtttgctgatccttgtttt

SEQ ID NO: 7390624 - DNA, 22 bp, Homo sapiens
caagtttgctgatccttgtttt

SEQ ID NO: 7390625 - DNA, 22 bp, Homo sapiens
caagtttgctgatccttgtttt

SEQ ID NO: 7390626 - DNA, 22 bp, Homo sapiens
caagtttagtcatggtggtagt

SEQ ID NO: 7390627 - DNA, 22 bp, Homo sapiens
caagtttggattatgaaaaagt

SEQ ID NO: 7390628 - DNA, 22 bp, Homo sapiens
caagtttggattatgaaaaagt

SEQ ID NO: 7390629 - DNA, 22 bp, Homo sapiens
caagtttgtgttctatcattct

SEQ ID NO: 7390630 - DNA, 22 bp, Homo sapiens
caagtttgtgttctatcattct

SEQ ID NO: 7390631 - DNA, 22 bp, Homo sapiens
caagtttgtgttctatcattct

SEQ ID NO: 7390632 - DNA, 22 bp, Homo sapiens
caagttttagaaatatctggat

SEQ ID NO: 7390633 - DNA, 17 bp, Homo sapiens
gcttgggctgcctgttg

SEQ ID NO: 7390634 - DNA, 22 bp, Homo sapiens
caataactgctgaggagaagca

SEQ ID NO: 7390635 - DNA, 22 bp, Homo sapiens
caataactgctgaggagaagca

SEQ ID NO: 7390636 - DNA, 22 bp, Homo sapiens
caataactttgatattttgcgg

SEQ ID NO: 7390637 - DNA, 22 bp, Homo sapiens
caataactttgatattttgcgg

SEQ ID NO: 7390638 - DNA, 22 bp, Homo sapiens
gcttggggagctcagtgtcctt

SEQ ID NO: 7390639 - DNA, 22 bp, Homo sapiens
gcttggggagctcagtgtcctt

SEQ ID NO: 7390640 - DNA, 22 bp, Homo sapiens
gcttggggagctcagtgtcctt

SEQ ID NO: 7390641 - DNA, 22 bp, Homo sapiens
gcttgggcttaactgtaggttc

SEQ ID NO: 7390642 - DNA, 22 bp, Homo sapiens
gcttgggcttaactgtaggttc

SEQ ID NO: 7390643 - DNA, 22 bp, Homo sapiens
gcttgggcttaactgtaggttc

SEQ ID NO: 7390644 - DNA, 22 bp, Homo sapiens
gcttggggagctcagtgtcctt

SEQ ID NO: 7390645 - DNA, 22 bp, Homo sapiens
gcttggggagctcagtgtcctt

SEQ ID NO: 7390646 - DNA, 22 bp, Homo sapiens
gcttggggagctcagtgtcctt

SEQ ID NO: 7390647 - DNA, 22 bp, Homo sapiens
gctttctggttctcaaagcact

SEQ ID NO: 7390648 - DNA, 22 bp, Homo sapiens
gctttctggtttgtgctacagg

SEQ ID NO: 7390649 - DNA, 22 bp, Homo sapiens
gctttctggttctcaaagcact

SEQ ID NO: 7390650 - DNA, 22 bp, Homo sapiens
gcttggggtcatgaggctgctg

SEQ ID NO: 7390651 - DNA, 22 bp, Homo sapiens
gcttggggtcatgaggctgctg

SEQ ID NO: 7390652 - DNA, 22 bp, Homo sapiens
gcttggggtcatgaggctgctg

SEQ ID NO: 7390653 - DNA, 22 bp, Homo sapiens
gctttctgctctgtaaaatggg

SEQ ID NO: 7390654 - DNA, 22 bp, Homo sapiens
gctttctggagcctgggggaac

SEQ ID NO: 7390655 - DNA, 22 bp, Homo sapiens
gctttctgggctatagaacggg

SEQ ID NO: 7390656 - DNA, 21 bp, Homo sapiens
gctttctgtggactctgcacc

SEQ ID NO: 7390657 - DNA, 22 bp, Homo sapiens
gctttctgtgcagtgaacacta

SEQ ID NO: 7390658 - DNA, 21 bp, Homo sapiens
gctttctgtggactctgcacc

SEQ ID NO: 7390659 - DNA, 22 bp, Homo sapiens
gctttcttagtgtgttaattgg

SEQ ID NO: 7390660 - DNA, 22 bp, Homo sapiens
gctttcttagtgtgttaattgg

SEQ ID NO: 7390661 - DNA, 22 bp, Homo sapiens
gctttcttagtgtgttaattgg

SEQ ID NO: 7390662 - DNA, 22 bp, Homo sapiens
gctttctgtggtgatgtaaagg

SEQ ID NO: 7390663 - DNA, 22 bp, Homo sapiens
gctttctgtaggtagttactgt

SEQ ID NO: 7390664 - DNA, 18 bp, Homo sapiens
gctttctgtgcagcggag

SEQ ID NO: 7390665 - DNA, 22 bp, Homo sapiens
gctttctgtaggtagttactgt

SEQ ID NO: 7390666 - DNA, 18 bp, Homo sapiens
gctttctgtgcagcggag

SEQ ID NO: 7390667 - DNA, 22 bp, Homo sapiens
gctttctggtttgtgctacagg

SEQ ID NO: 7390668 - DNA, 18 bp, Homo sapiens
gctttctgtagaaaaggg

SEQ ID NO: 7390669 - DNA, 18 bp, Homo sapiens
gctttctgtagaaaaggg

SEQ ID NO: 7390670 - DNA, 22 bp, Homo sapiens
cagactctcttccatgcatcac

SEQ ID NO: 7390671 - DNA, 22 bp, Homo sapiens
cagacgttggaggaaatatacc

SEQ ID NO: 7390672 - DNA, 19 bp, Homo sapiens
cagacctgtccagcctgtg

SEQ ID NO: 7390673 - DNA, 23 bp, Homo sapiens
cagacctttctgtatcagttatc

SEQ ID NO: 7390674 - DNA, 22 bp, Homo sapiens
cagacgggctcatggcagtccc

SEQ ID NO: 7390675 - DNA, 22 bp, Homo sapiens
cagacgggtggtctgcgaggcc

SEQ ID NO: 7390676 - DNA, 22 bp, Homo sapiens
cagacctgggtccctggcctgt

SEQ ID NO: 7390677 - DNA, 19 bp, Homo sapiens
cagacctgtccagcctgtg

SEQ ID NO: 7390678 - DNA, 19 bp, Homo sapiens
cagacctgtccagcctgtg

SEQ ID NO: 7390679 - DNA, 19 bp, Homo sapiens
cagacctgtccagcctgtg

SEQ ID NO: 7390680 - DNA, 22 bp, Homo sapiens
cagacctggggcctgggagccc

SEQ ID NO: 7390681 - DNA, 22 bp, Homo sapiens
cagacctggggcctgggagccc

SEQ ID NO: 7390682 - DNA, 22 bp, Homo sapiens
cagacctgggtccctggcctgt

SEQ ID NO: 7390683 - DNA, 22 bp, Homo sapiens
cagacctgggtccctggcctgt

SEQ ID NO: 7390684 - DNA, 22 bp, Homo sapiens
cagacctgggtccctggcctgt

SEQ ID NO: 7390685 - DNA, 19 bp, Homo sapiens
cagacctgtccagcctgtg

SEQ ID NO: 7390686 - DNA, 22 bp, Homo sapiens
cagacctgggtccctggcctgt

SEQ ID NO: 7390687 - DNA, 19 bp, Homo sapiens
cagacctgtccagcctgtg

SEQ ID NO: 7390688 - DNA, 19 bp, Homo sapiens
cagacctgtccagcctgtg

SEQ ID NO: 7390689 - DNA, 22 bp, Homo sapiens
cagacctctttttagcactccc

SEQ ID NO: 7390690 - DNA, 22 bp, Homo sapiens
cagacctctatggggtaaatct

SEQ ID NO: 7390691 - DNA, 17 bp, Homo sapiens
cagacctctgtgaagcc

SEQ ID NO: 7390692 - DNA, 22 bp, Homo sapiens
cagacctgaggagcactgagcc

SEQ ID NO: 7390693 - DNA, 22 bp, Homo sapiens
cagacctgaggagcactgagcc

SEQ ID NO: 7390694 - DNA, 22 bp, Homo sapiens
cagacctgaggagcactgagcc

SEQ ID NO: 7390695 - DNA, 22 bp, Homo sapiens
cagacctgaggagcactgagcc

SEQ ID NO: 7390696 - DNA, 22 bp, Homo sapiens
cagacctgaggagcactgagcc

SEQ ID NO: 7390697 - DNA, 22 bp, Homo sapiens
cagacctgaggttgagtaccag

SEQ ID NO: 7390698 - DNA, 20 bp, Homo sapiens
cagacctgcacccacttcga

SEQ ID NO: 7390699 - DNA, 20 bp, Homo sapiens
cagacctgcacccacttcga

SEQ ID NO: 7390700 - DNA, 20 bp, Homo sapiens
cagacctgcacccacttcga

SEQ ID NO: 7390701 - DNA, 22 bp, Homo sapiens
cagacctggaaaacaggcttgc

SEQ ID NO: 7390702 - DNA, 22 bp, Homo sapiens
cagacctggaaaacaggcttgc

SEQ ID NO: 7390703 - DNA, 22 bp, Homo sapiens
cagacctggaaaacaggcttgc

SEQ ID NO: 7390704 - DNA, 22 bp, Homo sapiens
cagacctggaaaacaggcttgc

SEQ ID NO: 7390705 - DNA, 22 bp, Homo sapiens
cagacctggaaaacaggcttgc

SEQ ID NO: 7390706 - DNA, 23 bp, Homo sapiens
cagacctggcagtcatcctcaac

SEQ ID NO: 7390707 - DNA, 22 bp, Homo sapiens
gggcagagactcagaaacagaa

SEQ ID NO: 7390708 - DNA, 22 bp, Homo sapiens
gggcagcagagccctgccgagt

SEQ ID NO: 7390709 - DNA, 22 bp, Homo sapiens
gggcagagactcagaaacagaa

SEQ ID NO: 7390710 - DNA, 22 bp, Homo sapiens
gggcagagactcagaaacagaa

SEQ ID NO: 7390711 - DNA, 22 bp, Homo sapiens
cagactgggctggtggaaagct

SEQ ID NO: 7390712 - DNA, 22 bp, Homo sapiens
cagactgggagtcaggaagaag

SEQ ID NO: 7390713 - DNA, 19 bp, Homo sapiens
cagactggttaagtagtcc

SEQ ID NO: 7390714 - DNA, 22 bp, Homo sapiens
cagactggctgaaggccgagtg

SEQ ID NO: 7390715 - DNA, 22 bp, Homo sapiens
cagactgggagtcaggaagaag

SEQ ID NO: 7390716 - DNA, 22 bp, Homo sapiens
cagactgggagtcaggaagaag

SEQ ID NO: 7390717 - DNA, 22 bp, Homo sapiens
cagactgggagtcaggaagaag

SEQ ID NO: 7390718 - DNA, 22 bp, Homo sapiens
cagactgggagtcaggaagaag

SEQ ID NO: 7390719 - DNA, 22 bp, Homo sapiens
cagactcttgagctgattgtat

SEQ ID NO: 7390720 - DNA, 22 bp, Homo sapiens
cagactcttgagctgattgtat

SEQ ID NO: 7390721 - DNA, 22 bp, Homo sapiens
cagactctgatgcagccttgtg

SEQ ID NO: 7390722 - DNA, 22 bp, Homo sapiens
cagactctcttccatgcatcac

SEQ ID NO: 7390723 - DNA, 22 bp, Homo sapiens
cagactctgatgcagccttgtg

SEQ ID NO: 7390724 - DNA, 22 bp, Homo sapiens
cagactggctgaaggccgagtg

SEQ ID NO: 7390725 - DNA, 22 bp, Homo sapiens
cagactggctgaaggccgagtg

SEQ ID NO: 7390726 - DNA, 22 bp, Homo sapiens
cagactggctgaaggccgagtg

SEQ ID NO: 7390727 - DNA, 22 bp, Homo sapiens
cagactggccacatctgcactg

SEQ ID NO: 7390728 - DNA, 22 bp, Homo sapiens
cagactggccacatctgcactg

SEQ ID NO: 7390729 - DNA, 22 bp, Homo sapiens
cagactggccacatctgcactg

SEQ ID NO: 7390730 - DNA, 22 bp, Homo sapiens
ggcttcagatttctcagttgtt

SEQ ID NO: 7390731 - DNA, 22 bp, Homo sapiens
ggcttcagatttctcagttgtt

SEQ ID NO: 7390732 - DNA, 22 bp, Homo sapiens
ggcttcagatttctcagttgtt

SEQ ID NO: 7390733 - DNA, 22 bp, Homo sapiens
ggcttcagctggttatttcctt

SEQ ID NO: 7390734 - DNA, 22 bp, Homo sapiens
ggcttcagctggttatttcctt

SEQ ID NO: 7390735 - DNA, 22 bp, Homo sapiens
ggcttcagaggggaggtagtgc

SEQ ID NO: 7390736 - DNA, 22 bp, Homo sapiens
ggcttcagaggggaggtagtgc

SEQ ID NO: 7390737 - DNA, 22 bp, Homo sapiens
cagacagggtcctgtccgtcac

SEQ ID NO: 7390738 - DNA, 17 bp, Homo sapiens
ggcttcagggagctggg

SEQ ID NO: 7390739 - DNA, 17 bp, Homo sapiens
ggcttcagggagctggg

SEQ ID NO: 7390740 - DNA, 22 bp, Homo sapiens
cagacagggtcctgtccgtcac

SEQ ID NO: 7390741 - DNA, 22 bp, Homo sapiens
ggcttcagaggagaagagggtg

SEQ ID NO: 7390742 - DNA, 22 bp, Homo sapiens
ggcttcagaggagaagagggtg

SEQ ID NO: 7390743 - DNA, 22 bp, Homo sapiens
ggcttcagaggggaggtagtgc

SEQ ID NO: 7390744 - DNA, 22 bp, Homo sapiens
ggcttcagaagactggacaggt

SEQ ID NO: 7390745 - DNA, 22 bp, Homo sapiens
ggcttcagaagactggacaggt

SEQ ID NO: 7390746 - DNA, 22 bp, Homo sapiens
ggcttcagaagactggacaggt

SEQ ID NO: 7390747 - DNA, 22 bp, Homo sapiens
ggcttcagaagactggacaggt

SEQ ID NO: 7390748 - DNA, 22 bp, Homo sapiens
ggcttcagaagactggacaggt

SEQ ID NO: 7390749 - DNA, 22 bp, Homo sapiens
ggcttcacctgtgcactctacc

SEQ ID NO: 7390750 - DNA, 22 bp, Homo sapiens
ggcttcaaatggagcaaccaga

SEQ ID NO: 7390751 - DNA, 22 bp, Homo sapiens
ggcttcaaaacctatctttgat

SEQ ID NO: 7390752 - DNA, 22 bp, Homo sapiens
ggcttatgggctacggtttgct

SEQ ID NO: 7390753 - DNA, 22 bp, Homo sapiens
ggcttatgtaggacactgtgca

SEQ ID NO: 7390754 - DNA, 17 bp, Homo sapiens
ggcttatctgttgggtg

SEQ ID NO: 7390755 - DNA, 22 bp, Homo sapiens
ggcttcaccaggtgcatgcatg

SEQ ID NO: 7390756 - DNA, 22 bp, Homo sapiens
ggcttcaatgtattcacattca

SEQ ID NO: 7390757 - DNA, 22 bp, Homo sapiens
ggcttcaagtcgtatatttggg

SEQ ID NO: 7390758 - DNA, 22 bp, Homo sapiens
ggcttagcaactcctgaggctc

SEQ ID NO: 7390759 - DNA, 22 bp, Homo sapiens
ggcttagattgacactgatctc

SEQ ID NO: 7390760 - DNA, 22 bp, Homo sapiens
ggcttagcaactcctgaggctc

SEQ ID NO: 7390761 - DNA, 20 bp, Homo sapiens
ggcttagactgagttctcac

SEQ ID NO: 7390762 - DNA, 22 bp, Homo sapiens
ggcttaccgcaagctccgcctc

SEQ ID NO: 7390763 - DNA, 22 bp, Homo sapiens
ggcttaatggttctttttctca

SEQ ID NO: 7390764 - DNA, 22 bp, Homo sapiens
cagacccttttctgagaggacc

SEQ ID NO: 7390765 - DNA, 22 bp, Homo sapiens
cagacctcaaagctgcagtgct

SEQ ID NO: 7390766 - DNA, 22 bp, Homo sapiens
cagaccctgggccacagaggag

SEQ ID NO: 7390767 - DNA, 22 bp, Homo sapiens
cagaccctgggccacagaggag

SEQ ID NO: 7390768 - DNA, 22 bp, Homo sapiens
cagacccttttctgagaggacc

SEQ ID NO: 7390769 - DNA, 22 bp, Homo sapiens
cagacctcagtcctcagtagga

SEQ ID NO: 7390770 - DNA, 22 bp, Homo sapiens
cagacctcaattatgtaagtaa

SEQ ID NO: 7390771 - DNA, 22 bp, Homo sapiens
cagacctcaaagctgcagtgct

SEQ ID NO: 7390772 - DNA, 22 bp, Homo sapiens
cagacctcaaagctgcagtgct

SEQ ID NO: 7390773 - DNA, 22 bp, Homo sapiens
cagaccctgggccacagaggag

SEQ ID NO: 7390774 - DNA, 22 bp, Homo sapiens
cagaccctgggccacagaggag

SEQ ID NO: 7390775 - DNA, 22 bp, Homo sapiens
cagaccctcttctattggtggg

SEQ ID NO: 7390776 - DNA, 22 bp, Homo sapiens
cagaccctgggccacagaggag

SEQ ID NO: 7390777 - DNA, 22 bp, Homo sapiens
cagaccctcttctattggtggg

SEQ ID NO: 7390778 - DNA, 21 bp, Homo sapiens
cagaccctctagaggccacct

SEQ ID NO: 7390779 - DNA, 21 bp, Homo sapiens
cagaccattgcatgagcaggt

SEQ ID NO: 7390780 - DNA, 21 bp, Homo sapiens
cagaccctctagaggccacct

SEQ ID NO: 7390781 - DNA, 21 bp, Homo sapiens
cagaccctctagaggccacct

SEQ ID NO: 7390782 - DNA, 21 bp, Homo sapiens
cagaccctctagaggccacct

SEQ ID NO: 7390783 - DNA, 21 bp, Homo sapiens
cagaccctctagaggccacct

SEQ ID NO: 7390784 - DNA, 23 bp, Homo sapiens
cagaccctcaatccacttgtttt

SEQ ID NO: 7390785 - DNA, 22 bp, Homo sapiens
cagaccccgagtttgcagagtt

SEQ ID NO: 7390786 - DNA, 22 bp, Homo sapiens
cagaccccgagtttgcagagtt

SEQ ID NO: 7390787 - DNA, 22 bp, Homo sapiens
cagaccccgagtttgcagagtt

SEQ ID NO: 7390788 - DNA, 22 bp, Homo sapiens
cagacccaggatccaaatgttg

SEQ ID NO: 7390789 - DNA, 22 bp, Homo sapiens
cagacccaggatccaaatgttg

SEQ ID NO: 7390790 - DNA, 22 bp, Homo sapiens
cagaccatcttgaagcaaactg

SEQ ID NO: 7390791 - DNA, 22 bp, Homo sapiens
cagacccaggatccaaatgttg

SEQ ID NO: 7390792 - DNA, 22 bp, Homo sapiens
cagaccagccatttgcctcttc

SEQ ID NO: 7390793 - DNA, 22 bp, Homo sapiens
cagaccagtagggctcatccca

SEQ ID NO: 7390794 - DNA, 22 bp, Homo sapiens
cagaccagtagggctcatccca

SEQ ID NO: 7390795 - DNA, 22 bp, Homo sapiens
cagaccagtagggctcatccca

SEQ ID NO: 7390796 - DNA, 22 bp, Homo sapiens
cagaccagaaggaagccgacaa

SEQ ID NO: 7390797 - DNA, 22 bp, Homo sapiens
cagaccagaaggaagccgacaa

SEQ ID NO: 7390798 - DNA, 22 bp, Homo sapiens
cagacagggtgggtttctgggc

SEQ ID NO: 7390799 - DNA, 22 bp, Homo sapiens
cagagacagcaagttgatttcc

SEQ ID NO: 7390800 - DNA, 22 bp, Homo sapiens
cagagacagcaagttgatttcc

SEQ ID NO: 7390801 - DNA, 22 bp, Homo sapiens
cagagacagcctgggagggaca

SEQ ID NO: 7390802 - DNA, 22 bp, Homo sapiens
cagagacagcctgggagggaca

SEQ ID NO: 7390803 - DNA, 22 bp, Homo sapiens
cagagacagcctgggagggaca

SEQ ID NO: 7390804 - DNA, 22 bp, Homo sapiens
cagagacagcctgggagggaca

SEQ ID NO: 7390805 - DNA, 22 bp, Homo sapiens
gggcagcccagaactgctgcag

SEQ ID NO: 7390806 - DNA, 22 bp, Homo sapiens
gggcagcccagaactgctgcag

SEQ ID NO: 7390807 - DNA, 22 bp, Homo sapiens
gggcagcccagaactgctgcag

SEQ ID NO: 7390808 - DNA, 22 bp, Homo sapiens
gggcagcccagaactgctgcag

SEQ ID NO: 7390809 - DNA, 22 bp, Homo sapiens
cagagacagcaagttgatttcc

SEQ ID NO: 7390810 - DNA, 22 bp, Homo sapiens
cagagacagcaagttgatttcc

SEQ ID NO: 7390811 - DNA, 22 bp, Homo sapiens
cagagacaggaatcagctgcag

SEQ ID NO: 7390812 - DNA, 22 bp, Homo sapiens
cagagacaggaatcagctgcag

SEQ ID NO: 7390813 - DNA, 22 bp, Homo sapiens
cagagacaggaatcagctgcag

SEQ ID NO: 7390814 - DNA, 22 bp, Homo sapiens
cagagacaggaatcagctgcag

SEQ ID NO: 7390815 - DNA, 22 bp, Homo sapiens
cagagacaggaatcagctgcag

SEQ ID NO: 7390816 - DNA, 22 bp, Homo sapiens
cagagacaggaatcagctgcag

SEQ ID NO: 7390817 - DNA, 22 bp, Homo sapiens
cagagacaggaatcagctgcag

SEQ ID NO: 7390818 - DNA, 22 bp, Homo sapiens
cagagacaggaatcagctgcag

SEQ ID NO: 7390819 - DNA, 22 bp, Homo sapiens
cagagacaggaatcagctgcag

SEQ ID NO: 7390820 - DNA, 22 bp, Homo sapiens
cagagacagcctgggagggaca

SEQ ID NO: 7390821 - DNA, 22 bp, Homo sapiens
cagagacagcctgggagggaca

SEQ ID NO: 7390822 - DNA, 22 bp, Homo sapiens
gggcagcatgtcactagcatgg

SEQ ID NO: 7390823 - DNA, 22 bp, Homo sapiens
gggcagcatgtcactagcatgg

SEQ ID NO: 7390824 - DNA, 22 bp, Homo sapiens
gggcagcatgtcactagcatgg

SEQ ID NO: 7390825 - DNA, 22 bp, Homo sapiens
gggcagcatgaggaccctcatc

SEQ ID NO: 7390826 - DNA, 22 bp, Homo sapiens
gggcagcattctgtgggcaggt

SEQ ID NO: 7390827 - DNA, 22 bp, Homo sapiens
gggcagcattctgtgggcaggt

SEQ ID NO: 7390828 - DNA, 22 bp, Homo sapiens
gggcagcatgtcactagcatgg

SEQ ID NO: 7390829 - DNA, 22 bp, Homo sapiens
gggcagcattctgtgggcaggt

SEQ ID NO: 7390830 - DNA, 22 bp, Homo sapiens
gggcagcattctgtgggcaggt

SEQ ID NO: 7390831 - DNA, 22 bp, Homo sapiens
gggcagcattctgtgggcaggt

SEQ ID NO: 7390832 - DNA, 22 bp, Homo sapiens
gggcagcattctgtgggcaggt

SEQ ID NO: 7390833 - DNA, 22 bp, Homo sapiens
gggcagcattctgtgggcaggt

SEQ ID NO: 7390834 - DNA, 22 bp, Homo sapiens
gggcagcattctgtgggcaggt

SEQ ID NO: 7390835 - DNA, 22 bp, Homo sapiens
gggcagcattctgtgggcaggt

SEQ ID NO: 7390836 - DNA, 22 bp, Homo sapiens
gggcagcattctgtgggcaggt

SEQ ID NO: 7390837 - DNA, 22 bp, Homo sapiens
gggcagcatttgaaaaacagat

SEQ ID NO: 7390838 - DNA, 22 bp, Homo sapiens
gggcagcatttgaaaaacagat

SEQ ID NO: 7390839 - DNA, 22 bp, Homo sapiens
gggcagcatttgaaaaacagat

SEQ ID NO: 7390840 - DNA, 22 bp, Homo sapiens
gggcagcagaggatcccttaat

SEQ ID NO: 7390841 - DNA, 22 bp, Homo sapiens
gggcagcagaggatcccttaat

SEQ ID NO: 7390842 - DNA, 22 bp, Homo sapiens
gggcagcagagccctgccgagt

SEQ ID NO: 7390843 - DNA, 22 bp, Homo sapiens
gggcagcagagccctgccgagt

SEQ ID NO: 7390844 - DNA, 22 bp, Homo sapiens
gggcagcagagccctgccgagt

SEQ ID NO: 7390845 - DNA, 21 bp, Homo sapiens
gggcagcagcagcaacaaggg

SEQ ID NO: 7390846 - DNA, 21 bp, Homo sapiens
gggcagcagcagcaacaaggg

SEQ ID NO: 7390847 - DNA, 22 bp, Homo sapiens
gggcagcagaggatcccttaat

SEQ ID NO: 7390848 - DNA, 22 bp, Homo sapiens
gggcagcagaggatcccttaat

SEQ ID NO: 7390849 - DNA, 21 bp, Homo sapiens
gggcagcagcagcaacaaggg

SEQ ID NO: 7390850 - DNA, 21 bp, Homo sapiens
gggcagcagcagcaacaaggg

SEQ ID NO: 7390851 - DNA, 22 bp, Homo sapiens
gggcagcagcaggaggtctctg

SEQ ID NO: 7390852 - DNA, 22 bp, Homo sapiens
gggcagcagcaggaggtctctg

SEQ ID NO: 7390853 - DNA, 22 bp, Homo sapiens
gggcagcagcaggaggtctctg

SEQ ID NO: 7390854 - DNA, 22 bp, Homo sapiens
gggcagcaggctccacgttcct

SEQ ID NO: 7390855 - DNA, 22 bp, Homo sapiens
gggcagcagccactcatttagc

SEQ ID NO: 7390856 - DNA, 22 bp, Homo sapiens
gggcagcagcaggaggtctctg

SEQ ID NO: 7390857 - DNA, 22 bp, Homo sapiens
gggcagcagcaggaggtctctg

SEQ ID NO: 7390858 - DNA, 22 bp, Homo sapiens
gggcagcatcaggaggggcttt

SEQ ID NO: 7390859 - DNA, 22 bp, Homo sapiens
gggcagcatcaggaggggcttt

SEQ ID NO: 7390860 - DNA, 22 bp, Homo sapiens
gggcagcatcaggaggggcttt

SEQ ID NO: 7390861 - DNA, 22 bp, Homo sapiens
gggcagcagttgccctaatcaa

SEQ ID NO: 7390862 - DNA, 22 bp, Homo sapiens
gggcagcataacaatcactgaa

SEQ ID NO: 7390863 - DNA, 22 bp, Homo sapiens
gggcagcaggctccacgttcct

SEQ ID NO: 7390864 - DNA, 22 bp, Homo sapiens
gggcagcagttgccctaatcaa

SEQ ID NO: 7390865 - DNA, 22 bp, Homo sapiens
gggcagcaggctccacgttcct

SEQ ID NO: 7390866 - DNA, 22 bp, Homo sapiens
gggcagcaggctccacgttcct

SEQ ID NO: 7390867 - DNA, 22 bp, Homo sapiens
gggcagcatcaggaggggcttt

SEQ ID NO: 7390868 - DNA, 22 bp, Homo sapiens
gggcagcatcaggaggggcttt

SEQ ID NO: 7390869 - DNA, 22 bp, Homo sapiens
gggcagcatgaggaccctcatc

SEQ ID NO: 7390870 - DNA, 22 bp, Homo sapiens
gggcagcatgaggaccctcatc

SEQ ID NO: 7390871 - DNA, 22 bp, Homo sapiens
gggcagcatgaggaccctcatc

SEQ ID NO: 7390872 - DNA, 22 bp, Homo sapiens
gggcagcatgaggaccctcatc

SEQ ID NO: 7390873 - DNA, 22 bp, Homo sapiens
gggcagcatcaggaggggcttt

SEQ ID NO: 7390874 - DNA, 22 bp, Homo sapiens
gggcagcatcaggaggggcttt

SEQ ID NO: 7390875 - DNA, 22 bp, Homo sapiens
cagagacaggagtgctcccagt

SEQ ID NO: 7390876 - DNA, 22 bp, Homo sapiens
cagagacaggagtgctcccagt

SEQ ID NO: 7390877 - DNA, 22 bp, Homo sapiens
cagagacaggagtgctcccagt

SEQ ID NO: 7390878 - DNA, 22 bp, Homo sapiens
cagagacaggatctcgaagact

SEQ ID NO: 7390879 - DNA, 22 bp, Homo sapiens
cagagacaggatctcgaagact

SEQ ID NO: 7390880 - DNA, 22 bp, Homo sapiens
cagagacaggatctcgaagact

SEQ ID NO: 7390881 - DNA, 22 bp, Homo sapiens
cagagacaggatctcgaagact

SEQ ID NO: 7390882 - DNA, 22 bp, Homo sapiens
cagagacaggatctcgaagact

SEQ ID NO: 7390883 - DNA, 22 bp, Homo sapiens
cagagacaggatctcgaagact

SEQ ID NO: 7390884 - DNA, 22 bp, Homo sapiens
cagagacaggatctcgaagact

SEQ ID NO: 7390885 - DNA, 22 bp, Homo sapiens
cagagacaggatctcgaagact

SEQ ID NO: 7390886 - DNA, 22 bp, Homo sapiens
cagagacaggatctcgaagact

SEQ ID NO: 7390887 - DNA, 22 bp, Homo sapiens
cagagacaggatctcgaagact

SEQ ID NO: 7390888 - DNA, 22 bp, Homo sapiens
cagagacaggagtgctcccagt

SEQ ID NO: 7390889 - DNA, 22 bp, Homo sapiens
cagagacaggagtgctcccagt

SEQ ID NO: 7390890 - DNA, 22 bp, Homo sapiens
cagagacaggagtgctcccagt

SEQ ID NO: 7390891 - DNA, 22 bp, Homo sapiens
cagagacaggagtgctcccagt

SEQ ID NO: 7390892 - DNA, 22 bp, Homo sapiens
cagagacaggaatcagctgcag

SEQ ID NO: 7390893 - DNA, 22 bp, Homo sapiens
cagagacaggagtgctcccagt

SEQ ID NO: 7390894 - DNA, 22 bp, Homo sapiens
cagagacaggaatcagctgcag

SEQ ID NO: 7390895 - DNA, 22 bp, Homo sapiens
cagagacaggagtgctcccagt

SEQ ID NO: 7390896 - DNA, 22 bp, Homo sapiens
cagagacaggagtgctcccagt

SEQ ID NO: 7390897 - DNA, 22 bp, Homo sapiens
cagagacaggaatcagctgcag

SEQ ID NO: 7390898 - DNA, 22 bp, Homo sapiens
gggcaggtatttatcttctatt

SEQ ID NO: 7390899 - DNA, 22 bp, Homo sapiens
cagagacagggcagggagtgtg

SEQ ID NO: 7390900 - DNA, 22 bp, Homo sapiens
cagagacagtttcacagggtct

SEQ ID NO: 7390901 - DNA, 22 bp, Homo sapiens
cagagacagtttcacagggtct

SEQ ID NO: 7390902 - DNA, 22 bp, Homo sapiens
cagagacagtttcacagggtct

SEQ ID NO: 7390903 - DNA, 22 bp, Homo sapiens
cagagacagggcagggagtgtg

SEQ ID NO: 7390904 - DNA, 22 bp, Homo sapiens
cagagacagggcagggagtgtg

SEQ ID NO: 7390905 - DNA, 22 bp, Homo sapiens
cagagacagggcagggagtgtg

SEQ ID NO: 7390906 - DNA, 22 bp, Homo sapiens
cagagacagggcagggagtgtg

SEQ ID NO: 7390907 - DNA, 22 bp, Homo sapiens
cagagacagggcagggagtgtg

SEQ ID NO: 7390908 - DNA, 22 bp, Homo sapiens
cagagacaggcttgccctccac

SEQ ID NO: 7390909 - DNA, 22 bp, Homo sapiens
cagagacaggcttgccctccac

SEQ ID NO: 7390910 - DNA, 22 bp, Homo sapiens
cagagacaggcttgccctccac

SEQ ID NO: 7390911 - DNA, 22 bp, Homo sapiens
cagagacaggatctcgaagact

SEQ ID NO: 7390912 - DNA, 22 bp, Homo sapiens
cagagacaggcttgccctccac

SEQ ID NO: 7390913 - DNA, 22 bp, Homo sapiens
cagagacaggcttgccctccac

SEQ ID NO: 7390914 - DNA, 22 bp, Homo sapiens
gggcagtgggtggctgcagcct

SEQ ID NO: 7390915 - DNA, 22 bp, Homo sapiens
gggcagtgggtggctgcagcct

SEQ ID NO: 7390916 - DNA, 22 bp, Homo sapiens
gggcagtgggtggctgcagcct

SEQ ID NO: 7390917 - DNA, 22 bp, Homo sapiens
gggcagtgggtggctgcagcct

SEQ ID NO: 7390918 - DNA, 22 bp, Homo sapiens
gggcagtgggtggctgcagcct

SEQ ID NO: 7390919 - DNA, 20 bp, Homo sapiens
gggcagtggcgctatctcag

SEQ ID NO: 7390920 - DNA, 20 bp, Homo sapiens
gggcagtggcgctatctcag

SEQ ID NO: 7390921 - DNA, 22 bp, Homo sapiens
gggcagtggctcacgcctgtaa

SEQ ID NO: 7390922 - DNA, 22 bp, Homo sapiens
gggcagtggctcacgcctgtaa

SEQ ID NO: 7390923 - DNA, 22 bp, Homo sapiens
gggcagtggctcacgcctgtaa

SEQ ID NO: 7390924 - DNA, 22 bp, Homo sapiens
gggcagtggctcacgcctgtaa

SEQ ID NO: 7390925 - DNA, 22 bp, Homo sapiens
gggcagtgggaccaggcaccag

SEQ ID NO: 7390926 - DNA, 22 bp, Homo sapiens
gggcagtgggaccaggcaccag

SEQ ID NO: 7390927 - DNA, 22 bp, Homo sapiens
gggcagtgggaccaggcaccag

SEQ ID NO: 7390928 - DNA, 22 bp, Homo sapiens
gggcagtgggaccaggcaccag

SEQ ID NO: 7390929 - DNA, 22 bp, Homo sapiens
gggcagtggtccaggctacagc

SEQ ID NO: 7390930 - DNA, 22 bp, Homo sapiens
gggcagtggtccaggctacagc

SEQ ID NO: 7390931 - DNA, 22 bp, Homo sapiens
gggcagtgggtggctgcagcct

SEQ ID NO: 7390932 - DNA, 22 bp, Homo sapiens
gggcagtgggtggctgcagcct

SEQ ID NO: 7390933 - DNA, 22 bp, Homo sapiens
gggcagtggtccaggctacagc

SEQ ID NO: 7390934 - DNA, 22 bp, Homo sapiens
gggcagtggtccaggctacagc

SEQ ID NO: 7390935 - DNA, 22 bp, Homo sapiens
gggcagtggtccaggctacagc

SEQ ID NO: 7390936 - DNA, 22 bp, Homo sapiens
gggcagtggtccaggctacagc

SEQ ID NO: 7390937 - DNA, 22 bp, Homo sapiens
gggcagtggttacacagctgag

SEQ ID NO: 7390938 - DNA, 22 bp, Homo sapiens
gggcagtggttacacagctgag

SEQ ID NO: 7390939 - DNA, 22 bp, Homo sapiens
gggcagtggttacacagctgag

SEQ ID NO: 7390940 - DNA, 22 bp, Homo sapiens
gggcagtggttacacagctgag

SEQ ID NO: 7390941 - DNA, 22 bp, Homo sapiens
gggcagtggttacacagctgag

SEQ ID NO: 7390942 - DNA, 22 bp, Homo sapiens
gggcagtgtcgaggtctggtcc

SEQ ID NO: 7390943 - DNA, 22 bp, Homo sapiens
gggcagtgtcgaggtctggtcc

SEQ ID NO: 7390944 - DNA, 22 bp, Homo sapiens
gggcagtggttacacagctgag

SEQ ID NO: 7390945 - DNA, 22 bp, Homo sapiens
gggcagtggttacacagctgag

SEQ ID NO: 7390946 - DNA, 22 bp, Homo sapiens
gggccagagcttggcagctggg

SEQ ID NO: 7390947 - DNA, 22 bp, Homo sapiens
gggccagagcttggcagctggg

SEQ ID NO: 7390948 - DNA, 22 bp, Homo sapiens
gggccagagcttggcagctggg

SEQ ID NO: 7390949 - DNA, 22 bp, Homo sapiens
gggccagagcttggcagctggg

SEQ ID NO: 7390950 - DNA, 22 bp, Homo sapiens
gggccagagcttggcagctggg

SEQ ID NO: 7390951 - DNA, 22 bp, Homo sapiens
gggccagcagtatcggaggcat

SEQ ID NO: 7390952 - DNA, 22 bp, Homo sapiens
gggccagcagtatcggaggcat

SEQ ID NO: 7390953 - DNA, 22 bp, Homo sapiens
gggccagagcttggcagctggg

SEQ ID NO: 7390954 - DNA, 22 bp, Homo sapiens
gggccagagcttggcagctggg

SEQ ID NO: 7390955 - DNA, 22 bp, Homo sapiens
gggccagagcttggcagctggg

SEQ ID NO: 7390956 - DNA, 22 bp, Homo sapiens
gggccagacctcttctcaggga

SEQ ID NO: 7390957 - DNA, 22 bp, Homo sapiens
gggccagacctcttctcaggga

SEQ ID NO: 7390958 - DNA, 22 bp, Homo sapiens
gggccagacctcttctcaggga

SEQ ID NO: 7390959 - DNA, 22 bp, Homo sapiens
gggccagacctcttctcaggga

SEQ ID NO: 7390960 - DNA, 22 bp, Homo sapiens
gggccagacctcttctcaggga

SEQ ID NO: 7390961 - DNA, 22 bp, Homo sapiens
gggccagagcacagaggatgtt

SEQ ID NO: 7390962 - DNA, 22 bp, Homo sapiens
gggccagagcacagaggatgtt

SEQ ID NO: 7390963 - DNA, 22 bp, Homo sapiens
gggccagacctcttctcaggga

SEQ ID NO: 7390964 - DNA, 22 bp, Homo sapiens
gggccagagcacagaggatgtt

SEQ ID NO: 7390965 - DNA, 22 bp, Homo sapiens
gggccagagcacagaggatgtt

SEQ ID NO: 7390966 - DNA, 22 bp, Homo sapiens
gggccagctctgtgatgtaggg

SEQ ID NO: 7390967 - DNA, 22 bp, Homo sapiens
gggctctgcgggcccggactcc

SEQ ID NO: 7390968 - DNA, 20 bp, Homo sapiens
gggctctgcttggcagaagt

SEQ ID NO: 7390969 - DNA, 20 bp, Homo sapiens
gggctctgcttggcagaagt

SEQ ID NO: 7390970 - DNA, 20 bp, Homo sapiens
gggctctgcttggcagaagt

SEQ ID NO: 7390971 - DNA, 20 bp, Homo sapiens
gggctctgcttggcagaagt

SEQ ID NO: 7390972 - DNA, 22 bp, Homo sapiens
gggccagcagtatcggaggcat

SEQ ID NO: 7390973 - DNA, 22 bp, Homo sapiens
gggccagcagtatcggaggcat

SEQ ID NO: 7390974 - DNA, 22 bp, Homo sapiens
gggccagcagtatcggaggcat

SEQ ID NO: 7390975 - DNA, 22 bp, Homo sapiens
gggccagcctactgctagaccc

SEQ ID NO: 7390976 - DNA, 22 bp, Homo sapiens
gggccagcctactgctagaccc

SEQ ID NO: 7390977 - DNA, 22 bp, Homo sapiens
gggccagcctactgctagaccc

SEQ ID NO: 7390978 - DNA, 22 bp, Homo sapiens
gggccagcagtatcggaggcat

SEQ ID NO: 7390979 - DNA, 22 bp, Homo sapiens
gggccagacccttggcgatctg

SEQ ID NO: 7390980 - DNA, 22 bp, Homo sapiens
gggccagacccttggcgatctg

SEQ ID NO: 7390981 - DNA, 22 bp, Homo sapiens
gggccacttctagtgcctcaga

SEQ ID NO: 7390982 - DNA, 22 bp, Homo sapiens
gggccagacccttggcgatctg

SEQ ID NO: 7390983 - DNA, 22 bp, Homo sapiens
gggccagacccttggcgatctg

SEQ ID NO: 7390984 - DNA, 22 bp, Homo sapiens
gggccactgggtcctgctggcc

SEQ ID NO: 7390985 - DNA, 22 bp, Homo sapiens
gggccagacccttggcgatctg

SEQ ID NO: 7390986 - DNA, 22 bp, Homo sapiens
gggccacttctagtgcctcaga

SEQ ID NO: 7390987 - DNA, 22 bp, Homo sapiens
gggccactgggtcctgctggcc

SEQ ID NO: 7390988 - DNA, 22 bp, Homo sapiens
gggccacctggattccatgtgt

SEQ ID NO: 7390989 - DNA, 22 bp, Homo sapiens
gggccacctggattccatgtgt

SEQ ID NO: 7390990 - DNA, 22 bp, Homo sapiens
gggccacctggattccatgtgt

SEQ ID NO: 7390991 - DNA, 22 bp, Homo sapiens
gggccaccccactgcccacgct

SEQ ID NO: 7390992 - DNA, 22 bp, Homo sapiens
gggccaccccactgcccacgct

SEQ ID NO: 7390993 - DNA, 22 bp, Homo sapiens
gggccacattgaagggtgggta

SEQ ID NO: 7390994 - DNA, 22 bp, Homo sapiens
gggccactcagattgtcccctt

SEQ ID NO: 7390995 - DNA, 22 bp, Homo sapiens
gggccactcctggctgctgagt

SEQ ID NO: 7390996 - DNA, 22 bp, Homo sapiens
gggccacggaaggaccagtggg

SEQ ID NO: 7390997 - DNA, 22 bp, Homo sapiens
gggcagtgtcggggcccaggga

SEQ ID NO: 7390998 - DNA, 22 bp, Homo sapiens
gggcagtgtcggggcccaggga

SEQ ID NO: 7390999 - DNA, 22 bp, Homo sapiens
gggcagtgtcggggcccaggga

SEQ ID NO: 7391000 - DNA, 22 bp, Homo sapiens
gggcagtgtcggggcccaggga

SEQ ID NO: 7391001 - DNA, 22 bp, Homo sapiens
gggcagtgtctggcccccaggc

SEQ ID NO: 7391002 - DNA, 22 bp, Homo sapiens
gggcagtgtctggcccccaggc

SEQ ID NO: 7391003 - DNA, 22 bp, Homo sapiens
gggcagtgtggtcgtgcctttg

SEQ ID NO: 7391004 - DNA, 22 bp, Homo sapiens
gggcagtgtggtcgtgcctttg

SEQ ID NO: 7391005 - DNA, 22 bp, Homo sapiens
gggcagtgtggtcgtgcctttg

SEQ ID NO: 7391006 - DNA, 22 bp, Homo sapiens
gggcagtgtggtcgtgcctttg

SEQ ID NO: 7391007 - DNA, 22 bp, Homo sapiens
gggcagtgtcgaggtctggtcc

SEQ ID NO: 7391008 - DNA, 22 bp, Homo sapiens
gggcagtgtctggcccccaggc

SEQ ID NO: 7391009 - DNA, 22 bp, Homo sapiens
gggcagtgtctggcccccaggc

SEQ ID NO: 7391010 - DNA, 22 bp, Homo sapiens
gggcagtgtctgcaaatgaaca

SEQ ID NO: 7391011 - DNA, 22 bp, Homo sapiens
gggcagtgtctgcaaatgaaca

SEQ ID NO: 7391012 - DNA, 22 bp, Homo sapiens
cagagcctcatcatccactcca

SEQ ID NO: 7391013 - DNA, 22 bp, Homo sapiens
cagagcctcatcatccactcca

SEQ ID NO: 7391014 - DNA, 22 bp, Homo sapiens
cagagcctcatcatccactcca

SEQ ID NO: 7391015 - DNA, 22 bp, Homo sapiens
cagagcctccctcctctgccat

SEQ ID NO: 7391016 - DNA, 22 bp, Homo sapiens
cagagcctccctcctctgccat

SEQ ID NO: 7391017 - DNA, 22 bp, Homo sapiens
cagagcctcagaatcctgtgga

SEQ ID NO: 7391018 - DNA, 22 bp, Homo sapiens
cagagcctcagaatcctgtgga

SEQ ID NO: 7391019 - DNA, 22 bp, Homo sapiens
cagagcctcagaatcctgtgga

SEQ ID NO: 7391020 - DNA, 19 bp, Homo sapiens
cagagcctcagagctagaa

SEQ ID NO: 7391021 - DNA, 19 bp, Homo sapiens
cagagcctcagagctagaa

SEQ ID NO: 7391022 - DNA, 19 bp, Homo sapiens
cagagcctcagagctagaa

SEQ ID NO: 7391023 - DNA, 22 bp, Homo sapiens
gggctgacgaaggccatgtgtg

SEQ ID NO: 7391024 - DNA, 22 bp, Homo sapiens
gggctgacgaaggccatgtgtg

SEQ ID NO: 7391025 - DNA, 22 bp, Homo sapiens
gggctgactcaaccttgcaaag

SEQ ID NO: 7391026 - DNA, 22 bp, Homo sapiens
gggctgacgaaggccatgtgtg

SEQ ID NO: 7391027 - DNA, 22 bp, Homo sapiens
gggctgagaagttgatcccaag

SEQ ID NO: 7391028 - DNA, 22 bp, Homo sapiens
gggctgactctgcactgagcca

SEQ ID NO: 7391029 - DNA, 22 bp, Homo sapiens
gggctgactcaaccttgcaaag

SEQ ID NO: 7391030 - DNA, 22 bp, Homo sapiens
gggctgactcctattggatgaa

SEQ ID NO: 7391031 - DNA, 22 bp, Homo sapiens
cagagcctaaaacgactccact

SEQ ID NO: 7391032 - DNA, 22 bp, Homo sapiens
cagagcccttggctggagccca

SEQ ID NO: 7391033 - DNA, 22 bp, Homo sapiens
cagagcccttggctggagccca

SEQ ID NO: 7391034 - DNA, 22 bp, Homo sapiens
cagagcctaaaacgactccact

SEQ ID NO: 7391035 - DNA, 22 bp, Homo sapiens
gggctctgtttagatcagagat

SEQ ID NO: 7391036 - DNA, 22 bp, Homo sapiens
gggctgaaaggccgcctcagat

SEQ ID NO: 7391037 - DNA, 22 bp, Homo sapiens
gggctgaaaggccgcctcagat

SEQ ID NO: 7391038 - DNA, 22 bp, Homo sapiens
gggctgaaaggccgcctcagat

SEQ ID NO: 7391039 - DNA, 22 bp, Homo sapiens
gggctgaaaggccgcctcagat

SEQ ID NO: 7391040 - DNA, 22 bp, Homo sapiens
gggctgacaaccatctgacaag

SEQ ID NO: 7391041 - DNA, 22 bp, Homo sapiens
gggctgaactcaagtcagctcc

SEQ ID NO: 7391042 - DNA, 22 bp, Homo sapiens
gggctgaatttgttgcatgtaa

SEQ ID NO: 7391043 - DNA, 22 bp, Homo sapiens
gggctgaatttgttgcatgtaa

SEQ ID NO: 7391044 - DNA, 22 bp, Homo sapiens
gggctctgtttagatcagagat

SEQ ID NO: 7391045 - DNA, 22 bp, Homo sapiens
gggctctgtttagatcagagat

SEQ ID NO: 7391046 - DNA, 22 bp, Homo sapiens
gggctctgtttagatcagagat

SEQ ID NO: 7391047 - DNA, 22 bp, Homo sapiens
gggctctgtttagaccagagat

SEQ ID NO: 7391048 - DNA, 22 bp, Homo sapiens
gggctctgtttagaccagagat

SEQ ID NO: 7391049 - DNA, 22 bp, Homo sapiens
gggctctgtttagaccagagat

SEQ ID NO: 7391050 - DNA, 22 bp, Homo sapiens
gggctctgtttagaccagagat

SEQ ID NO: 7391051 - DNA, 22 bp, Homo sapiens
gggctctgtttagaccagagat

SEQ ID NO: 7391052 - DNA, 22 bp, Homo sapiens
gggctctgtttagaccagagat

SEQ ID NO: 7391053 - DNA, 22 bp, Homo sapiens
gggctctgtttagaccagagat

SEQ ID NO: 7391054 - DNA, 22 bp, Homo sapiens
gggctgaccccacccctcactc

SEQ ID NO: 7391055 - DNA, 22 bp, Homo sapiens
gggctgaccccacccctcactc

SEQ ID NO: 7391056 - DNA, 17 bp, Homo sapiens
gggctgacagtggcctc

SEQ ID NO: 7391057 - DNA, 22 bp, Homo sapiens
gggctgacagtttcccctgaaa

SEQ ID NO: 7391058 - DNA, 22 bp, Homo sapiens
gggctgacagtttcccctgaaa

SEQ ID NO: 7391059 - DNA, 22 bp, Homo sapiens
gggctgacaccacccaggcgca

SEQ ID NO: 7391060 - DNA, 17 bp, Homo sapiens
gggctgacagtggcctc

SEQ ID NO: 7391061 - DNA, 22 bp, Homo sapiens
gggctgacagcacgccttctgt

SEQ ID NO: 7391062 - DNA, 22 bp, Homo sapiens
gggctgacaccacccaggcgca

SEQ ID NO: 7391063 - DNA, 22 bp, Homo sapiens
gggctgacaatctctttactta

SEQ ID NO: 7391064 - DNA, 22 bp, Homo sapiens
gggctgacaaccatctgacaag

SEQ ID NO: 7391065 - DNA, 22 bp, Homo sapiens
gggctgaatttgttgcatgtaa

SEQ ID NO: 7391066 - DNA, 20 bp, Homo sapiens
cagaggcaaggagacttgga

SEQ ID NO: 7391067 - DNA, 20 bp, Homo sapiens
cagaggcaaggagacttgga

SEQ ID NO: 7391068 - DNA, 20 bp, Homo sapiens
cagaggcaaggagacttgga

SEQ ID NO: 7391069 - DNA, 22 bp, Homo sapiens
cagaggcacaagaaagcaaggc

SEQ ID NO: 7391070 - DNA, 20 bp, Homo sapiens
cagaggcaaggagacttgga

SEQ ID NO: 7391071 - DNA, 22 bp, Homo sapiens
cagaggcacaagaaagcaaggc

SEQ ID NO: 7391072 - DNA, 22 bp, Homo sapiens
cagaggcacaagaaagcaaggc

SEQ ID NO: 7391073 - DNA, 22 bp, Homo sapiens
cagaggcacaagaaagcaaggc

SEQ ID NO: 7391074 - DNA, 22 bp, Homo sapiens
cagaggcacaagaaagcaaggc

SEQ ID NO: 7391075 - DNA, 22 bp, Homo sapiens
cagaggcaaaagaggtggaggt

SEQ ID NO: 7391076 - DNA, 22 bp, Homo sapiens
cagaggcaaaagaggtggaggt

SEQ ID NO: 7391077 - DNA, 22 bp, Homo sapiens
cagaggcaaaagaggtggaggt

SEQ ID NO: 7391078 - DNA, 22 bp, Homo sapiens
cagaggcaaaagaggtggaggt

SEQ ID NO: 7391079 - DNA, 20 bp, Homo sapiens
cagaggcaaggagacttgga

SEQ ID NO: 7391080 - DNA, 20 bp, Homo sapiens
cagaggcaaggagacttgga

SEQ ID NO: 7391081 - DNA, 20 bp, Homo sapiens
cagaggcaaggagacttgga

SEQ ID NO: 7391082 - DNA, 20 bp, Homo sapiens
cagaggcaaggagacttgga

SEQ ID NO: 7391083 - DNA, 20 bp, Homo sapiens
cagaggcaaggagacttgga

SEQ ID NO: 7391084 - DNA, 22 bp, Homo sapiens
cagaggcaaaagaggtggaggt

SEQ ID NO: 7391085 - DNA, 22 bp, Homo sapiens
cagaggcaaaagaggtggaggt

SEQ ID NO: 7391086 - DNA, 22 bp, Homo sapiens
cagaggcaaaagaggtggaggt

SEQ ID NO: 7391087 - DNA, 22 bp, Homo sapiens
cagaggcaaaagaggtggaggt

SEQ ID NO: 7391088 - DNA, 22 bp, Homo sapiens
cagaggcaaaagaggtggaggt

SEQ ID NO: 7391089 - DNA, 22 bp, Homo sapiens
cagaggattccctagtgacctg

SEQ ID NO: 7391090 - DNA, 22 bp, Homo sapiens
cagaggattatggagatggtct

SEQ ID NO: 7391091 - DNA, 22 bp, Homo sapiens
cagaggattatttcagaatcta

SEQ ID NO: 7391092 - DNA, 22 bp, Homo sapiens
cagaggatatatggtttgtatg

SEQ ID NO: 7391093 - DNA, 22 bp, Homo sapiens
cagaggatgatctggcctctct

SEQ ID NO: 7391094 - DNA, 22 bp, Homo sapiens
cagaggacttcccactcatctg

SEQ ID NO: 7391095 - DNA, 22 bp, Homo sapiens
cagaggagaattgcgggatcat

SEQ ID NO: 7391096 - DNA, 22 bp, Homo sapiens
gggctgagtgggcctcttactt

SEQ ID NO: 7391097 - DNA, 22 bp, Homo sapiens
cagaggagaattgcgggatcat

SEQ ID NO: 7391098 - DNA, 22 bp, Homo sapiens
cagaggagaattgcgggatcat

SEQ ID NO: 7391099 - DNA, 22 bp, Homo sapiens
cagaggagaattgcgggatcat

SEQ ID NO: 7391100 - DNA, 22 bp, Homo sapiens
gggctgagtcatctggggcctc

SEQ ID NO: 7391101 - DNA, 22 bp, Homo sapiens
gggctgaggggtatctcatggg

SEQ ID NO: 7391102 - DNA, 22 bp, Homo sapiens
gggctgagtcatctggggcctc

SEQ ID NO: 7391103 - DNA, 22 bp, Homo sapiens
gggctgagtcatctggggcctc

SEQ ID NO: 7391104 - DNA, 22 bp, Homo sapiens
gggctgagtcatctggggcctc

SEQ ID NO: 7391105 - DNA, 22 bp, Homo sapiens
gggctgaggggtatctcatggg

SEQ ID NO: 7391106 - DNA, 22 bp, Homo sapiens
gggctgaggggtatctcatggg

SEQ ID NO: 7391107 - DNA, 22 bp, Homo sapiens
gggctgaggggtatctcatggg

SEQ ID NO: 7391108 - DNA, 22 bp, Homo sapiens
gggctgaggggtatctcatggg

SEQ ID NO: 7391109 - DNA, 22 bp, Homo sapiens
cagagctgggtttgggaaacct

SEQ ID NO: 7391110 - DNA, 22 bp, Homo sapiens
gggctgaggggtatctcatggg

SEQ ID NO: 7391111 - DNA, 22 bp, Homo sapiens
gggctgaggggtatctcatggg

SEQ ID NO: 7391112 - DNA, 22 bp, Homo sapiens
gggctgaggggtatctcatggg

SEQ ID NO: 7391113 - DNA, 22 bp, Homo sapiens
cagagctgggtttgggaaacct

SEQ ID NO: 7391114 - DNA, 22 bp, Homo sapiens
gggctgagtctgctgcctgtca

SEQ ID NO: 7391115 - DNA, 22 bp, Homo sapiens
gggctgagtctgctgcctgtca

SEQ ID NO: 7391116 - DNA, 22 bp, Homo sapiens
gggctgagtctgctgcctgtca

SEQ ID NO: 7391117 - DNA, 22 bp, Homo sapiens
gggctgagtctgctgcctgtca

SEQ ID NO: 7391118 - DNA, 22 bp, Homo sapiens
gggctgagtctgctgcctgtca

SEQ ID NO: 7391119 - DNA, 22 bp, Homo sapiens
gggctgagtctgctgcctgtca

SEQ ID NO: 7391120 - DNA, 22 bp, Homo sapiens
gggctgagtctgctgcctgtca

SEQ ID NO: 7391121 - DNA, 22 bp, Homo sapiens
gggctgagtcatctggggcctc

SEQ ID NO: 7391122 - DNA, 22 bp, Homo sapiens
gggctgagtcatctggggcctc

SEQ ID NO: 7391123 - DNA, 22 bp, Homo sapiens
gggctgagtcatctggggcctc

SEQ ID NO: 7391124 - DNA, 22 bp, Homo sapiens
gggctgagtgacctcaggccaa

SEQ ID NO: 7391125 - DNA, 22 bp, Homo sapiens
gggctgagtgacctcaggccaa

SEQ ID NO: 7391126 - DNA, 22 bp, Homo sapiens
gggctgagtgacctcaggccaa

SEQ ID NO: 7391127 - DNA, 22 bp, Homo sapiens
gggctgagtgacctcaggccaa

SEQ ID NO: 7391128 - DNA, 22 bp, Homo sapiens
gggctgagtgacctcaggccaa

SEQ ID NO: 7391129 - DNA, 22 bp, Homo sapiens
gggctgagtctgctgcctgtca

SEQ ID NO: 7391130 - DNA, 22 bp, Homo sapiens
gggctgagtgacctcaggccaa

SEQ ID NO: 7391131 - DNA, 22 bp, Homo sapiens
gggctgagtgacctcaggccaa

SEQ ID NO: 7391132 - DNA, 22 bp, Homo sapiens
gggctgagtgacctcaggccaa

SEQ ID NO: 7391133 - DNA, 22 bp, Homo sapiens
gggctgagtgacctcaggccaa

SEQ ID NO: 7391134 - DNA, 22 bp, Homo sapiens
cagagctggggactgttggatg

SEQ ID NO: 7391135 - DNA, 22 bp, Homo sapiens
cagagctggggactgttggatg

SEQ ID NO: 7391136 - DNA, 22 bp, Homo sapiens
cagagctggggactgttggatg

SEQ ID NO: 7391137 - DNA, 22 bp, Homo sapiens
cagagctgggcatggtgaaagg

SEQ ID NO: 7391138 - DNA, 22 bp, Homo sapiens
cagagctggggactgttggatg

SEQ ID NO: 7391139 - DNA, 22 bp, Homo sapiens
cagagctgggtttgggaaacct

SEQ ID NO: 7391140 - DNA, 22 bp, Homo sapiens
cagagctggggactgttggatg

SEQ ID NO: 7391141 - DNA, 22 bp, Homo sapiens
cagagctggggactgttggatg

SEQ ID NO: 7391142 - DNA, 22 bp, Homo sapiens
cagagctgggatcccatgggcg

SEQ ID NO: 7391143 - DNA, 20 bp, Homo sapiens
cagagctgggatttgaacac

SEQ ID NO: 7391144 - DNA, 20 bp, Homo sapiens
cagagctgggatttgaacac

SEQ ID NO: 7391145 - DNA, 22 bp, Homo sapiens
cagagctgggcatggtgaaagg

SEQ ID NO: 7391146 - DNA, 22 bp, Homo sapiens
cagagctgggcatggtgaaagg

SEQ ID NO: 7391147 - DNA, 22 bp, Homo sapiens
cagagctgggcatggtgaaagg

SEQ ID NO: 7391148 - DNA, 20 bp, Homo sapiens
cagagctgggatttgaacac

SEQ ID NO: 7391149 - DNA, 22 bp, Homo sapiens
cagagctgggatcccatgggcg

SEQ ID NO: 7391150 - DNA, 22 bp, Homo sapiens
cagagctgggatcccatgggcg

SEQ ID NO: 7391151 - DNA, 22 bp, Homo sapiens
cagagctgggatcccatgggcg

SEQ ID NO: 7391152 - DNA, 23 bp, Homo sapiens
cagagctggcttcatgggtgtgc

SEQ ID NO: 7391153 - DNA, 22 bp, Homo sapiens
cagagctgggatcccatgggcg

SEQ ID NO: 7391154 - DNA, 22 bp, Homo sapiens
cagagctgggatcccatgggcg

SEQ ID NO: 7391155 - DNA, 22 bp, Homo sapiens
cagagctgggatcccatgggcg

SEQ ID NO: 7391156 - DNA, 22 bp, Homo sapiens
cagagctgggatcccatgggcg

SEQ ID NO: 7391157 - DNA, 22 bp, Homo sapiens
cagagctgggatcccatgggcg

SEQ ID NO: 7391158 - DNA, 22 bp, Homo sapiens
cagagctgggatcccatgggcg

SEQ ID NO: 7391159 - DNA, 23 bp, Homo sapiens
cagagctggcttcatgggtgtgc

SEQ ID NO: 7391160 - DNA, 23 bp, Homo sapiens
cagagctggcttcatgggtgtgc

SEQ ID NO: 7391161 - DNA, 23 bp, Homo sapiens
cagagctggcttcatgggtgtgc

SEQ ID NO: 7391162 - DNA, 23 bp, Homo sapiens
cagagctggcttcatgggtgtgc

SEQ ID NO: 7391163 - DNA, 23 bp, Homo sapiens
cagagctggcttcatgggtgtgc

SEQ ID NO: 7391164 - DNA, 23 bp, Homo sapiens
cagagctggcttcatgggtgtgc

SEQ ID NO: 7391165 - DNA, 23 bp, Homo sapiens
cagagctggcttcatgggtgtgc

SEQ ID NO: 7391166 - DNA, 22 bp, Homo sapiens
cagagctggctctgcatgtaca

SEQ ID NO: 7391167 - DNA, 22 bp, Homo sapiens
cagagctggctctgcatgtaca

SEQ ID NO: 7391168 - DNA, 22 bp, Homo sapiens
cagagctggctctgcatgtaca

SEQ ID NO: 7391169 - DNA, 22 bp, Homo sapiens
cagagctggctctgcatgtaca

SEQ ID NO: 7391170 - DNA, 23 bp, Homo sapiens
cagagctggctcagagctgcctg

SEQ ID NO: 7391171 - DNA, 22 bp, Homo sapiens
cagagctggctctgcatgtaca

SEQ ID NO: 7391172 - DNA, 19 bp, Homo sapiens
cagagctgctggcctcgtc

SEQ ID NO: 7391173 - DNA, 22 bp, Homo sapiens
cagagctgcttcccagtttgtg

SEQ ID NO: 7391174 - DNA, 22 bp, Homo sapiens
cagagctgcttcccagtttgtg

SEQ ID NO: 7391175 - DNA, 22 bp, Homo sapiens
cagagcctgcctctggctgtgg

SEQ ID NO: 7391176 - DNA, 22 bp, Homo sapiens
cagagcctgctcacgtctctgt

SEQ ID NO: 7391177 - DNA, 22 bp, Homo sapiens
cagagcctctaaaatttctatc

SEQ ID NO: 7391178 - DNA, 22 bp, Homo sapiens
cagagcctctcagaggtcagac

SEQ ID NO: 7391179 - DNA, 22 bp, Homo sapiens
cagagcctccctcctctgccat

SEQ ID NO: 7391180 - DNA, 22 bp, Homo sapiens
cagagcctctcagaggtcagac

SEQ ID NO: 7391181 - DNA, 22 bp, Homo sapiens
cagagcctctcagccccttggg

SEQ ID NO: 7391182 - DNA, 22 bp, Homo sapiens
cagagcctctcagccccttggg

SEQ ID NO: 7391183 - DNA, 22 bp, Homo sapiens
cagagcctctgccctgggcact

SEQ ID NO: 7391184 - DNA, 22 bp, Homo sapiens
cagagcctctgccctgggcact

SEQ ID NO: 7391185 - DNA, 22 bp, Homo sapiens
cagagcctgcctctggctgtgg

SEQ ID NO: 7391186 - DNA, 22 bp, Homo sapiens
cagagcctctgccctgggcact

SEQ ID NO: 7391187 - DNA, 22 bp, Homo sapiens
ggtgacagttccggaggtacag

SEQ ID NO: 7391188 - DNA, 22 bp, Homo sapiens
ggtgacagtggttaaaatttgt

SEQ ID NO: 7391189 - DNA, 22 bp, Homo sapiens
ggtgacagtggttaaaatttgt

SEQ ID NO: 7391190 - DNA, 22 bp, Homo sapiens
ggtgacagtggttaaaatttgt

SEQ ID NO: 7391191 - DNA, 22 bp, Homo sapiens
ggtgacagtggttaaaatttgt

SEQ ID NO: 7391192 - DNA, 22 bp, Homo sapiens
ggtgacagcgggtcaagaggag

SEQ ID NO: 7391193 - DNA, 22 bp, Homo sapiens
ggtctggaataaggtccaggaa

SEQ ID NO: 7391194 - DNA, 22 bp, Homo sapiens
ggtgacagtggttaaaatttgt

SEQ ID NO: 7391195 - DNA, 22 bp, Homo sapiens
ggtgacagtggttaaaatttgt

SEQ ID NO: 7391196 - DNA, 22 bp, Homo sapiens
ggtctggaagcgtcccaaaggt

SEQ ID NO: 7391197 - DNA, 22 bp, Homo sapiens
ggtctggaagcgtcccaaaggt

SEQ ID NO: 7391198 - DNA, 22 bp, Homo sapiens
ggtctggaagcgcagtaggctg

SEQ ID NO: 7391199 - DNA, 22 bp, Homo sapiens
ggtctggaataaggtccaggaa

SEQ ID NO: 7391200 - DNA, 22 bp, Homo sapiens
ggtctggaataaggtccaggaa

SEQ ID NO: 7391201 - DNA, 22 bp, Homo sapiens
ggtctggaataaggtccaggaa

SEQ ID NO: 7391202 - DNA, 22 bp, Homo sapiens
ggtctggaataaggtccaggaa

SEQ ID NO: 7391203 - DNA, 22 bp, Homo sapiens
ggtctgctttccttgccactgt

SEQ ID NO: 7391204 - DNA, 22 bp, Homo sapiens
ggtgacctcacctggtcccacc

SEQ ID NO: 7391205 - DNA, 22 bp, Homo sapiens
ggtgacctcacctggtcccacc

SEQ ID NO: 7391206 - DNA, 22 bp, Homo sapiens
ggtgacctcacctggtcccacc

SEQ ID NO: 7391207 - DNA, 22 bp, Homo sapiens
ggtgaccagggtcagtagcttt

SEQ ID NO: 7391208 - DNA, 22 bp, Homo sapiens
ggtgacctcacctggtcccacc

SEQ ID NO: 7391209 - DNA, 22 bp, Homo sapiens
ggtgacctcacctggtcccacc

SEQ ID NO: 7391210 - DNA, 22 bp, Homo sapiens
ggtgacatagttacttcaggct

SEQ ID NO: 7391211 - DNA, 22 bp, Homo sapiens
ggtgacagtggttaaaatttgt

SEQ ID NO: 7391212 - DNA, 22 bp, Homo sapiens
ggtgacagttccggaggtacag

SEQ ID NO: 7391213 - DNA, 22 bp, Homo sapiens
ggtgacagttccggaggtacag

SEQ ID NO: 7391214 - DNA, 22 bp, Homo sapiens
ggtgacatcagtaaccgtggtt

SEQ ID NO: 7391215 - DNA, 22 bp, Homo sapiens
ggtgacatagttacttcaggct

SEQ ID NO: 7391216 - DNA, 22 bp, Homo sapiens
ggtgacatctagagacatccaa

SEQ ID NO: 7391217 - DNA, 22 bp, Homo sapiens
ggtgacatcagtaaccgtggtt

SEQ ID NO: 7391218 - DNA, 22 bp, Homo sapiens
ggtgacatgcacctatcccttg

SEQ ID NO: 7391219 - DNA, 22 bp, Homo sapiens
ggtgacattatcattattttaa

SEQ ID NO: 7391220 - DNA, 22 bp, Homo sapiens
ggtgacattatcattattttaa

SEQ ID NO: 7391221 - DNA, 19 bp, Homo sapiens
ggtgaccacctggtcagtg

SEQ ID NO: 7391222 - DNA, 19 bp, Homo sapiens
ggtgaccacctggtcagtg

SEQ ID NO: 7391223 - DNA, 22 bp, Homo sapiens
ggtgacattatcattattttaa

SEQ ID NO: 7391224 - DNA, 22 bp, Homo sapiens
ggtctgaggtgggacccaggaa

SEQ ID NO: 7391225 - DNA, 22 bp, Homo sapiens
ggtctgaggtgggacccaggaa

SEQ ID NO: 7391226 - DNA, 22 bp, Homo sapiens
ggtctgaggtgggacccaggaa

SEQ ID NO: 7391227 - DNA, 22 bp, Homo sapiens
ggtctgaggctccaaggaggtg

SEQ ID NO: 7391228 - DNA, 22 bp, Homo sapiens
ggtctgaggctccaaggaggtg

SEQ ID NO: 7391229 - DNA, 22 bp, Homo sapiens
ggtctgagtagagggctggcga

SEQ ID NO: 7391230 - DNA, 22 bp, Homo sapiens
ggtctgagtagagggctggcga

SEQ ID NO: 7391231 - DNA, 22 bp, Homo sapiens
ggtctgaggtgggacccaggaa

SEQ ID NO: 7391232 - DNA, 22 bp, Homo sapiens
ggtctgagatatttgttcagct

SEQ ID NO: 7391233 - DNA, 18 bp, Homo sapiens
ggtctgagatcgtttttc

SEQ ID NO: 7391234 - DNA, 22 bp, Homo sapiens
ggtctgagcttgagcccatgct

SEQ ID NO: 7391235 - DNA, 22 bp, Homo sapiens
ggtctgagcttgagcccatgct

SEQ ID NO: 7391236 - DNA, 22 bp, Homo sapiens
ggtctgagcttgagcccatgct

SEQ ID NO: 7391237 - DNA, 22 bp, Homo sapiens
ggtctgaggctccaaggaggtg

SEQ ID NO: 7391238 - DNA, 22 bp, Homo sapiens
ggtctgagtgccagggagagaa

SEQ ID NO: 7391239 - DNA, 22 bp, Homo sapiens
ggtctgagtgggcaggggccgg

SEQ ID NO: 7391240 - DNA, 22 bp, Homo sapiens
ggtctgagtgggcaggggccgg

SEQ ID NO: 7391241 - DNA, 22 bp, Homo sapiens
ggtctgagtggggcctgagatt

SEQ ID NO: 7391242 - DNA, 22 bp, Homo sapiens
ggtctgagtgccagggagagaa

SEQ ID NO: 7391243 - DNA, 22 bp, Homo sapiens
ggtctgagtgccagggagagaa

SEQ ID NO: 7391244 - DNA, 22 bp, Homo sapiens
ggtctggaacccctcaagtgac

SEQ ID NO: 7391245 - DNA, 21 bp, Homo sapiens
ggtctgctgtgtctagcctca

SEQ ID NO: 7391246 - DNA, 21 bp, Homo sapiens
ggtctgctgtgtctagcctca

SEQ ID NO: 7391247 - DNA, 22 bp, Homo sapiens
ggtctgccctgggtggaggcgc

SEQ ID NO: 7391248 - DNA, 22 bp, Homo sapiens
ggtctgcccactactctccatt

SEQ ID NO: 7391249 - DNA, 22 bp, Homo sapiens
ggtctgcccactactctccatt

SEQ ID NO: 7391250 - DNA, 22 bp, Homo sapiens
ggtctgccacaagatttttgag

SEQ ID NO: 7391251 - DNA, 22 bp, Homo sapiens
ggtctgcccactactctccatt

SEQ ID NO: 7391252 - DNA, 22 bp, Homo sapiens
ggtgacgaatccatagcatcga

SEQ ID NO: 7391253 - DNA, 22 bp, Homo sapiens
ggtgacggggcccaggtttcct

SEQ ID NO: 7391254 - DNA, 22 bp, Homo sapiens
ggtgacgaatccatagcatcga

SEQ ID NO: 7391255 - DNA, 22 bp, Homo sapiens
ggtgacggggcccaggtttcct

SEQ ID NO: 7391256 - DNA, 22 bp, Homo sapiens
ggtgacggggcccaggtttcct

SEQ ID NO: 7391257 - DNA, 22 bp, Homo sapiens
ggtgactcccagctgctctctt

SEQ ID NO: 7391258 - DNA, 22 bp, Homo sapiens
ggtgactcccagctgctctctt

SEQ ID NO: 7391259 - DNA, 20 bp, Homo sapiens
ggtgagacaggcttctgcac

SEQ ID NO: 7391260 - DNA, 17 bp, Homo sapiens
ggtgagacctcccactc

SEQ ID NO: 7391261 - DNA, 22 bp, Homo sapiens
cagcaaagtaagctgacatgta

SEQ ID NO: 7391262 - DNA, 22 bp, Homo sapiens
cagcaaaggtagaagcacagga

SEQ ID NO: 7391263 - DNA, 22 bp, Homo sapiens
ggtgagactttagaagagccag

SEQ ID NO: 7391264 - DNA, 22 bp, Homo sapiens
ggtgagactttagaagagccag

SEQ ID NO: 7391265 - DNA, 22 bp, Homo sapiens
ggtgagactttagaagagccag

SEQ ID NO: 7391266 - DNA, 22 bp, Homo sapiens
cagcaagacaaggaacaaactg

SEQ ID NO: 7391267 - DNA, 22 bp, Homo sapiens
cagcaaatactactagttttta

SEQ ID NO: 7391268 - DNA, 22 bp, Homo sapiens
cagcaaatactactagttttta

SEQ ID NO: 7391269 - DNA, 22 bp, Homo sapiens
cagcaagacaaggaacaaactg

SEQ ID NO: 7391270 - DNA, 22 bp, Homo sapiens
cagcaaagtaagctgacatgta

SEQ ID NO: 7391271 - DNA, 22 bp, Homo sapiens
cagcaaagtaagctgacatgta

SEQ ID NO: 7391272 - DNA, 22 bp, Homo sapiens
cagcaaagtaagctgacatgta

SEQ ID NO: 7391273 - DNA, 22 bp, Homo sapiens
cagcaaagtaagctgacatgta

SEQ ID NO: 7391274 - DNA, 22 bp, Homo sapiens
cagcaaagtaagctgacatgta

SEQ ID NO: 7391275 - DNA, 22 bp, Homo sapiens
cagcaaagtaagctgacatgta

SEQ ID NO: 7391276 - DNA, 22 bp, Homo sapiens
cagcaagacaaggaacaaactg

SEQ ID NO: 7391277 - DNA, 22 bp, Homo sapiens
cagcaagacaggattcccgtgg

SEQ ID NO: 7391278 - DNA, 22 bp, Homo sapiens
cagcaagacaggattcccgtgg

SEQ ID NO: 7391279 - DNA, 22 bp, Homo sapiens
cagcaagacagtttcctaagtg

SEQ ID NO: 7391280 - DNA, 22 bp, Homo sapiens
cagcaagacagtttcctaagtg

SEQ ID NO: 7391281 - DNA, 21 bp, Homo sapiens
cagcaagacatgtttatcaag

SEQ ID NO: 7391282 - DNA, 21 bp, Homo sapiens
cagcaagacatgtttatcaag

SEQ ID NO: 7391283 - DNA, 22 bp, Homo sapiens
cagcaagacagtttcctaagtg

SEQ ID NO: 7391284 - DNA, 22 bp, Homo sapiens
cagcaagacagtttcctaagtg

SEQ ID NO: 7391285 - DNA, 21 bp, Homo sapiens
cagcaagacatgtttatcaag

SEQ ID NO: 7391286 - DNA, 21 bp, Homo sapiens
cagcaagacatgtttatcaag

SEQ ID NO: 7391287 - DNA, 22 bp, Homo sapiens
cagcaagatggtgaatgagacg

SEQ ID NO: 7391288 - DNA, 22 bp, Homo sapiens
cagcaagatggtgaatgagacg

SEQ ID NO: 7391289 - DNA, 22 bp, Homo sapiens
cagcaagattaagggcagaaaa

SEQ ID NO: 7391290 - DNA, 22 bp, Homo sapiens
cagcaagattaagggcagaaaa

SEQ ID NO: 7391291 - DNA, 22 bp, Homo sapiens
cagcaagattaagggcagaaaa

SEQ ID NO: 7391292 - DNA, 22 bp, Homo sapiens
cagcaagattaagggcagaaaa

SEQ ID NO: 7391293 - DNA, 22 bp, Homo sapiens
cagcaagatttttaaagcaagg

SEQ ID NO: 7391294 - DNA, 22 bp, Homo sapiens
cagcaagattaagggcagaaaa

SEQ ID NO: 7391295 - DNA, 22 bp, Homo sapiens
cagcaagatttttaaagcaagg

SEQ ID NO: 7391296 - DNA, 22 bp, Homo sapiens
cagcaagatttttaaagcaagg

SEQ ID NO: 7391297 - DNA, 22 bp, Homo sapiens
cagcaagatttttaaagcaagg

SEQ ID NO: 7391298 - DNA, 21 bp, Homo sapiens
cagcaaggaagtcgagtaggt

SEQ ID NO: 7391299 - DNA, 21 bp, Homo sapiens
cagcaaggaagtcgagtaggt

SEQ ID NO: 7391300 - DNA, 21 bp, Homo sapiens
cagcaaggaagtcgagtaggt

SEQ ID NO: 7391301 - DNA, 21 bp, Homo sapiens
cagcaaggaagtcgagtaggt

SEQ ID NO: 7391302 - DNA, 21 bp, Homo sapiens
cagcaaggaagtcgagtaggt

SEQ ID NO: 7391303 - DNA, 22 bp, Homo sapiens
cagcaagccaaatgtggcccga

SEQ ID NO: 7391304 - DNA, 22 bp, Homo sapiens
cagcaagccaaatgtggcccga

SEQ ID NO: 7391305 - DNA, 22 bp, Homo sapiens
cagcaagccaaatgtggcccga

SEQ ID NO: 7391306 - DNA, 22 bp, Homo sapiens
cagcaagatttttaaagcaagg

SEQ ID NO: 7391307 - DNA, 22 bp, Homo sapiens
cagcaagatttttaaagcaagg

SEQ ID NO: 7391308 - DNA, 22 bp, Homo sapiens
cagcaagagggtaaggttgaag

SEQ ID NO: 7391309 - DNA, 22 bp, Homo sapiens
cagcaagagggtaaggttgaag

SEQ ID NO: 7391310 - DNA, 22 bp, Homo sapiens
cagcaagagttggggttgttgg

SEQ ID NO: 7391311 - DNA, 22 bp, Homo sapiens
cagcaagagttggggttgttgg

SEQ ID NO: 7391312 - DNA, 22 bp, Homo sapiens
cagcaagagggtaaggttgaag

SEQ ID NO: 7391313 - DNA, 22 bp, Homo sapiens
cagcaagagaggcagggcaaat

SEQ ID NO: 7391314 - DNA, 22 bp, Homo sapiens
cagcaagagaggcagggcaaat

SEQ ID NO: 7391315 - DNA, 22 bp, Homo sapiens
cagcaagagaggcagggcaaat

SEQ ID NO: 7391316 - DNA, 22 bp, Homo sapiens
cagcaagagactgttctctaag

SEQ ID NO: 7391317 - DNA, 22 bp, Homo sapiens
cagcaagagactgttctctaag

SEQ ID NO: 7391318 - DNA, 22 bp, Homo sapiens
cagcaagagactgttctctaag

SEQ ID NO: 7391319 - DNA, 22 bp, Homo sapiens
cagcaagagaggcagggcaaat

SEQ ID NO: 7391320 - DNA, 22 bp, Homo sapiens
cagcaagagaggcagggcaaat

SEQ ID NO: 7391321 - DNA, 22 bp, Homo sapiens
cagcaagagactgttctctaag

SEQ ID NO: 7391322 - DNA, 22 bp, Homo sapiens
cagcaagagactgttctctaag

SEQ ID NO: 7391323 - DNA, 22 bp, Homo sapiens
cagcaagagactgttctctaag

SEQ ID NO: 7391324 - DNA, 22 bp, Homo sapiens
cagcaagacttcagggcttggt

SEQ ID NO: 7391325 - DNA, 22 bp, Homo sapiens
cagcaagacttcagggcttggt

SEQ ID NO: 7391326 - DNA, 22 bp, Homo sapiens
cagcaagacttcagggcttggt

SEQ ID NO: 7391327 - DNA, 22 bp, Homo sapiens
cagcaagacttcagggcttggt

SEQ ID NO: 7391328 - DNA, 22 bp, Homo sapiens
ggtgctgattaagaactgtata

SEQ ID NO: 7391329 - DNA, 22 bp, Homo sapiens
ggtgctgatgttattgatgctg

SEQ ID NO: 7391330 - DNA, 22 bp, Homo sapiens
ggtgctgattaagaactgtata

SEQ ID NO: 7391331 - DNA, 22 bp, Homo sapiens
ggtgctgattcactgacttctg

SEQ ID NO: 7391332 - DNA, 22 bp, Homo sapiens
ggtgctgattcactgacttctg

SEQ ID NO: 7391333 - DNA, 22 bp, Homo sapiens
ggtgctgatgttattgatgctg

SEQ ID NO: 7391334 - DNA, 22 bp, Homo sapiens
ggtgctgatgagttaggagagg

SEQ ID NO: 7391335 - DNA, 22 bp, Homo sapiens
ggtgctgatgaagatgtagcct

SEQ ID NO: 7391336 - DNA, 22 bp, Homo sapiens
ggtgctgatttgttgctgagat

SEQ ID NO: 7391337 - DNA, 22 bp, Homo sapiens
ggtgctggacacgtggcactcc

SEQ ID NO: 7391338 - DNA, 22 bp, Homo sapiens
ggtgctggacacgtggcactcc

SEQ ID NO: 7391339 - DNA, 22 bp, Homo sapiens
ggtgctggacacgtggcactcc

SEQ ID NO: 7391340 - DNA, 22 bp, Homo sapiens
ggtgctgctgctgaacccagct

SEQ ID NO: 7391341 - DNA, 22 bp, Homo sapiens
ggtgctgggaacgaggaattca

SEQ ID NO: 7391342 - DNA, 22 bp, Homo sapiens
ggtgctgggaacgaggaattca

SEQ ID NO: 7391343 - DNA, 22 bp, Homo sapiens
ggtgctgggaacgaggaattca

SEQ ID NO: 7391344 - DNA, 22 bp, Homo sapiens
ggtgctggacacgtggcactcc

SEQ ID NO: 7391345 - DNA, 21 bp, Homo sapiens
cagcacagtactgggtcttgc

SEQ ID NO: 7391346 - DNA, 23 bp, Homo sapiens
cagcacagtacatttcctgtctc

SEQ ID NO: 7391347 - DNA, 23 bp, Homo sapiens
cagcacagtacatttcctgtctc

SEQ ID NO: 7391348 - DNA, 22 bp, Homo sapiens
cagcacagtacaaggcacggat

SEQ ID NO: 7391349 - DNA, 23 bp, Homo sapiens
cagcacagtacatttcctgtctc

SEQ ID NO: 7391350 - DNA, 23 bp, Homo sapiens
cagcacagtacatttcctgtctc

SEQ ID NO: 7391351 - DNA, 22 bp, Homo sapiens
cagcacaattttcaggagtcca

SEQ ID NO: 7391352 - DNA, 22 bp, Homo sapiens
cagcacaattttcaggagtcca

SEQ ID NO: 7391353 - DNA, 22 bp, Homo sapiens
cagcacaattttcaggagtcca

SEQ ID NO: 7391354 - DNA, 22 bp, Homo sapiens
ggtgctggttcagggtggctgt

SEQ ID NO: 7391355 - DNA, 22 bp, Homo sapiens
cagcacagtacaaggcacggat

SEQ ID NO: 7391356 - DNA, 22 bp, Homo sapiens
cagcacagtacaaggcacggat

SEQ ID NO: 7391357 - DNA, 22 bp, Homo sapiens
cagcacacagtgactcgcacct

SEQ ID NO: 7391358 - DNA, 22 bp, Homo sapiens
cagcacacagtgactcgcacct

SEQ ID NO: 7391359 - DNA, 22 bp, Homo sapiens
cagcacacagtgactcgcacct

SEQ ID NO: 7391360 - DNA, 22 bp, Homo sapiens
cagcacacagtgactcgcacct

SEQ ID NO: 7391361 - DNA, 22 bp, Homo sapiens
ggtgctgacattcagagtctgg

SEQ ID NO: 7391362 - DNA, 19 bp, Homo sapiens
ggtgctgacatcatgcttt

SEQ ID NO: 7391363 - DNA, 22 bp, Homo sapiens
ggtgctgacattcagagtctgg

SEQ ID NO: 7391364 - DNA, 22 bp, Homo sapiens
ggtgctgacattcagagtctgg

SEQ ID NO: 7391365 - DNA, 22 bp, Homo sapiens
ggtgctgacattcagagtctgg

SEQ ID NO: 7391366 - DNA, 19 bp, Homo sapiens
ggtgctgacatcatgcttt

SEQ ID NO: 7391367 - DNA, 22 bp, Homo sapiens
ggtgctgaattctggaggaggc

SEQ ID NO: 7391368 - DNA, 22 bp, Homo sapiens
ggtgctgaataaatactagtta

SEQ ID NO: 7391369 - DNA, 22 bp, Homo sapiens
cagcaaggactgggcatgtgaa

SEQ ID NO: 7391370 - DNA, 22 bp, Homo sapiens
cagcaaggactgggcatgtgaa

SEQ ID NO: 7391371 - DNA, 21 bp, Homo sapiens
cagcaaggaagtcgagtaggt

SEQ ID NO: 7391372 - DNA, 22 bp, Homo sapiens
cagcaaggactgggcatgtgaa

SEQ ID NO: 7391373 - DNA, 22 bp, Homo sapiens
cagcaaggactgggcatgtgaa

SEQ ID NO: 7391374 - DNA, 22 bp, Homo sapiens
ggtgctgaaggactataacggt

SEQ ID NO: 7391375 - DNA, 22 bp, Homo sapiens
cagcaaggactgggcatgtgaa

SEQ ID NO: 7391376 - DNA, 22 bp, Homo sapiens
cagcaaggactgggcatgtgaa

SEQ ID NO: 7391377 - DNA, 22 bp, Homo sapiens
cagcaaggactgggcatgtgaa

SEQ ID NO: 7391378 - DNA, 22 bp, Homo sapiens
cagcaaggactgggcatgtgaa

SEQ ID NO: 7391379 - DNA, 22 bp, Homo sapiens
ggtgctgactgaggatggcttg

SEQ ID NO: 7391380 - DNA, 22 bp, Homo sapiens
ggtgctgactctgtcgtgagca

SEQ ID NO: 7391381 - DNA, 22 bp, Homo sapiens
ggtgctgactgaggatggcttg

SEQ ID NO: 7391382 - DNA, 22 bp, Homo sapiens
ggtgctgactgaggatggcttg

SEQ ID NO: 7391383 - DNA, 22 bp, Homo sapiens
ggtgctgacttcacagtcttac

SEQ ID NO: 7391384 - DNA, 22 bp, Homo sapiens
ggtgctgagagcctaggagggc

SEQ ID NO: 7391385 - DNA, 22 bp, Homo sapiens
ggtgctgatgaagatgtagcct

SEQ ID NO: 7391386 - DNA, 22 bp, Homo sapiens
ggtgctgatctaaatttaggac

SEQ ID NO: 7391387 - DNA, 22 bp, Homo sapiens
ggtgctgatattgttttggtga

SEQ ID NO: 7391388 - DNA, 22 bp, Homo sapiens
ggtgctgatagtaacaataata

SEQ ID NO: 7391389 - DNA, 22 bp, Homo sapiens
ggtgctgatattgttttggtga

SEQ ID NO: 7391390 - DNA, 22 bp, Homo sapiens
ggtgctgaggccttggcaggga

SEQ ID NO: 7391391 - DNA, 22 bp, Homo sapiens
ggtgctgagtgagctagaggct

SEQ ID NO: 7391392 - DNA, 22 bp, Homo sapiens
ggtgctgagtgagctagaggct

SEQ ID NO: 7391393 - DNA, 20 bp, Homo sapiens
ggtgctgataagaaagaagt

SEQ ID NO: 7391394 - DNA, 22 bp, Homo sapiens
cagcacatagcatgcttgtcag

SEQ ID NO: 7391395 - DNA, 22 bp, Homo sapiens
cagcacatagcatgcttgtcag

SEQ ID NO: 7391396 - DNA, 22 bp, Homo sapiens
cagcacatagcatgcttgtcag

SEQ ID NO: 7391397 - DNA, 22 bp, Homo sapiens
cagcacatagtaggtattcact

SEQ ID NO: 7391398 - DNA, 22 bp, Homo sapiens
cagcacatctccaagaatttct

SEQ ID NO: 7391399 - DNA, 22 bp, Homo sapiens
cagcacatctccaagaatttct

SEQ ID NO: 7391400 - DNA, 22 bp, Homo sapiens
cagcacatctgattatatgact

SEQ ID NO: 7391401 - DNA, 22 bp, Homo sapiens
cagcacatctgattatatgact

SEQ ID NO: 7391402 - DNA, 22 bp, Homo sapiens
cagcacataagccgaagactgt

SEQ ID NO: 7391403 - DNA, 22 bp, Homo sapiens
cagcacataagccgaagactgt

SEQ ID NO: 7391404 - DNA, 22 bp, Homo sapiens
cagcacataagccgaagactgt

SEQ ID NO: 7391405 - DNA, 22 bp, Homo sapiens
cagcacataatcagtgattgtg

SEQ ID NO: 7391406 - DNA, 22 bp, Homo sapiens
cagcacataatcagtgattgtg

SEQ ID NO: 7391407 - DNA, 22 bp, Homo sapiens
cagcacataagccgaagactgt

SEQ ID NO: 7391408 - DNA, 22 bp, Homo sapiens
cagcacataagccgaagactgt

SEQ ID NO: 7391409 - DNA, 22 bp, Homo sapiens
cagcacataagccgaagactgt

SEQ ID NO: 7391410 - DNA, 22 bp, Homo sapiens
cagcacagtttgcttggcagag

SEQ ID NO: 7391411 - DNA, 22 bp, Homo sapiens
cagcacagtttgcttggcagag

SEQ ID NO: 7391412 - DNA, 22 bp, Homo sapiens
cagcacattgatcagagacgct

SEQ ID NO: 7391413 - DNA, 22 bp, Homo sapiens
cagcacatttactcagccctca

SEQ ID NO: 7391414 - DNA, 22 bp, Homo sapiens
cagcacatttactcagccctca

SEQ ID NO: 7391415 - DNA, 22 bp, Homo sapiens
cagcacatttactcagccctca

SEQ ID NO: 7391416 - DNA, 19 bp, Homo sapiens
cagcacatgcttctctgag

SEQ ID NO: 7391417 - DNA, 22 bp, Homo sapiens
cagcacatggatggagttagga

SEQ ID NO: 7391418 - DNA, 22 bp, Homo sapiens
cagcacatggatggagttagga

SEQ ID NO: 7391419 - DNA, 19 bp, Homo sapiens
cagcacatgcttctctgag

SEQ ID NO: 7391420 - DNA, 22 bp, Homo sapiens
cagcacatagcatgcttgtcag

SEQ ID NO: 7391421 - DNA, 22 bp, Homo sapiens
cagcacatcttctgatcttttg

SEQ ID NO: 7391422 - DNA, 22 bp, Homo sapiens
cagcacatgctcatcagggaag

SEQ ID NO: 7391423 - DNA, 22 bp, Homo sapiens
cagcacatgctcatcagggaag

SEQ ID NO: 7391424 - DNA, 19 bp, Homo sapiens
cagcacatgcttctctgag

SEQ ID NO: 7391425 - DNA, 22 bp, Homo sapiens
cagcacatgctcatcagggaag

SEQ ID NO: 7391426 - DNA, 22 bp, Homo sapiens
cagcaccatttgcagcctcttt

SEQ ID NO: 7391427 - DNA, 22 bp, Homo sapiens
cagcaccatttgcagcctcttt

SEQ ID NO: 7391428 - DNA, 22 bp, Homo sapiens
cagcaccatttgcagcctcttt

SEQ ID NO: 7391429 - DNA, 22 bp, Homo sapiens
cagcaccatttgcagcctcttt

SEQ ID NO: 7391430 - DNA, 22 bp, Homo sapiens
cagcaccatttgcagcctcttt

SEQ ID NO: 7391431 - DNA, 22 bp, Homo sapiens
cagcaccattttcctggtcagc

SEQ ID NO: 7391432 - DNA, 22 bp, Homo sapiens
cagcaccatttgcagcctcttt

SEQ ID NO: 7391433 - DNA, 22 bp, Homo sapiens
cagcaccaggcagacctggagc

SEQ ID NO: 7391434 - DNA, 22 bp, Homo sapiens
cagcaccagcatattccagggc

SEQ ID NO: 7391435 - DNA, 22 bp, Homo sapiens
cagcaccaggcagacctggagc

SEQ ID NO: 7391436 - DNA, 22 bp, Homo sapiens
cagcaccaggcagacctggagc

SEQ ID NO: 7391437 - DNA, 22 bp, Homo sapiens
cagcaccagcatattccagggc

SEQ ID NO: 7391438 - DNA, 22 bp, Homo sapiens
cagcacatttactcagccctca

SEQ ID NO: 7391439 - DNA, 22 bp, Homo sapiens
cagcacatttactcagccctca

SEQ ID NO: 7391440 - DNA, 22 bp, Homo sapiens
cagcacagtttcccccatgagc

SEQ ID NO: 7391441 - DNA, 22 bp, Homo sapiens
cagcacagtttcccccatgagc

SEQ ID NO: 7391442 - DNA, 22 bp, Homo sapiens
cagcacagtgttaggtaatttg

SEQ ID NO: 7391443 - DNA, 22 bp, Homo sapiens
cagcacagtttcccccatgagc

SEQ ID NO: 7391444 - DNA, 22 bp, Homo sapiens
cagcacagtttcccccatgagc

SEQ ID NO: 7391445 - DNA, 22 bp, Homo sapiens
cagcacagtttcccccatgagc

SEQ ID NO: 7391446 - DNA, 22 bp, Homo sapiens
cagcacagtttcccccatgagc

SEQ ID NO: 7391447 - DNA, 22 bp, Homo sapiens
cagcacagtgcagatgctgact

SEQ ID NO: 7391448 - DNA, 22 bp, Homo sapiens
cagcacagtgcagatgctgact

SEQ ID NO: 7391449 - DNA, 22 bp, Homo sapiens
cagcacagtgcagatgctgact

SEQ ID NO: 7391450 - DNA, 22 bp, Homo sapiens
cagcacagtttctggcccgccg

SEQ ID NO: 7391451 - DNA, 22 bp, Homo sapiens
cagcacagtttctggcccgccg

SEQ ID NO: 7391452 - DNA, 22 bp, Homo sapiens
cagcacagtttcccccatgagc

SEQ ID NO: 7391453 - DNA, 22 bp, Homo sapiens
cagcacagtttgcttggcagag

SEQ ID NO: 7391454 - DNA, 22 bp, Homo sapiens
cagcacagtttgcttggcagag

SEQ ID NO: 7391455 - DNA, 22 bp, Homo sapiens
cagcacagtttgcttggcagag

SEQ ID NO: 7391456 - DNA, 22 bp, Homo sapiens
cagcacagtttgcttggcagag

SEQ ID NO: 7391457 - DNA, 22 bp, Homo sapiens
cagcacagtttctggcccgccg

SEQ ID NO: 7391458 - DNA, 22 bp, Homo sapiens
cagcacagtttctggcccgccg

SEQ ID NO: 7391459 - DNA, 22 bp, Homo sapiens
cagcacagtgaccagacccact

SEQ ID NO: 7391460 - DNA, 22 bp, Homo sapiens
cagcacagtgcagatgctgact

SEQ ID NO: 7391461 - DNA, 22 bp, Homo sapiens
cagcacagtgcagatgctgact

SEQ ID NO: 7391462 - DNA, 22 bp, Homo sapiens
cagcacagtgcagatgctgact

SEQ ID NO: 7391463 - DNA, 22 bp, Homo sapiens
cagcacagtgaccagacccact

SEQ ID NO: 7391464 - DNA, 22 bp, Homo sapiens
cagcacagtgaccagacccact

SEQ ID NO: 7391465 - DNA, 22 bp, Homo sapiens
cagcacagtagagtagttgtaa

SEQ ID NO: 7391466 - DNA, 22 bp, Homo sapiens
cagcacagtagagtagttgtaa

SEQ ID NO: 7391467 - DNA, 22 bp, Homo sapiens
cagcacagtagagtagttgtaa

SEQ ID NO: 7391468 - DNA, 22 bp, Homo sapiens
cagcacagtcctttgcttactg

SEQ ID NO: 7391469 - DNA, 22 bp, Homo sapiens
cagcacagtcctttgcttactg

SEQ ID NO: 7391470 - DNA, 22 bp, Homo sapiens
cagcacagtcctttgcttactg

SEQ ID NO: 7391471 - DNA, 22 bp, Homo sapiens
cagcacagtgaccagacccact

SEQ ID NO: 7391472 - DNA, 22 bp, Homo sapiens
cagcacagtgaccagacccact

SEQ ID NO: 7391473 - DNA, 22 bp, Homo sapiens
cagcacagtgaccagacccact

SEQ ID NO: 7391474 - DNA, 22 bp, Homo sapiens
cagcacagtgaccagacccact

SEQ ID NO: 7391475 - DNA, 22 bp, Homo sapiens
cagcacagtgaccagacccact

SEQ ID NO: 7391476 - DNA, 22 bp, Homo sapiens
cagcacagtcctttgcttactg

SEQ ID NO: 7391477 - DNA, 22 bp, Homo sapiens
ggtcagtggccaggaagcagtc

SEQ ID NO: 7391478 - DNA, 22 bp, Homo sapiens
ggtcagtggccaggaagcagtc

SEQ ID NO: 7391479 - DNA, 21 bp, Homo sapiens
ggtcagtggctttcttgcacc

SEQ ID NO: 7391480 - DNA, 21 bp, Homo sapiens
ggtcagtggctttcttgcacc

SEQ ID NO: 7391481 - DNA, 21 bp, Homo sapiens
ggtcagtggctttcttgcacc

SEQ ID NO: 7391482 - DNA, 22 bp, Homo sapiens
ggtcagtggccaggaagcagtc

SEQ ID NO: 7391483 - DNA, 22 bp, Homo sapiens
ggtcagtggcagggggtacttc

SEQ ID NO: 7391484 - DNA, 22 bp, Homo sapiens
ggtcagtggcagggggtacttc

SEQ ID NO: 7391485 - DNA, 22 bp, Homo sapiens
ggtcagtggagccggaaagacc

SEQ ID NO: 7391486 - DNA, 22 bp, Homo sapiens
ggtcagtgctgccagagtgacc

SEQ ID NO: 7391487 - DNA, 22 bp, Homo sapiens
ggtcagtgctgccagagtgacc

SEQ ID NO: 7391488 - DNA, 22 bp, Homo sapiens
ggtcagtggagccggaaagacc

SEQ ID NO: 7391489 - DNA, 22 bp, Homo sapiens
ggtcagtggagccggaaagacc

SEQ ID NO: 7391490 - DNA, 22 bp, Homo sapiens
ggtcagtggacaaaggagtttc

SEQ ID NO: 7391491 - DNA, 22 bp, Homo sapiens
ggtcagtggacaaaggagtttc

SEQ ID NO: 7391492 - DNA, 22 bp, Homo sapiens
ggtcagtggcagggggtacttc

SEQ ID NO: 7391493 - DNA, 22 bp, Homo sapiens
ggtcagtgtatgtattgataag

SEQ ID NO: 7391494 - DNA, 22 bp, Homo sapiens
ggtcagtgtttcatctgtgaaa

SEQ ID NO: 7391495 - DNA, 22 bp, Homo sapiens
ggtcagtgtatgtattgataag

SEQ ID NO: 7391496 - DNA, 22 bp, Homo sapiens
ggtcagtgtatgtattgataag

SEQ ID NO: 7391497 - DNA, 22 bp, Homo sapiens
ggtcagtgtacacatgtgcagg

SEQ ID NO: 7391498 - DNA, 22 bp, Homo sapiens
ggtcagtgtacacatgtgcagg

SEQ ID NO: 7391499 - DNA, 22 bp, Homo sapiens
ggtcagtgtacacatgtgcagg

SEQ ID NO: 7391500 - DNA, 22 bp, Homo sapiens
ggtcatctcaggtgtgcttgat

SEQ ID NO: 7391501 - DNA, 22 bp, Homo sapiens
ggtcatctgcctccaaagcact

SEQ ID NO: 7391502 - DNA, 22 bp, Homo sapiens
ggtcatacaggtatctggtact

SEQ ID NO: 7391503 - DNA, 22 bp, Homo sapiens
ggtcatagagctggaaattggc

SEQ ID NO: 7391504 - DNA, 22 bp, Homo sapiens
ggtcagtgtttcatctgtgaaa

SEQ ID NO: 7391505 - DNA, 22 bp, Homo sapiens
ggtcagtgagacaatttaagcc

SEQ ID NO: 7391506 - DNA, 22 bp, Homo sapiens
ggtcagtgagcaaacaaccacg

SEQ ID NO: 7391507 - DNA, 22 bp, Homo sapiens
ggtcagtgagacaatttaagcc

SEQ ID NO: 7391508 - DNA, 22 bp, Homo sapiens
ggtcagtgacttttttctgtgg

SEQ ID NO: 7391509 - DNA, 22 bp, Homo sapiens
ggtcagtgacttttttctgtgg

SEQ ID NO: 7391510 - DNA, 22 bp, Homo sapiens
ggtcagtgaatgtttgagcaga

SEQ ID NO: 7391511 - DNA, 22 bp, Homo sapiens
ggtcagtgaatgtttgagcaga

SEQ ID NO: 7391512 - DNA, 22 bp, Homo sapiens
ggtcaggtttttaggagtgacc

SEQ ID NO: 7391513 - DNA, 22 bp, Homo sapiens
ggtcagtctctcccgagtgttg

SEQ ID NO: 7391514 - DNA, 22 bp, Homo sapiens
ggtcagtgctgccagagtgacc

SEQ ID NO: 7391515 - DNA, 22 bp, Homo sapiens
ggtcagtgcgtgcccgcgcgtg

SEQ ID NO: 7391516 - DNA, 22 bp, Homo sapiens
ggtcagtgcgtgcccgcgcgtg

SEQ ID NO: 7391517 - DNA, 22 bp, Homo sapiens
ggtcagtgcgatttcccactcc

SEQ ID NO: 7391518 - DNA, 22 bp, Homo sapiens
ggtcagtgcgatttcccactcc

SEQ ID NO: 7391519 - DNA, 22 bp, Homo sapiens
ggtcagtgcgatttcccactcc

SEQ ID NO: 7391520 - DNA, 22 bp, Homo sapiens
ggtcagtgcctatcatgtgggc

SEQ ID NO: 7391521 - DNA, 22 bp, Homo sapiens
ggtcagtgcctatcatgtgggc

SEQ ID NO: 7391522 - DNA, 23 bp, Homo sapiens
ggtcagtgagttcgtttctctgg

SEQ ID NO: 7391523 - DNA, 23 bp, Homo sapiens
ggtcagtgagttcgtttctctgg

SEQ ID NO: 7391524 - DNA, 22 bp, Homo sapiens
ggtcagtgagcaaacaaccacg

SEQ ID NO: 7391525 - DNA, 22 bp, Homo sapiens
cagaggtaccagcagcctctgg

SEQ ID NO: 7391526 - DNA, 22 bp, Homo sapiens
cagaggtacagccattgaagat

SEQ ID NO: 7391527 - DNA, 22 bp, Homo sapiens
cagaggtaccagcagcctctgg

SEQ ID NO: 7391528 - DNA, 22 bp, Homo sapiens
cagaggtacagccattgaagat

SEQ ID NO: 7391529 - DNA, 22 bp, Homo sapiens
cagaggtacaagctaagttggg

SEQ ID NO: 7391530 - DNA, 22 bp, Homo sapiens
cagaggtacaagctaagttggg

SEQ ID NO: 7391531 - DNA, 22 bp, Homo sapiens
cagaggtacaagctaagttggg

SEQ ID NO: 7391532 - DNA, 21 bp, Homo sapiens
cagagggtttctcaggtgttt

SEQ ID NO: 7391533 - DNA, 21 bp, Homo sapiens
cagagggtttctcaggtgttt

SEQ ID NO: 7391534 - DNA, 21 bp, Homo sapiens
cagagggtttctcaggtgttt

SEQ ID NO: 7391535 - DNA, 21 bp, Homo sapiens
cagagggtttctcaggtgttt

SEQ ID NO: 7391536 - DNA, 22 bp, Homo sapiens
cagagggttgtcaggcgccttg

SEQ ID NO: 7391537 - DNA, 22 bp, Homo sapiens
cagagggttgtcaggcgccttg

SEQ ID NO: 7391538 - DNA, 22 bp, Homo sapiens
cagagggttgtcaggcgccttg

SEQ ID NO: 7391539 - DNA, 22 bp, Homo sapiens
cagagggttgatgtgaggctta

SEQ ID NO: 7391540 - DNA, 22 bp, Homo sapiens
cagagggttgatgtgaggctta

SEQ ID NO: 7391541 - DNA, 23 bp, Homo sapiens
cagagggttccatggagcatggt

SEQ ID NO: 7391542 - DNA, 22 bp, Homo sapiens
cagagggttgatgtgaggctta

SEQ ID NO: 7391543 - DNA, 23 bp, Homo sapiens
cagagggttccatggagcatggt

SEQ ID NO: 7391544 - DNA, 22 bp, Homo sapiens
cagagggttgatgtgaggctta

SEQ ID NO: 7391545 - DNA, 22 bp, Homo sapiens
cagaggtagaaggcatgcagtg

SEQ ID NO: 7391546 - DNA, 22 bp, Homo sapiens
cagaggtagaaggcatgcagtg

SEQ ID NO: 7391547 - DNA, 22 bp, Homo sapiens
cagaggtagaactggccctcac

SEQ ID NO: 7391548 - DNA, 22 bp, Homo sapiens
cagaggtaccagcagcctctgg

SEQ ID NO: 7391549 - DNA, 22 bp, Homo sapiens
cagaggtagaactggccctcac

SEQ ID NO: 7391550 - DNA, 22 bp, Homo sapiens
cagaggtagcatgctgtggctt

SEQ ID NO: 7391551 - DNA, 22 bp, Homo sapiens
cagaggtagaaggcatgcagtg

SEQ ID NO: 7391552 - DNA, 22 bp, Homo sapiens
cagaggtagccgagtgcaatcg

SEQ ID NO: 7391553 - DNA, 22 bp, Homo sapiens
ggtcacaggggagaagagtgat

SEQ ID NO: 7391554 - DNA, 22 bp, Homo sapiens
ggtcacaggggagaagagtgat

SEQ ID NO: 7391555 - DNA, 22 bp, Homo sapiens
ggtcacagggaagggctctcaa

SEQ ID NO: 7391556 - DNA, 22 bp, Homo sapiens
ggtcacaggggagaagagtgat

SEQ ID NO: 7391557 - DNA, 22 bp, Homo sapiens
ggtcacaggggagaagagtgat

SEQ ID NO: 7391558 - DNA, 22 bp, Homo sapiens
ggtcacaggggagaagagtgat

SEQ ID NO: 7391559 - DNA, 22 bp, Homo sapiens
cagagtctggactgcaggctcc

SEQ ID NO: 7391560 - DNA, 22 bp, Homo sapiens
cagagtctggactgcaggctcc

SEQ ID NO: 7391561 - DNA, 17 bp, Homo sapiens
cagagtctgtctgcatc

SEQ ID NO: 7391562 - DNA, 17 bp, Homo sapiens
cagagtctgtctgcatc

SEQ ID NO: 7391563 - DNA, 17 bp, Homo sapiens
cagagtctgtctgcatc

SEQ ID NO: 7391564 - DNA, 17 bp, Homo sapiens
cagagtctgtctgcatc

SEQ ID NO: 7391565 - DNA, 17 bp, Homo sapiens
cagagtctgtctgcatc

SEQ ID NO: 7391566 - DNA, 17 bp, Homo sapiens
cagagtctgtctgcatc

SEQ ID NO: 7391567 - DNA, 22 bp, Homo sapiens
cagagtcttgtgtgttcagccc

SEQ ID NO: 7391568 - DNA, 18 bp, Homo sapiens
ggtcctgggcctggctca

SEQ ID NO: 7391569 - DNA, 18 bp, Homo sapiens
ggtcctgggcctggctca

SEQ ID NO: 7391570 - DNA, 18 bp, Homo sapiens
ggtcctgggcctggctca

SEQ ID NO: 7391571 - DNA, 18 bp, Homo sapiens
ggtcctgggcctggctca

SEQ ID NO: 7391572 - DNA, 22 bp, Homo sapiens
ggtctgagagccactgaatccc

SEQ ID NO: 7391573 - DNA, 22 bp, Homo sapiens
ggtctgagatatttgttcagct

SEQ ID NO: 7391574 - DNA, 22 bp, Homo sapiens
ggtcctgggaagatgctcatga

SEQ ID NO: 7391575 - DNA, 22 bp, Homo sapiens
ggtcctgggaagatgctcatga

SEQ ID NO: 7391576 - DNA, 22 bp, Homo sapiens
cagagtcttgtgtgttcagccc

SEQ ID NO: 7391577 - DNA, 22 bp, Homo sapiens
cagagtctctgggaggctgggt

SEQ ID NO: 7391578 - DNA, 22 bp, Homo sapiens
cagagtctctgggaggctgggt

SEQ ID NO: 7391579 - DNA, 22 bp, Homo sapiens
cagagtcattgacttccaggag

SEQ ID NO: 7391580 - DNA, 19 bp, Homo sapiens
cagagtccttgaccagtcc

SEQ ID NO: 7391581 - DNA, 19 bp, Homo sapiens
cagagtccttgaccagtcc

SEQ ID NO: 7391582 - DNA, 22 bp, Homo sapiens
cagagtctgcgagcagaggggc

SEQ ID NO: 7391583 - DNA, 22 bp, Homo sapiens
cagagtctgcgagcagaggggc

SEQ ID NO: 7391584 - DNA, 22 bp, Homo sapiens
cagagtctctgggaggctgggt

SEQ ID NO: 7391585 - DNA, 22 bp, Homo sapiens
cagagtcctggacacagagaca

SEQ ID NO: 7391586 - DNA, 19 bp, Homo sapiens
cagagtccttgaccagtcc

SEQ ID NO: 7391587 - DNA, 22 bp, Homo sapiens
cagagtcctggacacagagaca

SEQ ID NO: 7391588 - DNA, 22 bp, Homo sapiens
cagagtcctggacacagagaca

SEQ ID NO: 7391589 - DNA, 22 bp, Homo sapiens
cagagtcctggacacagagaca

SEQ ID NO: 7391590 - DNA, 22 bp, Homo sapiens
cagagtcctggacacagagaca

SEQ ID NO: 7391591 - DNA, 22 bp, Homo sapiens
cagagtcctgcaccagctccag

SEQ ID NO: 7391592 - DNA, 22 bp, Homo sapiens
cagagtcctgcaccagctccag

SEQ ID NO: 7391593 - DNA, 22 bp, Homo sapiens
cagagtcctgcaccagctccag

SEQ ID NO: 7391594 - DNA, 22 bp, Homo sapiens
cagagtcagctagtcttgggat

SEQ ID NO: 7391595 - DNA, 22 bp, Homo sapiens
cagagtcagctagtcttgggat

SEQ ID NO: 7391596 - DNA, 23 bp, Homo sapiens
cagagtcagggggccccacctct

SEQ ID NO: 7391597 - DNA, 22 bp, Homo sapiens
cagagtcagtattgaattgaaa

SEQ ID NO: 7391598 - DNA, 22 bp, Homo sapiens
cagagtcatgggccgtcaggca

SEQ ID NO: 7391599 - DNA, 22 bp, Homo sapiens
cagagtcagtattgaattgaaa

SEQ ID NO: 7391600 - DNA, 22 bp, Homo sapiens
cagagtcattgacttccaggag

SEQ ID NO: 7391601 - DNA, 22 bp, Homo sapiens
cagagtcatgggccgtcaggca

SEQ ID NO: 7391602 - DNA, 22 bp, Homo sapiens
cagagtcattgacttccaggag

SEQ ID NO: 7391603 - DNA, 22 bp, Homo sapiens
cagagtccaattgctcagagcg

SEQ ID NO: 7391604 - DNA, 22 bp, Homo sapiens
cagagtccaattgctcagagcg

SEQ ID NO: 7391605 - DNA, 22 bp, Homo sapiens
cagagtcccagatgcccctcct

SEQ ID NO: 7391606 - DNA, 22 bp, Homo sapiens
cagagtcccagatgcccctcct

SEQ ID NO: 7391607 - DNA, 22 bp, Homo sapiens
cagagtccccagcggcgcgggc

SEQ ID NO: 7391608 - DNA, 22 bp, Homo sapiens
cagagtcccagatgcccctcct

SEQ ID NO: 7391609 - DNA, 22 bp, Homo sapiens
cagagtccaattgctcagagcg

SEQ ID NO: 7391610 - DNA, 22 bp, Homo sapiens
ggtcattttcactttcaagtta

SEQ ID NO: 7391611 - DNA, 22 bp, Homo sapiens
ggtcattgaaatcagaagggtt

SEQ ID NO: 7391612 - DNA, 22 bp, Homo sapiens
ggtccaaggctcggtggcgggg

SEQ ID NO: 7391613 - DNA, 22 bp, Homo sapiens
ggtccaaggctcggtggcgggg

SEQ ID NO: 7391614 - DNA, 23 bp, Homo sapiens
ggtccacccgagcctgcagcttc

SEQ ID NO: 7391615 - DNA, 22 bp, Homo sapiens
ggtccacctccaagctggggac

SEQ ID NO: 7391616 - DNA, 22 bp, Homo sapiens
ggtccagaagctggtagggtag

SEQ ID NO: 7391617 - DNA, 23 bp, Homo sapiens
ggtccacccgagcctgcagcttc

SEQ ID NO: 7391618 - DNA, 22 bp, Homo sapiens
ggtccacctccaagctggggac

SEQ ID NO: 7391619 - DNA, 22 bp, Homo sapiens
ggtccagaagctggtagggtag

SEQ ID NO: 7391620 - DNA, 22 bp, Homo sapiens
ggtccagaagctggtagggtag

SEQ ID NO: 7391621 - DNA, 22 bp, Homo sapiens
ggtcatctgcctccaaagcact

SEQ ID NO: 7391622 - DNA, 22 bp, Homo sapiens
ggtcatgagggagcagtgcagg

SEQ ID NO: 7391623 - DNA, 22 bp, Homo sapiens
ggtcatggatagctggagcctt

SEQ ID NO: 7391624 - DNA, 22 bp, Homo sapiens
ggtcatgctgtgaatcagtgct

SEQ ID NO: 7391625 - DNA, 15 bp, Homo sapiens
ggtcatgagtagaga

SEQ ID NO: 7391626 - DNA, 22 bp, Homo sapiens
ggtcatgagggagcagtgcagg

SEQ ID NO: 7391627 - DNA, 22 bp, Homo sapiens
ggtcatgaggagggagaaggtt

SEQ ID NO: 7391628 - DNA, 22 bp, Homo sapiens
ggtcatggatagctggagcctt

SEQ ID NO: 7391629 - DNA, 22 bp, Homo sapiens
cagagggctcttggctgcctgc

SEQ ID NO: 7391630 - DNA, 22 bp, Homo sapiens
cagagggctcttggctgcctgc

SEQ ID NO: 7391631 - DNA, 22 bp, Homo sapiens
cagagggctcttggctgcctgc

SEQ ID NO: 7391632 - DNA, 22 bp, Homo sapiens
cagagggctcttggctgcctgc

SEQ ID NO: 7391633 - DNA, 22 bp, Homo sapiens
cagagggctcttggctgcctgc

SEQ ID NO: 7391634 - DNA, 22 bp, Homo sapiens
cagagggctcttggctgcctgc

SEQ ID NO: 7391635 - DNA, 22 bp, Homo sapiens
cagagggctcttggctgcctgc

SEQ ID NO: 7391636 - DNA, 22 bp, Homo sapiens
cagagggctcttggctgcctgc

SEQ ID NO: 7391637 - DNA, 22 bp, Homo sapiens
cagagggctgccctgagttcgt

SEQ ID NO: 7391638 - DNA, 22 bp, Homo sapiens
cagagggctgccctgagttcgt

SEQ ID NO: 7391639 - DNA, 22 bp, Homo sapiens
cagagggctgccctgagttcgt

SEQ ID NO: 7391640 - DNA, 22 bp, Homo sapiens
cagagggctgtgtaaggatgtt

SEQ ID NO: 7391641 - DNA, 22 bp, Homo sapiens
cagagggctgtgtaaggatgtt

SEQ ID NO: 7391642 - DNA, 22 bp, Homo sapiens
cagagggctgtgtaaggatgtt

SEQ ID NO: 7391643 - DNA, 22 bp, Homo sapiens
cagagggctgtgtaaggatgtt

SEQ ID NO: 7391644 - DNA, 22 bp, Homo sapiens
cagagggctgtgtaaggatgtt

SEQ ID NO: 7391645 - DNA, 22 bp, Homo sapiens
cagagggctgtgtaaggatgtt

SEQ ID NO: 7391646 - DNA, 22 bp, Homo sapiens
cagagggcttcaggttcaggat

SEQ ID NO: 7391647 - DNA, 22 bp, Homo sapiens
cagagggcttcaggttcaggat

SEQ ID NO: 7391648 - DNA, 22 bp, Homo sapiens
cagagggcttcaggttcaggat

SEQ ID NO: 7391649 - DNA, 22 bp, Homo sapiens
cagagggcttcaggttcaggat

SEQ ID NO: 7391650 - DNA, 22 bp, Homo sapiens
cagagggcttcaggttcaggat

SEQ ID NO: 7391651 - DNA, 22 bp, Homo sapiens
cagagggcttcaggttcaggat

SEQ ID NO: 7391652 - DNA, 22 bp, Homo sapiens
cagagggctcggcggccgctcc

SEQ ID NO: 7391653 - DNA, 22 bp, Homo sapiens
cagagggctcggcggccgctcc

SEQ ID NO: 7391654 - DNA, 22 bp, Homo sapiens
cagagggctcggcggccgctcc

SEQ ID NO: 7391655 - DNA, 22 bp, Homo sapiens
cagagggctcagtcctgctgga

SEQ ID NO: 7391656 - DNA, 22 bp, Homo sapiens
cagagggctcagtcctgctgga

SEQ ID NO: 7391657 - DNA, 22 bp, Homo sapiens
cagagggctcagtcctgctgga

SEQ ID NO: 7391658 - DNA, 22 bp, Homo sapiens
cagagggctcagtcctgctgga

SEQ ID NO: 7391659 - DNA, 22 bp, Homo sapiens
cagagggctcggcggccgctcc

SEQ ID NO: 7391660 - DNA, 22 bp, Homo sapiens
cagagggctcttggctgcctgc

SEQ ID NO: 7391661 - DNA, 22 bp, Homo sapiens
cagagggctcggcggccgctcc

SEQ ID NO: 7391662 - DNA, 22 bp, Homo sapiens
cagagggctcggcggccgctcc

SEQ ID NO: 7391663 - DNA, 22 bp, Homo sapiens
cagagggctcggcggccgctcc

SEQ ID NO: 7391664 - DNA, 22 bp, Homo sapiens
cagagggcgtccgggttaactt

SEQ ID NO: 7391665 - DNA, 22 bp, Homo sapiens
cagagggcgtccgggttaactt

SEQ ID NO: 7391666 - DNA, 21 bp, Homo sapiens
cagagggccggcatgtggtct

SEQ ID NO: 7391667 - DNA, 22 bp, Homo sapiens
cagagggaaaaggggagtaata

SEQ ID NO: 7391668 - DNA, 22 bp, Homo sapiens
cagagggaaaaggggagtaata

SEQ ID NO: 7391669 - DNA, 22 bp, Homo sapiens
cagagggaaaaggggagtaata

SEQ ID NO: 7391670 - DNA, 22 bp, Homo sapiens
cagaggctttgccctggaaacc

SEQ ID NO: 7391671 - DNA, 22 bp, Homo sapiens
cagagggaaaaggggagtaata

SEQ ID NO: 7391672 - DNA, 22 bp, Homo sapiens
cagagggaaaaggggagtaata

SEQ ID NO: 7391673 - DNA, 22 bp, Homo sapiens
cagagggaaaaggggagtaata

SEQ ID NO: 7391674 - DNA, 22 bp, Homo sapiens
cagagggaaaaggggagtaata

SEQ ID NO: 7391675 - DNA, 21 bp, Homo sapiens
cagagggcttttctctgttct

SEQ ID NO: 7391676 - DNA, 21 bp, Homo sapiens
cagagggcttttctctgttct

SEQ ID NO: 7391677 - DNA, 22 bp, Homo sapiens
cagaggggataacaggtgtaga

SEQ ID NO: 7391678 - DNA, 21 bp, Homo sapiens
cagagggcttttctctgttct

SEQ ID NO: 7391679 - DNA, 21 bp, Homo sapiens
cagagggcttttctctgttct

SEQ ID NO: 7391680 - DNA, 22 bp, Homo sapiens
cagagggcttcaggttcaggat

SEQ ID NO: 7391681 - DNA, 22 bp, Homo sapiens
cagaggggataacaggtgtaga

SEQ ID NO: 7391682 - DNA, 22 bp, Homo sapiens
cagaggggataacaggtgtaga

SEQ ID NO: 7391683 - DNA, 22 bp, Homo sapiens
cagaggggataacaggtgtaga

SEQ ID NO: 7391684 - DNA, 21 bp, Homo sapiens
cagaggggctagcctggctgc

SEQ ID NO: 7391685 - DNA, 21 bp, Homo sapiens
cagaggggctagcctggctgc

SEQ ID NO: 7391686 - DNA, 22 bp, Homo sapiens
cagaggggataacaggtgtaga

SEQ ID NO: 7391687 - DNA, 21 bp, Homo sapiens
cagaggggctagcctggctgc

SEQ ID NO: 7391688 - DNA, 22 bp, Homo sapiens
cagaggggctgacacccttggc

SEQ ID NO: 7391689 - DNA, 22 bp, Homo sapiens
cagaggggctgacacccttggc

SEQ ID NO: 7391690 - DNA, 22 bp, Homo sapiens
cagaggggctgacacccttggc

SEQ ID NO: 7391691 - DNA, 21 bp, Homo sapiens
cagaggggctagcctggctgc

SEQ ID NO: 7391692 - DNA, 21 bp, Homo sapiens
cagaggggctagcctggctgc

SEQ ID NO: 7391693 - DNA, 21 bp, Homo sapiens
cagaggggctagcctggctgc

SEQ ID NO: 7391694 - DNA, 22 bp, Homo sapiens
cagagggtcaccaggaagtgca

SEQ ID NO: 7391695 - DNA, 22 bp, Homo sapiens
cagagggtcaccaggaagtgca

SEQ ID NO: 7391696 - DNA, 22 bp, Homo sapiens
cagagggtggaggccaggctct

SEQ ID NO: 7391697 - DNA, 22 bp, Homo sapiens
cagaggggtgtagagatcactg

SEQ ID NO: 7391698 - DNA, 22 bp, Homo sapiens
cagagggtcaccaggaagtgca

SEQ ID NO: 7391699 - DNA, 22 bp, Homo sapiens
cagaggggtgtagagatcactg

SEQ ID NO: 7391700 - DNA, 22 bp, Homo sapiens
cagaggggtgtagagatcactg

SEQ ID NO: 7391701 - DNA, 22 bp, Homo sapiens
cagaggggctgacacccttggc

SEQ ID NO: 7391702 - DNA, 22 bp, Homo sapiens
cagaggggctgacacccttggc

SEQ ID NO: 7391703 - DNA, 22 bp, Homo sapiens
cagaggggtgtagagatcactg

SEQ ID NO: 7391704 - DNA, 22 bp, Homo sapiens
cagaggggtgtagagatcactg

SEQ ID NO: 7391705 - DNA, 22 bp, Homo sapiens
cagaggggtgtagagatcactg

SEQ ID NO: 7391706 - DNA, 23 bp, Homo sapiens
cagagggttccatggagcatggt

SEQ ID NO: 7391707 - DNA, 23 bp, Homo sapiens
cagagggttccatggagcatggt

SEQ ID NO: 7391708 - DNA, 23 bp, Homo sapiens
cagagggttccatggagcatggt

SEQ ID NO: 7391709 - DNA, 23 bp, Homo sapiens
cagagggttccatggagcatggt

SEQ ID NO: 7391710 - DNA, 22 bp, Homo sapiens
cagagggtgtgaaggggatgaa

SEQ ID NO: 7391711 - DNA, 22 bp, Homo sapiens
cagagggtgtgaaggggatgaa

SEQ ID NO: 7391712 - DNA, 22 bp, Homo sapiens
cagagggtggaggccaggctct

SEQ ID NO: 7391713 - DNA, 23 bp, Homo sapiens
cagagggttccatggagcatggt

SEQ ID NO: 7391714 - DNA, 22 bp, Homo sapiens
cagagggtgtgaaggggatgaa

SEQ ID NO: 7391715 - DNA, 22 bp, Homo sapiens
cagaggcacaagaaagcaaggc

SEQ ID NO: 7391716 - DNA, 22 bp, Homo sapiens
cagaggcacaagaaagcaaggc

SEQ ID NO: 7391717 - DNA, 22 bp, Homo sapiens
cagaggcacaagaaagcaaggc

SEQ ID NO: 7391718 - DNA, 22 bp, Homo sapiens
cagaggcacagcttcttttaat

SEQ ID NO: 7391719 - DNA, 22 bp, Homo sapiens
cagaggcacagtgcgggccact

SEQ ID NO: 7391720 - DNA, 22 bp, Homo sapiens
cagaggcacagcttcttttaat

SEQ ID NO: 7391721 - DNA, 19 bp, Homo sapiens
cagaggcaccaggtataga

SEQ ID NO: 7391722 - DNA, 19 bp, Homo sapiens
cagaggcaccaggtataga

SEQ ID NO: 7391723 - DNA, 22 bp, Homo sapiens
cagaggcacagtgcgggccact

SEQ ID NO: 7391724 - DNA, 22 bp, Homo sapiens
cagaggcacagtgcgggccact

SEQ ID NO: 7391725 - DNA, 22 bp, Homo sapiens
cagaggcacagtgcgggccact

SEQ ID NO: 7391726 - DNA, 22 bp, Homo sapiens
cagaggcacagtgcgggccact

SEQ ID NO: 7391727 - DNA, 22 bp, Homo sapiens
cagaggcacagtgcgggccact

SEQ ID NO: 7391728 - DNA, 22 bp, Homo sapiens
cagaggcacagtgcgggccact

SEQ ID NO: 7391729 - DNA, 16 bp, Homo sapiens
cagaggcacctggctc

SEQ ID NO: 7391730 - DNA, 16 bp, Homo sapiens
cagaggcacctggctc

SEQ ID NO: 7391731 - DNA, 16 bp, Homo sapiens
cagaggcacctggctc

SEQ ID NO: 7391732 - DNA, 22 bp, Homo sapiens
ggggagaccatctgaaggtgat

SEQ ID NO: 7391733 - DNA, 22 bp, Homo sapiens
ggggagaccatctgaaggtgat

SEQ ID NO: 7391734 - DNA, 22 bp, Homo sapiens
ggggagaccatctgaaggtgat

SEQ ID NO: 7391735 - DNA, 19 bp, Homo sapiens
cagaggcaccaggtataga

SEQ ID NO: 7391736 - DNA, 19 bp, Homo sapiens
cagaggcaccaggtataga

SEQ ID NO: 7391737 - DNA, 19 bp, Homo sapiens
cagaggcaccaggtataga

SEQ ID NO: 7391738 - DNA, 22 bp, Homo sapiens
ggggagagtattttattcaagt

SEQ ID NO: 7391739 - DNA, 22 bp, Homo sapiens
ggggagagtattttattcaagt

SEQ ID NO: 7391740 - DNA, 22 bp, Homo sapiens
ggggagagtcctttccagttcc

SEQ ID NO: 7391741 - DNA, 22 bp, Homo sapiens
ggggagagtattttattcaagt

SEQ ID NO: 7391742 - DNA, 22 bp, Homo sapiens
ggggagagtcctttccagttcc

SEQ ID NO: 7391743 - DNA, 22 bp, Homo sapiens
ggggagagtcctttccagttcc

SEQ ID NO: 7391744 - DNA, 22 bp, Homo sapiens
ggggagcaggctgggctgtctg

SEQ ID NO: 7391745 - DNA, 22 bp, Homo sapiens
ggggagcaggctgggctgtctg

SEQ ID NO: 7391746 - DNA, 22 bp, Homo sapiens
ggggagcaggctgggctgtctg

SEQ ID NO: 7391747 - DNA, 22 bp, Homo sapiens
ggggagctcatgatgtctttgt

SEQ ID NO: 7391748 - DNA, 22 bp, Homo sapiens
ggggagcaggctgggctgtctg

SEQ ID NO: 7391749 - DNA, 22 bp, Homo sapiens
ggggagcaggctgggctgtctg

SEQ ID NO: 7391750 - DNA, 22 bp, Homo sapiens
ggggagcaggctgggctgtctg

SEQ ID NO: 7391751 - DNA, 22 bp, Homo sapiens
ggggagctgacaaccacatcct

SEQ ID NO: 7391752 - DNA, 22 bp, Homo sapiens
ggggagctgagacactgccctc

SEQ ID NO: 7391753 - DNA, 22 bp, Homo sapiens
ggggagctgccacagttctctg

SEQ ID NO: 7391754 - DNA, 22 bp, Homo sapiens
ggggagctgccacagttctctg

SEQ ID NO: 7391755 - DNA, 22 bp, Homo sapiens
ggggagctgagacactgccctc

SEQ ID NO: 7391756 - DNA, 22 bp, Homo sapiens
ggggagctgggaggtgagttac

SEQ ID NO: 7391757 - DNA, 22 bp, Homo sapiens
ggggagcttagggtctctgaat

SEQ ID NO: 7391758 - DNA, 22 bp, Homo sapiens
ggggagctgggaggtgagttac

SEQ ID NO: 7391759 - DNA, 22 bp, Homo sapiens
ggggagctgggaggtgagttac

SEQ ID NO: 7391760 - DNA, 22 bp, Homo sapiens
ggggagcttggttattcatgca

SEQ ID NO: 7391761 - DNA, 22 bp, Homo sapiens
ggggagcttcaggtggcttaca

SEQ ID NO: 7391762 - DNA, 18 bp, Homo sapiens
ggggagcagactgaactc

SEQ ID NO: 7391763 - DNA, 18 bp, Homo sapiens
ggggagcagactgaactc

SEQ ID NO: 7391764 - DNA, 22 bp, Homo sapiens
ggggagcagaagcagcaacaac

SEQ ID NO: 7391765 - DNA, 22 bp, Homo sapiens
ggggagcagaagcagcaacaac

SEQ ID NO: 7391766 - DNA, 22 bp, Homo sapiens
ggggagcaggctgggctgtctg

SEQ ID NO: 7391767 - DNA, 18 bp, Homo sapiens
ggggagcagactgaactc

SEQ ID NO: 7391768 - DNA, 22 bp, Homo sapiens
ggggagcaattgcccccttaga

SEQ ID NO: 7391769 - DNA, 22 bp, Homo sapiens
ggggagcaatagttgaggtgtg

SEQ ID NO: 7391770 - DNA, 22 bp, Homo sapiens
ggggagcaattgcccccttaga

SEQ ID NO: 7391771 - DNA, 22 bp, Homo sapiens
ggggagcaattgcccccttaga

SEQ ID NO: 7391772 - DNA, 22 bp, Homo sapiens
ggggagcaattgcccccttaga

SEQ ID NO: 7391773 - DNA, 22 bp, Homo sapiens
ggggagcagaagcagcaacaac

SEQ ID NO: 7391774 - DNA, 22 bp, Homo sapiens
ggggagcagaagcagcaacaac

SEQ ID NO: 7391775 - DNA, 22 bp, Homo sapiens
ggggagcagaagcagcaacaac

SEQ ID NO: 7391776 - DNA, 22 bp, Homo sapiens
ggggagcaatagttgaggtgtg

SEQ ID NO: 7391777 - DNA, 22 bp, Homo sapiens
ggggagcaatagttgaggtgtg

SEQ ID NO: 7391778 - DNA, 22 bp, Homo sapiens
ggggagcaatagttgaggtgtg

SEQ ID NO: 7391779 - DNA, 22 bp, Homo sapiens
ggggagcaatagttgaggtgtg

SEQ ID NO: 7391780 - DNA, 22 bp, Homo sapiens
ggggagcaatagttgaggtgtg

SEQ ID NO: 7391781 - DNA, 22 bp, Homo sapiens
ggggagagtcctttccagttcc

SEQ ID NO: 7391782 - DNA, 22 bp, Homo sapiens
ggggagatgcttaggtccgggg

SEQ ID NO: 7391783 - DNA, 22 bp, Homo sapiens
ggggagcaatagttgaggtgtg

SEQ ID NO: 7391784 - DNA, 22 bp, Homo sapiens
ggggagcaatagttgaggtgtg

SEQ ID NO: 7391785 - DNA, 22 bp, Homo sapiens
ggggagcaatagttgaggtgtg

SEQ ID NO: 7391786 - DNA, 22 bp, Homo sapiens
gtgcccagtgcaggcccgcagg

SEQ ID NO: 7391787 - DNA, 22 bp, Homo sapiens
gtgcccagtgcaggcccgcagg

SEQ ID NO: 7391788 - DNA, 22 bp, Homo sapiens
gtgcccagttgaggccaggact

SEQ ID NO: 7391789 - DNA, 22 bp, Homo sapiens
gtgcccagttgaggccaggact

SEQ ID NO: 7391790 - DNA, 22 bp, Homo sapiens
gtgcccagttgaggccaggact

SEQ ID NO: 7391791 - DNA, 22 bp, Homo sapiens
gtgcccagttgaggccaggact

SEQ ID NO: 7391792 - DNA, 22 bp, Homo sapiens
gtgcccagttgaggccaggact

SEQ ID NO: 7391793 - DNA, 22 bp, Homo sapiens
gtgcccccaaataccaggctac

SEQ ID NO: 7391794 - DNA, 22 bp, Homo sapiens
gtgcccccaaataccaggctac

SEQ ID NO: 7391795 - DNA, 22 bp, Homo sapiens
gtgcccccaaataccaggctac

SEQ ID NO: 7391796 - DNA, 22 bp, Homo sapiens
gtgccccagacacgcatgtggg

SEQ ID NO: 7391797 - DNA, 20 bp, Homo sapiens
gtgcccagttggtgacagac

SEQ ID NO: 7391798 - DNA, 20 bp, Homo sapiens
gtgcccagttggtgacagac

SEQ ID NO: 7391799 - DNA, 20 bp, Homo sapiens
gtgcccagttggtgacagac

SEQ ID NO: 7391800 - DNA, 22 bp, Homo sapiens
gtgcccagttgaggccaggact

SEQ ID NO: 7391801 - DNA, 20 bp, Homo sapiens
gtgcccagttggtgacagac

SEQ ID NO: 7391802 - DNA, 20 bp, Homo sapiens
gtgcccagttggtgacagac

SEQ ID NO: 7391803 - DNA, 22 bp, Homo sapiens
gtgcccagttgaggccaggact

SEQ ID NO: 7391804 - DNA, 22 bp, Homo sapiens
gtgctgtgcgctttttctgtat

SEQ ID NO: 7391805 - DNA, 22 bp, Homo sapiens
gtgctgtgcgctttttctgtat

SEQ ID NO: 7391806 - DNA, 22 bp, Homo sapiens
gtgctgagtcatctttatctgt

SEQ ID NO: 7391807 - DNA, 20 bp, Homo sapiens
gtgctgagtgaaatgagatt

SEQ ID NO: 7391808 - DNA, 22 bp, Homo sapiens
gtgctgagtagaatgaatgcct

SEQ ID NO: 7391809 - DNA, 22 bp, Homo sapiens
gtgctgagtagaatgaatgcct

SEQ ID NO: 7391810 - DNA, 22 bp, Homo sapiens
gtgctgagtagaatgaatgcct

SEQ ID NO: 7391811 - DNA, 22 bp, Homo sapiens
gtgctgagtagaatgaatgcct

SEQ ID NO: 7391812 - DNA, 20 bp, Homo sapiens
gtgcccagttggtgacagac

SEQ ID NO: 7391813 - DNA, 22 bp, Homo sapiens
gtgccctcctgaagccatcaca

SEQ ID NO: 7391814 - DNA, 22 bp, Homo sapiens
gtgccctcctgaagccatcaca

SEQ ID NO: 7391815 - DNA, 22 bp, Homo sapiens
gtgccctccgtgttcatagagc

SEQ ID NO: 7391816 - DNA, 22 bp, Homo sapiens
gtgccctcatgaaacgaaggat

SEQ ID NO: 7391817 - DNA, 22 bp, Homo sapiens
gtgccctccgtgttcatagagc

SEQ ID NO: 7391818 - DNA, 22 bp, Homo sapiens
gtgccctcatgaaacgaaggat

SEQ ID NO: 7391819 - DNA, 22 bp, Homo sapiens
gtgccctcacaaagtggaaaga

SEQ ID NO: 7391820 - DNA, 22 bp, Homo sapiens
gtgcccctggcaaatttccctg

SEQ ID NO: 7391821 - DNA, 21 bp, Homo sapiens
gtgcccgtcccaggagccgac

SEQ ID NO: 7391822 - DNA, 22 bp, Homo sapiens
gtgccctcacaaagtggaaaga

SEQ ID NO: 7391823 - DNA, 22 bp, Homo sapiens
gtgctgtgtgatccatgctggc

SEQ ID NO: 7391824 - DNA, 22 bp, Homo sapiens
gtgctgtgtgatccatgctggc

SEQ ID NO: 7391825 - DNA, 22 bp, Homo sapiens
gtgctgtgtgatccatgctggc

SEQ ID NO: 7391826 - DNA, 18 bp, Homo sapiens
gtgctgtgggcagtggcc

SEQ ID NO: 7391827 - DNA, 18 bp, Homo sapiens
gtgctgtgggcagtggcc

SEQ ID NO: 7391828 - DNA, 18 bp, Homo sapiens
gtgctgtgggcagtggcc

SEQ ID NO: 7391829 - DNA, 22 bp, Homo sapiens
gtgctgttgcctggctgcacgg

SEQ ID NO: 7391830 - DNA, 22 bp, Homo sapiens
cagccctggcccaggtgcctta

SEQ ID NO: 7391831 - DNA, 22 bp, Homo sapiens
cagccctggcagctttcagggt

SEQ ID NO: 7391832 - DNA, 22 bp, Homo sapiens
cagccctggcccaggtgcctta

SEQ ID NO: 7391833 - DNA, 22 bp, Homo sapiens
cagccctggcccaggtgcctta

SEQ ID NO: 7391834 - DNA, 22 bp, Homo sapiens
cagccctggcccaggtgcctta

SEQ ID NO: 7391835 - DNA, 22 bp, Homo sapiens
cagccctggcccaggtgcctta

SEQ ID NO: 7391836 - DNA, 22 bp, Homo sapiens
cagccctggcccaggtgcctta

SEQ ID NO: 7391837 - DNA, 20 bp, Homo sapiens
cagcctccactcactcagct

SEQ ID NO: 7391838 - DNA, 22 bp, Homo sapiens
cagccctggcagctttcagggt

SEQ ID NO: 7391839 - DNA, 22 bp, Homo sapiens
cagccctggcagctttcagggt

SEQ ID NO: 7391840 - DNA, 22 bp, Homo sapiens
cagccctggcagctttcagggt

SEQ ID NO: 7391841 - DNA, 22 bp, Homo sapiens
cagccctggcagctttcagggt

SEQ ID NO: 7391842 - DNA, 23 bp, Homo sapiens
cagccctggagatgtgggaggca

SEQ ID NO: 7391843 - DNA, 22 bp, Homo sapiens
cagcctctttccacatcaggca

SEQ ID NO: 7391844 - DNA, 20 bp, Homo sapiens
cagcctccactcactcagct

SEQ ID NO: 7391845 - DNA, 22 bp, Homo sapiens
cagcctctttccacatcaggca

SEQ ID NO: 7391846 - DNA, 20 bp, Homo sapiens
cagcctccactcactcagct

SEQ ID NO: 7391847 - DNA, 20 bp, Homo sapiens
cagcctccactcactcagct

SEQ ID NO: 7391848 - DNA, 20 bp, Homo sapiens
cagcctccactcactcagct

SEQ ID NO: 7391849 - DNA, 20 bp, Homo sapiens
cagcctccactcactcagct

SEQ ID NO: 7391850 - DNA, 22 bp, Homo sapiens
cagccctggaacagctgactca

SEQ ID NO: 7391851 - DNA, 22 bp, Homo sapiens
cagccctggaacagctgactca

SEQ ID NO: 7391852 - DNA, 22 bp, Homo sapiens
cagccctggaacagctgactca

SEQ ID NO: 7391853 - DNA, 22 bp, Homo sapiens
cagccctggaacagctgactca

SEQ ID NO: 7391854 - DNA, 22 bp, Homo sapiens
cagccctgcttccccgctagtt

SEQ ID NO: 7391855 - DNA, 22 bp, Homo sapiens
cagccctgcttccccgctagtt

SEQ ID NO: 7391856 - DNA, 22 bp, Homo sapiens
cagccctgcttccccgctagtt

SEQ ID NO: 7391857 - DNA, 22 bp, Homo sapiens
cagccctggaacagctgactca

SEQ ID NO: 7391858 - DNA, 22 bp, Homo sapiens
cagccctggaacagctgactca

SEQ ID NO: 7391859 - DNA, 22 bp, Homo sapiens
cagccctggaacagctgactca

SEQ ID NO: 7391860 - DNA, 22 bp, Homo sapiens
cagccctggaacagctgactca

SEQ ID NO: 7391861 - DNA, 22 bp, Homo sapiens
cagccctggaacagctgactca

SEQ ID NO: 7391862 - DNA, 22 bp, Homo sapiens
cagccctggaacagctgactca

SEQ ID NO: 7391863 - DNA, 23 bp, Homo sapiens
cagccctggagatgtgggaggca

SEQ ID NO: 7391864 - DNA, 23 bp, Homo sapiens
cagccctggagatgtgggaggca

SEQ ID NO: 7391865 - DNA, 23 bp, Homo sapiens
cagccctggagatgtgggaggca

SEQ ID NO: 7391866 - DNA, 23 bp, Homo sapiens
cagccctggagatgtgggaggca

SEQ ID NO: 7391867 - DNA, 23 bp, Homo sapiens
cagccctggagatgtgggaggca

SEQ ID NO: 7391868 - DNA, 23 bp, Homo sapiens
cagccctggagatgtgggaggca

SEQ ID NO: 7391869 - DNA, 23 bp, Homo sapiens
cagccctggagatgtgggaggca

SEQ ID NO: 7391870 - DNA, 22 bp, Homo sapiens
cagccctggaacagctgactca

SEQ ID NO: 7391871 - DNA, 22 bp, Homo sapiens
cagccctggaacagctgactca

SEQ ID NO: 7391872 - DNA, 22 bp, Homo sapiens
cagccctggaacagctgactca

SEQ ID NO: 7391873 - DNA, 16 bp, Homo sapiens
cagcctgcagtggtca

SEQ ID NO: 7391874 - DNA, 22 bp, Homo sapiens
cagcctgcagggctgcctgttg

SEQ ID NO: 7391875 - DNA, 22 bp, Homo sapiens
cagcctgcagggctgcctgttg

SEQ ID NO: 7391876 - DNA, 22 bp, Homo sapiens
cagcctgcagggctgcctgttg

SEQ ID NO: 7391877 - DNA, 20 bp, Homo sapiens
cagcctgcatcatctgcagc

SEQ ID NO: 7391878 - DNA, 22 bp, Homo sapiens
cagcctgcagggctgcctgttg

SEQ ID NO: 7391879 - DNA, 22 bp, Homo sapiens
cagcctgcatttgtatctgtat

SEQ ID NO: 7391880 - DNA, 22 bp, Homo sapiens
cagcctgcatttgtatctgtat

SEQ ID NO: 7391881 - DNA, 20 bp, Homo sapiens
cagcctgcatcatctgcagc

SEQ ID NO: 7391882 - DNA, 22 bp, Homo sapiens
cagcctgccctggaagcccagc

SEQ ID NO: 7391883 - DNA, 22 bp, Homo sapiens
cagcctgccgtcagccaggtag

SEQ ID NO: 7391884 - DNA, 22 bp, Homo sapiens
cagcctgccgtcagccaggtag

SEQ ID NO: 7391885 - DNA, 22 bp, Homo sapiens
cagcctgccgtcagccaggtag

SEQ ID NO: 7391886 - DNA, 22 bp, Homo sapiens
cagcctgctagggcaatgcctt

SEQ ID NO: 7391887 - DNA, 22 bp, Homo sapiens
cagcctgcctcagtttccctct

SEQ ID NO: 7391888 - DNA, 22 bp, Homo sapiens
cagcctgagccttctgtagcaa

SEQ ID NO: 7391889 - DNA, 22 bp, Homo sapiens
cagcctgcaggaggccgtcagc

SEQ ID NO: 7391890 - DNA, 22 bp, Homo sapiens
cagcctgcagggctgcctgttg

SEQ ID NO: 7391891 - DNA, 22 bp, Homo sapiens
cagcctgcagggctgcctgttg

SEQ ID NO: 7391892 - DNA, 22 bp, Homo sapiens
cagcctgagccttctgtagcaa

SEQ ID NO: 7391893 - DNA, 22 bp, Homo sapiens
cagcctgagccttctgtagcaa

SEQ ID NO: 7391894 - DNA, 22 bp, Homo sapiens
cagcctgactatggctgcaggt

SEQ ID NO: 7391895 - DNA, 22 bp, Homo sapiens
cagcctgagccttctgtagcaa

SEQ ID NO: 7391896 - DNA, 22 bp, Homo sapiens
cagcctgactatggctgcaggt

SEQ ID NO: 7391897 - DNA, 22 bp, Homo sapiens
cagcctgacaccagctttgggc

SEQ ID NO: 7391898 - DNA, 22 bp, Homo sapiens
cagcctgactatggctgcaggt

SEQ ID NO: 7391899 - DNA, 22 bp, Homo sapiens
cagcctgactatggctgcaggt

SEQ ID NO: 7391900 - DNA, 22 bp, Homo sapiens
cagcctctttccacatcaggca

SEQ ID NO: 7391901 - DNA, 22 bp, Homo sapiens
cagccctgctggcaatgatgag

SEQ ID NO: 7391902 - DNA, 22 bp, Homo sapiens
cagccctgctggcaatgatgag

SEQ ID NO: 7391903 - DNA, 22 bp, Homo sapiens
cagccctgctggcaatgatgag

SEQ ID NO: 7391904 - DNA, 22 bp, Homo sapiens
cagccctgctggcaatgatgag

SEQ ID NO: 7391905 - DNA, 22 bp, Homo sapiens
cagccctgctggttttgggcaa

SEQ ID NO: 7391906 - DNA, 22 bp, Homo sapiens
cagccctgctggcaatgatgag

SEQ ID NO: 7391907 - DNA, 22 bp, Homo sapiens
cagccctgctggcaatgatgag

SEQ ID NO: 7391908 - DNA, 22 bp, Homo sapiens
cagccctgctggttttgggcaa

SEQ ID NO: 7391909 - DNA, 22 bp, Homo sapiens
cagccctgctggttttgggcaa

SEQ ID NO: 7391910 - DNA, 22 bp, Homo sapiens
cagccctgcttccccgctagtt

SEQ ID NO: 7391911 - DNA, 22 bp, Homo sapiens
cagccctgctggttttgggcaa

SEQ ID NO: 7391912 - DNA, 22 bp, Homo sapiens
cagccctgctggttttgggcaa

SEQ ID NO: 7391913 - DNA, 22 bp, Homo sapiens
cagccctgcttccccgctagtt

SEQ ID NO: 7391914 - DNA, 22 bp, Homo sapiens
cagccctgcttccccgctagtt

SEQ ID NO: 7391915 - DNA, 22 bp, Homo sapiens
cagccctgcttccccgctagtt

SEQ ID NO: 7391916 - DNA, 22 bp, Homo sapiens
cagccctgcttccccgctagtt

SEQ ID NO: 7391917 - DNA, 22 bp, Homo sapiens
cagccctgcttccccgctagtt

SEQ ID NO: 7391918 - DNA, 22 bp, Homo sapiens
cagccctgcttccccgctagtt

SEQ ID NO: 7391919 - DNA, 22 bp, Homo sapiens
cagccctgcttccccgctagtt

SEQ ID NO: 7391920 - DNA, 22 bp, Homo sapiens
cagccctgcttccccgctagtt

SEQ ID NO: 7391921 - DNA, 22 bp, Homo sapiens
cagccctgcttccccgctagtt

SEQ ID NO: 7391922 - DNA, 22 bp, Homo sapiens
cagccctgcttccccgctagtt

SEQ ID NO: 7391923 - DNA, 22 bp, Homo sapiens
cagccctgcttccccgctagtt

SEQ ID NO: 7391924 - DNA, 22 bp, Homo sapiens
cagccctgctcttagtgtctcc

SEQ ID NO: 7391925 - DNA, 22 bp, Homo sapiens
cagccctgctcttagtgtctcc

SEQ ID NO: 7391926 - DNA, 22 bp, Homo sapiens
cagccctgctcttagtgtctcc

SEQ ID NO: 7391927 - DNA, 22 bp, Homo sapiens
cagccctgctcttagtgtctcc

SEQ ID NO: 7391928 - DNA, 22 bp, Homo sapiens
cagccctgctcttagtgtctcc

SEQ ID NO: 7391929 - DNA, 22 bp, Homo sapiens
cagccctgctgacactgtctga

SEQ ID NO: 7391930 - DNA, 22 bp, Homo sapiens
cagccctgctgacactgtctga

SEQ ID NO: 7391931 - DNA, 22 bp, Homo sapiens
cagccctgctcttagtgtctcc

SEQ ID NO: 7391932 - DNA, 22 bp, Homo sapiens
cagccctgctcttagtgtctcc

SEQ ID NO: 7391933 - DNA, 22 bp, Homo sapiens
cagccctgctggcaatgatgag

SEQ ID NO: 7391934 - DNA, 22 bp, Homo sapiens
cagccctgctgccttagtgcct

SEQ ID NO: 7391935 - DNA, 22 bp, Homo sapiens
cagccctgctgacactgtctga

SEQ ID NO: 7391936 - DNA, 22 bp, Homo sapiens
cagccctgctgccttagtgcct

SEQ ID NO: 7391937 - DNA, 22 bp, Homo sapiens
cagccctgctgccttagtgcct

SEQ ID NO: 7391938 - DNA, 22 bp, Homo sapiens
cagccctgctgccttagtgcct

SEQ ID NO: 7391939 - DNA, 22 bp, Homo sapiens
cagccctgctcttagtgtctcc

SEQ ID NO: 7391940 - DNA, 22 bp, Homo sapiens
cagccctgctgacactgtctga

SEQ ID NO: 7391941 - DNA, 22 bp, Homo sapiens
cagccctgctgacactgtctga

SEQ ID NO: 7391942 - DNA, 22 bp, Homo sapiens
cagccctgctgacactgtctga

SEQ ID NO: 7391943 - DNA, 22 bp, Homo sapiens
cagccctgctgacactgtctga

SEQ ID NO: 7391944 - DNA, 23 bp, Homo sapiens
cagccctgaaatcgaggtgacac

SEQ ID NO: 7391945 - DNA, 23 bp, Homo sapiens
cagccctgaaatcgaggtgacac

SEQ ID NO: 7391946 - DNA, 22 bp, Homo sapiens
cagccctgaaacaacctcctct

SEQ ID NO: 7391947 - DNA, 22 bp, Homo sapiens
cagccctgaaacaacctcctct

SEQ ID NO: 7391948 - DNA, 22 bp, Homo sapiens
cagccctgaaacaacctcctct

SEQ ID NO: 7391949 - DNA, 23 bp, Homo sapiens
cagccctgaaatcgaggtgacac

SEQ ID NO: 7391950 - DNA, 23 bp, Homo sapiens
cagccctgaaatcgaggtgacac

SEQ ID NO: 7391951 - DNA, 23 bp, Homo sapiens
cagccctgaaatcgaggtgacac

SEQ ID NO: 7391952 - DNA, 22 bp, Homo sapiens
cagccctgcagccatggcctgt

SEQ ID NO: 7391953 - DNA, 22 bp, Homo sapiens
cagccctgcagccatggcctgt

SEQ ID NO: 7391954 - DNA, 22 bp, Homo sapiens
cagccctgcagccatggcctgt

SEQ ID NO: 7391955 - DNA, 22 bp, Homo sapiens
cagccctgcagccatggcctgt

SEQ ID NO: 7391956 - DNA, 22 bp, Homo sapiens
cagccctgcagccatggcctgt

SEQ ID NO: 7391957 - DNA, 22 bp, Homo sapiens
cagccctgcagccatggcctgt

SEQ ID NO: 7391958 - DNA, 23 bp, Homo sapiens
cagccctgaaatcgaggtgacac

SEQ ID NO: 7391959 - DNA, 22 bp, Homo sapiens
cagccctgcagctggatctcac

SEQ ID NO: 7391960 - DNA, 22 bp, Homo sapiens
cagccctgcagctggatctcac

SEQ ID NO: 7391961 - DNA, 22 bp, Homo sapiens
cagccctgcagccatggcctgt

SEQ ID NO: 7391962 - DNA, 22 bp, Homo sapiens
cagccctgcagccatggcctgt

SEQ ID NO: 7391963 - DNA, 22 bp, Homo sapiens
cagccctgcagctggatctcac

SEQ ID NO: 7391964 - DNA, 22 bp, Homo sapiens
cagccctgcagctggatctcac

SEQ ID NO: 7391965 - DNA, 22 bp, Homo sapiens
cagccctgccatggagcctcct

SEQ ID NO: 7391966 - DNA, 22 bp, Homo sapiens
cagccctgccatggagcctcct

SEQ ID NO: 7391967 - DNA, 22 bp, Homo sapiens
cagccctgcagctggatctcac

SEQ ID NO: 7391968 - DNA, 22 bp, Homo sapiens
cagccctgccatggagcctcct

SEQ ID NO: 7391969 - DNA, 22 bp, Homo sapiens
cagccctgccatggagcctcct

SEQ ID NO: 7391970 - DNA, 22 bp, Homo sapiens
cagccctgccatggagcctcct

SEQ ID NO: 7391971 - DNA, 22 bp, Homo sapiens
cagccctgccatggagcctcct

SEQ ID NO: 7391972 - DNA, 22 bp, Homo sapiens
cagccctgccatggagcctcct

SEQ ID NO: 7391973 - DNA, 22 bp, Homo sapiens
cagccctgccatggagcctcct

SEQ ID NO: 7391974 - DNA, 17 bp, Homo sapiens
cagccctgccgttccca

SEQ ID NO: 7391975 - DNA, 17 bp, Homo sapiens
cagccctgccgttccca

SEQ ID NO: 7391976 - DNA, 22 bp, Homo sapiens
cagccctgcggaggtgtatact

SEQ ID NO: 7391977 - DNA, 22 bp, Homo sapiens
cagccctgcggaggtgtatact

SEQ ID NO: 7391978 - DNA, 22 bp, Homo sapiens
cagccctgcggaggtgtatact

SEQ ID NO: 7391979 - DNA, 17 bp, Homo sapiens
cagccctgccgttccca

SEQ ID NO: 7391980 - DNA, 17 bp, Homo sapiens
cagccctgccgttccca

SEQ ID NO: 7391981 - DNA, 22 bp, Homo sapiens
cagccctgccatggagcctcct

SEQ ID NO: 7391982 - DNA, 17 bp, Homo sapiens
cagccctgccgttccca

SEQ ID NO: 7391983 - DNA, 17 bp, Homo sapiens
cagccctgccgttccca

SEQ ID NO: 7391984 - DNA, 17 bp, Homo sapiens
cagccctgccgttccca

SEQ ID NO: 7391985 - DNA, 22 bp, Homo sapiens
cagctagcggtgctggcggctc

SEQ ID NO: 7391986 - DNA, 22 bp, Homo sapiens
cagctagcggtgctggcggctc

SEQ ID NO: 7391987 - DNA, 22 bp, Homo sapiens
cagctagcggtgctggcggctc

SEQ ID NO: 7391988 - DNA, 22 bp, Homo sapiens
cagctagctaagaaggccagag

SEQ ID NO: 7391989 - DNA, 22 bp, Homo sapiens
cagctagcggtgctggcggctc

SEQ ID NO: 7391990 - DNA, 22 bp, Homo sapiens
cagctagagggatgctgtgtga

SEQ ID NO: 7391991 - DNA, 22 bp, Homo sapiens
cagctagctaagaaggccagag

SEQ ID NO: 7391992 - DNA, 22 bp, Homo sapiens
cagctagctaagaaggccagag

SEQ ID NO: 7391993 - DNA, 22 bp, Homo sapiens
cagctagcttccctgcagtgct

SEQ ID NO: 7391994 - DNA, 22 bp, Homo sapiens
cagctagcttccctgcagtgct

SEQ ID NO: 7391995 - DNA, 22 bp, Homo sapiens
cagctaggaaaccagagggcag

SEQ ID NO: 7391996 - DNA, 22 bp, Homo sapiens
cagctactcctcccatgacttc

SEQ ID NO: 7391997 - DNA, 22 bp, Homo sapiens
cagctaccatggtttgttccag

SEQ ID NO: 7391998 - DNA, 22 bp, Homo sapiens
cagctactcctcccatgacttc

SEQ ID NO: 7391999 - DNA, 22 bp, Homo sapiens
cagctagaaagtctgttaggga

SEQ ID NO: 7392000 - DNA, 22 bp, Homo sapiens
cagctacagttccactgagcat

SEQ ID NO: 7392001 - DNA, 22 bp, Homo sapiens
cagctacaggacctgatgcacc

SEQ ID NO: 7392002 - DNA, 22 bp, Homo sapiens
cagctacagttccactgagcat

SEQ ID NO: 7392003 - DNA, 22 bp, Homo sapiens
cagctacagttccactgagcat

SEQ ID NO: 7392004 - DNA, 22 bp, Homo sapiens
cagctacagttccactgagcat

SEQ ID NO: 7392005 - DNA, 22 bp, Homo sapiens
cagctacagttccactgagcat

SEQ ID NO: 7392006 - DNA, 22 bp, Homo sapiens
cagctacaggacgggcatctgc

SEQ ID NO: 7392007 - DNA, 22 bp, Homo sapiens
cagcctgtggcagaggtctaat

SEQ ID NO: 7392008 - DNA, 22 bp, Homo sapiens
cagccttcgacagttggagtag

SEQ ID NO: 7392009 - DNA, 22 bp, Homo sapiens
cagctaaggctccttctaggta

SEQ ID NO: 7392010 - DNA, 22 bp, Homo sapiens
cagctaagttccaggggctttc

SEQ ID NO: 7392011 - DNA, 22 bp, Homo sapiens
cagctaaggctccttctaggta

SEQ ID NO: 7392012 - DNA, 22 bp, Homo sapiens
cagctacaaatacttttgtatg

SEQ ID NO: 7392013 - DNA, 22 bp, Homo sapiens
cagctacaaatacttttgtatg

SEQ ID NO: 7392014 - DNA, 22 bp, Homo sapiens
cagctaatcctctctatccaag

SEQ ID NO: 7392015 - DNA, 22 bp, Homo sapiens
cagctacacaccagaactatta

SEQ ID NO: 7392016 - DNA, 22 bp, Homo sapiens
cagctacacaccagaactatta

SEQ ID NO: 7392017 - DNA, 22 bp, Homo sapiens
cagctacacaccagaactatta

SEQ ID NO: 7392018 - DNA, 22 bp, Homo sapiens
cagctacaaatacttttgtatg

SEQ ID NO: 7392019 - DNA, 22 bp, Homo sapiens
cagctacaggacctgatgcacc

SEQ ID NO: 7392020 - DNA, 22 bp, Homo sapiens
cagctacaggacctgatgcacc

SEQ ID NO: 7392021 - DNA, 22 bp, Homo sapiens
cagctacaggacctgatgcacc

SEQ ID NO: 7392022 - DNA, 22 bp, Homo sapiens
cagctacaggacgggcatctgc

SEQ ID NO: 7392023 - DNA, 22 bp, Homo sapiens
cagctacagtctgattggttca

SEQ ID NO: 7392024 - DNA, 22 bp, Homo sapiens
cagctacagtctgattggttca

SEQ ID NO: 7392025 - DNA, 22 bp, Homo sapiens
cagctacacttctgggtgtgtc

SEQ ID NO: 7392026 - DNA, 22 bp, Homo sapiens
cagctacagaggccacatggct

SEQ ID NO: 7392027 - DNA, 22 bp, Homo sapiens
cagctacagaggccacatggct

SEQ ID NO: 7392028 - DNA, 22 bp, Homo sapiens
cagctacacgtgcccctggggt

SEQ ID NO: 7392029 - DNA, 22 bp, Homo sapiens
cagctacagaggccacatggct

SEQ ID NO: 7392030 - DNA, 22 bp, Homo sapiens
cagctacagaggccacatggct

SEQ ID NO: 7392031 - DNA, 22 bp, Homo sapiens
gtgcccagtcctgccttgacag

SEQ ID NO: 7392032 - DNA, 22 bp, Homo sapiens
gtgcccagtcctgccttgacag

SEQ ID NO: 7392033 - DNA, 22 bp, Homo sapiens
gtgcccagtgcaggcccgcagg

SEQ ID NO: 7392034 - DNA, 22 bp, Homo sapiens
gtgcccagtgcaggcccgcagg

SEQ ID NO: 7392035 - DNA, 22 bp, Homo sapiens
gtgcccagtcctgccttgacag

SEQ ID NO: 7392036 - DNA, 22 bp, Homo sapiens
gtgcccagtcctgccttgacag

SEQ ID NO: 7392037 - DNA, 22 bp, Homo sapiens
gtgcccagtcctgccttgacag

SEQ ID NO: 7392038 - DNA, 22 bp, Homo sapiens
gtgcccagtaaatgaaagcttt

SEQ ID NO: 7392039 - DNA, 22 bp, Homo sapiens
gtgcccagtaaatgaaagcttt

SEQ ID NO: 7392040 - DNA, 22 bp, Homo sapiens
gtgcccagtcctgccttgacag

SEQ ID NO: 7392041 - DNA, 22 bp, Homo sapiens
gtgcccagtcctgccttgacag

SEQ ID NO: 7392042 - DNA, 22 bp, Homo sapiens
gtgcccagtcctgccttgacag

SEQ ID NO: 7392043 - DNA, 22 bp, Homo sapiens
gtgcccagtcctgccttgacag

SEQ ID NO: 7392044 - DNA, 22 bp, Homo sapiens
gtgcccagtcctgccttgacag

SEQ ID NO: 7392045 - DNA, 22 bp, Homo sapiens
gtgcccagtcctgccttgacag

SEQ ID NO: 7392046 - DNA, 22 bp, Homo sapiens
gtgcccagtaaatgaaagcttt

SEQ ID NO: 7392047 - DNA, 22 bp, Homo sapiens
gtgcccaggtgtccctgagaag

SEQ ID NO: 7392048 - DNA, 22 bp, Homo sapiens
cagctattccaggagtagaatc

SEQ ID NO: 7392049 - DNA, 22 bp, Homo sapiens
cagctattattttctctaaatt

SEQ ID NO: 7392050 - DNA, 22 bp, Homo sapiens
gtgcccaggtgtccctgagaag

SEQ ID NO: 7392051 - DNA, 22 bp, Homo sapiens
gtgcccagtaaatgaaagcttt

SEQ ID NO: 7392052 - DNA, 22 bp, Homo sapiens
gtgcccagtaaatgaaagcttt

SEQ ID NO: 7392053 - DNA, 22 bp, Homo sapiens
cagctattctctgaaatgaata

SEQ ID NO: 7392054 - DNA, 22 bp, Homo sapiens
gtgcccaggtgtccctgagaag

SEQ ID NO: 7392055 - DNA, 22 bp, Homo sapiens
gtgcccaggtgtccctgagaag

SEQ ID NO: 7392056 - DNA, 22 bp, Homo sapiens
cagctattaatgtttttgctga

SEQ ID NO: 7392057 - DNA, 22 bp, Homo sapiens
cagctatagatggactgaagag

SEQ ID NO: 7392058 - DNA, 22 bp, Homo sapiens
cagctagtaaatggcaagacta

SEQ ID NO: 7392059 - DNA, 22 bp, Homo sapiens
cagctatattgttttctactgt

SEQ ID NO: 7392060 - DNA, 22 bp, Homo sapiens
cagctagtacaatgggagagca

SEQ ID NO: 7392061 - DNA, 22 bp, Homo sapiens
cagctagtacaatgggagagca

SEQ ID NO: 7392062 - DNA, 22 bp, Homo sapiens
cagctagtcagaggcagggcca

SEQ ID NO: 7392063 - DNA, 22 bp, Homo sapiens
cagctagtcagaggcagggcca

SEQ ID NO: 7392064 - DNA, 20 bp, Homo sapiens
cagctagtggtaggagtcgg

SEQ ID NO: 7392065 - DNA, 20 bp, Homo sapiens
cagctagtggtaggagtcgg

SEQ ID NO: 7392066 - DNA, 22 bp, Homo sapiens
cagctaggaaaccagagggcag

SEQ ID NO: 7392067 - DNA, 22 bp, Homo sapiens
cagctaggaagtccttggcgaa

SEQ ID NO: 7392068 - DNA, 22 bp, Homo sapiens
cagctagggagtggcagagctt

SEQ ID NO: 7392069 - DNA, 22 bp, Homo sapiens
cagctagggagtggcagagctt

SEQ ID NO: 7392070 - DNA, 22 bp, Homo sapiens
cagctaggagaaaaggtgtttt

SEQ ID NO: 7392071 - DNA, 22 bp, Homo sapiens
cagctagtaaatggcaagacta

SEQ ID NO: 7392072 - DNA, 22 bp, Homo sapiens
cagctagggagtggcagagctt

SEQ ID NO: 7392073 - DNA, 22 bp, Homo sapiens
cagctagtaaatggcaagacta

SEQ ID NO: 7392074 - DNA, 22 bp, Homo sapiens
cagctagggagtggcagagctt

SEQ ID NO: 7392075 - DNA, 22 bp, Homo sapiens
cagctagggagtggcagagctt

SEQ ID NO: 7392076 - DNA, 22 bp, Homo sapiens
cagcctggagccacagcccagg

SEQ ID NO: 7392077 - DNA, 22 bp, Homo sapiens
cagcctggagccacagcccagg

SEQ ID NO: 7392078 - DNA, 22 bp, Homo sapiens
cagcctggagccacagcccagg

SEQ ID NO: 7392079 - DNA, 22 bp, Homo sapiens
cagcctggagccacagcccagg

SEQ ID NO: 7392080 - DNA, 22 bp, Homo sapiens
cagcctggagccacagcccagg

SEQ ID NO: 7392081 - DNA, 22 bp, Homo sapiens
cagcctggagccacagcccagg

SEQ ID NO: 7392082 - DNA, 22 bp, Homo sapiens
cagcctggagccacagcccagg

SEQ ID NO: 7392083 - DNA, 22 bp, Homo sapiens
cagcctggagccacagcccagg

SEQ ID NO: 7392084 - DNA, 22 bp, Homo sapiens
cagcctggagccacagcccagg

SEQ ID NO: 7392085 - DNA, 22 bp, Homo sapiens
cagcctggattgcagaatgcta

SEQ ID NO: 7392086 - DNA, 22 bp, Homo sapiens
cagcctggattgcagaatgcta

SEQ ID NO: 7392087 - DNA, 22 bp, Homo sapiens
cagcctggattgcagaatgcta

SEQ ID NO: 7392088 - DNA, 22 bp, Homo sapiens
cagcctggattgcagaatgcta

SEQ ID NO: 7392089 - DNA, 22 bp, Homo sapiens
cagcctggagccacagcccagg

SEQ ID NO: 7392090 - DNA, 22 bp, Homo sapiens
cagcctggattgcagaatgcta

SEQ ID NO: 7392091 - DNA, 22 bp, Homo sapiens
cagcctggattgcagaatgcta

SEQ ID NO: 7392092 - DNA, 22 bp, Homo sapiens
cagcctggattgcagaatgcta

SEQ ID NO: 7392093 - DNA, 22 bp, Homo sapiens
cagcctgctagggcaatgcctt

SEQ ID NO: 7392094 - DNA, 22 bp, Homo sapiens
cagcctgctagggcaatgcctt

SEQ ID NO: 7392095 - DNA, 22 bp, Homo sapiens
cagcctgctagggcaatgcctt

SEQ ID NO: 7392096 - DNA, 22 bp, Homo sapiens
cagcctgctctcagatgttgag

SEQ ID NO: 7392097 - DNA, 21 bp, Homo sapiens
cagcctgctgctccagggcca

SEQ ID NO: 7392098 - DNA, 21 bp, Homo sapiens
cagcctgctgctccagggcca

SEQ ID NO: 7392099 - DNA, 21 bp, Homo sapiens
cagcctgctgctccagggcca

SEQ ID NO: 7392100 - DNA, 21 bp, Homo sapiens
cagcctgctgctccagggcca

SEQ ID NO: 7392101 - DNA, 21 bp, Homo sapiens
cagcctgctgctccagggcca

SEQ ID NO: 7392102 - DNA, 22 bp, Homo sapiens
cagcctgctagggcaatgcctt

SEQ ID NO: 7392103 - DNA, 22 bp, Homo sapiens
cagcctggacagcgaccagagt

SEQ ID NO: 7392104 - DNA, 22 bp, Homo sapiens
cagcctggacagcgaccagagt

SEQ ID NO: 7392105 - DNA, 22 bp, Homo sapiens
cagcctggacagcgaccagagt

SEQ ID NO: 7392106 - DNA, 21 bp, Homo sapiens
cagcctgctgctccagggcca

SEQ ID NO: 7392107 - DNA, 22 bp, Homo sapiens
cagcctgctctcagatgttgag

SEQ ID NO: 7392108 - DNA, 21 bp, Homo sapiens
cagcctgctgctccagggcca

SEQ ID NO: 7392109 - DNA, 22 bp, Homo sapiens
cagcctggacagcgaccagagt

SEQ ID NO: 7392110 - DNA, 22 bp, Homo sapiens
cagcctggacagcgaccagagt

SEQ ID NO: 7392111 - DNA, 22 bp, Homo sapiens
cagcctggacagcgaccagagt

SEQ ID NO: 7392112 - DNA, 22 bp, Homo sapiens
cagcctggacagcgaccagagt

SEQ ID NO: 7392113 - DNA, 22 bp, Homo sapiens
cagcctgtcggctccttcattc

SEQ ID NO: 7392114 - DNA, 22 bp, Homo sapiens
cagcctgtcggctccttcattc

SEQ ID NO: 7392115 - DNA, 22 bp, Homo sapiens
cagcctgtagtctggtccaggt

SEQ ID NO: 7392116 - DNA, 22 bp, Homo sapiens
cagcctgtctgggcagagtgga

SEQ ID NO: 7392117 - DNA, 22 bp, Homo sapiens
cagcctgtctgggcagagtgga

SEQ ID NO: 7392118 - DNA, 22 bp, Homo sapiens
cagcctgtctgggcagagtgga

SEQ ID NO: 7392119 - DNA, 22 bp, Homo sapiens
cagccttcaaggcttagctcag

SEQ ID NO: 7392120 - DNA, 22 bp, Homo sapiens
cagcctgtggcagaggtctaat

SEQ ID NO: 7392121 - DNA, 22 bp, Homo sapiens
cagcctgtggcagaggtctaat

SEQ ID NO: 7392122 - DNA, 22 bp, Homo sapiens
cagcctgtggcagaggtctaat

SEQ ID NO: 7392123 - DNA, 22 bp, Homo sapiens
cagcctgtagaatacagtaaat

SEQ ID NO: 7392124 - DNA, 22 bp, Homo sapiens
cagcctgtagaatacagtaaat

SEQ ID NO: 7392125 - DNA, 22 bp, Homo sapiens
cagcctggtccccggctcaccc

SEQ ID NO: 7392126 - DNA, 22 bp, Homo sapiens
cagcctggtccccggctcaccc

SEQ ID NO: 7392127 - DNA, 22 bp, Homo sapiens
cagcctggtccccggctcaccc

SEQ ID NO: 7392128 - DNA, 22 bp, Homo sapiens
cagcctggtccccggctcaccc

SEQ ID NO: 7392129 - DNA, 22 bp, Homo sapiens
cagcctgggctccagagtccct

SEQ ID NO: 7392130 - DNA, 22 bp, Homo sapiens
cagcctgggctccagagtccct

SEQ ID NO: 7392131 - DNA, 22 bp, Homo sapiens
cagcctgggctccagagtccct

SEQ ID NO: 7392132 - DNA, 22 bp, Homo sapiens
cagcctgggctccagagtccct

SEQ ID NO: 7392133 - DNA, 22 bp, Homo sapiens
cagcctgggctccagagtccct

SEQ ID NO: 7392134 - DNA, 22 bp, Homo sapiens
cagcctggtccccggctcaccc

SEQ ID NO: 7392135 - DNA, 22 bp, Homo sapiens
cagcctggtccccggctcaccc

SEQ ID NO: 7392136 - DNA, 22 bp, Homo sapiens
cagcctggtccccggctcaccc

SEQ ID NO: 7392137 - DNA, 22 bp, Homo sapiens
cagcctggtccccggctcaccc

SEQ ID NO: 7392138 - DNA, 22 bp, Homo sapiens
cagcctgggctccagagtccct

SEQ ID NO: 7392139 - DNA, 22 bp, Homo sapiens
cagcctggcctgggactgctga

SEQ ID NO: 7392140 - DNA, 22 bp, Homo sapiens
cagcctggcctgggactgctga

SEQ ID NO: 7392141 - DNA, 22 bp, Homo sapiens
cagcctggcctgggactgctga

SEQ ID NO: 7392142 - DNA, 22 bp, Homo sapiens
cagcctggcctgggactgctga

SEQ ID NO: 7392143 - DNA, 22 bp, Homo sapiens
cagcctggcctgggactgctga

SEQ ID NO: 7392144 - DNA, 22 bp, Homo sapiens
cagcctggcctgggactgctga

SEQ ID NO: 7392145 - DNA, 22 bp, Homo sapiens
cagccaggcctggtgaccaaag

SEQ ID NO: 7392146 - DNA, 22 bp, Homo sapiens
cagccaggcctggtgaccaaag

SEQ ID NO: 7392147 - DNA, 22 bp, Homo sapiens
cagccaggcctggtgaccaaag

SEQ ID NO: 7392148 - DNA, 22 bp, Homo sapiens
cagccaggcctggtgaccaaag

SEQ ID NO: 7392149 - DNA, 22 bp, Homo sapiens
cagccaggcctggtgaccaaag

SEQ ID NO: 7392150 - DNA, 22 bp, Homo sapiens
cagccagggagcaaagagttga

SEQ ID NO: 7392151 - DNA, 22 bp, Homo sapiens
cagccagggagcaaagagttga

SEQ ID NO: 7392152 - DNA, 22 bp, Homo sapiens
cagccagggagcaaagagttga

SEQ ID NO: 7392153 - DNA, 22 bp, Homo sapiens
cagccagggagggcaaatgaga

SEQ ID NO: 7392154 - DNA, 22 bp, Homo sapiens
cagccagggagggcaaatgaga

SEQ ID NO: 7392155 - DNA, 22 bp, Homo sapiens
gtctggagcctgggtccctgct

SEQ ID NO: 7392156 - DNA, 22 bp, Homo sapiens
gtctggagccccagtcaatgag

SEQ ID NO: 7392157 - DNA, 22 bp, Homo sapiens
gtctggagccccagtcaatgag

SEQ ID NO: 7392158 - DNA, 22 bp, Homo sapiens
gtctggagccccagtcaatgag

SEQ ID NO: 7392159 - DNA, 22 bp, Homo sapiens
gtctggagccaccctaagcatt

SEQ ID NO: 7392160 - DNA, 22 bp, Homo sapiens
gtctggagccactgctgctgct

SEQ ID NO: 7392161 - DNA, 22 bp, Homo sapiens
gtctggagccactgctgctgct

SEQ ID NO: 7392162 - DNA, 22 bp, Homo sapiens
gtctggagccactgctgctgct

SEQ ID NO: 7392163 - DNA, 22 bp, Homo sapiens
gtctggagacttgggtcatcaa

SEQ ID NO: 7392164 - DNA, 22 bp, Homo sapiens
gtctggagagctgagcagagtt

SEQ ID NO: 7392165 - DNA, 22 bp, Homo sapiens
gtctggactttatcccaaggtt

SEQ ID NO: 7392166 - DNA, 22 bp, Homo sapiens
gtctggagacttgggtcatcaa

SEQ ID NO: 7392167 - DNA, 22 bp, Homo sapiens
gtctggagagctgagcagagtt

SEQ ID NO: 7392168 - DNA, 22 bp, Homo sapiens
gtctggagagctgagcagagtt

SEQ ID NO: 7392169 - DNA, 22 bp, Homo sapiens
gtctggagagctgagcagagtt

SEQ ID NO: 7392170 - DNA, 22 bp, Homo sapiens
gtctggagagctgagcagagtt

SEQ ID NO: 7392171 - DNA, 22 bp, Homo sapiens
gtctggagagctgagcagagtt

SEQ ID NO: 7392172 - DNA, 22 bp, Homo sapiens
gtctggagccaccctaagcatt

SEQ ID NO: 7392173 - DNA, 22 bp, Homo sapiens
gtctggaaattaagaggaggtt

SEQ ID NO: 7392174 - DNA, 22 bp, Homo sapiens
gtctggaaattaagaggaggtt

SEQ ID NO: 7392175 - DNA, 22 bp, Homo sapiens
gtctggaaatattgacttcaga

SEQ ID NO: 7392176 - DNA, 22 bp, Homo sapiens
gtctggaaaggggcttttatct

SEQ ID NO: 7392177 - DNA, 22 bp, Homo sapiens
gtctggaaagagctgaggttca

SEQ ID NO: 7392178 - DNA, 22 bp, Homo sapiens
gtctggaaccaagacgtgtagc

SEQ ID NO: 7392179 - DNA, 22 bp, Homo sapiens
gtctggaaatttaaggtatgag

SEQ ID NO: 7392180 - DNA, 22 bp, Homo sapiens
gtctggaaatttaaggtatgag

SEQ ID NO: 7392181 - DNA, 22 bp, Homo sapiens
gtctggaagaacctgtgccagt

SEQ ID NO: 7392182 - DNA, 22 bp, Homo sapiens
gtctggaaccaatatttgaggg

SEQ ID NO: 7392183 - DNA, 22 bp, Homo sapiens
gtctggaagaacctgtgccagt

SEQ ID NO: 7392184 - DNA, 22 bp, Homo sapiens
gtctggaaggaggagatggagc

SEQ ID NO: 7392185 - DNA, 22 bp, Homo sapiens
gtctggaaggaggagatggagc

SEQ ID NO: 7392186 - DNA, 22 bp, Homo sapiens
gtctggaagctctaggggagaa

SEQ ID NO: 7392187 - DNA, 22 bp, Homo sapiens
gtctggaagagcaggaataaac

SEQ ID NO: 7392188 - DNA, 22 bp, Homo sapiens
gtctggaagaactagggatgtt

SEQ ID NO: 7392189 - DNA, 22 bp, Homo sapiens
gtctggaagaactagggatgtt

SEQ ID NO: 7392190 - DNA, 22 bp, Homo sapiens
gtctggaatatagcaagctctt

SEQ ID NO: 7392191 - DNA, 22 bp, Homo sapiens
gtctggaatatagcaagctctt

SEQ ID NO: 7392192 - DNA, 22 bp, Homo sapiens
gtctggaagggagtgcattttc

SEQ ID NO: 7392193 - DNA, 22 bp, Homo sapiens
gtctggacagcagcacctcggc

SEQ ID NO: 7392194 - DNA, 22 bp, Homo sapiens
gtctggaccttggactccttaa

SEQ ID NO: 7392195 - DNA, 22 bp, Homo sapiens
gtctggactttatcccaaggtt

SEQ ID NO: 7392196 - DNA, 22 bp, Homo sapiens
gtccctgggcgcctccgtgctc

SEQ ID NO: 7392197 - DNA, 22 bp, Homo sapiens
gtccctgggcgcctccgtgctc

SEQ ID NO: 7392198 - DNA, 22 bp, Homo sapiens
gtccctgggcgcctccgtgctc

SEQ ID NO: 7392199 - DNA, 22 bp, Homo sapiens
gtccctggggaatcagctggag

SEQ ID NO: 7392200 - DNA, 22 bp, Homo sapiens
gtccctgggggtttaggactca

SEQ ID NO: 7392201 - DNA, 22 bp, Homo sapiens
gtccctgggggtttaggactca

SEQ ID NO: 7392202 - DNA, 22 bp, Homo sapiens
gtccctggggaatcagctggag

SEQ ID NO: 7392203 - DNA, 22 bp, Homo sapiens
gtccctgggaaaggagagggca

SEQ ID NO: 7392204 - DNA, 22 bp, Homo sapiens
gtccctgggaaaggagagggca

SEQ ID NO: 7392205 - DNA, 22 bp, Homo sapiens
gtccctgggaaaggagagggca

SEQ ID NO: 7392206 - DNA, 22 bp, Homo sapiens
gtccctgggatgcccttctggg

SEQ ID NO: 7392207 - DNA, 22 bp, Homo sapiens
gtccctgggatgcccttctggg

SEQ ID NO: 7392208 - DNA, 19 bp, Homo sapiens
gtccctgggcagaggcacc

SEQ ID NO: 7392209 - DNA, 19 bp, Homo sapiens
gtccctgggcagaggcacc

SEQ ID NO: 7392210 - DNA, 19 bp, Homo sapiens
gtccctgggcagaggcacc

SEQ ID NO: 7392211 - DNA, 19 bp, Homo sapiens
gtccctgggcagaggcacc

SEQ ID NO: 7392212 - DNA, 19 bp, Homo sapiens
gtccctgggcagaggcacc

SEQ ID NO: 7392213 - DNA, 22 bp, Homo sapiens
gtcccaggcttatgtggagctt

SEQ ID NO: 7392214 - DNA, 22 bp, Homo sapiens
gtcccaggcttatgtggagctt

SEQ ID NO: 7392215 - DNA, 22 bp, Homo sapiens
gtcccagggaagaaggcagcac

SEQ ID NO: 7392216 - DNA, 22 bp, Homo sapiens
gtcccagggaagaaggcagcac

SEQ ID NO: 7392217 - DNA, 22 bp, Homo sapiens
gtcccagggaagaaggcagcac

SEQ ID NO: 7392218 - DNA, 22 bp, Homo sapiens
gtcccagggaagaaggcagcac

SEQ ID NO: 7392219 - DNA, 22 bp, Homo sapiens
gtcccagggaagaaggcagcac

SEQ ID NO: 7392220 - DNA, 22 bp, Homo sapiens
gtcccagggaagaaggcagcac

SEQ ID NO: 7392221 - DNA, 22 bp, Homo sapiens
gtccctggcgctttcgagcctt

SEQ ID NO: 7392222 - DNA, 22 bp, Homo sapiens
gtccctggcgctttcgagcctt

SEQ ID NO: 7392223 - DNA, 22 bp, Homo sapiens
gtccctggcgctttcgagcctt

SEQ ID NO: 7392224 - DNA, 22 bp, Homo sapiens
gtccctgggaaaggagagggca

SEQ ID NO: 7392225 - DNA, 22 bp, Homo sapiens
gtccctggatctgggacagctg

SEQ ID NO: 7392226 - DNA, 22 bp, Homo sapiens
gtccctggatctgggacagctg

SEQ ID NO: 7392227 - DNA, 22 bp, Homo sapiens
gtcccaggcttatgtggagctt

SEQ ID NO: 7392228 - DNA, 22 bp, Homo sapiens
gtcccaggcttatgtggagctt

SEQ ID NO: 7392229 - DNA, 22 bp, Homo sapiens
gtcccaggcttatgtggagctt

SEQ ID NO: 7392230 - DNA, 22 bp, Homo sapiens
gtcccaggctccatggcagcca

SEQ ID NO: 7392231 - DNA, 22 bp, Homo sapiens
gtcccaggctccatggcagcca

SEQ ID NO: 7392232 - DNA, 22 bp, Homo sapiens
gtcccaggctccatggcagcca

SEQ ID NO: 7392233 - DNA, 22 bp, Homo sapiens
gtcccaggctccatggcagcca

SEQ ID NO: 7392234 - DNA, 22 bp, Homo sapiens
gtccctgggtctaaggcagtaa

SEQ ID NO: 7392235 - DNA, 22 bp, Homo sapiens
gtccctggtctaccgtggcttc

SEQ ID NO: 7392236 - DNA, 22 bp, Homo sapiens
gtccctggtctaccgtggcttc

SEQ ID NO: 7392237 - DNA, 22 bp, Homo sapiens
gtccctgggtctaaggcagtaa

SEQ ID NO: 7392238 - DNA, 22 bp, Homo sapiens
gtccctgggtctaaggcagtaa

SEQ ID NO: 7392239 - DNA, 22 bp, Homo sapiens
gtccctggtttgcccaggacca

SEQ ID NO: 7392240 - DNA, 22 bp, Homo sapiens
gtccctggtttgcccaggacca

SEQ ID NO: 7392241 - DNA, 22 bp, Homo sapiens
gtccctggtttgcccaggacca

SEQ ID NO: 7392242 - DNA, 22 bp, Homo sapiens
gtccctggtttgcccaggacca

SEQ ID NO: 7392243 - DNA, 22 bp, Homo sapiens
gtccctgggtagctcagtggct

SEQ ID NO: 7392244 - DNA, 22 bp, Homo sapiens
gtccctgggtagctcagtggct

SEQ ID NO: 7392245 - DNA, 22 bp, Homo sapiens
gtccctgggtctaaggcagtaa

SEQ ID NO: 7392246 - DNA, 22 bp, Homo sapiens
gtccctgggtctaaggcagtaa

SEQ ID NO: 7392247 - DNA, 22 bp, Homo sapiens
gtccctgggtctaaggcagtaa

SEQ ID NO: 7392248 - DNA, 22 bp, Homo sapiens
gtccctgggtctaaggcagtaa

SEQ ID NO: 7392249 - DNA, 22 bp, Homo sapiens
gtcccttcctcattccacttta

SEQ ID NO: 7392250 - DNA, 22 bp, Homo sapiens
gtcccttcctcattccacttta

SEQ ID NO: 7392251 - DNA, 22 bp, Homo sapiens
gtcccttggctcacaaacagct

SEQ ID NO: 7392252 - DNA, 22 bp, Homo sapiens
gtccgattggtatcggtgatca

SEQ ID NO: 7392253 - DNA, 19 bp, Homo sapiens
gtcccttcactcctgctgg

SEQ ID NO: 7392254 - DNA, 19 bp, Homo sapiens
gtcccttcactcctgctgg

SEQ ID NO: 7392255 - DNA, 19 bp, Homo sapiens
gtcccttcactcctgctgg

SEQ ID NO: 7392256 - DNA, 22 bp, Homo sapiens
gtctggaaagagctgaggttca

SEQ ID NO: 7392257 - DNA, 22 bp, Homo sapiens
gtctgcttttctgaattgcctg

SEQ ID NO: 7392258 - DNA, 22 bp, Homo sapiens
gtctgctttgtctttcatgata

SEQ ID NO: 7392259 - DNA, 22 bp, Homo sapiens
gtctgctttgtctttcatgata

SEQ ID NO: 7392260 - DNA, 22 bp, Homo sapiens
gtctcttttatggtgagttgat

SEQ ID NO: 7392261 - DNA, 22 bp, Homo sapiens
gtctgctttctgggaactcttt

SEQ ID NO: 7392262 - DNA, 22 bp, Homo sapiens
gtctgtctgttgttgagaagca

SEQ ID NO: 7392263 - DNA, 22 bp, Homo sapiens
gtctgtctctctccagagtgca

SEQ ID NO: 7392264 - DNA, 22 bp, Homo sapiens
gtctgtgcttattcagcagggg

SEQ ID NO: 7392265 - DNA, 22 bp, Homo sapiens
gtctgtgcttattcagcagggg

SEQ ID NO: 7392266 - DNA, 22 bp, Homo sapiens
gtctgtgcttattcagcagggg

SEQ ID NO: 7392267 - DNA, 22 bp, Homo sapiens
gtctgtggagttgcttgctgga

SEQ ID NO: 7392268 - DNA, 22 bp, Homo sapiens
gtctgtggcaggggagaagttt

SEQ ID NO: 7392269 - DNA, 22 bp, Homo sapiens
gtctgtggcaggggagaagttt

SEQ ID NO: 7392270 - DNA, 22 bp, Homo sapiens
gtctgtggcaggggagaagttt

SEQ ID NO: 7392271 - DNA, 22 bp, Homo sapiens
gtctgtggcaggggagaagttt

SEQ ID NO: 7392272 - DNA, 22 bp, Homo sapiens
gtctgtgggccaaatacagccc

SEQ ID NO: 7392273 - DNA, 22 bp, Homo sapiens
gtctgtggtccctgctggggac

SEQ ID NO: 7392274 - DNA, 22 bp, Homo sapiens
gtctgtgtgcacagagctttgg

SEQ ID NO: 7392275 - DNA, 19 bp, Homo sapiens
gtctgtgtatttgttgctg

SEQ ID NO: 7392276 - DNA, 22 bp, Homo sapiens
gtctgtggtccctgctggggac

SEQ ID NO: 7392277 - DNA, 22 bp, Homo sapiens
gtctgtggtccctgctggggac

SEQ ID NO: 7392278 - DNA, 22 bp, Homo sapiens
gtctgtggtagacaggaaggca

SEQ ID NO: 7392279 - DNA, 22 bp, Homo sapiens
gtctgtgggccaaatacagccc

SEQ ID NO: 7392280 - DNA, 22 bp, Homo sapiens
gtctgtggtagacaggaaggca

SEQ ID NO: 7392281 - DNA, 22 bp, Homo sapiens
gtctgtggtagacaggaaggca

SEQ ID NO: 7392282 - DNA, 22 bp, Homo sapiens
gtctgtggtccctgctggggac

SEQ ID NO: 7392283 - DNA, 18 bp, Homo sapiens
gtctgtgtggcttgggga

SEQ ID NO: 7392284 - DNA, 22 bp, Homo sapiens
gtctgtgtgcacagcgagtgcc

SEQ ID NO: 7392285 - DNA, 22 bp, Homo sapiens
gtctgtgtgcacagcgagtgcc

SEQ ID NO: 7392286 - DNA, 22 bp, Homo sapiens
gtctgtgtgcacagcgagtgcc

SEQ ID NO: 7392287 - DNA, 22 bp, Homo sapiens
gtctgtgtgcacagcgagtgcc

SEQ ID NO: 7392288 - DNA, 22 bp, Homo sapiens
cagccctcatcccgcctgcgtt

SEQ ID NO: 7392289 - DNA, 22 bp, Homo sapiens
cagccctcatcccgcctgcgtt

SEQ ID NO: 7392290 - DNA, 22 bp, Homo sapiens
cagccctcatcccgcctgcgtt

SEQ ID NO: 7392291 - DNA, 22 bp, Homo sapiens
cagccctcatcccgcctgcgtt

SEQ ID NO: 7392292 - DNA, 22 bp, Homo sapiens
cagccctcaggtcctcagcagc

SEQ ID NO: 7392293 - DNA, 22 bp, Homo sapiens
gtctgtacccacgtcctgctag

SEQ ID NO: 7392294 - DNA, 22 bp, Homo sapiens
cagccctcaggtcctcagcagc

SEQ ID NO: 7392295 - DNA, 22 bp, Homo sapiens
gtctgtaattattaaagaaagg

SEQ ID NO: 7392296 - DNA, 22 bp, Homo sapiens
cagccctcatcccgcctgcgtt

SEQ ID NO: 7392297 - DNA, 22 bp, Homo sapiens
gtctgtaattattaaagaaagg

SEQ ID NO: 7392298 - DNA, 22 bp, Homo sapiens
cagccctcaggtcctcagcagc

SEQ ID NO: 7392299 - DNA, 22 bp, Homo sapiens
cagccctcaaaccacttccagg

SEQ ID NO: 7392300 - DNA, 22 bp, Homo sapiens
cagccctcaggtcctcagcagc

SEQ ID NO: 7392301 - DNA, 22 bp, Homo sapiens
cagccctcaggtcctcagcagc

SEQ ID NO: 7392302 - DNA, 22 bp, Homo sapiens
cagccctcaggtcctcagcagc

SEQ ID NO: 7392303 - DNA, 22 bp, Homo sapiens
cagccccttcctggcatctgga

SEQ ID NO: 7392304 - DNA, 22 bp, Homo sapiens
cagccctcaggtcctcagcagc

SEQ ID NO: 7392305 - DNA, 22 bp, Homo sapiens
cagccctcaggtcctcagcagc

SEQ ID NO: 7392306 - DNA, 22 bp, Homo sapiens
cagccctcaggtcctcagcagc

SEQ ID NO: 7392307 - DNA, 19 bp, Homo sapiens
gtctgtccccacgagtggc

SEQ ID NO: 7392308 - DNA, 22 bp, Homo sapiens
gtctgtcccaatagccaacagg

SEQ ID NO: 7392309 - DNA, 22 bp, Homo sapiens
gtctgtcccaatagccaacagg

SEQ ID NO: 7392310 - DNA, 22 bp, Homo sapiens
gtctgtccatcagcaaaggctt

SEQ ID NO: 7392311 - DNA, 22 bp, Homo sapiens
gtctgtccatcagcaaaggctt

SEQ ID NO: 7392312 - DNA, 22 bp, Homo sapiens
gtctgtccatcagcaaaggctt

SEQ ID NO: 7392313 - DNA, 22 bp, Homo sapiens
gtctgtccatgagtagttccat

SEQ ID NO: 7392314 - DNA, 22 bp, Homo sapiens
gtctgtcccaatagccaacagg

SEQ ID NO: 7392315 - DNA, 22 bp, Homo sapiens
gtctgtccttttcatctcccaa

SEQ ID NO: 7392316 - DNA, 22 bp, Homo sapiens
gtctgtctccctgtgactgaga

SEQ ID NO: 7392317 - DNA, 22 bp, Homo sapiens
gtctgtccttttcatctcccaa

SEQ ID NO: 7392318 - DNA, 22 bp, Homo sapiens
gtctgtcctgtacccagcatct

SEQ ID NO: 7392319 - DNA, 22 bp, Homo sapiens
gtctgtcctgtacccagcatct

SEQ ID NO: 7392320 - DNA, 22 bp, Homo sapiens
gtctgtccttccgactgtagct

SEQ ID NO: 7392321 - DNA, 22 bp, Homo sapiens
gtctgtcctgtacccagcatct

SEQ ID NO: 7392322 - DNA, 22 bp, Homo sapiens
gtctgtccacttggaagctccc

SEQ ID NO: 7392323 - DNA, 22 bp, Homo sapiens
gtctgtccacttggaagctccc

SEQ ID NO: 7392324 - DNA, 22 bp, Homo sapiens
gtctgtccagcaacacaggagt

SEQ ID NO: 7392325 - DNA, 22 bp, Homo sapiens
gtctgtccacttggaagctccc

SEQ ID NO: 7392326 - DNA, 22 bp, Homo sapiens
gtctgtccagcaacacaggagt

SEQ ID NO: 7392327 - DNA, 22 bp, Homo sapiens
gtctgtccaggagattcagtct

SEQ ID NO: 7392328 - DNA, 22 bp, Homo sapiens
gtctgtccaggtgaatgcttca

SEQ ID NO: 7392329 - DNA, 22 bp, Homo sapiens
gtctgtatttatgcaatgaggg

SEQ ID NO: 7392330 - DNA, 22 bp, Homo sapiens
gtctgtcactcaggggctggag

SEQ ID NO: 7392331 - DNA, 22 bp, Homo sapiens
gtctgtcatctgagatggagtg

SEQ ID NO: 7392332 - DNA, 22 bp, Homo sapiens
gtctgtagtcacacaggtgaca

SEQ ID NO: 7392333 - DNA, 22 bp, Homo sapiens
gtctgtagatgagtcttaagaa

SEQ ID NO: 7392334 - DNA, 22 bp, Homo sapiens
gtctgtattcctgtcggcagcc

SEQ ID NO: 7392335 - DNA, 22 bp, Homo sapiens
gtctgtatcagaggagtgaatg

SEQ ID NO: 7392336 - DNA, 22 bp, Homo sapiens
cagccaggggctggcgtgttga

SEQ ID NO: 7392337 - DNA, 22 bp, Homo sapiens
cagccagggagggcaaatgaga

SEQ ID NO: 7392338 - DNA, 22 bp, Homo sapiens
cagccagggagggcaaatgaga

SEQ ID NO: 7392339 - DNA, 22 bp, Homo sapiens
cagccaggggctggcgtgttga

SEQ ID NO: 7392340 - DNA, 22 bp, Homo sapiens
cagccaggggctggcgtgttga

SEQ ID NO: 7392341 - DNA, 22 bp, Homo sapiens
cagccagggtcaggcagcttct

SEQ ID NO: 7392342 - DNA, 22 bp, Homo sapiens
cagccagggtcaggcagcttct

SEQ ID NO: 7392343 - DNA, 22 bp, Homo sapiens
cagccagggtcaggcagcttct

SEQ ID NO: 7392344 - DNA, 22 bp, Homo sapiens
cagccagggtcaggcagcttct

SEQ ID NO: 7392345 - DNA, 22 bp, Homo sapiens
cagccagggtcaggcagcttct

SEQ ID NO: 7392346 - DNA, 22 bp, Homo sapiens
cagccaggtatgggcgtgcggg

SEQ ID NO: 7392347 - DNA, 22 bp, Homo sapiens
cagccagggtcaggcagcttct

SEQ ID NO: 7392348 - DNA, 22 bp, Homo sapiens
cagccaggttcaagtccttata

SEQ ID NO: 7392349 - DNA, 22 bp, Homo sapiens
cagccaggttcaagtccttata

SEQ ID NO: 7392350 - DNA, 22 bp, Homo sapiens
cagcccaggctcagatgttggg

SEQ ID NO: 7392351 - DNA, 22 bp, Homo sapiens
cagcccaggctcagatgttggg

SEQ ID NO: 7392352 - DNA, 22 bp, Homo sapiens
cagcccaggctcagatgttggg

SEQ ID NO: 7392353 - DNA, 22 bp, Homo sapiens
cagccccatggtgtgctccagc

SEQ ID NO: 7392354 - DNA, 22 bp, Homo sapiens
cagcccaggctcagatgttggg

SEQ ID NO: 7392355 - DNA, 22 bp, Homo sapiens
cagcccaggctcagatgttggg

SEQ ID NO: 7392356 - DNA, 22 bp, Homo sapiens
cagcccaggctcagatgttggg

SEQ ID NO: 7392357 - DNA, 22 bp, Homo sapiens
cagcccaggctcagatgttggg

SEQ ID NO: 7392358 - DNA, 22 bp, Homo sapiens
cagcccaggctcagatgttggg

SEQ ID NO: 7392359 - DNA, 22 bp, Homo sapiens
cagccaggttagtgctaattgt

SEQ ID NO: 7392360 - DNA, 22 bp, Homo sapiens
cagccaggttagtgctaattgt

SEQ ID NO: 7392361 - DNA, 22 bp, Homo sapiens
cagccaggtatgggcgtgcggg

SEQ ID NO: 7392362 - DNA, 22 bp, Homo sapiens
cagccagggtcaggcagcttct

SEQ ID NO: 7392363 - DNA, 22 bp, Homo sapiens
cagccaggtatgggcgtgcggg

SEQ ID NO: 7392364 - DNA, 22 bp, Homo sapiens
cagccaggtatgggcgtgcggg

SEQ ID NO: 7392365 - DNA, 22 bp, Homo sapiens
cagccaggtatgggcgtgcggg

SEQ ID NO: 7392366 - DNA, 22 bp, Homo sapiens
cagcccccatggggaggtcaag

SEQ ID NO: 7392367 - DNA, 22 bp, Homo sapiens
cagcccctcacagagctgtcct

SEQ ID NO: 7392368 - DNA, 22 bp, Homo sapiens
cagcccctcacagagctgtcct

SEQ ID NO: 7392369 - DNA, 22 bp, Homo sapiens
cagcccctcacagagctgtcct

SEQ ID NO: 7392370 - DNA, 22 bp, Homo sapiens
cagcccctcacagagctgtcct

SEQ ID NO: 7392371 - DNA, 22 bp, Homo sapiens
cagcccctcacagagctgtcct

SEQ ID NO: 7392372 - DNA, 22 bp, Homo sapiens
cagccccatggtgtgctccagc

SEQ ID NO: 7392373 - DNA, 22 bp, Homo sapiens
cagccccatggtgtgctccagc

SEQ ID NO: 7392374 - DNA, 22 bp, Homo sapiens
cagcccctccctcaggcaggtg

SEQ ID NO: 7392375 - DNA, 22 bp, Homo sapiens
cagcccctccctcaggcaggtg

SEQ ID NO: 7392376 - DNA, 22 bp, Homo sapiens
cagcccctccctcaggcaggtg

SEQ ID NO: 7392377 - DNA, 22 bp, Homo sapiens
cagcccctggcgcacgccgagc

SEQ ID NO: 7392378 - DNA, 22 bp, Homo sapiens
cagcccctggcgcacgccgagc

SEQ ID NO: 7392379 - DNA, 22 bp, Homo sapiens
cagcccctcacagagctgtcct

SEQ ID NO: 7392380 - DNA, 22 bp, Homo sapiens
cagcccctccctcaggcaggtg

SEQ ID NO: 7392381 - DNA, 22 bp, Homo sapiens
cagcccctcacagagctgtcct

SEQ ID NO: 7392382 - DNA, 22 bp, Homo sapiens
cagcccctcacagagctgtcct

SEQ ID NO: 7392383 - DNA, 22 bp, Homo sapiens
cagccccttgtccggtagccac

SEQ ID NO: 7392384 - DNA, 22 bp, Homo sapiens
cagccccttcctggcatctgga

SEQ ID NO: 7392385 - DNA, 22 bp, Homo sapiens
cagccccttcctggcatctgga

SEQ ID NO: 7392386 - DNA, 22 bp, Homo sapiens
cagccccttcctggcatctgga

SEQ ID NO: 7392387 - DNA, 22 bp, Homo sapiens
cagccccttcctggcatctgga

SEQ ID NO: 7392388 - DNA, 22 bp, Homo sapiens
cagccccttcctggcatctgga

SEQ ID NO: 7392389 - DNA, 22 bp, Homo sapiens
cagccccttcctggcatctgga

SEQ ID NO: 7392390 - DNA, 22 bp, Homo sapiens
cagcccctggcgcacgccgagc

SEQ ID NO: 7392391 - DNA, 22 bp, Homo sapiens
cagccccttcctggcatctgga

SEQ ID NO: 7392392 - DNA, 22 bp, Homo sapiens
cagccccttgtccggtagccac

SEQ ID NO: 7392393 - DNA, 22 bp, Homo sapiens
cagccccttgtccggtagccac

SEQ ID NO: 7392394 - DNA, 22 bp, Homo sapiens
cagccccttgtccggtagccac

SEQ ID NO: 7392395 - DNA, 22 bp, Homo sapiens
cagcccgtcacacgctagcatc

SEQ ID NO: 7392396 - DNA, 22 bp, Homo sapiens
cagcccgtcacacgctagcatc

SEQ ID NO: 7392397 - DNA, 22 bp, Homo sapiens
cagccctcaaaccacttccagg

SEQ ID NO: 7392398 - DNA, 22 bp, Homo sapiens
cagccctcaaaccacttccagg

SEQ ID NO: 7392399 - DNA, 22 bp, Homo sapiens
cagccctcaaaccacttccagg

SEQ ID NO: 7392400 - DNA, 22 bp, Homo sapiens
cagccctcaaaccacttccagg

SEQ ID NO: 7392401 - DNA, 22 bp, Homo sapiens
cagccctcaaaccacttccagg

SEQ ID NO: 7392402 - DNA, 22 bp, Homo sapiens
cagccctcaaaccacttccagg

SEQ ID NO: 7392403 - DNA, 22 bp, Homo sapiens
gtcccagagagcactagtccat

SEQ ID NO: 7392404 - DNA, 22 bp, Homo sapiens
gtcccagagagcactagtccat

SEQ ID NO: 7392405 - DNA, 22 bp, Homo sapiens
gtccagccagctggtccttgcc

SEQ ID NO: 7392406 - DNA, 22 bp, Homo sapiens
gtccagccagctggtccttgcc

SEQ ID NO: 7392407 - DNA, 22 bp, Homo sapiens
gtccagccagctggtccttgcc

SEQ ID NO: 7392408 - DNA, 22 bp, Homo sapiens
gtccagccagctggtccttgcc

SEQ ID NO: 7392409 - DNA, 22 bp, Homo sapiens
gtccagccactcaccttccagc

SEQ ID NO: 7392410 - DNA, 22 bp, Homo sapiens
gtccagccaccctggaggcacg

SEQ ID NO: 7392411 - DNA, 22 bp, Homo sapiens
gtccagccactcaccttccagc

SEQ ID NO: 7392412 - DNA, 22 bp, Homo sapiens
cagcaggctgtggaaatcctgg

SEQ ID NO: 7392413 - DNA, 22 bp, Homo sapiens
cagcaggctgtggaaatcctgg

SEQ ID NO: 7392414 - DNA, 22 bp, Homo sapiens
cagcaggctgtggaaatcctgg

SEQ ID NO: 7392415 - DNA, 22 bp, Homo sapiens
cagcaggctgtggaaatcctgg

SEQ ID NO: 7392416 - DNA, 22 bp, Homo sapiens
cagcaggctggacttcagtccc

SEQ ID NO: 7392417 - DNA, 22 bp, Homo sapiens
cagcaggctggacttcagtccc

SEQ ID NO: 7392418 - DNA, 22 bp, Homo sapiens
cagcaggctgcgattgctcatt

SEQ ID NO: 7392419 - DNA, 22 bp, Homo sapiens
cagcaggctctgagtggctgcc

SEQ ID NO: 7392420 - DNA, 22 bp, Homo sapiens
cagcaggctctgagtggctgcc

SEQ ID NO: 7392421 - DNA, 22 bp, Homo sapiens
cagcaggctctgagtggctgcc

SEQ ID NO: 7392422 - DNA, 22 bp, Homo sapiens
cagcaggctctgagtggctgcc

SEQ ID NO: 7392423 - DNA, 22 bp, Homo sapiens
cagcaggctctgagtggctgcc

SEQ ID NO: 7392424 - DNA, 20 bp, Homo sapiens
cagcaggctatggggcaccc

SEQ ID NO: 7392425 - DNA, 22 bp, Homo sapiens
cagcaggctctgagtggctgcc

SEQ ID NO: 7392426 - DNA, 22 bp, Homo sapiens
cagcaggctctgagtggctgcc

SEQ ID NO: 7392427 - DNA, 22 bp, Homo sapiens
cagcaggctctgagtggctgcc

SEQ ID NO: 7392428 - DNA, 22 bp, Homo sapiens
cagcaggctctgagtggctgcc

SEQ ID NO: 7392429 - DNA, 22 bp, Homo sapiens
cagcaggctctgagtggctgcc

SEQ ID NO: 7392430 - DNA, 22 bp, Homo sapiens
cagcaggctctgagtggctgcc

SEQ ID NO: 7392431 - DNA, 22 bp, Homo sapiens
cagcaggctctgagtggctgcc

SEQ ID NO: 7392432 - DNA, 22 bp, Homo sapiens
cagcaggctgcgattgctcatt

SEQ ID NO: 7392433 - DNA, 22 bp, Homo sapiens
cagcaggctgcgattgctcatt

SEQ ID NO: 7392434 - DNA, 22 bp, Homo sapiens
cagcaggctgcgattgctcatt

SEQ ID NO: 7392435 - DNA, 22 bp, Homo sapiens
cagcaggctgcgattgctcatt

SEQ ID NO: 7392436 - DNA, 22 bp, Homo sapiens
gtcccaggcagagtcaggaggg

SEQ ID NO: 7392437 - DNA, 22 bp, Homo sapiens
gtcccaggcagagtcaggaggg

SEQ ID NO: 7392438 - DNA, 22 bp, Homo sapiens
gtcccaggcagagtcaggaggg

SEQ ID NO: 7392439 - DNA, 22 bp, Homo sapiens
gtcccaggcagagtcaggaggg

SEQ ID NO: 7392440 - DNA, 22 bp, Homo sapiens
gtcccaggagttgctgggcctt

SEQ ID NO: 7392441 - DNA, 22 bp, Homo sapiens
gtcccaggagttgctgggcctt

SEQ ID NO: 7392442 - DNA, 22 bp, Homo sapiens
gtcccaggagttgctgggcctt

SEQ ID NO: 7392443 - DNA, 22 bp, Homo sapiens
gtcccaggagttgctgggcctt

SEQ ID NO: 7392444 - DNA, 22 bp, Homo sapiens
gtcccaggcaggccactggcag

SEQ ID NO: 7392445 - DNA, 22 bp, Homo sapiens
gtcccaggctccatggcagcca

SEQ ID NO: 7392446 - DNA, 22 bp, Homo sapiens
gtcccaggctccatggcagcca

SEQ ID NO: 7392447 - DNA, 22 bp, Homo sapiens
gtcccaggctccatggcagcca

SEQ ID NO: 7392448 - DNA, 22 bp, Homo sapiens
gtcccaggctccatggcagcca

SEQ ID NO: 7392449 - DNA, 22 bp, Homo sapiens
gtcccaggcaggccactggcag

SEQ ID NO: 7392450 - DNA, 22 bp, Homo sapiens
gtcccaggcaggccactggcag

SEQ ID NO: 7392451 - DNA, 22 bp, Homo sapiens
gtcccaggcaggccactggcag

SEQ ID NO: 7392452 - DNA, 22 bp, Homo sapiens
gtcccaggcaggccactggcag

SEQ ID NO: 7392453 - DNA, 22 bp, Homo sapiens
gtcccaggcagagtcaggaggg

SEQ ID NO: 7392454 - DNA, 22 bp, Homo sapiens
gtcccaggcagagtcaggaggg

SEQ ID NO: 7392455 - DNA, 22 bp, Homo sapiens
gtcccaggcagagtcaggaggg

SEQ ID NO: 7392456 - DNA, 22 bp, Homo sapiens
gtcccaggaacattctggctag

SEQ ID NO: 7392457 - DNA, 22 bp, Homo sapiens
gtcccaggaacattctggctag

SEQ ID NO: 7392458 - DNA, 22 bp, Homo sapiens
gtcccaggaacattctggctag

SEQ ID NO: 7392459 - DNA, 22 bp, Homo sapiens
gtcccaggaacattctggctag

SEQ ID NO: 7392460 - DNA, 22 bp, Homo sapiens
gtcccaggaacattctggctag

SEQ ID NO: 7392461 - DNA, 22 bp, Homo sapiens
gtcccagcttcccactagcagc

SEQ ID NO: 7392462 - DNA, 22 bp, Homo sapiens
gtcccagcttcccactagcagc

SEQ ID NO: 7392463 - DNA, 22 bp, Homo sapiens
gtcccagcttcccactagcagc

SEQ ID NO: 7392464 - DNA, 22 bp, Homo sapiens
gtcccagaggacagggtcacat

SEQ ID NO: 7392465 - DNA, 22 bp, Homo sapiens
gtcccagagagcactagtccat

SEQ ID NO: 7392466 - DNA, 22 bp, Homo sapiens
gtcccagaggacagggtcacat

SEQ ID NO: 7392467 - DNA, 22 bp, Homo sapiens
gtcccagaggctttggccacag

SEQ ID NO: 7392468 - DNA, 22 bp, Homo sapiens
gtcccagcttcccactagcagc

SEQ ID NO: 7392469 - DNA, 22 bp, Homo sapiens
gtcccagcttcccactagcagc

SEQ ID NO: 7392470 - DNA, 22 bp, Homo sapiens
gtcccagatgtctggaactccc

SEQ ID NO: 7392471 - DNA, 22 bp, Homo sapiens
cagcaggcggcccgcgggcccg

SEQ ID NO: 7392472 - DNA, 22 bp, Homo sapiens
cagcaggcggcccgcgggcccg

SEQ ID NO: 7392473 - DNA, 22 bp, Homo sapiens
gtcattattctgggattctata

SEQ ID NO: 7392474 - DNA, 22 bp, Homo sapiens
gtcattaaaggttttaaatgct

SEQ ID NO: 7392475 - DNA, 22 bp, Homo sapiens
cagcaggcgttgggagaaagac

SEQ ID NO: 7392476 - DNA, 22 bp, Homo sapiens
cagcaggcggcccgcgggcccg

SEQ ID NO: 7392477 - DNA, 22 bp, Homo sapiens
cagcaggcgttgggagaaagac

SEQ ID NO: 7392478 - DNA, 22 bp, Homo sapiens
cagcaggcgttgggagaaagac

SEQ ID NO: 7392479 - DNA, 20 bp, Homo sapiens
cagcaggctatggggcaccc

SEQ ID NO: 7392480 - DNA, 20 bp, Homo sapiens
cagcaggctatggggcaccc

SEQ ID NO: 7392481 - DNA, 20 bp, Homo sapiens
cagcaggctatggggcaccc

SEQ ID NO: 7392482 - DNA, 22 bp, Homo sapiens
cagcaggcgttgggagaaagac

SEQ ID NO: 7392483 - DNA, 22 bp, Homo sapiens
cagcaggcgttgggagaaagac

SEQ ID NO: 7392484 - DNA, 20 bp, Homo sapiens
cagcaggctatggggcaccc

SEQ ID NO: 7392485 - DNA, 20 bp, Homo sapiens
cagcaggctatggggcaccc

SEQ ID NO: 7392486 - DNA, 20 bp, Homo sapiens
cagcaggctatggggcaccc

SEQ ID NO: 7392487 - DNA, 22 bp, Homo sapiens
gtcatggtgctagcgggaatgt

SEQ ID NO: 7392488 - DNA, 18 bp, Homo sapiens
gtcatgggtagtttagta

SEQ ID NO: 7392489 - DNA, 22 bp, Homo sapiens
gtcatgtgaataagtgtggggt

SEQ ID NO: 7392490 - DNA, 22 bp, Homo sapiens
gtcatggtgctcatcattggtg

SEQ ID NO: 7392491 - DNA, 22 bp, Homo sapiens
gtcatgcatgggctctgaagaa

SEQ ID NO: 7392492 - DNA, 22 bp, Homo sapiens
gtcatgcagacagggttgtttt

SEQ ID NO: 7392493 - DNA, 22 bp, Homo sapiens
gtcatgagttctcggggcagac

SEQ ID NO: 7392494 - DNA, 22 bp, Homo sapiens
gtcatgcatgggctctgaagaa

SEQ ID NO: 7392495 - DNA, 19 bp, Homo sapiens
gtcatcttttaataatgtg

SEQ ID NO: 7392496 - DNA, 22 bp, Homo sapiens
gtcatgaaattctagagcttga

SEQ ID NO: 7392497 - DNA, 22 bp, Homo sapiens
gtcatcttgctgttttagatct

SEQ ID NO: 7392498 - DNA, 22 bp, Homo sapiens
gtcataaagcttgttgcattta

SEQ ID NO: 7392499 - DNA, 22 bp, Homo sapiens
gtcataatataaaaactgactt

SEQ ID NO: 7392500 - DNA, 22 bp, Homo sapiens
gtcataggcatggatgtgggtt

SEQ ID NO: 7392501 - DNA, 22 bp, Homo sapiens
gtcataatataaaaactgactt

SEQ ID NO: 7392502 - DNA, 22 bp, Homo sapiens
gtcataggtagggggaaggatg

SEQ ID NO: 7392503 - DNA, 22 bp, Homo sapiens
gtcataggttcaaaaggcagat

SEQ ID NO: 7392504 - DNA, 22 bp, Homo sapiens
gtcataattccataacagatat

SEQ ID NO: 7392505 - DNA, 22 bp, Homo sapiens
gtcataatcacagttttatgca

SEQ ID NO: 7392506 - DNA, 22 bp, Homo sapiens
gtcataggttcaaaaggcagat

SEQ ID NO: 7392507 - DNA, 22 bp, Homo sapiens
gtcataggttcaaaaggcagat

SEQ ID NO: 7392508 - DNA, 22 bp, Homo sapiens
gtcatagtagtggaacagcagc

SEQ ID NO: 7392509 - DNA, 22 bp, Homo sapiens
gtcatatacactgcatgtaatc

SEQ ID NO: 7392510 - DNA, 22 bp, Homo sapiens
gtcatatacactgcatgtaatc

SEQ ID NO: 7392511 - DNA, 22 bp, Homo sapiens
gtcatataggtaggattcagct

SEQ ID NO: 7392512 - DNA, 22 bp, Homo sapiens
gtcatattgaagaagactggca

SEQ ID NO: 7392513 - DNA, 22 bp, Homo sapiens
gtcatcatcaggcagatgctgc

SEQ ID NO: 7392514 - DNA, 23 bp, Homo sapiens
gtcatcattaaagtcacagagac

SEQ ID NO: 7392515 - DNA, 22 bp, Homo sapiens
gtcatcactggtagcaaagatt

SEQ ID NO: 7392516 - DNA, 22 bp, Homo sapiens
gtcatcatttttagcatatggg

SEQ ID NO: 7392517 - DNA, 21 bp, Homo sapiens
gtcatccacctctcgggctct

SEQ ID NO: 7392518 - DNA, 22 bp, Homo sapiens
gtcatcttctctcagcccaggc

SEQ ID NO: 7392519 - DNA, 22 bp, Homo sapiens
gtcatcttcgcagagtgatttt

SEQ ID NO: 7392520 - DNA, 22 bp, Homo sapiens
gtcatcttaaggactgctatag

SEQ ID NO: 7392521 - DNA, 22 bp, Homo sapiens
gtcatcttaaggactgctatag

SEQ ID NO: 7392522 - DNA, 22 bp, Homo sapiens
cagcagctgcgtgcccaggccg

SEQ ID NO: 7392523 - DNA, 22 bp, Homo sapiens
cagcagctgcgtgcccaggccg

SEQ ID NO: 7392524 - DNA, 22 bp, Homo sapiens
cagcagctgggaaggaggctga

SEQ ID NO: 7392525 - DNA, 22 bp, Homo sapiens
cagcagctgggaaggaggctga

SEQ ID NO: 7392526 - DNA, 22 bp, Homo sapiens
cagcagctgggaaggaggctga

SEQ ID NO: 7392527 - DNA, 22 bp, Homo sapiens
cagcagctgggaaggaggctga

SEQ ID NO: 7392528 - DNA, 22 bp, Homo sapiens
cagcagctgcgtgcccaggccg

SEQ ID NO: 7392529 - DNA, 22 bp, Homo sapiens
cagcagctgcgtgcccaggccg

SEQ ID NO: 7392530 - DNA, 22 bp, Homo sapiens
cagcagctggtgagacacagcc

SEQ ID NO: 7392531 - DNA, 22 bp, Homo sapiens
cagcagctggtgagacacagcc

SEQ ID NO: 7392532 - DNA, 22 bp, Homo sapiens
cagcagctggtgagacacagcc

SEQ ID NO: 7392533 - DNA, 22 bp, Homo sapiens
cagcagctgggaaggaggctga

SEQ ID NO: 7392534 - DNA, 22 bp, Homo sapiens
cagcagctgggaaggaggctga

SEQ ID NO: 7392535 - DNA, 22 bp, Homo sapiens
cagcagctgggaaggaggctga

SEQ ID NO: 7392536 - DNA, 22 bp, Homo sapiens
cagcagctgggaaggaggctga

SEQ ID NO: 7392537 - DNA, 22 bp, Homo sapiens
cagcagctgggaaggaggctga

SEQ ID NO: 7392538 - DNA, 22 bp, Homo sapiens
cagcagctcactcaggtggctc

SEQ ID NO: 7392539 - DNA, 22 bp, Homo sapiens
cagcagctcactcaggtggctc

SEQ ID NO: 7392540 - DNA, 22 bp, Homo sapiens
cagcagctgatggggaagtgat

SEQ ID NO: 7392541 - DNA, 22 bp, Homo sapiens
cagcagctgatggggaagtgat

SEQ ID NO: 7392542 - DNA, 22 bp, Homo sapiens
cagcagctgcaaatggaaacag

SEQ ID NO: 7392543 - DNA, 22 bp, Homo sapiens
cagcagctgatggggaagtgat

SEQ ID NO: 7392544 - DNA, 22 bp, Homo sapiens
cagcagctgcaaatggaaacag

SEQ ID NO: 7392545 - DNA, 22 bp, Homo sapiens
cagcagctgcaaatggaaacag

SEQ ID NO: 7392546 - DNA, 22 bp, Homo sapiens
cagcagctgcctcagctgggga

SEQ ID NO: 7392547 - DNA, 22 bp, Homo sapiens
cagcagctgcctcagctgggga

SEQ ID NO: 7392548 - DNA, 22 bp, Homo sapiens
cagcagctgcaaatggaaacag

SEQ ID NO: 7392549 - DNA, 22 bp, Homo sapiens
cagcagctgcaaatggaaacag

SEQ ID NO: 7392550 - DNA, 22 bp, Homo sapiens
cagcagctgcctcagctgggga

SEQ ID NO: 7392551 - DNA, 22 bp, Homo sapiens
cagcagctgcctcagctgggga

SEQ ID NO: 7392552 - DNA, 22 bp, Homo sapiens
cagcagctgcctcagctgggga

SEQ ID NO: 7392553 - DNA, 23 bp, Homo sapiens
cagcagctgcctggttttttggt

SEQ ID NO: 7392554 - DNA, 23 bp, Homo sapiens
cagcagctgcctggttttttggt

SEQ ID NO: 7392555 - DNA, 23 bp, Homo sapiens
cagcagctgcctggttttttggt

SEQ ID NO: 7392556 - DNA, 22 bp, Homo sapiens
cagcagctgcgtgcccaggccg

SEQ ID NO: 7392557 - DNA, 22 bp, Homo sapiens
cagcagctgcgtgcccaggccg

SEQ ID NO: 7392558 - DNA, 22 bp, Homo sapiens
cagcacctacccatcctgagtc

SEQ ID NO: 7392559 - DNA, 22 bp, Homo sapiens
cagcacctacccatcctgagtc

SEQ ID NO: 7392560 - DNA, 22 bp, Homo sapiens
cagcacctacccatcctgagtc

SEQ ID NO: 7392561 - DNA, 22 bp, Homo sapiens
cagcaccctttccactgccttg

SEQ ID NO: 7392562 - DNA, 22 bp, Homo sapiens
cagcacctctgggtcttgtctt

SEQ ID NO: 7392563 - DNA, 22 bp, Homo sapiens
cagcacctctgggtcttgtctt

SEQ ID NO: 7392564 - DNA, 22 bp, Homo sapiens
cagcacctaggacagtagtcag

SEQ ID NO: 7392565 - DNA, 22 bp, Homo sapiens
cagcaccattttcctggtcagc

SEQ ID NO: 7392566 - DNA, 22 bp, Homo sapiens
cagcaccattttcctggtcagc

SEQ ID NO: 7392567 - DNA, 22 bp, Homo sapiens
cagcaccattttcctggtcagc

SEQ ID NO: 7392568 - DNA, 22 bp, Homo sapiens
cagcaccattttcctggtcagc

SEQ ID NO: 7392569 - DNA, 22 bp, Homo sapiens
cagcaccattttcctggtcagc

SEQ ID NO: 7392570 - DNA, 22 bp, Homo sapiens
cagcacccctcctggctatgaa

SEQ ID NO: 7392571 - DNA, 22 bp, Homo sapiens
cagcaccctcggaggctgccgt

SEQ ID NO: 7392572 - DNA, 22 bp, Homo sapiens
cagcaccctttccactgccttg

SEQ ID NO: 7392573 - DNA, 22 bp, Homo sapiens
cagcaccctttccactgccttg

SEQ ID NO: 7392574 - DNA, 22 bp, Homo sapiens
cagcacccctcctggctatgaa

SEQ ID NO: 7392575 - DNA, 22 bp, Homo sapiens
cagcaccctcggaggctgccgt

SEQ ID NO: 7392576 - DNA, 22 bp, Homo sapiens
cagcaccctcggaggctgccgt

SEQ ID NO: 7392577 - DNA, 22 bp, Homo sapiens
cagcacccctcctggctatgaa

SEQ ID NO: 7392578 - DNA, 22 bp, Homo sapiens
cagcacctgttagcattaaata

SEQ ID NO: 7392579 - DNA, 22 bp, Homo sapiens
cagcacctgttagcattaaata

SEQ ID NO: 7392580 - DNA, 22 bp, Homo sapiens
cagcacctgttagcattaaata

SEQ ID NO: 7392581 - DNA, 22 bp, Homo sapiens
cagcacctggcacaggagggcc

SEQ ID NO: 7392582 - DNA, 22 bp, Homo sapiens
cagcacctgctcttagacacgg

SEQ ID NO: 7392583 - DNA, 22 bp, Homo sapiens
cagcacctgctcttagacacgg

SEQ ID NO: 7392584 - DNA, 22 bp, Homo sapiens
cagcaccttccttaactccagg

SEQ ID NO: 7392585 - DNA, 22 bp, Homo sapiens
cagcaccttcctatccaggaga

SEQ ID NO: 7392586 - DNA, 22 bp, Homo sapiens
cagcaccttcctatccaggaga

SEQ ID NO: 7392587 - DNA, 22 bp, Homo sapiens
cagcaccttcctatccaggaga

SEQ ID NO: 7392588 - DNA, 22 bp, Homo sapiens
cagcaccttccttaactccagg

SEQ ID NO: 7392589 - DNA, 22 bp, Homo sapiens
cagcagctagaggaagggcaga

SEQ ID NO: 7392590 - DNA, 22 bp, Homo sapiens
cagcagctagaggaagggcaga

SEQ ID NO: 7392591 - DNA, 22 bp, Homo sapiens
cagcagctacttggagcagcag

SEQ ID NO: 7392592 - DNA, 22 bp, Homo sapiens
cagcagctacttggagcagcag

SEQ ID NO: 7392593 - DNA, 22 bp, Homo sapiens
cagcagctagaggaagggcaga

SEQ ID NO: 7392594 - DNA, 22 bp, Homo sapiens
cagcagctacttggagcagcag

SEQ ID NO: 7392595 - DNA, 22 bp, Homo sapiens
cagcactaggatatacatttcc

SEQ ID NO: 7392596 - DNA, 22 bp, Homo sapiens
cagcaggacatggaggagtaaa

SEQ ID NO: 7392597 - DNA, 22 bp, Homo sapiens
cagcaggacatggaggagtaaa

SEQ ID NO: 7392598 - DNA, 22 bp, Homo sapiens
cagcaggacatggaggagtaaa

SEQ ID NO: 7392599 - DNA, 22 bp, Homo sapiens
cagcaggaagtactagctttga

SEQ ID NO: 7392600 - DNA, 22 bp, Homo sapiens
cagcaggaagtactagctttga

SEQ ID NO: 7392601 - DNA, 22 bp, Homo sapiens
cagcaggaaggtttcccctgca

SEQ ID NO: 7392602 - DNA, 22 bp, Homo sapiens
cagcaggacatggaggagtaaa

SEQ ID NO: 7392603 - DNA, 22 bp, Homo sapiens
cagcaggacatggaggagtaaa

SEQ ID NO: 7392604 - DNA, 22 bp, Homo sapiens
gtcataaagacagaaacattcc

SEQ ID NO: 7392605 - DNA, 22 bp, Homo sapiens
gtcagcattgcagatatatggc

SEQ ID NO: 7392606 - DNA, 22 bp, Homo sapiens
gtcagcatccagctgtgaaagg

SEQ ID NO: 7392607 - DNA, 22 bp, Homo sapiens
gtcagcatgagcaagggctgac

SEQ ID NO: 7392608 - DNA, 22 bp, Homo sapiens
gtcagcattagcaatgactggt

SEQ ID NO: 7392609 - DNA, 22 bp, Homo sapiens
gtcagcattgcagatatatggc

SEQ ID NO: 7392610 - DNA, 22 bp, Homo sapiens
gtcagcctgcactcagggagcg

SEQ ID NO: 7392611 - DNA, 22 bp, Homo sapiens
cagcaggaaggtttcccctgca

SEQ ID NO: 7392612 - DNA, 22 bp, Homo sapiens
cagcaggaaggtttcccctgca

SEQ ID NO: 7392613 - DNA, 22 bp, Homo sapiens
cagcaggaaggtttcccctgca

SEQ ID NO: 7392614 - DNA, 22 bp, Homo sapiens
cagcaggaaacttaaaggtaat

SEQ ID NO: 7392615 - DNA, 22 bp, Homo sapiens
cagcaggaaagacatctgagca

SEQ ID NO: 7392616 - DNA, 22 bp, Homo sapiens
cagcaggaaagacatctgagca

SEQ ID NO: 7392617 - DNA, 20 bp, Homo sapiens
cagcaggaaaagtgcctcag

SEQ ID NO: 7392618 - DNA, 20 bp, Homo sapiens
cagcaggaaaagtgcctcag

SEQ ID NO: 7392619 - DNA, 20 bp, Homo sapiens
cagcaggaaaagtgcctcag

SEQ ID NO: 7392620 - DNA, 20 bp, Homo sapiens
cagcaggaaaagtgcctcag

SEQ ID NO: 7392621 - DNA, 20 bp, Homo sapiens
cagcaggaaaagtgcctcag

SEQ ID NO: 7392622 - DNA, 20 bp, Homo sapiens
cagcaggaaaagtgcctcag

SEQ ID NO: 7392623 - DNA, 22 bp, Homo sapiens
cagcaggaaaatcaattctgtg

SEQ ID NO: 7392624 - DNA, 22 bp, Homo sapiens
cagcaggaaaatcaattctgtg

SEQ ID NO: 7392625 - DNA, 22 bp, Homo sapiens
cagcaggaaaatcaattctgtg

SEQ ID NO: 7392626 - DNA, 22 bp, Homo sapiens
cagcaggaaaatcaattctgtg

SEQ ID NO: 7392627 - DNA, 22 bp, Homo sapiens
cagcaggaaacttaaaggtaat

SEQ ID NO: 7392628 - DNA, 22 bp, Homo sapiens
cagcaggaaacttaaaggtaat

SEQ ID NO: 7392629 - DNA, 22 bp, Homo sapiens
cagcaggaaacttaaaggtaat

SEQ ID NO: 7392630 - DNA, 22 bp, Homo sapiens
cagcagctttgccaagtcagcc

SEQ ID NO: 7392631 - DNA, 22 bp, Homo sapiens
cagcagcttctgttgatcagaa

SEQ ID NO: 7392632 - DNA, 22 bp, Homo sapiens
cagcagcttctgttgatcagaa

SEQ ID NO: 7392633 - DNA, 22 bp, Homo sapiens
cagcagcttctgttgatcagaa

SEQ ID NO: 7392634 - DNA, 22 bp, Homo sapiens
cagcagcttctgttgatcagaa

SEQ ID NO: 7392635 - DNA, 22 bp, Homo sapiens
cagcagcttctgttgatcagaa

SEQ ID NO: 7392636 - DNA, 22 bp, Homo sapiens
cagcagcttttgcattctcatt

SEQ ID NO: 7392637 - DNA, 22 bp, Homo sapiens
cagcagcttttgcattctcatt

SEQ ID NO: 7392638 - DNA, 22 bp, Homo sapiens
cagcagcttttgcattctcatt

SEQ ID NO: 7392639 - DNA, 22 bp, Homo sapiens
cagcagcttttgcattctcatt

SEQ ID NO: 7392640 - DNA, 22 bp, Homo sapiens
cagcagctttgccaagtcagcc

SEQ ID NO: 7392641 - DNA, 22 bp, Homo sapiens
cagcagctttgccaagtcagcc

SEQ ID NO: 7392642 - DNA, 22 bp, Homo sapiens
cagcagcttttgcattctcatt

SEQ ID NO: 7392643 - DNA, 22 bp, Homo sapiens
cagcagcttttgcattctcatt

SEQ ID NO: 7392644 - DNA, 22 bp, Homo sapiens
cagcagcttttgcattctcatt

SEQ ID NO: 7392645 - DNA, 22 bp, Homo sapiens
cagcagcttttgcattctcatt

SEQ ID NO: 7392646 - DNA, 20 bp, Homo sapiens
cagcaggaaaagtgcctcag

SEQ ID NO: 7392647 - DNA, 22 bp, Homo sapiens
cagcagctggtgagacacagcc

SEQ ID NO: 7392648 - DNA, 22 bp, Homo sapiens
cagcagctggtgagacacagcc

SEQ ID NO: 7392649 - DNA, 22 bp, Homo sapiens
cagcagctggtgagacacagcc

SEQ ID NO: 7392650 - DNA, 22 bp, Homo sapiens
cagcagctggttatacctgtgg

SEQ ID NO: 7392651 - DNA, 22 bp, Homo sapiens
cagcagctggtgagacacagcc

SEQ ID NO: 7392652 - DNA, 22 bp, Homo sapiens
cagcagctggttatacctgtgg

SEQ ID NO: 7392653 - DNA, 22 bp, Homo sapiens
cagcagctggttgaatccttct

SEQ ID NO: 7392654 - DNA, 22 bp, Homo sapiens
cagcagctggttgaatccttct

SEQ ID NO: 7392655 - DNA, 22 bp, Homo sapiens
cagcagctggttatacctgtgg

SEQ ID NO: 7392656 - DNA, 22 bp, Homo sapiens
cagcagctggttatacctgtgg

SEQ ID NO: 7392657 - DNA, 22 bp, Homo sapiens
cagcagctggttatacctgtgg

SEQ ID NO: 7392658 - DNA, 22 bp, Homo sapiens
cagcagctggttgaatccttct

SEQ ID NO: 7392659 - DNA, 22 bp, Homo sapiens
cagcagctggttgaatccttct

SEQ ID NO: 7392660 - DNA, 22 bp, Homo sapiens
cagcagctggttgaatccttct

SEQ ID NO: 7392661 - DNA, 22 bp, Homo sapiens
cagcagctgtttacggaacacc

SEQ ID NO: 7392662 - DNA, 22 bp, Homo sapiens
cagcagctgtttacggaacacc

SEQ ID NO: 7392663 - DNA, 22 bp, Homo sapiens
cagcagctgtttacggaacacc

SEQ ID NO: 7392664 - DNA, 22 bp, Homo sapiens
cagcagctgtttacggaacacc

SEQ ID NO: 7392665 - DNA, 20 bp, Homo sapiens
atgaaattcctgttttctga

SEQ ID NO: 7392666 - DNA, 20 bp, Homo sapiens
atgaaattcctgttttctga

SEQ ID NO: 7392667 - DNA, 18 bp, Homo sapiens
atgaacactgagctgaat

SEQ ID NO: 7392668 - DNA, 22 bp, Homo sapiens
atgaaattcatctgagaatgct

SEQ ID NO: 7392669 - DNA, 22 bp, Homo sapiens
atgaacagaggaatagaattct

SEQ ID NO: 7392670 - DNA, 20 bp, Homo sapiens
atgaaattcctgttttctga

SEQ ID NO: 7392671 - DNA, 22 bp, Homo sapiens
atgaacagaggcactaggaggg

SEQ ID NO: 7392672 - DNA, 22 bp, Homo sapiens
atgaacagaggcactaggaggg

SEQ ID NO: 7392673 - DNA, 22 bp, Homo sapiens
atgaacagcattgaaatccagc

SEQ ID NO: 7392674 - DNA, 22 bp, Homo sapiens
atgaacagcattgaaatccagc

SEQ ID NO: 7392675 - DNA, 22 bp, Homo sapiens
atgaacagcattgaaatccagc

SEQ ID NO: 7392676 - DNA, 22 bp, Homo sapiens
atgaacagtacaaagcacagac

SEQ ID NO: 7392677 - DNA, 22 bp, Homo sapiens
atgaacagtacaaagcacagac

SEQ ID NO: 7392678 - DNA, 22 bp, Homo sapiens
atgaacagcattgaaatccagc

SEQ ID NO: 7392679 - DNA, 22 bp, Homo sapiens
atgaacagtatgcaacatgatt

SEQ ID NO: 7392680 - DNA, 22 bp, Homo sapiens
atgaacagtatgcaacatgatt

SEQ ID NO: 7392681 - DNA, 22 bp, Homo sapiens
atgaacagtatgcaacatgatt

SEQ ID NO: 7392682 - DNA, 22 bp, Homo sapiens
atgaacatcggaaatgagactg

SEQ ID NO: 7392683 - DNA, 22 bp, Homo sapiens
atgaacatcggaaatgagactg

SEQ ID NO: 7392684 - DNA, 22 bp, Homo sapiens
atgaacatcctaggaggcattt

SEQ ID NO: 7392685 - DNA, 22 bp, Homo sapiens
atgaacagtatgcaacatgatt

SEQ ID NO: 7392686 - DNA, 22 bp, Homo sapiens
atgaacagtatgcaacatgatt

SEQ ID NO: 7392687 - DNA, 22 bp, Homo sapiens
atgaaattcatctgagaatgct

SEQ ID NO: 7392688 - DNA, 22 bp, Homo sapiens
atgaaacagtgtgtatagcaaa

SEQ ID NO: 7392689 - DNA, 22 bp, Homo sapiens
atgaaattaatcaacacataca

SEQ ID NO: 7392690 - DNA, 22 bp, Homo sapiens
atgaaacagtgtgtatagcaaa

SEQ ID NO: 7392691 - DNA, 22 bp, Homo sapiens
atgaaacagtgtgtatagcaaa

SEQ ID NO: 7392692 - DNA, 22 bp, Homo sapiens
atgaaacagtgtgtatagcaaa

SEQ ID NO: 7392693 - DNA, 22 bp, Homo sapiens
atgaaacagtgtgtatagcaaa

SEQ ID NO: 7392694 - DNA, 22 bp, Homo sapiens
atgaaacagtgtgtatagcaaa

SEQ ID NO: 7392695 - DNA, 22 bp, Homo sapiens
atgaaacagtgaattagtcaag

SEQ ID NO: 7392696 - DNA, 22 bp, Homo sapiens
atgaaacagtgaattagtcaag

SEQ ID NO: 7392697 - DNA, 22 bp, Homo sapiens
atgaaacagtgaattagtcaag

SEQ ID NO: 7392698 - DNA, 22 bp, Homo sapiens
atgaaacagagtacttaatata

SEQ ID NO: 7392699 - DNA, 22 bp, Homo sapiens
atgaaacagtgtgtatagcaaa

SEQ ID NO: 7392700 - DNA, 22 bp, Homo sapiens
atgaaacagtgaattagtcaag

SEQ ID NO: 7392701 - DNA, 22 bp, Homo sapiens
atgaaaatgtacatgtgtataa

SEQ ID NO: 7392702 - DNA, 22 bp, Homo sapiens
atgaaaatgtacatgtgtataa

SEQ ID NO: 7392703 - DNA, 22 bp, Homo sapiens
atgaaaatgtacatgtgtataa

SEQ ID NO: 7392704 - DNA, 22 bp, Homo sapiens
atgaaaatgtacatgtgtataa

SEQ ID NO: 7392705 - DNA, 22 bp, Homo sapiens
atgaaaattctatgcaggccag

SEQ ID NO: 7392706 - DNA, 22 bp, Homo sapiens
atgaaaatgtacatgtgtataa

SEQ ID NO: 7392707 - DNA, 22 bp, Homo sapiens
atgaaaattctatgcaggccag

SEQ ID NO: 7392708 - DNA, 22 bp, Homo sapiens
atgaaaatgtacatgtgtataa

SEQ ID NO: 7392709 - DNA, 22 bp, Homo sapiens
atgaaaatactgtggttgatag

SEQ ID NO: 7392710 - DNA, 22 bp, Homo sapiens
atgaaaagttcgatctagaagg

SEQ ID NO: 7392711 - DNA, 22 bp, Homo sapiens
atgaaaatgtacatgtgtataa

SEQ ID NO: 7392712 - DNA, 22 bp, Homo sapiens
atgaaaatgtacatgtgtataa

SEQ ID NO: 7392713 - DNA, 22 bp, Homo sapiens
atgaaaatgtacatgtgtataa

SEQ ID NO: 7392714 - DNA, 22 bp, Homo sapiens
atgaaaatactgtggttgatag

SEQ ID NO: 7392715 - DNA, 22 bp, Homo sapiens
atgaaaatactgtggttgatag

SEQ ID NO: 7392716 - DNA, 22 bp, Homo sapiens
atgaaaatactgtggttgatag

SEQ ID NO: 7392717 - DNA, 22 bp, Homo sapiens
atgaaacagagtacttaatata

SEQ ID NO: 7392718 - DNA, 22 bp, Homo sapiens
atgaaacagagtacttaatata

SEQ ID NO: 7392719 - DNA, 22 bp, Homo sapiens
atgaaacagagtacttaatata

SEQ ID NO: 7392720 - DNA, 22 bp, Homo sapiens
atgaaacagagtacttaatata

SEQ ID NO: 7392721 - DNA, 22 bp, Homo sapiens
atgaaacagagtacttaatata

SEQ ID NO: 7392722 - DNA, 22 bp, Homo sapiens
atgaaacagagtacttaatata

SEQ ID NO: 7392723 - DNA, 22 bp, Homo sapiens
atgaaacacacacgcgcatact

SEQ ID NO: 7392724 - DNA, 22 bp, Homo sapiens
atgaaacaagggtattttctct

SEQ ID NO: 7392725 - DNA, 22 bp, Homo sapiens
atgaaacaagggtattttctct

SEQ ID NO: 7392726 - DNA, 22 bp, Homo sapiens
atgaaacaacagacttggtcaa

SEQ ID NO: 7392727 - DNA, 22 bp, Homo sapiens
atgaaacaacagacttggtcaa

SEQ ID NO: 7392728 - DNA, 22 bp, Homo sapiens
atgaaacaaacctctatggagt

SEQ ID NO: 7392729 - DNA, 22 bp, Homo sapiens
atgaaacaagggtattttctct

SEQ ID NO: 7392730 - DNA, 22 bp, Homo sapiens
atgaaacaagggtattttctct

SEQ ID NO: 7392731 - DNA, 22 bp, Homo sapiens
atgaaacaacagacttggtcaa

SEQ ID NO: 7392732 - DNA, 22 bp, Homo sapiens
atgaaaattgacagcggaagta

SEQ ID NO: 7392733 - DNA, 22 bp, Homo sapiens
atgaaaattgacagcggaagta

SEQ ID NO: 7392734 - DNA, 22 bp, Homo sapiens
atgaaacaaacctctatggagt

SEQ ID NO: 7392735 - DNA, 22 bp, Homo sapiens
ctttctgaaagacattttaact

SEQ ID NO: 7392736 - DNA, 22 bp, Homo sapiens
ctttctgaaagacattttaact

SEQ ID NO: 7392737 - DNA, 22 bp, Homo sapiens
ctttctcttgagcaagagctgt

SEQ ID NO: 7392738 - DNA, 22 bp, Homo sapiens
ctttctcttgagcaagagctgt

SEQ ID NO: 7392739 - DNA, 22 bp, Homo sapiens
ctttctcttgagcaagagctgt

SEQ ID NO: 7392740 - DNA, 22 bp, Homo sapiens
ctttctgaggagacgggctttg

SEQ ID NO: 7392741 - DNA, 22 bp, Homo sapiens
ctttctgagtccaacccctgat

SEQ ID NO: 7392742 - DNA, 22 bp, Homo sapiens
ctttctgaaagacattttaact

SEQ ID NO: 7392743 - DNA, 22 bp, Homo sapiens
ctttctgaagtttaagttctaa

SEQ ID NO: 7392744 - DNA, 22 bp, Homo sapiens
ctttctgaagtttaagttctaa

SEQ ID NO: 7392745 - DNA, 22 bp, Homo sapiens
ctttctcttgagcaagagctgt

SEQ ID NO: 7392746 - DNA, 22 bp, Homo sapiens
ctttctcttgagcaagagctgt

SEQ ID NO: 7392747 - DNA, 22 bp, Homo sapiens
ctttctcttcgaaaacctgccc

SEQ ID NO: 7392748 - DNA, 22 bp, Homo sapiens
ctttctcttcgaaaacctgccc

SEQ ID NO: 7392749 - DNA, 22 bp, Homo sapiens
ctttctcttcgaaaacctgccc

SEQ ID NO: 7392750 - DNA, 22 bp, Homo sapiens
ctttctcttcgaaaacctgccc

SEQ ID NO: 7392751 - DNA, 22 bp, Homo sapiens
atgaagactaatgtgaatggga

SEQ ID NO: 7392752 - DNA, 23 bp, Homo sapiens
atgaagacccgtggtgtccccac

SEQ ID NO: 7392753 - DNA, 23 bp, Homo sapiens
atgaagacccgtggtgtccccac

SEQ ID NO: 7392754 - DNA, 22 bp, Homo sapiens
atgaagacaggtctcatcacca

SEQ ID NO: 7392755 - DNA, 22 bp, Homo sapiens
ctttctgattttaagctctaat

SEQ ID NO: 7392756 - DNA, 22 bp, Homo sapiens
ctttctgattttaagctctaat

SEQ ID NO: 7392757 - DNA, 22 bp, Homo sapiens
ctttctggcacagccgcgggat

SEQ ID NO: 7392758 - DNA, 22 bp, Homo sapiens
ctttctggagtggaaaggtatt

SEQ ID NO: 7392759 - DNA, 22 bp, Homo sapiens
ctttctggagtggaaaggtatt

SEQ ID NO: 7392760 - DNA, 22 bp, Homo sapiens
ctttctggacaagacagaggga

SEQ ID NO: 7392761 - DNA, 22 bp, Homo sapiens
ctttcttcaacctcattctgca

SEQ ID NO: 7392762 - DNA, 22 bp, Homo sapiens
ctttcttatacctgtcagggcc

SEQ ID NO: 7392763 - DNA, 22 bp, Homo sapiens
ctttcttatacctgtcagggcc

SEQ ID NO: 7392764 - DNA, 22 bp, Homo sapiens
ctttcttaatttttaaggacac

SEQ ID NO: 7392765 - DNA, 22 bp, Homo sapiens
ctttcttatacctgtcagggcc

SEQ ID NO: 7392766 - DNA, 22 bp, Homo sapiens
ctttctggacaagacagaggga

SEQ ID NO: 7392767 - DNA, 22 bp, Homo sapiens
ctttctggctgaagtgatgaat

SEQ ID NO: 7392768 - DNA, 22 bp, Homo sapiens
ctttcttaatttttaaggacac

SEQ ID NO: 7392769 - DNA, 22 bp, Homo sapiens
ctttctggctgaagtgatgaat

SEQ ID NO: 7392770 - DNA, 22 bp, Homo sapiens
ctttcttaatttttaaggacac

SEQ ID NO: 7392771 - DNA, 22 bp, Homo sapiens
ctttcttaatttttaaggacac

SEQ ID NO: 7392772 - DNA, 22 bp, Homo sapiens
ctttcttaatttttaaggacac

SEQ ID NO: 7392773 - DNA, 22 bp, Homo sapiens
ctttcttaatttttaaggacac

SEQ ID NO: 7392774 - DNA, 22 bp, Homo sapiens
atgaacatgtgactcagacctg

SEQ ID NO: 7392775 - DNA, 23 bp, Homo sapiens
atgaacattagtttcagatattg

SEQ ID NO: 7392776 - DNA, 23 bp, Homo sapiens
atgaacattagtttcagatattg

SEQ ID NO: 7392777 - DNA, 22 bp, Homo sapiens
atgaacattaaaatggtagaat

SEQ ID NO: 7392778 - DNA, 22 bp, Homo sapiens
atgaacatctctgatccaagca

SEQ ID NO: 7392779 - DNA, 22 bp, Homo sapiens
atgaacatctctgatccaagca

SEQ ID NO: 7392780 - DNA, 22 bp, Homo sapiens
atgaacatctctgatccaagca

SEQ ID NO: 7392781 - DNA, 22 bp, Homo sapiens
atgaacatgtgactcagacctg

SEQ ID NO: 7392782 - DNA, 22 bp, Homo sapiens
atgaacatgtgactcagacctg

SEQ ID NO: 7392783 - DNA, 22 bp, Homo sapiens
atgaaccataggcaagacaata

SEQ ID NO: 7392784 - DNA, 22 bp, Homo sapiens
atgaaccataggcaagacaata

SEQ ID NO: 7392785 - DNA, 22 bp, Homo sapiens
atgaacatttggtttggcagca

SEQ ID NO: 7392786 - DNA, 22 bp, Homo sapiens
atgaactacatgatcctgaaat

SEQ ID NO: 7392787 - DNA, 22 bp, Homo sapiens
atgaactatcatcagttccacc

SEQ ID NO: 7392788 - DNA, 22 bp, Homo sapiens
atgaactaagagtcattagtgt

SEQ ID NO: 7392789 - DNA, 22 bp, Homo sapiens
atgaaccttgatttgttcatct

SEQ ID NO: 7392790 - DNA, 22 bp, Homo sapiens
atgaactgagcttaattgctga

SEQ ID NO: 7392791 - DNA, 22 bp, Homo sapiens
atgaactgagcttaattgctga

SEQ ID NO: 7392792 - DNA, 22 bp, Homo sapiens
atgaactgcagtataaacttgg

SEQ ID NO: 7392793 - DNA, 22 bp, Homo sapiens
atgaactgcatgtattttagtg

SEQ ID NO: 7392794 - DNA, 22 bp, Homo sapiens
atgaactgcatgttttctactg

SEQ ID NO: 7392795 - DNA, 22 bp, Homo sapiens
atgaactgtccaatcttagagg

SEQ ID NO: 7392796 - DNA, 22 bp, Homo sapiens
atgaactttctttacagttttg

SEQ ID NO: 7392797 - DNA, 20 bp, Homo sapiens
atgaagacaaatccgacttg

SEQ ID NO: 7392798 - DNA, 22 bp, Homo sapiens
atgaagacaaactgggtagaaa

SEQ ID NO: 7392799 - DNA, 22 bp, Homo sapiens
atgaagacaaacgacgttgcaa

SEQ ID NO: 7392800 - DNA, 22 bp, Homo sapiens
atgaagaaaaatccagctgtcc

SEQ ID NO: 7392801 - DNA, 22 bp, Homo sapiens
atgaagaaaaatccagctgtcc

SEQ ID NO: 7392802 - DNA, 22 bp, Homo sapiens
atgaagaaaaatccagctgtcc

SEQ ID NO: 7392803 - DNA, 22 bp, Homo sapiens
atgaagaaaaatccagctgtcc

SEQ ID NO: 7392804 - DNA, 22 bp, Homo sapiens
cttctttaatgtatacaaaaga

SEQ ID NO: 7392805 - DNA, 22 bp, Homo sapiens
cttctttaatgtatacaaaaga

SEQ ID NO: 7392806 - DNA, 22 bp, Homo sapiens
cttctttaatgtatacaaaaga

SEQ ID NO: 7392807 - DNA, 22 bp, Homo sapiens
cttctttaatgtatacaaaaga

SEQ ID NO: 7392808 - DNA, 22 bp, Homo sapiens
cttctttaatgtatacaaaaga

SEQ ID NO: 7392809 - DNA, 22 bp, Homo sapiens
cttctttaatgtatacaaaaga

SEQ ID NO: 7392810 - DNA, 22 bp, Homo sapiens
cttctttaatgtatacaaaaga

SEQ ID NO: 7392811 - DNA, 18 bp, Homo sapiens
cttcttgtttgatttggg

SEQ ID NO: 7392812 - DNA, 22 bp, Homo sapiens
cttcttgttttagccctcatac

SEQ ID NO: 7392813 - DNA, 22 bp, Homo sapiens
cttcttgtcaatttgccattgt

SEQ ID NO: 7392814 - DNA, 22 bp, Homo sapiens
cttcttgtcaatttgccattgt

SEQ ID NO: 7392815 - DNA, 22 bp, Homo sapiens
cttcttgtcaatttgccattgt

SEQ ID NO: 7392816 - DNA, 22 bp, Homo sapiens
cttcttgtgcactctctatgta

SEQ ID NO: 7392817 - DNA, 22 bp, Homo sapiens
cttcttgtgcactctctatgta

SEQ ID NO: 7392818 - DNA, 22 bp, Homo sapiens
cttcttgtcagtgatttcttcc

SEQ ID NO: 7392819 - DNA, 22 bp, Homo sapiens
cttcttgtcagtgatttcttcc

SEQ ID NO: 7392820 - DNA, 22 bp, Homo sapiens
cttcttgttttagccctcatac

SEQ ID NO: 7392821 - DNA, 18 bp, Homo sapiens
cttcttgtttgatttggg

SEQ ID NO: 7392822 - DNA, 22 bp, Homo sapiens
cttcttgttgttagggtcctgt

SEQ ID NO: 7392823 - DNA, 22 bp, Homo sapiens
cttcttgttgttagggtcctgt

SEQ ID NO: 7392824 - DNA, 22 bp, Homo sapiens
cttcttgtgctgggccagcttc

SEQ ID NO: 7392825 - DNA, 18 bp, Homo sapiens
cttcttgtttgatttggg

SEQ ID NO: 7392826 - DNA, 22 bp, Homo sapiens
cttcttgtgctgggccagcttc

SEQ ID NO: 7392827 - DNA, 22 bp, Homo sapiens
cttcttgtgcccatacgttaga

SEQ ID NO: 7392828 - DNA, 22 bp, Homo sapiens
cttcttgtgcccatacgttaga

SEQ ID NO: 7392829 - DNA, 22 bp, Homo sapiens
cttcttgtgcccatacgttaga

SEQ ID NO: 7392830 - DNA, 22 bp, Homo sapiens
cttctttaccaagagatagagt

SEQ ID NO: 7392831 - DNA, 22 bp, Homo sapiens
cttctttaccaagagatagagt

SEQ ID NO: 7392832 - DNA, 22 bp, Homo sapiens
cttctttaccaagagatagagt

SEQ ID NO: 7392833 - DNA, 22 bp, Homo sapiens
cttctttaccaagagatagagt

SEQ ID NO: 7392834 - DNA, 22 bp, Homo sapiens
cttctttactttctagaaataa

SEQ ID NO: 7392835 - DNA, 22 bp, Homo sapiens
cttctttactttctagaaataa

SEQ ID NO: 7392836 - DNA, 22 bp, Homo sapiens
cttctttactttctagaaataa

SEQ ID NO: 7392837 - DNA, 22 bp, Homo sapiens
cttctttactttctagaaataa

SEQ ID NO: 7392838 - DNA, 22 bp, Homo sapiens
cttctttaccaagagatagagt

SEQ ID NO: 7392839 - DNA, 22 bp, Homo sapiens
atctggagatcagctggtggca

SEQ ID NO: 7392840 - DNA, 22 bp, Homo sapiens
atctggagagctggcagcccag

SEQ ID NO: 7392841 - DNA, 22 bp, Homo sapiens
atctggagaatgtttgtctccg

SEQ ID NO: 7392842 - DNA, 22 bp, Homo sapiens
atctggagagatcttcacaaaa

SEQ ID NO: 7392843 - DNA, 22 bp, Homo sapiens
cttctttactttctagaaataa

SEQ ID NO: 7392844 - DNA, 22 bp, Homo sapiens
cttctttactttctagaaataa

SEQ ID NO: 7392845 - DNA, 22 bp, Homo sapiens
atctggccctctcagccctgtt

SEQ ID NO: 7392846 - DNA, 22 bp, Homo sapiens
atctggattctagatctagatc

SEQ ID NO: 7392847 - DNA, 22 bp, Homo sapiens
atctggataggttgttttgcat

SEQ ID NO: 7392848 - DNA, 22 bp, Homo sapiens
atctggagtttcagttttctgg

SEQ ID NO: 7392849 - DNA, 23 bp, Homo sapiens
atctggagtgttgagtaggtact

SEQ ID NO: 7392850 - DNA, 22 bp, Homo sapiens
atctggagtgggacacagaaat

SEQ ID NO: 7392851 - DNA, 22 bp, Homo sapiens
atctggagtgggacacagaaat

SEQ ID NO: 7392852 - DNA, 22 bp, Homo sapiens
atctggagtagaaaaatcgctt

SEQ ID NO: 7392853 - DNA, 22 bp, Homo sapiens
atctggaggtcatcgtttgttc

SEQ ID NO: 7392854 - DNA, 22 bp, Homo sapiens
atctggaggctaagtcatttgc

SEQ ID NO: 7392855 - DNA, 22 bp, Homo sapiens
atctggaggcctgtcttatccc

SEQ ID NO: 7392856 - DNA, 22 bp, Homo sapiens
atctggaggcattactctgtct

SEQ ID NO: 7392857 - DNA, 22 bp, Homo sapiens
atctggaggcaaaggggcgtga

SEQ ID NO: 7392858 - DNA, 22 bp, Homo sapiens
atctggaggcaaaggggcgtga

SEQ ID NO: 7392859 - DNA, 22 bp, Homo sapiens
atctggaggattctgggacttg

SEQ ID NO: 7392860 - DNA, 22 bp, Homo sapiens
atctggaggattctgggacttg

SEQ ID NO: 7392861 - DNA, 22 bp, Homo sapiens
atctggagcttgttagatgttt

SEQ ID NO: 7392862 - DNA, 22 bp, Homo sapiens
atctggagcttgttagatgttt

SEQ ID NO: 7392863 - DNA, 22 bp, Homo sapiens
atctggagctctgcacacctgg

SEQ ID NO: 7392864 - DNA, 22 bp, Homo sapiens
atctggagcttaagcttatata

SEQ ID NO: 7392865 - DNA, 22 bp, Homo sapiens
atctggagcagggccacaaggc

SEQ ID NO: 7392866 - DNA, 22 bp, Homo sapiens
atctggagcaagattaagagat

SEQ ID NO: 7392867 - DNA, 22 bp, Homo sapiens
atctggagatttcttttcaata

SEQ ID NO: 7392868 - DNA, 22 bp, Homo sapiens
atctggagatgggtctgtcacc

SEQ ID NO: 7392869 - DNA, 22 bp, Homo sapiens
atctggagatctgaattttgtg

SEQ ID NO: 7392870 - DNA, 22 bp, Homo sapiens
ctttcccacgcagtggatgaga

SEQ ID NO: 7392871 - DNA, 22 bp, Homo sapiens
ctttcccacgcagtggatgaga

SEQ ID NO: 7392872 - DNA, 22 bp, Homo sapiens
ctttccagtttctaagtacagt

SEQ ID NO: 7392873 - DNA, 22 bp, Homo sapiens
ctttcccacgcagtggatgaga

SEQ ID NO: 7392874 - DNA, 22 bp, Homo sapiens
ctttccccagtatatcattgcc

SEQ ID NO: 7392875 - DNA, 22 bp, Homo sapiens
ctttccccaagcaccacagtgc

SEQ ID NO: 7392876 - DNA, 22 bp, Homo sapiens
ctttccccaagcaccacagtgc

SEQ ID NO: 7392877 - DNA, 22 bp, Homo sapiens
ctttcccagagtagttgatgct

SEQ ID NO: 7392878 - DNA, 22 bp, Homo sapiens
ctttcccagagtagttgatgct

SEQ ID NO: 7392879 - DNA, 22 bp, Homo sapiens
ctttcccagagtagttgatgct

SEQ ID NO: 7392880 - DNA, 22 bp, Homo sapiens
ctttccctgcttagaaggattt

SEQ ID NO: 7392881 - DNA, 22 bp, Homo sapiens
ctttccctgcttagaaggattt

SEQ ID NO: 7392882 - DNA, 22 bp, Homo sapiens
ctttcccttagccccattctat

SEQ ID NO: 7392883 - DNA, 22 bp, Homo sapiens
ctttcccttagccccattctat

SEQ ID NO: 7392884 - DNA, 22 bp, Homo sapiens
ctttcccttagccccattctat

SEQ ID NO: 7392885 - DNA, 22 bp, Homo sapiens
ctttcccttagccccattctat

SEQ ID NO: 7392886 - DNA, 22 bp, Homo sapiens
ctttcccttagccccattctat

SEQ ID NO: 7392887 - DNA, 22 bp, Homo sapiens
ctttcctagatggccatctttc

SEQ ID NO: 7392888 - DNA, 22 bp, Homo sapiens
ctttcctagatggccatctttc

SEQ ID NO: 7392889 - DNA, 22 bp, Homo sapiens
ctttcctagtagttacagaatg

SEQ ID NO: 7392890 - DNA, 22 bp, Homo sapiens
atgaaaagttcgatctagaagg

SEQ ID NO: 7392891 - DNA, 22 bp, Homo sapiens
atgaaaagttcgatctagaagg

SEQ ID NO: 7392892 - DNA, 22 bp, Homo sapiens
atgaaaagttcgatctagaagg

SEQ ID NO: 7392893 - DNA, 22 bp, Homo sapiens
atgaaaagttcgatctagaagg

SEQ ID NO: 7392894 - DNA, 22 bp, Homo sapiens
atgaaaagttcgatctagaagg

SEQ ID NO: 7392895 - DNA, 22 bp, Homo sapiens
atgaaaagttcgatctagaagg

SEQ ID NO: 7392896 - DNA, 22 bp, Homo sapiens
ctttcccttagccccattctat

SEQ ID NO: 7392897 - DNA, 22 bp, Homo sapiens
ctttcccttagccccattctat

SEQ ID NO: 7392898 - DNA, 22 bp, Homo sapiens
ctttcccttagccccattctat

SEQ ID NO: 7392899 - DNA, 22 bp, Homo sapiens
ctttcccttagccccattctat

SEQ ID NO: 7392900 - DNA, 22 bp, Homo sapiens
ctttcccttttgccttgcgtgg

SEQ ID NO: 7392901 - DNA, 22 bp, Homo sapiens
ctttcccttttgccttgcgtgg

SEQ ID NO: 7392902 - DNA, 22 bp, Homo sapiens
ctttcctagaaatatatactta

SEQ ID NO: 7392903 - DNA, 22 bp, Homo sapiens
atctggctatttctggtcgggg

SEQ ID NO: 7392904 - DNA, 22 bp, Homo sapiens
atctggctatttctggtcgggg

SEQ ID NO: 7392905 - DNA, 22 bp, Homo sapiens
atctggctcacttagtctagga

SEQ ID NO: 7392906 - DNA, 22 bp, Homo sapiens
atctggctcacctgggtaaata

SEQ ID NO: 7392907 - DNA, 22 bp, Homo sapiens
ctttcaaagaccttggcatggg

SEQ ID NO: 7392908 - DNA, 22 bp, Homo sapiens
ctttcaaagaccttggcatggg

SEQ ID NO: 7392909 - DNA, 22 bp, Homo sapiens
ctttcaaagaccttggcatggg

SEQ ID NO: 7392910 - DNA, 22 bp, Homo sapiens
ctttcaaagagtaggaggtttt

SEQ ID NO: 7392911 - DNA, 22 bp, Homo sapiens
ctttcaaagaccttggcatggg

SEQ ID NO: 7392912 - DNA, 22 bp, Homo sapiens
ctttcaaagagtaggaggtttt

SEQ ID NO: 7392913 - DNA, 22 bp, Homo sapiens
ctttcaaagagtaggaggtttt

SEQ ID NO: 7392914 - DNA, 22 bp, Homo sapiens
ctttcaaagagtaggaggtttt

SEQ ID NO: 7392915 - DNA, 22 bp, Homo sapiens
ctttcaactacatacaggcgat

SEQ ID NO: 7392916 - DNA, 22 bp, Homo sapiens
ctttccagcatttccttgtgaa

SEQ ID NO: 7392917 - DNA, 22 bp, Homo sapiens
ctttccagcatttccttgtgaa

SEQ ID NO: 7392918 - DNA, 22 bp, Homo sapiens
ctttcaagctcgcccccgctct

SEQ ID NO: 7392919 - DNA, 22 bp, Homo sapiens
ctttccagtttctaagtacagt

SEQ ID NO: 7392920 - DNA, 22 bp, Homo sapiens
ctttccagtttctaagtacagt

SEQ ID NO: 7392921 - DNA, 22 bp, Homo sapiens
ctttccagtaccaggaagcgga

SEQ ID NO: 7392922 - DNA, 22 bp, Homo sapiens
ctttccagtaccaggaagcgga

SEQ ID NO: 7392923 - DNA, 22 bp, Homo sapiens
ctttccagtaccaggaagcgga

SEQ ID NO: 7392924 - DNA, 22 bp, Homo sapiens
ctttccaggtctaaaggcaggg

SEQ ID NO: 7392925 - DNA, 22 bp, Homo sapiens
ctttccaggtctaaaggcaggg

SEQ ID NO: 7392926 - DNA, 22 bp, Homo sapiens
ctttccaggtctaaaggcaggg

SEQ ID NO: 7392927 - DNA, 22 bp, Homo sapiens
ctttccaggctgagtttgcttg

SEQ ID NO: 7392928 - DNA, 22 bp, Homo sapiens
ctttccaggctgagtttgcttg

SEQ ID NO: 7392929 - DNA, 19 bp, Homo sapiens
ctttccaggagatgctgag

SEQ ID NO: 7392930 - DNA, 22 bp, Homo sapiens
ctttccaggctgagtttgcttg

SEQ ID NO: 7392931 - DNA, 22 bp, Homo sapiens
ctttccaggctgagtttgcttg

SEQ ID NO: 7392932 - DNA, 19 bp, Homo sapiens
ctttccaggagatgctgag

SEQ ID NO: 7392933 - DNA, 22 bp, Homo sapiens
ctttccaggacttgcatttctg

SEQ ID NO: 7392934 - DNA, 19 bp, Homo sapiens
ctttccaggagatgctgag

SEQ ID NO: 7392935 - DNA, 19 bp, Homo sapiens
ctttccaggagatgctgag

SEQ ID NO: 7392936 - DNA, 19 bp, Homo sapiens
ctttccaggagatgctgag

SEQ ID NO: 7392937 - DNA, 22 bp, Homo sapiens
ctttccaggaatcctcacagcc

SEQ ID NO: 7392938 - DNA, 22 bp, Homo sapiens
ctttccaggacttgcatttctg

SEQ ID NO: 7392939 - DNA, 22 bp, Homo sapiens
ctttccaggacttgcatttctg

SEQ ID NO: 7392940 - DNA, 22 bp, Homo sapiens
ctttccaggaatcctcacagcc

SEQ ID NO: 7392941 - DNA, 22 bp, Homo sapiens
ctttccaggaatcctcacagcc

SEQ ID NO: 7392942 - DNA, 19 bp, Homo sapiens
ctttccagctcgagcaatt

SEQ ID NO: 7392943 - DNA, 22 bp, Homo sapiens
ctttccaggaatcctcacagcc

SEQ ID NO: 7392944 - DNA, 22 bp, Homo sapiens
ctttccaggaatcctcacagcc

SEQ ID NO: 7392945 - DNA, 22 bp, Homo sapiens
atgacagcattcaagacataga

SEQ ID NO: 7392946 - DNA, 22 bp, Homo sapiens
atgacagctctagcacacagta

SEQ ID NO: 7392947 - DNA, 22 bp, Homo sapiens
atgacagcattcaagacataga

SEQ ID NO: 7392948 - DNA, 22 bp, Homo sapiens
atgacagatgctgtggggaggt

SEQ ID NO: 7392949 - DNA, 22 bp, Homo sapiens
atgacagatgctgtggggaggt

SEQ ID NO: 7392950 - DNA, 22 bp, Homo sapiens
atgacaggaataactatgatgg

SEQ ID NO: 7392951 - DNA, 22 bp, Homo sapiens
atgacaggaggcagctgggcag

SEQ ID NO: 7392952 - DNA, 22 bp, Homo sapiens
atgacaggttttgtggattata

SEQ ID NO: 7392953 - DNA, 22 bp, Homo sapiens
atgacaggtgattttatgcttt

SEQ ID NO: 7392954 - DNA, 22 bp, Homo sapiens
atgacagtactggtgacaatac

SEQ ID NO: 7392955 - DNA, 22 bp, Homo sapiens
gaaacatttgttgagtacttgc

SEQ ID NO: 7392956 - DNA, 22 bp, Homo sapiens
gaaacatttgttgagtacttgc

SEQ ID NO: 7392957 - DNA, 22 bp, Homo sapiens
gaaacatttgttgagtacttgc

SEQ ID NO: 7392958 - DNA, 22 bp, Homo sapiens
gaaacatttgttgagtacttgc

SEQ ID NO: 7392959 - DNA, 22 bp, Homo sapiens
gaaacattgtgttctacagatt

SEQ ID NO: 7392960 - DNA, 22 bp, Homo sapiens
gaaacatttgttgagtacttgc

SEQ ID NO: 7392961 - DNA, 22 bp, Homo sapiens
gaaaccacagtacccaggaaaa

SEQ ID NO: 7392962 - DNA, 22 bp, Homo sapiens
gaaacatttgttgagtacttgc

SEQ ID NO: 7392963 - DNA, 22 bp, Homo sapiens
gaaacatttgttgagtacttgc

SEQ ID NO: 7392964 - DNA, 22 bp, Homo sapiens
atgacagatgctgtggggaggt

SEQ ID NO: 7392965 - DNA, 22 bp, Homo sapiens
atgacagatgctgtggggaggt

SEQ ID NO: 7392966 - DNA, 21 bp, Homo sapiens
atgacagatgctgcagatcgt

SEQ ID NO: 7392967 - DNA, 21 bp, Homo sapiens
atgacagatgctgcagatcgt

SEQ ID NO: 7392968 - DNA, 21 bp, Homo sapiens
atgacagatgctgcagatcgt

SEQ ID NO: 7392969 - DNA, 22 bp, Homo sapiens
gaaaccagataagggaggctga

SEQ ID NO: 7392970 - DNA, 22 bp, Homo sapiens
gaaaccacagtacccaggaaaa

SEQ ID NO: 7392971 - DNA, 20 bp, Homo sapiens
gaaaccagaacgcagccctg

SEQ ID NO: 7392972 - DNA, 20 bp, Homo sapiens
gaaaccagaacgcagccctg

SEQ ID NO: 7392973 - DNA, 20 bp, Homo sapiens
gaaaccagaacgcagccctg

SEQ ID NO: 7392974 - DNA, 22 bp, Homo sapiens
gaaagcataactaatatttatt

SEQ ID NO: 7392975 - DNA, 22 bp, Homo sapiens
gaaagcataactaatatttatt

SEQ ID NO: 7392976 - DNA, 22 bp, Homo sapiens
gaaagcataactaatatttatt

SEQ ID NO: 7392977 - DNA, 22 bp, Homo sapiens
gaaagcataactaatatttatt

SEQ ID NO: 7392978 - DNA, 17 bp, Homo sapiens
gaaagcatcacatgctc

SEQ ID NO: 7392979 - DNA, 17 bp, Homo sapiens
gaaagcatcacatgctc

SEQ ID NO: 7392980 - DNA, 22 bp, Homo sapiens
gaaaggttgggtgaatggtgga

SEQ ID NO: 7392981 - DNA, 22 bp, Homo sapiens
gaaaggttgtaacaagactctt

SEQ ID NO: 7392982 - DNA, 22 bp, Homo sapiens
gaaaggtttaagtaggatttgt

SEQ ID NO: 7392983 - DNA, 22 bp, Homo sapiens
gaaaggtttcatctacttttca

SEQ ID NO: 7392984 - DNA, 22 bp, Homo sapiens
atgacatatgattctgaagaca

SEQ ID NO: 7392985 - DNA, 22 bp, Homo sapiens
atgacatgacctggtagagaca

SEQ ID NO: 7392986 - DNA, 22 bp, Homo sapiens
atgacatcactacattattcct

SEQ ID NO: 7392987 - DNA, 22 bp, Homo sapiens
gaaagcagtatttagttctgtt

SEQ ID NO: 7392988 - DNA, 22 bp, Homo sapiens
gaaagcagtatttagttctgtt

SEQ ID NO: 7392989 - DNA, 22 bp, Homo sapiens
atgacagtaggtaaatgatagc

SEQ ID NO: 7392990 - DNA, 22 bp, Homo sapiens
atgacagtaggtaaatgatagc

SEQ ID NO: 7392991 - DNA, 22 bp, Homo sapiens
atgacagtactggtgacaatac

SEQ ID NO: 7392992 - DNA, 22 bp, Homo sapiens
atgacaggaggcagctgggcag

SEQ ID NO: 7392993 - DNA, 22 bp, Homo sapiens
atgacagtgggtcttgcaaaga

SEQ ID NO: 7392994 - DNA, 22 bp, Homo sapiens
atgacagtaggtaaatgatagc

SEQ ID NO: 7392995 - DNA, 22 bp, Homo sapiens
atgacataaagctatgctaggt

SEQ ID NO: 7392996 - DNA, 22 bp, Homo sapiens
atgacagttctttagagatgta

SEQ ID NO: 7392997 - DNA, 22 bp, Homo sapiens
atgacagttctttagagatgta

SEQ ID NO: 7392998 - DNA, 22 bp, Homo sapiens
atgacataaagctatgctaggt

SEQ ID NO: 7392999 - DNA, 22 bp, Homo sapiens
atgacataagtgaaaaacatca

SEQ ID NO: 7393000 - DNA, 22 bp, Homo sapiens
atgacataagtgaaaaacatca

SEQ ID NO: 7393001 - DNA, 22 bp, Homo sapiens
atgacataagtgaaaaacatca

SEQ ID NO: 7393002 - DNA, 22 bp, Homo sapiens
atgacataagtgaaaaacatca

SEQ ID NO: 7393003 - DNA, 22 bp, Homo sapiens
atgacataagtgaaaaacatca

SEQ ID NO: 7393004 - DNA, 22 bp, Homo sapiens
atgacatatgattctgaagaca

SEQ ID NO: 7393005 - DNA, 22 bp, Homo sapiens
atgacatcaacagtggtgctgt

SEQ ID NO: 7393006 - DNA, 22 bp, Homo sapiens
atgacatcaacagtggtgctgt

SEQ ID NO: 7393007 - DNA, 22 bp, Homo sapiens
gaaacattgtgttctacagatt

SEQ ID NO: 7393008 - DNA, 22 bp, Homo sapiens
gaaacattgtgttctacagatt

SEQ ID NO: 7393009 - DNA, 22 bp, Homo sapiens
gaaacattgtgttctacagatt

SEQ ID NO: 7393010 - DNA, 22 bp, Homo sapiens
gaaacattgtgttctacagatt

SEQ ID NO: 7393011 - DNA, 22 bp, Homo sapiens
gaaacattgtgttctacagatt

SEQ ID NO: 7393012 - DNA, 22 bp, Homo sapiens
gaaacattgtgttctacagatt

SEQ ID NO: 7393013 - DNA, 22 bp, Homo sapiens
gaaacattgtgttctacagatt

SEQ ID NO: 7393014 - DNA, 22 bp, Homo sapiens
gaaacattgtgttctacagatt

SEQ ID NO: 7393015 - DNA, 22 bp, Homo sapiens
gaaacattggtctgccccttat

SEQ ID NO: 7393016 - DNA, 22 bp, Homo sapiens
gaaacattgagcagaaggagaa

SEQ ID NO: 7393017 - DNA, 22 bp, Homo sapiens
gaaacattgagcagaaggagaa

SEQ ID NO: 7393018 - DNA, 22 bp, Homo sapiens
gaaacattgagcagaaggagaa

SEQ ID NO: 7393019 - DNA, 22 bp, Homo sapiens
gaaacattgagcagaaggagaa

SEQ ID NO: 7393020 - DNA, 20 bp, Homo sapiens
gaaacattggcagcaactga

SEQ ID NO: 7393021 - DNA, 20 bp, Homo sapiens
gaaacattggcagcaactga

SEQ ID NO: 7393022 - DNA, 20 bp, Homo sapiens
gaaacattggcagcaactga

SEQ ID NO: 7393023 - DNA, 20 bp, Homo sapiens
gaaacattggcagcaactga

SEQ ID NO: 7393024 - DNA, 20 bp, Homo sapiens
gaaacattggcagcaactga

SEQ ID NO: 7393025 - DNA, 22 bp, Homo sapiens
gaaacattcagtcaacagtgtt

SEQ ID NO: 7393026 - DNA, 22 bp, Homo sapiens
gaaacattcagtcaacagtgtt

SEQ ID NO: 7393027 - DNA, 22 bp, Homo sapiens
gaaacattcagtcaacagtgtt

SEQ ID NO: 7393028 - DNA, 22 bp, Homo sapiens
gaaacattcagtcaacagtgtt

SEQ ID NO: 7393029 - DNA, 22 bp, Homo sapiens
gaaacattcatatgagaaacct

SEQ ID NO: 7393030 - DNA, 22 bp, Homo sapiens
gaaacattcatatgagaaacct

SEQ ID NO: 7393031 - DNA, 22 bp, Homo sapiens
gaaacattcatatgagaaacct

SEQ ID NO: 7393032 - DNA, 22 bp, Homo sapiens
gaaacattcatatgagaaacct

SEQ ID NO: 7393033 - DNA, 22 bp, Homo sapiens
gaaacatagttgagacactgct

SEQ ID NO: 7393034 - DNA, 22 bp, Homo sapiens
gaaacatagttgagacactgct

SEQ ID NO: 7393035 - DNA, 22 bp, Homo sapiens
gaaacatagttgagacactgct

SEQ ID NO: 7393036 - DNA, 22 bp, Homo sapiens
gaaacatagttgagacactgct

SEQ ID NO: 7393037 - DNA, 22 bp, Homo sapiens
gaaacatagttgagacactgct

SEQ ID NO: 7393038 - DNA, 22 bp, Homo sapiens
gaaacatattaatccagtgaaa

SEQ ID NO: 7393039 - DNA, 22 bp, Homo sapiens
gaaacatattaatccagtgaaa

SEQ ID NO: 7393040 - DNA, 22 bp, Homo sapiens
gaaacatgtctgacaatttacc

SEQ ID NO: 7393041 - DNA, 22 bp, Homo sapiens
gaaacatgtctgacaatttacc

SEQ ID NO: 7393042 - DNA, 22 bp, Homo sapiens
gaaacatgtctgacaatttacc

SEQ ID NO: 7393043 - DNA, 22 bp, Homo sapiens
gaaacattcagtcaacagtgtt

SEQ ID NO: 7393044 - DNA, 22 bp, Homo sapiens
gaaacattcagtcaacagtgtt

SEQ ID NO: 7393045 - DNA, 22 bp, Homo sapiens
gaaacaggtggcaggctagatt

SEQ ID NO: 7393046 - DNA, 22 bp, Homo sapiens
gaaacaggtggcaggctagatt

SEQ ID NO: 7393047 - DNA, 22 bp, Homo sapiens
gaaacagggagtagtaatttac

SEQ ID NO: 7393048 - DNA, 22 bp, Homo sapiens
gaaacaggccaggttccaggcc

SEQ ID NO: 7393049 - DNA, 22 bp, Homo sapiens
gaaacagtcaactttctttccc

SEQ ID NO: 7393050 - DNA, 22 bp, Homo sapiens
gaaacagtcaactttctttccc

SEQ ID NO: 7393051 - DNA, 22 bp, Homo sapiens
gaaacagtcaactttctttccc

SEQ ID NO: 7393052 - DNA, 22 bp, Homo sapiens
gaaacagtgagaacttttcctg

SEQ ID NO: 7393053 - DNA, 22 bp, Homo sapiens
gaaacagtgagaacttttcctg

SEQ ID NO: 7393054 - DNA, 22 bp, Homo sapiens
gaaacagtgagaacttttcctg

SEQ ID NO: 7393055 - DNA, 22 bp, Homo sapiens
gaaacatacgatttaggagaaa

SEQ ID NO: 7393056 - DNA, 22 bp, Homo sapiens
gaaaatgttagcttcatagtca

SEQ ID NO: 7393057 - DNA, 22 bp, Homo sapiens
gaaaatgttagcttcatagtca

SEQ ID NO: 7393058 - DNA, 22 bp, Homo sapiens
gaaaatgtgtcatccctactgt

SEQ ID NO: 7393059 - DNA, 22 bp, Homo sapiens
ctttctttcgaagacgtgatta

SEQ ID NO: 7393060 - DNA, 22 bp, Homo sapiens
gaaaatgttagcttcatagtca

SEQ ID NO: 7393061 - DNA, 22 bp, Homo sapiens
gaaaatgttagcttcatagtca

SEQ ID NO: 7393062 - DNA, 22 bp, Homo sapiens
gaaaatgttagcttcatagtca

SEQ ID NO: 7393063 - DNA, 22 bp, Homo sapiens
ctttctttcgaagacgtgatta

SEQ ID NO: 7393064 - DNA, 22 bp, Homo sapiens
ctttctttcgaagacgtgatta

SEQ ID NO: 7393065 - DNA, 22 bp, Homo sapiens
ctttctttcgaagacgtgatta

SEQ ID NO: 7393066 - DNA, 22 bp, Homo sapiens
ctttctttcgaagacgtgatta

SEQ ID NO: 7393067 - DNA, 22 bp, Homo sapiens
ctttctttcgaagacgtgatta

SEQ ID NO: 7393068 - DNA, 22 bp, Homo sapiens
ctttctttcgaagacgtgatta

SEQ ID NO: 7393069 - DNA, 22 bp, Homo sapiens
ctttctttcgaagacgtgatta

SEQ ID NO: 7393070 - DNA, 22 bp, Homo sapiens
ctttctttcgaagacgtgatta

SEQ ID NO: 7393071 - DNA, 22 bp, Homo sapiens
ctttctttcgaagacgtgatta

SEQ ID NO: 7393072 - DNA, 22 bp, Homo sapiens
ctttcttggtcctgaagatggc

SEQ ID NO: 7393073 - DNA, 22 bp, Homo sapiens
ctttctttcgaagacgtgatta

SEQ ID NO: 7393074 - DNA, 22 bp, Homo sapiens
ctttcttggtcctgaagatggc

SEQ ID NO: 7393075 - DNA, 22 bp, Homo sapiens
ctttcttcatctgtaatatgga

SEQ ID NO: 7393076 - DNA, 22 bp, Homo sapiens
ctttcttcatcaagtgccacgt

SEQ ID NO: 7393077 - DNA, 22 bp, Homo sapiens
ctttcttcaagctggtctcaat

SEQ ID NO: 7393078 - DNA, 22 bp, Homo sapiens
ctttcttcaacctcattctgca

SEQ ID NO: 7393079 - DNA, 22 bp, Homo sapiens
ctttcttcaacctcattctgca

SEQ ID NO: 7393080 - DNA, 22 bp, Homo sapiens
ctttcttcatctgtaatatgga

SEQ ID NO: 7393081 - DNA, 22 bp, Homo sapiens
ctttcttcatctgtaatatgga

SEQ ID NO: 7393082 - DNA, 22 bp, Homo sapiens
ctttcttctccctcaatattac

SEQ ID NO: 7393083 - DNA, 22 bp, Homo sapiens
ctttcttgcataatttgaaacc

SEQ ID NO: 7393084 - DNA, 22 bp, Homo sapiens
ctttcttctccctcaatattac

SEQ ID NO: 7393085 - DNA, 22 bp, Homo sapiens
ctttcttctccctcaatattac

SEQ ID NO: 7393086 - DNA, 22 bp, Homo sapiens
gaaatacagttgggaggaggta

SEQ ID NO: 7393087 - DNA, 22 bp, Homo sapiens
gaaatacagttgggaggaggta

SEQ ID NO: 7393088 - DNA, 22 bp, Homo sapiens
gaaatacagttgggaggaggta

SEQ ID NO: 7393089 - DNA, 22 bp, Homo sapiens
gaaatactgcacaccctgtaag

SEQ ID NO: 7393090 - DNA, 21 bp, Homo sapiens
gaaatactgccttaggagctg

SEQ ID NO: 7393091 - DNA, 21 bp, Homo sapiens
gaaatactgccttaggagctg

SEQ ID NO: 7393092 - DNA, 22 bp, Homo sapiens
gaaatacgagtttattcattta

SEQ ID NO: 7393093 - DNA, 22 bp, Homo sapiens
gaaatactgcacaccctgtaag

SEQ ID NO: 7393094 - DNA, 21 bp, Homo sapiens
gaaatactgccttaggagctg

SEQ ID NO: 7393095 - DNA, 22 bp, Homo sapiens
gaaatactgtaaagttattatt

SEQ ID NO: 7393096 - DNA, 22 bp, Homo sapiens
gaaatactgtaaagttattatt

SEQ ID NO: 7393097 - DNA, 22 bp, Homo sapiens
gaaatacagttgggaggaggta

SEQ ID NO: 7393098 - DNA, 22 bp, Homo sapiens
gaaatacagttgggaggaggta

SEQ ID NO: 7393099 - DNA, 22 bp, Homo sapiens
gaaatacagttgggaggaggta

SEQ ID NO: 7393100 - DNA, 22 bp, Homo sapiens
gaaatacagttgggaggaggta

SEQ ID NO: 7393101 - DNA, 22 bp, Homo sapiens
gaaatacaggaatgccacacag

SEQ ID NO: 7393102 - DNA, 22 bp, Homo sapiens
gaaatacaggaatgccacacag

SEQ ID NO: 7393103 - DNA, 22 bp, Homo sapiens
gaaagtgcagtcagacaaggca

SEQ ID NO: 7393104 - DNA, 22 bp, Homo sapiens
gaaagtgcagtcagacaaggca

SEQ ID NO: 7393105 - DNA, 22 bp, Homo sapiens
gaaagtgcagtcagacaaggca

SEQ ID NO: 7393106 - DNA, 22 bp, Homo sapiens
gaaagtcatggatgaacactac

SEQ ID NO: 7393107 - DNA, 22 bp, Homo sapiens
gaaagtcatggatgaacactac

SEQ ID NO: 7393108 - DNA, 22 bp, Homo sapiens
gaaagtgcagtcagacaaggca

SEQ ID NO: 7393109 - DNA, 22 bp, Homo sapiens
gaaatagacactttctatgaat

SEQ ID NO: 7393110 - DNA, 22 bp, Homo sapiens
gaaatagacactttctatgaat

SEQ ID NO: 7393111 - DNA, 22 bp, Homo sapiens
gaaatagacactttctatgaat

SEQ ID NO: 7393112 - DNA, 22 bp, Homo sapiens
gaaatagacactttctatgaat

SEQ ID NO: 7393113 - DNA, 22 bp, Homo sapiens
gaaatagacactttctatgaat

SEQ ID NO: 7393114 - DNA, 22 bp, Homo sapiens
gaaatagacactttctatgaat

SEQ ID NO: 7393115 - DNA, 22 bp, Homo sapiens
gaaatagacactttctatgaat

SEQ ID NO: 7393116 - DNA, 22 bp, Homo sapiens
gaaatagacactttctatgaat

SEQ ID NO: 7393117 - DNA, 22 bp, Homo sapiens
gaaatagacactttctatgaat

SEQ ID NO: 7393118 - DNA, 22 bp, Homo sapiens
gaaatagaagctgccaatttct

SEQ ID NO: 7393119 - DNA, 22 bp, Homo sapiens
gaaatagaagctgccaatttct

SEQ ID NO: 7393120 - DNA, 20 bp, Homo sapiens
gaaatacttacccaactgtt

SEQ ID NO: 7393121 - DNA, 22 bp, Homo sapiens
gaaatagaagctgccaatttct

SEQ ID NO: 7393122 - DNA, 22 bp, Homo sapiens
gaaatactgtaaagttattatt

SEQ ID NO: 7393123 - DNA, 22 bp, Homo sapiens
gaaatactgtaaagttattatt

SEQ ID NO: 7393124 - DNA, 22 bp, Homo sapiens
gaaatactgtaaagttattatt

SEQ ID NO: 7393125 - DNA, 20 bp, Homo sapiens
gaaatacttacccaactgtt

SEQ ID NO: 7393126 - DNA, 22 bp, Homo sapiens
gaaagtatttaagtccatattt

SEQ ID NO: 7393127 - DNA, 22 bp, Homo sapiens
gaaagtatttaagtccatattt

SEQ ID NO: 7393128 - DNA, 22 bp, Homo sapiens
gaaagtatttacattaacatct

SEQ ID NO: 7393129 - DNA, 22 bp, Homo sapiens
gaaagtatttacattaacatct

SEQ ID NO: 7393130 - DNA, 22 bp, Homo sapiens
gaaagtattctccctgaatttt

SEQ ID NO: 7393131 - DNA, 22 bp, Homo sapiens
gaaagtattctccctgaatttt

SEQ ID NO: 7393132 - DNA, 22 bp, Homo sapiens
gaaagtatttaagtccatattt

SEQ ID NO: 7393133 - DNA, 22 bp, Homo sapiens
gaaagtatttaagtccatattt

SEQ ID NO: 7393134 - DNA, 22 bp, Homo sapiens
gaaagtatttaagtccatattt

SEQ ID NO: 7393135 - DNA, 22 bp, Homo sapiens
gaaagtatttaagtccatattt

SEQ ID NO: 7393136 - DNA, 19 bp, Homo sapiens
gaaagtcatagagcttgtc

SEQ ID NO: 7393137 - DNA, 19 bp, Homo sapiens
gaaagtcatagagcttgtc

SEQ ID NO: 7393138 - DNA, 23 bp, Homo sapiens
gaaagtcaatatggtagctttga

SEQ ID NO: 7393139 - DNA, 22 bp, Homo sapiens
gaaagtcatggatgaacactac

SEQ ID NO: 7393140 - DNA, 19 bp, Homo sapiens
gaaagtcatagagcttgtc

SEQ ID NO: 7393141 - DNA, 23 bp, Homo sapiens
gaaagtcaatatggtagctttga

SEQ ID NO: 7393142 - DNA, 22 bp, Homo sapiens
gaaagtatttacattaacatct

SEQ ID NO: 7393143 - DNA, 22 bp, Homo sapiens
gaaagtatttacattaacatct

SEQ ID NO: 7393144 - DNA, 22 bp, Homo sapiens
gaaagtatttacattaacatct

SEQ ID NO: 7393145 - DNA, 22 bp, Homo sapiens
gaaagtatttacattaacatct

SEQ ID NO: 7393146 - DNA, 22 bp, Homo sapiens
gaaagtatttacattaacatct

SEQ ID NO: 7393147 - DNA, 22 bp, Homo sapiens
gaaagtaacatttcttgaatta

SEQ ID NO: 7393148 - DNA, 22 bp, Homo sapiens
gaaaggtttggcttttcagtag

SEQ ID NO: 7393149 - DNA, 22 bp, Homo sapiens
gaaaggtttcatctacttttca

SEQ ID NO: 7393150 - DNA, 22 bp, Homo sapiens
gaaagtatgccatctacctctt

SEQ ID NO: 7393151 - DNA, 22 bp, Homo sapiens
gaaagtatgccatctacctctt

SEQ ID NO: 7393152 - DNA, 22 bp, Homo sapiens
gaaagtatgccatctacctctt

SEQ ID NO: 7393153 - DNA, 22 bp, Homo sapiens
gaaagtaacatttcttgaatta

SEQ ID NO: 7393154 - DNA, 22 bp, Homo sapiens
gaaagtaacatttcttgaatta

SEQ ID NO: 7393155 - DNA, 22 bp, Homo sapiens
gaaagtattcacaaagttcttg

SEQ ID NO: 7393156 - DNA, 22 bp, Homo sapiens
gaaagtattctccctgaatttt

SEQ ID NO: 7393157 - DNA, 22 bp, Homo sapiens
gaaagtatgccatctacctctt

SEQ ID NO: 7393158 - DNA, 22 bp, Homo sapiens
gaaagtattcacaaagttcttg

SEQ ID NO: 7393159 - DNA, 22 bp, Homo sapiens
gaaagtattcacaaagttcttg

SEQ ID NO: 7393160 - DNA, 22 bp, Homo sapiens
gaaagtattcacaaagttcttg

SEQ ID NO: 7393161 - DNA, 22 bp, Homo sapiens
gaaagtattagcctagaagtca

SEQ ID NO: 7393162 - DNA, 22 bp, Homo sapiens
gaaagtattagcctagaagtca

SEQ ID NO: 7393163 - DNA, 22 bp, Homo sapiens
gaaagtattagcctagaagtca

SEQ ID NO: 7393164 - DNA, 22 bp, Homo sapiens
gaaagtattagcctagaagtca

SEQ ID NO: 7393165 - DNA, 22 bp, Homo sapiens
gaaagtattagcctagaagtca

SEQ ID NO: 7393166 - DNA, 22 bp, Homo sapiens
gaaatttattatctacatcatt

SEQ ID NO: 7393167 - DNA, 22 bp, Homo sapiens
atgatggaaaaagatcagtcaa

SEQ ID NO: 7393168 - DNA, 22 bp, Homo sapiens
gaaatttattatctacatcatt

SEQ ID NO: 7393169 - DNA, 19 bp, Homo sapiens
atgatgcagagctgactca

SEQ ID NO: 7393170 - DNA, 19 bp, Homo sapiens
atgatgcagagctgactca

SEQ ID NO: 7393171 - DNA, 22 bp, Homo sapiens
atgatgcaccattataagagtt

SEQ ID NO: 7393172 - DNA, 22 bp, Homo sapiens
atgatgcataatttatacatgc

SEQ ID NO: 7393173 - DNA, 22 bp, Homo sapiens
atgatgcataatttatacatgc

SEQ ID NO: 7393174 - DNA, 22 bp, Homo sapiens
atgatgaaattttctatcatgt

SEQ ID NO: 7393175 - DNA, 22 bp, Homo sapiens
atgatgaattttaaaagcacca

SEQ ID NO: 7393176 - DNA, 22 bp, Homo sapiens
atgatgaaattttctatcatgt

SEQ ID NO: 7393177 - DNA, 22 bp, Homo sapiens
atgatcagggcagaagcagaag

SEQ ID NO: 7393178 - DNA, 22 bp, Homo sapiens
atgatcatacagagccctggta

SEQ ID NO: 7393179 - DNA, 22 bp, Homo sapiens
atgatcagggcagaagcagaag

SEQ ID NO: 7393180 - DNA, 22 bp, Homo sapiens
atgatcaagaattttgtattcc

SEQ ID NO: 7393181 - DNA, 22 bp, Homo sapiens
atgatcatggaagtgcacccat

SEQ ID NO: 7393182 - DNA, 22 bp, Homo sapiens
atgatccaaagccacaggggca

SEQ ID NO: 7393183 - DNA, 22 bp, Homo sapiens
atgatccaaagccacaggggca

SEQ ID NO: 7393184 - DNA, 22 bp, Homo sapiens
atgatccaaagccacaggggca

SEQ ID NO: 7393185 - DNA, 22 bp, Homo sapiens
atgatccaaagccacaggggca

SEQ ID NO: 7393186 - DNA, 22 bp, Homo sapiens
atgatctcattctttcaaaggg

SEQ ID NO: 7393187 - DNA, 19 bp, Homo sapiens
atgatctgcccttgtaata

SEQ ID NO: 7393188 - DNA, 22 bp, Homo sapiens
atgatctgataatcatccacta

SEQ ID NO: 7393189 - DNA, 22 bp, Homo sapiens
atgatctcattctttcaaaggg

SEQ ID NO: 7393190 - DNA, 18 bp, Homo sapiens
atgatcttagcaaatatt

SEQ ID NO: 7393191 - DNA, 22 bp, Homo sapiens
atgatgaaactaggaactagag

SEQ ID NO: 7393192 - DNA, 22 bp, Homo sapiens
atgatgaaactaggaactagag

SEQ ID NO: 7393193 - DNA, 22 bp, Homo sapiens
atgatgaaaactgaaggttagg

SEQ ID NO: 7393194 - DNA, 22 bp, Homo sapiens
atgatcaagaattttgtattcc

SEQ ID NO: 7393195 - DNA, 22 bp, Homo sapiens
atgatattttagtaaagtgata

SEQ ID NO: 7393196 - DNA, 22 bp, Homo sapiens
atgatcagcagttttcagtgtt

SEQ ID NO: 7393197 - DNA, 22 bp, Homo sapiens
atgatcagcagttttcagtgtt

SEQ ID NO: 7393198 - DNA, 22 bp, Homo sapiens
atgatatttgcaatgtgcttgc

SEQ ID NO: 7393199 - DNA, 22 bp, Homo sapiens
atgatattttagtaaagtgata

SEQ ID NO: 7393200 - DNA, 22 bp, Homo sapiens
atgatattttagtaaagtgata

SEQ ID NO: 7393201 - DNA, 22 bp, Homo sapiens
atgatatttgcaatgtgcttgc

SEQ ID NO: 7393202 - DNA, 22 bp, Homo sapiens
atgatatttgcaatgtgcttgc

SEQ ID NO: 7393203 - DNA, 22 bp, Homo sapiens
atgatattattctagcccagag

SEQ ID NO: 7393204 - DNA, 21 bp, Homo sapiens
atgatatgcttgtatttccaa

SEQ ID NO: 7393205 - DNA, 21 bp, Homo sapiens
atgatatgcttgtatttccaa

SEQ ID NO: 7393206 - DNA, 22 bp, Homo sapiens
gaaatagaggacagctggatca

SEQ ID NO: 7393207 - DNA, 22 bp, Homo sapiens
gaaatagaggacagctggatca

SEQ ID NO: 7393208 - DNA, 22 bp, Homo sapiens
gaaatagaggacagctggatca

SEQ ID NO: 7393209 - DNA, 22 bp, Homo sapiens
gaaatagaggacagctggatca

SEQ ID NO: 7393210 - DNA, 22 bp, Homo sapiens
gaaatagaggacagctggatca

SEQ ID NO: 7393211 - DNA, 22 bp, Homo sapiens
gaaatagaggacagctggatca

SEQ ID NO: 7393212 - DNA, 22 bp, Homo sapiens
gaaatagatctctgggatgcaa

SEQ ID NO: 7393213 - DNA, 22 bp, Homo sapiens
gaaatagatctctgggatgcaa

SEQ ID NO: 7393214 - DNA, 22 bp, Homo sapiens
gaaatagtacagcatagttctt

SEQ ID NO: 7393215 - DNA, 22 bp, Homo sapiens
gaaatagtacagcatagttctt

SEQ ID NO: 7393216 - DNA, 22 bp, Homo sapiens
gaaatagtacagcatagttctt

SEQ ID NO: 7393217 - DNA, 22 bp, Homo sapiens
gaaatagatctctgggatgcaa

SEQ ID NO: 7393218 - DNA, 19 bp, Homo sapiens
atgatacaggtgaaaattg

SEQ ID NO: 7393219 - DNA, 22 bp, Homo sapiens
gaaatatacatgaagtcggctg

SEQ ID NO: 7393220 - DNA, 22 bp, Homo sapiens
gaaatatacatgaagtcggctg

SEQ ID NO: 7393221 - DNA, 22 bp, Homo sapiens
gaaatatacatgaagtcggctg

SEQ ID NO: 7393222 - DNA, 22 bp, Homo sapiens
gaaatagtacagcatagttctt

SEQ ID NO: 7393223 - DNA, 22 bp, Homo sapiens
gaaatatacatgaagtcggctg

SEQ ID NO: 7393224 - DNA, 19 bp, Homo sapiens
atgatacaggtgaaaattg

SEQ ID NO: 7393225 - DNA, 19 bp, Homo sapiens
atgatacaggtgaaaattg

SEQ ID NO: 7393226 - DNA, 19 bp, Homo sapiens
atgatacaggtgaaaattg

SEQ ID NO: 7393227 - DNA, 19 bp, Homo sapiens
atgatacaggtgaaaattg

SEQ ID NO: 7393228 - DNA, 19 bp, Homo sapiens
atgatacaggtgaaaattg

SEQ ID NO: 7393229 - DNA, 22 bp, Homo sapiens
gaacaaattggagaaatcagga

SEQ ID NO: 7393230 - DNA, 22 bp, Homo sapiens
gaacaaattggagaaatcagga

SEQ ID NO: 7393231 - DNA, 22 bp, Homo sapiens
gaacaaattggagaaatcagga

SEQ ID NO: 7393232 - DNA, 22 bp, Homo sapiens
gaacaaattggagaaatcagga

SEQ ID NO: 7393233 - DNA, 22 bp, Homo sapiens
gaacaaattggagaaatcagga

SEQ ID NO: 7393234 - DNA, 22 bp, Homo sapiens
gaacaactttgaaacatgaaga

SEQ ID NO: 7393235 - DNA, 22 bp, Homo sapiens
gaacaactttgaaacatgaaga

SEQ ID NO: 7393236 - DNA, 22 bp, Homo sapiens
gaacaactttgaaacatgaaga

SEQ ID NO: 7393237 - DNA, 22 bp, Homo sapiens
gaacaactcttcttgagagatg

SEQ ID NO: 7393238 - DNA, 22 bp, Homo sapiens
gaacaactccaagggacatcat

SEQ ID NO: 7393239 - DNA, 22 bp, Homo sapiens
gaacaaattggagaaatcagga

SEQ ID NO: 7393240 - DNA, 22 bp, Homo sapiens
gaacaaattggagaaatcagga

SEQ ID NO: 7393241 - DNA, 22 bp, Homo sapiens
gaacaaattggagaaatcagga

SEQ ID NO: 7393242 - DNA, 22 bp, Homo sapiens
gaacaaattggagaaatcagga

SEQ ID NO: 7393243 - DNA, 22 bp, Homo sapiens
gaacaaattggagaaatcagga

SEQ ID NO: 7393244 - DNA, 22 bp, Homo sapiens
gaacaaattctcatcaacttgt

SEQ ID NO: 7393245 - DNA, 22 bp, Homo sapiens
gaacaaattctcatcaacttgt

SEQ ID NO: 7393246 - DNA, 22 bp, Homo sapiens
gaacaaatcccttcctgtctcc

SEQ ID NO: 7393247 - DNA, 22 bp, Homo sapiens
gaacaaatcccttcctgtctcc

SEQ ID NO: 7393248 - DNA, 22 bp, Homo sapiens
gaacaaatcccttcctgtctcc

SEQ ID NO: 7393249 - DNA, 22 bp, Homo sapiens
gaacaaatcccttcctgtctcc

SEQ ID NO: 7393250 - DNA, 22 bp, Homo sapiens
gaacaaattctcatcaacttgt

SEQ ID NO: 7393251 - DNA, 22 bp, Homo sapiens
gaacaaattctcatcaacttgt

SEQ ID NO: 7393252 - DNA, 22 bp, Homo sapiens
gaacaaattctcatcaacttgt

SEQ ID NO: 7393253 - DNA, 22 bp, Homo sapiens
gaacaaactgggtcccaatgat

SEQ ID NO: 7393254 - DNA, 22 bp, Homo sapiens
gaacaaactgggtcccaatgat

SEQ ID NO: 7393255 - DNA, 22 bp, Homo sapiens
gaacaaactgggtcccaatgat

SEQ ID NO: 7393256 - DNA, 22 bp, Homo sapiens
gaacaaacatttttggcagtat

SEQ ID NO: 7393257 - DNA, 22 bp, Homo sapiens
gaacaaactgggtcccaatgat

SEQ ID NO: 7393258 - DNA, 19 bp, Homo sapiens
gaacaaacttaaacttttc

SEQ ID NO: 7393259 - DNA, 22 bp, Homo sapiens
gaacaaagacatggaggaggat

SEQ ID NO: 7393260 - DNA, 19 bp, Homo sapiens
gaacaaacttaaacttttc

SEQ ID NO: 7393261 - DNA, 19 bp, Homo sapiens
gaacaaacttaaacttttc

SEQ ID NO: 7393262 - DNA, 19 bp, Homo sapiens
gaacaaacttaaacttttc

SEQ ID NO: 7393263 - DNA, 22 bp, Homo sapiens
gaacaaacagtcaggacagtct

SEQ ID NO: 7393264 - DNA, 22 bp, Homo sapiens
gaacaaacagtcaggacagtct

SEQ ID NO: 7393265 - DNA, 22 bp, Homo sapiens
gaacaaacagtcaggacagtct

SEQ ID NO: 7393266 - DNA, 22 bp, Homo sapiens
gaacaaacagaagaggcggaac

SEQ ID NO: 7393267 - DNA, 22 bp, Homo sapiens
gaacaaacacatcccagcagtg

SEQ ID NO: 7393268 - DNA, 22 bp, Homo sapiens
gaacaaacacatcccagcagtg

SEQ ID NO: 7393269 - DNA, 22 bp, Homo sapiens
gaacaaacacatcccagcagtg

SEQ ID NO: 7393270 - DNA, 22 bp, Homo sapiens
gaacaaacacatcccagcagtg

SEQ ID NO: 7393271 - DNA, 22 bp, Homo sapiens
gaaatttattatctacatcatt

SEQ ID NO: 7393272 - DNA, 22 bp, Homo sapiens
gaacaaacacatcccagcagtg

SEQ ID NO: 7393273 - DNA, 22 bp, Homo sapiens
gaaggctggaaggcaagtagga

SEQ ID NO: 7393274 - DNA, 22 bp, Homo sapiens
gaaggctggaaggcaagtagga

SEQ ID NO: 7393275 - DNA, 22 bp, Homo sapiens
gaaggctggaaggcaagtagga

SEQ ID NO: 7393276 - DNA, 22 bp, Homo sapiens
gaaggctggaaggcaagtagga

SEQ ID NO: 7393277 - DNA, 22 bp, Homo sapiens
gaaggctggaaggcaagtagga

SEQ ID NO: 7393278 - DNA, 22 bp, Homo sapiens
gaaggctggaaggcaagtagga

SEQ ID NO: 7393279 - DNA, 22 bp, Homo sapiens
gaaggctgctgggaagtgtggt

SEQ ID NO: 7393280 - DNA, 22 bp, Homo sapiens
gaaggctggaaggcaagtagga

SEQ ID NO: 7393281 - DNA, 22 bp, Homo sapiens
gaaggctgctgggaagtgtggt

SEQ ID NO: 7393282 - DNA, 22 bp, Homo sapiens
gaaggctgctgggaagtgtggt

SEQ ID NO: 7393283 - DNA, 22 bp, Homo sapiens
gaaggctgctgggaagtgtggt

SEQ ID NO: 7393284 - DNA, 22 bp, Homo sapiens
gaaggctgctgggaagtgtggt

SEQ ID NO: 7393285 - DNA, 22 bp, Homo sapiens
gaaggctggctttctgagagca

SEQ ID NO: 7393286 - DNA, 22 bp, Homo sapiens
gaaggctggctttctgagagca

SEQ ID NO: 7393287 - DNA, 22 bp, Homo sapiens
gaaggctggggcatcagtgaaa

SEQ ID NO: 7393288 - DNA, 22 bp, Homo sapiens
gaaggctggctttctgagagca

SEQ ID NO: 7393289 - DNA, 22 bp, Homo sapiens
gaaggctggctttctgagagca

SEQ ID NO: 7393290 - DNA, 22 bp, Homo sapiens
gaaggctggctttctgagagca

SEQ ID NO: 7393291 - DNA, 22 bp, Homo sapiens
gaaggctggctttctgagagca

SEQ ID NO: 7393292 - DNA, 22 bp, Homo sapiens
gaaggctggctttctgagagca

SEQ ID NO: 7393293 - DNA, 22 bp, Homo sapiens
gaaggctggctcagctttccag

SEQ ID NO: 7393294 - DNA, 22 bp, Homo sapiens
gaaggctggaaggcaagtagga

SEQ ID NO: 7393295 - DNA, 22 bp, Homo sapiens
gaaggctggccattccccattc

SEQ ID NO: 7393296 - DNA, 22 bp, Homo sapiens
gaacaatacaggctttattcct

SEQ ID NO: 7393297 - DNA, 22 bp, Homo sapiens
gaacaatagtggtaacaaagcc

SEQ ID NO: 7393298 - DNA, 22 bp, Homo sapiens
gaacaatgaaagacataaactc

SEQ ID NO: 7393299 - DNA, 22 bp, Homo sapiens
gaacaatagtggtaacaaagcc

SEQ ID NO: 7393300 - DNA, 22 bp, Homo sapiens
gaacaatacaggctttattcct

SEQ ID NO: 7393301 - DNA, 22 bp, Homo sapiens
gaacaatacaggctttattcct

SEQ ID NO: 7393302 - DNA, 22 bp, Homo sapiens
gaacaagtttccaaattataac

SEQ ID NO: 7393303 - DNA, 22 bp, Homo sapiens
gaacaaggattcccaaagaaga

SEQ ID NO: 7393304 - DNA, 22 bp, Homo sapiens
gaaggcaagatctcagtggagg

SEQ ID NO: 7393305 - DNA, 22 bp, Homo sapiens
gaaggcaagatctcagtggagg

SEQ ID NO: 7393306 - DNA, 22 bp, Homo sapiens
gaaggcaacaccaggatgcact

SEQ ID NO: 7393307 - DNA, 22 bp, Homo sapiens
gaaggcaagctttggatatgag

SEQ ID NO: 7393308 - DNA, 22 bp, Homo sapiens
gaaggcaagcagcataaatgtc

SEQ ID NO: 7393309 - DNA, 22 bp, Homo sapiens
gaaggctgctgggaagtgtggt

SEQ ID NO: 7393310 - DNA, 22 bp, Homo sapiens
gaaggcaagcagcataaatgtc

SEQ ID NO: 7393311 - DNA, 22 bp, Homo sapiens
gaaggcaagcagcataaatgtc

SEQ ID NO: 7393312 - DNA, 22 bp, Homo sapiens
atgcacaatgttttgatttgag

SEQ ID NO: 7393313 - DNA, 22 bp, Homo sapiens
atgcacaatgttttgatttgag

SEQ ID NO: 7393314 - DNA, 22 bp, Homo sapiens
atgcacaagttatatgtatgga

SEQ ID NO: 7393315 - DNA, 22 bp, Homo sapiens
atgcacaatgttttgatttgag

SEQ ID NO: 7393316 - DNA, 22 bp, Homo sapiens
atgcacaattaggatatagctt

SEQ ID NO: 7393317 - DNA, 22 bp, Homo sapiens
atgcacaattaggatatagctt

SEQ ID NO: 7393318 - DNA, 22 bp, Homo sapiens
atgcacaattaggatatagctt

SEQ ID NO: 7393319 - DNA, 22 bp, Homo sapiens
gaaggcttattttctttgtaaa

SEQ ID NO: 7393320 - DNA, 22 bp, Homo sapiens
gaaggcttattttctttgtaaa

SEQ ID NO: 7393321 - DNA, 22 bp, Homo sapiens
gaaggcttattttctttgtaaa

SEQ ID NO: 7393322 - DNA, 22 bp, Homo sapiens
atgcacaaggtagattattatt

SEQ ID NO: 7393323 - DNA, 22 bp, Homo sapiens
atgcacaaggtagattattatt

SEQ ID NO: 7393324 - DNA, 22 bp, Homo sapiens
atgcacaagttatatgtatgga

SEQ ID NO: 7393325 - DNA, 22 bp, Homo sapiens
gaaggctgtttctggtagtgat

SEQ ID NO: 7393326 - DNA, 16 bp, Homo sapiens
gaaggcttactgcagg

SEQ ID NO: 7393327 - DNA, 16 bp, Homo sapiens
gaaggcttactgcagg

SEQ ID NO: 7393328 - DNA, 22 bp, Homo sapiens
gaaggcttatgtgtgactttcg

SEQ ID NO: 7393329 - DNA, 22 bp, Homo sapiens
gaaggcttatgtgtgactttcg

SEQ ID NO: 7393330 - DNA, 22 bp, Homo sapiens
gaaggcttagaaacaagggagc

SEQ ID NO: 7393331 - DNA, 22 bp, Homo sapiens
gaaggcttagaaacaagggagc

SEQ ID NO: 7393332 - DNA, 22 bp, Homo sapiens
gaaggctgtttctggtagtgat

SEQ ID NO: 7393333 - DNA, 22 bp, Homo sapiens
gaaggctgtggctggtctcagt

SEQ ID NO: 7393334 - DNA, 22 bp, Homo sapiens
gaaggctgtttctggtagtgat

SEQ ID NO: 7393335 - DNA, 22 bp, Homo sapiens
gaaggctgtttctggtagtgat

SEQ ID NO: 7393336 - DNA, 22 bp, Homo sapiens
gaaggctgtggctggtctcagt

SEQ ID NO: 7393337 - DNA, 22 bp, Homo sapiens
gaaggctgtggctggtctcagt

SEQ ID NO: 7393338 - DNA, 22 bp, Homo sapiens
gaaggctgtcagagaggagggc

SEQ ID NO: 7393339 - DNA, 22 bp, Homo sapiens
gaaggctgtggctggtctcagt

SEQ ID NO: 7393340 - DNA, 22 bp, Homo sapiens
gaaggctgtcagagaggagggc

SEQ ID NO: 7393341 - DNA, 22 bp, Homo sapiens
gaaggctgtcagagaggagggc

SEQ ID NO: 7393342 - DNA, 22 bp, Homo sapiens
gaaggctgtaggcaaagtagga

SEQ ID NO: 7393343 - DNA, 22 bp, Homo sapiens
gaaggctggggccttctcatct

SEQ ID NO: 7393344 - DNA, 22 bp, Homo sapiens
gaaggctggggccttctcatct

SEQ ID NO: 7393345 - DNA, 22 bp, Homo sapiens
gaaggctggggccttctcatct

SEQ ID NO: 7393346 - DNA, 22 bp, Homo sapiens
gaaggctggggcatcagtgaaa

SEQ ID NO: 7393347 - DNA, 22 bp, Homo sapiens
gaaggctggggcatcagtgaaa

SEQ ID NO: 7393348 - DNA, 16 bp, Homo sapiens
gaaggctgggtgatcc

SEQ ID NO: 7393349 - DNA, 22 bp, Homo sapiens
gaaggctgtaggcaaagtagga

SEQ ID NO: 7393350 - DNA, 22 bp, Homo sapiens
gaaggctgtaggcaaagtagga

SEQ ID NO: 7393351 - DNA, 22 bp, Homo sapiens
gaaggctgtcagagaggagggc

SEQ ID NO: 7393352 - DNA, 22 bp, Homo sapiens
gaaggctgtcagagaggagggc

SEQ ID NO: 7393353 - DNA, 22 bp, Homo sapiens
gaaggctgtcagagaggagggc

SEQ ID NO: 7393354 - DNA, 22 bp, Homo sapiens
gaaggctgtcagagaggagggc

SEQ ID NO: 7393355 - DNA, 22 bp, Homo sapiens
atgcacagacccaaaggccatc

SEQ ID NO: 7393356 - DNA, 22 bp, Homo sapiens
atgcacagatccccaggaccct

SEQ ID NO: 7393357 - DNA, 22 bp, Homo sapiens
atgcacagacccaaaggccatc

SEQ ID NO: 7393358 - DNA, 22 bp, Homo sapiens
atgcacagacccaaaggccatc

SEQ ID NO: 7393359 - DNA, 22 bp, Homo sapiens
atgcacagatcctggcacttag

SEQ ID NO: 7393360 - DNA, 22 bp, Homo sapiens
atgcacagatccccaggaccct

SEQ ID NO: 7393361 - DNA, 22 bp, Homo sapiens
atgcacagcagtgagttcagtg

SEQ ID NO: 7393362 - DNA, 22 bp, Homo sapiens
atgcacagcagtgagttcagtg

SEQ ID NO: 7393363 - DNA, 22 bp, Homo sapiens
atgcacaggacagcctctactc

SEQ ID NO: 7393364 - DNA, 22 bp, Homo sapiens
atgcacagcagtgagttcagtg

SEQ ID NO: 7393365 - DNA, 22 bp, Homo sapiens
atgcacagctgaacactctaaa

SEQ ID NO: 7393366 - DNA, 22 bp, Homo sapiens
atgcacagcagtgagttcagtg

SEQ ID NO: 7393367 - DNA, 22 bp, Homo sapiens
atgcacagctgaacactctaaa

SEQ ID NO: 7393368 - DNA, 22 bp, Homo sapiens
atgcacagctgaacactctaaa

SEQ ID NO: 7393369 - DNA, 22 bp, Homo sapiens
atgcacagctgaacactctaaa

SEQ ID NO: 7393370 - DNA, 22 bp, Homo sapiens
atgcacacacattatgtctgtg

SEQ ID NO: 7393371 - DNA, 22 bp, Homo sapiens
atgcacacacattatgtctgtg

SEQ ID NO: 7393372 - DNA, 22 bp, Homo sapiens
atgcacaattaggatatagctt

SEQ ID NO: 7393373 - DNA, 22 bp, Homo sapiens
atgcacaattaggatatagctt

SEQ ID NO: 7393374 - DNA, 22 bp, Homo sapiens
atgcacacaagcttatgtatta

SEQ ID NO: 7393375 - DNA, 22 bp, Homo sapiens
atgcacacaagcttatgtatta

SEQ ID NO: 7393376 - DNA, 22 bp, Homo sapiens
atgcacacaagcttatgtatta

SEQ ID NO: 7393377 - DNA, 22 bp, Homo sapiens
atgcacacacattatgtctgtg

SEQ ID NO: 7393378 - DNA, 22 bp, Homo sapiens
atgcacacacattatgtctgtg

SEQ ID NO: 7393379 - DNA, 22 bp, Homo sapiens
atgcacacacattatgtctgtg

SEQ ID NO: 7393380 - DNA, 19 bp, Homo sapiens
atgcacacattgaagagga

SEQ ID NO: 7393381 - DNA, 19 bp, Homo sapiens
atgcacacattgaagagga

SEQ ID NO: 7393382 - DNA, 22 bp, Homo sapiens
atgcacacgtaccctacaaggc

SEQ ID NO: 7393383 - DNA, 22 bp, Homo sapiens
atgcacagaacaattttaagag

SEQ ID NO: 7393384 - DNA, 22 bp, Homo sapiens
atgcacagaacaattttaagag

SEQ ID NO: 7393385 - DNA, 22 bp, Homo sapiens
atgcacagaaaaattgcttact

SEQ ID NO: 7393386 - DNA, 22 bp, Homo sapiens
atgcacacgtaccctacaaggc

SEQ ID NO: 7393387 - DNA, 22 bp, Homo sapiens
atgcacacgtaccctacaaggc

SEQ ID NO: 7393388 - DNA, 22 bp, Homo sapiens
atgcacactgaatgcttacttt

SEQ ID NO: 7393389 - DNA, 22 bp, Homo sapiens
atgcacactgaatgcttacttt

SEQ ID NO: 7393390 - DNA, 22 bp, Homo sapiens
atgcacactgaatgcttacttt

SEQ ID NO: 7393391 - DNA, 22 bp, Homo sapiens
atgcacactgggattcaactgg

SEQ ID NO: 7393392 - DNA, 22 bp, Homo sapiens
atgcacactgggattcaactgg

SEQ ID NO: 7393393 - DNA, 22 bp, Homo sapiens
atgcacactgggattcaactgg

SEQ ID NO: 7393394 - DNA, 22 bp, Homo sapiens
gaatcacagaggcaaattctga

SEQ ID NO: 7393395 - DNA, 22 bp, Homo sapiens
gaatcacactcgtaagtgagtt

SEQ ID NO: 7393396 - DNA, 22 bp, Homo sapiens
gaatcacactcgtaagtgagtt

SEQ ID NO: 7393397 - DNA, 22 bp, Homo sapiens
gaatcacactcgtaagtgagtt

SEQ ID NO: 7393398 - DNA, 22 bp, Homo sapiens
gaatcacactcgtaagtgagtt

SEQ ID NO: 7393399 - DNA, 22 bp, Homo sapiens
gaatcacactcgtaagtgagtt

SEQ ID NO: 7393400 - DNA, 22 bp, Homo sapiens
gaatcaattgtgaagactatga

SEQ ID NO: 7393401 - DNA, 22 bp, Homo sapiens
gaatcaattgtgaagactatga

SEQ ID NO: 7393402 - DNA, 22 bp, Homo sapiens
gaatcaattgtgaagactatga

SEQ ID NO: 7393403 - DNA, 22 bp, Homo sapiens
gaatcaattatccaggctgttg

SEQ ID NO: 7393404 - DNA, 22 bp, Homo sapiens
gaatcaattatccaggctgttg

SEQ ID NO: 7393405 - DNA, 22 bp, Homo sapiens
gaatcaatggtagattaagtaa

SEQ ID NO: 7393406 - DNA, 22 bp, Homo sapiens
gaatcaatggtagattaagtaa

SEQ ID NO: 7393407 - DNA, 22 bp, Homo sapiens
gaatcaatggtagattaagtaa

SEQ ID NO: 7393408 - DNA, 22 bp, Homo sapiens
gaatcaaatcaagttcttttga

SEQ ID NO: 7393409 - DNA, 22 bp, Homo sapiens
gaatcaaatcaagttcttttga

SEQ ID NO: 7393410 - DNA, 22 bp, Homo sapiens
gaatacaaataataccaaggtg

SEQ ID NO: 7393411 - DNA, 22 bp, Homo sapiens
gaatattttcagtacagatggt

SEQ ID NO: 7393412 - DNA, 22 bp, Homo sapiens
gaatattttcagtacagatggt

SEQ ID NO: 7393413 - DNA, 22 bp, Homo sapiens
gaatattttcagtacagatggt

SEQ ID NO: 7393414 - DNA, 22 bp, Homo sapiens
gaatattttcagtacagatggt

SEQ ID NO: 7393415 - DNA, 22 bp, Homo sapiens
gaatattttcagtacagatggt

SEQ ID NO: 7393416 - DNA, 22 bp, Homo sapiens
gaatattttcagtacagatggt

SEQ ID NO: 7393417 - DNA, 22 bp, Homo sapiens
gaatattttcagtacagatggt

SEQ ID NO: 7393418 - DNA, 22 bp, Homo sapiens
gaatatttttaaagggactaat

SEQ ID NO: 7393419 - DNA, 22 bp, Homo sapiens
gaatatttttaaagggactaat

SEQ ID NO: 7393420 - DNA, 22 bp, Homo sapiens
gaatattttcagtacagatggt

SEQ ID NO: 7393421 - DNA, 22 bp, Homo sapiens
gaatattttcagtacagatggt

SEQ ID NO: 7393422 - DNA, 22 bp, Homo sapiens
gaatcaaatcaagttcttttga

SEQ ID NO: 7393423 - DNA, 22 bp, Homo sapiens
gaatcaaatcaagttcttttga

SEQ ID NO: 7393424 - DNA, 22 bp, Homo sapiens
gaatatttttaaagggactaat

SEQ ID NO: 7393425 - DNA, 22 bp, Homo sapiens
gaatatttttaaagggactaat

SEQ ID NO: 7393426 - DNA, 22 bp, Homo sapiens
gaatatttttaaagggactaat

SEQ ID NO: 7393427 - DNA, 22 bp, Homo sapiens
gaatatttttaaagggactaat

SEQ ID NO: 7393428 - DNA, 22 bp, Homo sapiens
gaatcagcctgagtttgcagct

SEQ ID NO: 7393429 - DNA, 19 bp, Homo sapiens
gaattttaggacttcagca

SEQ ID NO: 7393430 - DNA, 22 bp, Homo sapiens
gaatcagcctgagtttgcagct

SEQ ID NO: 7393431 - DNA, 19 bp, Homo sapiens
gaattttaggacttcagca

SEQ ID NO: 7393432 - DNA, 22 bp, Homo sapiens
gacaataaagtgatacatggga

SEQ ID NO: 7393433 - DNA, 22 bp, Homo sapiens
gaattttatcttattacttgca

SEQ ID NO: 7393434 - DNA, 22 bp, Homo sapiens
gaattttatcttattacttgca

SEQ ID NO: 7393435 - DNA, 22 bp, Homo sapiens
gaattttatcttattacttgca

SEQ ID NO: 7393436 - DNA, 22 bp, Homo sapiens
gaattttatcttattacttgca

SEQ ID NO: 7393437 - DNA, 22 bp, Homo sapiens
gaattttatcttattacttgca

SEQ ID NO: 7393438 - DNA, 22 bp, Homo sapiens
gaatcagaatctctggggttgg

SEQ ID NO: 7393439 - DNA, 22 bp, Homo sapiens
gaatcagaatctgcatttttaa

SEQ ID NO: 7393440 - DNA, 22 bp, Homo sapiens
gaatcagactgacctgagttca

SEQ ID NO: 7393441 - DNA, 22 bp, Homo sapiens
gaatcagactacaaatgacccc

SEQ ID NO: 7393442 - DNA, 22 bp, Homo sapiens
gaatcagataataagcaagcat

SEQ ID NO: 7393443 - DNA, 22 bp, Homo sapiens
gaatcagatactgatttcagtc

SEQ ID NO: 7393444 - DNA, 22 bp, Homo sapiens
gacaatgcagaagtacttgttc

SEQ ID NO: 7393445 - DNA, 22 bp, Homo sapiens
gacaatgagtgaggcacctggg

SEQ ID NO: 7393446 - DNA, 22 bp, Homo sapiens
gacaatgcagaagtacttgttc

SEQ ID NO: 7393447 - DNA, 22 bp, Homo sapiens
gacaatgcagaagtacttgttc

SEQ ID NO: 7393448 - DNA, 22 bp, Homo sapiens
gacaatctggacccagtcttca

SEQ ID NO: 7393449 - DNA, 22 bp, Homo sapiens
gacaatctggacccagtcttca

SEQ ID NO: 7393450 - DNA, 22 bp, Homo sapiens
gacaatctggacccagtcttca

SEQ ID NO: 7393451 - DNA, 22 bp, Homo sapiens
gacaatcagccatatccagggt

SEQ ID NO: 7393452 - DNA, 22 bp, Homo sapiens
gacaatatagttgaatgagcaa

SEQ ID NO: 7393453 - DNA, 22 bp, Homo sapiens
gacaatgtgacagaccaatgat

SEQ ID NO: 7393454 - DNA, 22 bp, Homo sapiens
gacaatgtaaatcaggatagca

SEQ ID NO: 7393455 - DNA, 22 bp, Homo sapiens
gacaatggtggatacatgtcat

SEQ ID NO: 7393456 - DNA, 22 bp, Homo sapiens
gacaatgcattgtgattgtgac

SEQ ID NO: 7393457 - DNA, 21 bp, Homo sapiens
gacaatgcagtcttttttgga

SEQ ID NO: 7393458 - DNA, 21 bp, Homo sapiens
gacaatgcagtcttttttgga

SEQ ID NO: 7393459 - DNA, 22 bp, Homo sapiens
gacaataagaacagatactgtg

SEQ ID NO: 7393460 - DNA, 22 bp, Homo sapiens
gacaataagaacagatactgtg

SEQ ID NO: 7393461 - DNA, 22 bp, Homo sapiens
gacaataagaacagatactgtg

SEQ ID NO: 7393462 - DNA, 22 bp, Homo sapiens
gacaataagaacagatactgtg

SEQ ID NO: 7393463 - DNA, 22 bp, Homo sapiens
gacaataagaaaagaggaggca

SEQ ID NO: 7393464 - DNA, 22 bp, Homo sapiens
gacaataaagtgatacatggga

SEQ ID NO: 7393465 - DNA, 22 bp, Homo sapiens
gacaataaagtgatacatggga

SEQ ID NO: 7393466 - DNA, 22 bp, Homo sapiens
gaatacaaagcagaactcatac

SEQ ID NO: 7393467 - DNA, 22 bp, Homo sapiens
gaatacaaagcagaactcatac

SEQ ID NO: 7393468 - DNA, 23 bp, Homo sapiens
gaatacaaagcagatggtccagc

SEQ ID NO: 7393469 - DNA, 23 bp, Homo sapiens
gaatacaaagcagatggtccagc

SEQ ID NO: 7393470 - DNA, 23 bp, Homo sapiens
gaatacaaagcagatggtccagc

SEQ ID NO: 7393471 - DNA, 23 bp, Homo sapiens
gaatacaaagcagatggtccagc

SEQ ID NO: 7393472 - DNA, 23 bp, Homo sapiens
gaatacaaagcagatggtccagc

SEQ ID NO: 7393473 - DNA, 22 bp, Homo sapiens
gaatacaaataataccaaggtg

SEQ ID NO: 7393474 - DNA, 22 bp, Homo sapiens
gaatacaaataataccaaggtg

SEQ ID NO: 7393475 - DNA, 22 bp, Homo sapiens
gaatacaaataataccaaggtg

SEQ ID NO: 7393476 - DNA, 22 bp, Homo sapiens
gaatacaaataataccaaggtg

SEQ ID NO: 7393477 - DNA, 22 bp, Homo sapiens
gaatacaaataataccaaggtg

SEQ ID NO: 7393478 - DNA, 22 bp, Homo sapiens
gaatacaaacttaaggctttac

SEQ ID NO: 7393479 - DNA, 22 bp, Homo sapiens
gaatacaaagcagaactcatac

SEQ ID NO: 7393480 - DNA, 22 bp, Homo sapiens
gaatacaaacttaaggctttac

SEQ ID NO: 7393481 - DNA, 22 bp, Homo sapiens
gaatacaaacttaaggctttac

SEQ ID NO: 7393482 - DNA, 22 bp, Homo sapiens
gaatacaaagcagaactcatac

SEQ ID NO: 7393483 - DNA, 22 bp, Homo sapiens
gaatacaaagcagaactcatac

SEQ ID NO: 7393484 - DNA, 22 bp, Homo sapiens
gaatacaaagcagaactcatac

SEQ ID NO: 7393485 - DNA, 22 bp, Homo sapiens
gaatacaaagcagaactcatac

SEQ ID NO: 7393486 - DNA, 22 bp, Homo sapiens
gaatacaaagcagaactcatac

SEQ ID NO: 7393487 - DNA, 22 bp, Homo sapiens
gaatacaaagcagaactcatac

SEQ ID NO: 7393488 - DNA, 22 bp, Homo sapiens
gaatacaaagcagaactcatac

SEQ ID NO: 7393489 - DNA, 22 bp, Homo sapiens
gaataattgtgatgcttgaagt

SEQ ID NO: 7393490 - DNA, 22 bp, Homo sapiens
gaataattgtgatgcttgaagt

SEQ ID NO: 7393491 - DNA, 22 bp, Homo sapiens
gaataatattgactttgcaggc

SEQ ID NO: 7393492 - DNA, 22 bp, Homo sapiens
gaataatattgactttgcaggc

SEQ ID NO: 7393493 - DNA, 22 bp, Homo sapiens
gaataatcatgaaattcagtga

SEQ ID NO: 7393494 - DNA, 22 bp, Homo sapiens
gaataattttgatcagaaggga

SEQ ID NO: 7393495 - DNA, 22 bp, Homo sapiens
gaataattttgatcagaaggga

SEQ ID NO: 7393496 - DNA, 22 bp, Homo sapiens
gaataattttgatcagaaggga

SEQ ID NO: 7393497 - DNA, 22 bp, Homo sapiens
gaataattttgatcagaaggga

SEQ ID NO: 7393498 - DNA, 22 bp, Homo sapiens
gaatacaaacttaaggctttac

SEQ ID NO: 7393499 - DNA, 22 bp, Homo sapiens
gaatacaaacttaaggctttac

SEQ ID NO: 7393500 - DNA, 22 bp, Homo sapiens
gaatacaaacttaaggctttac

SEQ ID NO: 7393501 - DNA, 22 bp, Homo sapiens
gaataatagcagaaattagcag

SEQ ID NO: 7393502 - DNA, 22 bp, Homo sapiens
gaataatagcagaaattagcag

SEQ ID NO: 7393503 - DNA, 22 bp, Homo sapiens
gaataactccatgatatgcttt

SEQ ID NO: 7393504 - DNA, 22 bp, Homo sapiens
gaataactccatgatatgcttt

SEQ ID NO: 7393505 - DNA, 22 bp, Homo sapiens
gaataacattttttcctttaca

SEQ ID NO: 7393506 - DNA, 22 bp, Homo sapiens
gaataacattttttcctttaca

SEQ ID NO: 7393507 - DNA, 22 bp, Homo sapiens
gaataatattgactttgcaggc

SEQ ID NO: 7393508 - DNA, 22 bp, Homo sapiens
gaataatattgactttgcaggc

SEQ ID NO: 7393509 - DNA, 22 bp, Homo sapiens
gaataatattgactttgcaggc

SEQ ID NO: 7393510 - DNA, 22 bp, Homo sapiens
gaataatattgactttgcaggc

SEQ ID NO: 7393511 - DNA, 22 bp, Homo sapiens
gaataatattgactttgcaggc

SEQ ID NO: 7393512 - DNA, 22 bp, Homo sapiens
gaataatattgactttgcaggc

SEQ ID NO: 7393513 - DNA, 22 bp, Homo sapiens
gaataatagcagaaattagcag

SEQ ID NO: 7393514 - DNA, 22 bp, Homo sapiens
gaataatagcagaaattagcag

SEQ ID NO: 7393515 - DNA, 22 bp, Homo sapiens
gaataatagcagaaattagcag

SEQ ID NO: 7393516 - DNA, 22 bp, Homo sapiens
gaataatagcagaaattagcag

SEQ ID NO: 7393517 - DNA, 22 bp, Homo sapiens
gaagtcttgaagagcactgtaa

SEQ ID NO: 7393518 - DNA, 22 bp, Homo sapiens
gaagtcttgaaacacaaactag

SEQ ID NO: 7393519 - DNA, 22 bp, Homo sapiens
gaagtcttttagcaaaacgaac

SEQ ID NO: 7393520 - DNA, 22 bp, Homo sapiens
gaagtcttttagcaaaacgaac

SEQ ID NO: 7393521 - DNA, 22 bp, Homo sapiens
gaagtcttcatctgatgctctg

SEQ ID NO: 7393522 - DNA, 22 bp, Homo sapiens
atgcacagtaatgagctggttg

SEQ ID NO: 7393523 - DNA, 22 bp, Homo sapiens
atgcacagtaatgagctggttg

SEQ ID NO: 7393524 - DNA, 22 bp, Homo sapiens
atgcacagtaatgagctggttg

SEQ ID NO: 7393525 - DNA, 22 bp, Homo sapiens
atgcacaggtgctgatgcacgc

SEQ ID NO: 7393526 - DNA, 22 bp, Homo sapiens
atgcacaggtgctgatgcacgc

SEQ ID NO: 7393527 - DNA, 22 bp, Homo sapiens
atgcacaggtgctgatgcacgc

SEQ ID NO: 7393528 - DNA, 22 bp, Homo sapiens
atgcacaggaccacacataatg

SEQ ID NO: 7393529 - DNA, 22 bp, Homo sapiens
atgcacaggaccacacataatg

SEQ ID NO: 7393530 - DNA, 22 bp, Homo sapiens
atgcacaggaccacacataatg

SEQ ID NO: 7393531 - DNA, 22 bp, Homo sapiens
atgcacaggctgtgggctggtt

SEQ ID NO: 7393532 - DNA, 22 bp, Homo sapiens
gacgcactgaaggctggttacc

SEQ ID NO: 7393533 - DNA, 22 bp, Homo sapiens
gacgagagactccatccaccac

SEQ ID NO: 7393534 - DNA, 22 bp, Homo sapiens
gacgagagactccatccaccac

SEQ ID NO: 7393535 - DNA, 22 bp, Homo sapiens
gacctttagtgtcatgttatat

SEQ ID NO: 7393536 - DNA, 22 bp, Homo sapiens
gacctttagtgtcatgttatat

SEQ ID NO: 7393537 - DNA, 22 bp, Homo sapiens
gacctttagtgtccaatattca

SEQ ID NO: 7393538 - DNA, 22 bp, Homo sapiens
gacggagctggttgctgcggct

SEQ ID NO: 7393539 - DNA, 22 bp, Homo sapiens
gacggagctggttgctgcggct

SEQ ID NO: 7393540 - DNA, 22 bp, Homo sapiens
gacggagctggttgctgcggct

SEQ ID NO: 7393541 - DNA, 22 bp, Homo sapiens
gacggagctggttgctgcggct

SEQ ID NO: 7393542 - DNA, 22 bp, Homo sapiens
gacgcctcttccctgctgcact

SEQ ID NO: 7393543 - DNA, 22 bp, Homo sapiens
gacgagagactccatccaccac

SEQ ID NO: 7393544 - DNA, 22 bp, Homo sapiens
gacggagctggttgctgcggct

SEQ ID NO: 7393545 - DNA, 22 bp, Homo sapiens
gacggagctggttgctgcggct

SEQ ID NO: 7393546 - DNA, 22 bp, Homo sapiens
gacggcagaaactcatgaggtc

SEQ ID NO: 7393547 - DNA, 22 bp, Homo sapiens
gacggcagaaactcatgaggtc

SEQ ID NO: 7393548 - DNA, 22 bp, Homo sapiens
gacggggcagccagctggtggc

SEQ ID NO: 7393549 - DNA, 22 bp, Homo sapiens
gacggcagaaactcatgaggtc

SEQ ID NO: 7393550 - DNA, 22 bp, Homo sapiens
gacgggtgtccctatgtccatt

SEQ ID NO: 7393551 - DNA, 22 bp, Homo sapiens
gacgggtgtatgctcccagcca

SEQ ID NO: 7393552 - DNA, 22 bp, Homo sapiens
gacggggcagccagctggtggc

SEQ ID NO: 7393553 - DNA, 19 bp, Homo sapiens
gactaaataataatagcag

SEQ ID NO: 7393554 - DNA, 22 bp, Homo sapiens
gactaaataaaagccaaacttc

SEQ ID NO: 7393555 - DNA, 22 bp, Homo sapiens
gactaaattcctgttcgcgatg

SEQ ID NO: 7393556 - DNA, 22 bp, Homo sapiens
gactaaatcagacttttccaaa

SEQ ID NO: 7393557 - DNA, 22 bp, Homo sapiens
gactggaaagcctgtcctcaga

SEQ ID NO: 7393558 - DNA, 22 bp, Homo sapiens
gactggaaagcctgtcctcaga

SEQ ID NO: 7393559 - DNA, 22 bp, Homo sapiens
gactacagatagccaattaagt

SEQ ID NO: 7393560 - DNA, 22 bp, Homo sapiens
gactacaggccggcatcagaga

SEQ ID NO: 7393561 - DNA, 19 bp, Homo sapiens
gactacagggggaagaagt

SEQ ID NO: 7393562 - DNA, 22 bp, Homo sapiens
gactacaacaataagaacagct

SEQ ID NO: 7393563 - DNA, 22 bp, Homo sapiens
gactaagggagagctgtgcttg

SEQ ID NO: 7393564 - DNA, 22 bp, Homo sapiens
gactacagatagccaattaagt

SEQ ID NO: 7393565 - DNA, 22 bp, Homo sapiens
gactacaggccggcatcagaga

SEQ ID NO: 7393566 - DNA, 22 bp, Homo sapiens
gactggagataaaaccatgagt

SEQ ID NO: 7393567 - DNA, 21 bp, Homo sapiens
gactggagagaggaagtctgg

SEQ ID NO: 7393568 - DNA, 21 bp, Homo sapiens
gactggagagaggaagtctgg

SEQ ID NO: 7393569 - DNA, 22 bp, Homo sapiens
gactggagataaaaccatgagt

SEQ ID NO: 7393570 - DNA, 22 bp, Homo sapiens
gactggagataaaaccatgagt

SEQ ID NO: 7393571 - DNA, 22 bp, Homo sapiens
gactggagcccccaaggacacc

SEQ ID NO: 7393572 - DNA, 22 bp, Homo sapiens
gactggagcccccaaggacacc

SEQ ID NO: 7393573 - DNA, 22 bp, Homo sapiens
gactggagcccccaaggacacc

SEQ ID NO: 7393574 - DNA, 22 bp, Homo sapiens
gactggaaagcctgtcctcaga

SEQ ID NO: 7393575 - DNA, 22 bp, Homo sapiens
gactggaatcccaggctctgtg

SEQ ID NO: 7393576 - DNA, 21 bp, Homo sapiens
gactggagagaggaagtctgg

SEQ ID NO: 7393577 - DNA, 22 bp, Homo sapiens
gactggagcccccaaggacacc

SEQ ID NO: 7393578 - DNA, 22 bp, Homo sapiens
gactggagcccccaaggacacc

SEQ ID NO: 7393579 - DNA, 22 bp, Homo sapiens
gactggagtgcctccaggaaag

SEQ ID NO: 7393580 - DNA, 22 bp, Homo sapiens
gactggagtgcctccaggaaag

SEQ ID NO: 7393581 - DNA, 22 bp, Homo sapiens
gactggagtcaatgagcagcac

SEQ ID NO: 7393582 - DNA, 22 bp, Homo sapiens
gactggagtcaatgagcagcac

SEQ ID NO: 7393583 - DNA, 22 bp, Homo sapiens
gactggagtgcctccaggaaag

SEQ ID NO: 7393584 - DNA, 22 bp, Homo sapiens
gactggagtgcctccaggaaag

SEQ ID NO: 7393585 - DNA, 22 bp, Homo sapiens
gactggagtgcctccaggaaag

SEQ ID NO: 7393586 - DNA, 22 bp, Homo sapiens
gactggctctatctccttggcg

SEQ ID NO: 7393587 - DNA, 22 bp, Homo sapiens
gactgggagggttcagctgggt

SEQ ID NO: 7393588 - DNA, 22 bp, Homo sapiens
gactgggagggttcagctgggt

SEQ ID NO: 7393589 - DNA, 22 bp, Homo sapiens
gactgggcagccggtagggaag

SEQ ID NO: 7393590 - DNA, 22 bp, Homo sapiens
gactgggagggttcagctgggt

SEQ ID NO: 7393591 - DNA, 22 bp, Homo sapiens
gactgggagggttcagctgggt

SEQ ID NO: 7393592 - DNA, 22 bp, Homo sapiens
gactggcctggggctgggcaca

SEQ ID NO: 7393593 - DNA, 22 bp, Homo sapiens
gactggctctatcaggataaat

SEQ ID NO: 7393594 - DNA, 22 bp, Homo sapiens
gactggcctggggctgggcaca

SEQ ID NO: 7393595 - DNA, 22 bp, Homo sapiens
gactggcctggagatgcagctg

SEQ ID NO: 7393596 - DNA, 22 bp, Homo sapiens
gaccctggcagataccgtcaca

SEQ ID NO: 7393597 - DNA, 22 bp, Homo sapiens
gaccctggagccgtctgaggca

SEQ ID NO: 7393598 - DNA, 22 bp, Homo sapiens
gaccctggagttagtcctgtgt

SEQ ID NO: 7393599 - DNA, 22 bp, Homo sapiens
gaccttgtgatccacctgcctt

SEQ ID NO: 7393600 - DNA, 22 bp, Homo sapiens
gaccttgtgatccacctgcctt

SEQ ID NO: 7393601 - DNA, 22 bp, Homo sapiens
gaccttgtgatccacccgcttt

SEQ ID NO: 7393602 - DNA, 22 bp, Homo sapiens
gaccttgtgatccacccgcttt

SEQ ID NO: 7393603 - DNA, 22 bp, Homo sapiens
gaccttgtgatccacccgcttt

SEQ ID NO: 7393604 - DNA, 22 bp, Homo sapiens
gaccttgtgatccacccgcttt

SEQ ID NO: 7393605 - DNA, 22 bp, Homo sapiens
gaccctggcaggtagcctcaca

SEQ ID NO: 7393606 - DNA, 22 bp, Homo sapiens
gaccctggcagataccgtcaca

SEQ ID NO: 7393607 - DNA, 23 bp, Homo sapiens
atgctctatttgggatatgacag

SEQ ID NO: 7393608 - DNA, 17 bp, Homo sapiens
atgctctatagtcagtg

SEQ ID NO: 7393609 - DNA, 23 bp, Homo sapiens
atgctctatttgggatatgacag

SEQ ID NO: 7393610 - DNA, 22 bp, Homo sapiens
atgctctataaatatgacatgt

SEQ ID NO: 7393611 - DNA, 22 bp, Homo sapiens
atgctctataaatatgacatgt

SEQ ID NO: 7393612 - DNA, 22 bp, Homo sapiens
atgctctggagtacgtgaaatt

SEQ ID NO: 7393613 - DNA, 22 bp, Homo sapiens
atgctctggagtacgtgaaatt

SEQ ID NO: 7393614 - DNA, 22 bp, Homo sapiens
atgctctgggcaggagccctgg

SEQ ID NO: 7393615 - DNA, 22 bp, Homo sapiens
gaccctggagccgtctgaggca

SEQ ID NO: 7393616 - DNA, 22 bp, Homo sapiens
gaccttgtgatctgcccacctt

SEQ ID NO: 7393617 - DNA, 22 bp, Homo sapiens
gaccttgtgatccgcccgcctt

SEQ ID NO: 7393618 - DNA, 22 bp, Homo sapiens
gaccttgtgatccccctgcctt

SEQ ID NO: 7393619 - DNA, 22 bp, Homo sapiens
gaccttgtgatccgcccgcctt

SEQ ID NO: 7393620 - DNA, 22 bp, Homo sapiens
gaccttgtgatccgcccgcctt

SEQ ID NO: 7393621 - DNA, 22 bp, Homo sapiens
gaccttgtgatccgcccgcctt

SEQ ID NO: 7393622 - DNA, 22 bp, Homo sapiens
gaccttgtgatccgcccgcctt

SEQ ID NO: 7393623 - DNA, 22 bp, Homo sapiens
gaccttgtgatccacctgcctt

SEQ ID NO: 7393624 - DNA, 22 bp, Homo sapiens
gaccttgtgatccacctgcctt

SEQ ID NO: 7393625 - DNA, 22 bp, Homo sapiens
gaccttgtgatccagccacctt

SEQ ID NO: 7393626 - DNA, 22 bp, Homo sapiens
gaccttgtgatccagccacctt

SEQ ID NO: 7393627 - DNA, 22 bp, Homo sapiens
gaccttgtgatccccctgcctt

SEQ ID NO: 7393628 - DNA, 22 bp, Homo sapiens
gaccttgtgatccagccacctt

SEQ ID NO: 7393629 - DNA, 22 bp, Homo sapiens
gaccttgtgatccccctgcctt

SEQ ID NO: 7393630 - DNA, 22 bp, Homo sapiens
gaccttgtgatccagccacctt

SEQ ID NO: 7393631 - DNA, 22 bp, Homo sapiens
gaccttgtgatccagccacctt

SEQ ID NO: 7393632 - DNA, 21 bp, Homo sapiens
gacctttacatttttcactgt

SEQ ID NO: 7393633 - DNA, 22 bp, Homo sapiens
gacctttaatgtttctaccact

SEQ ID NO: 7393634 - DNA, 22 bp, Homo sapiens
gaccttgtgctccgaggcgggc

SEQ ID NO: 7393635 - DNA, 22 bp, Homo sapiens
gaccttgtgctccgaggcgggc

SEQ ID NO: 7393636 - DNA, 22 bp, Homo sapiens
gaccttgtgctccgaggcgggc

SEQ ID NO: 7393637 - DNA, 22 bp, Homo sapiens
gaccttgtgctccgaggcgggc

SEQ ID NO: 7393638 - DNA, 22 bp, Homo sapiens
gaccttgtgatctgcccacctt

SEQ ID NO: 7393639 - DNA, 22 bp, Homo sapiens
gaccttgtgatctgcctgcctt

SEQ ID NO: 7393640 - DNA, 22 bp, Homo sapiens
gaccttgtgatctgcctgcctt

SEQ ID NO: 7393641 - DNA, 22 bp, Homo sapiens
gaccttgtgatctgcccacctt

SEQ ID NO: 7393642 - DNA, 22 bp, Homo sapiens
gaccttgtgatctgcccacctt

SEQ ID NO: 7393643 - DNA, 22 bp, Homo sapiens
gaccttgtgatctgcccacctt

SEQ ID NO: 7393644 - DNA, 22 bp, Homo sapiens
gaccttgtgatctgcccacctt

SEQ ID NO: 7393645 - DNA, 22 bp, Homo sapiens
gaccttgtgatctgcccacctt

SEQ ID NO: 7393646 - DNA, 22 bp, Homo sapiens
gaccttgtgatctgcccacctt

SEQ ID NO: 7393647 - DNA, 22 bp, Homo sapiens
atgctattttacataggaatgg

SEQ ID NO: 7393648 - DNA, 22 bp, Homo sapiens
atgctattttacataggaatgg

SEQ ID NO: 7393649 - DNA, 22 bp, Homo sapiens
atgctatttaccacacatcatt

SEQ ID NO: 7393650 - DNA, 22 bp, Homo sapiens
atgctatttaccacacatcatt

SEQ ID NO: 7393651 - DNA, 22 bp, Homo sapiens
atgctatttaccacacatcatt

SEQ ID NO: 7393652 - DNA, 22 bp, Homo sapiens
atgctattgaaaagaaataaga

SEQ ID NO: 7393653 - DNA, 22 bp, Homo sapiens
atgctatttaccacacatcatt

SEQ ID NO: 7393654 - DNA, 22 bp, Homo sapiens
atgctattccagaatgtaaatt

SEQ ID NO: 7393655 - DNA, 22 bp, Homo sapiens
atgctcagacaccgggcggggg

SEQ ID NO: 7393656 - DNA, 22 bp, Homo sapiens
atgctcacttcagagaagatga

SEQ ID NO: 7393657 - DNA, 22 bp, Homo sapiens
atgctcagcctgaggtggggag

SEQ ID NO: 7393658 - DNA, 22 bp, Homo sapiens
atgctcagggcacactctggac

SEQ ID NO: 7393659 - DNA, 22 bp, Homo sapiens
atgctcagggcacactctggac

SEQ ID NO: 7393660 - DNA, 22 bp, Homo sapiens
atgctattttacataggaatgg

SEQ ID NO: 7393661 - DNA, 22 bp, Homo sapiens
atgctcagtagctggctgaccc

SEQ ID NO: 7393662 - DNA, 22 bp, Homo sapiens
atgctcaggttttgcccaagac

SEQ ID NO: 7393663 - DNA, 22 bp, Homo sapiens
atgctcagggcacactctggac

SEQ ID NO: 7393664 - DNA, 22 bp, Homo sapiens
atgctcagggcacactctggac

SEQ ID NO: 7393665 - DNA, 22 bp, Homo sapiens
atgctcctcgagtgtctcacag

SEQ ID NO: 7393666 - DNA, 18 bp, Homo sapiens
atgctcctatctctgagc

SEQ ID NO: 7393667 - DNA, 22 bp, Homo sapiens
atgctccagtgtgatgcttcat

SEQ ID NO: 7393668 - DNA, 22 bp, Homo sapiens
atgctcagtagctggctgaccc

SEQ ID NO: 7393669 - DNA, 22 bp, Homo sapiens
atgctcaggttttgcccaagac

SEQ ID NO: 7393670 - DNA, 22 bp, Homo sapiens
atgctccaccttttgcaggaac

SEQ ID NO: 7393671 - DNA, 22 bp, Homo sapiens
atgctctaagcttagtgaggca

SEQ ID NO: 7393672 - DNA, 18 bp, Homo sapiens
atgctctagtctttcctg

SEQ ID NO: 7393673 - DNA, 22 bp, Homo sapiens
atgctctagagctcttttcact

SEQ ID NO: 7393674 - DNA, 18 bp, Homo sapiens
atgctctagtctttcctg

SEQ ID NO: 7393675 - DNA, 22 bp, Homo sapiens
atgctctagacatactggctat

SEQ ID NO: 7393676 - DNA, 22 bp, Homo sapiens
atgctctacttacggctttcag

SEQ ID NO: 7393677 - DNA, 22 bp, Homo sapiens
atgctcctcgagtgtctcacag

SEQ ID NO: 7393678 - DNA, 22 bp, Homo sapiens
atgctccttggcttcaaagcca

SEQ ID NO: 7393679 - DNA, 22 bp, Homo sapiens
atgctccttggcttcaaagcca

SEQ ID NO: 7393680 - DNA, 22 bp, Homo sapiens
atgctccttggcttcaaagcca

SEQ ID NO: 7393681 - DNA, 22 bp, Homo sapiens
atgctattccagaatgtaaatt

SEQ ID NO: 7393682 - DNA, 22 bp, Homo sapiens
atgctattaatatccagtctga

SEQ ID NO: 7393683 - DNA, 22 bp, Homo sapiens
atgctattccagaatgtaaatt

SEQ ID NO: 7393684 - DNA, 22 bp, Homo sapiens
atgctattccagaatgtaaatt

SEQ ID NO: 7393685 - DNA, 22 bp, Homo sapiens
atgctattccagaatgtaaatt

SEQ ID NO: 7393686 - DNA, 22 bp, Homo sapiens
atgctattaatatccagtctga

SEQ ID NO: 7393687 - DNA, 22 bp, Homo sapiens
atgctatgtttggtgttggaga

SEQ ID NO: 7393688 - DNA, 22 bp, Homo sapiens
gaccacagattcctaagtggca

SEQ ID NO: 7393689 - DNA, 22 bp, Homo sapiens
gaccacagcagtgcaagaggag

SEQ ID NO: 7393690 - DNA, 22 bp, Homo sapiens
gaccacagaagccttgataggg

SEQ ID NO: 7393691 - DNA, 22 bp, Homo sapiens
gaccacagaagccttgataggg

SEQ ID NO: 7393692 - DNA, 22 bp, Homo sapiens
gaccacagactggaaagagggc

SEQ ID NO: 7393693 - DNA, 22 bp, Homo sapiens
gaccacagagcacggcctgctt

SEQ ID NO: 7393694 - DNA, 22 bp, Homo sapiens
gaccacagaggtgtgggagaga

SEQ ID NO: 7393695 - DNA, 22 bp, Homo sapiens
gaccacagagcacggcctgctt

SEQ ID NO: 7393696 - DNA, 22 bp, Homo sapiens
gaccacagaggtgtgggagaga

SEQ ID NO: 7393697 - DNA, 22 bp, Homo sapiens
gaccacagaggtgtgggagaga

SEQ ID NO: 7393698 - DNA, 22 bp, Homo sapiens
gaccacagattcctaagtggca

SEQ ID NO: 7393699 - DNA, 22 bp, Homo sapiens
gaccaaggaagaggggagccag

SEQ ID NO: 7393700 - DNA, 22 bp, Homo sapiens
gaccaagatacagcatcataga

SEQ ID NO: 7393701 - DNA, 22 bp, Homo sapiens
gaccaagatacagcatcataga

SEQ ID NO: 7393702 - DNA, 22 bp, Homo sapiens
gaccaaggccaggccagggcgt

SEQ ID NO: 7393703 - DNA, 22 bp, Homo sapiens
gaccaaggccaggccagggcgt

SEQ ID NO: 7393704 - DNA, 22 bp, Homo sapiens
gaccaaggccaggccagggcgt

SEQ ID NO: 7393705 - DNA, 22 bp, Homo sapiens
gaccacacgtcccagagagccc

SEQ ID NO: 7393706 - DNA, 22 bp, Homo sapiens
gacatttgttcctctaagtgac

SEQ ID NO: 7393707 - DNA, 21 bp, Homo sapiens
gaccaaagggctggcactgcc

SEQ ID NO: 7393708 - DNA, 22 bp, Homo sapiens
gaccaaagaagccacccgtcct

SEQ ID NO: 7393709 - DNA, 22 bp, Homo sapiens
gacatttgtatcttaggggaaa

SEQ ID NO: 7393710 - DNA, 22 bp, Homo sapiens
gaccaagatacagcatcataga

SEQ ID NO: 7393711 - DNA, 22 bp, Homo sapiens
gaccaagatacagcatcataga

SEQ ID NO: 7393712 - DNA, 22 bp, Homo sapiens
gaccaagatacagcatcataga

SEQ ID NO: 7393713 - DNA, 22 bp, Homo sapiens
gaccaacagaatttcctgtttt

SEQ ID NO: 7393714 - DNA, 22 bp, Homo sapiens
gaccaacagaatttcctgtttt

SEQ ID NO: 7393715 - DNA, 22 bp, Homo sapiens
gaccaaatgaatggtaatgagt

SEQ ID NO: 7393716 - DNA, 22 bp, Homo sapiens
gacatttcaatctcattatggg

SEQ ID NO: 7393717 - DNA, 22 bp, Homo sapiens
gacatttcaatctcattatggg

SEQ ID NO: 7393718 - DNA, 22 bp, Homo sapiens
gacatttcaatctcattatggg

SEQ ID NO: 7393719 - DNA, 22 bp, Homo sapiens
gacatttattggattttacgag

SEQ ID NO: 7393720 - DNA, 22 bp, Homo sapiens
gacatttctagcccataaaact

SEQ ID NO: 7393721 - DNA, 22 bp, Homo sapiens
gacatttattggattttacgag

SEQ ID NO: 7393722 - DNA, 22 bp, Homo sapiens
gacatttattggattttacgag

SEQ ID NO: 7393723 - DNA, 22 bp, Homo sapiens
gacatttattggattttacgag

SEQ ID NO: 7393724 - DNA, 22 bp, Homo sapiens
gacatttattggattttacgag

SEQ ID NO: 7393725 - DNA, 22 bp, Homo sapiens
gacatttattagaaaactatca

SEQ ID NO: 7393726 - DNA, 22 bp, Homo sapiens
gacatttattagaaaactatca

SEQ ID NO: 7393727 - DNA, 22 bp, Homo sapiens
gacatttattagaaaactatca

SEQ ID NO: 7393728 - DNA, 22 bp, Homo sapiens
gacatttattagaaaactatca

SEQ ID NO: 7393729 - DNA, 22 bp, Homo sapiens
gacatttattagaaaactatca

SEQ ID NO: 7393730 - DNA, 22 bp, Homo sapiens
gacatttattagaaaactatca

SEQ ID NO: 7393731 - DNA, 22 bp, Homo sapiens
gacatttattagaaaactatca

SEQ ID NO: 7393732 - DNA, 22 bp, Homo sapiens
gacatttattagaaaactatca

SEQ ID NO: 7393733 - DNA, 22 bp, Homo sapiens
gacatttatgaaggagatatgc

SEQ ID NO: 7393734 - DNA, 22 bp, Homo sapiens
gacatacaagctggtacctcct

SEQ ID NO: 7393735 - DNA, 22 bp, Homo sapiens
gacatacaagctggtacctcct

SEQ ID NO: 7393736 - DNA, 22 bp, Homo sapiens
gacatacaagctggtacctcct

SEQ ID NO: 7393737 - DNA, 22 bp, Homo sapiens
gacataatcctcctcacctact

SEQ ID NO: 7393738 - DNA, 22 bp, Homo sapiens
gacataataatctgacctagat

SEQ ID NO: 7393739 - DNA, 22 bp, Homo sapiens
gacataatcctcctcacctact

SEQ ID NO: 7393740 - DNA, 22 bp, Homo sapiens
gacataaagttcttgcttgaat

SEQ ID NO: 7393741 - DNA, 22 bp, Homo sapiens
gacactccagcttttggctcaa

SEQ ID NO: 7393742 - DNA, 22 bp, Homo sapiens
gacactctcctccagtggatag

SEQ ID NO: 7393743 - DNA, 22 bp, Homo sapiens
gacactcagtaggacttcaagg

SEQ ID NO: 7393744 - DNA, 22 bp, Homo sapiens
gacacgtttctgaattctgaag

SEQ ID NO: 7393745 - DNA, 22 bp, Homo sapiens
gacactatatgacacttcagtt

SEQ ID NO: 7393746 - DNA, 22 bp, Homo sapiens
gacactacgtggctcacatttc

SEQ ID NO: 7393747 - DNA, 22 bp, Homo sapiens
gacactctcctccagtggatag

SEQ ID NO: 7393748 - DNA, 22 bp, Homo sapiens
gacacaaagtttgtcagaaatt

SEQ ID NO: 7393749 - DNA, 22 bp, Homo sapiens
gacacaaagtttgtcagaaatt

SEQ ID NO: 7393750 - DNA, 22 bp, Homo sapiens
gacacaaagtttgtcagaaatt

SEQ ID NO: 7393751 - DNA, 22 bp, Homo sapiens
gacacaaagtttgtcagaaatt

SEQ ID NO: 7393752 - DNA, 22 bp, Homo sapiens
gacacaaagtttgtcagaaatt

SEQ ID NO: 7393753 - DNA, 22 bp, Homo sapiens
gacacaaagtttgtcagaaatt

SEQ ID NO: 7393754 - DNA, 22 bp, Homo sapiens
gacacaaagtttgtcagaaatt

SEQ ID NO: 7393755 - DNA, 22 bp, Homo sapiens
gacacaaagtttgtcagaaatt

SEQ ID NO: 7393756 - DNA, 22 bp, Homo sapiens
gacacagtttttctcacggtgg

SEQ ID NO: 7393757 - DNA, 22 bp, Homo sapiens
gacacagtttttctcacggtgg

SEQ ID NO: 7393758 - DNA, 22 bp, Homo sapiens
gacacaaagtttgtcagaaatt

SEQ ID NO: 7393759 - DNA, 22 bp, Homo sapiens
gacacaaagtttgtcagaaatt

SEQ ID NO: 7393760 - DNA, 22 bp, Homo sapiens
gacacaaagtttgtcagaaatt

SEQ ID NO: 7393761 - DNA, 21 bp, Homo sapiens
gacacaaagggtagtaatggt

SEQ ID NO: 7393762 - DNA, 21 bp, Homo sapiens
gacacaaagggtagtaatggt

SEQ ID NO: 7393763 - DNA, 21 bp, Homo sapiens
gacacaaagggtagtaatggt

SEQ ID NO: 7393764 - DNA, 21 bp, Homo sapiens
gacacaaagggtagtaatggt

SEQ ID NO: 7393765 - DNA, 21 bp, Homo sapiens
gacacaaagggtagtaatggt

SEQ ID NO: 7393766 - DNA, 21 bp, Homo sapiens
gacacaaagggtagtaatggt

SEQ ID NO: 7393767 - DNA, 21 bp, Homo sapiens
gacacaaagggtagtaatggt

SEQ ID NO: 7393768 - DNA, 21 bp, Homo sapiens
gacacaaagggtagtaatggt

SEQ ID NO: 7393769 - DNA, 21 bp, Homo sapiens
gacacaaagggtagtaatggt

SEQ ID NO: 7393770 - DNA, 22 bp, Homo sapiens
gacaattgcttttgccgaataa

SEQ ID NO: 7393771 - DNA, 22 bp, Homo sapiens
gacaatttctcaatatagaaac

SEQ ID NO: 7393772 - DNA, 21 bp, Homo sapiens
gacacaaagggtagtaatggt

SEQ ID NO: 7393773 - DNA, 22 bp, Homo sapiens
gacaatttctcaatatagaaac

SEQ ID NO: 7393774 - DNA, 22 bp, Homo sapiens
gacaatgtgttgaaagggaaaa

SEQ ID NO: 7393775 - DNA, 22 bp, Homo sapiens
gacaatgtgaggcgagtttgtt

SEQ ID NO: 7393776 - DNA, 19 bp, Homo sapiens
gacaattagagatcactca

SEQ ID NO: 7393777 - DNA, 19 bp, Homo sapiens
gacaattagagatcactca

SEQ ID NO: 7393778 - DNA, 22 bp, Homo sapiens
gacaatgtgcaattgcagctag

SEQ ID NO: 7393779 - DNA, 22 bp, Homo sapiens
gacaatgtgcaattgcagctag

SEQ ID NO: 7393780 - DNA, 22 bp, Homo sapiens
gacaattaggttaagagcaaga

SEQ ID NO: 7393781 - DNA, 22 bp, Homo sapiens
gacaattaggttaagagcaaga

SEQ ID NO: 7393782 - DNA, 22 bp, Homo sapiens
gacaattgcttttgccgaataa

SEQ ID NO: 7393783 - DNA, 22 bp, Homo sapiens
gacaattgcttttgccgaataa

SEQ ID NO: 7393784 - DNA, 22 bp, Homo sapiens
gacaattagatcattcctttga

SEQ ID NO: 7393785 - DNA, 22 bp, Homo sapiens
gacaattagatcattcctttga

SEQ ID NO: 7393786 - DNA, 22 bp, Homo sapiens
gacacatgtcagacggacaccc

SEQ ID NO: 7393787 - DNA, 22 bp, Homo sapiens
gacaccagaagacataagcaga

SEQ ID NO: 7393788 - DNA, 22 bp, Homo sapiens
gacaccagaagacataagcaga

SEQ ID NO: 7393789 - DNA, 22 bp, Homo sapiens
gacacattgatgtgagtacata

SEQ ID NO: 7393790 - DNA, 22 bp, Homo sapiens
gacacatgtcagacggacaccc

SEQ ID NO: 7393791 - DNA, 22 bp, Homo sapiens
gacacattgatgtgagtacata

SEQ ID NO: 7393792 - DNA, 22 bp, Homo sapiens
gacacatgaccataaatgctaa

SEQ ID NO: 7393793 - DNA, 22 bp, Homo sapiens
gacacatgaccataaatgctaa

SEQ ID NO: 7393794 - DNA, 22 bp, Homo sapiens
gacacatatgcgtatagtttag

SEQ ID NO: 7393795 - DNA, 22 bp, Homo sapiens
gacacatagatctatctcactc

SEQ ID NO: 7393796 - DNA, 22 bp, Homo sapiens
gacacatacagcagtaagtcta

SEQ ID NO: 7393797 - DNA, 22 bp, Homo sapiens
gacacccctttcaacttggtgg

SEQ ID NO: 7393798 - DNA, 22 bp, Homo sapiens
gacaccagtaaatattcaaaag

SEQ ID NO: 7393799 - DNA, 22 bp, Homo sapiens
gacaccagtaaatattcaaaag

SEQ ID NO: 7393800 - DNA, 22 bp, Homo sapiens
gacaccattacctttctatatt

SEQ ID NO: 7393801 - DNA, 23 bp, Homo sapiens
gacacctttgccagatcaagatg

SEQ ID NO: 7393802 - DNA, 18 bp, Homo sapiens
gacaccagcctctgcccc

SEQ ID NO: 7393803 - DNA, 22 bp, Homo sapiens
gacaccaggaatagttctgtct

SEQ ID NO: 7393804 - DNA, 22 bp, Homo sapiens
gacaccaggaatagttctgtct

SEQ ID NO: 7393805 - DNA, 23 bp, Homo sapiens
gacaccaggcgtggccctcgaca

SEQ ID NO: 7393806 - DNA, 23 bp, Homo sapiens
gacaccaggcgtggccctcgaca

SEQ ID NO: 7393807 - DNA, 22 bp, Homo sapiens
gacaccaggtctgttgtcctcc

SEQ ID NO: 7393808 - DNA, 22 bp, Homo sapiens
gacaccaggtctgttgtcctcc

SEQ ID NO: 7393809 - DNA, 22 bp, Homo sapiens
gacaccaggtctgttgtcctcc

SEQ ID NO: 7393810 - DNA, 22 bp, Homo sapiens
gacaccagtaaatattcaaaag

SEQ ID NO: 7393811 - DNA, 22 bp, Homo sapiens
gacaccagagactgatgaggcc

SEQ ID NO: 7393812 - DNA, 22 bp, Homo sapiens
gacaccagagactgatgaggcc

SEQ ID NO: 7393813 - DNA, 22 bp, Homo sapiens
gacaccagaagacataagcaga

SEQ ID NO: 7393814 - DNA, 22 bp, Homo sapiens
gacaccagagactgatgaggcc

SEQ ID NO: 7393815 - DNA, 22 bp, Homo sapiens
gacaccagcaaggctgtgagga

SEQ ID NO: 7393816 - DNA, 22 bp, Homo sapiens
gacaccagcaaggctgtgagga

SEQ ID NO: 7393817 - DNA, 18 bp, Homo sapiens
gacaccagcctctgcccc

SEQ ID NO: 7393818 - DNA, 18 bp, Homo sapiens
gacaccagcctctgcccc

SEQ ID NO: 7393819 - DNA, 18 bp, Homo sapiens
gacaccagcctctgcccc

SEQ ID NO: 7393820 - DNA, 22 bp, Homo sapiens
gacaccagcaaggctgtgagga

SEQ ID NO: 7393821 - DNA, 22 bp, Homo sapiens
atgtctgataaataatgcataa

SEQ ID NO: 7393822 - DNA, 22 bp, Homo sapiens
atgtctgataaataatgcataa

SEQ ID NO: 7393823 - DNA, 22 bp, Homo sapiens
atgtctgagtctgctccagttg

SEQ ID NO: 7393824 - DNA, 22 bp, Homo sapiens
atgtctgagtctgctccagttg

SEQ ID NO: 7393825 - DNA, 20 bp, Homo sapiens
atgtctgaagtaatccattt

SEQ ID NO: 7393826 - DNA, 20 bp, Homo sapiens
atgtctgaagtaatccattt

SEQ ID NO: 7393827 - DNA, 20 bp, Homo sapiens
atgtctgaagtaatccattt

SEQ ID NO: 7393828 - DNA, 20 bp, Homo sapiens
atgtctgaagtaatccattt

SEQ ID NO: 7393829 - DNA, 20 bp, Homo sapiens
atgtctgaagtaatccattt

SEQ ID NO: 7393830 - DNA, 22 bp, Homo sapiens
atgtctgcggcccaggccaggg

SEQ ID NO: 7393831 - DNA, 22 bp, Homo sapiens
atgtctgcgttatatcaatatc

SEQ ID NO: 7393832 - DNA, 22 bp, Homo sapiens
atgtctgcggcccaggccaggg

SEQ ID NO: 7393833 - DNA, 22 bp, Homo sapiens
atgtctgcaaatatctgccagt

SEQ ID NO: 7393834 - DNA, 22 bp, Homo sapiens
atgtctgataaataatgcataa

SEQ ID NO: 7393835 - DNA, 22 bp, Homo sapiens
atgtctctttactcttagaacc

SEQ ID NO: 7393836 - DNA, 22 bp, Homo sapiens
atgtctctttagagcaacagta

SEQ ID NO: 7393837 - DNA, 22 bp, Homo sapiens
atgtctctttagagcaacagta

SEQ ID NO: 7393838 - DNA, 22 bp, Homo sapiens
atgtctctttagagcaacagta

SEQ ID NO: 7393839 - DNA, 22 bp, Homo sapiens
atgtctctttactcttagaacc

SEQ ID NO: 7393840 - DNA, 22 bp, Homo sapiens
atgtctctttagagcaacagta

SEQ ID NO: 7393841 - DNA, 19 bp, Homo sapiens
atgtctctgtagcacatac

SEQ ID NO: 7393842 - DNA, 19 bp, Homo sapiens
atgtctctgtagcacatac

SEQ ID NO: 7393843 - DNA, 23 bp, Homo sapiens
atgtctctgggcagtagggcttg

SEQ ID NO: 7393844 - DNA, 19 bp, Homo sapiens
atgtctctgtagcacatac

SEQ ID NO: 7393845 - DNA, 19 bp, Homo sapiens
atgtctctgtagcacatac

SEQ ID NO: 7393846 - DNA, 22 bp, Homo sapiens
atgtctctttactcttagaacc

SEQ ID NO: 7393847 - DNA, 22 bp, Homo sapiens
gagggcgcttcagagagatgaa

SEQ ID NO: 7393848 - DNA, 22 bp, Homo sapiens
gagggcgcttcagagagatgaa

SEQ ID NO: 7393849 - DNA, 22 bp, Homo sapiens
gagggcgatggtttcagtttct

SEQ ID NO: 7393850 - DNA, 22 bp, Homo sapiens
gagggcgttcagtcagtgtctc

SEQ ID NO: 7393851 - DNA, 22 bp, Homo sapiens
gagggctcaactactactaggc

SEQ ID NO: 7393852 - DNA, 22 bp, Homo sapiens
gagggctcaactactactaggc

SEQ ID NO: 7393853 - DNA, 22 bp, Homo sapiens
gagggctcaactactactaggc

SEQ ID NO: 7393854 - DNA, 22 bp, Homo sapiens
gagggctcaactactactaggc

SEQ ID NO: 7393855 - DNA, 22 bp, Homo sapiens
gagggctcaactactactaggc

SEQ ID NO: 7393856 - DNA, 22 bp, Homo sapiens
atgtctgctattcatagggaaa

SEQ ID NO: 7393857 - DNA, 22 bp, Homo sapiens
gagggcagagacagtgattcac

SEQ ID NO: 7393858 - DNA, 22 bp, Homo sapiens
atgtctgctttccttttaatca

SEQ ID NO: 7393859 - DNA, 22 bp, Homo sapiens
atgtctgctattcatagggaaa

SEQ ID NO: 7393860 - DNA, 22 bp, Homo sapiens
atgtctgcgttatatcaatatc

SEQ ID NO: 7393861 - DNA, 22 bp, Homo sapiens
gagggcctggcacagggaggct

SEQ ID NO: 7393862 - DNA, 22 bp, Homo sapiens
gagggcgatggtttcagtttct

SEQ ID NO: 7393863 - DNA, 22 bp, Homo sapiens
gagggcagaaaattatgcggtg

SEQ ID NO: 7393864 - DNA, 22 bp, Homo sapiens
gagggctctgtctggaagggaa

SEQ ID NO: 7393865 - DNA, 22 bp, Homo sapiens
gagggctctgtctggaagggaa

SEQ ID NO: 7393866 - DNA, 22 bp, Homo sapiens
gagggctctgtctggaagggaa

SEQ ID NO: 7393867 - DNA, 22 bp, Homo sapiens
gagggctctgtctggaagggaa

SEQ ID NO: 7393868 - DNA, 22 bp, Homo sapiens
gagggctgaagattgtggcccc

SEQ ID NO: 7393869 - DNA, 22 bp, Homo sapiens
gagggctgaagattgtggcccc

SEQ ID NO: 7393870 - DNA, 22 bp, Homo sapiens
gagggctgaagattgtggcccc

SEQ ID NO: 7393871 - DNA, 22 bp, Homo sapiens
gagggctgaagattgtggcccc

SEQ ID NO: 7393872 - DNA, 22 bp, Homo sapiens
gagggctgaagattgtggcccc

SEQ ID NO: 7393873 - DNA, 22 bp, Homo sapiens
gagggctgaagattgtggcccc

SEQ ID NO: 7393874 - DNA, 22 bp, Homo sapiens
gagggctgaagattgtggcccc

SEQ ID NO: 7393875 - DNA, 22 bp, Homo sapiens
gagggctgaagattgtggcccc

SEQ ID NO: 7393876 - DNA, 23 bp, Homo sapiens
gagggctctgagtgcttgggcca

SEQ ID NO: 7393877 - DNA, 23 bp, Homo sapiens
gagggctctgagtgcttgggcca

SEQ ID NO: 7393878 - DNA, 23 bp, Homo sapiens
gagggctctgagtgcttgggcca

SEQ ID NO: 7393879 - DNA, 23 bp, Homo sapiens
gagggctctgagtgcttgggcca

SEQ ID NO: 7393880 - DNA, 23 bp, Homo sapiens
gagggctctgagtgcttgggcca

SEQ ID NO: 7393881 - DNA, 22 bp, Homo sapiens
gagggctctgaaaggaggtcac

SEQ ID NO: 7393882 - DNA, 22 bp, Homo sapiens
gagggctctgaaaggaggtcac

SEQ ID NO: 7393883 - DNA, 22 bp, Homo sapiens
gagggctctgaaaggaggtcac

SEQ ID NO: 7393884 - DNA, 22 bp, Homo sapiens
gagggctctactcaccaccctg

SEQ ID NO: 7393885 - DNA, 22 bp, Homo sapiens
gagggctctaccaagtaactct

SEQ ID NO: 7393886 - DNA, 22 bp, Homo sapiens
gagggctctaccaagtaactct

SEQ ID NO: 7393887 - DNA, 22 bp, Homo sapiens
gagggctctactcaccaccctg

SEQ ID NO: 7393888 - DNA, 22 bp, Homo sapiens
gagggctcactgagaaagcagt

SEQ ID NO: 7393889 - DNA, 22 bp, Homo sapiens
gagggctcactgagaaagcagt

SEQ ID NO: 7393890 - DNA, 22 bp, Homo sapiens
gagggctcactgagaaagcagt

SEQ ID NO: 7393891 - DNA, 22 bp, Homo sapiens
gagggctcactgagaaagcagt

SEQ ID NO: 7393892 - DNA, 22 bp, Homo sapiens
gagggctccattccccgtgccc

SEQ ID NO: 7393893 - DNA, 22 bp, Homo sapiens
gagggctccacacgggcccagc

SEQ ID NO: 7393894 - DNA, 19 bp, Homo sapiens
gagggctcatttgaacaat

SEQ ID NO: 7393895 - DNA, 22 bp, Homo sapiens
gagggctccacacgggcccagc

SEQ ID NO: 7393896 - DNA, 19 bp, Homo sapiens
gagggctcatttgaacaat

SEQ ID NO: 7393897 - DNA, 20 bp, Homo sapiens
gagggctcgtggatggataa

SEQ ID NO: 7393898 - DNA, 20 bp, Homo sapiens
gagggctcgtggatggataa

SEQ ID NO: 7393899 - DNA, 22 bp, Homo sapiens
gagggctcctcacattctctat

SEQ ID NO: 7393900 - DNA, 20 bp, Homo sapiens
gagggctcgtggatggataa

SEQ ID NO: 7393901 - DNA, 20 bp, Homo sapiens
gagggctcgtggatggataa

SEQ ID NO: 7393902 - DNA, 20 bp, Homo sapiens
gagggctcgtggatggataa

SEQ ID NO: 7393903 - DNA, 22 bp, Homo sapiens
gagggctctaccaagtaactct

SEQ ID NO: 7393904 - DNA, 22 bp, Homo sapiens
gagggctctaccaagtaactct

SEQ ID NO: 7393905 - DNA, 22 bp, Homo sapiens
gagggctccattccccgtgccc

SEQ ID NO: 7393906 - DNA, 22 bp, Homo sapiens
gagggctccattccccgtgccc

SEQ ID NO: 7393907 - DNA, 22 bp, Homo sapiens
gagggctcctcacattctctat

SEQ ID NO: 7393908 - DNA, 22 bp, Homo sapiens
gagggctcctcacattctctat

SEQ ID NO: 7393909 - DNA, 22 bp, Homo sapiens
gagggctcctcacattctctat

SEQ ID NO: 7393910 - DNA, 22 bp, Homo sapiens
atgtgagcagggagatgctgcc

SEQ ID NO: 7393911 - DNA, 22 bp, Homo sapiens
atgtgagcaggtgctggctgct

SEQ ID NO: 7393912 - DNA, 22 bp, Homo sapiens
atgtgagatgcacataattata

SEQ ID NO: 7393913 - DNA, 22 bp, Homo sapiens
atgtgagatgcacataattata

SEQ ID NO: 7393914 - DNA, 22 bp, Homo sapiens
atgtgagatgcacataattata

SEQ ID NO: 7393915 - DNA, 22 bp, Homo sapiens
atgtgagctccggcaggtggaa

SEQ ID NO: 7393916 - DNA, 22 bp, Homo sapiens
atgtgagaataactcaaaacaa

SEQ ID NO: 7393917 - DNA, 22 bp, Homo sapiens
atgtgagaactcaggaaatact

SEQ ID NO: 7393918 - DNA, 22 bp, Homo sapiens
atgtgagactaaaaagatgtgc

SEQ ID NO: 7393919 - DNA, 22 bp, Homo sapiens
atgtgagactaaaaagatgtgc

SEQ ID NO: 7393920 - DNA, 18 bp, Homo sapiens
atgtgagagaatcttctt

SEQ ID NO: 7393921 - DNA, 18 bp, Homo sapiens
atgtgagagaatcttctt

SEQ ID NO: 7393922 - DNA, 22 bp, Homo sapiens
atgtgactccaggcagttttgt

SEQ ID NO: 7393923 - DNA, 22 bp, Homo sapiens
atgtgacttcagtcttcttaca

SEQ ID NO: 7393924 - DNA, 22 bp, Homo sapiens
atgtgactttgtgtcttccatc

SEQ ID NO: 7393925 - DNA, 22 bp, Homo sapiens
atgtgacagtgtttgacagatg

SEQ ID NO: 7393926 - DNA, 22 bp, Homo sapiens
atgtgactccaggcagttttgt

SEQ ID NO: 7393927 - DNA, 22 bp, Homo sapiens
atgtgactagcccttcatgacc

SEQ ID NO: 7393928 - DNA, 22 bp, Homo sapiens
atgtgactccacagctgtgctg

SEQ ID NO: 7393929 - DNA, 22 bp, Homo sapiens
atgtgagggaaatcagtcagaa

SEQ ID NO: 7393930 - DNA, 22 bp, Homo sapiens
atgtgagggctcaggctgactg

SEQ ID NO: 7393931 - DNA, 22 bp, Homo sapiens
gaggtagggcagaggctgaatg

SEQ ID NO: 7393932 - DNA, 22 bp, Homo sapiens
gaggtagggcagaggctgaatg

SEQ ID NO: 7393933 - DNA, 22 bp, Homo sapiens
atgtgagggctcaggctgactg

SEQ ID NO: 7393934 - DNA, 22 bp, Homo sapiens
gaggtagggcagaggctgaatg

SEQ ID NO: 7393935 - DNA, 20 bp, Homo sapiens
gaggtagggcttaaggcaag

SEQ ID NO: 7393936 - DNA, 22 bp, Homo sapiens
gaggtagggcagaggctgaatg

SEQ ID NO: 7393937 - DNA, 20 bp, Homo sapiens
gaggtagggcttaaggcaag

SEQ ID NO: 7393938 - DNA, 20 bp, Homo sapiens
gaggtagggcttaaggcaag

SEQ ID NO: 7393939 - DNA, 20 bp, Homo sapiens
gaggtagggcttaaggcaag

SEQ ID NO: 7393940 - DNA, 22 bp, Homo sapiens
gaggtggatgttgcagtgagct

SEQ ID NO: 7393941 - DNA, 22 bp, Homo sapiens
gaggtaggtgtaggaggcctgc

SEQ ID NO: 7393942 - DNA, 22 bp, Homo sapiens
gaggtggatgttgcagtgagct

SEQ ID NO: 7393943 - DNA, 22 bp, Homo sapiens
gaggtggatgttgcagtgagct

SEQ ID NO: 7393944 - DNA, 22 bp, Homo sapiens
gaggtggatgttgcagtgagct

SEQ ID NO: 7393945 - DNA, 23 bp, Homo sapiens
gaggtggcaatgagggcagttgg

SEQ ID NO: 7393946 - DNA, 23 bp, Homo sapiens
gaggtggcaatgagggcagttgg

SEQ ID NO: 7393947 - DNA, 22 bp, Homo sapiens
gaggtggatgttgcagtgagct

SEQ ID NO: 7393948 - DNA, 22 bp, Homo sapiens
gagggctgaagtgttttatgag

SEQ ID NO: 7393949 - DNA, 22 bp, Homo sapiens
atgtgaaactgaagcatccata

SEQ ID NO: 7393950 - DNA, 22 bp, Homo sapiens
atgtgaaacgcaatgggatcat

SEQ ID NO: 7393951 - DNA, 22 bp, Homo sapiens
gagggctgaagattgtggcccc

SEQ ID NO: 7393952 - DNA, 22 bp, Homo sapiens
gagggctgaagattgtggcccc

SEQ ID NO: 7393953 - DNA, 22 bp, Homo sapiens
gagggctgaagattgtggcccc

SEQ ID NO: 7393954 - DNA, 22 bp, Homo sapiens
atgtgaaagaggtgttcagtgg

SEQ ID NO: 7393955 - DNA, 20 bp, Homo sapiens
atgtgaaagatcagttgtct

SEQ ID NO: 7393956 - DNA, 20 bp, Homo sapiens
atgtgaaagatcagttgtct

SEQ ID NO: 7393957 - DNA, 20 bp, Homo sapiens
atgtgaaagatcagttgtct

SEQ ID NO: 7393958 - DNA, 22 bp, Homo sapiens
atgtgaaatagctggatatgaa

SEQ ID NO: 7393959 - DNA, 22 bp, Homo sapiens
atgtgaaatagctggatatgaa

SEQ ID NO: 7393960 - DNA, 22 bp, Homo sapiens
atgtgaatgcagttatctataa

SEQ ID NO: 7393961 - DNA, 22 bp, Homo sapiens
atgtgaatgcagttatctataa

SEQ ID NO: 7393962 - DNA, 22 bp, Homo sapiens
atgtgaatgcagttatctataa

SEQ ID NO: 7393963 - DNA, 22 bp, Homo sapiens
atgtgaatgcagttatctataa

SEQ ID NO: 7393964 - DNA, 20 bp, Homo sapiens
atgtgaagtaggaagggtgt

SEQ ID NO: 7393965 - DNA, 22 bp, Homo sapiens
atgtgacagtgtttgacagatg

SEQ ID NO: 7393966 - DNA, 22 bp, Homo sapiens
atgtgacagtgtttgacagatg

SEQ ID NO: 7393967 - DNA, 22 bp, Homo sapiens
atgtgacagtgtttgacagatg

SEQ ID NO: 7393968 - DNA, 22 bp, Homo sapiens
atgtgacaatatttggtcttat

SEQ ID NO: 7393969 - DNA, 22 bp, Homo sapiens
atgtgacaatatttggtcttat

SEQ ID NO: 7393970 - DNA, 21 bp, Homo sapiens
atgtgaaatatcatcagagca

SEQ ID NO: 7393971 - DNA, 21 bp, Homo sapiens
atgtgaaatatcatcagagca

SEQ ID NO: 7393972 - DNA, 21 bp, Homo sapiens
atgtgaaatatcatcagagca

SEQ ID NO: 7393973 - DNA, 21 bp, Homo sapiens
atgtgaaatatcatcagagca

SEQ ID NO: 7393974 - DNA, 21 bp, Homo sapiens
atgtgaaatatcatcagagca

SEQ ID NO: 7393975 - DNA, 22 bp, Homo sapiens
atgtgaaatattaagccgagga

SEQ ID NO: 7393976 - DNA, 22 bp, Homo sapiens
atgtgaactctgtactctctga

SEQ ID NO: 7393977 - DNA, 22 bp, Homo sapiens
atgtgaagcttgtgctaacata

SEQ ID NO: 7393978 - DNA, 19 bp, Homo sapiens
atgtctctgtagcacatac

SEQ ID NO: 7393979 - DNA, 22 bp, Homo sapiens
atgtctctgctgtggttagctt

SEQ ID NO: 7393980 - DNA, 19 bp, Homo sapiens
atgtctctgtagcacatac

SEQ ID NO: 7393981 - DNA, 19 bp, Homo sapiens
atgtctctgtagcacatac

SEQ ID NO: 7393982 - DNA, 23 bp, Homo sapiens
atgtctctgggcagtagggcttg

SEQ ID NO: 7393983 - DNA, 22 bp, Homo sapiens
atgtctctgccccagagagctt

SEQ ID NO: 7393984 - DNA, 22 bp, Homo sapiens
atgtctctctctgagtgccaga

SEQ ID NO: 7393985 - DNA, 22 bp, Homo sapiens
atgtctctgctgtggttagctt

SEQ ID NO: 7393986 - DNA, 22 bp, Homo sapiens
atgtctctgctgtggttagctt

SEQ ID NO: 7393987 - DNA, 22 bp, Homo sapiens
atgtctctgccccagagagctt

SEQ ID NO: 7393988 - DNA, 22 bp, Homo sapiens
atgtctctctctgagtgccaga

SEQ ID NO: 7393989 - DNA, 22 bp, Homo sapiens
atgtctctgccccagagagctt

SEQ ID NO: 7393990 - DNA, 22 bp, Homo sapiens
atgtctctcatgaccaaagaag

SEQ ID NO: 7393991 - DNA, 22 bp, Homo sapiens
atgtctctcatgaccaaagaag

SEQ ID NO: 7393992 - DNA, 22 bp, Homo sapiens
atgtctctctctgagtgccaga

SEQ ID NO: 7393993 - DNA, 22 bp, Homo sapiens
atgtctctcaggtttaacttta

SEQ ID NO: 7393994 - DNA, 22 bp, Homo sapiens
atgtctctcaggtttaacttta

SEQ ID NO: 7393995 - DNA, 22 bp, Homo sapiens
atgtctatgttctttactgtgt

SEQ ID NO: 7393996 - DNA, 22 bp, Homo sapiens
atgtctctcaggtttaacttta

SEQ ID NO: 7393997 - DNA, 22 bp, Homo sapiens
atgtctatatagtcaataatca

SEQ ID NO: 7393998 - DNA, 22 bp, Homo sapiens
atgtctatatagtcaataatca

SEQ ID NO: 7393999 - DNA, 22 bp, Homo sapiens
atgtctagagcaagagatgctg

SEQ ID NO: 7394000 - DNA, 22 bp, Homo sapiens
atgtctaaaagataaagtttaa

SEQ ID NO: 7394001 - DNA, 22 bp, Homo sapiens
atgtctaaaagataaagtttaa

SEQ ID NO: 7394002 - DNA, 21 bp, Homo sapiens
atgtctatgacatatttcctt

SEQ ID NO: 7394003 - DNA, 22 bp, Homo sapiens
atgtctatatagtcaataatca

SEQ ID NO: 7394004 - DNA, 22 bp, Homo sapiens
atgtctatggaatttccacaca

SEQ ID NO: 7394005 - DNA, 22 bp, Homo sapiens
atgtcctttgtatccctaggca

SEQ ID NO: 7394006 - DNA, 22 bp, Homo sapiens
atgtccttttaaaatgtgagaa

SEQ ID NO: 7394007 - DNA, 22 bp, Homo sapiens
atgtcctttgttctgagggagt

SEQ ID NO: 7394008 - DNA, 22 bp, Homo sapiens
atgtccttttatttaaagcagg

SEQ ID NO: 7394009 - DNA, 22 bp, Homo sapiens
atgtccttttaaaatgtgagaa

SEQ ID NO: 7394010 - DNA, 22 bp, Homo sapiens
atgtccttttatttaaagcagg

SEQ ID NO: 7394011 - DNA, 22 bp, Homo sapiens
atgtccttttatttaaagcagg

SEQ ID NO: 7394012 - DNA, 22 bp, Homo sapiens
atgtcctcttctgcctcaggcc

SEQ ID NO: 7394013 - DNA, 22 bp, Homo sapiens
atgtcctcttctgcctcaggcc

SEQ ID NO: 7394014 - DNA, 23 bp, Homo sapiens
atgtcctgcatagttgcttctgt

SEQ ID NO: 7394015 - DNA, 20 bp, Homo sapiens
atgtcctgcttctcctcacc

SEQ ID NO: 7394016 - DNA, 23 bp, Homo sapiens
atgtcctgtgatgcttaatgacc

SEQ ID NO: 7394017 - DNA, 22 bp, Homo sapiens
atgtcctgttaaatagattgta

SEQ ID NO: 7394018 - DNA, 22 bp, Homo sapiens
atgtcctgggctgggttatgtt

SEQ ID NO: 7394019 - DNA, 22 bp, Homo sapiens
atgtcctggggtcttctcttca

SEQ ID NO: 7394020 - DNA, 22 bp, Homo sapiens
atgtccttccattttgatctgt

SEQ ID NO: 7394021 - DNA, 22 bp, Homo sapiens
atgtccttcatctaggagatgg

SEQ ID NO: 7394022 - DNA, 22 bp, Homo sapiens
atgtccttaatctgaatgttag

SEQ ID NO: 7394023 - DNA, 22 bp, Homo sapiens
atgtccttcggacaaaattctt

SEQ ID NO: 7394024 - DNA, 22 bp, Homo sapiens
atgtccttcggacaaaattctt

SEQ ID NO: 7394025 - DNA, 22 bp, Homo sapiens
atgtccttcctgagatccctgt

SEQ ID NO: 7394026 - DNA, 22 bp, Homo sapiens
atgtccttgtgagtaaatgatg

SEQ ID NO: 7394027 - DNA, 22 bp, Homo sapiens
atgtccttgtgagtaaatgatg

SEQ ID NO: 7394028 - DNA, 22 bp, Homo sapiens
atgtccttgagaccctcctcgg

SEQ ID NO: 7394029 - DNA, 22 bp, Homo sapiens
atgtccttggaacacctgaggt

SEQ ID NO: 7394030 - DNA, 22 bp, Homo sapiens
atgtagacctttctttgtgatt

SEQ ID NO: 7394031 - DNA, 15 bp, Homo sapiens
atgtagagagatatg

SEQ ID NO: 7394032 - DNA, 22 bp, Homo sapiens
atgtagagcagtgttgtccaat

SEQ ID NO: 7394033 - DNA, 22 bp, Homo sapiens
atgtagaattccttctactttg

SEQ ID NO: 7394034 - DNA, 22 bp, Homo sapiens
atgtagaattccttctactttg

SEQ ID NO: 7394035 - DNA, 22 bp, Homo sapiens
atgtagagctccttgatcctcc

SEQ ID NO: 7394036 - DNA, 22 bp, Homo sapiens
atgtagaggagtttctggtctg

SEQ ID NO: 7394037 - DNA, 22 bp, Homo sapiens
atgtagagctccttgatcctcc

SEQ ID NO: 7394038 - DNA, 22 bp, Homo sapiens
atgtagaggagtttctggtctg

SEQ ID NO: 7394039 - DNA, 22 bp, Homo sapiens
atgtagagggtttggccaggag

SEQ ID NO: 7394040 - DNA, 22 bp, Homo sapiens
atgtagagggtttggccaggag

SEQ ID NO: 7394041 - DNA, 22 bp, Homo sapiens
atgtagagtagaatagtacaac

SEQ ID NO: 7394042 - DNA, 22 bp, Homo sapiens
atgtagaagctgacagtgctgt

SEQ ID NO: 7394043 - DNA, 22 bp, Homo sapiens
atgtagaagtgggcattataga

SEQ ID NO: 7394044 - DNA, 22 bp, Homo sapiens
atgtagaagtgggcattataga

SEQ ID NO: 7394045 - DNA, 22 bp, Homo sapiens
atgtagaagtgggcattataga

SEQ ID NO: 7394046 - DNA, 22 bp, Homo sapiens
atgtagaatggtgattggcagg

SEQ ID NO: 7394047 - DNA, 22 bp, Homo sapiens
atgtagaaataatttcagttcc

SEQ ID NO: 7394048 - DNA, 22 bp, Homo sapiens
atgtagaaataatttcagttcc

SEQ ID NO: 7394049 - DNA, 22 bp, Homo sapiens
gaggcagcgggtcaggaccgtg

SEQ ID NO: 7394050 - DNA, 22 bp, Homo sapiens
gaggcagcgggtcaggaccgtg

SEQ ID NO: 7394051 - DNA, 22 bp, Homo sapiens
atgtagaacaggttaatgacag

SEQ ID NO: 7394052 - DNA, 22 bp, Homo sapiens
atgtagaaattaggatgatagt

SEQ ID NO: 7394053 - DNA, 22 bp, Homo sapiens
gaggcagcgggtcaggaccgtg

SEQ ID NO: 7394054 - DNA, 22 bp, Homo sapiens
gaggcagcgggtcaggaccgtg

SEQ ID NO: 7394055 - DNA, 22 bp, Homo sapiens
gaggcagcgggtcaggaccgtg

SEQ ID NO: 7394056 - DNA, 22 bp, Homo sapiens
gaggcagcgggtcaggaccgtg

SEQ ID NO: 7394057 - DNA, 22 bp, Homo sapiens
gaggcagcggctcacagagaaa

SEQ ID NO: 7394058 - DNA, 22 bp, Homo sapiens
gaggcagcggctcacagagaaa

SEQ ID NO: 7394059 - DNA, 22 bp, Homo sapiens
gaggcagcggctcacagagaaa

SEQ ID NO: 7394060 - DNA, 22 bp, Homo sapiens
gaggcagcggctcacagagaaa

SEQ ID NO: 7394061 - DNA, 22 bp, Homo sapiens
atgtagatttgcttctcctgcc

SEQ ID NO: 7394062 - DNA, 22 bp, Homo sapiens
atgtagcagaagatgttttcct

SEQ ID NO: 7394063 - DNA, 22 bp, Homo sapiens
atgtagcagaggagacgtgtgt

SEQ ID NO: 7394064 - DNA, 22 bp, Homo sapiens
atgtagcagaagatgttttcct

SEQ ID NO: 7394065 - DNA, 22 bp, Homo sapiens
atgtagatgcaccaagactgct

SEQ ID NO: 7394066 - DNA, 22 bp, Homo sapiens
atgtagatgcaatggatgtcct

SEQ ID NO: 7394067 - DNA, 22 bp, Homo sapiens
atgtagagtagaatagtacaac

SEQ ID NO: 7394068 - DNA, 22 bp, Homo sapiens
atgtagagtagaatagtacaac

SEQ ID NO: 7394069 - DNA, 23 bp, Homo sapiens
atgtagagtacagcacaacagca

SEQ ID NO: 7394070 - DNA, 23 bp, Homo sapiens
atgtagagtacagcacaacagca

SEQ ID NO: 7394071 - DNA, 22 bp, Homo sapiens
atgtagctgcagatgataatgc

SEQ ID NO: 7394072 - DNA, 22 bp, Homo sapiens
atgtagcatgcatgttgttttg

SEQ ID NO: 7394073 - DNA, 22 bp, Homo sapiens
atgtcatgaaatgctactaact

SEQ ID NO: 7394074 - DNA, 22 bp, Homo sapiens
atgtcatgaaatgctactaact

SEQ ID NO: 7394075 - DNA, 22 bp, Homo sapiens
atgtcatgaaatgctactaact

SEQ ID NO: 7394076 - DNA, 22 bp, Homo sapiens
atgtagctgcagatgataatgc

SEQ ID NO: 7394077 - DNA, 22 bp, Homo sapiens
atgtagctgcagatgataatgc

SEQ ID NO: 7394078 - DNA, 20 bp, Homo sapiens
atgtagcagtgtgctgggaa

SEQ ID NO: 7394079 - DNA, 22 bp, Homo sapiens
atgtagcagatatttgtgcaca

SEQ ID NO: 7394080 - DNA, 22 bp, Homo sapiens
atgtagcatctatcctgataaa

SEQ ID NO: 7394081 - DNA, 22 bp, Homo sapiens
atgtagcatctatcctgataaa

SEQ ID NO: 7394082 - DNA, 22 bp, Homo sapiens
atgtagcatgaggcactgtgcc

SEQ ID NO: 7394083 - DNA, 22 bp, Homo sapiens
atgtagcatgaggcactgtgcc

SEQ ID NO: 7394084 - DNA, 20 bp, Homo sapiens
atgtcctcagccactgccct

SEQ ID NO: 7394085 - DNA, 22 bp, Homo sapiens
atgtcccttgtctgtgatgtct

SEQ ID NO: 7394086 - DNA, 22 bp, Homo sapiens
atgtcctcggctctgtgctgct

SEQ ID NO: 7394087 - DNA, 22 bp, Homo sapiens
atgtcatttaaatgtttgtata

SEQ ID NO: 7394088 - DNA, 23 bp, Homo sapiens
atgtccccttcttgatgcctggc

SEQ ID NO: 7394089 - DNA, 22 bp, Homo sapiens
atgtcatgaaatgctactaact

SEQ ID NO: 7394090 - DNA, 22 bp, Homo sapiens
atgtcatgggccaaaaatagtt

SEQ ID NO: 7394091 - DNA, 22 bp, Homo sapiens
atgtcatgggccaaaaatagtt

SEQ ID NO: 7394092 - DNA, 22 bp, Homo sapiens
atgtcatgggccaaaaatagtt

SEQ ID NO: 7394093 - DNA, 22 bp, Homo sapiens
atgtcatgaggctagcccccaa

SEQ ID NO: 7394094 - DNA, 22 bp, Homo sapiens
atgttctttcagccagtgcatc

SEQ ID NO: 7394095 - DNA, 22 bp, Homo sapiens
atgttctttcagccagtgcatc

SEQ ID NO: 7394096 - DNA, 22 bp, Homo sapiens
atgttctttgaaatattttaga

SEQ ID NO: 7394097 - DNA, 22 bp, Homo sapiens
atgttctttgaaatattttaga

SEQ ID NO: 7394098 - DNA, 22 bp, Homo sapiens
atgttctttgaaatattttaga

SEQ ID NO: 7394099 - DNA, 22 bp, Homo sapiens
atgttctttcagccagtgcatc

SEQ ID NO: 7394100 - DNA, 22 bp, Homo sapiens
atgttcttgttcaaatgtcagt

SEQ ID NO: 7394101 - DNA, 22 bp, Homo sapiens
atgttcttgttcaaatgtcagt

SEQ ID NO: 7394102 - DNA, 22 bp, Homo sapiens
atgttcttgttcaaatgtcagt

SEQ ID NO: 7394103 - DNA, 22 bp, Homo sapiens
atgttcttgttcaaatgtcagt

SEQ ID NO: 7394104 - DNA, 22 bp, Homo sapiens
atgttcttgttcaaatgtcagt

SEQ ID NO: 7394105 - DNA, 22 bp, Homo sapiens
atgttgcacaaagtccatccat

SEQ ID NO: 7394106 - DNA, 22 bp, Homo sapiens
atgttgcacaaagtccatccat

SEQ ID NO: 7394107 - DNA, 22 bp, Homo sapiens
atgttctttggaatttatgaaa

SEQ ID NO: 7394108 - DNA, 22 bp, Homo sapiens
atgttctttggaatttatgaaa

SEQ ID NO: 7394109 - DNA, 22 bp, Homo sapiens
atgttctttgtgattctgagct

SEQ ID NO: 7394110 - DNA, 22 bp, Homo sapiens
atgttcttccaaatctgtaaca

SEQ ID NO: 7394111 - DNA, 20 bp, Homo sapiens
atgttcttcatttaatgttc

SEQ ID NO: 7394112 - DNA, 20 bp, Homo sapiens
atgttcttcatttaatgttc

SEQ ID NO: 7394113 - DNA, 20 bp, Homo sapiens
atgttcttcatttaatgttc

SEQ ID NO: 7394114 - DNA, 20 bp, Homo sapiens
atgttcttcatttaatgttc

SEQ ID NO: 7394115 - DNA, 22 bp, Homo sapiens
atgttcttagcaaagtacttgc

SEQ ID NO: 7394116 - DNA, 22 bp, Homo sapiens
atgttcttagcaaagtacttgc

SEQ ID NO: 7394117 - DNA, 22 bp, Homo sapiens
atgttctgttttgtaattcata

SEQ ID NO: 7394118 - DNA, 22 bp, Homo sapiens
atgttctgttttgtaattcata

SEQ ID NO: 7394119 - DNA, 22 bp, Homo sapiens
atgttcttatcattctttcgga

SEQ ID NO: 7394120 - DNA, 20 bp, Homo sapiens
atgttcttcatttaatgttc

SEQ ID NO: 7394121 - DNA, 20 bp, Homo sapiens
atgttcttcatttaatgttc

SEQ ID NO: 7394122 - DNA, 22 bp, Homo sapiens
atgttcttggatgttgtgtata

SEQ ID NO: 7394123 - DNA, 22 bp, Homo sapiens
atgttcttgactttcctgcctg

SEQ ID NO: 7394124 - DNA, 22 bp, Homo sapiens
atgttcttctatctttattaaa

SEQ ID NO: 7394125 - DNA, 22 bp, Homo sapiens
atgttcttggatgttgtgtata

SEQ ID NO: 7394126 - DNA, 22 bp, Homo sapiens
atgttcttggatgttgtgtata

SEQ ID NO: 7394127 - DNA, 22 bp, Homo sapiens
atgttcttggatgttgtgtata

SEQ ID NO: 7394128 - DNA, 22 bp, Homo sapiens
atgttcttggatgttgtgtata

SEQ ID NO: 7394129 - DNA, 22 bp, Homo sapiens
atgttcttccttcaatttggaa

SEQ ID NO: 7394130 - DNA, 22 bp, Homo sapiens
atgttcttccaaatctgtaaca

SEQ ID NO: 7394131 - DNA, 22 bp, Homo sapiens
atgttcttccaaatctgtaaca

SEQ ID NO: 7394132 - DNA, 22 bp, Homo sapiens
atgttcttccaaatctgtaaca

SEQ ID NO: 7394133 - DNA, 22 bp, Homo sapiens
atgttcttctatctttattaaa

SEQ ID NO: 7394134 - DNA, 22 bp, Homo sapiens
atgttcttctatctttattaaa

SEQ ID NO: 7394135 - DNA, 22 bp, Homo sapiens
atgttcttctatctttattaaa

SEQ ID NO: 7394136 - DNA, 22 bp, Homo sapiens
atgttattttggaaaatacaaa

SEQ ID NO: 7394137 - DNA, 22 bp, Homo sapiens
atgttattttggaaaatacaaa

SEQ ID NO: 7394138 - DNA, 22 bp, Homo sapiens
atgtgtcttctaagccaagcct

SEQ ID NO: 7394139 - DNA, 22 bp, Homo sapiens
atgttattttggaaaatacaaa

SEQ ID NO: 7394140 - DNA, 22 bp, Homo sapiens
atgttattttggaaaatacaaa

SEQ ID NO: 7394141 - DNA, 22 bp, Homo sapiens
atgttattttggaaaatacaaa

SEQ ID NO: 7394142 - DNA, 22 bp, Homo sapiens
atgttattttggaaaatacaaa

SEQ ID NO: 7394143 - DNA, 22 bp, Homo sapiens
atgttctgaataatgtgcatta

SEQ ID NO: 7394144 - DNA, 22 bp, Homo sapiens
atgttctgaataatgtgcatta

SEQ ID NO: 7394145 - DNA, 22 bp, Homo sapiens
atgttctgaataatgtgcatta

SEQ ID NO: 7394146 - DNA, 22 bp, Homo sapiens
atgttctgaatcaagcaactct

SEQ ID NO: 7394147 - DNA, 22 bp, Homo sapiens
atgttctgtttcttaatcttga

SEQ ID NO: 7394148 - DNA, 22 bp, Homo sapiens
atgttctgtttcttaatcttga

SEQ ID NO: 7394149 - DNA, 20 bp, Homo sapiens
atgttctgtggctgtcatgg

SEQ ID NO: 7394150 - DNA, 20 bp, Homo sapiens
atgttctgtggctgtcatgg

SEQ ID NO: 7394151 - DNA, 22 bp, Homo sapiens
atgttctgtttcttaatcttga

SEQ ID NO: 7394152 - DNA, 22 bp, Homo sapiens
atgttctgaatcaagcaactct

SEQ ID NO: 7394153 - DNA, 19 bp, Homo sapiens
atgttctgaattactgtaa

SEQ ID NO: 7394154 - DNA, 19 bp, Homo sapiens
atgttctgaattactgtaa

SEQ ID NO: 7394155 - DNA, 22 bp, Homo sapiens
atgttctgcctccattttgagt

SEQ ID NO: 7394156 - DNA, 22 bp, Homo sapiens
atgttctgcctccattttgagt

SEQ ID NO: 7394157 - DNA, 20 bp, Homo sapiens
atgtgtcttagagcatcagg

SEQ ID NO: 7394158 - DNA, 22 bp, Homo sapiens
atgtgtcttatttgattccaca

SEQ ID NO: 7394159 - DNA, 22 bp, Homo sapiens
atgtgtcttctaagccaagcct

SEQ ID NO: 7394160 - DNA, 22 bp, Homo sapiens
atgtgtcttatttgattccaca

SEQ ID NO: 7394161 - DNA, 22 bp, Homo sapiens
atgtgtcttatttgattccaca

SEQ ID NO: 7394162 - DNA, 22 bp, Homo sapiens
atgtgtcttatttgattccaca

SEQ ID NO: 7394163 - DNA, 22 bp, Homo sapiens
atgtgtcttctaagccaagcct

SEQ ID NO: 7394164 - DNA, 22 bp, Homo sapiens
atgtgtctgtgggcacacacac

SEQ ID NO: 7394165 - DNA, 22 bp, Homo sapiens
atgtgtctgtgggcacacacac

SEQ ID NO: 7394166 - DNA, 22 bp, Homo sapiens
atgtgtctgtgggcacacacac

SEQ ID NO: 7394167 - DNA, 20 bp, Homo sapiens
atgtgtcttagagcatcagg

SEQ ID NO: 7394168 - DNA, 20 bp, Homo sapiens
atgtgtcttagagcatcagg

SEQ ID NO: 7394169 - DNA, 20 bp, Homo sapiens
atgtgtcttagagcatcagg

SEQ ID NO: 7394170 - DNA, 22 bp, Homo sapiens
atgtgtctggttattgacatgc

SEQ ID NO: 7394171 - DNA, 22 bp, Homo sapiens
atgtgtctggttattgacatgc

SEQ ID NO: 7394172 - DNA, 22 bp, Homo sapiens
atgtgtctggcatggctctatt

SEQ ID NO: 7394173 - DNA, 22 bp, Homo sapiens
atgtgtctggcatggctctatt

SEQ ID NO: 7394174 - DNA, 20 bp, Homo sapiens
atgtgtctgtaaacaactct

SEQ ID NO: 7394175 - DNA, 22 bp, Homo sapiens
atgtgtctggttattgacatgc

SEQ ID NO: 7394176 - DNA, 20 bp, Homo sapiens
atgtgtctgtaaacaactct

SEQ ID NO: 7394177 - DNA, 20 bp, Homo sapiens
atgtgtctgtaaacaactct

SEQ ID NO: 7394178 - DNA, 22 bp, Homo sapiens
gaggtggccagagtcaagagcc

SEQ ID NO: 7394179 - DNA, 22 bp, Homo sapiens
gaggtggccagagtcaagagcc

SEQ ID NO: 7394180 - DNA, 22 bp, Homo sapiens
gaggtggccagagtcaagagcc

SEQ ID NO: 7394181 - DNA, 22 bp, Homo sapiens
gaggtggccagagtcaagagcc

SEQ ID NO: 7394182 - DNA, 22 bp, Homo sapiens
gaggtggccagagtcaagagcc

SEQ ID NO: 7394183 - DNA, 22 bp, Homo sapiens
gaggtggccaagcgaggaaggg

SEQ ID NO: 7394184 - DNA, 22 bp, Homo sapiens
gaggtggccaagcgaggaaggg

SEQ ID NO: 7394185 - DNA, 22 bp, Homo sapiens
gaggtggcattaagattctggt

SEQ ID NO: 7394186 - DNA, 22 bp, Homo sapiens
gaggtggccaagcgaggaaggg

SEQ ID NO: 7394187 - DNA, 22 bp, Homo sapiens
gaggtggccaagcgaggaaggg

SEQ ID NO: 7394188 - DNA, 22 bp, Homo sapiens
gaggtggccaagcgaggaaggg

SEQ ID NO: 7394189 - DNA, 22 bp, Homo sapiens
gaggtggcctcaagcagtcttc

SEQ ID NO: 7394190 - DNA, 22 bp, Homo sapiens
gaggtggcccttgctcagcctt

SEQ ID NO: 7394191 - DNA, 22 bp, Homo sapiens
gaggtggcctcaagcagtcttc

SEQ ID NO: 7394192 - DNA, 22 bp, Homo sapiens
gaggtggcctcaagcagtcttc

SEQ ID NO: 7394193 - DNA, 22 bp, Homo sapiens
gaggtggcctcaagcagtcttc

SEQ ID NO: 7394194 - DNA, 22 bp, Homo sapiens
gaggtggcctcaagcagtcttc

SEQ ID NO: 7394195 - DNA, 22 bp, Homo sapiens
gaggtggcccttgctcagcctt

SEQ ID NO: 7394196 - DNA, 22 bp, Homo sapiens
gaggtggcccttgctcagcctt

SEQ ID NO: 7394197 - DNA, 22 bp, Homo sapiens
gaggtggcccttgctcagcctt

SEQ ID NO: 7394198 - DNA, 22 bp, Homo sapiens
gaggtggcccttgctcagcctt

SEQ ID NO: 7394199 - DNA, 22 bp, Homo sapiens
gaggtggcccttgctcagcctt

SEQ ID NO: 7394200 - DNA, 22 bp, Homo sapiens
gaggtggcagaggcctggacct

SEQ ID NO: 7394201 - DNA, 22 bp, Homo sapiens
gaggtggcattaagattctggt

SEQ ID NO: 7394202 - DNA, 22 bp, Homo sapiens
gaggtggcagaggcctggacct

SEQ ID NO: 7394203 - DNA, 22 bp, Homo sapiens
gaggtggcagaggcctggacct

SEQ ID NO: 7394204 - DNA, 22 bp, Homo sapiens
gaggtggcactgtgaggagcac

SEQ ID NO: 7394205 - DNA, 22 bp, Homo sapiens
gaggtggcactgtgaggagcac

SEQ ID NO: 7394206 - DNA, 22 bp, Homo sapiens
gaggtggcactgtgaggagcac

SEQ ID NO: 7394207 - DNA, 22 bp, Homo sapiens
gaggtggcactgtgaggagcac

SEQ ID NO: 7394208 - DNA, 22 bp, Homo sapiens
gaggtggcactgtgaggagcac

SEQ ID NO: 7394209 - DNA, 22 bp, Homo sapiens
gaggtggcactgtgaggagcac

SEQ ID NO: 7394210 - DNA, 22 bp, Homo sapiens
gaggtggcactgtgaggagcac

SEQ ID NO: 7394211 - DNA, 22 bp, Homo sapiens
gaggtggcactgtgaggagcac

SEQ ID NO: 7394212 - DNA, 22 bp, Homo sapiens
gaggtggcactgtgaggagcac

SEQ ID NO: 7394213 - DNA, 22 bp, Homo sapiens
gaggtggcaatttaatgcagtc

SEQ ID NO: 7394214 - DNA, 23 bp, Homo sapiens
gaggtggcaatgagggcagttgg

SEQ ID NO: 7394215 - DNA, 22 bp, Homo sapiens
gaggtggcaatttaatgcagtc

SEQ ID NO: 7394216 - DNA, 22 bp, Homo sapiens
gaggtggcactgtgaggagcac

SEQ ID NO: 7394217 - DNA, 22 bp, Homo sapiens
gaggtggcactgtgaggagcac

SEQ ID NO: 7394218 - DNA, 22 bp, Homo sapiens
atgtgtctggcatggaaagtgt

SEQ ID NO: 7394219 - DNA, 20 bp, Homo sapiens
atgtgtctgcctctgtgttc

SEQ ID NO: 7394220 - DNA, 20 bp, Homo sapiens
atgtgtctgcctctgtgttc

SEQ ID NO: 7394221 - DNA, 22 bp, Homo sapiens
atgtgtctgatggccctgaatt

SEQ ID NO: 7394222 - DNA, 22 bp, Homo sapiens
atgtgtctggcatggaaagtgt

SEQ ID NO: 7394223 - DNA, 22 bp, Homo sapiens
atgtgtctggcatggaaagtgt

SEQ ID NO: 7394224 - DNA, 20 bp, Homo sapiens
atgtgtctgcctctgtgttc

SEQ ID NO: 7394225 - DNA, 22 bp, Homo sapiens
atgtgtctgatggccctgaatt

SEQ ID NO: 7394226 - DNA, 22 bp, Homo sapiens
atgtgtctgatggccctgaatt

SEQ ID NO: 7394227 - DNA, 17 bp, Homo sapiens
atgtgtctgagtgtcct

SEQ ID NO: 7394228 - DNA, 17 bp, Homo sapiens
atgtgtctgagtgtcct

SEQ ID NO: 7394229 - DNA, 22 bp, Homo sapiens
atgtgtctctaaaatttagtaa

SEQ ID NO: 7394230 - DNA, 22 bp, Homo sapiens
atgtgtctctaaaatttagtaa

SEQ ID NO: 7394231 - DNA, 17 bp, Homo sapiens
atgtgtctagtgcaacc

SEQ ID NO: 7394232 - DNA, 22 bp, Homo sapiens
atgtgtctctaccaatgcaatt

SEQ ID NO: 7394233 - DNA, 22 bp, Homo sapiens
atgtgtctctaccaatgcaatt

SEQ ID NO: 7394234 - DNA, 22 bp, Homo sapiens
atgtgtctctaccaatgcaatt

SEQ ID NO: 7394235 - DNA, 22 bp, Homo sapiens
atgtgtctctaccaatgcaatt

SEQ ID NO: 7394236 - DNA, 17 bp, Homo sapiens
atgtgtctgagtgtcct

SEQ ID NO: 7394237 - DNA, 17 bp, Homo sapiens
atgtgtctgagtgtcct

SEQ ID NO: 7394238 - DNA, 22 bp, Homo sapiens
atgtgtctgaccactgtattgg

SEQ ID NO: 7394239 - DNA, 22 bp, Homo sapiens
atgtgtctgaccactgtattgg

SEQ ID NO: 7394240 - DNA, 22 bp, Homo sapiens
atgtgtctgaccactgtattgg

SEQ ID NO: 7394241 - DNA, 22 bp, Homo sapiens
atgtgtctgaccactgtattgg

SEQ ID NO: 7394242 - DNA, 22 bp, Homo sapiens
atgtgtctagattgctgtaccg

SEQ ID NO: 7394243 - DNA, 17 bp, Homo sapiens
atgtgtctagtgcaacc

SEQ ID NO: 7394244 - DNA, 17 bp, Homo sapiens
atgtgtctagtgcaacc

SEQ ID NO: 7394245 - DNA, 22 bp, Homo sapiens
atgtgtctagattgctgtaccg

SEQ ID NO: 7394246 - DNA, 22 bp, Homo sapiens
atgtgtctctaaaatttagtaa

SEQ ID NO: 7394247 - DNA, 22 bp, Homo sapiens
atgtgtctaattccaggagcac

SEQ ID NO: 7394248 - DNA, 22 bp, Homo sapiens
atgtgtctaattccaggagcac

SEQ ID NO: 7394249 - DNA, 22 bp, Homo sapiens
atgtgtctaattccaggagcac

SEQ ID NO: 7394250 - DNA, 22 bp, Homo sapiens
gaggtggctccaggagcaatgc

SEQ ID NO: 7394251 - DNA, 22 bp, Homo sapiens
gaggtggcgcgccatccctgcc

SEQ ID NO: 7394252 - DNA, 22 bp, Homo sapiens
gaggtggctccaggagcaatgc

SEQ ID NO: 7394253 - DNA, 22 bp, Homo sapiens
gaggtggctccaggagcaatgc

SEQ ID NO: 7394254 - DNA, 22 bp, Homo sapiens
gaggtggcgcgccatccctgcc

SEQ ID NO: 7394255 - DNA, 22 bp, Homo sapiens
gaggtggcgcgccatccctgcc

SEQ ID NO: 7394256 - DNA, 22 bp, Homo sapiens
gaggtggcgcgccatccctgcc

SEQ ID NO: 7394257 - DNA, 22 bp, Homo sapiens
gaggtggcctcaagcagtcttc

SEQ ID NO: 7394258 - DNA, 22 bp, Homo sapiens
gaggtggcgcgccatccctgcc

SEQ ID NO: 7394259 - DNA, 22 bp, Homo sapiens
gaggtggcctcaagcagtcttc

SEQ ID NO: 7394260 - DNA, 22 bp, Homo sapiens
gaggtggcgcgccatccctgcc

SEQ ID NO: 7394261 - DNA, 22 bp, Homo sapiens
gaggtggcgcgccatccctgcc

SEQ ID NO: 7394262 - DNA, 22 bp, Homo sapiens
gagttcagtagttatagtctag

SEQ ID NO: 7394263 - DNA, 22 bp, Homo sapiens
gagttcatattcagagatcgct

SEQ ID NO: 7394264 - DNA, 22 bp, Homo sapiens
atgtttaatcggctgcctttcc

SEQ ID NO: 7394265 - DNA, 22 bp, Homo sapiens
gagttattttgagcagatggtt

SEQ ID NO: 7394266 - DNA, 22 bp, Homo sapiens
gagttcaatttccagctgttct

SEQ ID NO: 7394267 - DNA, 22 bp, Homo sapiens
atgtttaatcggctgcctttcc

SEQ ID NO: 7394268 - DNA, 22 bp, Homo sapiens
atgtttaatcggctgcctttcc

SEQ ID NO: 7394269 - DNA, 22 bp, Homo sapiens
atgtttaatcggctgcctttcc

SEQ ID NO: 7394270 - DNA, 22 bp, Homo sapiens
gataatattagaagatacaaat

SEQ ID NO: 7394271 - DNA, 20 bp, Homo sapiens
gataatatttactaggtact

SEQ ID NO: 7394272 - DNA, 22 bp, Homo sapiens
gataatgatgacaatgacaacc

SEQ ID NO: 7394273 - DNA, 19 bp, Homo sapiens
gagttcctgcaaggcctcc

SEQ ID NO: 7394274 - DNA, 22 bp, Homo sapiens
gagttctattatggttagaagt

SEQ ID NO: 7394275 - DNA, 22 bp, Homo sapiens
gagttctaaaggcagaacataa

SEQ ID NO: 7394276 - DNA, 22 bp, Homo sapiens
gataatatctggtttattcacc

SEQ ID NO: 7394277 - DNA, 22 bp, Homo sapiens
atgtttaaagggttgagaaata

SEQ ID NO: 7394278 - DNA, 22 bp, Homo sapiens
atgtttaaaggagtcagagact

SEQ ID NO: 7394279 - DNA, 22 bp, Homo sapiens
atgtttaaagggttgagaaata

SEQ ID NO: 7394280 - DNA, 22 bp, Homo sapiens
atgtttaaagggttgagaaata

SEQ ID NO: 7394281 - DNA, 22 bp, Homo sapiens
atgtttaaagggttgagaaata

SEQ ID NO: 7394282 - DNA, 22 bp, Homo sapiens
atgtttaaagggttgagaaata

SEQ ID NO: 7394283 - DNA, 22 bp, Homo sapiens
atgtttaaagggttgagaaata

SEQ ID NO: 7394284 - DNA, 22 bp, Homo sapiens
atgtttaaagggttgagaaata

SEQ ID NO: 7394285 - DNA, 22 bp, Homo sapiens
atgtttaaatttatagacagtg

SEQ ID NO: 7394286 - DNA, 22 bp, Homo sapiens
atgtttaaatttatagacagtg

SEQ ID NO: 7394287 - DNA, 22 bp, Homo sapiens
atgtttaaatttatagacagtg

SEQ ID NO: 7394288 - DNA, 22 bp, Homo sapiens
atgtttaaatttatagacagtg

SEQ ID NO: 7394289 - DNA, 22 bp, Homo sapiens
atgtttaaggaactggtttgct

SEQ ID NO: 7394290 - DNA, 22 bp, Homo sapiens
atgtttaaggaactggtttgct

SEQ ID NO: 7394291 - DNA, 22 bp, Homo sapiens
atgtttaaggaactggtttgct

SEQ ID NO: 7394292 - DNA, 22 bp, Homo sapiens
atgtttaaggaactggtttgct

SEQ ID NO: 7394293 - DNA, 22 bp, Homo sapiens
atgtttaaggaactggtttgct

SEQ ID NO: 7394294 - DNA, 22 bp, Homo sapiens
atgtttaagaaagtcttccata

SEQ ID NO: 7394295 - DNA, 22 bp, Homo sapiens
atgtttaagaaagtcttccata

SEQ ID NO: 7394296 - DNA, 22 bp, Homo sapiens
atgtttaagaaagtcttccata

SEQ ID NO: 7394297 - DNA, 22 bp, Homo sapiens
atgtttaaatttatagacagtg

SEQ ID NO: 7394298 - DNA, 22 bp, Homo sapiens
atgtttaaatttatagacagtg

SEQ ID NO: 7394299 - DNA, 22 bp, Homo sapiens
atgtttaagaaagtcttccata

SEQ ID NO: 7394300 - DNA, 22 bp, Homo sapiens
atgtttaagaaagtcttccata

SEQ ID NO: 7394301 - DNA, 22 bp, Homo sapiens
atgttggccaggctggtcttga

SEQ ID NO: 7394302 - DNA, 22 bp, Homo sapiens
atgttgggaaggccgcaggcac

SEQ ID NO: 7394303 - DNA, 22 bp, Homo sapiens
atgttggactaggctcttaatt

SEQ ID NO: 7394304 - DNA, 22 bp, Homo sapiens
atgttgggaaggccgcaggcac

SEQ ID NO: 7394305 - DNA, 22 bp, Homo sapiens
atgttgggaaggccgcaggcac

SEQ ID NO: 7394306 - DNA, 22 bp, Homo sapiens
atgttggtgggtacagagggat

SEQ ID NO: 7394307 - DNA, 22 bp, Homo sapiens
atgttgtagcatatgaaatata

SEQ ID NO: 7394308 - DNA, 22 bp, Homo sapiens
atgttgtagcatatgaaatata

SEQ ID NO: 7394309 - DNA, 22 bp, Homo sapiens
atgttggagtcgtaaggcatgg

SEQ ID NO: 7394310 - DNA, 21 bp, Homo sapiens
atgttggaatccaaaaacatt

SEQ ID NO: 7394311 - DNA, 21 bp, Homo sapiens
atgttggaatccaaaaacatt

SEQ ID NO: 7394312 - DNA, 22 bp, Homo sapiens
atgttgcacaaagtccatccat

SEQ ID NO: 7394313 - DNA, 22 bp, Homo sapiens
atgttgcccattccaggagata

SEQ ID NO: 7394314 - DNA, 22 bp, Homo sapiens
atgttggagtcgtaaggcatgg

SEQ ID NO: 7394315 - DNA, 22 bp, Homo sapiens
atgttggagtcgtaaggcatgg

SEQ ID NO: 7394316 - DNA, 22 bp, Homo sapiens
atgttggagtcgtaaggcatgg

SEQ ID NO: 7394317 - DNA, 22 bp, Homo sapiens
atgttggagtcgtaaggcatgg

SEQ ID NO: 7394318 - DNA, 22 bp, Homo sapiens
atgtttaaaggagtcagagact

SEQ ID NO: 7394319 - DNA, 22 bp, Homo sapiens
atgtttaaaggagtcagagact

SEQ ID NO: 7394320 - DNA, 22 bp, Homo sapiens
atgtttaaaggagtcagagact

SEQ ID NO: 7394321 - DNA, 22 bp, Homo sapiens
atgtttaaaggagtcagagact

SEQ ID NO: 7394322 - DNA, 22 bp, Homo sapiens
atgttgtttttgtcccagaagg

SEQ ID NO: 7394323 - DNA, 22 bp, Homo sapiens
atgttgttttttcataaagtat

SEQ ID NO: 7394324 - DNA, 22 bp, Homo sapiens
atgttgtattatgttattgtct

SEQ ID NO: 7394325 - DNA, 22 bp, Homo sapiens
atgttgtaggtctcatggtaca

SEQ ID NO: 7394326 - DNA, 22 bp, Homo sapiens
atgttgtattatgttattgtct

SEQ ID NO: 7394327 - DNA, 22 bp, Homo sapiens
atgttgtgtttgactgttaccc

SEQ ID NO: 7394328 - DNA, 20 bp, Homo sapiens
atgttgtttactcatagcat

SEQ ID NO: 7394329 - DNA, 22 bp, Homo sapiens
atgttgttccctctacacaggt

SEQ ID NO: 7394330 - DNA, 22 bp, Homo sapiens
gataatttctccatctcaaggt

SEQ ID NO: 7394331 - DNA, 22 bp, Homo sapiens
gataatttctccatctcaaggt

SEQ ID NO: 7394332 - DNA, 22 bp, Homo sapiens
gataatttgatacctcaatcag

SEQ ID NO: 7394333 - DNA, 22 bp, Homo sapiens
gataattataggctaagccact

SEQ ID NO: 7394334 - DNA, 22 bp, Homo sapiens
gataattataggctaagccact

SEQ ID NO: 7394335 - DNA, 22 bp, Homo sapiens
gataattataggctaagccact

SEQ ID NO: 7394336 - DNA, 22 bp, Homo sapiens
gataatggggaatgataagtca

SEQ ID NO: 7394337 - DNA, 22 bp, Homo sapiens
gataatgagtgttctttgagct

SEQ ID NO: 7394338 - DNA, 22 bp, Homo sapiens
gataatgatgacaatgacaacc

SEQ ID NO: 7394339 - DNA, 22 bp, Homo sapiens
gataatggggaatgataagtca

SEQ ID NO: 7394340 - DNA, 22 bp, Homo sapiens
gataatgtggatttattgtgat

SEQ ID NO: 7394341 - DNA, 22 bp, Homo sapiens
gataatgtggatttattgtgat

SEQ ID NO: 7394342 - DNA, 22 bp, Homo sapiens
gataatgtgccgataatttcta

SEQ ID NO: 7394343 - DNA, 22 bp, Homo sapiens
gataattttagtctgaaaattg

SEQ ID NO: 7394344 - DNA, 22 bp, Homo sapiens
gataattttagtctgaaaattg

SEQ ID NO: 7394345 - DNA, 22 bp, Homo sapiens
gataattttagtctgaaaattg

SEQ ID NO: 7394346 - DNA, 22 bp, Homo sapiens
gataattttggttccaggttgg

SEQ ID NO: 7394347 - DNA, 22 bp, Homo sapiens
gataattttggttccaggttgg

SEQ ID NO: 7394348 - DNA, 22 bp, Homo sapiens
gataattttagtctgaaaattg

SEQ ID NO: 7394349 - DNA, 22 bp, Homo sapiens
gataattttagtctgaaaattg

SEQ ID NO: 7394350 - DNA, 22 bp, Homo sapiens
gatacaaaatataaatggagag

SEQ ID NO: 7394351 - DNA, 22 bp, Homo sapiens
gatacaaaatataaatggagag

SEQ ID NO: 7394352 - DNA, 22 bp, Homo sapiens
gatacaaaatataaatggagag

SEQ ID NO: 7394353 - DNA, 22 bp, Homo sapiens
gatacaaaatataaatggagag

SEQ ID NO: 7394354 - DNA, 22 bp, Homo sapiens
gatacaaaatataaatggagag

SEQ ID NO: 7394355 - DNA, 22 bp, Homo sapiens
gatacaaaatataaatggagag

SEQ ID NO: 7394356 - DNA, 22 bp, Homo sapiens
gatacaaaatataaatggagag

SEQ ID NO: 7394357 - DNA, 22 bp, Homo sapiens
gatacaaattcatgtctgaatt

SEQ ID NO: 7394358 - DNA, 22 bp, Homo sapiens
gatacaaaatataaatggagag

SEQ ID NO: 7394359 - DNA, 18 bp, Homo sapiens
gatatggaaggccatgcc

SEQ ID NO: 7394360 - DNA, 18 bp, Homo sapiens
gatatggaaggccatgcc

SEQ ID NO: 7394361 - DNA, 18 bp, Homo sapiens
gatatggaaggccatgcc

SEQ ID NO: 7394362 - DNA, 22 bp, Homo sapiens
gatatgtatgaggagtatgtat

SEQ ID NO: 7394363 - DNA, 22 bp, Homo sapiens
gatatgtaccacctcttaaaag

SEQ ID NO: 7394364 - DNA, 22 bp, Homo sapiens
gatatgtaccacctcttaaaag

SEQ ID NO: 7394365 - DNA, 18 bp, Homo sapiens
gatatggaaggccatgcc

SEQ ID NO: 7394366 - DNA, 19 bp, Homo sapiens
gatatgaacgttactggcc

SEQ ID NO: 7394367 - DNA, 22 bp, Homo sapiens
gatatcatatcagacaacctct

SEQ ID NO: 7394368 - DNA, 22 bp, Homo sapiens
gatatcatgggaaggtgtactt

SEQ ID NO: 7394369 - DNA, 22 bp, Homo sapiens
gatatcatgggaaggtgtactt

SEQ ID NO: 7394370 - DNA, 22 bp, Homo sapiens
gatatcattgagcccaggagtt

SEQ ID NO: 7394371 - DNA, 22 bp, Homo sapiens
gatatgaagtggcattgtgaag

SEQ ID NO: 7394372 - DNA, 19 bp, Homo sapiens
gatatgaacgttactggcc

SEQ ID NO: 7394373 - DNA, 22 bp, Homo sapiens
gatatgaagtggcattgtgaag

SEQ ID NO: 7394374 - DNA, 22 bp, Homo sapiens
gatatgcacattcaaaaattgc

SEQ ID NO: 7394375 - DNA, 22 bp, Homo sapiens
gatatgaagtggcattgtgaag

SEQ ID NO: 7394376 - DNA, 22 bp, Homo sapiens
gatatgaaaagagctgggaact

SEQ ID NO: 7394377 - DNA, 22 bp, Homo sapiens
gatatattttccatggtctgca

SEQ ID NO: 7394378 - DNA, 22 bp, Homo sapiens
gatatattttccatggtctgca

SEQ ID NO: 7394379 - DNA, 22 bp, Homo sapiens
gatatattttccatggtctgca

SEQ ID NO: 7394380 - DNA, 22 bp, Homo sapiens
gatatattttccatggtctgca

SEQ ID NO: 7394381 - DNA, 22 bp, Homo sapiens
gatatattttccatggtctgca

SEQ ID NO: 7394382 - DNA, 22 bp, Homo sapiens
gatatattttccatggtctgca

SEQ ID NO: 7394383 - DNA, 22 bp, Homo sapiens
gatatcagagacttggctacca

SEQ ID NO: 7394384 - DNA, 22 bp, Homo sapiens
gatacacaaaagtctagtgagg

SEQ ID NO: 7394385 - DNA, 22 bp, Homo sapiens
gatatatttggaccagagcatt

SEQ ID NO: 7394386 - DNA, 22 bp, Homo sapiens
gatatatttggaccagagcatt

SEQ ID NO: 7394387 - DNA, 22 bp, Homo sapiens
gatacacaaaagtctagtgagg

SEQ ID NO: 7394388 - DNA, 22 bp, Homo sapiens
gatatatttggaccagagcatt

SEQ ID NO: 7394389 - DNA, 22 bp, Homo sapiens
gatatatttggaccagagcatt

SEQ ID NO: 7394390 - DNA, 22 bp, Homo sapiens
gatacacaagtggaaggagacg

SEQ ID NO: 7394391 - DNA, 22 bp, Homo sapiens
gatacacaagtggaaggagacg

SEQ ID NO: 7394392 - DNA, 22 bp, Homo sapiens
gatacaaattcatgtctgaatt

SEQ ID NO: 7394393 - DNA, 22 bp, Homo sapiens
gatacaagactaataggaaaca

SEQ ID NO: 7394394 - DNA, 22 bp, Homo sapiens
gatacaagactaataggaaaca

SEQ ID NO: 7394395 - DNA, 22 bp, Homo sapiens
gatacaaattcatgtctgaatt

SEQ ID NO: 7394396 - DNA, 22 bp, Homo sapiens
gatacaaattcatgtctgaatt

SEQ ID NO: 7394397 - DNA, 22 bp, Homo sapiens
gatacaaattcatgtctgaatt

SEQ ID NO: 7394398 - DNA, 22 bp, Homo sapiens
gatacaaattcatgtctgaatt

SEQ ID NO: 7394399 - DNA, 22 bp, Homo sapiens
gatacaaattcatgtctgaatt

SEQ ID NO: 7394400 - DNA, 22 bp, Homo sapiens
gatacaaattcatgtctgaatt

SEQ ID NO: 7394401 - DNA, 22 bp, Homo sapiens
gatacaaattcatgtctgaatt

SEQ ID NO: 7394402 - DNA, 22 bp, Homo sapiens
atgggacagcatcttggtatta

SEQ ID NO: 7394403 - DNA, 22 bp, Homo sapiens
atgggacagcatcttggtatta

SEQ ID NO: 7394404 - DNA, 22 bp, Homo sapiens
atgggacacgttttaaggaaaa

SEQ ID NO: 7394405 - DNA, 22 bp, Homo sapiens
atgggacacagtccgccctcta

SEQ ID NO: 7394406 - DNA, 22 bp, Homo sapiens
atgggacaatttgaacacagtg

SEQ ID NO: 7394407 - DNA, 22 bp, Homo sapiens
atgggacaatttgaacacagtg

SEQ ID NO: 7394408 - DNA, 22 bp, Homo sapiens
atgggacaaacctttgatttga

SEQ ID NO: 7394409 - DNA, 22 bp, Homo sapiens
atgggaatccaccctttaaaat

SEQ ID NO: 7394410 - DNA, 22 bp, Homo sapiens
atgggacaggcatgggacttag

SEQ ID NO: 7394411 - DNA, 22 bp, Homo sapiens
atgggacagggctggctggtcc

SEQ ID NO: 7394412 - DNA, 22 bp, Homo sapiens
atgggacagggctggctggtcc

SEQ ID NO: 7394413 - DNA, 22 bp, Homo sapiens
atgggacagggctggctggtcc

SEQ ID NO: 7394414 - DNA, 22 bp, Homo sapiens
atgggacaggtactagaaaggg

SEQ ID NO: 7394415 - DNA, 22 bp, Homo sapiens
atgggacaggtactagaaaggg

SEQ ID NO: 7394416 - DNA, 22 bp, Homo sapiens
atgggacatagatccttgaggt

SEQ ID NO: 7394417 - DNA, 22 bp, Homo sapiens
atgggacatagatccttgaggt

SEQ ID NO: 7394418 - DNA, 22 bp, Homo sapiens
atgggacatagatccttgaggt

SEQ ID NO: 7394419 - DNA, 22 bp, Homo sapiens
atgggagaaacatcatgaggca

SEQ ID NO: 7394420 - DNA, 22 bp, Homo sapiens
atgggagaaacatcatgaggca

SEQ ID NO: 7394421 - DNA, 22 bp, Homo sapiens
atgggaaggttttgagagcggg

SEQ ID NO: 7394422 - DNA, 22 bp, Homo sapiens
atgggaaggttttgagagcggg

SEQ ID NO: 7394423 - DNA, 22 bp, Homo sapiens
atgggaagtgaagtcagggagg

SEQ ID NO: 7394424 - DNA, 22 bp, Homo sapiens
atgggaagtgaagtcagggagg

SEQ ID NO: 7394425 - DNA, 22 bp, Homo sapiens
atgggaagtgttagaagatttt

SEQ ID NO: 7394426 - DNA, 22 bp, Homo sapiens
atgggaagctgacctgcatgga

SEQ ID NO: 7394427 - DNA, 22 bp, Homo sapiens
atgggaagctgacctgcatgga

SEQ ID NO: 7394428 - DNA, 22 bp, Homo sapiens
atgggaaggttttgagagcggg

SEQ ID NO: 7394429 - DNA, 22 bp, Homo sapiens
atgggaaggttttgagagcggg

SEQ ID NO: 7394430 - DNA, 22 bp, Homo sapiens
atgggaaggttttgagagcggg

SEQ ID NO: 7394431 - DNA, 22 bp, Homo sapiens
atgggaaggttttgagagcggg

SEQ ID NO: 7394432 - DNA, 19 bp, Homo sapiens
atgggaagcggccagcgga

SEQ ID NO: 7394433 - DNA, 19 bp, Homo sapiens
atgggaagcggccagcgga

SEQ ID NO: 7394434 - DNA, 19 bp, Homo sapiens
atgggaagcggccagcgga

SEQ ID NO: 7394435 - DNA, 19 bp, Homo sapiens
atgggaagcggccagcgga

SEQ ID NO: 7394436 - DNA, 22 bp, Homo sapiens
atgggctgaggtgggatagaag

SEQ ID NO: 7394437 - DNA, 22 bp, Homo sapiens
atgggctgaggtgggatagaag

SEQ ID NO: 7394438 - DNA, 22 bp, Homo sapiens
atgggctgaggtgggatagaag

SEQ ID NO: 7394439 - DNA, 22 bp, Homo sapiens
atgggctgaggaagctcctgag

SEQ ID NO: 7394440 - DNA, 22 bp, Homo sapiens
atgggctgcttctccagcacct

SEQ ID NO: 7394441 - DNA, 22 bp, Homo sapiens
atgggctgaggaagctcctgag

SEQ ID NO: 7394442 - DNA, 22 bp, Homo sapiens
atgggctgaggaagctcctgag

SEQ ID NO: 7394443 - DNA, 22 bp, Homo sapiens
atgggctgaggaagctcctgag

SEQ ID NO: 7394444 - DNA, 22 bp, Homo sapiens
atgggctgaggaagctcctgag

SEQ ID NO: 7394445 - DNA, 22 bp, Homo sapiens
atgggctgaggaagctcctgag

SEQ ID NO: 7394446 - DNA, 22 bp, Homo sapiens
atgggctgaggaagctcctgag

SEQ ID NO: 7394447 - DNA, 22 bp, Homo sapiens
atgggctgaggaagctcctgag

SEQ ID NO: 7394448 - DNA, 22 bp, Homo sapiens
atgggctgacccagtcgtggca

SEQ ID NO: 7394449 - DNA, 22 bp, Homo sapiens
atgggctgacccagtcgtggca

SEQ ID NO: 7394450 - DNA, 22 bp, Homo sapiens
atgggctgacccagtcgtggca

SEQ ID NO: 7394451 - DNA, 22 bp, Homo sapiens
atgggctgacccagtcgtggca

SEQ ID NO: 7394452 - DNA, 22 bp, Homo sapiens
atgggctgacccagtcgtggca

SEQ ID NO: 7394453 - DNA, 22 bp, Homo sapiens
atgggctgacccagtcgtggca

SEQ ID NO: 7394454 - DNA, 22 bp, Homo sapiens
atgggctgacaagacatgcata

SEQ ID NO: 7394455 - DNA, 22 bp, Homo sapiens
atgggctgacccagtcgtggca

SEQ ID NO: 7394456 - DNA, 22 bp, Homo sapiens
atgggctgacccagtcgtggca

SEQ ID NO: 7394457 - DNA, 22 bp, Homo sapiens
atgggctgacccagtcgtggca

SEQ ID NO: 7394458 - DNA, 22 bp, Homo sapiens
atgggctgaaagagtaagctgt

SEQ ID NO: 7394459 - DNA, 22 bp, Homo sapiens
atgggctgaggaagctcctgag

SEQ ID NO: 7394460 - DNA, 22 bp, Homo sapiens
atgggctgactaatggtaaact

SEQ ID NO: 7394461 - DNA, 22 bp, Homo sapiens
atgggctgagaatcaagaatat

SEQ ID NO: 7394462 - DNA, 18 bp, Homo sapiens
atgggcaggtaagatcca

SEQ ID NO: 7394463 - DNA, 22 bp, Homo sapiens
atgggcagtaacagtggcagtc

SEQ ID NO: 7394464 - DNA, 22 bp, Homo sapiens
atgggctgaaagagtaagctgt

SEQ ID NO: 7394465 - DNA, 22 bp, Homo sapiens
atgggctgacaagacatgcata

SEQ ID NO: 7394466 - DNA, 22 bp, Homo sapiens
atgggctgaaagagtaagctgt

SEQ ID NO: 7394467 - DNA, 18 bp, Homo sapiens
atgggcaggtaagatcca

SEQ ID NO: 7394468 - DNA, 22 bp, Homo sapiens
atgggctctatgtctaggagat

SEQ ID NO: 7394469 - DNA, 22 bp, Homo sapiens
atgggctgacaagacatgcata

SEQ ID NO: 7394470 - DNA, 22 bp, Homo sapiens
atgggagaaacatcatgaggca

SEQ ID NO: 7394471 - DNA, 22 bp, Homo sapiens
atgggagaaacatcatgaggca

SEQ ID NO: 7394472 - DNA, 22 bp, Homo sapiens
atgggcagggcagtgtataaga

SEQ ID NO: 7394473 - DNA, 22 bp, Homo sapiens
atgggcagggcagtgtataaga

SEQ ID NO: 7394474 - DNA, 22 bp, Homo sapiens
atgggcagggcagtgtataaga

SEQ ID NO: 7394475 - DNA, 22 bp, Homo sapiens
atgggcaggcctctcatttctg

SEQ ID NO: 7394476 - DNA, 22 bp, Homo sapiens
atgggagaaacatcatgaggca

SEQ ID NO: 7394477 - DNA, 22 bp, Homo sapiens
atgggagaaacatcatgaggca

SEQ ID NO: 7394478 - DNA, 22 bp, Homo sapiens
atgggagaaacatcatgaggca

SEQ ID NO: 7394479 - DNA, 23 bp, Homo sapiens
atgggcttagaaagcaagtggga

SEQ ID NO: 7394480 - DNA, 22 bp, Homo sapiens
atgggctgtgggaccctggacc

SEQ ID NO: 7394481 - DNA, 22 bp, Homo sapiens
atgggctgtgggaccctggacc

SEQ ID NO: 7394482 - DNA, 22 bp, Homo sapiens
atgggcttgaccctacagaaag

SEQ ID NO: 7394483 - DNA, 22 bp, Homo sapiens
atgggctggggaagctcactcc

SEQ ID NO: 7394484 - DNA, 22 bp, Homo sapiens
atgggcttggcgacaatttgaa

SEQ ID NO: 7394485 - DNA, 22 bp, Homo sapiens
atggggaagagccagtgagctg

SEQ ID NO: 7394486 - DNA, 22 bp, Homo sapiens
atggggaagagccagtgagctg

SEQ ID NO: 7394487 - DNA, 22 bp, Homo sapiens
atggggaagagccagtgagctg

SEQ ID NO: 7394488 - DNA, 22 bp, Homo sapiens
atggggaagagccagtgagctg

SEQ ID NO: 7394489 - DNA, 22 bp, Homo sapiens
atggggaagcaattggatttcc

SEQ ID NO: 7394490 - DNA, 22 bp, Homo sapiens
atggggagagaagggctgagct

SEQ ID NO: 7394491 - DNA, 22 bp, Homo sapiens
atggggagagaagggctgagct

SEQ ID NO: 7394492 - DNA, 22 bp, Homo sapiens
atggggagagaagggctgagct

SEQ ID NO: 7394493 - DNA, 22 bp, Homo sapiens
atggggagagaagggctgagct

SEQ ID NO: 7394494 - DNA, 22 bp, Homo sapiens
atggggagagaagggctgagct

SEQ ID NO: 7394495 - DNA, 22 bp, Homo sapiens
atggggagagaagggctgagct

SEQ ID NO: 7394496 - DNA, 22 bp, Homo sapiens
atggggagagaagggctgagct

SEQ ID NO: 7394497 - DNA, 22 bp, Homo sapiens
atggggagagaagggctgagct

SEQ ID NO: 7394498 - DNA, 22 bp, Homo sapiens
atggggagagaagggctgagct

SEQ ID NO: 7394499 - DNA, 22 bp, Homo sapiens
atggggagagcctctgtcccca

SEQ ID NO: 7394500 - DNA, 22 bp, Homo sapiens
atggggagagaagggctgagct

SEQ ID NO: 7394501 - DNA, 22 bp, Homo sapiens
atggggagagcctctgtcccca

SEQ ID NO: 7394502 - DNA, 22 bp, Homo sapiens
atggggagagcctctgtcccca

SEQ ID NO: 7394503 - DNA, 22 bp, Homo sapiens
atggggagagcctctgtcccca

SEQ ID NO: 7394504 - DNA, 22 bp, Homo sapiens
atggggagagcctctgtcccca

SEQ ID NO: 7394505 - DNA, 22 bp, Homo sapiens
atggggagagcctctgtcccca

SEQ ID NO: 7394506 - DNA, 22 bp, Homo sapiens
atggggcagaggttaaaggtgg

SEQ ID NO: 7394507 - DNA, 22 bp, Homo sapiens
atggggcagaggttaaaggtgg

SEQ ID NO: 7394508 - DNA, 23 bp, Homo sapiens
atggggctcaacacttagtagct

SEQ ID NO: 7394509 - DNA, 22 bp, Homo sapiens
atggggctagacaaccagtgcc

SEQ ID NO: 7394510 - DNA, 22 bp, Homo sapiens
atggggctagacaaccagtgcc

SEQ ID NO: 7394511 - DNA, 22 bp, Homo sapiens
atggggctagacaaccagtgcc

SEQ ID NO: 7394512 - DNA, 22 bp, Homo sapiens
atggggagctcaccacctgttt

SEQ ID NO: 7394513 - DNA, 22 bp, Homo sapiens
atggggagctcaccacctgttt

SEQ ID NO: 7394514 - DNA, 22 bp, Homo sapiens
atggggagctcaccacctgttt

SEQ ID NO: 7394515 - DNA, 22 bp, Homo sapiens
atggggagctcaccacctgttt

SEQ ID NO: 7394516 - DNA, 22 bp, Homo sapiens
atggggagctcaccacctgttt

SEQ ID NO: 7394517 - DNA, 22 bp, Homo sapiens
atgggctgtgaggtccggcagg

SEQ ID NO: 7394518 - DNA, 22 bp, Homo sapiens
atgggctgtgaggtccggcagg

SEQ ID NO: 7394519 - DNA, 22 bp, Homo sapiens
atgggctgtgaggtccggcagg

SEQ ID NO: 7394520 - DNA, 22 bp, Homo sapiens
atgggctgtcctagtccagccc

SEQ ID NO: 7394521 - DNA, 22 bp, Homo sapiens
atgggctgtcctagtccagccc

SEQ ID NO: 7394522 - DNA, 22 bp, Homo sapiens
atgggctgtcctagtccagccc

SEQ ID NO: 7394523 - DNA, 22 bp, Homo sapiens
atgggctgtcctagtccagccc

SEQ ID NO: 7394524 - DNA, 22 bp, Homo sapiens
atgggctgtcctagtccagccc

SEQ ID NO: 7394525 - DNA, 22 bp, Homo sapiens
atgggctgtccattgctggctg

SEQ ID NO: 7394526 - DNA, 22 bp, Homo sapiens
atgggctgtccattgctggctg

SEQ ID NO: 7394527 - DNA, 22 bp, Homo sapiens
atgggctgtccattgctggctg

SEQ ID NO: 7394528 - DNA, 22 bp, Homo sapiens
atgggctgtccattgctggctg

SEQ ID NO: 7394529 - DNA, 22 bp, Homo sapiens
atgggctgtccattgctggctg

SEQ ID NO: 7394530 - DNA, 22 bp, Homo sapiens
atgggctgtccattgctggctg

SEQ ID NO: 7394531 - DNA, 20 bp, Homo sapiens
atgggctggttaggaagtgt

SEQ ID NO: 7394532 - DNA, 22 bp, Homo sapiens
atgggctggggaagctcactcc

SEQ ID NO: 7394533 - DNA, 22 bp, Homo sapiens
atgggctggggaagctcactcc

SEQ ID NO: 7394534 - DNA, 22 bp, Homo sapiens
atgggctggggaagctcactcc

SEQ ID NO: 7394535 - DNA, 20 bp, Homo sapiens
atgggctggttaggaagtgt

SEQ ID NO: 7394536 - DNA, 20 bp, Homo sapiens
atgggctggttaggaagtgt

SEQ ID NO: 7394537 - DNA, 22 bp, Homo sapiens
atgggctgcttctccagcacct

SEQ ID NO: 7394538 - DNA, 22 bp, Homo sapiens
atgggctgcttctccagcacct

SEQ ID NO: 7394539 - DNA, 22 bp, Homo sapiens
atgggctgcttctccagcacct

SEQ ID NO: 7394540 - DNA, 22 bp, Homo sapiens
atgggctgcttggcttccaccc

SEQ ID NO: 7394541 - DNA, 22 bp, Homo sapiens
atgggctgcttggcttccaccc

SEQ ID NO: 7394542 - DNA, 22 bp, Homo sapiens
atgggctgcttggcttccaccc

SEQ ID NO: 7394543 - DNA, 22 bp, Homo sapiens
atgggctgcttggcttccaccc

SEQ ID NO: 7394544 - DNA, 22 bp, Homo sapiens
atgggctggcagcctgaacagc

SEQ ID NO: 7394545 - DNA, 22 bp, Homo sapiens
atgggctggcagcctgaacagc

SEQ ID NO: 7394546 - DNA, 22 bp, Homo sapiens
atgggctggcctttcccgctct

SEQ ID NO: 7394547 - DNA, 22 bp, Homo sapiens
atgggctggcctttcccgctct

SEQ ID NO: 7394548 - DNA, 22 bp, Homo sapiens
atgggctgggaatacacagggg

SEQ ID NO: 7394549 - DNA, 22 bp, Homo sapiens
atgggctgggaatacacagggg

SEQ ID NO: 7394550 - DNA, 22 bp, Homo sapiens
atgggctgggatctgagtgtca

SEQ ID NO: 7394551 - DNA, 22 bp, Homo sapiens
atgggctgggatctgagtgtca

SEQ ID NO: 7394552 - DNA, 22 bp, Homo sapiens
atgggctgggatctgagtgtca

SEQ ID NO: 7394553 - DNA, 22 bp, Homo sapiens
atgggctggcctttcccgctct

SEQ ID NO: 7394554 - DNA, 22 bp, Homo sapiens
atgggctgggaatacacagggg

SEQ ID NO: 7394555 - DNA, 22 bp, Homo sapiens
atgggctgggatctgagtgtca

SEQ ID NO: 7394556 - DNA, 22 bp, Homo sapiens
atgggctgggatctgagtgtca

SEQ ID NO: 7394557 - DNA, 22 bp, Homo sapiens
atgggctgggatctgagtgtca

SEQ ID NO: 7394558 - DNA, 22 bp, Homo sapiens
atgggctggggaagctcactcc

SEQ ID NO: 7394559 - DNA, 22 bp, Homo sapiens
atgggctggggaagctcactcc

SEQ ID NO: 7394560 - DNA, 22 bp, Homo sapiens
atgggctggggaagctcactcc

SEQ ID NO: 7394561 - DNA, 22 bp, Homo sapiens
gaggcagcagggctggttcctt

SEQ ID NO: 7394562 - DNA, 22 bp, Homo sapiens
gaggcacatcacttggtgcatt

SEQ ID NO: 7394563 - DNA, 22 bp, Homo sapiens
gaggcacatcacttggtgcatt

SEQ ID NO: 7394564 - DNA, 22 bp, Homo sapiens
gaggcagcagggctggttcctt

SEQ ID NO: 7394565 - DNA, 22 bp, Homo sapiens
gaggcagcatctatggtgggaa

SEQ ID NO: 7394566 - DNA, 22 bp, Homo sapiens
gaggcacatatatacagagccc

SEQ ID NO: 7394567 - DNA, 22 bp, Homo sapiens
gaggcacatatatacagagccc

SEQ ID NO: 7394568 - DNA, 22 bp, Homo sapiens
gaggcacatatatacagagccc

SEQ ID NO: 7394569 - DNA, 22 bp, Homo sapiens
atggttattactgctgttccag

SEQ ID NO: 7394570 - DNA, 22 bp, Homo sapiens
atggtgtttataggcaaagatc

SEQ ID NO: 7394571 - DNA, 22 bp, Homo sapiens
atggtgtacagcaatgtgtcag

SEQ ID NO: 7394572 - DNA, 22 bp, Homo sapiens
atggtggtgaagagcacagtga

SEQ ID NO: 7394573 - DNA, 22 bp, Homo sapiens
atggtggtttgggagaaaaagc

SEQ ID NO: 7394574 - DNA, 22 bp, Homo sapiens
atggtggtttgggagaaaaagc

SEQ ID NO: 7394575 - DNA, 22 bp, Homo sapiens
atggtggtgaagagcacagtga

SEQ ID NO: 7394576 - DNA, 22 bp, Homo sapiens
atggtggtgaagagcacagtga

SEQ ID NO: 7394577 - DNA, 22 bp, Homo sapiens
atggtggtagaagcactatgtg

SEQ ID NO: 7394578 - DNA, 22 bp, Homo sapiens
atggtggtagaagcactatgtg

SEQ ID NO: 7394579 - DNA, 22 bp, Homo sapiens
atggtgtacagccagatgtaga

SEQ ID NO: 7394580 - DNA, 22 bp, Homo sapiens
atggtgtagcatgtgatatgac

SEQ ID NO: 7394581 - DNA, 22 bp, Homo sapiens
atggtgttgagtctctcttcac

SEQ ID NO: 7394582 - DNA, 22 bp, Homo sapiens
atggtggactcttgattcaggc

SEQ ID NO: 7394583 - DNA, 22 bp, Homo sapiens
atggtggactcttgattcaggc

SEQ ID NO: 7394584 - DNA, 22 bp, Homo sapiens
atggtggactcttgattcaggc

SEQ ID NO: 7394585 - DNA, 22 bp, Homo sapiens
atggtggactcttgattcaggc

SEQ ID NO: 7394586 - DNA, 22 bp, Homo sapiens
atggtggacgggagacaggact

SEQ ID NO: 7394587 - DNA, 22 bp, Homo sapiens
atggtggacgggagacaggact

SEQ ID NO: 7394588 - DNA, 22 bp, Homo sapiens
atggtggatttgtgattcagct

SEQ ID NO: 7394589 - DNA, 22 bp, Homo sapiens
atggtggatttgtgattcagct

SEQ ID NO: 7394590 - DNA, 22 bp, Homo sapiens
atggtggaggtgtattctggat

SEQ ID NO: 7394591 - DNA, 22 bp, Homo sapiens
atggtggaggtgtattctggat

SEQ ID NO: 7394592 - DNA, 22 bp, Homo sapiens
atggtggatttgtgattcagct

SEQ ID NO: 7394593 - DNA, 21 bp, Homo sapiens
atggtggcacaaatttgatct

SEQ ID NO: 7394594 - DNA, 22 bp, Homo sapiens
atggtggatttgtgattcagct

SEQ ID NO: 7394595 - DNA, 22 bp, Homo sapiens
gaggcagcatctatggtgggaa

SEQ ID NO: 7394596 - DNA, 22 bp, Homo sapiens
gaggcagcatctatggtgggaa

SEQ ID NO: 7394597 - DNA, 22 bp, Homo sapiens
gaggcagcatctatggtgggaa

SEQ ID NO: 7394598 - DNA, 22 bp, Homo sapiens
gaggcagcatggtaccttggag

SEQ ID NO: 7394599 - DNA, 22 bp, Homo sapiens
gaggcagcatggtaccttggag

SEQ ID NO: 7394600 - DNA, 22 bp, Homo sapiens
gaggcagcatggtaccttggag

SEQ ID NO: 7394601 - DNA, 22 bp, Homo sapiens
gaggcagcattcgcatagacag

SEQ ID NO: 7394602 - DNA, 22 bp, Homo sapiens
gaggcagcattcgcatagacag

SEQ ID NO: 7394603 - DNA, 22 bp, Homo sapiens
gaggcagcattcgcatagacag

SEQ ID NO: 7394604 - DNA, 22 bp, Homo sapiens
gaggcagcattcgcatagacag

SEQ ID NO: 7394605 - DNA, 22 bp, Homo sapiens
gaggcagcattcgcatagacag

SEQ ID NO: 7394606 - DNA, 22 bp, Homo sapiens
gaggcagcattcgcatagacag

SEQ ID NO: 7394607 - DNA, 22 bp, Homo sapiens
gaggcagcattcgcatagacag

SEQ ID NO: 7394608 - DNA, 22 bp, Homo sapiens
gaggcagcctcagtggacctcg

SEQ ID NO: 7394609 - DNA, 22 bp, Homo sapiens
gaggcagcctcagtggacctcg

SEQ ID NO: 7394610 - DNA, 22 bp, Homo sapiens
gaggcagcctcagtggacctcg

SEQ ID NO: 7394611 - DNA, 22 bp, Homo sapiens
gaggcagcctcagtggacctcg

SEQ ID NO: 7394612 - DNA, 22 bp, Homo sapiens
gaggcagcctcagtggacctcg

SEQ ID NO: 7394613 - DNA, 22 bp, Homo sapiens
gaggcagcctcagtggacctcg

SEQ ID NO: 7394614 - DNA, 22 bp, Homo sapiens
gaggcagccagaggttctcatt

SEQ ID NO: 7394615 - DNA, 22 bp, Homo sapiens
gaggcagccagaggttctcatt

SEQ ID NO: 7394616 - DNA, 22 bp, Homo sapiens
gaggcagccagaggttctcatt

SEQ ID NO: 7394617 - DNA, 22 bp, Homo sapiens
gaggcagccagaggttctcatt

SEQ ID NO: 7394618 - DNA, 22 bp, Homo sapiens
gaggcagcctcagtggacctcg

SEQ ID NO: 7394619 - DNA, 22 bp, Homo sapiens
gaggcagcctcagtggacctcg

SEQ ID NO: 7394620 - DNA, 22 bp, Homo sapiens
gaggcagcctcagtggacctcg

SEQ ID NO: 7394621 - DNA, 22 bp, Homo sapiens
gaggcagcctcagtggacctcg

SEQ ID NO: 7394622 - DNA, 22 bp, Homo sapiens
gaggcagcggctcacagagaaa

SEQ ID NO: 7394623 - DNA, 22 bp, Homo sapiens
gaggcagcggctcacagagaaa

SEQ ID NO: 7394624 - DNA, 22 bp, Homo sapiens
gaggcagcggctcacagagaaa

SEQ ID NO: 7394625 - DNA, 22 bp, Homo sapiens
gaggcagcggctcacagagaaa

SEQ ID NO: 7394626 - DNA, 22 bp, Homo sapiens
gaggagaagctattggaaggac

SEQ ID NO: 7394627 - DNA, 22 bp, Homo sapiens
gaggagaagctattggaaggac

SEQ ID NO: 7394628 - DNA, 22 bp, Homo sapiens
gaggagaagctattggaaggac

SEQ ID NO: 7394629 - DNA, 22 bp, Homo sapiens
gaggagaagctattggaaggac

SEQ ID NO: 7394630 - DNA, 22 bp, Homo sapiens
gaggagaagctattggaaggac

SEQ ID NO: 7394631 - DNA, 22 bp, Homo sapiens
gaggagaagctaagaaacacag

SEQ ID NO: 7394632 - DNA, 22 bp, Homo sapiens
gaggagaagctattggaaggac

SEQ ID NO: 7394633 - DNA, 22 bp, Homo sapiens
gaggagaagctattggaaggac

SEQ ID NO: 7394634 - DNA, 22 bp, Homo sapiens
gaggagaagctaagaaacacag

SEQ ID NO: 7394635 - DNA, 22 bp, Homo sapiens
gaggagaagctaagaaacacag

SEQ ID NO: 7394636 - DNA, 22 bp, Homo sapiens
gaggagaagctattggaaggac

SEQ ID NO: 7394637 - DNA, 22 bp, Homo sapiens
gaggagaagctaagaaacacag

SEQ ID NO: 7394638 - DNA, 22 bp, Homo sapiens
gaggagaagctaagaaacacag

SEQ ID NO: 7394639 - DNA, 22 bp, Homo sapiens
gaggagaagctaagaaacacag

SEQ ID NO: 7394640 - DNA, 22 bp, Homo sapiens
gaggagaagctaagaaacacag

SEQ ID NO: 7394641 - DNA, 22 bp, Homo sapiens
gaggaaggctaaggggcttaga

SEQ ID NO: 7394642 - DNA, 23 bp, Homo sapiens
atggggctcaacacttagtagct

SEQ ID NO: 7394643 - DNA, 22 bp, Homo sapiens
gaggaaggctaaggggcttaga

SEQ ID NO: 7394644 - DNA, 22 bp, Homo sapiens
gaggaagggactttattatctg

SEQ ID NO: 7394645 - DNA, 22 bp, Homo sapiens
gaggaagggactttattatctg

SEQ ID NO: 7394646 - DNA, 22 bp, Homo sapiens
gaggaaggctaaggggcttaga

SEQ ID NO: 7394647 - DNA, 22 bp, Homo sapiens
gaggaaggctaaggggcttaga

SEQ ID NO: 7394648 - DNA, 22 bp, Homo sapiens
gaggaaggctaaggggcttaga

SEQ ID NO: 7394649 - DNA, 22 bp, Homo sapiens
gaggagaagctaagaaacacag

SEQ ID NO: 7394650 - DNA, 22 bp, Homo sapiens
gaggagaaatttggggacctga

SEQ ID NO: 7394651 - DNA, 22 bp, Homo sapiens
gaggagaagctaagaaacacag

SEQ ID NO: 7394652 - DNA, 22 bp, Homo sapiens
gaggagaaatttggggacctga

SEQ ID NO: 7394653 - DNA, 22 bp, Homo sapiens
gaggagaaatttggggacctga

SEQ ID NO: 7394654 - DNA, 22 bp, Homo sapiens
gaggagaaatttggggacctga

SEQ ID NO: 7394655 - DNA, 22 bp, Homo sapiens
gaggagaaattatccttggtgt

SEQ ID NO: 7394656 - DNA, 22 bp, Homo sapiens
gaggagaaattatccttggtgt

SEQ ID NO: 7394657 - DNA, 22 bp, Homo sapiens
gaggagaaattatccttggtgt

SEQ ID NO: 7394658 - DNA, 22 bp, Homo sapiens
gaggagaaatttggggacctga

SEQ ID NO: 7394659 - DNA, 18 bp, Homo sapiens
atggtctcatactgggag

SEQ ID NO: 7394660 - DNA, 18 bp, Homo sapiens
atggtctcatactgggag

SEQ ID NO: 7394661 - DNA, 18 bp, Homo sapiens
atggtctcatactgggag

SEQ ID NO: 7394662 - DNA, 22 bp, Homo sapiens
gaggagaatgcgcaccacatat

SEQ ID NO: 7394663 - DNA, 22 bp, Homo sapiens
gaggagaagggcacggagaaaa

SEQ ID NO: 7394664 - DNA, 22 bp, Homo sapiens
gaggagaatgcgcaccacatat

SEQ ID NO: 7394665 - DNA, 22 bp, Homo sapiens
gaggagaagctattggaaggac

SEQ ID NO: 7394666 - DNA, 22 bp, Homo sapiens
gaggagaagctattggaaggac

SEQ ID NO: 7394667 - DNA, 22 bp, Homo sapiens
gaggagaagggcacggagaaaa

SEQ ID NO: 7394668 - DNA, 22 bp, Homo sapiens
gaggagaagggcacggagaaaa

SEQ ID NO: 7394669 - DNA, 22 bp, Homo sapiens
gaggagaagggcacggagaaaa

SEQ ID NO: 7394670 - DNA, 22 bp, Homo sapiens
gaggagaagggcacggagaaaa

SEQ ID NO: 7394671 - DNA, 22 bp, Homo sapiens
gaggagaagggcacggagaaaa

SEQ ID NO: 7394672 - DNA, 22 bp, Homo sapiens
gaggagaagggcacggagaaaa

SEQ ID NO: 7394673 - DNA, 22 bp, Homo sapiens
atggtcttgtgagagtaacagt

SEQ ID NO: 7394674 - DNA, 22 bp, Homo sapiens
atggtcttgggcttaggcagag

SEQ ID NO: 7394675 - DNA, 22 bp, Homo sapiens
atggtcttgtgagagtaacagt

SEQ ID NO: 7394676 - DNA, 22 bp, Homo sapiens
atggtcttgggcttaggcagag

SEQ ID NO: 7394677 - DNA, 22 bp, Homo sapiens
atggtcttgggcttaggcagag

SEQ ID NO: 7394678 - DNA, 22 bp, Homo sapiens
atggtcttagggtaggcagctg

SEQ ID NO: 7394679 - DNA, 18 bp, Homo sapiens
atggtctcatactgggag

SEQ ID NO: 7394680 - DNA, 18 bp, Homo sapiens
atggtctcatactgggag

SEQ ID NO: 7394681 - DNA, 22 bp, Homo sapiens
atggtgctcctgcaggaagcag

SEQ ID NO: 7394682 - DNA, 22 bp, Homo sapiens
atggtgccaaagatttctaagc

SEQ ID NO: 7394683 - DNA, 22 bp, Homo sapiens
atggtgctcctgcaggaagcag

SEQ ID NO: 7394684 - DNA, 22 bp, Homo sapiens
atggtgccaaagatttctaagc

SEQ ID NO: 7394685 - DNA, 22 bp, Homo sapiens
atggtggaatcggcgtgaatgg

SEQ ID NO: 7394686 - DNA, 22 bp, Homo sapiens
atggtggaagagcatcagaaag

SEQ ID NO: 7394687 - DNA, 22 bp, Homo sapiens
atggtgaagcttcatgggtgtt

SEQ ID NO: 7394688 - DNA, 22 bp, Homo sapiens
atggtgactcctaaatgtgaaa

SEQ ID NO: 7394689 - DNA, 22 bp, Homo sapiens
atggtcttgtgagagtaacagt

SEQ ID NO: 7394690 - DNA, 22 bp, Homo sapiens
atggtctttttgttatgagaga

SEQ ID NO: 7394691 - DNA, 22 bp, Homo sapiens
atggtctttttgttatgagaga

SEQ ID NO: 7394692 - DNA, 22 bp, Homo sapiens
gagagagaggtgctgccaggca

SEQ ID NO: 7394693 - DNA, 22 bp, Homo sapiens
gagagagaggtgctgccaggca

SEQ ID NO: 7394694 - DNA, 22 bp, Homo sapiens
gagagagaggtgctgccaggca

SEQ ID NO: 7394695 - DNA, 22 bp, Homo sapiens
gagagagaggtgctgccaggca

SEQ ID NO: 7394696 - DNA, 22 bp, Homo sapiens
gagagagacatgtaaacgcggt

SEQ ID NO: 7394697 - DNA, 22 bp, Homo sapiens
gagagagagctaatattaagct

SEQ ID NO: 7394698 - DNA, 22 bp, Homo sapiens
gagagagagctaatattaagct

SEQ ID NO: 7394699 - DNA, 22 bp, Homo sapiens
gagagagagctaatattaagct

SEQ ID NO: 7394700 - DNA, 22 bp, Homo sapiens
gagagagaggtgctgccaggca

SEQ ID NO: 7394701 - DNA, 22 bp, Homo sapiens
gagagagaggtgctgccaggca

SEQ ID NO: 7394702 - DNA, 22 bp, Homo sapiens
gagagagaaggcctgtgggtgt

SEQ ID NO: 7394703 - DNA, 22 bp, Homo sapiens
gagagagaaggcctgtgggtgt

SEQ ID NO: 7394704 - DNA, 22 bp, Homo sapiens
gagagagaagtgggtgtcacct

SEQ ID NO: 7394705 - DNA, 22 bp, Homo sapiens
gagagagaagtgggtgtcacct

SEQ ID NO: 7394706 - DNA, 22 bp, Homo sapiens
gagagagacatgtaaacgcggt

SEQ ID NO: 7394707 - DNA, 22 bp, Homo sapiens
gagagagaagtgggtgtcacct

SEQ ID NO: 7394708 - DNA, 22 bp, Homo sapiens
gagagagaagtgggtgtcacct

SEQ ID NO: 7394709 - DNA, 22 bp, Homo sapiens
gactggggaaggacccgagacc

SEQ ID NO: 7394710 - DNA, 22 bp, Homo sapiens
gactggggctctagccaggcct

SEQ ID NO: 7394711 - DNA, 22 bp, Homo sapiens
gactggggctctagccaggcct

SEQ ID NO: 7394712 - DNA, 21 bp, Homo sapiens
gactgggctgacttgtgctgg

SEQ ID NO: 7394713 - DNA, 21 bp, Homo sapiens
gactgggctgacttgtgctgg

SEQ ID NO: 7394714 - DNA, 21 bp, Homo sapiens
gactgggctgacttgtgctgg

SEQ ID NO: 7394715 - DNA, 22 bp, Homo sapiens
gactggggaaggacccgagacc

SEQ ID NO: 7394716 - DNA, 22 bp, Homo sapiens
gactgggccaaggtcagcagct

SEQ ID NO: 7394717 - DNA, 22 bp, Homo sapiens
gactgggcagccggtagggaag

SEQ ID NO: 7394718 - DNA, 22 bp, Homo sapiens
gactgggccaaggtcagcagct

SEQ ID NO: 7394719 - DNA, 22 bp, Homo sapiens
gactgggctccaagagggagag

SEQ ID NO: 7394720 - DNA, 22 bp, Homo sapiens
gactggggctctagccaggcct

SEQ ID NO: 7394721 - DNA, 22 bp, Homo sapiens
gactggggctctagccaggcct

SEQ ID NO: 7394722 - DNA, 22 bp, Homo sapiens
gactggggctctagccaggcct

SEQ ID NO: 7394723 - DNA, 22 bp, Homo sapiens
gactggggctctagccaggcct

SEQ ID NO: 7394724 - DNA, 22 bp, Homo sapiens
gagacagtggttgcagaagctc

SEQ ID NO: 7394725 - DNA, 22 bp, Homo sapiens
gagacagtgtccatccaggggc

SEQ ID NO: 7394726 - DNA, 22 bp, Homo sapiens
gagacagtgctccgtgggtcca

SEQ ID NO: 7394727 - DNA, 22 bp, Homo sapiens
gagacagtgtcagccattgaaa

SEQ ID NO: 7394728 - DNA, 22 bp, Homo sapiens
gagacatggcaaaagcactggt

SEQ ID NO: 7394729 - DNA, 22 bp, Homo sapiens
gagagcagactctcaaagctgg

SEQ ID NO: 7394730 - DNA, 22 bp, Homo sapiens
gagagcagactctcaaagctgg

SEQ ID NO: 7394731 - DNA, 22 bp, Homo sapiens
gagagcagactctcaaagctgg

SEQ ID NO: 7394732 - DNA, 22 bp, Homo sapiens
gagagcagactctcaaagctgg

SEQ ID NO: 7394733 - DNA, 22 bp, Homo sapiens
gagagcagactctcaaagctgg

SEQ ID NO: 7394734 - DNA, 22 bp, Homo sapiens
gagagcacggtcttgggcatgg

SEQ ID NO: 7394735 - DNA, 22 bp, Homo sapiens
gagagcacatgaacatggagga

SEQ ID NO: 7394736 - DNA, 22 bp, Homo sapiens
gagagcaatggggacgggcagg

SEQ ID NO: 7394737 - DNA, 22 bp, Homo sapiens
gagagcaatggggacgggcagg

SEQ ID NO: 7394738 - DNA, 23 bp, Homo sapiens
gagagcaatgagatgtaaacact

SEQ ID NO: 7394739 - DNA, 22 bp, Homo sapiens
gagagcaatggggacgggcagg

SEQ ID NO: 7394740 - DNA, 23 bp, Homo sapiens
gagagcaatgagatgtaaacact

SEQ ID NO: 7394741 - DNA, 22 bp, Homo sapiens
gagagatccagactgtgggtga

SEQ ID NO: 7394742 - DNA, 22 bp, Homo sapiens
gagagataggttgcaggaagct

SEQ ID NO: 7394743 - DNA, 22 bp, Homo sapiens
gagagagctctgtgcctgggat

SEQ ID NO: 7394744 - DNA, 22 bp, Homo sapiens
gagagagctctgtgcctgggat

SEQ ID NO: 7394745 - DNA, 23 bp, Homo sapiens
gagagagattgctaaaccactcc

SEQ ID NO: 7394746 - DNA, 23 bp, Homo sapiens
gagagagattgctaaaccactcc

SEQ ID NO: 7394747 - DNA, 22 bp, Homo sapiens
gagagagctctgtgcctgggat

SEQ ID NO: 7394748 - DNA, 22 bp, Homo sapiens
gagagagctctgtgcctgggat

SEQ ID NO: 7394749 - DNA, 22 bp, Homo sapiens
gagagagctctgtgcctgggat

SEQ ID NO: 7394750 - DNA, 22 bp, Homo sapiens
gagagagctctgtgcctgggat

SEQ ID NO: 7394751 - DNA, 22 bp, Homo sapiens
gagagaggcctccatgtactga

SEQ ID NO: 7394752 - DNA, 22 bp, Homo sapiens
gagagaggcctccatgtactga

SEQ ID NO: 7394753 - DNA, 22 bp, Homo sapiens
gagagaggcctccatgtactga

SEQ ID NO: 7394754 - DNA, 22 bp, Homo sapiens
gagagaggcctccatgtactga

SEQ ID NO: 7394755 - DNA, 22 bp, Homo sapiens
gagagaggcctccatgtactga

SEQ ID NO: 7394756 - DNA, 22 bp, Homo sapiens
gagagaggcctccatgtactga

SEQ ID NO: 7394757 - DNA, 22 bp, Homo sapiens
gagagaggcctccatgtactga

SEQ ID NO: 7394758 - DNA, 22 bp, Homo sapiens
gagagaggcctccatgtactga

SEQ ID NO: 7394759 - DNA, 22 bp, Homo sapiens
gagagaggcctccatgtactga

SEQ ID NO: 7394760 - DNA, 22 bp, Homo sapiens
gagagaggcctccatgtactga

SEQ ID NO: 7394761 - DNA, 22 bp, Homo sapiens
gagagtattacaaattttacaa

SEQ ID NO: 7394762 - DNA, 22 bp, Homo sapiens
gagagtattacaaattttacaa

SEQ ID NO: 7394763 - DNA, 22 bp, Homo sapiens
gagaggttgaacaacatactct

SEQ ID NO: 7394764 - DNA, 22 bp, Homo sapiens
atggagggtgtcagagagcgaa

SEQ ID NO: 7394765 - DNA, 22 bp, Homo sapiens
atggagggtgtcagagagcgaa

SEQ ID NO: 7394766 - DNA, 22 bp, Homo sapiens
atggagggtgtcagagagcgaa

SEQ ID NO: 7394767 - DNA, 22 bp, Homo sapiens
atggagggtgtcagagagcgaa

SEQ ID NO: 7394768 - DNA, 22 bp, Homo sapiens
atggagggtgtcagagagcgaa

SEQ ID NO: 7394769 - DNA, 22 bp, Homo sapiens
gagatggccagtgccaggacaa

SEQ ID NO: 7394770 - DNA, 22 bp, Homo sapiens
gagagtcactgtctgcatttcc

SEQ ID NO: 7394771 - DNA, 22 bp, Homo sapiens
gagagtcatacagaccaatata

SEQ ID NO: 7394772 - DNA, 22 bp, Homo sapiens
gagatggagtctttttctgtca

SEQ ID NO: 7394773 - DNA, 22 bp, Homo sapiens
gagagtccaggtctgggtcctt

SEQ ID NO: 7394774 - DNA, 22 bp, Homo sapiens
gagatggcaggtgtgtgggaca

SEQ ID NO: 7394775 - DNA, 22 bp, Homo sapiens
gagatggccagtgccaggacaa

SEQ ID NO: 7394776 - DNA, 21 bp, Homo sapiens
gagatggcccagtagcgggcc

SEQ ID NO: 7394777 - DNA, 22 bp, Homo sapiens
gagatggctctcagatctttga

SEQ ID NO: 7394778 - DNA, 23 bp, Homo sapiens
gagatggctggttgtcctctgaa

SEQ ID NO: 7394779 - DNA, 22 bp, Homo sapiens
gagatgggcgagaaggtggact

SEQ ID NO: 7394780 - DNA, 22 bp, Homo sapiens
gagatgggcgagaaggtggact

SEQ ID NO: 7394781 - DNA, 22 bp, Homo sapiens
gagatgggcgagaaggtggact

SEQ ID NO: 7394782 - DNA, 22 bp, Homo sapiens
gagatgggcgagaaggtggact

SEQ ID NO: 7394783 - DNA, 22 bp, Homo sapiens
gagatgggcgagaaggtggact

SEQ ID NO: 7394784 - DNA, 22 bp, Homo sapiens
gagatgggcgagaaggtggact

SEQ ID NO: 7394785 - DNA, 22 bp, Homo sapiens
gagatgggcgagaaggtggact

SEQ ID NO: 7394786 - DNA, 22 bp, Homo sapiens
gagatggcttgctctcacgtgg

SEQ ID NO: 7394787 - DNA, 22 bp, Homo sapiens
atggagggaaaagtggagagcc

SEQ ID NO: 7394788 - DNA, 22 bp, Homo sapiens
atggagggaaaagtggagagcc

SEQ ID NO: 7394789 - DNA, 21 bp, Homo sapiens
atggagggaccagggaagcag

SEQ ID NO: 7394790 - DNA, 21 bp, Homo sapiens
atggagggaccagggaagcag

SEQ ID NO: 7394791 - DNA, 21 bp, Homo sapiens
atggagggaccagggaagcag

SEQ ID NO: 7394792 - DNA, 22 bp, Homo sapiens
atggagggaaaagtggagagcc

SEQ ID NO: 7394793 - DNA, 21 bp, Homo sapiens
atggagggaccagggaagcag

SEQ ID NO: 7394794 - DNA, 21 bp, Homo sapiens
atggagggaccagggaagcag

SEQ ID NO: 7394795 - DNA, 21 bp, Homo sapiens
atggagggaccagggaagcag

SEQ ID NO: 7394796 - DNA, 21 bp, Homo sapiens
atggagggaccagggaagcag

SEQ ID NO: 7394797 - DNA, 21 bp, Homo sapiens
atggagggaccagggaagcag

SEQ ID NO: 7394798 - DNA, 22 bp, Homo sapiens
atggagggtggtaagacagaga

SEQ ID NO: 7394799 - DNA, 21 bp, Homo sapiens
atggagggaccagggaagcag

SEQ ID NO: 7394800 - DNA, 21 bp, Homo sapiens
atggagggaccagggaagcag

SEQ ID NO: 7394801 - DNA, 21 bp, Homo sapiens
atggagggaccagggaagcag

SEQ ID NO: 7394802 - DNA, 22 bp, Homo sapiens
atggagggtggtaagacagaga

SEQ ID NO: 7394803 - DNA, 22 bp, Homo sapiens
atggagggtggtaagacagaga

SEQ ID NO: 7394804 - DNA, 22 bp, Homo sapiens
atggagggtggtaagacagaga

SEQ ID NO: 7394805 - DNA, 22 bp, Homo sapiens
atggagggtggtaagacagaga

SEQ ID NO: 7394806 - DNA, 22 bp, Homo sapiens
atggagggtggtaagacagaga

SEQ ID NO: 7394807 - DNA, 22 bp, Homo sapiens
atggagggaaaagtggagagcc

SEQ ID NO: 7394808 - DNA, 22 bp, Homo sapiens
atggagggaaaagtggagagcc

SEQ ID NO: 7394809 - DNA, 22 bp, Homo sapiens
atggagggaaaagtggagagcc

SEQ ID NO: 7394810 - DNA, 22 bp, Homo sapiens
atggagggaaaagtggagagcc

SEQ ID NO: 7394811 - DNA, 22 bp, Homo sapiens
atggagggaaaagtggagagcc

SEQ ID NO: 7394812 - DNA, 18 bp, Homo sapiens
atggaggcagagagctga

SEQ ID NO: 7394813 - DNA, 22 bp, Homo sapiens
atggaggatgtgcagcatgggc

SEQ ID NO: 7394814 - DNA, 18 bp, Homo sapiens
atggaggcagagagctga

SEQ ID NO: 7394815 - DNA, 17 bp, Homo sapiens
atggaggcagacaggtc

SEQ ID NO: 7394816 - DNA, 18 bp, Homo sapiens
atggaggcagagagctga

SEQ ID NO: 7394817 - DNA, 17 bp, Homo sapiens
atggaggcagacaggtc

SEQ ID NO: 7394818 - DNA, 17 bp, Homo sapiens
atggaggcagacaggtc

SEQ ID NO: 7394819 - DNA, 17 bp, Homo sapiens
atggaggcagacaggtc

SEQ ID NO: 7394820 - DNA, 17 bp, Homo sapiens
atggaggcagacaggtc

SEQ ID NO: 7394821 - DNA, 22 bp, Homo sapiens
atggaggatgtgcagcatgggc

SEQ ID NO: 7394822 - DNA, 22 bp, Homo sapiens
atggaggatgtgcagcatgggc

SEQ ID NO: 7394823 - DNA, 22 bp, Homo sapiens
gagatggggaataggagcaagc

SEQ ID NO: 7394824 - DNA, 22 bp, Homo sapiens
gagatggggaataggagcaagc

SEQ ID NO: 7394825 - DNA, 22 bp, Homo sapiens
gagatggggaataggagcaagc

SEQ ID NO: 7394826 - DNA, 22 bp, Homo sapiens
gagatggggaataggagcaagc

SEQ ID NO: 7394827 - DNA, 22 bp, Homo sapiens
gagatggggaataggagcaagc

SEQ ID NO: 7394828 - DNA, 22 bp, Homo sapiens
gagatggggaataggagcaagc

SEQ ID NO: 7394829 - DNA, 22 bp, Homo sapiens
gagatggggaataggagcaagc

SEQ ID NO: 7394830 - DNA, 22 bp, Homo sapiens
gagatgggcgagaaggtggact

SEQ ID NO: 7394831 - DNA, 22 bp, Homo sapiens
gagatgggcgagaaggtggact

SEQ ID NO: 7394832 - DNA, 22 bp, Homo sapiens
gagatgggcgagaaggtggact

SEQ ID NO: 7394833 - DNA, 22 bp, Homo sapiens
gagatggggtcttgctatgttg

SEQ ID NO: 7394834 - DNA, 22 bp, Homo sapiens
gagatggggtcttgctatgttg

SEQ ID NO: 7394835 - DNA, 22 bp, Homo sapiens
gagatggggtcttgctatgttg

SEQ ID NO: 7394836 - DNA, 22 bp, Homo sapiens
gagatggggtcagctgggacat

SEQ ID NO: 7394837 - DNA, 22 bp, Homo sapiens
gagatggggtcagctgggacat

SEQ ID NO: 7394838 - DNA, 22 bp, Homo sapiens
gagatggggtcagctgggacat

SEQ ID NO: 7394839 - DNA, 22 bp, Homo sapiens
gagatggggtcagctgggacat

SEQ ID NO: 7394840 - DNA, 22 bp, Homo sapiens
gagatggggtcagctgggacat

SEQ ID NO: 7394841 - DNA, 22 bp, Homo sapiens
gagatggggtcagctgggacat

SEQ ID NO: 7394842 - DNA, 22 bp, Homo sapiens
gagatggggtcagctgggacat

SEQ ID NO: 7394843 - DNA, 22 bp, Homo sapiens
gagatggggaataggagcaagc

SEQ ID NO: 7394844 - DNA, 22 bp, Homo sapiens
gagatggtgttccactgccagt

SEQ ID NO: 7394845 - DNA, 22 bp, Homo sapiens
gagatggtagcctcagaagagt

SEQ ID NO: 7394846 - DNA, 22 bp, Homo sapiens
atggcattaggaccatgagcct

SEQ ID NO: 7394847 - DNA, 22 bp, Homo sapiens
atggcattaggaccatgagcct

SEQ ID NO: 7394848 - DNA, 22 bp, Homo sapiens
atggcattgcaagggcaggagg

SEQ ID NO: 7394849 - DNA, 22 bp, Homo sapiens
atggcattgcaagggcaggagg

SEQ ID NO: 7394850 - DNA, 22 bp, Homo sapiens
atggcattgcagcctctcccat

SEQ ID NO: 7394851 - DNA, 22 bp, Homo sapiens
atggcattgctgtgctccactg

SEQ ID NO: 7394852 - DNA, 22 bp, Homo sapiens
atggcattgagtaaagtcagta

SEQ ID NO: 7394853 - DNA, 22 bp, Homo sapiens
atggcattcacatttccagaga

SEQ ID NO: 7394854 - DNA, 22 bp, Homo sapiens
atggcattcacatttccagaga

SEQ ID NO: 7394855 - DNA, 22 bp, Homo sapiens
atggcattcacatttccagaga

SEQ ID NO: 7394856 - DNA, 17 bp, Homo sapiens
gagatgggtggatcacc

SEQ ID NO: 7394857 - DNA, 17 bp, Homo sapiens
gagatgggtggatcacc

SEQ ID NO: 7394858 - DNA, 17 bp, Homo sapiens
gagatgggtggatcacc

SEQ ID NO: 7394859 - DNA, 17 bp, Homo sapiens
gagatgggtggatcacc

SEQ ID NO: 7394860 - DNA, 17 bp, Homo sapiens
gagatgggtggatcacc

SEQ ID NO: 7394861 - DNA, 17 bp, Homo sapiens
gagatgggtggatcacc

SEQ ID NO: 7394862 - DNA, 17 bp, Homo sapiens
gagatgggtggatcacc

SEQ ID NO: 7394863 - DNA, 22 bp, Homo sapiens
atggccaactgaaatgaaagat

SEQ ID NO: 7394864 - DNA, 22 bp, Homo sapiens
atggccaagaaattgccgactg

SEQ ID NO: 7394865 - DNA, 22 bp, Homo sapiens
atggccaagaagtattcctgac

SEQ ID NO: 7394866 - DNA, 22 bp, Homo sapiens
atggccaactgaaatgaaagat

SEQ ID NO: 7394867 - DNA, 20 bp, Homo sapiens
atggccaacctgcttatgac

SEQ ID NO: 7394868 - DNA, 22 bp, Homo sapiens
atggccaagcatatacagattg

SEQ ID NO: 7394869 - DNA, 22 bp, Homo sapiens
atggccaagcatatacagattg

SEQ ID NO: 7394870 - DNA, 22 bp, Homo sapiens
atggccaagaatatttctcaac

SEQ ID NO: 7394871 - DNA, 22 bp, Homo sapiens
atggcatttgtcaagataagta

SEQ ID NO: 7394872 - DNA, 22 bp, Homo sapiens
atggcatttttagacagtcctt

SEQ ID NO: 7394873 - DNA, 22 bp, Homo sapiens
atggcatttttagacagtcctt

SEQ ID NO: 7394874 - DNA, 22 bp, Homo sapiens
atggcatttgaatctgtctttt

SEQ ID NO: 7394875 - DNA, 22 bp, Homo sapiens
atggcatttgaccgctttgtgg

SEQ ID NO: 7394876 - DNA, 22 bp, Homo sapiens
atggcattgctgtgctccactg

SEQ ID NO: 7394877 - DNA, 22 bp, Homo sapiens
atggcatttatgttgacaatgg

SEQ ID NO: 7394878 - DNA, 22 bp, Homo sapiens
atggcatttatgttgacaatgg

SEQ ID NO: 7394879 - DNA, 22 bp, Homo sapiens
atggccacatttagtaactggt

SEQ ID NO: 7394880 - DNA, 22 bp, Homo sapiens
atggccacatttagtaactggt

SEQ ID NO: 7394881 - DNA, 22 bp, Homo sapiens
atggccacatttagtaactggt

SEQ ID NO: 7394882 - DNA, 22 bp, Homo sapiens
atggccaagcatatacagattg

SEQ ID NO: 7394883 - DNA, 21 bp, Homo sapiens
atggccactatggtgcagcag

SEQ ID NO: 7394884 - DNA, 21 bp, Homo sapiens
atggccactatggtgcagcag

SEQ ID NO: 7394885 - DNA, 22 bp, Homo sapiens
atggccaccatttaatgaagct

SEQ ID NO: 7394886 - DNA, 22 bp, Homo sapiens
atggccaccatttaatgaagct

SEQ ID NO: 7394887 - DNA, 22 bp, Homo sapiens
atggccaccatttaatgaagct

SEQ ID NO: 7394888 - DNA, 22 bp, Homo sapiens
atggccaccatctctaaaacac

SEQ ID NO: 7394889 - DNA, 22 bp, Homo sapiens
atggccaccatctctaaaacac

SEQ ID NO: 7394890 - DNA, 22 bp, Homo sapiens
atggccaccatctctaaaacac

SEQ ID NO: 7394891 - DNA, 22 bp, Homo sapiens
atggccaccatctctaaaacac

SEQ ID NO: 7394892 - DNA, 22 bp, Homo sapiens
atggccagagagagcacacctg

SEQ ID NO: 7394893 - DNA, 22 bp, Homo sapiens
atggccagagagagcacacctg

SEQ ID NO: 7394894 - DNA, 22 bp, Homo sapiens
atggccagagagagcacacctg

SEQ ID NO: 7394895 - DNA, 22 bp, Homo sapiens
atggccagagaaggcagggtca

SEQ ID NO: 7394896 - DNA, 22 bp, Homo sapiens
atggccagagaaggcagggtca

SEQ ID NO: 7394897 - DNA, 22 bp, Homo sapiens
atggccagagagagcacacctg

SEQ ID NO: 7394898 - DNA, 22 bp, Homo sapiens
atggccagagaaggcagggtca

SEQ ID NO: 7394899 - DNA, 22 bp, Homo sapiens
atggccagagaaggcagggtca

SEQ ID NO: 7394900 - DNA, 22 bp, Homo sapiens
atggccagagaaggcagggtca

SEQ ID NO: 7394901 - DNA, 22 bp, Homo sapiens
atggccagagaaggcagggtca

SEQ ID NO: 7394902 - DNA, 21 bp, Homo sapiens
atggccactatggtgcagcag

SEQ ID NO: 7394903 - DNA, 21 bp, Homo sapiens
atggccactatggtgcagcag

SEQ ID NO: 7394904 - DNA, 22 bp, Homo sapiens
atggcttctagcattgtcacaa

SEQ ID NO: 7394905 - DNA, 21 bp, Homo sapiens
atggcttctcaggtgcactga

SEQ ID NO: 7394906 - DNA, 22 bp, Homo sapiens
atggcttcgagtatatacatag

SEQ ID NO: 7394907 - DNA, 22 bp, Homo sapiens
atggcttctagcattgtcacaa

SEQ ID NO: 7394908 - DNA, 22 bp, Homo sapiens
atggcttctcgctggcacctgt

SEQ ID NO: 7394909 - DNA, 18 bp, Homo sapiens
atggcttctgagtggagg

SEQ ID NO: 7394910 - DNA, 18 bp, Homo sapiens
atggcttctgagtggagg

SEQ ID NO: 7394911 - DNA, 22 bp, Homo sapiens
atggcttctcgctggcacctgt

SEQ ID NO: 7394912 - DNA, 21 bp, Homo sapiens
atggcttctcaggtgcactga

SEQ ID NO: 7394913 - DNA, 21 bp, Homo sapiens
atggcttctcaggtgcactga

SEQ ID NO: 7394914 - DNA, 22 bp, Homo sapiens
atggcttctcgctggcacctgt

SEQ ID NO: 7394915 - DNA, 22 bp, Homo sapiens
atggcttccaaggccctccgtg

SEQ ID NO: 7394916 - DNA, 17 bp, Homo sapiens
atggcttccattgacca

SEQ ID NO: 7394917 - DNA, 22 bp, Homo sapiens
atggcttcctctggattggatt

SEQ ID NO: 7394918 - DNA, 22 bp, Homo sapiens
atggcttcgagtatatacatag

SEQ ID NO: 7394919 - DNA, 22 bp, Homo sapiens
atggcttccaaggccctccgtg

SEQ ID NO: 7394920 - DNA, 22 bp, Homo sapiens
atggcttccaaggccctccgtg

SEQ ID NO: 7394921 - DNA, 22 bp, Homo sapiens
atggctgttttgtgacttctca

SEQ ID NO: 7394922 - DNA, 22 bp, Homo sapiens
atggccagagaggccagcctgg

SEQ ID NO: 7394923 - DNA, 22 bp, Homo sapiens
atggccagagaggccagcctgg

SEQ ID NO: 7394924 - DNA, 22 bp, Homo sapiens
atggccagagaggccagcctgg

SEQ ID NO: 7394925 - DNA, 21 bp, Homo sapiens
atggccagatctattaggtgg

SEQ ID NO: 7394926 - DNA, 22 bp, Homo sapiens
atggctggcatccaggtgggct

SEQ ID NO: 7394927 - DNA, 22 bp, Homo sapiens
atggctggcatccaggtgggct

SEQ ID NO: 7394928 - DNA, 22 bp, Homo sapiens
atggctggcatccaggtgggct

SEQ ID NO: 7394929 - DNA, 22 bp, Homo sapiens
atggctgtgttgttcctctgaa

SEQ ID NO: 7394930 - DNA, 22 bp, Homo sapiens
atggctgttttgtgacttctca

SEQ ID NO: 7394931 - DNA, 22 bp, Homo sapiens
atggctgtttagcttctctgct

SEQ ID NO: 7394932 - DNA, 22 bp, Homo sapiens
atggctgtttagcttctctgct

SEQ ID NO: 7394933 - DNA, 22 bp, Homo sapiens
atggctgttggcaggaggcctc

SEQ ID NO: 7394934 - DNA, 22 bp, Homo sapiens
atggctgttggcaggaggcctc

SEQ ID NO: 7394935 - DNA, 21 bp, Homo sapiens
atggcttttttaaagcttgtg

SEQ ID NO: 7394936 - DNA, 21 bp, Homo sapiens
atggcttttttaaagcttgtg

SEQ ID NO: 7394937 - DNA, 21 bp, Homo sapiens
atggcttttttaaagcttgtg

SEQ ID NO: 7394938 - DNA, 22 bp, Homo sapiens
atggcttttttcttgggcactc

SEQ ID NO: 7394939 - DNA, 22 bp, Homo sapiens
atggcttttgatgctaagccaa

SEQ ID NO: 7394940 - DNA, 22 bp, Homo sapiens
atggctttttagactttggtac

SEQ ID NO: 7394941 - DNA, 22 bp, Homo sapiens
atggcttttgatcaaaagaaat

SEQ ID NO: 7394942 - DNA, 22 bp, Homo sapiens
atggcttttgatcaaaagaaat

SEQ ID NO: 7394943 - DNA, 22 bp, Homo sapiens
atggcttttcacagagggttct

SEQ ID NO: 7394944 - DNA, 22 bp, Homo sapiens
atggctttgtgttcagagctga

SEQ ID NO: 7394945 - DNA, 22 bp, Homo sapiens
atggctttgttccaataaaact

SEQ ID NO: 7394946 - DNA, 22 bp, Homo sapiens
atggctttgttccaataaaact

SEQ ID NO: 7394947 - DNA, 22 bp, Homo sapiens
atggcttttaactttgatggca

SEQ ID NO: 7394948 - DNA, 22 bp, Homo sapiens
atggctttgactgtaagtggta

SEQ ID NO: 7394949 - DNA, 22 bp, Homo sapiens
atggctttgctcaagtttagcc

SEQ ID NO: 7394950 - DNA, 22 bp, Homo sapiens
atggctttgctcaagtttagcc

SEQ ID NO: 7394951 - DNA, 22 bp, Homo sapiens
atggctttgctcaagtttagcc

SEQ ID NO: 7394952 - DNA, 22 bp, Homo sapiens
atggctttggtgtgaccctggg

SEQ ID NO: 7394953 - DNA, 17 bp, Homo sapiens
atggctttgtcacacag

SEQ ID NO: 7394954 - DNA, 22 bp, Homo sapiens
atggctttctctaatgtggtat

SEQ ID NO: 7394955 - DNA, 22 bp, Homo sapiens
atggctttctgtgtttccgtag

SEQ ID NO: 7394956 - DNA, 22 bp, Homo sapiens
atggctttctgtgtttccgtag

SEQ ID NO: 7394957 - DNA, 22 bp, Homo sapiens
atggctttgaagtaatgtaatt

SEQ ID NO: 7394958 - DNA, 22 bp, Homo sapiens
atggctttgaagtaatgtaatt

SEQ ID NO: 7394959 - DNA, 22 bp, Homo sapiens
atggctttgaagttcagctttt

SEQ ID NO: 7394960 - DNA, 22 bp, Homo sapiens
atggcttctgtcttggaaactt

SEQ ID NO: 7394961 - DNA, 22 bp, Homo sapiens
atggcttctgtcttggaaactt

SEQ ID NO: 7394962 - DNA, 22 bp, Homo sapiens
atggcttgatagaaagctagtt

SEQ ID NO: 7394963 - DNA, 22 bp, Homo sapiens
atggcttctgtcttggaaattt

SEQ ID NO: 7394964 - DNA, 22 bp, Homo sapiens
atggcttggttggttaaagcac

SEQ ID NO: 7394965 - DNA, 22 bp, Homo sapiens
atggcttggttggttaaagcac

SEQ ID NO: 7394966 - DNA, 22 bp, Homo sapiens
atggcttggcaccatctccttg

SEQ ID NO: 7394967 - DNA, 22 bp, Homo sapiens
atggcttgcagagaaaagaggt

SEQ ID NO: 7394968 - DNA, 22 bp, Homo sapiens
atggcttgcttttagagagatc

SEQ ID NO: 7394969 - DNA, 22 bp, Homo sapiens
atggcttgcttttagagagatc

SEQ ID NO: 7394970 - DNA, 22 bp, Homo sapiens
atggcttggcaccatctccttg

SEQ ID NO: 7394971 - DNA, 22 bp, Homo sapiens
atggcttggcaccatctccttg

SEQ ID NO: 7394972 - DNA, 22 bp, Homo sapiens
atggctttccggactttggcca

SEQ ID NO: 7394973 - DNA, 22 bp, Homo sapiens
atggctttcagatttctatgtt

SEQ ID NO: 7394974 - DNA, 22 bp, Homo sapiens
atggctttcctgggacatgggc

SEQ ID NO: 7394975 - DNA, 22 bp, Homo sapiens
atggctttcctgggacatgggc

SEQ ID NO: 7394976 - DNA, 22 bp, Homo sapiens
atggctttccggactttggcca

SEQ ID NO: 7394977 - DNA, 22 bp, Homo sapiens
atggctttcctgggacatgggc

SEQ ID NO: 7394978 - DNA, 22 bp, Homo sapiens
atggctttcagatggtgaaaga

SEQ ID NO: 7394979 - DNA, 22 bp, Homo sapiens
atggctttcagatggtgaaaga

SEQ ID NO: 7394980 - DNA, 22 bp, Homo sapiens
atggctttcagatggtgaaaga

SEQ ID NO: 7394981 - DNA, 22 bp, Homo sapiens
atggcttgtccaagcggcagac

SEQ ID NO: 7394982 - DNA, 22 bp, Homo sapiens
atggcttgtctatgagtgctct

SEQ ID NO: 7394983 - DNA, 22 bp, Homo sapiens
atggcttgtctatgagtgctct

SEQ ID NO: 7394984 - DNA, 22 bp, Homo sapiens
atggcttgcagagaaaagaggt

SEQ ID NO: 7394985 - DNA, 22 bp, Homo sapiens
atggcttgttcattggtacctg

SEQ ID NO: 7394986 - DNA, 22 bp, Homo sapiens
atggcttgttcattggtacctg

SEQ ID NO: 7394987 - DNA, 22 bp, Homo sapiens
attaggaagtaagtatcacaag

SEQ ID NO: 7394988 - DNA, 22 bp, Homo sapiens
attaggaagtaagtatcacaag

SEQ ID NO: 7394989 - DNA, 22 bp, Homo sapiens
attaggaagtaagtatcacaag

SEQ ID NO: 7394990 - DNA, 22 bp, Homo sapiens
attaggaaattatatgtcctcc

SEQ ID NO: 7394991 - DNA, 22 bp, Homo sapiens
attaggaagaggatgtcagcat

SEQ ID NO: 7394992 - DNA, 22 bp, Homo sapiens
attaggaagaggatgtcagcat

SEQ ID NO: 7394993 - DNA, 22 bp, Homo sapiens
attagctttggtggaaaggagt

SEQ ID NO: 7394994 - DNA, 22 bp, Homo sapiens
attagctttggtggaaaggagt

SEQ ID NO: 7394995 - DNA, 22 bp, Homo sapiens
attaggaaactgaatgtcagaa

SEQ ID NO: 7394996 - DNA, 22 bp, Homo sapiens
attaggaaactgaatgtcagaa

SEQ ID NO: 7394997 - DNA, 22 bp, Homo sapiens
attaggaaatgtgttgcaagca

SEQ ID NO: 7394998 - DNA, 22 bp, Homo sapiens
attaggaaatgtgttgcaagca

SEQ ID NO: 7394999 - DNA, 22 bp, Homo sapiens
attagctttatttgaaatagga

SEQ ID NO: 7395000 - DNA, 22 bp, Homo sapiens
attagctttatttgaaatagga

SEQ ID NO: 7395001 - DNA, 22 bp, Homo sapiens
attagctttatttgaaatagga

SEQ ID NO: 7395002 - DNA, 22 bp, Homo sapiens
attagcttggtatgccataaag

SEQ ID NO: 7395003 - DNA, 22 bp, Homo sapiens
attagctttaaagactttgatt

SEQ ID NO: 7395004 - DNA, 22 bp, Homo sapiens
attagctttaaaccacagcagt

SEQ ID NO: 7395005 - DNA, 22 bp, Homo sapiens
attagctttaaaccacagcagt

SEQ ID NO: 7395006 - DNA, 22 bp, Homo sapiens
attagcttaggcatgaagagaa

SEQ ID NO: 7395007 - DNA, 22 bp, Homo sapiens
attagcttatcacacaagctgc

SEQ ID NO: 7395008 - DNA, 22 bp, Homo sapiens
attagcttatcacacaagctgc

SEQ ID NO: 7395009 - DNA, 22 bp, Homo sapiens
attagcttatcacacaagctgc

SEQ ID NO: 7395010 - DNA, 22 bp, Homo sapiens
attagcttatcacacaagctgc

SEQ ID NO: 7395011 - DNA, 22 bp, Homo sapiens
gatttctcttttgaagaggcct

SEQ ID NO: 7395012 - DNA, 22 bp, Homo sapiens
attagatacacagatttccact

SEQ ID NO: 7395013 - DNA, 22 bp, Homo sapiens
attagatacacagatttccact

SEQ ID NO: 7395014 - DNA, 22 bp, Homo sapiens
attagcttctgtgcatggactt

SEQ ID NO: 7395015 - DNA, 20 bp, Homo sapiens
attagcttggagacagtggc

SEQ ID NO: 7395016 - DNA, 20 bp, Homo sapiens
attagcttggagacagtggc

SEQ ID NO: 7395017 - DNA, 22 bp, Homo sapiens
attagcttcctatagtaagggg

SEQ ID NO: 7395018 - DNA, 22 bp, Homo sapiens
attagcttatcccatttctgaa

SEQ ID NO: 7395019 - DNA, 22 bp, Homo sapiens
attagcttatcccatttctgaa

SEQ ID NO: 7395020 - DNA, 22 bp, Homo sapiens
attagtcagtatttgtttgcca

SEQ ID NO: 7395021 - DNA, 22 bp, Homo sapiens
attagtattcagtttataacac

SEQ ID NO: 7395022 - DNA, 22 bp, Homo sapiens
attagtattcagtttataacac

SEQ ID NO: 7395023 - DNA, 22 bp, Homo sapiens
attagtctactgtctaataaat

SEQ ID NO: 7395024 - DNA, 22 bp, Homo sapiens
attagtattcagtttataacac

SEQ ID NO: 7395025 - DNA, 22 bp, Homo sapiens
attagtctactgtctaataaat

SEQ ID NO: 7395026 - DNA, 22 bp, Homo sapiens
attagtagagggagaagcttgg

SEQ ID NO: 7395027 - DNA, 22 bp, Homo sapiens
attagtagcacacagagatcag

SEQ ID NO: 7395028 - DNA, 22 bp, Homo sapiens
attagtagctgtaataactggg

SEQ ID NO: 7395029 - DNA, 22 bp, Homo sapiens
attagtattcagtttataacac

SEQ ID NO: 7395030 - DNA, 22 bp, Homo sapiens
attagtagtagttagcagcctc

SEQ ID NO: 7395031 - DNA, 22 bp, Homo sapiens
attaggtcatggggaggcccta

SEQ ID NO: 7395032 - DNA, 22 bp, Homo sapiens
attaggtggggttgttactgtt

SEQ ID NO: 7395033 - DNA, 22 bp, Homo sapiens
attaggttagtgtgcaagagaa

SEQ ID NO: 7395034 - DNA, 22 bp, Homo sapiens
attagggtaaggcttttcttag

SEQ ID NO: 7395035 - DNA, 22 bp, Homo sapiens
attagtaaaacattgtatatgt

SEQ ID NO: 7395036 - DNA, 22 bp, Homo sapiens
attagtaaaacattgtatatgt

SEQ ID NO: 7395037 - DNA, 22 bp, Homo sapiens
attagtaaaacattgtatatgt

SEQ ID NO: 7395038 - DNA, 22 bp, Homo sapiens
attaggttgaggtactcagagc

SEQ ID NO: 7395039 - DNA, 22 bp, Homo sapiens
attaggcattctgaatgaggtc

SEQ ID NO: 7395040 - DNA, 22 bp, Homo sapiens
attaggcattatggggataagg

SEQ ID NO: 7395041 - DNA, 22 bp, Homo sapiens
attaggtaatctttagatacac

SEQ ID NO: 7395042 - DNA, 22 bp, Homo sapiens
attaggatttggtatggtcata

SEQ ID NO: 7395043 - DNA, 22 bp, Homo sapiens
attaggcatatatgcttttaat

SEQ ID NO: 7395044 - DNA, 22 bp, Homo sapiens
attaggcagggcatggtggctc

SEQ ID NO: 7395045 - DNA, 22 bp, Homo sapiens
attaggcactagaatgtcaatt

SEQ ID NO: 7395046 - DNA, 22 bp, Homo sapiens
attaggcactagaatgtcaatt

SEQ ID NO: 7395047 - DNA, 22 bp, Homo sapiens
attaggcaattctgggcatctc

SEQ ID NO: 7395048 - DNA, 22 bp, Homo sapiens
attcaaattaagttaattcagc

SEQ ID NO: 7395049 - DNA, 22 bp, Homo sapiens
attcaaattaagttaattcagc

SEQ ID NO: 7395050 - DNA, 22 bp, Homo sapiens
attcaaattaagttaattcagc

SEQ ID NO: 7395051 - DNA, 22 bp, Homo sapiens
attcaaattaagttaattcagc

SEQ ID NO: 7395052 - DNA, 22 bp, Homo sapiens
attcaaattaagttaattcagc

SEQ ID NO: 7395053 - DNA, 22 bp, Homo sapiens
attcaaattaagttaattcagc

SEQ ID NO: 7395054 - DNA, 22 bp, Homo sapiens
attcaaattaagttaattcagc

SEQ ID NO: 7395055 - DNA, 22 bp, Homo sapiens
attcaaattaagttaattcagc

SEQ ID NO: 7395056 - DNA, 22 bp, Homo sapiens
attcaaattaagttaattcagc

SEQ ID NO: 7395057 - DNA, 22 bp, Homo sapiens
attcaaagtctagatgtagtgt

SEQ ID NO: 7395058 - DNA, 22 bp, Homo sapiens
attcaaagtctagatgtagtgt

SEQ ID NO: 7395059 - DNA, 22 bp, Homo sapiens
attcaaagtctagatgtagtgt

SEQ ID NO: 7395060 - DNA, 22 bp, Homo sapiens
attcaaagtactagctattttt

SEQ ID NO: 7395061 - DNA, 22 bp, Homo sapiens
attcaaagtagatgaagtttca

SEQ ID NO: 7395062 - DNA, 22 bp, Homo sapiens
attcaaatgtcaaatccaccag

SEQ ID NO: 7395063 - DNA, 22 bp, Homo sapiens
attcaaatgtcaaatccaccag

SEQ ID NO: 7395064 - DNA, 22 bp, Homo sapiens
attcaaattaagttaattcagc

SEQ ID NO: 7395065 - DNA, 22 bp, Homo sapiens
attcaaatgtcaaatccaccag

SEQ ID NO: 7395066 - DNA, 22 bp, Homo sapiens
attcaaagtactagctattttt

SEQ ID NO: 7395067 - DNA, 22 bp, Homo sapiens
attcaacatattctgagtaaaa

SEQ ID NO: 7395068 - DNA, 22 bp, Homo sapiens
attcaacatattctgagtaaaa

SEQ ID NO: 7395069 - DNA, 22 bp, Homo sapiens
attcaacatattctgagtaaaa

SEQ ID NO: 7395070 - DNA, 22 bp, Homo sapiens
attcaacttacaaaggagaaga

SEQ ID NO: 7395071 - DNA, 22 bp, Homo sapiens
attcaacttataagatattaat

SEQ ID NO: 7395072 - DNA, 22 bp, Homo sapiens
attcaagagcccatgtttcctg

SEQ ID NO: 7395073 - DNA, 22 bp, Homo sapiens
attcaagagcccatgtttcctg

SEQ ID NO: 7395074 - DNA, 22 bp, Homo sapiens
attcaactgtaaacttgttcac

SEQ ID NO: 7395075 - DNA, 22 bp, Homo sapiens
attcaactgtaaacttgttcac

SEQ ID NO: 7395076 - DNA, 22 bp, Homo sapiens
attagttgatctatatccaaag

SEQ ID NO: 7395077 - DNA, 22 bp, Homo sapiens
attagttggggtggagaaggat

SEQ ID NO: 7395078 - DNA, 22 bp, Homo sapiens
attagttgaacaagttaagtaa

SEQ ID NO: 7395079 - DNA, 22 bp, Homo sapiens
attagtgttgtggcttcatggc

SEQ ID NO: 7395080 - DNA, 22 bp, Homo sapiens
attagtgttgtggcttcatggc

SEQ ID NO: 7395081 - DNA, 22 bp, Homo sapiens
attagtgttgtaagaagctgcc

SEQ ID NO: 7395082 - DNA, 22 bp, Homo sapiens
attagtgttgtggcttcatggc

SEQ ID NO: 7395083 - DNA, 22 bp, Homo sapiens
attagtgtctgtgaataattct

SEQ ID NO: 7395084 - DNA, 22 bp, Homo sapiens
attagtgttcttatcttctagg

SEQ ID NO: 7395085 - DNA, 22 bp, Homo sapiens
attagtgttgtaagaagctgcc

SEQ ID NO: 7395086 - DNA, 22 bp, Homo sapiens
attagtgttgtaagaagctgcc

SEQ ID NO: 7395087 - DNA, 22 bp, Homo sapiens
attcaaagtactagctattttt

SEQ ID NO: 7395088 - DNA, 22 bp, Homo sapiens
attcaaagtactagctattttt

SEQ ID NO: 7395089 - DNA, 22 bp, Homo sapiens
attatttctcactcacataata

SEQ ID NO: 7395090 - DNA, 22 bp, Homo sapiens
attatttcagtcagacactggc

SEQ ID NO: 7395091 - DNA, 22 bp, Homo sapiens
attatttccttgctttgaggaa

SEQ ID NO: 7395092 - DNA, 22 bp, Homo sapiens
attatttcagtcagacactggc

SEQ ID NO: 7395093 - DNA, 22 bp, Homo sapiens
attagtgactctcacatatgcc

SEQ ID NO: 7395094 - DNA, 20 bp, Homo sapiens
attagtgcatctggacatgc

SEQ ID NO: 7395095 - DNA, 22 bp, Homo sapiens
attagtgcccaggctgcctctt

SEQ ID NO: 7395096 - DNA, 20 bp, Homo sapiens
attagtgcatctggacatgc

SEQ ID NO: 7395097 - DNA, 22 bp, Homo sapiens
attagtgtacatctcacacgca

SEQ ID NO: 7395098 - DNA, 22 bp, Homo sapiens
attagtgtcatgttgaggactt

SEQ ID NO: 7395099 - DNA, 22 bp, Homo sapiens
attagtgtacatctcacacgca

SEQ ID NO: 7395100 - DNA, 22 bp, Homo sapiens
attagtgtcatgttgaggactt

SEQ ID NO: 7395101 - DNA, 22 bp, Homo sapiens
attagtgtggaccctaatttaa

SEQ ID NO: 7395102 - DNA, 22 bp, Homo sapiens
attagtgtctgtgaataattct

SEQ ID NO: 7395103 - DNA, 22 bp, Homo sapiens
attagtgtctgtgaataattct

SEQ ID NO: 7395104 - DNA, 22 bp, Homo sapiens
attagtgtgtaggctggaaaaa

SEQ ID NO: 7395105 - DNA, 22 bp, Homo sapiens
attagtgttcttatcttctagg

SEQ ID NO: 7395106 - DNA, 22 bp, Homo sapiens
attagtgtgtaggctggaaaaa

SEQ ID NO: 7395107 - DNA, 22 bp, Homo sapiens
attagtgtggaccctaatttaa

SEQ ID NO: 7395108 - DNA, 22 bp, Homo sapiens
attacatatgttggcaacattt

SEQ ID NO: 7395109 - DNA, 22 bp, Homo sapiens
attacatatgttggcaacattt

SEQ ID NO: 7395110 - DNA, 22 bp, Homo sapiens
attacatatgttggcaacattt

SEQ ID NO: 7395111 - DNA, 22 bp, Homo sapiens
attacatatgttggcaacattt

SEQ ID NO: 7395112 - DNA, 22 bp, Homo sapiens
attacatatgttggcaacattt

SEQ ID NO: 7395113 - DNA, 22 bp, Homo sapiens
attacatatgttggcaacattt

SEQ ID NO: 7395114 - DNA, 22 bp, Homo sapiens
attacatatgttggcaacattt

SEQ ID NO: 7395115 - DNA, 22 bp, Homo sapiens
attacatatgttggcaacattt

SEQ ID NO: 7395116 - DNA, 22 bp, Homo sapiens
attacatgagagaatgtaaata

SEQ ID NO: 7395117 - DNA, 22 bp, Homo sapiens
attacatgagagaatgtaaata

SEQ ID NO: 7395118 - DNA, 22 bp, Homo sapiens
attacagttctacacatccttt

SEQ ID NO: 7395119 - DNA, 22 bp, Homo sapiens
attacagttaatttaccttctt

SEQ ID NO: 7395120 - DNA, 22 bp, Homo sapiens
attacagttaatttaccttctt

SEQ ID NO: 7395121 - DNA, 22 bp, Homo sapiens
attacagttctgcaggtagttt

SEQ ID NO: 7395122 - DNA, 22 bp, Homo sapiens
attacagttctgcaggtagttt

SEQ ID NO: 7395123 - DNA, 22 bp, Homo sapiens
attacgagaatgaagtatcagg

SEQ ID NO: 7395124 - DNA, 22 bp, Homo sapiens
attacctatttcattttctgtc

SEQ ID NO: 7395125 - DNA, 22 bp, Homo sapiens
attactatgatttgatcattac

SEQ ID NO: 7395126 - DNA, 22 bp, Homo sapiens
attactagattgtcaagattta

SEQ ID NO: 7395127 - DNA, 22 bp, Homo sapiens
attactcctagaatgcatttag

SEQ ID NO: 7395128 - DNA, 22 bp, Homo sapiens
attactgagcaacggtcatttc

SEQ ID NO: 7395129 - DNA, 22 bp, Homo sapiens
attactgagcttgtagctgcat

SEQ ID NO: 7395130 - DNA, 22 bp, Homo sapiens
attactgagcttgtagctgcat

SEQ ID NO: 7395131 - DNA, 22 bp, Homo sapiens
attactccttttctagcaggtg

SEQ ID NO: 7395132 - DNA, 22 bp, Homo sapiens
attactctgtctgcctctgacc

SEQ ID NO: 7395133 - DNA, 22 bp, Homo sapiens
attacctatttcattttctgtc

SEQ ID NO: 7395134 - DNA, 23 bp, Homo sapiens
attaccagcctgacaccaacaaa

SEQ ID NO: 7395135 - DNA, 23 bp, Homo sapiens
attaccagcctgacaccaacaaa

SEQ ID NO: 7395136 - DNA, 23 bp, Homo sapiens
attacatgagcaaatatagctat

SEQ ID NO: 7395137 - DNA, 22 bp, Homo sapiens
attaccacttaatcaacatatg

SEQ ID NO: 7395138 - DNA, 22 bp, Homo sapiens
attacatgagagaatgtaaata

SEQ ID NO: 7395139 - DNA, 22 bp, Homo sapiens
attacatgagagaatgtaaata

SEQ ID NO: 7395140 - DNA, 22 bp, Homo sapiens
attacatgagagaatgtaaata

SEQ ID NO: 7395141 - DNA, 22 bp, Homo sapiens
attacatgagagaatgtaaata

SEQ ID NO: 7395142 - DNA, 22 bp, Homo sapiens
gatatgtattgaatgatcattt

SEQ ID NO: 7395143 - DNA, 22 bp, Homo sapiens
gatatgtgcttgtaatatttat

SEQ ID NO: 7395144 - DNA, 22 bp, Homo sapiens
gatatgtgcttgtaatatttat

SEQ ID NO: 7395145 - DNA, 22 bp, Homo sapiens
gatatgtattccactataaagg

SEQ ID NO: 7395146 - DNA, 22 bp, Homo sapiens
gatatgtatgaggagtatgtat

SEQ ID NO: 7395147 - DNA, 22 bp, Homo sapiens
gatattcaagtggaattattct

SEQ ID NO: 7395148 - DNA, 22 bp, Homo sapiens
gatattcaaagattactgatat

SEQ ID NO: 7395149 - DNA, 22 bp, Homo sapiens
gatatgttgttgcctataccta

SEQ ID NO: 7395150 - DNA, 22 bp, Homo sapiens
gatatgtttaatgcctcagtat

SEQ ID NO: 7395151 - DNA, 22 bp, Homo sapiens
gatattcaagtggaattattct

SEQ ID NO: 7395152 - DNA, 22 bp, Homo sapiens
gatattcctgaaggacagggtt

SEQ ID NO: 7395153 - DNA, 22 bp, Homo sapiens
gatattcctgaaggacagggtt

SEQ ID NO: 7395154 - DNA, 22 bp, Homo sapiens
gatattcctgaaggacagggtt

SEQ ID NO: 7395155 - DNA, 22 bp, Homo sapiens
attacaatcgagagaaacaaat

SEQ ID NO: 7395156 - DNA, 22 bp, Homo sapiens
attacaatcgagagaaacaaat

SEQ ID NO: 7395157 - DNA, 22 bp, Homo sapiens
attacaatcgagagaaacaaat

SEQ ID NO: 7395158 - DNA, 22 bp, Homo sapiens
attacagtgggtaaacagaatt

SEQ ID NO: 7395159 - DNA, 22 bp, Homo sapiens
attacagtgggtaaacagaatt

SEQ ID NO: 7395160 - DNA, 22 bp, Homo sapiens
gatattgcacctctaatacatt

SEQ ID NO: 7395161 - DNA, 22 bp, Homo sapiens
gatattgtgatgatgtctttgg

SEQ ID NO: 7395162 - DNA, 22 bp, Homo sapiens
gatatttaactctcacaggtcc

SEQ ID NO: 7395163 - DNA, 22 bp, Homo sapiens
gatatttaactctcacaggtcc

SEQ ID NO: 7395164 - DNA, 22 bp, Homo sapiens
attacaatcgagagaaacaaat

SEQ ID NO: 7395165 - DNA, 22 bp, Homo sapiens
attacaatcgagagaaacaaat

SEQ ID NO: 7395166 - DNA, 22 bp, Homo sapiens
attacaatcgagagaaacaaat

SEQ ID NO: 7395167 - DNA, 22 bp, Homo sapiens
attacaatcgagagaaacaaat

SEQ ID NO: 7395168 - DNA, 22 bp, Homo sapiens
attacaatcgagagaaacaaat

SEQ ID NO: 7395169 - DNA, 22 bp, Homo sapiens
gatttccatgattgggccagaa

SEQ ID NO: 7395170 - DNA, 22 bp, Homo sapiens
gatttccctatagttttctctt

SEQ ID NO: 7395171 - DNA, 22 bp, Homo sapiens
gatttcctaatgtggatctctg

SEQ ID NO: 7395172 - DNA, 22 bp, Homo sapiens
gatttcccagcaaaagctggtt

SEQ ID NO: 7395173 - DNA, 22 bp, Homo sapiens
gatttccttgcatattggtaat

SEQ ID NO: 7395174 - DNA, 17 bp, Homo sapiens
gatttcctgaagttctt

SEQ ID NO: 7395175 - DNA, 22 bp, Homo sapiens
gatttcctagacatggggcaga

SEQ ID NO: 7395176 - DNA, 22 bp, Homo sapiens
gatttcctaatgtggatctctg

SEQ ID NO: 7395177 - DNA, 22 bp, Homo sapiens
gatttcctaatgtggatctctg

SEQ ID NO: 7395178 - DNA, 22 bp, Homo sapiens
gatttcctagacatggggcaga

SEQ ID NO: 7395179 - DNA, 22 bp, Homo sapiens
gatttcctagacatggggcaga

SEQ ID NO: 7395180 - DNA, 22 bp, Homo sapiens
gatttcctcactaacatccatc

SEQ ID NO: 7395181 - DNA, 17 bp, Homo sapiens
gatttcctgaagttctt

SEQ ID NO: 7395182 - DNA, 22 bp, Homo sapiens
gatttctcaatcctagtactat

SEQ ID NO: 7395183 - DNA, 22 bp, Homo sapiens
gatttctcaatcctagtactat

SEQ ID NO: 7395184 - DNA, 22 bp, Homo sapiens
gatttctagttcattatctatt

SEQ ID NO: 7395185 - DNA, 22 bp, Homo sapiens
gatttctcaatcctagtactat

SEQ ID NO: 7395186 - DNA, 22 bp, Homo sapiens
gatttctctgcacccactcagg

SEQ ID NO: 7395187 - DNA, 22 bp, Homo sapiens
gatttctgggctttatttcaga

SEQ ID NO: 7395188 - DNA, 22 bp, Homo sapiens
gatttctcatttgtggattgaa

SEQ ID NO: 7395189 - DNA, 22 bp, Homo sapiens
gatttctagttcattatctatt

SEQ ID NO: 7395190 - DNA, 22 bp, Homo sapiens
gatttctagttcattatctatt

SEQ ID NO: 7395191 - DNA, 22 bp, Homo sapiens
gatttctagtaagtcatgaagg

SEQ ID NO: 7395192 - DNA, 22 bp, Homo sapiens
gatttctacttgaacttgctaa

SEQ ID NO: 7395193 - DNA, 22 bp, Homo sapiens
gatttctacttgaacttgctaa

SEQ ID NO: 7395194 - DNA, 19 bp, Homo sapiens
gatttctacaaatgtcaga

SEQ ID NO: 7395195 - DNA, 22 bp, Homo sapiens
gatttctacttgaacttgctaa

SEQ ID NO: 7395196 - DNA, 19 bp, Homo sapiens
gatttctacaaatgtcaga

SEQ ID NO: 7395197 - DNA, 22 bp, Homo sapiens
gatttctaaggaggctgaactt

SEQ ID NO: 7395198 - DNA, 22 bp, Homo sapiens
gatttctaagttttaccacaaa

SEQ ID NO: 7395199 - DNA, 22 bp, Homo sapiens
gatttctaagttttaccacaaa

SEQ ID NO: 7395200 - DNA, 22 bp, Homo sapiens
attagaaaaactcaagggctct

SEQ ID NO: 7395201 - DNA, 22 bp, Homo sapiens
attagaaaaactcaagggctct

SEQ ID NO: 7395202 - DNA, 22 bp, Homo sapiens
attagaaaaactcaagggctct

SEQ ID NO: 7395203 - DNA, 22 bp, Homo sapiens
attactgaggcaaagtagtttt

SEQ ID NO: 7395204 - DNA, 22 bp, Homo sapiens
attactgaggcaaagtagtttt

SEQ ID NO: 7395205 - DNA, 22 bp, Homo sapiens
attactgaggcaaagtagtttt

SEQ ID NO: 7395206 - DNA, 22 bp, Homo sapiens
attactgtgactagccatctgg

SEQ ID NO: 7395207 - DNA, 22 bp, Homo sapiens
attagaaaatctggaggtgggg

SEQ ID NO: 7395208 - DNA, 22 bp, Homo sapiens
attagaaaatacatgggctgtc

SEQ ID NO: 7395209 - DNA, 22 bp, Homo sapiens
attagaaaccaagaggcaggct

SEQ ID NO: 7395210 - DNA, 22 bp, Homo sapiens
attagaaaccaagaggcaggct

SEQ ID NO: 7395211 - DNA, 22 bp, Homo sapiens
attagaaaatacatgggctgtc

SEQ ID NO: 7395212 - DNA, 22 bp, Homo sapiens
attagaaaatacatgggctgtc

SEQ ID NO: 7395213 - DNA, 22 bp, Homo sapiens
attagaaaaactcaagggctct

SEQ ID NO: 7395214 - DNA, 22 bp, Homo sapiens
attagaaaaactcaagggctct

SEQ ID NO: 7395215 - DNA, 22 bp, Homo sapiens
attagaaaatacatgggctgtc

SEQ ID NO: 7395216 - DNA, 22 bp, Homo sapiens
attagaaaccaagaggcaggct

SEQ ID NO: 7395217 - DNA, 22 bp, Homo sapiens
attagaaaatctggaggtgggg

SEQ ID NO: 7395218 - DNA, 23 bp, Homo sapiens
attagaaaggctttctggtgaaa

SEQ ID NO: 7395219 - DNA, 23 bp, Homo sapiens
attagaaaggctttctggtgaaa

SEQ ID NO: 7395220 - DNA, 23 bp, Homo sapiens
attagaaaggctttctggtgaaa

SEQ ID NO: 7395221 - DNA, 23 bp, Homo sapiens
attagaaaggctttctggtgaaa

SEQ ID NO: 7395222 - DNA, 23 bp, Homo sapiens
attagaaaggctttctggtgaaa

SEQ ID NO: 7395223 - DNA, 21 bp, Homo sapiens
gatttcacttaccttcattta

SEQ ID NO: 7395224 - DNA, 22 bp, Homo sapiens
gatttcagaagcaagaggaggt

SEQ ID NO: 7395225 - DNA, 22 bp, Homo sapiens
gatttcagagtttattaggtta

SEQ ID NO: 7395226 - DNA, 22 bp, Homo sapiens
gatttcaggctatctatgcaga

SEQ ID NO: 7395227 - DNA, 22 bp, Homo sapiens
gatttcagagtttattaggtta

SEQ ID NO: 7395228 - DNA, 23 bp, Homo sapiens
attagaaaggctttctggtgaaa

SEQ ID NO: 7395229 - DNA, 22 bp, Homo sapiens
gatttcacctgatcttgtcatc

SEQ ID NO: 7395230 - DNA, 22 bp, Homo sapiens
gatttcagggtgcagatgatga

SEQ ID NO: 7395231 - DNA, 22 bp, Homo sapiens
gatttcaggctatctatgcaga

SEQ ID NO: 7395232 - DNA, 22 bp, Homo sapiens
gatttcagggtgtcttccagct

SEQ ID NO: 7395233 - DNA, 22 bp, Homo sapiens
gatttccaggtcattaataaag

SEQ ID NO: 7395234 - DNA, 22 bp, Homo sapiens
gatttccaggtcattaataaag

SEQ ID NO: 7395235 - DNA, 22 bp, Homo sapiens
gatttcagtggctgtctcaaat

SEQ ID NO: 7395236 - DNA, 22 bp, Homo sapiens
gatttcagtggctgtctcaaat

SEQ ID NO: 7395237 - DNA, 22 bp, Homo sapiens
gatttccaggacgggaggtggg

SEQ ID NO: 7395238 - DNA, 22 bp, Homo sapiens
gatttccaggacgggaggtggg

SEQ ID NO: 7395239 - DNA, 22 bp, Homo sapiens
gcagcagagtagacagagccct

SEQ ID NO: 7395240 - DNA, 22 bp, Homo sapiens
gcagcagagtagacagagccct

SEQ ID NO: 7395241 - DNA, 22 bp, Homo sapiens
gcagcagagtagacagagccct

SEQ ID NO: 7395242 - DNA, 22 bp, Homo sapiens
gcagcagagtagacagagccct

SEQ ID NO: 7395243 - DNA, 22 bp, Homo sapiens
gcagcagagtagacagagccct

SEQ ID NO: 7395244 - DNA, 22 bp, Homo sapiens
gcagcagagtagacagagccct

SEQ ID NO: 7395245 - DNA, 22 bp, Homo sapiens
gcagcagagtttgggagatggt

SEQ ID NO: 7395246 - DNA, 22 bp, Homo sapiens
gcagcagagtttgggagatggt

SEQ ID NO: 7395247 - DNA, 22 bp, Homo sapiens
gcagcagagtttgggagatggt

SEQ ID NO: 7395248 - DNA, 22 bp, Homo sapiens
gcagcagagtttgggagatggt

SEQ ID NO: 7395249 - DNA, 22 bp, Homo sapiens
gcagcagagtagacagagccct

SEQ ID NO: 7395250 - DNA, 22 bp, Homo sapiens
gcagcagagtttgggagatggt

SEQ ID NO: 7395251 - DNA, 22 bp, Homo sapiens
gcagcagagtttgggagatggt

SEQ ID NO: 7395252 - DNA, 22 bp, Homo sapiens
gcagcagagtttgggagatggt

SEQ ID NO: 7395253 - DNA, 22 bp, Homo sapiens
gcagcagagtttgggagatggt

SEQ ID NO: 7395254 - DNA, 22 bp, Homo sapiens
gcagcagagtttgggagatggt

SEQ ID NO: 7395255 - DNA, 22 bp, Homo sapiens
gcagcagatgctttcatggaca

SEQ ID NO: 7395256 - DNA, 22 bp, Homo sapiens
gcagcagatgctttcatggaca

SEQ ID NO: 7395257 - DNA, 22 bp, Homo sapiens
gcagcagatgctttcatggaca

SEQ ID NO: 7395258 - DNA, 22 bp, Homo sapiens
gcagcagatgctttcatggaca

SEQ ID NO: 7395259 - DNA, 22 bp, Homo sapiens
attcagttctgctggttctgct

SEQ ID NO: 7395260 - DNA, 22 bp, Homo sapiens
attcagttctaaggtcagtgcc

SEQ ID NO: 7395261 - DNA, 22 bp, Homo sapiens
attcagttctaaggtcagtgcc

SEQ ID NO: 7395262 - DNA, 22 bp, Homo sapiens
attcagttctaaggtcagtgcc

SEQ ID NO: 7395263 - DNA, 22 bp, Homo sapiens
attcagttctggctgccttcct

SEQ ID NO: 7395264 - DNA, 22 bp, Homo sapiens
attcagttctggctgccttcct

SEQ ID NO: 7395265 - DNA, 22 bp, Homo sapiens
attcagttctgctggttctgct

SEQ ID NO: 7395266 - DNA, 22 bp, Homo sapiens
attcagttctgctggttctgct

SEQ ID NO: 7395267 - DNA, 22 bp, Homo sapiens
attcagttctgctggttctgct

SEQ ID NO: 7395268 - DNA, 22 bp, Homo sapiens
attcagttctggctgccttcct

SEQ ID NO: 7395269 - DNA, 22 bp, Homo sapiens
gcagcagatgtgggcccagagc

SEQ ID NO: 7395270 - DNA, 22 bp, Homo sapiens
gcagcagatgctttcatggaca

SEQ ID NO: 7395271 - DNA, 22 bp, Homo sapiens
gcagcagatgtgggcccagagc

SEQ ID NO: 7395272 - DNA, 22 bp, Homo sapiens
gcagcagatgtgggcccagagc

SEQ ID NO: 7395273 - DNA, 22 bp, Homo sapiens
gcagcagatgtgggcccagagc

SEQ ID NO: 7395274 - DNA, 22 bp, Homo sapiens
attcagttccttgtgattgtag

SEQ ID NO: 7395275 - DNA, 22 bp, Homo sapiens
attcagttccttgtgattgtag

SEQ ID NO: 7395276 - DNA, 22 bp, Homo sapiens
attcagttccttgtgattgtag

SEQ ID NO: 7395277 - DNA, 22 bp, Homo sapiens
attcagttgtaatctttgttag

SEQ ID NO: 7395278 - DNA, 22 bp, Homo sapiens
attcagttgtaatctttgttag

SEQ ID NO: 7395279 - DNA, 22 bp, Homo sapiens
attcagttgtaatctttgttag

SEQ ID NO: 7395280 - DNA, 22 bp, Homo sapiens
attcagttgtaatctttgttag

SEQ ID NO: 7395281 - DNA, 22 bp, Homo sapiens
attcagttgtaatctttgttag

SEQ ID NO: 7395282 - DNA, 22 bp, Homo sapiens
attcagttgtctactactgcct

SEQ ID NO: 7395283 - DNA, 22 bp, Homo sapiens
attcagttgtctactactgcct

SEQ ID NO: 7395284 - DNA, 22 bp, Homo sapiens
attcagttgtctactactgcct

SEQ ID NO: 7395285 - DNA, 22 bp, Homo sapiens
attcagtttcaatcattgtagt

SEQ ID NO: 7395286 - DNA, 22 bp, Homo sapiens
attcagtttcaatcattgtagt

SEQ ID NO: 7395287 - DNA, 22 bp, Homo sapiens
attcagtttcaatcattgtagt

SEQ ID NO: 7395288 - DNA, 22 bp, Homo sapiens
attcagtttcaatcattgtagt

SEQ ID NO: 7395289 - DNA, 23 bp, Homo sapiens
attcagttgtgagagaagacaca

SEQ ID NO: 7395290 - DNA, 23 bp, Homo sapiens
attcagttgtgagagaagacaca

SEQ ID NO: 7395291 - DNA, 22 bp, Homo sapiens
attcagttgtctactactgcct

SEQ ID NO: 7395292 - DNA, 23 bp, Homo sapiens
attcagttgtgagagaagacaca

SEQ ID NO: 7395293 - DNA, 23 bp, Homo sapiens
attcagttgtgagagaagacaca

SEQ ID NO: 7395294 - DNA, 22 bp, Homo sapiens
attcatctgtacttcaatatct

SEQ ID NO: 7395295 - DNA, 22 bp, Homo sapiens
attcatctctgcatatagagtc

SEQ ID NO: 7395296 - DNA, 22 bp, Homo sapiens
attcatctgtacttcaatatct

SEQ ID NO: 7395297 - DNA, 22 bp, Homo sapiens
attcatctctgcatatagagtc

SEQ ID NO: 7395298 - DNA, 22 bp, Homo sapiens
attcatccttaccagtccccgg

SEQ ID NO: 7395299 - DNA, 22 bp, Homo sapiens
attcatcagctaatggacattt

SEQ ID NO: 7395300 - DNA, 22 bp, Homo sapiens
attcatcagctaatggacattt

SEQ ID NO: 7395301 - DNA, 22 bp, Homo sapiens
attcatcaactgatagccatag

SEQ ID NO: 7395302 - DNA, 22 bp, Homo sapiens
attcatatcatagagttattga

SEQ ID NO: 7395303 - DNA, 22 bp, Homo sapiens
attcatatcatagagttattga

SEQ ID NO: 7395304 - DNA, 22 bp, Homo sapiens
attcatatcatagagttattga

SEQ ID NO: 7395305 - DNA, 22 bp, Homo sapiens
attcatatcatagagttattga

SEQ ID NO: 7395306 - DNA, 22 bp, Homo sapiens
attcatatcatagagttattga

SEQ ID NO: 7395307 - DNA, 22 bp, Homo sapiens
attcataagtaaatgattacct

SEQ ID NO: 7395308 - DNA, 22 bp, Homo sapiens
attcatatcatagagttattga

SEQ ID NO: 7395309 - DNA, 22 bp, Homo sapiens
attcatagctcagtacagactc

SEQ ID NO: 7395310 - DNA, 22 bp, Homo sapiens
attcatacaggctttgctctta

SEQ ID NO: 7395311 - DNA, 22 bp, Homo sapiens
attcataagtaaatgattacct

SEQ ID NO: 7395312 - DNA, 22 bp, Homo sapiens
attcataacggcaaatgtcacc

SEQ ID NO: 7395313 - DNA, 22 bp, Homo sapiens
attcagtttttgaagggaaatt

SEQ ID NO: 7395314 - DNA, 22 bp, Homo sapiens
attcataacggcaaatgtcacc

SEQ ID NO: 7395315 - DNA, 22 bp, Homo sapiens
attcataacggcaaatgtcacc

SEQ ID NO: 7395316 - DNA, 22 bp, Homo sapiens
attcagtttttgaagggaaatt

SEQ ID NO: 7395317 - DNA, 22 bp, Homo sapiens
attcagtttttattggaccagc

SEQ ID NO: 7395318 - DNA, 22 bp, Homo sapiens
attcagtttttgaagggaaatt

SEQ ID NO: 7395319 - DNA, 22 bp, Homo sapiens
attcagtttttgaagggaaatt

SEQ ID NO: 7395320 - DNA, 22 bp, Homo sapiens
attcagtttttattggaccagc

SEQ ID NO: 7395321 - DNA, 22 bp, Homo sapiens
attcataacggcaaatgtcacc

SEQ ID NO: 7395322 - DNA, 22 bp, Homo sapiens
attcataacggcaaatgtcacc

SEQ ID NO: 7395323 - DNA, 22 bp, Homo sapiens
attcagtttttattggaccagc

SEQ ID NO: 7395324 - DNA, 22 bp, Homo sapiens
attcagtttttattggaccagc

SEQ ID NO: 7395325 - DNA, 21 bp, Homo sapiens
attcagtttgacatctagcag

SEQ ID NO: 7395326 - DNA, 21 bp, Homo sapiens
attcagtttgacatctagcag

SEQ ID NO: 7395327 - DNA, 21 bp, Homo sapiens
attcagtttgacatctagcag

SEQ ID NO: 7395328 - DNA, 21 bp, Homo sapiens
attcagtttgacatctagcag

SEQ ID NO: 7395329 - DNA, 22 bp, Homo sapiens
attcagtttcatggcacagcta

SEQ ID NO: 7395330 - DNA, 22 bp, Homo sapiens
attcagtttcatggcacagcta

SEQ ID NO: 7395331 - DNA, 22 bp, Homo sapiens
attcagtttcaatcattgtagt

SEQ ID NO: 7395332 - DNA, 22 bp, Homo sapiens
attcagtttcaatcattgtagt

SEQ ID NO: 7395333 - DNA, 22 bp, Homo sapiens
attcagtttcatggcacagcta

SEQ ID NO: 7395334 - DNA, 22 bp, Homo sapiens
attcagtttcatggcacagcta

SEQ ID NO: 7395335 - DNA, 21 bp, Homo sapiens
gcagcagaggcttgacagaca

SEQ ID NO: 7395336 - DNA, 21 bp, Homo sapiens
gcagcagaggcttgacagaca

SEQ ID NO: 7395337 - DNA, 21 bp, Homo sapiens
gcagcagaggcttgacagaca

SEQ ID NO: 7395338 - DNA, 21 bp, Homo sapiens
gcagcagaggcttgacagaca

SEQ ID NO: 7395339 - DNA, 22 bp, Homo sapiens
gcagcagagtagacagagccct

SEQ ID NO: 7395340 - DNA, 22 bp, Homo sapiens
gcagcagagtagacagagccct

SEQ ID NO: 7395341 - DNA, 22 bp, Homo sapiens
gcagcagagtagacagagccct

SEQ ID NO: 7395342 - DNA, 22 bp, Homo sapiens
gcagcagagtagacagagccct

SEQ ID NO: 7395343 - DNA, 22 bp, Homo sapiens
gcagcagagtagacagagccct

SEQ ID NO: 7395344 - DNA, 21 bp, Homo sapiens
gcagcagaggcttgacagaca

SEQ ID NO: 7395345 - DNA, 22 bp, Homo sapiens
gcagcagagctttgtcctggct

SEQ ID NO: 7395346 - DNA, 22 bp, Homo sapiens
gcagcagagctttgtcctggct

SEQ ID NO: 7395347 - DNA, 22 bp, Homo sapiens
gcagcagagctttgtcctggct

SEQ ID NO: 7395348 - DNA, 22 bp, Homo sapiens
gcagcagagctttgtcctggct

SEQ ID NO: 7395349 - DNA, 22 bp, Homo sapiens
gcagcagagctttgtcctggct

SEQ ID NO: 7395350 - DNA, 22 bp, Homo sapiens
gcagcagaggccctactctttg

SEQ ID NO: 7395351 - DNA, 22 bp, Homo sapiens
gcagcagaggccctactctttg

SEQ ID NO: 7395352 - DNA, 22 bp, Homo sapiens
gcagcagaggccctactctttg

SEQ ID NO: 7395353 - DNA, 22 bp, Homo sapiens
gcagcagaggccctactctttg

SEQ ID NO: 7395354 - DNA, 22 bp, Homo sapiens
gcagcagagaacacaatgatgg

SEQ ID NO: 7395355 - DNA, 22 bp, Homo sapiens
gcagcagagaacacaatgatgg

SEQ ID NO: 7395356 - DNA, 22 bp, Homo sapiens
gcagcagagaacacaatgatgg

SEQ ID NO: 7395357 - DNA, 22 bp, Homo sapiens
gcagcagagaccccaggaagga

SEQ ID NO: 7395358 - DNA, 22 bp, Homo sapiens
gcagcagagaacacaatgatgg

SEQ ID NO: 7395359 - DNA, 20 bp, Homo sapiens
gcagcagacagacaggggac

SEQ ID NO: 7395360 - DNA, 20 bp, Homo sapiens
gcagcagacagacaggggac

SEQ ID NO: 7395361 - DNA, 20 bp, Homo sapiens
gcagcagacagacaggggac

SEQ ID NO: 7395362 - DNA, 20 bp, Homo sapiens
gcagcagacagacaggggac

SEQ ID NO: 7395363 - DNA, 22 bp, Homo sapiens
gcagcagagaccccaggaagga

SEQ ID NO: 7395364 - DNA, 22 bp, Homo sapiens
gcagcagagaccccaggaagga

SEQ ID NO: 7395365 - DNA, 22 bp, Homo sapiens
gcagcagagaccccaggaagga

SEQ ID NO: 7395366 - DNA, 17 bp, Homo sapiens
gcagcagagagaccctc

SEQ ID NO: 7395367 - DNA, 17 bp, Homo sapiens
gcagcagagagaccctc

SEQ ID NO: 7395368 - DNA, 22 bp, Homo sapiens
gcagcagagaccccaggaagga

SEQ ID NO: 7395369 - DNA, 22 bp, Homo sapiens
gcagcagagaccccaggaagga

SEQ ID NO: 7395370 - DNA, 22 bp, Homo sapiens
gcagcagagaccccaggaagga

SEQ ID NO: 7395371 - DNA, 22 bp, Homo sapiens
gcagcagagaccccaggaagga

SEQ ID NO: 7395372 - DNA, 22 bp, Homo sapiens
gcagcagagaccccaggaagga

SEQ ID NO: 7395373 - DNA, 22 bp, Homo sapiens
gcagcagagaccccaggaagga

SEQ ID NO: 7395374 - DNA, 22 bp, Homo sapiens
gcagcagagaccccaggaagga

SEQ ID NO: 7395375 - DNA, 22 bp, Homo sapiens
gcagcagagaccccaggaagga

SEQ ID NO: 7395376 - DNA, 22 bp, Homo sapiens
attcagaagcaatcacagtgag

SEQ ID NO: 7395377 - DNA, 22 bp, Homo sapiens
attcagaagcaatcacagtgag

SEQ ID NO: 7395378 - DNA, 22 bp, Homo sapiens
attcagaagcaatcacagtgag

SEQ ID NO: 7395379 - DNA, 22 bp, Homo sapiens
attcagaagcaatcacagtgag

SEQ ID NO: 7395380 - DNA, 22 bp, Homo sapiens
attcagaagcaatcacagtgag

SEQ ID NO: 7395381 - DNA, 22 bp, Homo sapiens
attcagaagcaatcacagtgag

SEQ ID NO: 7395382 - DNA, 22 bp, Homo sapiens
attcagaagctattcttagttc

SEQ ID NO: 7395383 - DNA, 22 bp, Homo sapiens
attcagaagctattcttagttc

SEQ ID NO: 7395384 - DNA, 20 bp, Homo sapiens
attcagaataggcatgtaaa

SEQ ID NO: 7395385 - DNA, 20 bp, Homo sapiens
attcagaataggcatgtaaa

SEQ ID NO: 7395386 - DNA, 20 bp, Homo sapiens
attcagaataggcatgtaaa

SEQ ID NO: 7395387 - DNA, 22 bp, Homo sapiens
attcagaatggcaaacttctag

SEQ ID NO: 7395388 - DNA, 22 bp, Homo sapiens
attcagaatggcaaacttctag

SEQ ID NO: 7395389 - DNA, 22 bp, Homo sapiens
attcagaatggcaaacttctag

SEQ ID NO: 7395390 - DNA, 22 bp, Homo sapiens
attcagaatggcaaacttctag

SEQ ID NO: 7395391 - DNA, 20 bp, Homo sapiens
attcagaataggcatgtaaa

SEQ ID NO: 7395392 - DNA, 20 bp, Homo sapiens
attcagaataggcatgtaaa

SEQ ID NO: 7395393 - DNA, 22 bp, Homo sapiens
attcagaatggcaaacttctag

SEQ ID NO: 7395394 - DNA, 22 bp, Homo sapiens
attcagaatggcaaacttctag

SEQ ID NO: 7395395 - DNA, 22 bp, Homo sapiens
attcagaattgtgggcagtaca

SEQ ID NO: 7395396 - DNA, 22 bp, Homo sapiens
attcagaattgtgggcagtaca

SEQ ID NO: 7395397 - DNA, 22 bp, Homo sapiens
attcagactcttgagcagtccc

SEQ ID NO: 7395398 - DNA, 22 bp, Homo sapiens
attcagactcttgagcagtccc

SEQ ID NO: 7395399 - DNA, 23 bp, Homo sapiens
gcagatgcttagcaggtcctctc

SEQ ID NO: 7395400 - DNA, 20 bp, Homo sapiens
gcagcagacagacaggggac

SEQ ID NO: 7395401 - DNA, 22 bp, Homo sapiens
gcagatggaaagtgcttgaggg

SEQ ID NO: 7395402 - DNA, 22 bp, Homo sapiens
gcagatggaaagtgcttgaggg

SEQ ID NO: 7395403 - DNA, 22 bp, Homo sapiens
gcagatggaaagtgcttgaggg

SEQ ID NO: 7395404 - DNA, 23 bp, Homo sapiens
attcagaattgtgtgtttgtata

SEQ ID NO: 7395405 - DNA, 23 bp, Homo sapiens
attcagaattgtgtgtttgtata

SEQ ID NO: 7395406 - DNA, 22 bp, Homo sapiens
attcagaattgtgggcagtaca

SEQ ID NO: 7395407 - DNA, 22 bp, Homo sapiens
attcagaattgtgggcagtaca

SEQ ID NO: 7395408 - DNA, 23 bp, Homo sapiens
attcagaattgtgtgtttgtata

SEQ ID NO: 7395409 - DNA, 23 bp, Homo sapiens
attcagaattgtgtgtttgtata

SEQ ID NO: 7395410 - DNA, 22 bp, Homo sapiens
attcagaattttggggagctaa

SEQ ID NO: 7395411 - DNA, 22 bp, Homo sapiens
attcagaattttggggagctaa

SEQ ID NO: 7395412 - DNA, 22 bp, Homo sapiens
attcagaattttggggagctaa

SEQ ID NO: 7395413 - DNA, 22 bp, Homo sapiens
attcagaattttggggagctaa

SEQ ID NO: 7395414 - DNA, 22 bp, Homo sapiens
attcagacattaccctggacat

SEQ ID NO: 7395415 - DNA, 22 bp, Homo sapiens
attcagactatgaacacgtcag

SEQ ID NO: 7395416 - DNA, 22 bp, Homo sapiens
attcagactatgaacacgtcag

SEQ ID NO: 7395417 - DNA, 20 bp, Homo sapiens
attcacatataccagggagg

SEQ ID NO: 7395418 - DNA, 19 bp, Homo sapiens
attcacatccctgggaagg

SEQ ID NO: 7395419 - DNA, 22 bp, Homo sapiens
attcacatgatgtatgtagggc

SEQ ID NO: 7395420 - DNA, 22 bp, Homo sapiens
attcacatgatgtatgtagggc

SEQ ID NO: 7395421 - DNA, 22 bp, Homo sapiens
attcacatgatgtatgtagggc

SEQ ID NO: 7395422 - DNA, 20 bp, Homo sapiens
attcacatataccagggagg

SEQ ID NO: 7395423 - DNA, 22 bp, Homo sapiens
gcactcaggactctcatcagta

SEQ ID NO: 7395424 - DNA, 22 bp, Homo sapiens
attcacaatagcagcttgcatg

SEQ ID NO: 7395425 - DNA, 22 bp, Homo sapiens
gcactcaggactctcatcagta

SEQ ID NO: 7395426 - DNA, 22 bp, Homo sapiens
attcacaatagcagcttgcatg

SEQ ID NO: 7395427 - DNA, 22 bp, Homo sapiens
gcactatagctgcagcacagag

SEQ ID NO: 7395428 - DNA, 22 bp, Homo sapiens
gcactagttctactgccagcaa

SEQ ID NO: 7395429 - DNA, 22 bp, Homo sapiens
gcactagttctactgccagcaa

SEQ ID NO: 7395430 - DNA, 22 bp, Homo sapiens
gcactagtctaggtgctaagat

SEQ ID NO: 7395431 - DNA, 22 bp, Homo sapiens
gcactagtcaagtgaacaattt

SEQ ID NO: 7395432 - DNA, 22 bp, Homo sapiens
gcactagtgttcttcagtaata

SEQ ID NO: 7395433 - DNA, 22 bp, Homo sapiens
attcacaatagcagcttgcatg

SEQ ID NO: 7395434 - DNA, 22 bp, Homo sapiens
attcacaatagcagcttgcatg

SEQ ID NO: 7395435 - DNA, 22 bp, Homo sapiens
attcacaatgatacataagcga

SEQ ID NO: 7395436 - DNA, 22 bp, Homo sapiens
attcacaatgatacataagcga

SEQ ID NO: 7395437 - DNA, 22 bp, Homo sapiens
attcacaatgatacataagcga

SEQ ID NO: 7395438 - DNA, 22 bp, Homo sapiens
attcacaatgatacataagcga

SEQ ID NO: 7395439 - DNA, 22 bp, Homo sapiens
attcacaatgatacataagcga

SEQ ID NO: 7395440 - DNA, 22 bp, Homo sapiens
gcacggctaatttttgtatttt

SEQ ID NO: 7395441 - DNA, 22 bp, Homo sapiens
gcacggctaatttttgtatttt

SEQ ID NO: 7395442 - DNA, 22 bp, Homo sapiens
gcacggctaatttttgtatttt

SEQ ID NO: 7395443 - DNA, 22 bp, Homo sapiens
gcacggctaatttttgtatttt

SEQ ID NO: 7395444 - DNA, 22 bp, Homo sapiens
gcactaaaccaacatgtaataa

SEQ ID NO: 7395445 - DNA, 22 bp, Homo sapiens
gcacgtggaatgctcatgagcc

SEQ ID NO: 7395446 - DNA, 22 bp, Homo sapiens
gcacgtgttctgtggcatgggt

SEQ ID NO: 7395447 - DNA, 22 bp, Homo sapiens
gcacgtgcacacatgtgtacaa

SEQ ID NO: 7395448 - DNA, 22 bp, Homo sapiens
gcactagattctgaagcagcag

SEQ ID NO: 7395449 - DNA, 22 bp, Homo sapiens
gcactaggtaagtgggtggcaa

SEQ ID NO: 7395450 - DNA, 22 bp, Homo sapiens
gcactagaagtacgccttgtaa

SEQ ID NO: 7395451 - DNA, 22 bp, Homo sapiens
gcactacatcttcacgtgtctt

SEQ ID NO: 7395452 - DNA, 22 bp, Homo sapiens
gcacgtgcacacatgtgtacaa

SEQ ID NO: 7395453 - DNA, 22 bp, Homo sapiens
gcactagaatcccttcaagaag

SEQ ID NO: 7395454 - DNA, 22 bp, Homo sapiens
gcactagaatcccttcaagaag

SEQ ID NO: 7395455 - DNA, 22 bp, Homo sapiens
gcactagagcagctctcagaga

SEQ ID NO: 7395456 - DNA, 22 bp, Homo sapiens
attcaagattaattctatgtca

SEQ ID NO: 7395457 - DNA, 22 bp, Homo sapiens
attcaagaggaacaatgaagat

SEQ ID NO: 7395458 - DNA, 22 bp, Homo sapiens
attcaagaggaacaatgaagat

SEQ ID NO: 7395459 - DNA, 22 bp, Homo sapiens
attcaaggtatttaaaacataa

SEQ ID NO: 7395460 - DNA, 22 bp, Homo sapiens
attcaaggtatttaaaacataa

SEQ ID NO: 7395461 - DNA, 22 bp, Homo sapiens
attcaagattaattctatgtca

SEQ ID NO: 7395462 - DNA, 22 bp, Homo sapiens
attcaaggtatttaaaacataa

SEQ ID NO: 7395463 - DNA, 22 bp, Homo sapiens
attcaagtaaacactgaaggaa

SEQ ID NO: 7395464 - DNA, 22 bp, Homo sapiens
attcaaggtttattcagtttag

SEQ ID NO: 7395465 - DNA, 22 bp, Homo sapiens
attcaagtaaacactgaaggaa

SEQ ID NO: 7395466 - DNA, 22 bp, Homo sapiens
attcaagtacagttttcttctt

SEQ ID NO: 7395467 - DNA, 22 bp, Homo sapiens
gcacctggggtacacagctaca

SEQ ID NO: 7395468 - DNA, 22 bp, Homo sapiens
attcaagtacagttttcttctt

SEQ ID NO: 7395469 - DNA, 22 bp, Homo sapiens
attcaaggtttattcagtttag

SEQ ID NO: 7395470 - DNA, 22 bp, Homo sapiens
attcaaggtttattcagtttag

SEQ ID NO: 7395471 - DNA, 22 bp, Homo sapiens
attcaaggttggctcaggaatt

SEQ ID NO: 7395472 - DNA, 22 bp, Homo sapiens
attcaaggttggctcaggaatt

SEQ ID NO: 7395473 - DNA, 19 bp, Homo sapiens
gcacgctggcttgataggg

SEQ ID NO: 7395474 - DNA, 22 bp, Homo sapiens
gcacggcaagacggggcctcct

SEQ ID NO: 7395475 - DNA, 22 bp, Homo sapiens
gcacggctaatttttgtatttt

SEQ ID NO: 7395476 - DNA, 22 bp, Homo sapiens
gcacggcctcgcccttggaacc

SEQ ID NO: 7395477 - DNA, 22 bp, Homo sapiens
gcacggcaagacggggcctcct

SEQ ID NO: 7395478 - DNA, 22 bp, Homo sapiens
gcacgaggcaccgctgttttgt

SEQ ID NO: 7395479 - DNA, 22 bp, Homo sapiens
gcacgctctcaggccagggcat

SEQ ID NO: 7395480 - DNA, 22 bp, Homo sapiens
gcacgaggcaccgctgttttgt

SEQ ID NO: 7395481 - DNA, 22 bp, Homo sapiens
gcacctttggaatgaaaagttg

SEQ ID NO: 7395482 - DNA, 22 bp, Homo sapiens
gcaccttgggaagcgccagttg

SEQ ID NO: 7395483 - DNA, 22 bp, Homo sapiens
gcacctttctatattcagtggc

SEQ ID NO: 7395484 - DNA, 22 bp, Homo sapiens
gcaccttggctttcttggtggc

SEQ ID NO: 7395485 - DNA, 22 bp, Homo sapiens
gcacctttctatattcagtggc

SEQ ID NO: 7395486 - DNA, 22 bp, Homo sapiens
gcaccttatttaaatgatgttt

SEQ ID NO: 7395487 - DNA, 22 bp, Homo sapiens
gcaccttagcctgaatttgtgt

SEQ ID NO: 7395488 - DNA, 22 bp, Homo sapiens
gcaccttaattaagaaattgcc

SEQ ID NO: 7395489 - DNA, 18 bp, Homo sapiens
gcaccttaccaattctac

SEQ ID NO: 7395490 - DNA, 18 bp, Homo sapiens
gcaccttaccaattctac

SEQ ID NO: 7395491 - DNA, 22 bp, Homo sapiens
gcacctggtttatataatcata

SEQ ID NO: 7395492 - DNA, 22 bp, Homo sapiens
gcacctggggtacacagctaca

SEQ ID NO: 7395493 - DNA, 22 bp, Homo sapiens
gcacctggtttatataatcata

SEQ ID NO: 7395494 - DNA, 22 bp, Homo sapiens
attcagaaagggttgcctggtt

SEQ ID NO: 7395495 - DNA, 21 bp, Homo sapiens
attcagaaagggaataaactc

SEQ ID NO: 7395496 - DNA, 21 bp, Homo sapiens
attcagaaagggaataaactc

SEQ ID NO: 7395497 - DNA, 21 bp, Homo sapiens
attcagaaagggaataaactc

SEQ ID NO: 7395498 - DNA, 21 bp, Homo sapiens
attcagaaagggaataaactc

SEQ ID NO: 7395499 - DNA, 21 bp, Homo sapiens
attcagaaagggaataaactc

SEQ ID NO: 7395500 - DNA, 21 bp, Homo sapiens
attcagaaagggaataaactc

SEQ ID NO: 7395501 - DNA, 22 bp, Homo sapiens
attcagaaagcaagtgctgggt

SEQ ID NO: 7395502 - DNA, 22 bp, Homo sapiens
attcagaaagcaagtgctgggt

SEQ ID NO: 7395503 - DNA, 22 bp, Homo sapiens
attcagaaagcaagtgctgggt

SEQ ID NO: 7395504 - DNA, 22 bp, Homo sapiens
attcagaaagttgtcatatttg

SEQ ID NO: 7395505 - DNA, 22 bp, Homo sapiens
attcagaaagttgtcatatttg

SEQ ID NO: 7395506 - DNA, 22 bp, Homo sapiens
attcagaaagttgtcatatttg

SEQ ID NO: 7395507 - DNA, 22 bp, Homo sapiens
attcagaaagttgtcatatttg

SEQ ID NO: 7395508 - DNA, 22 bp, Homo sapiens
attcagaaagttgtcatatttg

SEQ ID NO: 7395509 - DNA, 22 bp, Homo sapiens
attcagaaagttgtcatatttg

SEQ ID NO: 7395510 - DNA, 22 bp, Homo sapiens
attcagaaagggttgcctggtt

SEQ ID NO: 7395511 - DNA, 22 bp, Homo sapiens
attcagaaagggttgcctggtt

SEQ ID NO: 7395512 - DNA, 22 bp, Homo sapiens
attcagaagcaatcacagtgag

SEQ ID NO: 7395513 - DNA, 22 bp, Homo sapiens
attcagaaatagaaaatttgat

SEQ ID NO: 7395514 - DNA, 22 bp, Homo sapiens
attcagaaatagaaaatttgat

SEQ ID NO: 7395515 - DNA, 22 bp, Homo sapiens
attcagaaatagaaaatttgat

SEQ ID NO: 7395516 - DNA, 22 bp, Homo sapiens
attcagaaagttgtcatatttg

SEQ ID NO: 7395517 - DNA, 22 bp, Homo sapiens
attcagaaagttgtcatatttg

SEQ ID NO: 7395518 - DNA, 22 bp, Homo sapiens
attcactgtggtgtctgatata

SEQ ID NO: 7395519 - DNA, 22 bp, Homo sapiens
attcagaaactctgggcagaac

SEQ ID NO: 7395520 - DNA, 22 bp, Homo sapiens
attcagaaactctgggcagaac

SEQ ID NO: 7395521 - DNA, 22 bp, Homo sapiens
attcagaaactctgggcagaac

SEQ ID NO: 7395522 - DNA, 22 bp, Homo sapiens
attcagaaagatatgcctggtt

SEQ ID NO: 7395523 - DNA, 22 bp, Homo sapiens
attcagaaagatatgcctggtt

SEQ ID NO: 7395524 - DNA, 22 bp, Homo sapiens
attcagaaagatatgcctggtt

SEQ ID NO: 7395525 - DNA, 22 bp, Homo sapiens
attcacttattctcaaagtcct

SEQ ID NO: 7395526 - DNA, 22 bp, Homo sapiens
attcacttattctcaaagtcct

SEQ ID NO: 7395527 - DNA, 22 bp, Homo sapiens
attcactgtggtgactgatata

SEQ ID NO: 7395528 - DNA, 22 bp, Homo sapiens
attcactgtcagcttgcatggg

SEQ ID NO: 7395529 - DNA, 22 bp, Homo sapiens
attcactgtgggtcctttggat

SEQ ID NO: 7395530 - DNA, 22 bp, Homo sapiens
attcactgtgggtcctttggat

SEQ ID NO: 7395531 - DNA, 22 bp, Homo sapiens
attcactggtgtcagggatcag

SEQ ID NO: 7395532 - DNA, 22 bp, Homo sapiens
attcactggtgtcagggatcag

SEQ ID NO: 7395533 - DNA, 22 bp, Homo sapiens
attcactgtcagcttgcatggg

SEQ ID NO: 7395534 - DNA, 22 bp, Homo sapiens
attcactgtcagcttgcatggg

SEQ ID NO: 7395535 - DNA, 23 bp, Homo sapiens
attcactcagtgagagggcagcc

SEQ ID NO: 7395536 - DNA, 22 bp, Homo sapiens
attcactggcagacagaactca

SEQ ID NO: 7395537 - DNA, 22 bp, Homo sapiens
attcaccccctatttgcaatgc

SEQ ID NO: 7395538 - DNA, 22 bp, Homo sapiens
attcaccccctatttgcaatgc

SEQ ID NO: 7395539 - DNA, 22 bp, Homo sapiens
attcacctgttagtaaaaatct

SEQ ID NO: 7395540 - DNA, 22 bp, Homo sapiens
attcacctgttagtaaaaatct

SEQ ID NO: 7395541 - DNA, 22 bp, Homo sapiens
attcaccttgataaggggatca

SEQ ID NO: 7395542 - DNA, 22 bp, Homo sapiens
attcacctttccccaaaatgag

SEQ ID NO: 7395543 - DNA, 22 bp, Homo sapiens
attcactgaatttcatgattat

SEQ ID NO: 7395544 - DNA, 22 bp, Homo sapiens
attcactgaatttcatgattat

SEQ ID NO: 7395545 - DNA, 22 bp, Homo sapiens
attcacatttagcctctgacat

SEQ ID NO: 7395546 - DNA, 22 bp, Homo sapiens
attcacatttagcctctgacat

SEQ ID NO: 7395547 - DNA, 22 bp, Homo sapiens
attcacatttagacatcaggta

SEQ ID NO: 7395548 - DNA, 22 bp, Homo sapiens
attcacatttagacatcaggta

SEQ ID NO: 7395549 - DNA, 22 bp, Homo sapiens
attcacatttagacatcaggta

SEQ ID NO: 7395550 - DNA, 22 bp, Homo sapiens
attcacatttacaaagcactca

SEQ ID NO: 7395551 - DNA, 22 bp, Homo sapiens
attcacatttacaaagcactca

SEQ ID NO: 7395552 - DNA, 22 bp, Homo sapiens
attcacatttacaaagcactca

SEQ ID NO: 7395553 - DNA, 15 bp, Homo sapiens
attcacattgcttca

SEQ ID NO: 7395554 - DNA, 15 bp, Homo sapiens
attcacattgcttca

SEQ ID NO: 7395555 - DNA, 22 bp, Homo sapiens
attcacattttatttcactgga

SEQ ID NO: 7395556 - DNA, 22 bp, Homo sapiens
attcacattttatttcactgga

SEQ ID NO: 7395557 - DNA, 22 bp, Homo sapiens
attcacatttagcctctgacat

SEQ ID NO: 7395558 - DNA, 22 bp, Homo sapiens
attcacccacgtcttagtctgt

SEQ ID NO: 7395559 - DNA, 22 bp, Homo sapiens
attcaccatggaccaggggcct

SEQ ID NO: 7395560 - DNA, 22 bp, Homo sapiens
attcaccaagaatgatttcagt

SEQ ID NO: 7395561 - DNA, 22 bp, Homo sapiens
attcaccaagaatgatttcagt

SEQ ID NO: 7395562 - DNA, 22 bp, Homo sapiens
attcaccaagaatgatttcagt

SEQ ID NO: 7395563 - DNA, 22 bp, Homo sapiens
attcacattttatttcactgga

SEQ ID NO: 7395564 - DNA, 22 bp, Homo sapiens
attcacatgtgcttcttatcac

SEQ ID NO: 7395565 - DNA, 22 bp, Homo sapiens
attcacatgcccaagcagcacc

SEQ ID NO: 7395566 - DNA, 22 bp, Homo sapiens
attcacatgtgcttcttatcac

SEQ ID NO: 7395567 - DNA, 22 bp, Homo sapiens
attcacatgtgcttcttatcac

SEQ ID NO: 7395568 - DNA, 22 bp, Homo sapiens
attcacatgtgcttcttatcac

SEQ ID NO: 7395569 - DNA, 22 bp, Homo sapiens
attcacatgtgcttcttatcac

SEQ ID NO: 7395570 - DNA, 22 bp, Homo sapiens
attcacatgatgtatgtagggc

SEQ ID NO: 7395571 - DNA, 22 bp, Homo sapiens
attcacatgcccaagcagcacc

SEQ ID NO: 7395572 - DNA, 22 bp, Homo sapiens
attcacatgcccaagcagcacc

SEQ ID NO: 7395573 - DNA, 22 bp, Homo sapiens
attcacatgcccaagcagcacc

SEQ ID NO: 7395574 - DNA, 22 bp, Homo sapiens
attcacatgcccaagcagcacc

SEQ ID NO: 7395575 - DNA, 22 bp, Homo sapiens
attcacattgagcttcactgtg

SEQ ID NO: 7395576 - DNA, 22 bp, Homo sapiens
attcacattgagcttcactgtg

SEQ ID NO: 7395577 - DNA, 22 bp, Homo sapiens
attcacattgagcttcactgtg

SEQ ID NO: 7395578 - DNA, 22 bp, Homo sapiens
attcacattctagggccctact

SEQ ID NO: 7395579 - DNA, 22 bp, Homo sapiens
attcacatgttgaagccctaac

SEQ ID NO: 7395580 - DNA, 22 bp, Homo sapiens
attcacattctagggccctact

SEQ ID NO: 7395581 - DNA, 22 bp, Homo sapiens
attcacatgttgaagccctaac

SEQ ID NO: 7395582 - DNA, 22 bp, Homo sapiens
attcacatgttgaagccctaac

SEQ ID NO: 7395583 - DNA, 22 bp, Homo sapiens
attcacatgttgaagccctaac

SEQ ID NO: 7395584 - DNA, 22 bp, Homo sapiens
attgatttaggcttgttatgac

SEQ ID NO: 7395585 - DNA, 22 bp, Homo sapiens
attgatttaggcttgttatgac

SEQ ID NO: 7395586 - DNA, 22 bp, Homo sapiens
attgatttaggcttgttatgac

SEQ ID NO: 7395587 - DNA, 22 bp, Homo sapiens
attgatttaggcttgttatgac

SEQ ID NO: 7395588 - DNA, 22 bp, Homo sapiens
attgatttaggcttgttatgac

SEQ ID NO: 7395589 - DNA, 22 bp, Homo sapiens
attgatttaggcttgttatgac

SEQ ID NO: 7395590 - DNA, 22 bp, Homo sapiens
attgatttagctcaagacacat

SEQ ID NO: 7395591 - DNA, 22 bp, Homo sapiens
attgatttgaacaaagatatta

SEQ ID NO: 7395592 - DNA, 22 bp, Homo sapiens
attgatttgaacaaagatatta

SEQ ID NO: 7395593 - DNA, 22 bp, Homo sapiens
attgatttctgcttactcactg

SEQ ID NO: 7395594 - DNA, 22 bp, Homo sapiens
attgatttagctcaagacacat

SEQ ID NO: 7395595 - DNA, 18 bp, Homo sapiens
attgattgggagaggatt

SEQ ID NO: 7395596 - DNA, 22 bp, Homo sapiens
attgatttagctcaagacacat

SEQ ID NO: 7395597 - DNA, 22 bp, Homo sapiens
attgatttagctcaagacacat

SEQ ID NO: 7395598 - DNA, 22 bp, Homo sapiens
attgattgaagtaaaataacct

SEQ ID NO: 7395599 - DNA, 22 bp, Homo sapiens
attgatgttagaatctactcct

SEQ ID NO: 7395600 - DNA, 23 bp, Homo sapiens
attgattccctcttggaagggat

SEQ ID NO: 7395601 - DNA, 22 bp, Homo sapiens
attgattctaccagctactttg

SEQ ID NO: 7395602 - DNA, 22 bp, Homo sapiens
attgattctaccagctactttg

SEQ ID NO: 7395603 - DNA, 22 bp, Homo sapiens
attgattctcataggaccatct

SEQ ID NO: 7395604 - DNA, 22 bp, Homo sapiens
attgattctgtaagtcaacaat

SEQ ID NO: 7395605 - DNA, 22 bp, Homo sapiens
attgattctgtaagtcaacaat

SEQ ID NO: 7395606 - DNA, 22 bp, Homo sapiens
gcagggctgactcagccaccct

SEQ ID NO: 7395607 - DNA, 22 bp, Homo sapiens
gcagggctgactcagccaccct

SEQ ID NO: 7395608 - DNA, 22 bp, Homo sapiens
attgcaaagcattgtgagcgca

SEQ ID NO: 7395609 - DNA, 22 bp, Homo sapiens
gcagggctgactcagccaccct

SEQ ID NO: 7395610 - DNA, 22 bp, Homo sapiens
gcagggctgactcagccaccct

SEQ ID NO: 7395611 - DNA, 22 bp, Homo sapiens
attgcaaagaaatacatgctta

SEQ ID NO: 7395612 - DNA, 22 bp, Homo sapiens
attgcaaagaaatacatgctta

SEQ ID NO: 7395613 - DNA, 22 bp, Homo sapiens
attgcaaagaaatacatgctta

SEQ ID NO: 7395614 - DNA, 22 bp, Homo sapiens
attgcaaagaaatacatgctta

SEQ ID NO: 7395615 - DNA, 22 bp, Homo sapiens
attgcaaagaaatacatgctta

SEQ ID NO: 7395616 - DNA, 22 bp, Homo sapiens
attgcaaagaaatacatgctta

SEQ ID NO: 7395617 - DNA, 22 bp, Homo sapiens
attgcaaagaaatacatgctta

SEQ ID NO: 7395618 - DNA, 22 bp, Homo sapiens
attgcaaagaaatacatgctta

SEQ ID NO: 7395619 - DNA, 22 bp, Homo sapiens
attgcaaaattgtcctgtggaa

SEQ ID NO: 7395620 - DNA, 22 bp, Homo sapiens
attgcaaaattgtcctgtggaa

SEQ ID NO: 7395621 - DNA, 22 bp, Homo sapiens
attgcaaaattgtcctgtggaa

SEQ ID NO: 7395622 - DNA, 22 bp, Homo sapiens
attgatttgtagtgcctgcact

SEQ ID NO: 7395623 - DNA, 22 bp, Homo sapiens
attgattttcagactatgcgag

SEQ ID NO: 7395624 - DNA, 22 bp, Homo sapiens
attgatttttgaggactggtat

SEQ ID NO: 7395625 - DNA, 22 bp, Homo sapiens
attgatttgaacaaagatatta

SEQ ID NO: 7395626 - DNA, 22 bp, Homo sapiens
attgatttgaacaaagatatta

SEQ ID NO: 7395627 - DNA, 22 bp, Homo sapiens
attgatttgtagtgcctgcact

SEQ ID NO: 7395628 - DNA, 22 bp, Homo sapiens
gcagggctgctgaaacttgttt

SEQ ID NO: 7395629 - DNA, 22 bp, Homo sapiens
gcagggctgctgaaacttgttt

SEQ ID NO: 7395630 - DNA, 22 bp, Homo sapiens
gcagggctgctgaaacttgttt

SEQ ID NO: 7395631 - DNA, 22 bp, Homo sapiens
gcagggctgcagagggcactgt

SEQ ID NO: 7395632 - DNA, 22 bp, Homo sapiens
gcagggctgggacttactggta

SEQ ID NO: 7395633 - DNA, 22 bp, Homo sapiens
gcagggctgggacttactggta

SEQ ID NO: 7395634 - DNA, 18 bp, Homo sapiens
gcagggctggacaagtca

SEQ ID NO: 7395635 - DNA, 22 bp, Homo sapiens
gcagggctgggacttactggta

SEQ ID NO: 7395636 - DNA, 22 bp, Homo sapiens
gcagggctgcagagggcactgt

SEQ ID NO: 7395637 - DNA, 22 bp, Homo sapiens
gcagggctgcagagggcactgt

SEQ ID NO: 7395638 - DNA, 22 bp, Homo sapiens
gcagggctgcagagggcactgt

SEQ ID NO: 7395639 - DNA, 22 bp, Homo sapiens
gcagggctgcagagggcactgt

SEQ ID NO: 7395640 - DNA, 22 bp, Homo sapiens
gcagggctgcagagggcactgt

SEQ ID NO: 7395641 - DNA, 18 bp, Homo sapiens
gcagggctgcacacgcat

SEQ ID NO: 7395642 - DNA, 18 bp, Homo sapiens
gcagggctgcacacgcat

SEQ ID NO: 7395643 - DNA, 18 bp, Homo sapiens
gcagggctgcacacgcat

SEQ ID NO: 7395644 - DNA, 22 bp, Homo sapiens
gcagggctgatgttattgacga

SEQ ID NO: 7395645 - DNA, 22 bp, Homo sapiens
gcagggctgatgttattgacga

SEQ ID NO: 7395646 - DNA, 22 bp, Homo sapiens
gcagggctgatggcttccctca

SEQ ID NO: 7395647 - DNA, 22 bp, Homo sapiens
gcagggctgagtcatgtgtgcc

SEQ ID NO: 7395648 - DNA, 22 bp, Homo sapiens
gcagggctgagtcatgtgtgcc

SEQ ID NO: 7395649 - DNA, 22 bp, Homo sapiens
gcagggctgagtcatgtgtgcc

SEQ ID NO: 7395650 - DNA, 22 bp, Homo sapiens
gcagggctgagtcatgtgtgcc

SEQ ID NO: 7395651 - DNA, 22 bp, Homo sapiens
gcagggctgagtcatgtgtgcc

SEQ ID NO: 7395652 - DNA, 22 bp, Homo sapiens
gcagggctgagtcatgtgtgcc

SEQ ID NO: 7395653 - DNA, 22 bp, Homo sapiens
gcagggctgatggcttccctca

SEQ ID NO: 7395654 - DNA, 22 bp, Homo sapiens
gcagggctgatggcttccctca

SEQ ID NO: 7395655 - DNA, 22 bp, Homo sapiens
gcagggctgatggcttccctca

SEQ ID NO: 7395656 - DNA, 22 bp, Homo sapiens
gcaggcctgcccagcaggatgg

SEQ ID NO: 7395657 - DNA, 22 bp, Homo sapiens
gcaggcctgcccagcaggatgg

SEQ ID NO: 7395658 - DNA, 22 bp, Homo sapiens
gcaggcctgcccagcaggatgg

SEQ ID NO: 7395659 - DNA, 22 bp, Homo sapiens
gcaggcctgcccagcaggatgg

SEQ ID NO: 7395660 - DNA, 22 bp, Homo sapiens
gcaggcctgcccagcaggatgg

SEQ ID NO: 7395661 - DNA, 22 bp, Homo sapiens
gcaggcctggtttacatggtag

SEQ ID NO: 7395662 - DNA, 22 bp, Homo sapiens
gcaggcctggtttacatggtag

SEQ ID NO: 7395663 - DNA, 22 bp, Homo sapiens
gcaggcctgggagtcatcttgt

SEQ ID NO: 7395664 - DNA, 22 bp, Homo sapiens
gcaggcctgcccagcaggatgg

SEQ ID NO: 7395665 - DNA, 22 bp, Homo sapiens
gcaggcctgcaggtatggccgg

SEQ ID NO: 7395666 - DNA, 22 bp, Homo sapiens
gcaggcctgcaggtatggccgg

SEQ ID NO: 7395667 - DNA, 22 bp, Homo sapiens
gcaggcctgcaggtatggccgg

SEQ ID NO: 7395668 - DNA, 22 bp, Homo sapiens
gcaggcctgactgtagggggca

SEQ ID NO: 7395669 - DNA, 22 bp, Homo sapiens
gcaggcctgactgtagggggca

SEQ ID NO: 7395670 - DNA, 19 bp, Homo sapiens
gcaggcctcttgggaatta

SEQ ID NO: 7395671 - DNA, 22 bp, Homo sapiens
gcaggcctgactgtagggggca

SEQ ID NO: 7395672 - DNA, 22 bp, Homo sapiens
gcaggcctgactgtagggggca

SEQ ID NO: 7395673 - DNA, 22 bp, Homo sapiens
gcaggcctgtcttgctcgccct

SEQ ID NO: 7395674 - DNA, 22 bp, Homo sapiens
gcaggcctgtcttgctcgccct

SEQ ID NO: 7395675 - DNA, 22 bp, Homo sapiens
gcaggcctgtcttgctcgccct

SEQ ID NO: 7395676 - DNA, 22 bp, Homo sapiens
gcaggcctgtaatgaagggaca

SEQ ID NO: 7395677 - DNA, 22 bp, Homo sapiens
gcaggcctgtaatgaagggaca

SEQ ID NO: 7395678 - DNA, 22 bp, Homo sapiens
gcaggcctggtttacatggtag

SEQ ID NO: 7395679 - DNA, 22 bp, Homo sapiens
gcaggcctgtaatgaagggaca

SEQ ID NO: 7395680 - DNA, 22 bp, Homo sapiens
gcaggcctgtaatgaagggaca

SEQ ID NO: 7395681 - DNA, 22 bp, Homo sapiens
gcaggcctggtttacatggtag

SEQ ID NO: 7395682 - DNA, 22 bp, Homo sapiens
gcaggcctggtttacatggtag

SEQ ID NO: 7395683 - DNA, 22 bp, Homo sapiens
gcaggcctggtttacatggtag

SEQ ID NO: 7395684 - DNA, 22 bp, Homo sapiens
gcaggcctttatccctgcctca

SEQ ID NO: 7395685 - DNA, 22 bp, Homo sapiens
gcaggccttggcaatgagcctg

SEQ ID NO: 7395686 - DNA, 22 bp, Homo sapiens
gcaggccttggcaatgagcctg

SEQ ID NO: 7395687 - DNA, 22 bp, Homo sapiens
gcaggccttggcaatgagcctg

SEQ ID NO: 7395688 - DNA, 22 bp, Homo sapiens
gcaggccttggcaatgagcctg

SEQ ID NO: 7395689 - DNA, 22 bp, Homo sapiens
gcaggccttggcaatgagcctg

SEQ ID NO: 7395690 - DNA, 22 bp, Homo sapiens
gcaggccttggcaatgagcctg

SEQ ID NO: 7395691 - DNA, 22 bp, Homo sapiens
gcaggcctgtcttgctcgccct

SEQ ID NO: 7395692 - DNA, 22 bp, Homo sapiens
attgatatcagtttgctgattg

SEQ ID NO: 7395693 - DNA, 22 bp, Homo sapiens
attgatatattatttctaactg

SEQ ID NO: 7395694 - DNA, 22 bp, Homo sapiens
attgatatcagtttgctgattg

SEQ ID NO: 7395695 - DNA, 22 bp, Homo sapiens
attgatggcggcctctccatat

SEQ ID NO: 7395696 - DNA, 22 bp, Homo sapiens
attgatggagagatttccattg

SEQ ID NO: 7395697 - DNA, 22 bp, Homo sapiens
attgatggaaaacaaatgatga

SEQ ID NO: 7395698 - DNA, 22 bp, Homo sapiens
attgatgagcattactctctaa

SEQ ID NO: 7395699 - DNA, 23 bp, Homo sapiens
attgatgacttgattacactttt

SEQ ID NO: 7395700 - DNA, 23 bp, Homo sapiens
attgatgacttgattacactttt

SEQ ID NO: 7395701 - DNA, 22 bp, Homo sapiens
attgatgttagaatctactcct

SEQ ID NO: 7395702 - DNA, 22 bp, Homo sapiens
attgatgttagaatctactcct

SEQ ID NO: 7395703 - DNA, 22 bp, Homo sapiens
attgatgttactattctggtct

SEQ ID NO: 7395704 - DNA, 22 bp, Homo sapiens
attgatgtgtcacaagagattt

SEQ ID NO: 7395705 - DNA, 22 bp, Homo sapiens
attgatgtgtcacaagagattt

SEQ ID NO: 7395706 - DNA, 22 bp, Homo sapiens
attgatgtgtcacaagagattt

SEQ ID NO: 7395707 - DNA, 22 bp, Homo sapiens
attgatgtgccgaaatagaggc

SEQ ID NO: 7395708 - DNA, 22 bp, Homo sapiens
attgatgtagtttcagatttca

SEQ ID NO: 7395709 - DNA, 22 bp, Homo sapiens
attgatggtgcttatagtcatg

SEQ ID NO: 7395710 - DNA, 22 bp, Homo sapiens
attgatggtgcttatagtcatg

SEQ ID NO: 7395711 - DNA, 22 bp, Homo sapiens
attgatgtagtttcagatttca

SEQ ID NO: 7395712 - DNA, 22 bp, Homo sapiens
attgatggtgatagtgctgtgg

SEQ ID NO: 7395713 - DNA, 22 bp, Homo sapiens
attgatgggtgccaatggagtg

SEQ ID NO: 7395714 - DNA, 22 bp, Homo sapiens
attgatgggaatggctaaactt

SEQ ID NO: 7395715 - DNA, 22 bp, Homo sapiens
attgacctgattgttcctggaa

SEQ ID NO: 7395716 - DNA, 22 bp, Homo sapiens
attgacctattggacatgaaac

SEQ ID NO: 7395717 - DNA, 23 bp, Homo sapiens
attgaccagctgtctcattttca

SEQ ID NO: 7395718 - DNA, 22 bp, Homo sapiens
gcaggcggaggttgcagtgagc

SEQ ID NO: 7395719 - DNA, 22 bp, Homo sapiens
gcaggcctttatccctgcctca

SEQ ID NO: 7395720 - DNA, 22 bp, Homo sapiens
gcaggcctttatccctgcctca

SEQ ID NO: 7395721 - DNA, 22 bp, Homo sapiens
gcaggcctttatccctgcctca

SEQ ID NO: 7395722 - DNA, 22 bp, Homo sapiens
gcaggcggaggttgcagtgagc

SEQ ID NO: 7395723 - DNA, 22 bp, Homo sapiens
gcaggcggaggttgcagtgagc

SEQ ID NO: 7395724 - DNA, 22 bp, Homo sapiens
attgatatattatttctaactg

SEQ ID NO: 7395725 - DNA, 22 bp, Homo sapiens
attgatatattatttctaactg

SEQ ID NO: 7395726 - DNA, 22 bp, Homo sapiens
attgataaattgcaatggggct

SEQ ID NO: 7395727 - DNA, 22 bp, Homo sapiens
attgagaaaataagtatggata

SEQ ID NO: 7395728 - DNA, 22 bp, Homo sapiens
attgactttcccttctcctcat

SEQ ID NO: 7395729 - DNA, 23 bp, Homo sapiens
attgactctaagagattcttgaa

SEQ ID NO: 7395730 - DNA, 22 bp, Homo sapiens
attgacttaaaggctctggtta

SEQ ID NO: 7395731 - DNA, 22 bp, Homo sapiens
attgacctggcagactggactg

SEQ ID NO: 7395732 - DNA, 23 bp, Homo sapiens
attgacctgtttagtctctccct

SEQ ID NO: 7395733 - DNA, 23 bp, Homo sapiens
attgactctaagagattcttgaa

SEQ ID NO: 7395734 - DNA, 22 bp, Homo sapiens
attccttgggctgccttattat

SEQ ID NO: 7395735 - DNA, 22 bp, Homo sapiens
attccttgggctgccttattat

SEQ ID NO: 7395736 - DNA, 22 bp, Homo sapiens
attccttgggctgccttattat

SEQ ID NO: 7395737 - DNA, 22 bp, Homo sapiens
attccttgtatatctacatgca

SEQ ID NO: 7395738 - DNA, 22 bp, Homo sapiens
attccttgtatatctacatgca

SEQ ID NO: 7395739 - DNA, 22 bp, Homo sapiens
attccttgtatatctacatgca

SEQ ID NO: 7395740 - DNA, 22 bp, Homo sapiens
attccttgggctgccttattat

SEQ ID NO: 7395741 - DNA, 22 bp, Homo sapiens
attccttgtatatctacatgca

SEQ ID NO: 7395742 - DNA, 19 bp, Homo sapiens
attcttcagcagtgagacc

SEQ ID NO: 7395743 - DNA, 19 bp, Homo sapiens
attcttcagcagtgagacc

SEQ ID NO: 7395744 - DNA, 19 bp, Homo sapiens
attcttcagcagtgagacc

SEQ ID NO: 7395745 - DNA, 19 bp, Homo sapiens
attcttcagcagtgagacc

SEQ ID NO: 7395746 - DNA, 22 bp, Homo sapiens
attccttggcattctggacttg

SEQ ID NO: 7395747 - DNA, 22 bp, Homo sapiens
attccttggcattctggacttg

SEQ ID NO: 7395748 - DNA, 22 bp, Homo sapiens
attccttggaacagatgcgaag

SEQ ID NO: 7395749 - DNA, 22 bp, Homo sapiens
attccttggaacagatgcgaag

SEQ ID NO: 7395750 - DNA, 22 bp, Homo sapiens
attccttgctctcatcaacctt

SEQ ID NO: 7395751 - DNA, 22 bp, Homo sapiens
attccttgggaattattgaatg

SEQ ID NO: 7395752 - DNA, 22 bp, Homo sapiens
attccttgggaattattgaatg

SEQ ID NO: 7395753 - DNA, 22 bp, Homo sapiens
attccttgggaattattgaatg

SEQ ID NO: 7395754 - DNA, 22 bp, Homo sapiens
attccttggcattctggacttg

SEQ ID NO: 7395755 - DNA, 19 bp, Homo sapiens
attcttcagcagtgagacc

SEQ ID NO: 7395756 - DNA, 22 bp, Homo sapiens
attcttcagtatgtgtggattg

SEQ ID NO: 7395757 - DNA, 22 bp, Homo sapiens
attcttcagtatgtgtggattg

SEQ ID NO: 7395758 - DNA, 22 bp, Homo sapiens
attcttcagtatgtgtggattg

SEQ ID NO: 7395759 - DNA, 22 bp, Homo sapiens
attcttcttgagtcttggactc

SEQ ID NO: 7395760 - DNA, 22 bp, Homo sapiens
attcttcttgagtcttggactc

SEQ ID NO: 7395761 - DNA, 22 bp, Homo sapiens
attcttgatatagatagttaat

SEQ ID NO: 7395762 - DNA, 19 bp, Homo sapiens
attcttggtgcaccttgta

SEQ ID NO: 7395763 - DNA, 23 bp, Homo sapiens
attcttggggaaatagtatgagc

SEQ ID NO: 7395764 - DNA, 23 bp, Homo sapiens
attcttggggaaatagtatgagc

SEQ ID NO: 7395765 - DNA, 22 bp, Homo sapiens
attcttgcttcacactcctctg

SEQ ID NO: 7395766 - DNA, 22 bp, Homo sapiens
attcttgcagtatacaactact

SEQ ID NO: 7395767 - DNA, 22 bp, Homo sapiens
attcttgcttcacactcctctg

SEQ ID NO: 7395768 - DNA, 22 bp, Homo sapiens
attcttggcaaggagatttaaa

SEQ ID NO: 7395769 - DNA, 22 bp, Homo sapiens
attcttggcaaggagatttaaa

SEQ ID NO: 7395770 - DNA, 22 bp, Homo sapiens
attctttaattcaattgaagga

SEQ ID NO: 7395771 - DNA, 22 bp, Homo sapiens
attctttaattcaattgaagga

SEQ ID NO: 7395772 - DNA, 22 bp, Homo sapiens
attctttaattcaattgaagga

SEQ ID NO: 7395773 - DNA, 22 bp, Homo sapiens
attctttaattcaattgaagga

SEQ ID NO: 7395774 - DNA, 22 bp, Homo sapiens
attcttgtttaatttgcatccc

SEQ ID NO: 7395775 - DNA, 22 bp, Homo sapiens
attcttgtaaattttgtgtgaa

SEQ ID NO: 7395776 - DNA, 22 bp, Homo sapiens
attcttgtaaattttgtgtgaa

SEQ ID NO: 7395777 - DNA, 19 bp, Homo sapiens
attcttgttaagtgtcatc

SEQ ID NO: 7395778 - DNA, 19 bp, Homo sapiens
attcttgttaagtgtcatc

SEQ ID NO: 7395779 - DNA, 22 bp, Homo sapiens
attcttgtttaatttgcatccc

SEQ ID NO: 7395780 - DNA, 22 bp, Homo sapiens
attctttacattggcttcttcc

SEQ ID NO: 7395781 - DNA, 22 bp, Homo sapiens
attctttacattggcttcttcc

SEQ ID NO: 7395782 - DNA, 22 bp, Homo sapiens
attctttacattggcttcttcc

SEQ ID NO: 7395783 - DNA, 22 bp, Homo sapiens
attctttacattggcttcttcc

SEQ ID NO: 7395784 - DNA, 22 bp, Homo sapiens
attctttagccagcaggtatat

SEQ ID NO: 7395785 - DNA, 22 bp, Homo sapiens
attctttagccagcaggtatat

SEQ ID NO: 7395786 - DNA, 22 bp, Homo sapiens
attctttaattcaattgaagga

SEQ ID NO: 7395787 - DNA, 22 bp, Homo sapiens
attctttaattcaattgaagga

SEQ ID NO: 7395788 - DNA, 22 bp, Homo sapiens
attctttaattcaattgaagga

SEQ ID NO: 7395789 - DNA, 22 bp, Homo sapiens
attctttaattcaattgaagga

SEQ ID NO: 7395790 - DNA, 22 bp, Homo sapiens
attctttagttggcttcttgcc

SEQ ID NO: 7395791 - DNA, 22 bp, Homo sapiens
attctttagttggcttcttgcc

SEQ ID NO: 7395792 - DNA, 22 bp, Homo sapiens
attctttattgctgatggttat

SEQ ID NO: 7395793 - DNA, 22 bp, Homo sapiens
attctttattgctgatggttat

SEQ ID NO: 7395794 - DNA, 22 bp, Homo sapiens
attctttattgctgatggttat

SEQ ID NO: 7395795 - DNA, 22 bp, Homo sapiens
attctttagttggcttcttgcc

SEQ ID NO: 7395796 - DNA, 22 bp, Homo sapiens
attctttagttggcttcttgcc

SEQ ID NO: 7395797 - DNA, 22 bp, Homo sapiens
attctttcaaggaatagttatt

SEQ ID NO: 7395798 - DNA, 22 bp, Homo sapiens
attctttcatataaaggctcag

SEQ ID NO: 7395799 - DNA, 22 bp, Homo sapiens
attctttcatataaaggctcag

SEQ ID NO: 7395800 - DNA, 22 bp, Homo sapiens
attctttcaaggaatagttatt

SEQ ID NO: 7395801 - DNA, 22 bp, Homo sapiens
attctttcaaggaatagttatt

SEQ ID NO: 7395802 - DNA, 22 bp, Homo sapiens
attctttcaaggaatagttatt

SEQ ID NO: 7395803 - DNA, 22 bp, Homo sapiens
attccttgcacatcagatagtt

SEQ ID NO: 7395804 - DNA, 22 bp, Homo sapiens
attccttgcacatcagatagtt

SEQ ID NO: 7395805 - DNA, 22 bp, Homo sapiens
attccttgcacatcagatagtt

SEQ ID NO: 7395806 - DNA, 22 bp, Homo sapiens
attccttgcacatcagatagtt

SEQ ID NO: 7395807 - DNA, 22 bp, Homo sapiens
attccttgcacatcagatagtt

SEQ ID NO: 7395808 - DNA, 22 bp, Homo sapiens
attccttgctctcatcaacctt

SEQ ID NO: 7395809 - DNA, 22 bp, Homo sapiens
attccttgctctcatcaacctt

SEQ ID NO: 7395810 - DNA, 22 bp, Homo sapiens
attccttgctctcatcaacctt

SEQ ID NO: 7395811 - DNA, 22 bp, Homo sapiens
attccttggaacagatgcgaag

SEQ ID NO: 7395812 - DNA, 22 bp, Homo sapiens
gcagctggacccacacggctta

SEQ ID NO: 7395813 - DNA, 22 bp, Homo sapiens
gcagctggacccacacggctta

SEQ ID NO: 7395814 - DNA, 22 bp, Homo sapiens
gcagctggacccacacggctta

SEQ ID NO: 7395815 - DNA, 22 bp, Homo sapiens
gcagctggaagtgacactctgt

SEQ ID NO: 7395816 - DNA, 22 bp, Homo sapiens
gcagctggacccacacggctta

SEQ ID NO: 7395817 - DNA, 22 bp, Homo sapiens
gcagctggacccacacggctta

SEQ ID NO: 7395818 - DNA, 22 bp, Homo sapiens
gcagctggacccacacggctta

SEQ ID NO: 7395819 - DNA, 22 bp, Homo sapiens
attccttctttgagaataagca

SEQ ID NO: 7395820 - DNA, 22 bp, Homo sapiens
gcagctggacccacacggctta

SEQ ID NO: 7395821 - DNA, 22 bp, Homo sapiens
attccttctttgagaataagca

SEQ ID NO: 7395822 - DNA, 22 bp, Homo sapiens
gcagctgctggagggaggcagg

SEQ ID NO: 7395823 - DNA, 22 bp, Homo sapiens
gcagctgctggagggaggcagg

SEQ ID NO: 7395824 - DNA, 22 bp, Homo sapiens
gcagctgctggagggaggcagg

SEQ ID NO: 7395825 - DNA, 22 bp, Homo sapiens
gcagctgctggagggaggcagg

SEQ ID NO: 7395826 - DNA, 22 bp, Homo sapiens
gcagctgctggagggaggcagg

SEQ ID NO: 7395827 - DNA, 22 bp, Homo sapiens
gcagctgctgggatcatttagg

SEQ ID NO: 7395828 - DNA, 22 bp, Homo sapiens
gcagctgctgggatcatttagg

SEQ ID NO: 7395829 - DNA, 22 bp, Homo sapiens
gcagctgctgtggcatcaagct

SEQ ID NO: 7395830 - DNA, 22 bp, Homo sapiens
gcagctgctgtggcatcaagct

SEQ ID NO: 7395831 - DNA, 22 bp, Homo sapiens
gcagctgctgtggcatcaagct

SEQ ID NO: 7395832 - DNA, 19 bp, Homo sapiens
gcagctgcttgaaaagaaa

SEQ ID NO: 7395833 - DNA, 19 bp, Homo sapiens
gcagctgcttgaaaagaaa

SEQ ID NO: 7395834 - DNA, 22 bp, Homo sapiens
gcagctgctgtggcatcaagct

SEQ ID NO: 7395835 - DNA, 22 bp, Homo sapiens
gcagctgctgtggcatcaagct

SEQ ID NO: 7395836 - DNA, 22 bp, Homo sapiens
gcagctgctgtggcatcaagct

SEQ ID NO: 7395837 - DNA, 22 bp, Homo sapiens
gcagctggaagtgacactctgt

SEQ ID NO: 7395838 - DNA, 22 bp, Homo sapiens
gcagctggaagtgacactctgt

SEQ ID NO: 7395839 - DNA, 22 bp, Homo sapiens
gcagctggaagtgacactctgt

SEQ ID NO: 7395840 - DNA, 22 bp, Homo sapiens
gcagctgcgaagaagtctatct

SEQ ID NO: 7395841 - DNA, 22 bp, Homo sapiens
gcagctgcgaagaagtctatct

SEQ ID NO: 7395842 - DNA, 22 bp, Homo sapiens
gcagctgcgctggtgtggggca

SEQ ID NO: 7395843 - DNA, 22 bp, Homo sapiens
gcagctgcgctggtgtggggca

SEQ ID NO: 7395844 - DNA, 22 bp, Homo sapiens
gcagctgcgctggtgtggggca

SEQ ID NO: 7395845 - DNA, 22 bp, Homo sapiens
gcagctgcgctggtgtggggca

SEQ ID NO: 7395846 - DNA, 22 bp, Homo sapiens
gcagctgcgctggtgtggggca

SEQ ID NO: 7395847 - DNA, 22 bp, Homo sapiens
gcagctgcgctggtgtggggca

SEQ ID NO: 7395848 - DNA, 22 bp, Homo sapiens
gcagctgctcacattctcacaa

SEQ ID NO: 7395849 - DNA, 22 bp, Homo sapiens
gcagctgctcacattctcacaa

SEQ ID NO: 7395850 - DNA, 22 bp, Homo sapiens
gcagctgctcacattctcacaa

SEQ ID NO: 7395851 - DNA, 22 bp, Homo sapiens
gcagctgctcccttttacagtg

SEQ ID NO: 7395852 - DNA, 22 bp, Homo sapiens
gcagctgctcacattctcacaa

SEQ ID NO: 7395853 - DNA, 22 bp, Homo sapiens
gcagctgctcacattctcacaa

SEQ ID NO: 7395854 - DNA, 22 bp, Homo sapiens
gcagctgctggaagttcctgcc

SEQ ID NO: 7395855 - DNA, 22 bp, Homo sapiens
gcagctgctggaagttcctgcc

SEQ ID NO: 7395856 - DNA, 22 bp, Homo sapiens
gcagctgctggaagttcctgcc

SEQ ID NO: 7395857 - DNA, 22 bp, Homo sapiens
gcagctgctggagggaggcagg

SEQ ID NO: 7395858 - DNA, 22 bp, Homo sapiens
gcagctgctggagggaggcagg

SEQ ID NO: 7395859 - DNA, 22 bp, Homo sapiens
gcagctgctggagggaggcagg

SEQ ID NO: 7395860 - DNA, 22 bp, Homo sapiens
gcagctgctggaagttcctgcc

SEQ ID NO: 7395861 - DNA, 22 bp, Homo sapiens
gcagctgctggaagttcctgcc

SEQ ID NO: 7395862 - DNA, 22 bp, Homo sapiens
gcagctgctggaagttcctgcc

SEQ ID NO: 7395863 - DNA, 22 bp, Homo sapiens
gcagctgctggaagttcctgcc

SEQ ID NO: 7395864 - DNA, 22 bp, Homo sapiens
gcagctgctcccttttacagtg

SEQ ID NO: 7395865 - DNA, 22 bp, Homo sapiens
gcagctgcctattcagggcttg

SEQ ID NO: 7395866 - DNA, 21 bp, Homo sapiens
gcagcgccctctgaccttgat

SEQ ID NO: 7395867 - DNA, 22 bp, Homo sapiens
gcagctgcctattcagggcttg

SEQ ID NO: 7395868 - DNA, 22 bp, Homo sapiens
gcagcgaggtgatgaaatagct

SEQ ID NO: 7395869 - DNA, 22 bp, Homo sapiens
gcagcgagtgcggctgccacag

SEQ ID NO: 7395870 - DNA, 22 bp, Homo sapiens
gcagcgagtgcggctgccacag

SEQ ID NO: 7395871 - DNA, 22 bp, Homo sapiens
gcagcgaggtgatgaaatagct

SEQ ID NO: 7395872 - DNA, 22 bp, Homo sapiens
gcagcgaggtgatgaaatagct

SEQ ID NO: 7395873 - DNA, 22 bp, Homo sapiens
gcagcgaggtgatgaaatagct

SEQ ID NO: 7395874 - DNA, 22 bp, Homo sapiens
gcagctgccttcagctggatgg

SEQ ID NO: 7395875 - DNA, 22 bp, Homo sapiens
gcagctgccttcagctggatgg

SEQ ID NO: 7395876 - DNA, 22 bp, Homo sapiens
gcagctgccttcagctggatgg

SEQ ID NO: 7395877 - DNA, 22 bp, Homo sapiens
gcagctgccttcagctggatgg

SEQ ID NO: 7395878 - DNA, 22 bp, Homo sapiens
gcagctgcctattcagggcttg

SEQ ID NO: 7395879 - DNA, 22 bp, Homo sapiens
gcagctgccttcagctggatgg

SEQ ID NO: 7395880 - DNA, 22 bp, Homo sapiens
gcagctgccttcagctggatgg

SEQ ID NO: 7395881 - DNA, 22 bp, Homo sapiens
gcagctgccttcagctggatgg

SEQ ID NO: 7395882 - DNA, 22 bp, Homo sapiens
gcagctgccttcagctggatgg

SEQ ID NO: 7395883 - DNA, 22 bp, Homo sapiens
gcattctatagtctacattaca

SEQ ID NO: 7395884 - DNA, 22 bp, Homo sapiens
gcattctatagtctacattaca

SEQ ID NO: 7395885 - DNA, 22 bp, Homo sapiens
gcattctagacagctacagaaa

SEQ ID NO: 7395886 - DNA, 22 bp, Homo sapiens
gcattcctttataggaaaatgg

SEQ ID NO: 7395887 - DNA, 22 bp, Homo sapiens
gcattcctttataggaaaatgg

SEQ ID NO: 7395888 - DNA, 22 bp, Homo sapiens
attgtgcaatgttttacaattt

SEQ ID NO: 7395889 - DNA, 22 bp, Homo sapiens
attgtgcaaatattatctgtag

SEQ ID NO: 7395890 - DNA, 22 bp, Homo sapiens
gccaaagagctgagtacatgta

SEQ ID NO: 7395891 - DNA, 22 bp, Homo sapiens
gccaaagcagtcttgcctctgc

SEQ ID NO: 7395892 - DNA, 22 bp, Homo sapiens
gccaaagcagtcttgcctctgc

SEQ ID NO: 7395893 - DNA, 22 bp, Homo sapiens
gccaaagcccaggagacagcca

SEQ ID NO: 7395894 - DNA, 22 bp, Homo sapiens
gccaaagcccaggagacagcca

SEQ ID NO: 7395895 - DNA, 22 bp, Homo sapiens
gccaaagcccaggagacagcca

SEQ ID NO: 7395896 - DNA, 23 bp, Homo sapiens
gcattctgatggttctctgtgat

SEQ ID NO: 7395897 - DNA, 22 bp, Homo sapiens
gcattctctctctaaatgttgt

SEQ ID NO: 7395898 - DNA, 22 bp, Homo sapiens
gcattctatagtctacattaca

SEQ ID NO: 7395899 - DNA, 22 bp, Homo sapiens
gcattctgtgctacagccattc

SEQ ID NO: 7395900 - DNA, 22 bp, Homo sapiens
attgtgaatagtgccgcagtaa

SEQ ID NO: 7395901 - DNA, 22 bp, Homo sapiens
attgtgaatagtgccgcagtaa

SEQ ID NO: 7395902 - DNA, 22 bp, Homo sapiens
attgtgaatagtgccgcagtaa

SEQ ID NO: 7395903 - DNA, 22 bp, Homo sapiens
attgtgaattgagagtacttct

SEQ ID NO: 7395904 - DNA, 22 bp, Homo sapiens
attgtgaattgagagtacttct

SEQ ID NO: 7395905 - DNA, 22 bp, Homo sapiens
attgtgaatagtgccgcagtaa

SEQ ID NO: 7395906 - DNA, 22 bp, Homo sapiens
attgtgactcctgatatagaaa

SEQ ID NO: 7395907 - DNA, 22 bp, Homo sapiens
attgtgactcctgatatagaaa

SEQ ID NO: 7395908 - DNA, 22 bp, Homo sapiens
attgtgacagtacctgccatgg

SEQ ID NO: 7395909 - DNA, 21 bp, Homo sapiens
attgtgaccatcattttggaa

SEQ ID NO: 7395910 - DNA, 22 bp, Homo sapiens
attgtgacaaatgtgccatact

SEQ ID NO: 7395911 - DNA, 22 bp, Homo sapiens
attgtgacaaatgtgccatact

SEQ ID NO: 7395912 - DNA, 22 bp, Homo sapiens
attgtgaattgagagtacttct

SEQ ID NO: 7395913 - DNA, 22 bp, Homo sapiens
attgtgaatttcagttagagcc

SEQ ID NO: 7395914 - DNA, 22 bp, Homo sapiens
attgtgactttgagctgaaagc

SEQ ID NO: 7395915 - DNA, 22 bp, Homo sapiens
attgtgagctcaagagtaccca

SEQ ID NO: 7395916 - DNA, 18 bp, Homo sapiens
attgtgactctcagttca

SEQ ID NO: 7395917 - DNA, 22 bp, Homo sapiens
attgtgactttgagctgaaagc

SEQ ID NO: 7395918 - DNA, 23 bp, Homo sapiens
attgtgagattactatcacactg

SEQ ID NO: 7395919 - DNA, 22 bp, Homo sapiens
attgtctttgtttaagggatac

SEQ ID NO: 7395920 - DNA, 22 bp, Homo sapiens
attgtctttgtttaagggatac

SEQ ID NO: 7395921 - DNA, 20 bp, Homo sapiens
attgtgaatactgcatatgt

SEQ ID NO: 7395922 - DNA, 20 bp, Homo sapiens
attgtgaatactgcatatgt

SEQ ID NO: 7395923 - DNA, 20 bp, Homo sapiens
attgtgaatactgcatatgt

SEQ ID NO: 7395924 - DNA, 22 bp, Homo sapiens
attgtctttggtgcttccagga

SEQ ID NO: 7395925 - DNA, 22 bp, Homo sapiens
attgtctttccactgagaagtt

SEQ ID NO: 7395926 - DNA, 22 bp, Homo sapiens
attgtctttggtgcttccagga

SEQ ID NO: 7395927 - DNA, 22 bp, Homo sapiens
attgtctttggtgcttccagga

SEQ ID NO: 7395928 - DNA, 22 bp, Homo sapiens
attgtctttggtgcttccagga

SEQ ID NO: 7395929 - DNA, 22 bp, Homo sapiens
attgtctttaacctctgagggg

SEQ ID NO: 7395930 - DNA, 22 bp, Homo sapiens
attgtctttccactgagaagtt

SEQ ID NO: 7395931 - DNA, 22 bp, Homo sapiens
attgtctttccactgagaagtt

SEQ ID NO: 7395932 - DNA, 22 bp, Homo sapiens
attgtctttaaaaatatacaac

SEQ ID NO: 7395933 - DNA, 22 bp, Homo sapiens
attgtctttaaaaatatacaac

SEQ ID NO: 7395934 - DNA, 22 bp, Homo sapiens
attgtctttaaaaatatacaac

SEQ ID NO: 7395935 - DNA, 22 bp, Homo sapiens
attgtctttaaaaatatacaac

SEQ ID NO: 7395936 - DNA, 22 bp, Homo sapiens
attgtctttaaaaatatacaac

SEQ ID NO: 7395937 - DNA, 22 bp, Homo sapiens
attgtctttaaaaatatacaac

SEQ ID NO: 7395938 - DNA, 22 bp, Homo sapiens
attgtctttaaaaatatacaac

SEQ ID NO: 7395939 - DNA, 22 bp, Homo sapiens
attgtcttctgtcttatagttc

SEQ ID NO: 7395940 - DNA, 22 bp, Homo sapiens
attgtcttctgtcttatagttc

SEQ ID NO: 7395941 - DNA, 22 bp, Homo sapiens
attgtcttggaaccaaggtctt

SEQ ID NO: 7395942 - DNA, 22 bp, Homo sapiens
attgtcttggaaccaaggtctt

SEQ ID NO: 7395943 - DNA, 22 bp, Homo sapiens
attgtcttggcattcaaattag

SEQ ID NO: 7395944 - DNA, 22 bp, Homo sapiens
attgtcttctggtcttatcttt

SEQ ID NO: 7395945 - DNA, 22 bp, Homo sapiens
attgtcttctggtcttatcttt

SEQ ID NO: 7395946 - DNA, 22 bp, Homo sapiens
attgtcttagtcagctcggact

SEQ ID NO: 7395947 - DNA, 22 bp, Homo sapiens
attgtcttctgtcttaggtgat

SEQ ID NO: 7395948 - DNA, 22 bp, Homo sapiens
attgtcttctgtcttatagttc

SEQ ID NO: 7395949 - DNA, 22 bp, Homo sapiens
attgtcttctgtcttatagttc

SEQ ID NO: 7395950 - DNA, 22 bp, Homo sapiens
attgtcttctgtcttatagttc

SEQ ID NO: 7395951 - DNA, 22 bp, Homo sapiens
attgtctgtactttaaaaatgt

SEQ ID NO: 7395952 - DNA, 22 bp, Homo sapiens
attgtcttaaacaaatgtgttt

SEQ ID NO: 7395953 - DNA, 17 bp, Homo sapiens
attgtctcttcacttat

SEQ ID NO: 7395954 - DNA, 22 bp, Homo sapiens
attgtctgaatccaaagctctg

SEQ ID NO: 7395955 - DNA, 22 bp, Homo sapiens
attgtcttctggtcttatcttt

SEQ ID NO: 7395956 - DNA, 22 bp, Homo sapiens
attgtcttacatactgtggagg

SEQ ID NO: 7395957 - DNA, 22 bp, Homo sapiens
attgtcttctggtcttatcttt

SEQ ID NO: 7395958 - DNA, 22 bp, Homo sapiens
attgtcttaaacaaatgtgttt

SEQ ID NO: 7395959 - DNA, 22 bp, Homo sapiens
attgtctgtactttaaaaatgt

SEQ ID NO: 7395960 - DNA, 22 bp, Homo sapiens
gccacagggcagatgcgcagag

SEQ ID NO: 7395961 - DNA, 22 bp, Homo sapiens
gccacagggcagatgcgcagag

SEQ ID NO: 7395962 - DNA, 22 bp, Homo sapiens
gccacagggcagatgcgcagag

SEQ ID NO: 7395963 - DNA, 22 bp, Homo sapiens
gccacagggcagatgcgcagag

SEQ ID NO: 7395964 - DNA, 22 bp, Homo sapiens
gccacagggaggcgttttcagg

SEQ ID NO: 7395965 - DNA, 22 bp, Homo sapiens
gccacagggaggcgttttcagg

SEQ ID NO: 7395966 - DNA, 22 bp, Homo sapiens
gccacagggattgttttgtgag

SEQ ID NO: 7395967 - DNA, 22 bp, Homo sapiens
gccacagggcagatgcgcagag

SEQ ID NO: 7395968 - DNA, 22 bp, Homo sapiens
gccacagggattgttttgtgag

SEQ ID NO: 7395969 - DNA, 22 bp, Homo sapiens
gccacagggattgttttgtgag

SEQ ID NO: 7395970 - DNA, 22 bp, Homo sapiens
gccacagggcgagcggaggcca

SEQ ID NO: 7395971 - DNA, 22 bp, Homo sapiens
gccacagggcgagcggaggcca

SEQ ID NO: 7395972 - DNA, 22 bp, Homo sapiens
gccacagggcgagcggaggcca

SEQ ID NO: 7395973 - DNA, 22 bp, Homo sapiens
gccacagggcgagcggaggcca

SEQ ID NO: 7395974 - DNA, 22 bp, Homo sapiens
gccacagggcgagcggaggcca

SEQ ID NO: 7395975 - DNA, 22 bp, Homo sapiens
gccacagggcgagcggaggcca

SEQ ID NO: 7395976 - DNA, 22 bp, Homo sapiens
gccacagggcgagcggaggcca

SEQ ID NO: 7395977 - DNA, 22 bp, Homo sapiens
gccacagggcagatgcgcagag

SEQ ID NO: 7395978 - DNA, 22 bp, Homo sapiens
gccacagggcagatgcgcagag

SEQ ID NO: 7395979 - DNA, 22 bp, Homo sapiens
gccacagggcagatgcgcagag

SEQ ID NO: 7395980 - DNA, 22 bp, Homo sapiens
gccaagcctgggaagagcccat

SEQ ID NO: 7395981 - DNA, 22 bp, Homo sapiens
gccaagagtttccagctgcaag

SEQ ID NO: 7395982 - DNA, 22 bp, Homo sapiens
gccaagcactgaggacattgtt

SEQ ID NO: 7395983 - DNA, 22 bp, Homo sapiens
gccaagaggctcattagcattc

SEQ ID NO: 7395984 - DNA, 22 bp, Homo sapiens
gccaagagtttccagctgcaag

SEQ ID NO: 7395985 - DNA, 22 bp, Homo sapiens
gccaagagtttccagctgcaag

SEQ ID NO: 7395986 - DNA, 20 bp, Homo sapiens
gccaagaatatgcccgactc

SEQ ID NO: 7395987 - DNA, 22 bp, Homo sapiens
gccaagaatgtggcatagctta

SEQ ID NO: 7395988 - DNA, 18 bp, Homo sapiens
gccaagagcttgcaaaca

SEQ ID NO: 7395989 - DNA, 22 bp, Homo sapiens
gccaagagtttccagctgcaag

SEQ ID NO: 7395990 - DNA, 22 bp, Homo sapiens
gccaagagtttccagctgcaag

SEQ ID NO: 7395991 - DNA, 21 bp, Homo sapiens
gccaagaacaagacagacatg

SEQ ID NO: 7395992 - DNA, 22 bp, Homo sapiens
gccaagaaggtggggacatgca

SEQ ID NO: 7395993 - DNA, 22 bp, Homo sapiens
gccaagaagggccatgtggatt

SEQ ID NO: 7395994 - DNA, 22 bp, Homo sapiens
gccaagaaggtggggacatgca

SEQ ID NO: 7395995 - DNA, 22 bp, Homo sapiens
gccaagaagtatggttggggct

SEQ ID NO: 7395996 - DNA, 22 bp, Homo sapiens
gccaagaatgcgacagccgtca

SEQ ID NO: 7395997 - DNA, 22 bp, Homo sapiens
gccaagagaatgtgagagaaat

SEQ ID NO: 7395998 - DNA, 22 bp, Homo sapiens
gccaagagaatgtgagagaaat

SEQ ID NO: 7395999 - DNA, 22 bp, Homo sapiens
gccaaaggattctatggagata

SEQ ID NO: 7396000 - DNA, 22 bp, Homo sapiens
gccaaagctggaggtggaggtg

SEQ ID NO: 7396001 - DNA, 23 bp, Homo sapiens
gccaaaggtctgttcagtggtga

SEQ ID NO: 7396002 - DNA, 22 bp, Homo sapiens
gccaaaggttggcctgtgagtt

SEQ ID NO: 7396003 - DNA, 22 bp, Homo sapiens
gccaaagtacctagccctctgc

SEQ ID NO: 7396004 - DNA, 22 bp, Homo sapiens
gccaaataccattaaccagaaa

SEQ ID NO: 7396005 - DNA, 22 bp, Homo sapiens
gccaaagtcctccagccatgca

SEQ ID NO: 7396006 - DNA, 22 bp, Homo sapiens
gccaagaaatgcccctcacaga

SEQ ID NO: 7396007 - DNA, 22 bp, Homo sapiens
gccaagaaagtggcacccctag

SEQ ID NO: 7396008 - DNA, 22 bp, Homo sapiens
gccaagaaagaacagcagggaa

SEQ ID NO: 7396009 - DNA, 21 bp, Homo sapiens
gccaagaacaagacagacatg

SEQ ID NO: 7396010 - DNA, 21 bp, Homo sapiens
gccaagaacaagacagacatg

SEQ ID NO: 7396011 - DNA, 22 bp, Homo sapiens
gccaagaaatgtgtcgggcagc

SEQ ID NO: 7396012 - DNA, 22 bp, Homo sapiens
gccaagaaatgtgtcgggcagc

SEQ ID NO: 7396013 - DNA, 22 bp, Homo sapiens
gccaacaggccttgctctgctc

SEQ ID NO: 7396014 - DNA, 22 bp, Homo sapiens
gccaaccattggcttcttgtca

SEQ ID NO: 7396015 - DNA, 20 bp, Homo sapiens
gccaacgcgctggggctgcc

SEQ ID NO: 7396016 - DNA, 22 bp, Homo sapiens
gccaaatctggatttagcaaga

SEQ ID NO: 7396017 - DNA, 22 bp, Homo sapiens
gccaaatcacagggccaaaagc

SEQ ID NO: 7396018 - DNA, 22 bp, Homo sapiens
gccaaatactggaatcatagaa

SEQ ID NO: 7396019 - DNA, 22 bp, Homo sapiens
gccaaatactggaatcatagaa

SEQ ID NO: 7396020 - DNA, 22 bp, Homo sapiens
gccaacaggccttgctctgctc

SEQ ID NO: 7396021 - DNA, 22 bp, Homo sapiens
gccaaattcctggcagaagcat

SEQ ID NO: 7396022 - DNA, 22 bp, Homo sapiens
gccaaattcctggcagaagcat

SEQ ID NO: 7396023 - DNA, 22 bp, Homo sapiens
gccaaattccttgaaaggtggg

SEQ ID NO: 7396024 - DNA, 22 bp, Homo sapiens
gccaaatttgtgagcccccaag

SEQ ID NO: 7396025 - DNA, 22 bp, Homo sapiens
gccaaatttgtgagcccccaag

SEQ ID NO: 7396026 - DNA, 22 bp, Homo sapiens
attgtcacttaaaagtgcatgt

SEQ ID NO: 7396027 - DNA, 18 bp, Homo sapiens
attgtcagaagtcatgtg

SEQ ID NO: 7396028 - DNA, 18 bp, Homo sapiens
attgtcagaagtcatgtg

SEQ ID NO: 7396029 - DNA, 22 bp, Homo sapiens
attgtatttgtacaagacatgt

SEQ ID NO: 7396030 - DNA, 22 bp, Homo sapiens
attgtatttgtacaagacatgt

SEQ ID NO: 7396031 - DNA, 22 bp, Homo sapiens
attgtatttgtacaagacatgt

SEQ ID NO: 7396032 - DNA, 22 bp, Homo sapiens
attgtcagctcgaaatgcatca

SEQ ID NO: 7396033 - DNA, 22 bp, Homo sapiens
attgtcagctcgaaatgcatca

SEQ ID NO: 7396034 - DNA, 22 bp, Homo sapiens
attgtcagccttcatagatcct

SEQ ID NO: 7396035 - DNA, 22 bp, Homo sapiens
attgtcagtgggatttgtcaac

SEQ ID NO: 7396036 - DNA, 22 bp, Homo sapiens
attgtcagtttaatatagtcaa

SEQ ID NO: 7396037 - DNA, 22 bp, Homo sapiens
attgtcatcgatgttagccagt

SEQ ID NO: 7396038 - DNA, 22 bp, Homo sapiens
attgtcctatctcagtgccatg

SEQ ID NO: 7396039 - DNA, 22 bp, Homo sapiens
attgtcattggcttctatgtct

SEQ ID NO: 7396040 - DNA, 22 bp, Homo sapiens
attgtcattggcttctatgtct

SEQ ID NO: 7396041 - DNA, 22 bp, Homo sapiens
attgtcattggcttctatgtct

SEQ ID NO: 7396042 - DNA, 22 bp, Homo sapiens
attgtcattggcttctatgtct

SEQ ID NO: 7396043 - DNA, 22 bp, Homo sapiens
attgtcattccagtcattgtta

SEQ ID NO: 7396044 - DNA, 22 bp, Homo sapiens
attgtcattccagtcattgtta

SEQ ID NO: 7396045 - DNA, 22 bp, Homo sapiens
attgtcattccagtcattgtta

SEQ ID NO: 7396046 - DNA, 22 bp, Homo sapiens
attgtcattccagtcattgtta

SEQ ID NO: 7396047 - DNA, 22 bp, Homo sapiens
attgtcattccagtcattgtta

SEQ ID NO: 7396048 - DNA, 22 bp, Homo sapiens
attgtccatctccacattaatg

SEQ ID NO: 7396049 - DNA, 22 bp, Homo sapiens
attgtccatctccacattaatg

SEQ ID NO: 7396050 - DNA, 22 bp, Homo sapiens
attgtcgtcaatggacacatag

SEQ ID NO: 7396051 - DNA, 22 bp, Homo sapiens
attgtcgtcaatggacacatag

SEQ ID NO: 7396052 - DNA, 22 bp, Homo sapiens
attgtcgtcaatggacacatag

SEQ ID NO: 7396053 - DNA, 22 bp, Homo sapiens
attgtctcttaaatgtggaaat

SEQ ID NO: 7396054 - DNA, 22 bp, Homo sapiens
attgtctctttcaataacttgt

SEQ ID NO: 7396055 - DNA, 22 bp, Homo sapiens
attgtctcttaaatgtggaaat

SEQ ID NO: 7396056 - DNA, 22 bp, Homo sapiens
attgtctatggctgctttcact

SEQ ID NO: 7396057 - DNA, 22 bp, Homo sapiens
attgtcgtcaatggacacatag

SEQ ID NO: 7396058 - DNA, 22 bp, Homo sapiens
attgtacttttattacatgtag

SEQ ID NO: 7396059 - DNA, 22 bp, Homo sapiens
attgtacttttattacatgtag

SEQ ID NO: 7396060 - DNA, 22 bp, Homo sapiens
attgtagcaatttctcttaatt

SEQ ID NO: 7396061 - DNA, 22 bp, Homo sapiens
attgtataacagcatgtatttt

SEQ ID NO: 7396062 - DNA, 22 bp, Homo sapiens
attgtataacagcatgtatttt

SEQ ID NO: 7396063 - DNA, 22 bp, Homo sapiens
attgtagcccatgcataaaccg

SEQ ID NO: 7396064 - DNA, 19 bp, Homo sapiens
gcatcagagcagaaggggt

SEQ ID NO: 7396065 - DNA, 19 bp, Homo sapiens
gcatcagagcagaaggggt

SEQ ID NO: 7396066 - DNA, 22 bp, Homo sapiens
attgtacttttattacatgtag

SEQ ID NO: 7396067 - DNA, 22 bp, Homo sapiens
gcatcagaatcatccggggaat

SEQ ID NO: 7396068 - DNA, 22 bp, Homo sapiens
gcatcagaatcatccggggaat

SEQ ID NO: 7396069 - DNA, 22 bp, Homo sapiens
gcatattttcacaagctcttgg

SEQ ID NO: 7396070 - DNA, 22 bp, Homo sapiens
gcatattttcacaagctcttgg

SEQ ID NO: 7396071 - DNA, 22 bp, Homo sapiens
gcatcaagacgatgtgaaatcg

SEQ ID NO: 7396072 - DNA, 17 bp, Homo sapiens
gcatcacagataacacg

SEQ ID NO: 7396073 - DNA, 17 bp, Homo sapiens
gcatcacagataacacg

SEQ ID NO: 7396074 - DNA, 17 bp, Homo sapiens
gcatcacagataacacg

SEQ ID NO: 7396075 - DNA, 22 bp, Homo sapiens
gcatcaagacgatgtgaaatcg

SEQ ID NO: 7396076 - DNA, 19 bp, Homo sapiens
gcatcaaagctgactcctg

SEQ ID NO: 7396077 - DNA, 19 bp, Homo sapiens
gcatcaaagctgactcctg

SEQ ID NO: 7396078 - DNA, 17 bp, Homo sapiens
gcatcacagataacacg

SEQ ID NO: 7396079 - DNA, 22 bp, Homo sapiens
gcatatgatcacgtgtgtcggt

SEQ ID NO: 7396080 - DNA, 22 bp, Homo sapiens
gcatatgatcacgtgtgtcggt

SEQ ID NO: 7396081 - DNA, 22 bp, Homo sapiens
gcatatgatcacgtgtgtcggt

SEQ ID NO: 7396082 - DNA, 22 bp, Homo sapiens
gcatatggcttcatttaattct

SEQ ID NO: 7396083 - DNA, 22 bp, Homo sapiens
gcatatggcttcatttaattct

SEQ ID NO: 7396084 - DNA, 22 bp, Homo sapiens
gcatattttcacaagctcttgg

SEQ ID NO: 7396085 - DNA, 22 bp, Homo sapiens
gcatattttcacaagctcttgg

SEQ ID NO: 7396086 - DNA, 22 bp, Homo sapiens
gcatattagtaatctttcaaca

SEQ ID NO: 7396087 - DNA, 22 bp, Homo sapiens
gcataggcactttcctcctcct

SEQ ID NO: 7396088 - DNA, 22 bp, Homo sapiens
gcatagaatttagagacaaaag

SEQ ID NO: 7396089 - DNA, 22 bp, Homo sapiens
gcatagctttgatgctgcctta

SEQ ID NO: 7396090 - DNA, 22 bp, Homo sapiens
gcatagtaggctgtcaaaaatg

SEQ ID NO: 7396091 - DNA, 22 bp, Homo sapiens
gcataggccactagtgccagga

SEQ ID NO: 7396092 - DNA, 22 bp, Homo sapiens
gcataggcactttcctcctcct

SEQ ID NO: 7396093 - DNA, 22 bp, Homo sapiens
gcatacagtccttgtattcttc

SEQ ID NO: 7396094 - DNA, 18 bp, Homo sapiens
gcatacagaggggaagta

SEQ ID NO: 7396095 - DNA, 22 bp, Homo sapiens
gcatacatacaatagctgccac

SEQ ID NO: 7396096 - DNA, 22 bp, Homo sapiens
gcatacatgaaaaggtactgac

SEQ ID NO: 7396097 - DNA, 22 bp, Homo sapiens
gcatacatgggtgcagggacat

SEQ ID NO: 7396098 - DNA, 22 bp, Homo sapiens
gcatacattgcaccctggtagt

SEQ ID NO: 7396099 - DNA, 22 bp, Homo sapiens
gcatacttcttgctgctttcag

SEQ ID NO: 7396100 - DNA, 22 bp, Homo sapiens
gcatacagagaggatgtggcat

SEQ ID NO: 7396101 - DNA, 22 bp, Homo sapiens
gcatacaaaggtttacaactga

SEQ ID NO: 7396102 - DNA, 22 bp, Homo sapiens
gcatacagagaggatgtggcat

SEQ ID NO: 7396103 - DNA, 22 bp, Homo sapiens
gcatacaaaggtttacaactga

SEQ ID NO: 7396104 - DNA, 22 bp, Homo sapiens
gcatacaaaggtttacaactga

SEQ ID NO: 7396105 - DNA, 22 bp, Homo sapiens
gcagtgtgtttggataacacac

SEQ ID NO: 7396106 - DNA, 22 bp, Homo sapiens
gcagtgttacctcttcagtggg

SEQ ID NO: 7396107 - DNA, 22 bp, Homo sapiens
gcagtgttacctcttcagtggg

SEQ ID NO: 7396108 - DNA, 22 bp, Homo sapiens
gcagtgttacctcttcagtggg

SEQ ID NO: 7396109 - DNA, 22 bp, Homo sapiens
gcagtgtgtttggataacacac

SEQ ID NO: 7396110 - DNA, 22 bp, Homo sapiens
gcagtgtgtttctgagatatgg

SEQ ID NO: 7396111 - DNA, 22 bp, Homo sapiens
gcagtgtgtgtccccacactgg

SEQ ID NO: 7396112 - DNA, 16 bp, Homo sapiens
gcagtgtgtttaatag

SEQ ID NO: 7396113 - DNA, 22 bp, Homo sapiens
gcagtgtgtggtgagggctgcc

SEQ ID NO: 7396114 - DNA, 22 bp, Homo sapiens
gcagtgtgtgtccccacactgg

SEQ ID NO: 7396115 - DNA, 22 bp, Homo sapiens
gcagtgtgtggtgagggctgcc

SEQ ID NO: 7396116 - DNA, 22 bp, Homo sapiens
gcagtgtgtggtgagggctgcc

SEQ ID NO: 7396117 - DNA, 22 bp, Homo sapiens
gcagtgtgtggtgagggctgcc

SEQ ID NO: 7396118 - DNA, 22 bp, Homo sapiens
gcagtgtgtctggagtacatgg

SEQ ID NO: 7396119 - DNA, 22 bp, Homo sapiens
gcagtgtgtctggagtacatgg

SEQ ID NO: 7396120 - DNA, 22 bp, Homo sapiens
gcagtgtgtggtgagggctgcc

SEQ ID NO: 7396121 - DNA, 22 bp, Homo sapiens
gcagtgtgtggtgagggctgcc

SEQ ID NO: 7396122 - DNA, 20 bp, Homo sapiens
gcagtgtgtatgaatagctg

SEQ ID NO: 7396123 - DNA, 22 bp, Homo sapiens
gcagtgtgtctcttggcttcct

SEQ ID NO: 7396124 - DNA, 22 bp, Homo sapiens
gcagtgtgtctcttggcttcct

SEQ ID NO: 7396125 - DNA, 22 bp, Homo sapiens
gcagtgtgtctcttggcttcct

SEQ ID NO: 7396126 - DNA, 22 bp, Homo sapiens
gcagtgtgtctggagtacatgg

SEQ ID NO: 7396127 - DNA, 22 bp, Homo sapiens
gcagtgtgtctcttggcttcct

SEQ ID NO: 7396128 - DNA, 22 bp, Homo sapiens
gcagtgtggccccagtatcacg

SEQ ID NO: 7396129 - DNA, 22 bp, Homo sapiens
gcagtgtgcatggcttttggcc

SEQ ID NO: 7396130 - DNA, 22 bp, Homo sapiens
gcagtgtggccccagtatcacg

SEQ ID NO: 7396131 - DNA, 22 bp, Homo sapiens
gcagtgtgcatggcttttggcc

SEQ ID NO: 7396132 - DNA, 22 bp, Homo sapiens
gcagtgtgatgcttccagccac

SEQ ID NO: 7396133 - DNA, 22 bp, Homo sapiens
gcagtgtgtagagtttaggaaa

SEQ ID NO: 7396134 - DNA, 22 bp, Homo sapiens
gcagtgtggcgtggggacctaa

SEQ ID NO: 7396135 - DNA, 22 bp, Homo sapiens
gcagtgtgtagagtttaggaaa

SEQ ID NO: 7396136 - DNA, 22 bp, Homo sapiens
gcagtgtggcgtggggacctaa

SEQ ID NO: 7396137 - DNA, 21 bp, Homo sapiens
gcagtgcttcgagactgtggt

SEQ ID NO: 7396138 - DNA, 22 bp, Homo sapiens
gcagggctgggatttgagccca

SEQ ID NO: 7396139 - DNA, 20 bp, Homo sapiens
gcagtgctggtgcctctgct

SEQ ID NO: 7396140 - DNA, 22 bp, Homo sapiens
gcagtgcttgctcaggcttcat

SEQ ID NO: 7396141 - DNA, 22 bp, Homo sapiens
gcagtgcttgaagaggtggcca

SEQ ID NO: 7396142 - DNA, 22 bp, Homo sapiens
gcagtgcttgaagaggtggcca

SEQ ID NO: 7396143 - DNA, 23 bp, Homo sapiens
gcagtgcttggcacagctgggtc

SEQ ID NO: 7396144 - DNA, 22 bp, Homo sapiens
gcagtgcttgaagaggtggcca

SEQ ID NO: 7396145 - DNA, 22 bp, Homo sapiens
gcagtgctttagtctgtccttt

SEQ ID NO: 7396146 - DNA, 23 bp, Homo sapiens
gcagtgtgaatccagtgtttcag

SEQ ID NO: 7396147 - DNA, 22 bp, Homo sapiens
gcagtgtgaccgagcttgcttc

SEQ ID NO: 7396148 - DNA, 22 bp, Homo sapiens
gcagtgtgaccgagcttgcttc

SEQ ID NO: 7396149 - DNA, 22 bp, Homo sapiens
gcagtgtgaccgagcttgcttc

SEQ ID NO: 7396150 - DNA, 22 bp, Homo sapiens
gcagtgtgacgctgttctccgt

SEQ ID NO: 7396151 - DNA, 22 bp, Homo sapiens
gcagtgtgatgcttccagccac

SEQ ID NO: 7396152 - DNA, 22 bp, Homo sapiens
gcagtgtgatgcttccagccac

SEQ ID NO: 7396153 - DNA, 22 bp, Homo sapiens
gcagtgtgaccgagcttgcttc

SEQ ID NO: 7396154 - DNA, 22 bp, Homo sapiens
caaatacaaatacgggcagctt

SEQ ID NO: 7396155 - DNA, 22 bp, Homo sapiens
caaatacaaatacgggcagctt

SEQ ID NO: 7396156 - DNA, 22 bp, Homo sapiens
caaatactaaacataagatttt

SEQ ID NO: 7396157 - DNA, 22 bp, Homo sapiens
caaatactaaacataagatttt

SEQ ID NO: 7396158 - DNA, 22 bp, Homo sapiens
caaatacaaatacgggcagctt

SEQ ID NO: 7396159 - DNA, 22 bp, Homo sapiens
caaatacaaatacgggcagctt

SEQ ID NO: 7396160 - DNA, 22 bp, Homo sapiens
caaatacaaatacgggcagctt

SEQ ID NO: 7396161 - DNA, 22 bp, Homo sapiens
caaatacaaatacgggcagctt

SEQ ID NO: 7396162 - DNA, 22 bp, Homo sapiens
caaatacaaatacgggcagctt

SEQ ID NO: 7396163 - DNA, 22 bp, Homo sapiens
caaataattactatcctcactt

SEQ ID NO: 7396164 - DNA, 22 bp, Homo sapiens
caaataattactatcctcactt

SEQ ID NO: 7396165 - DNA, 22 bp, Homo sapiens
caaatactaaacataagatttt

SEQ ID NO: 7396166 - DNA, 22 bp, Homo sapiens
caaatactaaacataagatttt

SEQ ID NO: 7396167 - DNA, 22 bp, Homo sapiens
caaatactaaacataagatttt

SEQ ID NO: 7396168 - DNA, 22 bp, Homo sapiens
caaatactacgattcttgcagt

SEQ ID NO: 7396169 - DNA, 22 bp, Homo sapiens
caaatactaaacataagatttt

SEQ ID NO: 7396170 - DNA, 22 bp, Homo sapiens
caaatactacgattcttgcagt

SEQ ID NO: 7396171 - DNA, 22 bp, Homo sapiens
caaatactacgattcttgcagt

SEQ ID NO: 7396172 - DNA, 22 bp, Homo sapiens
caaatactacgattcttgcagt

SEQ ID NO: 7396173 - DNA, 22 bp, Homo sapiens
caaaggaagctccttgatggcg

SEQ ID NO: 7396174 - DNA, 22 bp, Homo sapiens
caaaggaagctccttgatggcg

SEQ ID NO: 7396175 - DNA, 22 bp, Homo sapiens
caaaggaagctccttgatggcg

SEQ ID NO: 7396176 - DNA, 22 bp, Homo sapiens
caaaggaggtaatgggtgtgag

SEQ ID NO: 7396177 - DNA, 22 bp, Homo sapiens
caaaggcaacatatacttgttt

SEQ ID NO: 7396178 - DNA, 22 bp, Homo sapiens
caaagtgctggaattacaggtg

SEQ ID NO: 7396179 - DNA, 22 bp, Homo sapiens
caaagtgctggaattacaggtg

SEQ ID NO: 7396180 - DNA, 22 bp, Homo sapiens
caaagtgctggaattacaggtg

SEQ ID NO: 7396181 - DNA, 22 bp, Homo sapiens
caaagtgctggaattacaggtg

SEQ ID NO: 7396182 - DNA, 22 bp, Homo sapiens
caaataattactatcctcactt

SEQ ID NO: 7396183 - DNA, 22 bp, Homo sapiens
caaagtgctgggattacaggct

SEQ ID NO: 7396184 - DNA, 22 bp, Homo sapiens
caaagtgctgggattacaggct

SEQ ID NO: 7396185 - DNA, 22 bp, Homo sapiens
caaaggaaatactaatctggaa

SEQ ID NO: 7396186 - DNA, 22 bp, Homo sapiens
caaaggaagctccttgatggcg

SEQ ID NO: 7396187 - DNA, 22 bp, Homo sapiens
caaaggaaatactaatctggaa

SEQ ID NO: 7396188 - DNA, 22 bp, Homo sapiens
caaaggaaatactaatctggaa

SEQ ID NO: 7396189 - DNA, 22 bp, Homo sapiens
caaaggaaatactaatctggaa

SEQ ID NO: 7396190 - DNA, 22 bp, Homo sapiens
caaagcttggagaagcagctgg

SEQ ID NO: 7396191 - DNA, 22 bp, Homo sapiens
caaagctgtgaattcctacaaa

SEQ ID NO: 7396192 - DNA, 22 bp, Homo sapiens
caaaggaaatactaatctggaa

SEQ ID NO: 7396193 - DNA, 22 bp, Homo sapiens
caaagctgtgaattcctacaaa

SEQ ID NO: 7396194 - DNA, 22 bp, Homo sapiens
caaagctggactgctcagttca

SEQ ID NO: 7396195 - DNA, 22 bp, Homo sapiens
caaagctggactgctcagttca

SEQ ID NO: 7396196 - DNA, 22 bp, Homo sapiens
caaagctggactgctcagttca

SEQ ID NO: 7396197 - DNA, 22 bp, Homo sapiens
caaagctgacgaggtcagcatc

SEQ ID NO: 7396198 - DNA, 22 bp, Homo sapiens
caaagctgatactcagcaagta

SEQ ID NO: 7396199 - DNA, 22 bp, Homo sapiens
caaagctgatactcagcaagta

SEQ ID NO: 7396200 - DNA, 22 bp, Homo sapiens
caaagctgatactcagcaagta

SEQ ID NO: 7396201 - DNA, 22 bp, Homo sapiens
caaagctggaaaaggaggctgg

SEQ ID NO: 7396202 - DNA, 22 bp, Homo sapiens
caaagctggaaaaggaggctgg

SEQ ID NO: 7396203 - DNA, 22 bp, Homo sapiens
caaagctataaattcagacaga

SEQ ID NO: 7396204 - DNA, 18 bp, Homo sapiens
caaagctcacgttccatc

SEQ ID NO: 7396205 - DNA, 18 bp, Homo sapiens
caaagctcacgttccatc

SEQ ID NO: 7396206 - DNA, 18 bp, Homo sapiens
caaagctcacgttccatc

SEQ ID NO: 7396207 - DNA, 22 bp, Homo sapiens
caaagcctctgatttcacttgt

SEQ ID NO: 7396208 - DNA, 22 bp, Homo sapiens
caaagcctctgatttcacttgt

SEQ ID NO: 7396209 - DNA, 22 bp, Homo sapiens
caaagccctggaaagatgaaga

SEQ ID NO: 7396210 - DNA, 22 bp, Homo sapiens
caaagcctctgatttcacttgt

SEQ ID NO: 7396211 - DNA, 22 bp, Homo sapiens
caaagctcagccctccaatgaa

SEQ ID NO: 7396212 - DNA, 22 bp, Homo sapiens
caaagctcatgctcttagccat

SEQ ID NO: 7396213 - DNA, 22 bp, Homo sapiens
caaagctcatgctcttagccat

SEQ ID NO: 7396214 - DNA, 18 bp, Homo sapiens
caaagctcacgttccatc

SEQ ID NO: 7396215 - DNA, 22 bp, Homo sapiens
caaagctcagccctccaatgaa

SEQ ID NO: 7396216 - DNA, 22 bp, Homo sapiens
caaagctcatgctcttagccat

SEQ ID NO: 7396217 - DNA, 21 bp, Homo sapiens
caaagctcattctttggtcat

SEQ ID NO: 7396218 - DNA, 22 bp, Homo sapiens
caaagctcatgctcttagccat

SEQ ID NO: 7396219 - DNA, 22 bp, Homo sapiens
caaagctcgccacctctgaggg

SEQ ID NO: 7396220 - DNA, 22 bp, Homo sapiens
caaagctcagccctccaatgaa

SEQ ID NO: 7396221 - DNA, 22 bp, Homo sapiens
caaagctcgccacctctgaggg

SEQ ID NO: 7396222 - DNA, 21 bp, Homo sapiens
caaagctcattctttggtcat

SEQ ID NO: 7396223 - DNA, 22 bp, Homo sapiens
caaagctcgccacctctgaggg

SEQ ID NO: 7396224 - DNA, 22 bp, Homo sapiens
caaagctcgccacctctgaggg

SEQ ID NO: 7396225 - DNA, 22 bp, Homo sapiens
caaagctgacgaggtcagcatc

SEQ ID NO: 7396226 - DNA, 22 bp, Homo sapiens
caaagctgacgaggtcagcatc

SEQ ID NO: 7396227 - DNA, 22 bp, Homo sapiens
caaagctgacgaggtcagcatc

SEQ ID NO: 7396228 - DNA, 22 bp, Homo sapiens
caaatactgagtttattttcaa

SEQ ID NO: 7396229 - DNA, 22 bp, Homo sapiens
caaatactgagtttattttcaa

SEQ ID NO: 7396230 - DNA, 22 bp, Homo sapiens
caaatactgagtttattttcaa

SEQ ID NO: 7396231 - DNA, 22 bp, Homo sapiens
caaatactgggtaagttaattt

SEQ ID NO: 7396232 - DNA, 22 bp, Homo sapiens
caaatactgggtaagttaattt

SEQ ID NO: 7396233 - DNA, 22 bp, Homo sapiens
caaatactgggtaagttaattt

SEQ ID NO: 7396234 - DNA, 22 bp, Homo sapiens
caaatactgagtttattttcaa

SEQ ID NO: 7396235 - DNA, 22 bp, Homo sapiens
caaatactgagtttattttcaa

SEQ ID NO: 7396236 - DNA, 22 bp, Homo sapiens
caaatactgagtttattttcaa

SEQ ID NO: 7396237 - DNA, 22 bp, Homo sapiens
caaatactgagtttattttcaa

SEQ ID NO: 7396238 - DNA, 22 bp, Homo sapiens
caaatactctggatgtgtttgt

SEQ ID NO: 7396239 - DNA, 22 bp, Homo sapiens
caaatactctggatgtgtttgt

SEQ ID NO: 7396240 - DNA, 22 bp, Homo sapiens
caaatactctggatgtgtttgt

SEQ ID NO: 7396241 - DNA, 22 bp, Homo sapiens
caaatactgagcacgcaatcaa

SEQ ID NO: 7396242 - DNA, 22 bp, Homo sapiens
caaatactctggatgtgtttgt

SEQ ID NO: 7396243 - DNA, 22 bp, Homo sapiens
caaatactctggatgtgtttgt

SEQ ID NO: 7396244 - DNA, 22 bp, Homo sapiens
caaatactgagcacgcaatcaa

SEQ ID NO: 7396245 - DNA, 22 bp, Homo sapiens
caaatactgtactgaacactgt

SEQ ID NO: 7396246 - DNA, 22 bp, Homo sapiens
caaatactgtactgaacactgt

SEQ ID NO: 7396247 - DNA, 22 bp, Homo sapiens
caaatactgtactgaacactgt

SEQ ID NO: 7396248 - DNA, 22 bp, Homo sapiens
caaatactgtactgaacactgt

SEQ ID NO: 7396249 - DNA, 22 bp, Homo sapiens
caaatactgtactgaacactgt

SEQ ID NO: 7396250 - DNA, 22 bp, Homo sapiens
caaatactgtactgaacactgt

SEQ ID NO: 7396251 - DNA, 22 bp, Homo sapiens
caaatactgtactgaacactgt

SEQ ID NO: 7396252 - DNA, 22 bp, Homo sapiens
caaatactgggtaagttaattt

SEQ ID NO: 7396253 - DNA, 22 bp, Homo sapiens
caaatacttactgaacctgtgc

SEQ ID NO: 7396254 - DNA, 22 bp, Homo sapiens
caaatacttactgaacctgtgc

SEQ ID NO: 7396255 - DNA, 22 bp, Homo sapiens
caaatacttactgaacctgtgc

SEQ ID NO: 7396256 - DNA, 22 bp, Homo sapiens
caaatacttactgaacctgtgc

SEQ ID NO: 7396257 - DNA, 22 bp, Homo sapiens
caaatacttactgaacctgtgc

SEQ ID NO: 7396258 - DNA, 18 bp, Homo sapiens
caaatactgttgtcttat

SEQ ID NO: 7396259 - DNA, 18 bp, Homo sapiens
caaatactgttgtcttat

SEQ ID NO: 7396260 - DNA, 18 bp, Homo sapiens
caaatactgttgtcttat

SEQ ID NO: 7396261 - DNA, 18 bp, Homo sapiens
caaatactgttgtcttat

SEQ ID NO: 7396262 - DNA, 18 bp, Homo sapiens
caaatactgttgtcttat

SEQ ID NO: 7396263 - DNA, 22 bp, Homo sapiens
caaatactttatatacttcaaa

SEQ ID NO: 7396264 - DNA, 22 bp, Homo sapiens
caaatactttatatacttcaaa

SEQ ID NO: 7396265 - DNA, 22 bp, Homo sapiens
caaatactttatatacttcaaa

SEQ ID NO: 7396266 - DNA, 22 bp, Homo sapiens
caaatactttatatacttcaaa

SEQ ID NO: 7396267 - DNA, 22 bp, Homo sapiens
caaatactttatatacttcaaa

SEQ ID NO: 7396268 - DNA, 22 bp, Homo sapiens
caaatactttatatacttcaaa

SEQ ID NO: 7396269 - DNA, 22 bp, Homo sapiens
caaatactttatatacttcaaa

SEQ ID NO: 7396270 - DNA, 22 bp, Homo sapiens
caaatacttttagcctattgag

SEQ ID NO: 7396271 - DNA, 22 bp, Homo sapiens
caaatactttatatacttcaaa

SEQ ID NO: 7396272 - DNA, 22 bp, Homo sapiens
caaatactttatatacttcaaa

SEQ ID NO: 7396273 - DNA, 21 bp, Homo sapiens
caaatacttagaaacttaaga

SEQ ID NO: 7396274 - DNA, 21 bp, Homo sapiens
caaatacttagaaacttaaga

SEQ ID NO: 7396275 - DNA, 21 bp, Homo sapiens
caaatacttagaaacttaaga

SEQ ID NO: 7396276 - DNA, 21 bp, Homo sapiens
caaatacttagaaacttaaga

SEQ ID NO: 7396277 - DNA, 21 bp, Homo sapiens
caaatacttagaaacttaaga

SEQ ID NO: 7396278 - DNA, 21 bp, Homo sapiens
caaatacttagaaacttaaga

SEQ ID NO: 7396279 - DNA, 21 bp, Homo sapiens
caaatacttagaaacttaaga

SEQ ID NO: 7396280 - DNA, 21 bp, Homo sapiens
caaatacttagaaacttaaga

SEQ ID NO: 7396281 - DNA, 21 bp, Homo sapiens
caaatacttagaaacttaaga

SEQ ID NO: 7396282 - DNA, 22 bp, Homo sapiens
caaatagaaggtactcagagaa

SEQ ID NO: 7396283 - DNA, 22 bp, Homo sapiens
caaatagaaggtactcagagaa

SEQ ID NO: 7396284 - DNA, 22 bp, Homo sapiens
caaatagaaggtactcagagaa

SEQ ID NO: 7396285 - DNA, 22 bp, Homo sapiens
caaatagaaggtactcagagaa

SEQ ID NO: 7396286 - DNA, 21 bp, Homo sapiens
caaatagacatggctagagga

SEQ ID NO: 7396287 - DNA, 21 bp, Homo sapiens
caaatagacatggctagagga

SEQ ID NO: 7396288 - DNA, 22 bp, Homo sapiens
caaatagacaagatggcaggaa

SEQ ID NO: 7396289 - DNA, 22 bp, Homo sapiens
caaatagacaagatggcaggaa

SEQ ID NO: 7396290 - DNA, 22 bp, Homo sapiens
caaatagacaagatggcaggaa

SEQ ID NO: 7396291 - DNA, 22 bp, Homo sapiens
caaatagaactcacagacaaga

SEQ ID NO: 7396292 - DNA, 22 bp, Homo sapiens
caaatagaactcacagacaaga

SEQ ID NO: 7396293 - DNA, 22 bp, Homo sapiens
caaatacttttagcctattgag

SEQ ID NO: 7396294 - DNA, 22 bp, Homo sapiens
caaatagaactcacagacaaga

SEQ ID NO: 7396295 - DNA, 22 bp, Homo sapiens
caaatagaactcacagacaaga

SEQ ID NO: 7396296 - DNA, 22 bp, Homo sapiens
caaatagaactcacagacaaga

SEQ ID NO: 7396297 - DNA, 22 bp, Homo sapiens
caaatagaactcacagacaaga

SEQ ID NO: 7396298 - DNA, 22 bp, Homo sapiens
caaatagaactcacagacaaga

SEQ ID NO: 7396299 - DNA, 22 bp, Homo sapiens
caaatagaactcacagacaaga

SEQ ID NO: 7396300 - DNA, 22 bp, Homo sapiens
caaatagactctagaatttatt

SEQ ID NO: 7396301 - DNA, 22 bp, Homo sapiens
caaatagactctagaatttatt

SEQ ID NO: 7396302 - DNA, 22 bp, Homo sapiens
caaatagactctagaatttatt

SEQ ID NO: 7396303 - DNA, 22 bp, Homo sapiens
caaatagactctagaatttatt

SEQ ID NO: 7396304 - DNA, 22 bp, Homo sapiens
caaatagactctagaatttatt

SEQ ID NO: 7396305 - DNA, 22 bp, Homo sapiens
caaatagactctagaatttatt

SEQ ID NO: 7396306 - DNA, 22 bp, Homo sapiens
gctctggttccagttccgcacc

SEQ ID NO: 7396307 - DNA, 21 bp, Homo sapiens
gctcttggaaggggctcagct

SEQ ID NO: 7396308 - DNA, 22 bp, Homo sapiens
gctcttggaagacaggatgtgt

SEQ ID NO: 7396309 - DNA, 22 bp, Homo sapiens
gctcttgtcaaaaattagttga

SEQ ID NO: 7396310 - DNA, 22 bp, Homo sapiens
gctcttgtcaaaaattagttga

SEQ ID NO: 7396311 - DNA, 22 bp, Homo sapiens
gctcttgtcaaaaattagttga

SEQ ID NO: 7396312 - DNA, 22 bp, Homo sapiens
gctcttggtctcagcctctgaa

SEQ ID NO: 7396313 - DNA, 22 bp, Homo sapiens
gctcttggtctcagcctctgaa

SEQ ID NO: 7396314 - DNA, 22 bp, Homo sapiens
gctcttgggggacagatggagt

SEQ ID NO: 7396315 - DNA, 22 bp, Homo sapiens
gctcttgggggacagatggagt

SEQ ID NO: 7396316 - DNA, 21 bp, Homo sapiens
gctcttggaaggggctcagct

SEQ ID NO: 7396317 - DNA, 18 bp, Homo sapiens
gctctggttccttcaacc

SEQ ID NO: 7396318 - DNA, 22 bp, Homo sapiens
gctcttggccaagtggaagggt

SEQ ID NO: 7396319 - DNA, 22 bp, Homo sapiens
gctctttaattcattcatggat

SEQ ID NO: 7396320 - DNA, 22 bp, Homo sapiens
gctcttgtcaaaaattagttga

SEQ ID NO: 7396321 - DNA, 22 bp, Homo sapiens
gctcttgtcaaaaattagttga

SEQ ID NO: 7396322 - DNA, 22 bp, Homo sapiens
gctcttgtcaaaaattagttga

SEQ ID NO: 7396323 - DNA, 22 bp, Homo sapiens
gctctttactgtgagggtggtc

SEQ ID NO: 7396324 - DNA, 22 bp, Homo sapiens
gctctttagcgggggccaggcc

SEQ ID NO: 7396325 - DNA, 22 bp, Homo sapiens
gctctttctgtccgcagggcct

SEQ ID NO: 7396326 - DNA, 22 bp, Homo sapiens
gctctttgcacagctctgccct

SEQ ID NO: 7396327 - DNA, 22 bp, Homo sapiens
gctctttgcacagctctgccct

SEQ ID NO: 7396328 - DNA, 22 bp, Homo sapiens
gctctttgcacagctctgccct

SEQ ID NO: 7396329 - DNA, 22 bp, Homo sapiens
gctctttggattcctttacaaa

SEQ ID NO: 7396330 - DNA, 22 bp, Homo sapiens
gctctttggattcctttacaaa

SEQ ID NO: 7396331 - DNA, 22 bp, Homo sapiens
gctgacccctacaggttgtgtt

SEQ ID NO: 7396332 - DNA, 22 bp, Homo sapiens
gctgacccctacaggttgtgtt

SEQ ID NO: 7396333 - DNA, 22 bp, Homo sapiens
gctgacccctacaggttgtgtt

SEQ ID NO: 7396334 - DNA, 20 bp, Homo sapiens
gctgaccataaatcacactg

SEQ ID NO: 7396335 - DNA, 22 bp, Homo sapiens
gctgacattccctgtgaaactt

SEQ ID NO: 7396336 - DNA, 22 bp, Homo sapiens
gctgaccatgaattaagcatct

SEQ ID NO: 7396337 - DNA, 22 bp, Homo sapiens
gctgacagcaaggggctgccct

SEQ ID NO: 7396338 - DNA, 22 bp, Homo sapiens
gctgacagcgtttccagtgatg

SEQ ID NO: 7396339 - DNA, 22 bp, Homo sapiens
gctgacagcgtttccagtgatg

SEQ ID NO: 7396340 - DNA, 22 bp, Homo sapiens
gctgacagcgtttccagtgatg

SEQ ID NO: 7396341 - DNA, 22 bp, Homo sapiens
gctgacagcaaggggctgccct

SEQ ID NO: 7396342 - DNA, 22 bp, Homo sapiens
gctgacagttactgctgtaaca

SEQ ID NO: 7396343 - DNA, 22 bp, Homo sapiens
gctgacagttactgctgtaaca

SEQ ID NO: 7396344 - DNA, 22 bp, Homo sapiens
gctgacagttgtacctgcccct

SEQ ID NO: 7396345 - DNA, 22 bp, Homo sapiens
gctgaaaggggtgacattcttt

SEQ ID NO: 7396346 - DNA, 22 bp, Homo sapiens
gctcttttcacagtccaaaatg

SEQ ID NO: 7396347 - DNA, 22 bp, Homo sapiens
gctgaaaaatagtgtcgtgttt

SEQ ID NO: 7396348 - DNA, 22 bp, Homo sapiens
gctctttggattcctttacaaa

SEQ ID NO: 7396349 - DNA, 20 bp, Homo sapiens
gctctttgtaagggaatttg

SEQ ID NO: 7396350 - DNA, 20 bp, Homo sapiens
gctctttgtaagggaatttg

SEQ ID NO: 7396351 - DNA, 22 bp, Homo sapiens
gctctttgtattttggaatcaa

SEQ ID NO: 7396352 - DNA, 22 bp, Homo sapiens
gctctttgtattttggaatcaa

SEQ ID NO: 7396353 - DNA, 23 bp, Homo sapiens
gctctttgttcatgtggatgcct

SEQ ID NO: 7396354 - DNA, 23 bp, Homo sapiens
gctctttgttcatgtggatgcct

SEQ ID NO: 7396355 - DNA, 22 bp, Homo sapiens
gctgacagagtgcctggcctca

SEQ ID NO: 7396356 - DNA, 22 bp, Homo sapiens
gctgacagagtgcctggcctca

SEQ ID NO: 7396357 - DNA, 22 bp, Homo sapiens
gctgaaatgaaaacacaggtcg

SEQ ID NO: 7396358 - DNA, 22 bp, Homo sapiens
gctgaaatgcagatccctcact

SEQ ID NO: 7396359 - DNA, 22 bp, Homo sapiens
gctgaaatgcagatccctcact

SEQ ID NO: 7396360 - DNA, 22 bp, Homo sapiens
gctgaaatgccttgtaaatatt

SEQ ID NO: 7396361 - DNA, 22 bp, Homo sapiens
gctgaaatgaaaacacaggtcg

SEQ ID NO: 7396362 - DNA, 22 bp, Homo sapiens
gctgaaatgaaaacacaggtcg

SEQ ID NO: 7396363 - DNA, 22 bp, Homo sapiens
gctgaaatcccagcattcccca

SEQ ID NO: 7396364 - DNA, 19 bp, Homo sapiens
gctgaaatcaaatttggaa

SEQ ID NO: 7396365 - DNA, 22 bp, Homo sapiens
gctgaaatcccagcattcccca

SEQ ID NO: 7396366 - DNA, 22 bp, Homo sapiens
gctgactgatggacacagcacc

SEQ ID NO: 7396367 - DNA, 22 bp, Homo sapiens
gctgacctgaatcattcggggt

SEQ ID NO: 7396368 - DNA, 22 bp, Homo sapiens
gctgactgatggacacagcacc

SEQ ID NO: 7396369 - DNA, 22 bp, Homo sapiens
gctgactgatggacacagcacc

SEQ ID NO: 7396370 - DNA, 22 bp, Homo sapiens
gctgactgctcagggccagctg

SEQ ID NO: 7396371 - DNA, 22 bp, Homo sapiens
gctgactgctcagggccagctg

SEQ ID NO: 7396372 - DNA, 22 bp, Homo sapiens
gctgactggttgcacagagggt

SEQ ID NO: 7396373 - DNA, 22 bp, Homo sapiens
gctgactggttgcacagagggt

SEQ ID NO: 7396374 - DNA, 22 bp, Homo sapiens
gctgactggttcaggtcccgct

SEQ ID NO: 7396375 - DNA, 22 bp, Homo sapiens
gctgactgctcagggccagctg

SEQ ID NO: 7396376 - DNA, 22 bp, Homo sapiens
gctgacctgaatcattcggggt

SEQ ID NO: 7396377 - DNA, 22 bp, Homo sapiens
gctgacctcgtccaggcgcttc

SEQ ID NO: 7396378 - DNA, 22 bp, Homo sapiens
gctgacctcgtccaggcgcttc

SEQ ID NO: 7396379 - DNA, 22 bp, Homo sapiens
gctgacctgctctcagcagaga

SEQ ID NO: 7396380 - DNA, 22 bp, Homo sapiens
gctgacctgtggcagaagctca

SEQ ID NO: 7396381 - DNA, 17 bp, Homo sapiens
gctgaccctggagaagt

SEQ ID NO: 7396382 - DNA, 22 bp, Homo sapiens
gctgactcagatgcagctggat

SEQ ID NO: 7396383 - DNA, 22 bp, Homo sapiens
gctgactgagctggcttttcgt

SEQ ID NO: 7396384 - DNA, 22 bp, Homo sapiens
gctgactcagatgcagctggat

SEQ ID NO: 7396385 - DNA, 22 bp, Homo sapiens
gctgaccttcaaatccagcgag

SEQ ID NO: 7396386 - DNA, 22 bp, Homo sapiens
gctgaccttcaaatccagcgag

SEQ ID NO: 7396387 - DNA, 22 bp, Homo sapiens
gctgacctttgccaggaaggca

SEQ ID NO: 7396388 - DNA, 22 bp, Homo sapiens
caaatgatacctattactaggc

SEQ ID NO: 7396389 - DNA, 22 bp, Homo sapiens
caaatgcatagaaagatgaaac

SEQ ID NO: 7396390 - DNA, 22 bp, Homo sapiens
caaatgcatagaaagatgaaac

SEQ ID NO: 7396391 - DNA, 22 bp, Homo sapiens
caaatgcatagtttataagaag

SEQ ID NO: 7396392 - DNA, 22 bp, Homo sapiens
caaatgcatagaaagatgaaac

SEQ ID NO: 7396393 - DNA, 22 bp, Homo sapiens
caaatgcatagtttataagaag

SEQ ID NO: 7396394 - DNA, 22 bp, Homo sapiens
caaatgcatagtttataagaag

SEQ ID NO: 7396395 - DNA, 22 bp, Homo sapiens
caaatgcatagtttataagaag

SEQ ID NO: 7396396 - DNA, 22 bp, Homo sapiens
caaatgcatagtttataagaag

SEQ ID NO: 7396397 - DNA, 22 bp, Homo sapiens
caaatgcatagtttataagaag

SEQ ID NO: 7396398 - DNA, 22 bp, Homo sapiens
caaatgcatagtttataagaag

SEQ ID NO: 7396399 - DNA, 22 bp, Homo sapiens
caaatgcatagtttataagaag

SEQ ID NO: 7396400 - DNA, 22 bp, Homo sapiens
caaatgcatagtttataagaag

SEQ ID NO: 7396401 - DNA, 22 bp, Homo sapiens
caaatgcatagtttataagaag

SEQ ID NO: 7396402 - DNA, 22 bp, Homo sapiens
caaatgatacctattactaggc

SEQ ID NO: 7396403 - DNA, 22 bp, Homo sapiens
caaatgatacctattactaggc

SEQ ID NO: 7396404 - DNA, 22 bp, Homo sapiens
caaatgatacctattactaggc

SEQ ID NO: 7396405 - DNA, 22 bp, Homo sapiens
caaatgatacctattactaggc

SEQ ID NO: 7396406 - DNA, 22 bp, Homo sapiens
caaatgaatttccctgcaaatg

SEQ ID NO: 7396407 - DNA, 20 bp, Homo sapiens
gctgactgtttgggtggcgg

SEQ ID NO: 7396408 - DNA, 22 bp, Homo sapiens
gctgactgtccgctgctcccgg

SEQ ID NO: 7396409 - DNA, 23 bp, Homo sapiens
gctgactgtgaaattctggagct

SEQ ID NO: 7396410 - DNA, 22 bp, Homo sapiens
caaatgctactaataggcaagt

SEQ ID NO: 7396411 - DNA, 22 bp, Homo sapiens
caaatgctaacttctttccaaa

SEQ ID NO: 7396412 - DNA, 22 bp, Homo sapiens
caaatgctactaataggcaagt

SEQ ID NO: 7396413 - DNA, 22 bp, Homo sapiens
caaatgctactaataggcaagt

SEQ ID NO: 7396414 - DNA, 22 bp, Homo sapiens
caaatgctactaataggcaagt

SEQ ID NO: 7396415 - DNA, 22 bp, Homo sapiens
caaatgctactaataggcaagt

SEQ ID NO: 7396416 - DNA, 22 bp, Homo sapiens
caaatgctactaataggcaagt

SEQ ID NO: 7396417 - DNA, 22 bp, Homo sapiens
caaatgctactaataggcaagt

SEQ ID NO: 7396418 - DNA, 22 bp, Homo sapiens
caaatgctaacttctttccaaa

SEQ ID NO: 7396419 - DNA, 22 bp, Homo sapiens
caaatgcatgagaaataagagg

SEQ ID NO: 7396420 - DNA, 22 bp, Homo sapiens
caaatgcatgagaaataagagg

SEQ ID NO: 7396421 - DNA, 22 bp, Homo sapiens
caaatgctaacttctttccaaa

SEQ ID NO: 7396422 - DNA, 22 bp, Homo sapiens
caaatgctaacttctttccaaa

SEQ ID NO: 7396423 - DNA, 22 bp, Homo sapiens
caaatgctaacttctttccaaa

SEQ ID NO: 7396424 - DNA, 22 bp, Homo sapiens
caaatgcatgagaaataagagg

SEQ ID NO: 7396425 - DNA, 22 bp, Homo sapiens
caaatgcatgagaaataagagg

SEQ ID NO: 7396426 - DNA, 22 bp, Homo sapiens
caaatgcatagtttataagaag

SEQ ID NO: 7396427 - DNA, 22 bp, Homo sapiens
caaatgcatagtttataagaag

SEQ ID NO: 7396428 - DNA, 22 bp, Homo sapiens
caaatgcatgagaaataagagg

SEQ ID NO: 7396429 - DNA, 22 bp, Homo sapiens
caaatgcatgagaaataagagg

SEQ ID NO: 7396430 - DNA, 22 bp, Homo sapiens
caaatgcatgagaaataagagg

SEQ ID NO: 7396431 - DNA, 22 bp, Homo sapiens
caaatgcatgagaaataagagg

SEQ ID NO: 7396432 - DNA, 22 bp, Homo sapiens
caaatgcatgagaaataagagg

SEQ ID NO: 7396433 - DNA, 22 bp, Homo sapiens
caaatgcatgagaaataagagg

SEQ ID NO: 7396434 - DNA, 22 bp, Homo sapiens
caaatgcatgagaaataagagg

SEQ ID NO: 7396435 - DNA, 22 bp, Homo sapiens
caaatgcatgagaaataagagg

SEQ ID NO: 7396436 - DNA, 22 bp, Homo sapiens
caaatggatacaggcaaacatt

SEQ ID NO: 7396437 - DNA, 22 bp, Homo sapiens
caaatggagaattagcagtttg

SEQ ID NO: 7396438 - DNA, 22 bp, Homo sapiens
caaatggaaagagcagaagctt

SEQ ID NO: 7396439 - DNA, 22 bp, Homo sapiens
caaatggaaagagcagaagctt

SEQ ID NO: 7396440 - DNA, 22 bp, Homo sapiens
caaatggcaacaagaacactgg

SEQ ID NO: 7396441 - DNA, 22 bp, Homo sapiens
caaatggctggcatccttctac

SEQ ID NO: 7396442 - DNA, 22 bp, Homo sapiens
caaatggcaacaagaacactgg

SEQ ID NO: 7396443 - DNA, 22 bp, Homo sapiens
caaatggatacaggcaaacatt

SEQ ID NO: 7396444 - DNA, 21 bp, Homo sapiens
caaatgctggctggatgagga

SEQ ID NO: 7396445 - DNA, 21 bp, Homo sapiens
caaatgctggctggatgagga

SEQ ID NO: 7396446 - DNA, 21 bp, Homo sapiens
caaatgctggctggatgagga

SEQ ID NO: 7396447 - DNA, 22 bp, Homo sapiens
caaatgctggccctgctactta

SEQ ID NO: 7396448 - DNA, 22 bp, Homo sapiens
caaatgctggccctgctactta

SEQ ID NO: 7396449 - DNA, 22 bp, Homo sapiens
caaatgctggccctgctactta

SEQ ID NO: 7396450 - DNA, 22 bp, Homo sapiens
caaatgctggccctgctactta

SEQ ID NO: 7396451 - DNA, 22 bp, Homo sapiens
caaatgctggccctgctactta

SEQ ID NO: 7396452 - DNA, 22 bp, Homo sapiens
caaatgctatgattttgagttt

SEQ ID NO: 7396453 - DNA, 22 bp, Homo sapiens
caaatgctatgattttgagttt

SEQ ID NO: 7396454 - DNA, 22 bp, Homo sapiens
caaatgctatgattttgagttt

SEQ ID NO: 7396455 - DNA, 22 bp, Homo sapiens
caaaattagaaatgcagctgtt

SEQ ID NO: 7396456 - DNA, 22 bp, Homo sapiens
caaaattagaaatgcagctgtt

SEQ ID NO: 7396457 - DNA, 22 bp, Homo sapiens
caaaattagaaatgcagctgtt

SEQ ID NO: 7396458 - DNA, 22 bp, Homo sapiens
caaaattagaaatgcagctgtt

SEQ ID NO: 7396459 - DNA, 22 bp, Homo sapiens
caaaattagaaatgcagctgtt

SEQ ID NO: 7396460 - DNA, 22 bp, Homo sapiens
caaaattagaaatgcagctgtt

SEQ ID NO: 7396461 - DNA, 22 bp, Homo sapiens
caaaattagaaatgcagctgtt

SEQ ID NO: 7396462 - DNA, 22 bp, Homo sapiens
caaaatgttctggcacctttaa

SEQ ID NO: 7396463 - DNA, 22 bp, Homo sapiens
caaaatgttctggcacctttaa

SEQ ID NO: 7396464 - DNA, 22 bp, Homo sapiens
caaaatgttctggcacctttaa

SEQ ID NO: 7396465 - DNA, 22 bp, Homo sapiens
caaaatgttctggcacctttaa

SEQ ID NO: 7396466 - DNA, 22 bp, Homo sapiens
caaaatgttctggcacctttaa

SEQ ID NO: 7396467 - DNA, 22 bp, Homo sapiens
caaaatgttctggcacctttaa

SEQ ID NO: 7396468 - DNA, 22 bp, Homo sapiens
caaaatgttctggcacctttaa

SEQ ID NO: 7396469 - DNA, 22 bp, Homo sapiens
caaaatgttctggcacctttaa

SEQ ID NO: 7396470 - DNA, 22 bp, Homo sapiens
caaaatgtgagtcccacctcaa

SEQ ID NO: 7396471 - DNA, 22 bp, Homo sapiens
caaaatgtgagtcccacctcaa

SEQ ID NO: 7396472 - DNA, 22 bp, Homo sapiens
caaaatgtgagtcccacctcaa

SEQ ID NO: 7396473 - DNA, 22 bp, Homo sapiens
caaaatgtgagtcccacctcaa

SEQ ID NO: 7396474 - DNA, 22 bp, Homo sapiens
caaaatgtgagtcccacctcaa

SEQ ID NO: 7396475 - DNA, 22 bp, Homo sapiens
caaaatagatgttaacctggaa

SEQ ID NO: 7396476 - DNA, 22 bp, Homo sapiens
caaaatagatgttaacctggaa

SEQ ID NO: 7396477 - DNA, 22 bp, Homo sapiens
caaaatagatgttaacctggaa

SEQ ID NO: 7396478 - DNA, 22 bp, Homo sapiens
caaaatgatgtgattttattgt

SEQ ID NO: 7396479 - DNA, 22 bp, Homo sapiens
caaaatgatgtgattttattgt

SEQ ID NO: 7396480 - DNA, 22 bp, Homo sapiens
caaaatgatgtgattttattgt

SEQ ID NO: 7396481 - DNA, 22 bp, Homo sapiens
caaaataccacgacttgtttta

SEQ ID NO: 7396482 - DNA, 22 bp, Homo sapiens
caaaatagatgttaacctggaa

SEQ ID NO: 7396483 - DNA, 22 bp, Homo sapiens
caaaatgcatctgagaccaggc

SEQ ID NO: 7396484 - DNA, 22 bp, Homo sapiens
caaaatgcatctgagaccaggc

SEQ ID NO: 7396485 - DNA, 23 bp, Homo sapiens
caaaatggtttaaaagtggcata

SEQ ID NO: 7396486 - DNA, 23 bp, Homo sapiens
caaaatggtttaaaagtggcata

SEQ ID NO: 7396487 - DNA, 22 bp, Homo sapiens
caaaatgatgtgattttattgt

SEQ ID NO: 7396488 - DNA, 22 bp, Homo sapiens
caaaatgatgtgattttattgt

SEQ ID NO: 7396489 - DNA, 22 bp, Homo sapiens
caaaatgatgtgattttattgt

SEQ ID NO: 7396490 - DNA, 22 bp, Homo sapiens
caaaatgatgtgattttattgt

SEQ ID NO: 7396491 - DNA, 22 bp, Homo sapiens
caaacaatttgcatttccttag

SEQ ID NO: 7396492 - DNA, 22 bp, Homo sapiens
caaacatagtgaagcaatgaca

SEQ ID NO: 7396493 - DNA, 22 bp, Homo sapiens
caaacatagtgaagcaatgaca

SEQ ID NO: 7396494 - DNA, 22 bp, Homo sapiens
caaacatagtgaagcaatgaca

SEQ ID NO: 7396495 - DNA, 22 bp, Homo sapiens
caaacatagtgaagcaatgaca

SEQ ID NO: 7396496 - DNA, 22 bp, Homo sapiens
caaacatagtgaagcaatgaca

SEQ ID NO: 7396497 - DNA, 22 bp, Homo sapiens
caaacattcaagtacaagtctt

SEQ ID NO: 7396498 - DNA, 22 bp, Homo sapiens
caaacattcaagtacaagtctt

SEQ ID NO: 7396499 - DNA, 22 bp, Homo sapiens
caaacatctgcaccttgaccgg

SEQ ID NO: 7396500 - DNA, 22 bp, Homo sapiens
caaacatctgcaccttgaccgg

SEQ ID NO: 7396501 - DNA, 22 bp, Homo sapiens
caaacatagtgaagcaatgaca

SEQ ID NO: 7396502 - DNA, 22 bp, Homo sapiens
caaacatctgcaccttgaccgg

SEQ ID NO: 7396503 - DNA, 22 bp, Homo sapiens
caaacatctgcaccttgaccgg

SEQ ID NO: 7396504 - DNA, 22 bp, Homo sapiens
caaaattgatgaatgtatgatt

SEQ ID NO: 7396505 - DNA, 22 bp, Homo sapiens
caaaattgattgtggtgatggt

SEQ ID NO: 7396506 - DNA, 22 bp, Homo sapiens
caaacaatttgcatttccttag

SEQ ID NO: 7396507 - DNA, 22 bp, Homo sapiens
caaacaatttgcatttccttag

SEQ ID NO: 7396508 - DNA, 22 bp, Homo sapiens
caaacaatttgcatttccttag

SEQ ID NO: 7396509 - DNA, 22 bp, Homo sapiens
caaaattagggagtgagctgga

SEQ ID NO: 7396510 - DNA, 22 bp, Homo sapiens
caaaattctgcatttctaataa

SEQ ID NO: 7396511 - DNA, 22 bp, Homo sapiens
caaaattctgcatttctaataa

SEQ ID NO: 7396512 - DNA, 22 bp, Homo sapiens
caaaattctgcatttctaataa

SEQ ID NO: 7396513 - DNA, 22 bp, Homo sapiens
caaaattagggagtgagctgga

SEQ ID NO: 7396514 - DNA, 22 bp, Homo sapiens
caaaattctgcatttctaataa

SEQ ID NO: 7396515 - DNA, 22 bp, Homo sapiens
caaaattctgcatttctaataa

SEQ ID NO: 7396516 - DNA, 22 bp, Homo sapiens
caaaattctgcatttctaataa

SEQ ID NO: 7396517 - DNA, 22 bp, Homo sapiens
caaaattctgcatttctaataa

SEQ ID NO: 7396518 - DNA, 22 bp, Homo sapiens
caaaattagggagtgagctgga

SEQ ID NO: 7396519 - DNA, 22 bp, Homo sapiens
caaaattagggagtgagctgga

SEQ ID NO: 7396520 - DNA, 22 bp, Homo sapiens
caaaattagggagtgagctgga

SEQ ID NO: 7396521 - DNA, 22 bp, Homo sapiens
caaaattagggagtgagctgga

SEQ ID NO: 7396522 - DNA, 22 bp, Homo sapiens
caaaattagggagtgagctgga

SEQ ID NO: 7396523 - DNA, 22 bp, Homo sapiens
caaaattagaaatgcagctgtt

SEQ ID NO: 7396524 - DNA, 22 bp, Homo sapiens
caaaattagaaatgcagctgtt

SEQ ID NO: 7396525 - DNA, 22 bp, Homo sapiens
caaaattagggagtgagctgga

SEQ ID NO: 7396526 - DNA, 22 bp, Homo sapiens
caaaattagggagtgagctgga

SEQ ID NO: 7396527 - DNA, 22 bp, Homo sapiens
caaaattagaaatgcagctgtt

SEQ ID NO: 7396528 - DNA, 21 bp, Homo sapiens
caaagccaggcaactctctcc

SEQ ID NO: 7396529 - DNA, 21 bp, Homo sapiens
caaagccaggcaactctctcc

SEQ ID NO: 7396530 - DNA, 22 bp, Homo sapiens
caaagccaggctttctaatgta

SEQ ID NO: 7396531 - DNA, 21 bp, Homo sapiens
caaagccaggcaactctctcc

SEQ ID NO: 7396532 - DNA, 22 bp, Homo sapiens
caaagcagttttaatcaagtag

SEQ ID NO: 7396533 - DNA, 22 bp, Homo sapiens
caaagcagttttaatcaagtag

SEQ ID NO: 7396534 - DNA, 21 bp, Homo sapiens
caaagccaggcaactctctcc

SEQ ID NO: 7396535 - DNA, 22 bp, Homo sapiens
caaagcagttttaatcaagtag

SEQ ID NO: 7396536 - DNA, 22 bp, Homo sapiens
caaagccatagagtagataaga

SEQ ID NO: 7396537 - DNA, 22 bp, Homo sapiens
caaagcccagaggcctcacttt

SEQ ID NO: 7396538 - DNA, 22 bp, Homo sapiens
caaagccaggctttctaatgta

SEQ ID NO: 7396539 - DNA, 22 bp, Homo sapiens
caaagccaggctttctaatgta

SEQ ID NO: 7396540 - DNA, 22 bp, Homo sapiens
caaagccaggctttctaatgta

SEQ ID NO: 7396541 - DNA, 20 bp, Homo sapiens
caaagcagtaggataaaaat

SEQ ID NO: 7396542 - DNA, 20 bp, Homo sapiens
caaagcagtaggataaaaat

SEQ ID NO: 7396543 - DNA, 22 bp, Homo sapiens
caaagcagtattggattcttta

SEQ ID NO: 7396544 - DNA, 22 bp, Homo sapiens
caaagcagtattggattcttta

SEQ ID NO: 7396545 - DNA, 22 bp, Homo sapiens
caaagcagtattggattcttta

SEQ ID NO: 7396546 - DNA, 22 bp, Homo sapiens
caaagcagtgatccttaaagga

SEQ ID NO: 7396547 - DNA, 22 bp, Homo sapiens
caaagcagtgatccttaaagga

SEQ ID NO: 7396548 - DNA, 18 bp, Homo sapiens
caaagcaggtgacagtgt

SEQ ID NO: 7396549 - DNA, 18 bp, Homo sapiens
caaagcaggtgacagtgt

SEQ ID NO: 7396550 - DNA, 18 bp, Homo sapiens
caaagcaggtgacagtgt

SEQ ID NO: 7396551 - DNA, 18 bp, Homo sapiens
caaagcaggtgacagtgt

SEQ ID NO: 7396552 - DNA, 22 bp, Homo sapiens
caaagcaggcttgtcaaattgc

SEQ ID NO: 7396553 - DNA, 22 bp, Homo sapiens
caaagcaggcttgtcaaattgc

SEQ ID NO: 7396554 - DNA, 22 bp, Homo sapiens
caaagcaggaagctcctgacag

SEQ ID NO: 7396555 - DNA, 22 bp, Homo sapiens
caaagcaggaagctcctgacag

SEQ ID NO: 7396556 - DNA, 22 bp, Homo sapiens
caaagcaggaagctcctgacag

SEQ ID NO: 7396557 - DNA, 22 bp, Homo sapiens
caaagcaggaagctcctgacag

SEQ ID NO: 7396558 - DNA, 22 bp, Homo sapiens
caaagcaggaagaatattgaaa

SEQ ID NO: 7396559 - DNA, 22 bp, Homo sapiens
caaagcagcggattgggatagt

SEQ ID NO: 7396560 - DNA, 22 bp, Homo sapiens
caaagcagcctgcagtgtggac

SEQ ID NO: 7396561 - DNA, 22 bp, Homo sapiens
caaagcagcctgcagtgtggac

SEQ ID NO: 7396562 - DNA, 22 bp, Homo sapiens
caaagcagcctgcagtgtggac

SEQ ID NO: 7396563 - DNA, 22 bp, Homo sapiens
caaagcagcctgcagtgtggac

SEQ ID NO: 7396564 - DNA, 22 bp, Homo sapiens
caaagcagcctgcagtgtggac

SEQ ID NO: 7396565 - DNA, 22 bp, Homo sapiens
caaagcagagaactgtctcatt

SEQ ID NO: 7396566 - DNA, 22 bp, Homo sapiens
caaagcagacgcagtaagggta

SEQ ID NO: 7396567 - DNA, 22 bp, Homo sapiens
caaagcagacgcagtaagggta

SEQ ID NO: 7396568 - DNA, 22 bp, Homo sapiens
caaagcagagaactgtctcatt

SEQ ID NO: 7396569 - DNA, 22 bp, Homo sapiens
caaagcagagaactgtctcatt

SEQ ID NO: 7396570 - DNA, 22 bp, Homo sapiens
caaagcagagaactgtctcatt

SEQ ID NO: 7396571 - DNA, 22 bp, Homo sapiens
caaagcagagaactgtctcatt

SEQ ID NO: 7396572 - DNA, 22 bp, Homo sapiens
caaagcagagaactgtctcatt

SEQ ID NO: 7396573 - DNA, 22 bp, Homo sapiens
caaagcagagccagagcttgtc

SEQ ID NO: 7396574 - DNA, 22 bp, Homo sapiens
caaagcagagccagagcttgtc

SEQ ID NO: 7396575 - DNA, 22 bp, Homo sapiens
caaagcagagccagagcttgtc

SEQ ID NO: 7396576 - DNA, 22 bp, Homo sapiens
caaacattccgcttctcccagg

SEQ ID NO: 7396577 - DNA, 22 bp, Homo sapiens
caaacattccgcttctcccagg

SEQ ID NO: 7396578 - DNA, 22 bp, Homo sapiens
caaacattcagatgcaatggta

SEQ ID NO: 7396579 - DNA, 22 bp, Homo sapiens
caaacattccgcttctcccagg

SEQ ID NO: 7396580 - DNA, 22 bp, Homo sapiens
caaacattccgcttctcccagg

SEQ ID NO: 7396581 - DNA, 22 bp, Homo sapiens
caaacattcagatgcaatggta

SEQ ID NO: 7396582 - DNA, 22 bp, Homo sapiens
caaagaggttttgagggcagct

SEQ ID NO: 7396583 - DNA, 22 bp, Homo sapiens
caaagaggttttgagggcagct

SEQ ID NO: 7396584 - DNA, 22 bp, Homo sapiens
caaagagttttttcatataatg

SEQ ID NO: 7396585 - DNA, 22 bp, Homo sapiens
caaagagttttttcatataatg

SEQ ID NO: 7396586 - DNA, 22 bp, Homo sapiens
caaagaggttttgagggcagct

SEQ ID NO: 7396587 - DNA, 22 bp, Homo sapiens
caaagagttttttcatataatg

SEQ ID NO: 7396588 - DNA, 22 bp, Homo sapiens
caaacattcaagtacaagtctt

SEQ ID NO: 7396589 - DNA, 22 bp, Homo sapiens
caaacattcaagtacaagtctt

SEQ ID NO: 7396590 - DNA, 22 bp, Homo sapiens
caaacattcaagtacaagtctt

SEQ ID NO: 7396591 - DNA, 22 bp, Homo sapiens
caaacattcagatgcaatggta

SEQ ID NO: 7396592 - DNA, 22 bp, Homo sapiens
caaacattcaagtacaagtctt

SEQ ID NO: 7396593 - DNA, 22 bp, Homo sapiens
caaacattcagatgcaatggta

SEQ ID NO: 7396594 - DNA, 22 bp, Homo sapiens
caaacattcagatgcaatggta

SEQ ID NO: 7396595 - DNA, 22 bp, Homo sapiens
caaacattcaagtacaagtctt

SEQ ID NO: 7396596 - DNA, 22 bp, Homo sapiens
caaacattcaagtacaagtctt

SEQ ID NO: 7396597 - DNA, 22 bp, Homo sapiens
caaacattcaagtacaagtctt

SEQ ID NO: 7396598 - DNA, 22 bp, Homo sapiens
caaacattcaagtacaagtctt

SEQ ID NO: 7396599 - DNA, 22 bp, Homo sapiens
attttactttgtgaatattgac

SEQ ID NO: 7396600 - DNA, 22 bp, Homo sapiens
attttactttgtgaatattgac

SEQ ID NO: 7396601 - DNA, 22 bp, Homo sapiens
attttacttcatttgaaatgcc

SEQ ID NO: 7396602 - DNA, 22 bp, Homo sapiens
attttacttagtgtaatgtcca

SEQ ID NO: 7396603 - DNA, 22 bp, Homo sapiens
attttagagaaacaaacgtagg

SEQ ID NO: 7396604 - DNA, 22 bp, Homo sapiens
attttagagaaacaaacgtagg

SEQ ID NO: 7396605 - DNA, 22 bp, Homo sapiens
attttagagaaacaaacgtagg

SEQ ID NO: 7396606 - DNA, 22 bp, Homo sapiens
attttactttgtgaatattgac

SEQ ID NO: 7396607 - DNA, 22 bp, Homo sapiens
attttactttgtgaatattgac

SEQ ID NO: 7396608 - DNA, 22 bp, Homo sapiens
attttactttgtgaatattgac

SEQ ID NO: 7396609 - DNA, 22 bp, Homo sapiens
attttagagaaacaaacgtagg

SEQ ID NO: 7396610 - DNA, 22 bp, Homo sapiens
attttagagaaacaaacgtagg

SEQ ID NO: 7396611 - DNA, 22 bp, Homo sapiens
attttagagctccaagtacagc

SEQ ID NO: 7396612 - DNA, 22 bp, Homo sapiens
attttagagctccaagtacagc

SEQ ID NO: 7396613 - DNA, 22 bp, Homo sapiens
attttagagctccaagtacagc

SEQ ID NO: 7396614 - DNA, 22 bp, Homo sapiens
attttagagaaacaaacgtagg

SEQ ID NO: 7396615 - DNA, 22 bp, Homo sapiens
attttagagctccaagtacagc

SEQ ID NO: 7396616 - DNA, 22 bp, Homo sapiens
attttagagctccaagtacagc

SEQ ID NO: 7396617 - DNA, 22 bp, Homo sapiens
attttagagctccaagtacagc

SEQ ID NO: 7396618 - DNA, 22 bp, Homo sapiens
attttagagctccaagtacagc

SEQ ID NO: 7396619 - DNA, 22 bp, Homo sapiens
attttagagctccaagtacagc

SEQ ID NO: 7396620 - DNA, 22 bp, Homo sapiens
attttgctgtggtacattagga

SEQ ID NO: 7396621 - DNA, 22 bp, Homo sapiens
attttgctttatgtaaatatgt

SEQ ID NO: 7396622 - DNA, 22 bp, Homo sapiens
atttttcaactttggaaatggc

SEQ ID NO: 7396623 - DNA, 22 bp, Homo sapiens
atttttatgacaaaccatcctc

SEQ ID NO: 7396624 - DNA, 22 bp, Homo sapiens
atttttatgacaaaccatcctc

SEQ ID NO: 7396625 - DNA, 23 bp, Homo sapiens
atttttagcctctctgagctgag

SEQ ID NO: 7396626 - DNA, 22 bp, Homo sapiens
atttttatgacaaaccatcctc

SEQ ID NO: 7396627 - DNA, 22 bp, Homo sapiens
atttttatgacaaaccatcctc

SEQ ID NO: 7396628 - DNA, 22 bp, Homo sapiens
attttgtttcctttggagtaga

SEQ ID NO: 7396629 - DNA, 22 bp, Homo sapiens
attttgtttcctttggagtaga

SEQ ID NO: 7396630 - DNA, 22 bp, Homo sapiens
attttgctttatgtaaatatgt

SEQ ID NO: 7396631 - DNA, 22 bp, Homo sapiens
attttgctttatgtaaatatgt

SEQ ID NO: 7396632 - DNA, 22 bp, Homo sapiens
attttgctttatgtaaatatgt

SEQ ID NO: 7396633 - DNA, 22 bp, Homo sapiens
attttgtttcctttggagtaga

SEQ ID NO: 7396634 - DNA, 22 bp, Homo sapiens
attttgtttcctttggagtaga

SEQ ID NO: 7396635 - DNA, 22 bp, Homo sapiens
atttttcagcttcattgaggca

SEQ ID NO: 7396636 - DNA, 22 bp, Homo sapiens
atttttcaactttggaaatggc

SEQ ID NO: 7396637 - DNA, 22 bp, Homo sapiens
atttttcaactttggaaatggc

SEQ ID NO: 7396638 - DNA, 22 bp, Homo sapiens
atttttcaactttggaaatggc

SEQ ID NO: 7396639 - DNA, 22 bp, Homo sapiens
atttttcaactttggaaatggc

SEQ ID NO: 7396640 - DNA, 22 bp, Homo sapiens
atttttcaactttggaaatggc

SEQ ID NO: 7396641 - DNA, 22 bp, Homo sapiens
atttttcagcttcattgaggca

SEQ ID NO: 7396642 - DNA, 22 bp, Homo sapiens
atttttcagcttcattgaggca

SEQ ID NO: 7396643 - DNA, 22 bp, Homo sapiens
atttttcagcttcattgaggca

SEQ ID NO: 7396644 - DNA, 22 bp, Homo sapiens
atttttcagcttcattgaggca

SEQ ID NO: 7396645 - DNA, 22 bp, Homo sapiens
atttttcagcttcattgaggca

SEQ ID NO: 7396646 - DNA, 22 bp, Homo sapiens
atttttccaattaggataaaga

SEQ ID NO: 7396647 - DNA, 22 bp, Homo sapiens
atttttccaattaggataaaga

SEQ ID NO: 7396648 - DNA, 22 bp, Homo sapiens
atttttccaattaggataaaga

SEQ ID NO: 7396649 - DNA, 22 bp, Homo sapiens
atttttccaattaggataaaga

SEQ ID NO: 7396650 - DNA, 22 bp, Homo sapiens
atttttcagcttcattgaggca

SEQ ID NO: 7396651 - DNA, 22 bp, Homo sapiens
atttttcagcttcattgaggca

SEQ ID NO: 7396652 - DNA, 22 bp, Homo sapiens
atttttccatgatacttatctg

SEQ ID NO: 7396653 - DNA, 22 bp, Homo sapiens
atttttccaattaggataaaga

SEQ ID NO: 7396654 - DNA, 22 bp, Homo sapiens
atttttccatgatacttatctg

SEQ ID NO: 7396655 - DNA, 22 bp, Homo sapiens
atttttccatgatacttatctg

SEQ ID NO: 7396656 - DNA, 22 bp, Homo sapiens
atttttccatgatacttatctg

SEQ ID NO: 7396657 - DNA, 22 bp, Homo sapiens
atttttccatgatacttatctg

SEQ ID NO: 7396658 - DNA, 22 bp, Homo sapiens
atttttgagctgtgaacatagc

SEQ ID NO: 7396659 - DNA, 22 bp, Homo sapiens
atttttgagctgtgaacatagc

SEQ ID NO: 7396660 - DNA, 22 bp, Homo sapiens
atttttgagctgtgaacatagc

SEQ ID NO: 7396661 - DNA, 22 bp, Homo sapiens
atttttgagctgtgaacatagc

SEQ ID NO: 7396662 - DNA, 22 bp, Homo sapiens
atttttgagctgtgaacatagc

SEQ ID NO: 7396663 - DNA, 19 bp, Homo sapiens
atttttcttcctctgtgca

SEQ ID NO: 7396664 - DNA, 19 bp, Homo sapiens
atttttcttcctctgtgca

SEQ ID NO: 7396665 - DNA, 19 bp, Homo sapiens
atttttcttcctctgtgca

SEQ ID NO: 7396666 - DNA, 19 bp, Homo sapiens
atttttcttcctctgtgca

SEQ ID NO: 7396667 - DNA, 19 bp, Homo sapiens
atttttcttcctctgtgca

SEQ ID NO: 7396668 - DNA, 19 bp, Homo sapiens
atttttcttcctctgtgca

SEQ ID NO: 7396669 - DNA, 19 bp, Homo sapiens
atttttcttcctctgtgca

SEQ ID NO: 7396670 - DNA, 19 bp, Homo sapiens
atttttcttcctctgtgca

SEQ ID NO: 7396671 - DNA, 19 bp, Homo sapiens
atttttcttcctctgtgca

SEQ ID NO: 7396672 - DNA, 22 bp, Homo sapiens
atttttctctttccactgagat

SEQ ID NO: 7396673 - DNA, 22 bp, Homo sapiens
atttttctctttccactgagat

SEQ ID NO: 7396674 - DNA, 22 bp, Homo sapiens
atttttctctttccactgagat

SEQ ID NO: 7396675 - DNA, 22 bp, Homo sapiens
atttttctctttccactgagat

SEQ ID NO: 7396676 - DNA, 22 bp, Homo sapiens
atttttctctttccactgagat

SEQ ID NO: 7396677 - DNA, 22 bp, Homo sapiens
atttttctctttccactgagat

SEQ ID NO: 7396678 - DNA, 22 bp, Homo sapiens
atttttctctttccactgagat

SEQ ID NO: 7396679 - DNA, 22 bp, Homo sapiens
atttttctctttccactgagat

SEQ ID NO: 7396680 - DNA, 22 bp, Homo sapiens
atttttctctttccactgagat

SEQ ID NO: 7396681 - DNA, 22 bp, Homo sapiens
atttttgccctgcagtacataa

SEQ ID NO: 7396682 - DNA, 22 bp, Homo sapiens
atttttgccctgcagtacataa

SEQ ID NO: 7396683 - DNA, 22 bp, Homo sapiens
atttttgagctgtgaacatagc

SEQ ID NO: 7396684 - DNA, 22 bp, Homo sapiens
atttttgccctgcagtacataa

SEQ ID NO: 7396685 - DNA, 22 bp, Homo sapiens
atttttggctgttgtcagaggt

SEQ ID NO: 7396686 - DNA, 22 bp, Homo sapiens
atttttggctgttgtcagaggt

SEQ ID NO: 7396687 - DNA, 22 bp, Homo sapiens
atttttgtatccccagctcctg

SEQ ID NO: 7396688 - DNA, 22 bp, Homo sapiens
atttttgtatccccagctcctg

SEQ ID NO: 7396689 - DNA, 22 bp, Homo sapiens
caaaagcagttctatctgagtt

SEQ ID NO: 7396690 - DNA, 22 bp, Homo sapiens
attttttagaacctggcctgat

SEQ ID NO: 7396691 - DNA, 22 bp, Homo sapiens
caaaagcagttctatctgagtt

SEQ ID NO: 7396692 - DNA, 22 bp, Homo sapiens
atttttgtatccccagctcctg

SEQ ID NO: 7396693 - DNA, 22 bp, Homo sapiens
caaaagcagttctatctgagtt

SEQ ID NO: 7396694 - DNA, 22 bp, Homo sapiens
attttttagaacctggcctgat

SEQ ID NO: 7396695 - DNA, 22 bp, Homo sapiens
caaaagcagttctatctgagtt

SEQ ID NO: 7396696 - DNA, 22 bp, Homo sapiens
caaaagcagttctatctgagtt

SEQ ID NO: 7396697 - DNA, 22 bp, Homo sapiens
caaaataccacgacttgtttta

SEQ ID NO: 7396698 - DNA, 22 bp, Homo sapiens
caaaagcagttctatctgagtt

SEQ ID NO: 7396699 - DNA, 22 bp, Homo sapiens
caaaataccacgacttgtttta

SEQ ID NO: 7396700 - DNA, 22 bp, Homo sapiens
atttttctctcacacttaccag

SEQ ID NO: 7396701 - DNA, 22 bp, Homo sapiens
atttttctctcacacttaccag

SEQ ID NO: 7396702 - DNA, 22 bp, Homo sapiens
atttttctctcacacttaccag

SEQ ID NO: 7396703 - DNA, 22 bp, Homo sapiens
atttttctctcacacttaccag

SEQ ID NO: 7396704 - DNA, 22 bp, Homo sapiens
atttttctctcacacttaccag

SEQ ID NO: 7396705 - DNA, 22 bp, Homo sapiens
atttttctctccactccattaa

SEQ ID NO: 7396706 - DNA, 22 bp, Homo sapiens
atttttctctccactccattaa

SEQ ID NO: 7396707 - DNA, 22 bp, Homo sapiens
atttttctctccactccattaa

SEQ ID NO: 7396708 - DNA, 22 bp, Homo sapiens
atttttctctcacacttaccag

SEQ ID NO: 7396709 - DNA, 22 bp, Homo sapiens
atttttctctcacacttaccag

SEQ ID NO: 7396710 - DNA, 22 bp, Homo sapiens
atttttctctttccactgagat

SEQ ID NO: 7396711 - DNA, 22 bp, Homo sapiens
atttttctctttccactgagat

SEQ ID NO: 7396712 - DNA, 22 bp, Homo sapiens
atttttctctttccactgagat

SEQ ID NO: 7396713 - DNA, 22 bp, Homo sapiens
atttttctctccactccattaa

SEQ ID NO: 7396714 - DNA, 22 bp, Homo sapiens
atttttctctccactccattaa

SEQ ID NO: 7396715 - DNA, 22 bp, Homo sapiens
atttttctctccactccattaa

SEQ ID NO: 7396716 - DNA, 22 bp, Homo sapiens
atttttctctccactccattaa

SEQ ID NO: 7396717 - DNA, 22 bp, Homo sapiens
atttttctctccactccattaa

SEQ ID NO: 7396718 - DNA, 22 bp, Homo sapiens
atttttctctccactccattaa

SEQ ID NO: 7396719 - DNA, 22 bp, Homo sapiens
atttttctctccactccattaa

SEQ ID NO: 7396720 - DNA, 22 bp, Homo sapiens
atttttcctgggtgctttagtt

SEQ ID NO: 7396721 - DNA, 22 bp, Homo sapiens
atttttctctcacacttaccag

SEQ ID NO: 7396722 - DNA, 22 bp, Homo sapiens
atttttcctgggtgctttagtt

SEQ ID NO: 7396723 - DNA, 22 bp, Homo sapiens
atttttcctgggtgctttagtt

SEQ ID NO: 7396724 - DNA, 22 bp, Homo sapiens
atttttcctgggtgctttagtt

SEQ ID NO: 7396725 - DNA, 23 bp, Homo sapiens
atttttcctggaacagtcaccca

SEQ ID NO: 7396726 - DNA, 23 bp, Homo sapiens
atttttcctggaacagtcaccca

SEQ ID NO: 7396727 - DNA, 22 bp, Homo sapiens
atttttcctgctggatctgctc

SEQ ID NO: 7396728 - DNA, 22 bp, Homo sapiens
atttttcctgctggatctgctc

SEQ ID NO: 7396729 - DNA, 23 bp, Homo sapiens
atttttcctggaacagtcaccca

SEQ ID NO: 7396730 - DNA, 22 bp, Homo sapiens
atttttccattctctgttagta

SEQ ID NO: 7396731 - DNA, 22 bp, Homo sapiens
atttttccattctctgttagta

SEQ ID NO: 7396732 - DNA, 22 bp, Homo sapiens
atttttccattctctgttagta

SEQ ID NO: 7396733 - DNA, 22 bp, Homo sapiens
atttttccatgatacttatctg

SEQ ID NO: 7396734 - DNA, 22 bp, Homo sapiens
atttttccatgatacttatctg

SEQ ID NO: 7396735 - DNA, 22 bp, Homo sapiens
atttttccatgatacttatctg

SEQ ID NO: 7396736 - DNA, 22 bp, Homo sapiens
atttttcctgctggatctgctc

SEQ ID NO: 7396737 - DNA, 22 bp, Homo sapiens
atttttcctgctggatctgctc

SEQ ID NO: 7396738 - DNA, 22 bp, Homo sapiens
atttttcctgctggatctgctc

SEQ ID NO: 7396739 - DNA, 18 bp, Homo sapiens
atttttcccagatggata

SEQ ID NO: 7396740 - DNA, 18 bp, Homo sapiens
atttttcccagatggata

SEQ ID NO: 7396741 - DNA, 18 bp, Homo sapiens
atttttcccagatggata

SEQ ID NO: 7396742 - DNA, 18 bp, Homo sapiens
atttttcccagatggata

SEQ ID NO: 7396743 - DNA, 18 bp, Homo sapiens
atttttcccagatggata

SEQ ID NO: 7396744 - DNA, 22 bp, Homo sapiens
atttggaaaatctggttataga

SEQ ID NO: 7396745 - DNA, 22 bp, Homo sapiens
atttggaaaatctggttataga

SEQ ID NO: 7396746 - DNA, 22 bp, Homo sapiens
atttggaaaatctggttataga

SEQ ID NO: 7396747 - DNA, 22 bp, Homo sapiens
atttggaaaatctggttataga

SEQ ID NO: 7396748 - DNA, 22 bp, Homo sapiens
atttggaaacaaatggtttcgc

SEQ ID NO: 7396749 - DNA, 22 bp, Homo sapiens
atttggaaacaaatggtttcgc

SEQ ID NO: 7396750 - DNA, 22 bp, Homo sapiens
atttggaaacaaatggtttcgc

SEQ ID NO: 7396751 - DNA, 22 bp, Homo sapiens
atttggaaacaattatattctt

SEQ ID NO: 7396752 - DNA, 22 bp, Homo sapiens
atttggaaacaattatattctt

SEQ ID NO: 7396753 - DNA, 22 bp, Homo sapiens
atttggaaacaaatggtttcgc

SEQ ID NO: 7396754 - DNA, 22 bp, Homo sapiens
atttggaaacaaatggtttcgc

SEQ ID NO: 7396755 - DNA, 22 bp, Homo sapiens
atttggaaacaattatattctt

SEQ ID NO: 7396756 - DNA, 22 bp, Homo sapiens
atttggaaacatgctgaccatg

SEQ ID NO: 7396757 - DNA, 22 bp, Homo sapiens
atttggaaacaattatattctt

SEQ ID NO: 7396758 - DNA, 22 bp, Homo sapiens
atttggaaacaattatattctt

SEQ ID NO: 7396759 - DNA, 19 bp, Homo sapiens
atttggaaataaggtcttc

SEQ ID NO: 7396760 - DNA, 22 bp, Homo sapiens
atttggaaatacgcgcttttgg

SEQ ID NO: 7396761 - DNA, 19 bp, Homo sapiens
atttggaaataaggtcttc

SEQ ID NO: 7396762 - DNA, 22 bp, Homo sapiens
atttggaaacatgctgaccatg

SEQ ID NO: 7396763 - DNA, 22 bp, Homo sapiens
atttggaaacatgctgaccatg

SEQ ID NO: 7396764 - DNA, 22 bp, Homo sapiens
atttggaaacatgctgaccatg

SEQ ID NO: 7396765 - DNA, 19 bp, Homo sapiens
atttggaaataaggtcttc

SEQ ID NO: 7396766 - DNA, 19 bp, Homo sapiens
atttggaaataaggtcttc

SEQ ID NO: 7396767 - DNA, 22 bp, Homo sapiens
atttggaaatgcatctcttgag

SEQ ID NO: 7396768 - DNA, 22 bp, Homo sapiens
atttggaaatgtaagaatgcaa

SEQ ID NO: 7396769 - DNA, 22 bp, Homo sapiens
atttggaaatgcatctcttgag

SEQ ID NO: 7396770 - DNA, 22 bp, Homo sapiens
atttggaaatacgcgcttttgg

SEQ ID NO: 7396771 - DNA, 22 bp, Homo sapiens
atttggaaatacgcgcttttgg

SEQ ID NO: 7396772 - DNA, 19 bp, Homo sapiens
atttggaaataaggtcttc

SEQ ID NO: 7396773 - DNA, 22 bp, Homo sapiens
atttggaaatgcatctcttgag

SEQ ID NO: 7396774 - DNA, 22 bp, Homo sapiens
atttggaaatgcatctcttgag

SEQ ID NO: 7396775 - DNA, 22 bp, Homo sapiens
atttggaaatacgcgcttttgg

SEQ ID NO: 7396776 - DNA, 22 bp, Homo sapiens
atttggaaaagtttcttcaact

SEQ ID NO: 7396777 - DNA, 22 bp, Homo sapiens
atttggaaaagtttcttcaact

SEQ ID NO: 7396778 - DNA, 22 bp, Homo sapiens
atttggaaaagcggtaacttgc

SEQ ID NO: 7396779 - DNA, 22 bp, Homo sapiens
atttggaaaagtttcttcaact

SEQ ID NO: 7396780 - DNA, 22 bp, Homo sapiens
atttggaaaatctggttataga

SEQ ID NO: 7396781 - DNA, 22 bp, Homo sapiens
atttggaaaagtttcttcaact

SEQ ID NO: 7396782 - DNA, 22 bp, Homo sapiens
atttggaaaatctggttataga

SEQ ID NO: 7396783 - DNA, 22 bp, Homo sapiens
atttggaaaagcggtaacttgc

SEQ ID NO: 7396784 - DNA, 22 bp, Homo sapiens
atttggaaaagcggtaacttgc

SEQ ID NO: 7396785 - DNA, 22 bp, Homo sapiens
atttggaaaagcggtaacttgc

SEQ ID NO: 7396786 - DNA, 22 bp, Homo sapiens
atttggaaaagcggtaacttgc

SEQ ID NO: 7396787 - DNA, 22 bp, Homo sapiens
atttggaaaagcggtaacttgc

SEQ ID NO: 7396788 - DNA, 22 bp, Homo sapiens
atttgctgagctcaaagaaaag

SEQ ID NO: 7396789 - DNA, 22 bp, Homo sapiens
atttgctgagctcaaagaaaag

SEQ ID NO: 7396790 - DNA, 22 bp, Homo sapiens
atttgctgaatcaatgaatttt

SEQ ID NO: 7396791 - DNA, 22 bp, Homo sapiens
atttgctgagctcaaagaaaag

SEQ ID NO: 7396792 - DNA, 22 bp, Homo sapiens
gccccctctttggagccagcca

SEQ ID NO: 7396793 - DNA, 22 bp, Homo sapiens
gccccctatgaagaagggcaca

SEQ ID NO: 7396794 - DNA, 22 bp, Homo sapiens
gccccctctttggagccagcca

SEQ ID NO: 7396795 - DNA, 22 bp, Homo sapiens
gccccctctttggagccagcca

SEQ ID NO: 7396796 - DNA, 22 bp, Homo sapiens
atttgctagcaagtattctgaa

SEQ ID NO: 7396797 - DNA, 22 bp, Homo sapiens
atttgctagtggaattttcctg

SEQ ID NO: 7396798 - DNA, 22 bp, Homo sapiens
atttgccttttaaactcacaat

SEQ ID NO: 7396799 - DNA, 22 bp, Homo sapiens
atttgccttttaaactcacaat

SEQ ID NO: 7396800 - DNA, 22 bp, Homo sapiens
atttgccttttaaactcacaat

SEQ ID NO: 7396801 - DNA, 22 bp, Homo sapiens
atttgccttttaaactcacaat

SEQ ID NO: 7396802 - DNA, 22 bp, Homo sapiens
gcccccagacctcagtgggctg

SEQ ID NO: 7396803 - DNA, 22 bp, Homo sapiens
gcccccagacctcagtgggctg

SEQ ID NO: 7396804 - DNA, 22 bp, Homo sapiens
gcccccagacctcagtgggctg

SEQ ID NO: 7396805 - DNA, 22 bp, Homo sapiens
gcccccagacctcagtgggctg

SEQ ID NO: 7396806 - DNA, 22 bp, Homo sapiens
gcccccagagaatgaggtacga

SEQ ID NO: 7396807 - DNA, 18 bp, Homo sapiens
gcccccagatgctactga

SEQ ID NO: 7396808 - DNA, 22 bp, Homo sapiens
gcccccagctctcaagctcaaa

SEQ ID NO: 7396809 - DNA, 18 bp, Homo sapiens
gcccccagatgctactga

SEQ ID NO: 7396810 - DNA, 18 bp, Homo sapiens
gcccccagatgctactga

SEQ ID NO: 7396811 - DNA, 22 bp, Homo sapiens
gcccccagagaatgaggtacga

SEQ ID NO: 7396812 - DNA, 22 bp, Homo sapiens
gcccccagagaatgaggtacga

SEQ ID NO: 7396813 - DNA, 22 bp, Homo sapiens
gcccccagaagggccacagatt

SEQ ID NO: 7396814 - DNA, 22 bp, Homo sapiens
gcccccagaagggccacagatt

SEQ ID NO: 7396815 - DNA, 22 bp, Homo sapiens
gcccccagaagggccacagatt

SEQ ID NO: 7396816 - DNA, 22 bp, Homo sapiens
gcccccagaagggccacagatt

SEQ ID NO: 7396817 - DNA, 22 bp, Homo sapiens
gcccccagaagggccacagatt

SEQ ID NO: 7396818 - DNA, 22 bp, Homo sapiens
gcccccagaagggccacagatt

SEQ ID NO: 7396819 - DNA, 22 bp, Homo sapiens
gcccccagaagggccacagatt

SEQ ID NO: 7396820 - DNA, 22 bp, Homo sapiens
gcccccagaagggccacagatt

SEQ ID NO: 7396821 - DNA, 22 bp, Homo sapiens
gcccccagaagggccacagatt

SEQ ID NO: 7396822 - DNA, 22 bp, Homo sapiens
gcccccagaagggccacagatt

SEQ ID NO: 7396823 - DNA, 22 bp, Homo sapiens
gcccccagaagggccacagatt

SEQ ID NO: 7396824 - DNA, 22 bp, Homo sapiens
gcccccaggcactacatgtgaa

SEQ ID NO: 7396825 - DNA, 22 bp, Homo sapiens
gcccccagctctcaagctcaaa

SEQ ID NO: 7396826 - DNA, 22 bp, Homo sapiens
gcccccaggctctggagaacct

SEQ ID NO: 7396827 - DNA, 22 bp, Homo sapiens
gcccccaggctctggagaacct

SEQ ID NO: 7396828 - DNA, 22 bp, Homo sapiens
gcccccaggctctggagaacct

SEQ ID NO: 7396829 - DNA, 22 bp, Homo sapiens
gcccccaggcactacatgtgaa

SEQ ID NO: 7396830 - DNA, 22 bp, Homo sapiens
gcccccagctctcaagctcaaa

SEQ ID NO: 7396831 - DNA, 22 bp, Homo sapiens
gcccccagctctcaagctcaaa

SEQ ID NO: 7396832 - DNA, 22 bp, Homo sapiens
gcccccagctctcaagctcaaa

SEQ ID NO: 7396833 - DNA, 22 bp, Homo sapiens
gcccccagctctcaagctcaaa

SEQ ID NO: 7396834 - DNA, 22 bp, Homo sapiens
gcccccaggctctggagaacct

SEQ ID NO: 7396835 - DNA, 22 bp, Homo sapiens
gcccccaggctctggagaacct

SEQ ID NO: 7396836 - DNA, 22 bp, Homo sapiens
gcccccaggtgacttatccaca

SEQ ID NO: 7396837 - DNA, 22 bp, Homo sapiens
gcccccaggtgacttatccaca

SEQ ID NO: 7396838 - DNA, 22 bp, Homo sapiens
gcccccgtagtagatgaggcgc

SEQ ID NO: 7396839 - DNA, 22 bp, Homo sapiens
gcccccgtagtagatgaggcgc

SEQ ID NO: 7396840 - DNA, 22 bp, Homo sapiens
gccccctcaaagaggaagctct

SEQ ID NO: 7396841 - DNA, 22 bp, Homo sapiens
gcccccgtagtagatgaggcgc

SEQ ID NO: 7396842 - DNA, 22 bp, Homo sapiens
atttggaagaaatctgtcacag

SEQ ID NO: 7396843 - DNA, 22 bp, Homo sapiens
atttggaagaaatctgtcacag

SEQ ID NO: 7396844 - DNA, 22 bp, Homo sapiens
gcctaggagacaagcgtgaaag

SEQ ID NO: 7396845 - DNA, 22 bp, Homo sapiens
atttggaagaaatctgtcacag

SEQ ID NO: 7396846 - DNA, 22 bp, Homo sapiens
atttggaagaaatctgtcacag

SEQ ID NO: 7396847 - DNA, 22 bp, Homo sapiens
atttggaagaaatctgtcacag

SEQ ID NO: 7396848 - DNA, 22 bp, Homo sapiens
atttggaagaaatctgtcacag

SEQ ID NO: 7396849 - DNA, 22 bp, Homo sapiens
atttggaagaaatctgtcacag

SEQ ID NO: 7396850 - DNA, 22 bp, Homo sapiens
gcctaggagtggggatggcggt

SEQ ID NO: 7396851 - DNA, 22 bp, Homo sapiens
gcctaggagtacagaatggttt

SEQ ID NO: 7396852 - DNA, 22 bp, Homo sapiens
gcctaggagtacagaatggttt

SEQ ID NO: 7396853 - DNA, 20 bp, Homo sapiens
gcctaggggttgggaaagca

SEQ ID NO: 7396854 - DNA, 20 bp, Homo sapiens
gcctaggggttgggaaagca

SEQ ID NO: 7396855 - DNA, 22 bp, Homo sapiens
gcctaggggtaagagtactggc

SEQ ID NO: 7396856 - DNA, 22 bp, Homo sapiens
gcctaggggtaagagtactggc

SEQ ID NO: 7396857 - DNA, 22 bp, Homo sapiens
gcctagggatgacaaatattct

SEQ ID NO: 7396858 - DNA, 21 bp, Homo sapiens
gcctagggagatgggactgcc

SEQ ID NO: 7396859 - DNA, 21 bp, Homo sapiens
gcctagggagatgggactgcc

SEQ ID NO: 7396860 - DNA, 21 bp, Homo sapiens
gcctagggagatgggactgcc

SEQ ID NO: 7396861 - DNA, 21 bp, Homo sapiens
gcctagggagatgggactgcc

SEQ ID NO: 7396862 - DNA, 22 bp, Homo sapiens
gcctaggatcaaccacatgaaa

SEQ ID NO: 7396863 - DNA, 22 bp, Homo sapiens
atttggaactgggcatgcaaac

SEQ ID NO: 7396864 - DNA, 22 bp, Homo sapiens
atttggaactgggcatgcaaac

SEQ ID NO: 7396865 - DNA, 22 bp, Homo sapiens
atttggaacttataataagttt

SEQ ID NO: 7396866 - DNA, 22 bp, Homo sapiens
atttggaactgggcatgcaaac

SEQ ID NO: 7396867 - DNA, 22 bp, Homo sapiens
atttggaacttataataagttt

SEQ ID NO: 7396868 - DNA, 22 bp, Homo sapiens
atttggaacttataataagttt

SEQ ID NO: 7396869 - DNA, 22 bp, Homo sapiens
atttggaacttataataagttt

SEQ ID NO: 7396870 - DNA, 22 bp, Homo sapiens
atttggaacttataataagttt

SEQ ID NO: 7396871 - DNA, 22 bp, Homo sapiens
atttggaacttataataagttt

SEQ ID NO: 7396872 - DNA, 22 bp, Homo sapiens
atttggaacttataataagttt

SEQ ID NO: 7396873 - DNA, 22 bp, Homo sapiens
atttggaacttataataagttt

SEQ ID NO: 7396874 - DNA, 22 bp, Homo sapiens
atttggaacttataataagttt

SEQ ID NO: 7396875 - DNA, 22 bp, Homo sapiens
atttggaacaaatattagtaaa

SEQ ID NO: 7396876 - DNA, 22 bp, Homo sapiens
atttggaacaaatattagtaaa

SEQ ID NO: 7396877 - DNA, 22 bp, Homo sapiens
atttggaacaaatattagtaaa

SEQ ID NO: 7396878 - DNA, 22 bp, Homo sapiens
atttggaacaaatattagtaaa

SEQ ID NO: 7396879 - DNA, 22 bp, Homo sapiens
atttggaactgggcatgcaaac

SEQ ID NO: 7396880 - DNA, 22 bp, Homo sapiens
atttggaactgggcatgcaaac

SEQ ID NO: 7396881 - DNA, 22 bp, Homo sapiens
atttggaacaaatattagtaaa

SEQ ID NO: 7396882 - DNA, 22 bp, Homo sapiens
atttggaaatgtaagaatgcaa

SEQ ID NO: 7396883 - DNA, 22 bp, Homo sapiens
atttggaaatgtaagaatgcaa

SEQ ID NO: 7396884 - DNA, 22 bp, Homo sapiens
atttggaaatgcatctcttgag

SEQ ID NO: 7396885 - DNA, 22 bp, Homo sapiens
atttggaaatgtaagaatgcaa

SEQ ID NO: 7396886 - DNA, 22 bp, Homo sapiens
atttggaaatgtaagaatgcaa

SEQ ID NO: 7396887 - DNA, 22 bp, Homo sapiens
atttggaacaaatattagtaaa

SEQ ID NO: 7396888 - DNA, 22 bp, Homo sapiens
atttggaacaaatattagtaaa

SEQ ID NO: 7396889 - DNA, 22 bp, Homo sapiens
gcctatatgttaataggaggga

SEQ ID NO: 7396890 - DNA, 19 bp, Homo sapiens
gcctatgtcttcaaatcat

SEQ ID NO: 7396891 - DNA, 19 bp, Homo sapiens
gcctatgtcttcaaatcat

SEQ ID NO: 7396892 - DNA, 22 bp, Homo sapiens
gcctatggattggagaaggagc

SEQ ID NO: 7396893 - DNA, 22 bp, Homo sapiens
gcctattaaagagcttggagca

SEQ ID NO: 7396894 - DNA, 22 bp, Homo sapiens
gcctattttattatgcatgtaa

SEQ ID NO: 7396895 - DNA, 22 bp, Homo sapiens
gcctattatcagagctagtgat

SEQ ID NO: 7396896 - DNA, 22 bp, Homo sapiens
gcctcaaaagtgttgtagaggg

SEQ ID NO: 7396897 - DNA, 22 bp, Homo sapiens
gcctcaaatgtggagcactatt

SEQ ID NO: 7396898 - DNA, 22 bp, Homo sapiens
gcctagggtgctcagggacgag

SEQ ID NO: 7396899 - DNA, 22 bp, Homo sapiens
gcctagggtgctcagggacgag

SEQ ID NO: 7396900 - DNA, 22 bp, Homo sapiens
gcctagggtgctcagggacgag

SEQ ID NO: 7396901 - DNA, 22 bp, Homo sapiens
gcctagggtgctcagggacgag

SEQ ID NO: 7396902 - DNA, 20 bp, Homo sapiens
gcctagggtcacttcagtga

SEQ ID NO: 7396903 - DNA, 20 bp, Homo sapiens
gcctagggtcacttcagtga

SEQ ID NO: 7396904 - DNA, 22 bp, Homo sapiens
gcctagggttggcctgagaatc

SEQ ID NO: 7396905 - DNA, 22 bp, Homo sapiens
gcctagggttggcctgagaatc

SEQ ID NO: 7396906 - DNA, 22 bp, Homo sapiens
gcctagggttggcctgagaatc

SEQ ID NO: 7396907 - DNA, 22 bp, Homo sapiens
gcctaggtaccagcagagagcc

SEQ ID NO: 7396908 - DNA, 22 bp, Homo sapiens
gcctaggtaccagcagagagcc

SEQ ID NO: 7396909 - DNA, 22 bp, Homo sapiens
gcctagtgcactggcagggctc

SEQ ID NO: 7396910 - DNA, 22 bp, Homo sapiens
gcctagggttggcctgagaatc

SEQ ID NO: 7396911 - DNA, 22 bp, Homo sapiens
gcctaggtaccagcagagagcc

SEQ ID NO: 7396912 - DNA, 19 bp, Homo sapiens
gcctcacaggtctcaggcc

SEQ ID NO: 7396913 - DNA, 22 bp, Homo sapiens
gcctcacagactgactgaaagc

SEQ ID NO: 7396914 - DNA, 22 bp, Homo sapiens
gcctcacatattcatggttact

SEQ ID NO: 7396915 - DNA, 19 bp, Homo sapiens
gcctctgagggcaggacac

SEQ ID NO: 7396916 - DNA, 22 bp, Homo sapiens
gcctcttgtttccttacatgga

SEQ ID NO: 7396917 - DNA, 22 bp, Homo sapiens
gcctgaagaacagctgtgagga

SEQ ID NO: 7396918 - DNA, 22 bp, Homo sapiens
gcctgaagaacagctgtgagga

SEQ ID NO: 7396919 - DNA, 22 bp, Homo sapiens
gcctctgagtttggagaagagc

SEQ ID NO: 7396920 - DNA, 22 bp, Homo sapiens
gcctcttgcaaagcggttagcc

SEQ ID NO: 7396921 - DNA, 22 bp, Homo sapiens
gcctctgcaactccgccttggt

SEQ ID NO: 7396922 - DNA, 22 bp, Homo sapiens
attttacttagtgtaatgtcca

SEQ ID NO: 7396923 - DNA, 22 bp, Homo sapiens
attttacttagtgtaatgtcca

SEQ ID NO: 7396924 - DNA, 22 bp, Homo sapiens
attttactactccaattaatga

SEQ ID NO: 7396925 - DNA, 22 bp, Homo sapiens
attttacttagtgtaatgtcca

SEQ ID NO: 7396926 - DNA, 22 bp, Homo sapiens
attttactactccaattaatga

SEQ ID NO: 7396927 - DNA, 22 bp, Homo sapiens
attttactactccaattaatga

SEQ ID NO: 7396928 - DNA, 22 bp, Homo sapiens
attttactactccaattaatga

SEQ ID NO: 7396929 - DNA, 22 bp, Homo sapiens
gcctggcaccacagcctttcag

SEQ ID NO: 7396930 - DNA, 22 bp, Homo sapiens
gcctggcaccacagcctttcag

SEQ ID NO: 7396931 - DNA, 22 bp, Homo sapiens
attttactactccaattaatga

SEQ ID NO: 7396932 - DNA, 22 bp, Homo sapiens
gcctggcacattgcagtggatt

SEQ ID NO: 7396933 - DNA, 22 bp, Homo sapiens
gcctggcacattgcagtggatt

SEQ ID NO: 7396934 - DNA, 22 bp, Homo sapiens
gcctggcacattgcagtggatt

SEQ ID NO: 7396935 - DNA, 22 bp, Homo sapiens
gcctggcaaggccctgttgact

SEQ ID NO: 7396936 - DNA, 22 bp, Homo sapiens
gcctggcaaggccctgttgact

SEQ ID NO: 7396937 - DNA, 23 bp, Homo sapiens
gcctggcaaagcactaccgagag

SEQ ID NO: 7396938 - DNA, 23 bp, Homo sapiens
gcctggcaaagcactaccgagag

SEQ ID NO: 7396939 - DNA, 22 bp, Homo sapiens
gcctggcaatggcctcaggaag

SEQ ID NO: 7396940 - DNA, 22 bp, Homo sapiens
gcctggcaatggcctcaggaag

SEQ ID NO: 7396941 - DNA, 22 bp, Homo sapiens
gcctggcaatggcctcaggaag

SEQ ID NO: 7396942 - DNA, 22 bp, Homo sapiens
gcctggcaatggcctcaggaag

SEQ ID NO: 7396943 - DNA, 22 bp, Homo sapiens
gcctggcaaggccctgttgact

SEQ ID NO: 7396944 - DNA, 22 bp, Homo sapiens
gcctggcacagtagggacccaa

SEQ ID NO: 7396945 - DNA, 22 bp, Homo sapiens
gcctggcacagtagggacccaa

SEQ ID NO: 7396946 - DNA, 22 bp, Homo sapiens
gcctggcacagtagggacccaa

SEQ ID NO: 7396947 - DNA, 22 bp, Homo sapiens
gcctggcacaggaattaggagg

SEQ ID NO: 7396948 - DNA, 22 bp, Homo sapiens
gcctggcacaggaattaggagg

SEQ ID NO: 7396949 - DNA, 22 bp, Homo sapiens
gcctggcaatggcctcaggaag

SEQ ID NO: 7396950 - DNA, 22 bp, Homo sapiens
gcctggcaatggcctcaggaag

SEQ ID NO: 7396951 - DNA, 22 bp, Homo sapiens
gcctggcaatggcctcaggaag

SEQ ID NO: 7396952 - DNA, 22 bp, Homo sapiens
gcctggattacaaacagccaac

SEQ ID NO: 7396953 - DNA, 22 bp, Homo sapiens
gcctggattccttgtttctcag

SEQ ID NO: 7396954 - DNA, 23 bp, Homo sapiens
gcctggattaaggcagtgacttc

SEQ ID NO: 7396955 - DNA, 22 bp, Homo sapiens
gcctggattccttgtttctcag

SEQ ID NO: 7396956 - DNA, 22 bp, Homo sapiens
gcctggattccttgtttctcag

SEQ ID NO: 7396957 - DNA, 21 bp, Homo sapiens
gcctggcaaaaaccggccctg

SEQ ID NO: 7396958 - DNA, 21 bp, Homo sapiens
gcctggcaaaaaccggccctg

SEQ ID NO: 7396959 - DNA, 21 bp, Homo sapiens
gcctggcaaaaaccggccctg

SEQ ID NO: 7396960 - DNA, 22 bp, Homo sapiens
gcctggattccttgtttctcag

SEQ ID NO: 7396961 - DNA, 22 bp, Homo sapiens
gcctggagttgtggtgaagcca

SEQ ID NO: 7396962 - DNA, 22 bp, Homo sapiens
gcctggagttgtggtgaagcca

SEQ ID NO: 7396963 - DNA, 22 bp, Homo sapiens
gcctggatcccagggagtcagg

SEQ ID NO: 7396964 - DNA, 22 bp, Homo sapiens
gcctggagttgtggtgaagcca

SEQ ID NO: 7396965 - DNA, 22 bp, Homo sapiens
atttggaatgctagtgaatgta

SEQ ID NO: 7396966 - DNA, 22 bp, Homo sapiens
atttggaatgctagtgaatgta

SEQ ID NO: 7396967 - DNA, 22 bp, Homo sapiens
atttggaatgggagcctggcat

SEQ ID NO: 7396968 - DNA, 22 bp, Homo sapiens
atttggaatgggagcctggcat

SEQ ID NO: 7396969 - DNA, 22 bp, Homo sapiens
atttggaatgggagcctggcat

SEQ ID NO: 7396970 - DNA, 22 bp, Homo sapiens
atttggaatgctagtgaatgta

SEQ ID NO: 7396971 - DNA, 22 bp, Homo sapiens
atttggaatgctagtgaatgta

SEQ ID NO: 7396972 - DNA, 22 bp, Homo sapiens
atttggaatgctagtgaatgta

SEQ ID NO: 7396973 - DNA, 22 bp, Homo sapiens
atttggaatgggagcctggcat

SEQ ID NO: 7396974 - DNA, 22 bp, Homo sapiens
atttggaatggtctggcatttg

SEQ ID NO: 7396975 - DNA, 22 bp, Homo sapiens
atttggaatggtctggcatttg

SEQ ID NO: 7396976 - DNA, 22 bp, Homo sapiens
atttggaatggtctggcatttg

SEQ ID NO: 7396977 - DNA, 22 bp, Homo sapiens
atttggaatggtctggcatttg

SEQ ID NO: 7396978 - DNA, 22 bp, Homo sapiens
atttggaatgtgtttgatcacc

SEQ ID NO: 7396979 - DNA, 22 bp, Homo sapiens
atttggaatggtctggcatttg

SEQ ID NO: 7396980 - DNA, 22 bp, Homo sapiens
atttggaatgtgtttgatcacc

SEQ ID NO: 7396981 - DNA, 22 bp, Homo sapiens
atttggaatgtgtttgatcacc

SEQ ID NO: 7396982 - DNA, 22 bp, Homo sapiens
atttggaatgtgtttgatcacc

SEQ ID NO: 7396983 - DNA, 22 bp, Homo sapiens
atttggaatggtctggcatttg

SEQ ID NO: 7396984 - DNA, 22 bp, Homo sapiens
gcctggagttgaaactattatt

SEQ ID NO: 7396985 - DNA, 22 bp, Homo sapiens
gcctggagttgaaactattatt

SEQ ID NO: 7396986 - DNA, 20 bp, Homo sapiens
gcctggaggcaatgggaaga

SEQ ID NO: 7396987 - DNA, 22 bp, Homo sapiens
gcctggaggaatgtagctgagg

SEQ ID NO: 7396988 - DNA, 22 bp, Homo sapiens
gcctggaggaatgtagctgagg

SEQ ID NO: 7396989 - DNA, 22 bp, Homo sapiens
gcctggaggaatgtagctgagg

SEQ ID NO: 7396990 - DNA, 22 bp, Homo sapiens
gcctgagaaggacacagcaggt

SEQ ID NO: 7396991 - DNA, 22 bp, Homo sapiens
gcctgagaaggacacagcaggt

SEQ ID NO: 7396992 - DNA, 22 bp, Homo sapiens
gcctgagaaggacacagcaggt

SEQ ID NO: 7396993 - DNA, 22 bp, Homo sapiens
gcctgagaaggacacagcaggt

SEQ ID NO: 7396994 - DNA, 22 bp, Homo sapiens
gcctgagaaggacacagcaggt

SEQ ID NO: 7396995 - DNA, 22 bp, Homo sapiens
gcctgagaaggacacagcaggt

SEQ ID NO: 7396996 - DNA, 22 bp, Homo sapiens
gcctgacttgtgtattttacat

SEQ ID NO: 7396997 - DNA, 22 bp, Homo sapiens
gcctgagaaggataggaagcga

SEQ ID NO: 7396998 - DNA, 22 bp, Homo sapiens
gcctgagaaggataggaagcga

SEQ ID NO: 7396999 - DNA, 22 bp, Homo sapiens
gcctgacctcttctgccctggg

SEQ ID NO: 7397000 - DNA, 21 bp, Homo sapiens
gcctgaccttactactggggt

SEQ ID NO: 7397001 - DNA, 22 bp, Homo sapiens
gcctgacctcttctgccctggg

SEQ ID NO: 7397002 - DNA, 22 bp, Homo sapiens
gcctgacctcttctgccctggg

SEQ ID NO: 7397003 - DNA, 22 bp, Homo sapiens
gcctgaagctggaataattgta

SEQ ID NO: 7397004 - DNA, 22 bp, Homo sapiens
gcctgaagctggaataattgta

SEQ ID NO: 7397005 - DNA, 22 bp, Homo sapiens
gcctgaaggagtcagagagggc

SEQ ID NO: 7397006 - DNA, 22 bp, Homo sapiens
gcctgaagtttcatgcctctat

SEQ ID NO: 7397007 - DNA, 22 bp, Homo sapiens
gcctgaaggagtcagagagggc

SEQ ID NO: 7397008 - DNA, 22 bp, Homo sapiens
gcctgaagtttcatgcctctat

SEQ ID NO: 7397009 - DNA, 22 bp, Homo sapiens
gcctgagagtctccagaccttg

SEQ ID NO: 7397010 - DNA, 22 bp, Homo sapiens
gcctgagagtctccagaccttg

SEQ ID NO: 7397011 - DNA, 22 bp, Homo sapiens
gcctgagagacccatggggcaa

SEQ ID NO: 7397012 - DNA, 22 bp, Homo sapiens
gcctgagagacccatggggcaa

SEQ ID NO: 7397013 - DNA, 22 bp, Homo sapiens
gcctgagagaactgaccaagag

SEQ ID NO: 7397014 - DNA, 22 bp, Homo sapiens
gcctgagagaactgaccaagag

SEQ ID NO: 7397015 - DNA, 22 bp, Homo sapiens
gcctgagagaactgaccaagag

SEQ ID NO: 7397016 - DNA, 22 bp, Homo sapiens
gcctgagagaactgaccaagag

SEQ ID NO: 7397017 - DNA, 22 bp, Homo sapiens
gcctgagacagtgtggtccaat

SEQ ID NO: 7397018 - DNA, 22 bp, Homo sapiens
gcctgagacagtgtggtccaat

SEQ ID NO: 7397019 - DNA, 22 bp, Homo sapiens
gcctgagagttgaagttcagtg

SEQ ID NO: 7397020 - DNA, 22 bp, Homo sapiens
gcctgagagttgaagttcagtg

SEQ ID NO: 7397021 - DNA, 22 bp, Homo sapiens
gcctgagatcaggagaaagcca

SEQ ID NO: 7397022 - DNA, 22 bp, Homo sapiens
atttggaagtttggagtgaagg

SEQ ID NO: 7397023 - DNA, 22 bp, Homo sapiens
atttggaagtttggagtgaagg

SEQ ID NO: 7397024 - DNA, 22 bp, Homo sapiens
atttggaagtttggagtgaagg

SEQ ID NO: 7397025 - DNA, 22 bp, Homo sapiens
atttggaagtttggagtgaagg

SEQ ID NO: 7397026 - DNA, 22 bp, Homo sapiens
atttggaagtttggagtgaagg

SEQ ID NO: 7397027 - DNA, 22 bp, Homo sapiens
atttggaagtttttgtgggaat

SEQ ID NO: 7397028 - DNA, 22 bp, Homo sapiens
atttggaagtttggagtgaagg

SEQ ID NO: 7397029 - DNA, 22 bp, Homo sapiens
atttggaatagctgtagaaata

SEQ ID NO: 7397030 - DNA, 22 bp, Homo sapiens
atttggaatagctgtagaaata

SEQ ID NO: 7397031 - DNA, 22 bp, Homo sapiens
atttggaatagctgtagaaata

SEQ ID NO: 7397032 - DNA, 22 bp, Homo sapiens
atttggaagtttttgtgggaat

SEQ ID NO: 7397033 - DNA, 22 bp, Homo sapiens
atttggaagtttttgtgggaat

SEQ ID NO: 7397034 - DNA, 22 bp, Homo sapiens
atttggaagtttttgtgggaat

SEQ ID NO: 7397035 - DNA, 22 bp, Homo sapiens
atttggaatagctgtagaaata

SEQ ID NO: 7397036 - DNA, 22 bp, Homo sapiens
atttggaatagctgtagaaata

SEQ ID NO: 7397037 - DNA, 22 bp, Homo sapiens
atttggaatagctgtagaaata

SEQ ID NO: 7397038 - DNA, 22 bp, Homo sapiens
atttggaaggtttacaaagaga

SEQ ID NO: 7397039 - DNA, 22 bp, Homo sapiens
atttggaaggtttacaaagaga

SEQ ID NO: 7397040 - DNA, 22 bp, Homo sapiens
atttggaaggtttacaaagaga

SEQ ID NO: 7397041 - DNA, 22 bp, Homo sapiens
atttggaaggcgtttctctgta

SEQ ID NO: 7397042 - DNA, 22 bp, Homo sapiens
atttggaaggcgtttctctgta

SEQ ID NO: 7397043 - DNA, 22 bp, Homo sapiens
atttggaaggcgtttctctgta

SEQ ID NO: 7397044 - DNA, 22 bp, Homo sapiens
atttggaaggcgtttctctgta

SEQ ID NO: 7397045 - DNA, 22 bp, Homo sapiens
atttggaaggtttacaaagaga

SEQ ID NO: 7397046 - DNA, 22 bp, Homo sapiens
atttggaaggtttacaaagaga

SEQ ID NO: 7397047 - DNA, 22 bp, Homo sapiens
atttggaaggtttacaaagaga

SEQ ID NO: 7397048 - DNA, 22 bp, Homo sapiens
atttggaaggtttacaaagaga

SEQ ID NO: 7397049 - DNA, 22 bp, Homo sapiens
atttggaaggcgtttctctgta

SEQ ID NO: 7397050 - DNA, 22 bp, Homo sapiens
atttggaagcttgaagattatt

SEQ ID NO: 7397051 - DNA, 22 bp, Homo sapiens
atttggaagcttgaagattatt

SEQ ID NO: 7397052 - DNA, 22 bp, Homo sapiens
atttggaagcttgaagattatt

SEQ ID NO: 7397053 - DNA, 22 bp, Homo sapiens
atttggaagcttgaagattatt

SEQ ID NO: 7397054 - DNA, 22 bp, Homo sapiens
atttggaagcttgaagattatt

SEQ ID NO: 7397055 - DNA, 22 bp, Homo sapiens
atttggaagcttgaagattatt

SEQ ID NO: 7397056 - DNA, 22 bp, Homo sapiens
atttggaaggagctgcacagca

SEQ ID NO: 7397057 - DNA, 22 bp, Homo sapiens
atttggaaggagctgcacagca

SEQ ID NO: 7397058 - DNA, 22 bp, Homo sapiens
atttggaaggagctgcacagca

SEQ ID NO: 7397059 - DNA, 22 bp, Homo sapiens
atttggaaggagctgcacagca

SEQ ID NO: 7397060 - DNA, 22 bp, Homo sapiens
atttggaaggcgtttctctgta

SEQ ID NO: 7397061 - DNA, 22 bp, Homo sapiens
atttggaaggagctgcacagca

SEQ ID NO: 7397062 - DNA, 22 bp, Homo sapiens
atttggaaggagctgcacagca

SEQ ID NO: 7397063 - DNA, 22 bp, Homo sapiens
atttggaaggagctgcacagca

SEQ ID NO: 7397064 - DNA, 22 bp, Homo sapiens
atttggaagcatttccaaagca

SEQ ID NO: 7397065 - DNA, 22 bp, Homo sapiens
atttggaagcatttccaaagca

SEQ ID NO: 7397066 - DNA, 22 bp, Homo sapiens
atttggaagcatttccaaagca

SEQ ID NO: 7397067 - DNA, 22 bp, Homo sapiens
atttggaagcatttccaaagca

SEQ ID NO: 7397068 - DNA, 22 bp, Homo sapiens
atttggaagcatttccaaagca

SEQ ID NO: 7397069 - DNA, 22 bp, Homo sapiens
atttggaagcatttccaaagca

SEQ ID NO: 7397070 - DNA, 22 bp, Homo sapiens
gcctgagattcccggagccgtg

SEQ ID NO: 7397071 - DNA, 22 bp, Homo sapiens
gcctgagattcccggagccgtg

SEQ ID NO: 7397072 - DNA, 22 bp, Homo sapiens
gccaggctggtcttgaactcct

SEQ ID NO: 7397073 - DNA, 22 bp, Homo sapiens
gccaggctggggggagatgtct

SEQ ID NO: 7397074 - DNA, 22 bp, Homo sapiens
gccaggctggggggagatgtct

SEQ ID NO: 7397075 - DNA, 22 bp, Homo sapiens
gccaggctggggggagatgtct

SEQ ID NO: 7397076 - DNA, 22 bp, Homo sapiens
gccaggctggggggagatgtct

SEQ ID NO: 7397077 - DNA, 22 bp, Homo sapiens
gccaggctggccagcaccttct

SEQ ID NO: 7397078 - DNA, 22 bp, Homo sapiens
gccaggctggccagcaccttct

SEQ ID NO: 7397079 - DNA, 22 bp, Homo sapiens
gccaggctggggggagatgtct

SEQ ID NO: 7397080 - DNA, 22 bp, Homo sapiens
gccaggctggggggagatgtct

SEQ ID NO: 7397081 - DNA, 22 bp, Homo sapiens
gccaggctggtcttgaactcct

SEQ ID NO: 7397082 - DNA, 22 bp, Homo sapiens
gccaggctggtgcaaggatatt

SEQ ID NO: 7397083 - DNA, 22 bp, Homo sapiens
gccaggctggtcttgaactcct

SEQ ID NO: 7397084 - DNA, 22 bp, Homo sapiens
gccaggctggtgcaaggatatt

SEQ ID NO: 7397085 - DNA, 22 bp, Homo sapiens
gccaggctggtcttgaactcct

SEQ ID NO: 7397086 - DNA, 22 bp, Homo sapiens
gccaggctggtcttgaactcct

SEQ ID NO: 7397087 - DNA, 22 bp, Homo sapiens
gccaggctggtcttgaactcct

SEQ ID NO: 7397088 - DNA, 22 bp, Homo sapiens
gccaggctggtcttgaactcct

SEQ ID NO: 7397089 - DNA, 22 bp, Homo sapiens
gccaggctgctggctgctgtcc

SEQ ID NO: 7397090 - DNA, 22 bp, Homo sapiens
gccaggctggaaagaacagaca

SEQ ID NO: 7397091 - DNA, 22 bp, Homo sapiens
gccaggctggaaagaacagaca

SEQ ID NO: 7397092 - DNA, 22 bp, Homo sapiens
gccaggctggaaagaacagaca

SEQ ID NO: 7397093 - DNA, 22 bp, Homo sapiens
gccaggctggaaagaacagaca

SEQ ID NO: 7397094 - DNA, 22 bp, Homo sapiens
gccaggctggaaagaacagaca

SEQ ID NO: 7397095 - DNA, 22 bp, Homo sapiens
gccaggctggaaagaacagaca

SEQ ID NO: 7397096 - DNA, 22 bp, Homo sapiens
gccaggctggaaagaacagaca

SEQ ID NO: 7397097 - DNA, 22 bp, Homo sapiens
gccaggctggcaaaaggaaacc

SEQ ID NO: 7397098 - DNA, 22 bp, Homo sapiens
gccaggctggcaaaaggaaacc

SEQ ID NO: 7397099 - DNA, 22 bp, Homo sapiens
gccaggctggccagcaccttct

SEQ ID NO: 7397100 - DNA, 22 bp, Homo sapiens
gccaggctggccagcaccttct

SEQ ID NO: 7397101 - DNA, 22 bp, Homo sapiens
gccaggctggccagcaccttct

SEQ ID NO: 7397102 - DNA, 22 bp, Homo sapiens
gccaggctggccagcaccttct

SEQ ID NO: 7397103 - DNA, 22 bp, Homo sapiens
gccaggctggcaaaaggaaacc

SEQ ID NO: 7397104 - DNA, 22 bp, Homo sapiens
gccaggctggcaaaaggaaacc

SEQ ID NO: 7397105 - DNA, 22 bp, Homo sapiens
gccaggctggcaaaaggaaacc

SEQ ID NO: 7397106 - DNA, 22 bp, Homo sapiens
gccaggctggcaaaaggaaacc

SEQ ID NO: 7397107 - DNA, 22 bp, Homo sapiens
gccacaggtaggaacctacctc

SEQ ID NO: 7397108 - DNA, 22 bp, Homo sapiens
gccacaggtaggaacctacctc

SEQ ID NO: 7397109 - DNA, 22 bp, Homo sapiens
gccacaggtaggaacctacctc

SEQ ID NO: 7397110 - DNA, 22 bp, Homo sapiens
gccacaggtactatgggagaga

SEQ ID NO: 7397111 - DNA, 22 bp, Homo sapiens
gccacaggtactatgggagaga

SEQ ID NO: 7397112 - DNA, 22 bp, Homo sapiens
gccacaggtcggctagagggtc

SEQ ID NO: 7397113 - DNA, 22 bp, Homo sapiens
gccacaggtcggctagagggtc

SEQ ID NO: 7397114 - DNA, 22 bp, Homo sapiens
gccacaggtcggctagagggtc

SEQ ID NO: 7397115 - DNA, 22 bp, Homo sapiens
gccacaggtaggaacctacctc

SEQ ID NO: 7397116 - DNA, 22 bp, Homo sapiens
gccacaggtcggctagagggtc

SEQ ID NO: 7397117 - DNA, 22 bp, Homo sapiens
gccacaggtactatgggagaga

SEQ ID NO: 7397118 - DNA, 22 bp, Homo sapiens
gccacagggcgagcggaggcca

SEQ ID NO: 7397119 - DNA, 22 bp, Homo sapiens
gccacagggcgagcggaggcca

SEQ ID NO: 7397120 - DNA, 22 bp, Homo sapiens
gccacagggcgagcggaggcca

SEQ ID NO: 7397121 - DNA, 22 bp, Homo sapiens
gccacaggtactatgggagaga

SEQ ID NO: 7397122 - DNA, 22 bp, Homo sapiens
gccacaggtactatgggagaga

SEQ ID NO: 7397123 - DNA, 22 bp, Homo sapiens
gccacaggtactatgggagaga

SEQ ID NO: 7397124 - DNA, 22 bp, Homo sapiens
gccacaggtactatgggagaga

SEQ ID NO: 7397125 - DNA, 22 bp, Homo sapiens
gccacaggtactatgggagaga

SEQ ID NO: 7397126 - DNA, 22 bp, Homo sapiens
gccacaggtactatgggagaga

SEQ ID NO: 7397127 - DNA, 22 bp, Homo sapiens
gccacaggtactatgggagaga

SEQ ID NO: 7397128 - DNA, 22 bp, Homo sapiens
gccacaggtggaattaagaaat

SEQ ID NO: 7397129 - DNA, 22 bp, Homo sapiens
gccacaggtggaattaagaaat

SEQ ID NO: 7397130 - DNA, 22 bp, Homo sapiens
gccacaggtcggctagagggtc

SEQ ID NO: 7397131 - DNA, 22 bp, Homo sapiens
gccacaggtggaattaagaaat

SEQ ID NO: 7397132 - DNA, 22 bp, Homo sapiens
gccacaggtgggctctgggaaa

SEQ ID NO: 7397133 - DNA, 22 bp, Homo sapiens
gccacaggtgggctctgggaaa

SEQ ID NO: 7397134 - DNA, 22 bp, Homo sapiens
gccacagtcactgctgcagggg

SEQ ID NO: 7397135 - DNA, 22 bp, Homo sapiens
gccacagtcactgctgcagggg

SEQ ID NO: 7397136 - DNA, 22 bp, Homo sapiens
gccacagtcactgctgcagggg

SEQ ID NO: 7397137 - DNA, 22 bp, Homo sapiens
gccacaggtgggctctgggaaa

SEQ ID NO: 7397138 - DNA, 22 bp, Homo sapiens
gccacaggtgggctctgggaaa

SEQ ID NO: 7397139 - DNA, 19 bp, Homo sapiens
gccaggcctggacctgcag

SEQ ID NO: 7397140 - DNA, 19 bp, Homo sapiens
gccaggcctggacctgcag

SEQ ID NO: 7397141 - DNA, 19 bp, Homo sapiens
gccaggcctggacctgcag

SEQ ID NO: 7397142 - DNA, 22 bp, Homo sapiens
gccaggctgctggctgctgtcc

SEQ ID NO: 7397143 - DNA, 22 bp, Homo sapiens
gccacaggtgggctctgggaaa

SEQ ID NO: 7397144 - DNA, 22 bp, Homo sapiens
gccaggcgggtctcaaactcct

SEQ ID NO: 7397145 - DNA, 22 bp, Homo sapiens
atttcatgttgatctttcgagg

SEQ ID NO: 7397146 - DNA, 22 bp, Homo sapiens
atttcatgtttcatctacctaa

SEQ ID NO: 7397147 - DNA, 22 bp, Homo sapiens
atttcatgttgatctttcgagg

SEQ ID NO: 7397148 - DNA, 22 bp, Homo sapiens
atttccaggagaaaggatttta

SEQ ID NO: 7397149 - DNA, 22 bp, Homo sapiens
atttccaggagaaaggatttta

SEQ ID NO: 7397150 - DNA, 22 bp, Homo sapiens
gccaggtggaggttgcagtgag

SEQ ID NO: 7397151 - DNA, 22 bp, Homo sapiens
gccaggtggaggttgcagtgag

SEQ ID NO: 7397152 - DNA, 22 bp, Homo sapiens
gccaggtggctgagcagctgca

SEQ ID NO: 7397153 - DNA, 22 bp, Homo sapiens
atttcatgttaactgaacagaa

SEQ ID NO: 7397154 - DNA, 22 bp, Homo sapiens
atttcatgttaactgaacagaa

SEQ ID NO: 7397155 - DNA, 22 bp, Homo sapiens
atttcatgttaactgaacagaa

SEQ ID NO: 7397156 - DNA, 22 bp, Homo sapiens
gccaggtggctgagcagctgca

SEQ ID NO: 7397157 - DNA, 22 bp, Homo sapiens
gccaggtggaggttgcagtgag

SEQ ID NO: 7397158 - DNA, 22 bp, Homo sapiens
gccaggtggaggttgcagtgag

SEQ ID NO: 7397159 - DNA, 22 bp, Homo sapiens
gccaggtggaggttgcagtgag

SEQ ID NO: 7397160 - DNA, 22 bp, Homo sapiens
gccaggtggaggttgcagtgag

SEQ ID NO: 7397161 - DNA, 22 bp, Homo sapiens
gccaggtggaggttgcagtgag

SEQ ID NO: 7397162 - DNA, 22 bp, Homo sapiens
atttccagtacccagaacagag

SEQ ID NO: 7397163 - DNA, 22 bp, Homo sapiens
atttccagtacccagaacagag

SEQ ID NO: 7397164 - DNA, 22 bp, Homo sapiens
atttccaggtaacctgttgagt

SEQ ID NO: 7397165 - DNA, 22 bp, Homo sapiens
atttccaggctgttttgtgaat

SEQ ID NO: 7397166 - DNA, 22 bp, Homo sapiens
atttccagtacccagaacagag

SEQ ID NO: 7397167 - DNA, 22 bp, Homo sapiens
atttccaggctgttttgtgaat

SEQ ID NO: 7397168 - DNA, 22 bp, Homo sapiens
atttccaggagttgaggtctga

SEQ ID NO: 7397169 - DNA, 22 bp, Homo sapiens
atttccagtgcactgaatagaa

SEQ ID NO: 7397170 - DNA, 22 bp, Homo sapiens
atttccagtgactctcacaggt

SEQ ID NO: 7397171 - DNA, 22 bp, Homo sapiens
atttccagtgcactgaatagaa

SEQ ID NO: 7397172 - DNA, 22 bp, Homo sapiens
atttccagtgactctcacaggt

SEQ ID NO: 7397173 - DNA, 22 bp, Homo sapiens
atttccagtcctaatgatctgg

SEQ ID NO: 7397174 - DNA, 22 bp, Homo sapiens
atttccagtactattttctgct

SEQ ID NO: 7397175 - DNA, 22 bp, Homo sapiens
atttccagtatgcaaatgcctc

SEQ ID NO: 7397176 - DNA, 22 bp, Homo sapiens
gccaggtgagtgcgcgccgtcc

SEQ ID NO: 7397177 - DNA, 22 bp, Homo sapiens
gccaggtgagtgcgcgccgtcc

SEQ ID NO: 7397178 - DNA, 22 bp, Homo sapiens
gccaggtgatttcaaagtcctt

SEQ ID NO: 7397179 - DNA, 22 bp, Homo sapiens
gccaggtgatttcaaagtcctt

SEQ ID NO: 7397180 - DNA, 22 bp, Homo sapiens
gccaggtgcacctgccctggcc

SEQ ID NO: 7397181 - DNA, 22 bp, Homo sapiens
gccaggtgcacctgccctggcc

SEQ ID NO: 7397182 - DNA, 22 bp, Homo sapiens
gccaggtgcacctgccctggcc

SEQ ID NO: 7397183 - DNA, 22 bp, Homo sapiens
gccaggtgagaggactgaggct

SEQ ID NO: 7397184 - DNA, 22 bp, Homo sapiens
gccaggtgagaggactgaggct

SEQ ID NO: 7397185 - DNA, 22 bp, Homo sapiens
gccaggtgagaggactgaggct

SEQ ID NO: 7397186 - DNA, 22 bp, Homo sapiens
gccaggctggtgcaaggatatt

SEQ ID NO: 7397187 - DNA, 22 bp, Homo sapiens
gccaggctggtgcaaggatatt

SEQ ID NO: 7397188 - DNA, 22 bp, Homo sapiens
gccaggctggtgcaaggatatt

SEQ ID NO: 7397189 - DNA, 22 bp, Homo sapiens
gccaggtctgggtagcagagga

SEQ ID NO: 7397190 - DNA, 19 bp, Homo sapiens
gccaggtcttgggtccagg

SEQ ID NO: 7397191 - DNA, 19 bp, Homo sapiens
gccaggtcttgggtccagg

SEQ ID NO: 7397192 - DNA, 22 bp, Homo sapiens
gccaggtgagaggactgaggct

SEQ ID NO: 7397193 - DNA, 22 bp, Homo sapiens
gccaggtgagaggactgaggct

SEQ ID NO: 7397194 - DNA, 22 bp, Homo sapiens
gccaggtgcatggctgagtctc

SEQ ID NO: 7397195 - DNA, 22 bp, Homo sapiens
gccaggtgctatccctgcgctg

SEQ ID NO: 7397196 - DNA, 22 bp, Homo sapiens
gccaggtgctatccctgcgctg

SEQ ID NO: 7397197 - DNA, 22 bp, Homo sapiens
gccaggtgctatccctgcgctg

SEQ ID NO: 7397198 - DNA, 22 bp, Homo sapiens
gccaggtgctatccctgcgctg

SEQ ID NO: 7397199 - DNA, 22 bp, Homo sapiens
gccaggtgctatccctgcgctg

SEQ ID NO: 7397200 - DNA, 22 bp, Homo sapiens
gccaggtggaggttgcagtgag

SEQ ID NO: 7397201 - DNA, 22 bp, Homo sapiens
gccaggtggaggttgcagtgag

SEQ ID NO: 7397202 - DNA, 22 bp, Homo sapiens
gccaggtggaggttgcagtgag

SEQ ID NO: 7397203 - DNA, 22 bp, Homo sapiens
gccaggtgcatattagaagcat

SEQ ID NO: 7397204 - DNA, 22 bp, Homo sapiens
gccaggtgcatattagaagcat

SEQ ID NO: 7397205 - DNA, 22 bp, Homo sapiens
gccaggtgcatggctgagtctc

SEQ ID NO: 7397206 - DNA, 22 bp, Homo sapiens
gccaggtgcatattagaagcat

SEQ ID NO: 7397207 - DNA, 22 bp, Homo sapiens
gccaggtgcatattagaagcat

SEQ ID NO: 7397208 - DNA, 22 bp, Homo sapiens
gccaggtgcatattagaagcat

SEQ ID NO: 7397209 - DNA, 22 bp, Homo sapiens
gccaggtgcatggctgagtctc

SEQ ID NO: 7397210 - DNA, 22 bp, Homo sapiens
gccaggtgcatggctgagtctc

SEQ ID NO: 7397211 - DNA, 22 bp, Homo sapiens
gccaggtgcatggctgagtctc

SEQ ID NO: 7397212 - DNA, 22 bp, Homo sapiens
gccaggtgcatggctgagtctc

SEQ ID NO: 7397213 - DNA, 22 bp, Homo sapiens
gcccacagtctatcagtttgcg

SEQ ID NO: 7397214 - DNA, 22 bp, Homo sapiens
gcccacagtctatcagtttgcg

SEQ ID NO: 7397215 - DNA, 21 bp, Homo sapiens
gcccacagtgaggaggatccc

SEQ ID NO: 7397216 - DNA, 22 bp, Homo sapiens
gcccacagtacgaggctcaggc

SEQ ID NO: 7397217 - DNA, 21 bp, Homo sapiens
gcccacagtgaggaggatccc

SEQ ID NO: 7397218 - DNA, 21 bp, Homo sapiens
gcccacagtgaggaggatccc

SEQ ID NO: 7397219 - DNA, 21 bp, Homo sapiens
gcccacagtgaggaggatccc

SEQ ID NO: 7397220 - DNA, 21 bp, Homo sapiens
gcccacagtgaggaggatccc

SEQ ID NO: 7397221 - DNA, 21 bp, Homo sapiens
gcccacagtgaggaggatccc

SEQ ID NO: 7397222 - DNA, 22 bp, Homo sapiens
gcccacagtgtagcaggtactc

SEQ ID NO: 7397223 - DNA, 22 bp, Homo sapiens
gcccacagtgtagcaggtactc

SEQ ID NO: 7397224 - DNA, 22 bp, Homo sapiens
gcccacagtgtagcaggtactc

SEQ ID NO: 7397225 - DNA, 22 bp, Homo sapiens
gcccacagtgtagcaggtactc

SEQ ID NO: 7397226 - DNA, 22 bp, Homo sapiens
gcccacagtgtagcaggtactc

SEQ ID NO: 7397227 - DNA, 22 bp, Homo sapiens
gcccacagtgtagcaggtactc

SEQ ID NO: 7397228 - DNA, 22 bp, Homo sapiens
gcccacagtgtagcaggtactc

SEQ ID NO: 7397229 - DNA, 22 bp, Homo sapiens
gcccacagttaatgggggctct

SEQ ID NO: 7397230 - DNA, 22 bp, Homo sapiens
gcccacagttaatgggggctct

SEQ ID NO: 7397231 - DNA, 22 bp, Homo sapiens
gcccacagttaatgggggctct

SEQ ID NO: 7397232 - DNA, 23 bp, Homo sapiens
gcccaccctcagcgtcctcacgg

SEQ ID NO: 7397233 - DNA, 23 bp, Homo sapiens
gcccaccctcagcgtcctcacgg

SEQ ID NO: 7397234 - DNA, 17 bp, Homo sapiens
gcccacccttaggagct

SEQ ID NO: 7397235 - DNA, 17 bp, Homo sapiens
gcccacccttaggagct

SEQ ID NO: 7397236 - DNA, 17 bp, Homo sapiens
gcccacccttaggagct

SEQ ID NO: 7397237 - DNA, 17 bp, Homo sapiens
gcccacccttaggagct

SEQ ID NO: 7397238 - DNA, 17 bp, Homo sapiens
gcccacccttaggagct

SEQ ID NO: 7397239 - DNA, 22 bp, Homo sapiens
gcccacagttagtttgcatggc

SEQ ID NO: 7397240 - DNA, 22 bp, Homo sapiens
gcccacagttagtttgcatggc

SEQ ID NO: 7397241 - DNA, 22 bp, Homo sapiens
gcccacatccactagacatgca

SEQ ID NO: 7397242 - DNA, 22 bp, Homo sapiens
gcccacagttagtttgcatggc

SEQ ID NO: 7397243 - DNA, 22 bp, Homo sapiens
gcccacatttttggcttagagg

SEQ ID NO: 7397244 - DNA, 23 bp, Homo sapiens
gcccaccctcagcgtcctcacgg

SEQ ID NO: 7397245 - DNA, 23 bp, Homo sapiens
gcccaccctcagcgtcctcacgg

SEQ ID NO: 7397246 - DNA, 23 bp, Homo sapiens
gcccaccctcagcgtcctcacgg

SEQ ID NO: 7397247 - DNA, 23 bp, Homo sapiens
gcccaccctcagcgtcctcacgg

SEQ ID NO: 7397248 - DNA, 23 bp, Homo sapiens
gcccaccctcagcgtcctcacgg

SEQ ID NO: 7397249 - DNA, 23 bp, Homo sapiens
gcccaccctcagcgtcctcacgg

SEQ ID NO: 7397250 - DNA, 22 bp, Homo sapiens
atttccattatcatgacaaatt

SEQ ID NO: 7397251 - DNA, 22 bp, Homo sapiens
atttccattatcatgacaaatt

SEQ ID NO: 7397252 - DNA, 22 bp, Homo sapiens
atttccattatcatgacaaatt

SEQ ID NO: 7397253 - DNA, 22 bp, Homo sapiens
atttccatgtcggtattttata

SEQ ID NO: 7397254 - DNA, 22 bp, Homo sapiens
atttccatgtcggtattttata

SEQ ID NO: 7397255 - DNA, 22 bp, Homo sapiens
atttccatgtcggtattttata

SEQ ID NO: 7397256 - DNA, 22 bp, Homo sapiens
atttccatgtcggtattttata

SEQ ID NO: 7397257 - DNA, 22 bp, Homo sapiens
atttccatgtccaaaaattagt

SEQ ID NO: 7397258 - DNA, 22 bp, Homo sapiens
atttccatgtccaaaaattagt

SEQ ID NO: 7397259 - DNA, 22 bp, Homo sapiens
atttccatgtccaaaaattagt

SEQ ID NO: 7397260 - DNA, 22 bp, Homo sapiens
atttccattttcagccattact

SEQ ID NO: 7397261 - DNA, 22 bp, Homo sapiens
atttccattatcatgacaaatt

SEQ ID NO: 7397262 - DNA, 22 bp, Homo sapiens
gcccacagtctatcagtttgcg

SEQ ID NO: 7397263 - DNA, 22 bp, Homo sapiens
gcccacagtctatcagtttgcg

SEQ ID NO: 7397264 - DNA, 22 bp, Homo sapiens
atttcccaacacattagaaaat

SEQ ID NO: 7397265 - DNA, 22 bp, Homo sapiens
atttccatgccttagcttaagg

SEQ ID NO: 7397266 - DNA, 22 bp, Homo sapiens
atttccatgaattcccactcat

SEQ ID NO: 7397267 - DNA, 22 bp, Homo sapiens
atttccatgccttagcttaagg

SEQ ID NO: 7397268 - DNA, 22 bp, Homo sapiens
atttccatgccttagcttaagg

SEQ ID NO: 7397269 - DNA, 22 bp, Homo sapiens
atttccatgaaggcagatttta

SEQ ID NO: 7397270 - DNA, 22 bp, Homo sapiens
atttccatgaagtttagttata

SEQ ID NO: 7397271 - DNA, 22 bp, Homo sapiens
atttccatgaagtttagttata

SEQ ID NO: 7397272 - DNA, 22 bp, Homo sapiens
atttccatgaagtttagttata

SEQ ID NO: 7397273 - DNA, 22 bp, Homo sapiens
atttccatagagcgtctcacag

SEQ ID NO: 7397274 - DNA, 22 bp, Homo sapiens
atttccatgaaggcagatttta

SEQ ID NO: 7397275 - DNA, 22 bp, Homo sapiens
atttccatgaaggcagatttta

SEQ ID NO: 7397276 - DNA, 22 bp, Homo sapiens
atttccatacacccatttctga

SEQ ID NO: 7397277 - DNA, 22 bp, Homo sapiens
atttccatacacccatttctga

SEQ ID NO: 7397278 - DNA, 22 bp, Homo sapiens
atttccatacacccatttctga

SEQ ID NO: 7397279 - DNA, 22 bp, Homo sapiens
atttccatacacccatttctga

SEQ ID NO: 7397280 - DNA, 22 bp, Homo sapiens
atttctgtgcagtaaatggtga

SEQ ID NO: 7397281 - DNA, 22 bp, Homo sapiens
atttctgtgcagtaaatggtga

SEQ ID NO: 7397282 - DNA, 22 bp, Homo sapiens
atttctgtggcttcattctcct

SEQ ID NO: 7397283 - DNA, 22 bp, Homo sapiens
atttctgtgcagtaaatggtga

SEQ ID NO: 7397284 - DNA, 22 bp, Homo sapiens
atttctgtggcttcattctcct

SEQ ID NO: 7397285 - DNA, 22 bp, Homo sapiens
atttctgtatcctgctgtcaga

SEQ ID NO: 7397286 - DNA, 22 bp, Homo sapiens
atttctgtatcctgctgtcaga

SEQ ID NO: 7397287 - DNA, 22 bp, Homo sapiens
atttctgtatcctgctgtcaga

SEQ ID NO: 7397288 - DNA, 22 bp, Homo sapiens
atttctgtgcagtaaatggtga

SEQ ID NO: 7397289 - DNA, 22 bp, Homo sapiens
atttctgttatacctttctcag

SEQ ID NO: 7397290 - DNA, 22 bp, Homo sapiens
atttctgttatacctttctcag

SEQ ID NO: 7397291 - DNA, 22 bp, Homo sapiens
atttctgttgcttataaattac

SEQ ID NO: 7397292 - DNA, 22 bp, Homo sapiens
atttctgttatacctttctcag

SEQ ID NO: 7397293 - DNA, 22 bp, Homo sapiens
atttctgtggcttcattctcct

SEQ ID NO: 7397294 - DNA, 22 bp, Homo sapiens
atttctgtggcttcattctcct

SEQ ID NO: 7397295 - DNA, 22 bp, Homo sapiens
atttctgttgcttataaattac

SEQ ID NO: 7397296 - DNA, 22 bp, Homo sapiens
gccccaggttgcctgtcccagg

SEQ ID NO: 7397297 - DNA, 22 bp, Homo sapiens
gccccaggttgcctgtcccagg

SEQ ID NO: 7397298 - DNA, 22 bp, Homo sapiens
atttctgttgcttataaattac

SEQ ID NO: 7397299 - DNA, 22 bp, Homo sapiens
atttctgttgcttataaattac

SEQ ID NO: 7397300 - DNA, 22 bp, Homo sapiens
atttctgttgcttataaattac

SEQ ID NO: 7397301 - DNA, 22 bp, Homo sapiens
gcccccacaggcgggctcgggt

SEQ ID NO: 7397302 - DNA, 22 bp, Homo sapiens
gccccaggttgcctgtcccagg

SEQ ID NO: 7397303 - DNA, 22 bp, Homo sapiens
gcccccacaggcgggctcgggt

SEQ ID NO: 7397304 - DNA, 22 bp, Homo sapiens
gcccccacaggcgggctcgggt

SEQ ID NO: 7397305 - DNA, 22 bp, Homo sapiens
gcccccacaggcgggctcgggt

SEQ ID NO: 7397306 - DNA, 22 bp, Homo sapiens
gcccccacaggcgggctcgggt

SEQ ID NO: 7397307 - DNA, 17 bp, Homo sapiens
gcccccagaaatctcag

SEQ ID NO: 7397308 - DNA, 17 bp, Homo sapiens
gcccccagaaatctcag

SEQ ID NO: 7397309 - DNA, 17 bp, Homo sapiens
gcccccagaaatctcag

SEQ ID NO: 7397310 - DNA, 22 bp, Homo sapiens
atttctgctctgacctgaaagt

SEQ ID NO: 7397311 - DNA, 22 bp, Homo sapiens
atttctggactgaaaaggaagt

SEQ ID NO: 7397312 - DNA, 22 bp, Homo sapiens
atttctgctactgcaccctagt

SEQ ID NO: 7397313 - DNA, 22 bp, Homo sapiens
atttctggattttggatgctgc

SEQ ID NO: 7397314 - DNA, 22 bp, Homo sapiens
atttctggattttggatgctgc

SEQ ID NO: 7397315 - DNA, 22 bp, Homo sapiens
atttctggctgttggaaagttc

SEQ ID NO: 7397316 - DNA, 22 bp, Homo sapiens
atttctggctgttggaaagttc

SEQ ID NO: 7397317 - DNA, 22 bp, Homo sapiens
atttctgataaacgtaagctgc

SEQ ID NO: 7397318 - DNA, 22 bp, Homo sapiens
atttctgatagtaaaggtcttt

SEQ ID NO: 7397319 - DNA, 22 bp, Homo sapiens
atttctgatagtaaaggtcttt

SEQ ID NO: 7397320 - DNA, 22 bp, Homo sapiens
atttctgcatctctggagatct

SEQ ID NO: 7397321 - DNA, 22 bp, Homo sapiens
atttctgcatctctggagatct

SEQ ID NO: 7397322 - DNA, 22 bp, Homo sapiens
atttctgccaaagtggggacct

SEQ ID NO: 7397323 - DNA, 22 bp, Homo sapiens
atttctgccaaagtggggacct

SEQ ID NO: 7397324 - DNA, 22 bp, Homo sapiens
atttctgccatagccaggggat

SEQ ID NO: 7397325 - DNA, 22 bp, Homo sapiens
atttctgctactgcaccctagt

SEQ ID NO: 7397326 - DNA, 22 bp, Homo sapiens
atttctgtaacttatgaaagtt

SEQ ID NO: 7397327 - DNA, 22 bp, Homo sapiens
atttctgtaacttatgaaagtt

SEQ ID NO: 7397328 - DNA, 22 bp, Homo sapiens
atttctgtaacttatgaaagtt

SEQ ID NO: 7397329 - DNA, 22 bp, Homo sapiens
atttctgtaacttatgaaagtt

SEQ ID NO: 7397330 - DNA, 22 bp, Homo sapiens
atttctgtagtccacattcttt

SEQ ID NO: 7397331 - DNA, 22 bp, Homo sapiens
atttctgtagtccacattcttt

SEQ ID NO: 7397332 - DNA, 22 bp, Homo sapiens
atttctgtagtccacattcttt

SEQ ID NO: 7397333 - DNA, 22 bp, Homo sapiens
atttctgtagtccacattcttt

SEQ ID NO: 7397334 - DNA, 22 bp, Homo sapiens
atttctcagttcctactgttta

SEQ ID NO: 7397335 - DNA, 22 bp, Homo sapiens
atttctcagttcctactgttta

SEQ ID NO: 7397336 - DNA, 22 bp, Homo sapiens
atttctcagtgtgatcaggcct

SEQ ID NO: 7397337 - DNA, 22 bp, Homo sapiens
atttctcagtgtgatcaggcct

SEQ ID NO: 7397338 - DNA, 22 bp, Homo sapiens
atttctcagtgtgatcaggcct

SEQ ID NO: 7397339 - DNA, 22 bp, Homo sapiens
atttctcagttcctactgttta

SEQ ID NO: 7397340 - DNA, 22 bp, Homo sapiens
atttctgataaacgtaagctgc

SEQ ID NO: 7397341 - DNA, 22 bp, Homo sapiens
atttctgataaacgtaagctgc

SEQ ID NO: 7397342 - DNA, 22 bp, Homo sapiens
atttctgatacccggtcaccct

SEQ ID NO: 7397343 - DNA, 22 bp, Homo sapiens
gcccacctaacctgctcacctt

SEQ ID NO: 7397344 - DNA, 22 bp, Homo sapiens
gcccacctaacctgctcacctt

SEQ ID NO: 7397345 - DNA, 17 bp, Homo sapiens
gcccacccttaggagct

SEQ ID NO: 7397346 - DNA, 17 bp, Homo sapiens
gcccacccttaggagct

SEQ ID NO: 7397347 - DNA, 17 bp, Homo sapiens
gcccacccttaggagct

SEQ ID NO: 7397348 - DNA, 22 bp, Homo sapiens
gcccacctaacctgctcacctt

SEQ ID NO: 7397349 - DNA, 19 bp, Homo sapiens
gcccacggccctgctctgc

SEQ ID NO: 7397350 - DNA, 22 bp, Homo sapiens
gcccacctaacctgctcacctt

SEQ ID NO: 7397351 - DNA, 22 bp, Homo sapiens
atttctcagtgtacattatgtt

SEQ ID NO: 7397352 - DNA, 22 bp, Homo sapiens
atttctcagtgtacattatgtt

SEQ ID NO: 7397353 - DNA, 22 bp, Homo sapiens
atcaaatataataattttcgct

SEQ ID NO: 7397354 - DNA, 22 bp, Homo sapiens
atcaaatataataattttcgct

SEQ ID NO: 7397355 - DNA, 22 bp, Homo sapiens
atcaaatataataattttcgct

SEQ ID NO: 7397356 - DNA, 22 bp, Homo sapiens
atcaaatataataattttcgct

SEQ ID NO: 7397357 - DNA, 22 bp, Homo sapiens
atcaaatataataattttcgct

SEQ ID NO: 7397358 - DNA, 22 bp, Homo sapiens
atcaaatacaaagggcataagg

SEQ ID NO: 7397359 - DNA, 22 bp, Homo sapiens
atcaaatacaaagggcataagg

SEQ ID NO: 7397360 - DNA, 22 bp, Homo sapiens
atcaaatacaaagggcataagg

SEQ ID NO: 7397361 - DNA, 22 bp, Homo sapiens
atcaaatacaaagggcataagg

SEQ ID NO: 7397362 - DNA, 22 bp, Homo sapiens
atcaaatacaaagggcataagg

SEQ ID NO: 7397363 - DNA, 22 bp, Homo sapiens
atcaaatacaaagggcataagg

SEQ ID NO: 7397364 - DNA, 22 bp, Homo sapiens
atcaaatacaaagggcataagg

SEQ ID NO: 7397365 - DNA, 22 bp, Homo sapiens
atcaaatacaaagggcataagg

SEQ ID NO: 7397366 - DNA, 22 bp, Homo sapiens
atcaaatacaaagggcataagg

SEQ ID NO: 7397367 - DNA, 22 bp, Homo sapiens
atcaaataaaggtacctagctt

SEQ ID NO: 7397368 - DNA, 22 bp, Homo sapiens
atcaaataaaggtacctagctt

SEQ ID NO: 7397369 - DNA, 22 bp, Homo sapiens
atcaaataaaggtacctagctt

SEQ ID NO: 7397370 - DNA, 22 bp, Homo sapiens
atcaaataaaggtacctagctt

SEQ ID NO: 7397371 - DNA, 22 bp, Homo sapiens
atcaaataaaggtacctagctt

SEQ ID NO: 7397372 - DNA, 22 bp, Homo sapiens
atcaaataaaggtacctagctt

SEQ ID NO: 7397373 - DNA, 22 bp, Homo sapiens
atcaaagtttcccagaagttgt

SEQ ID NO: 7397374 - DNA, 22 bp, Homo sapiens
atcaaagtttcccagaagttgt

SEQ ID NO: 7397375 - DNA, 22 bp, Homo sapiens
atcaaagtttcccagaagttgt

SEQ ID NO: 7397376 - DNA, 22 bp, Homo sapiens
atcaaagttcgtaactgataac

SEQ ID NO: 7397377 - DNA, 22 bp, Homo sapiens
atcaaagttcgtaactgataac

SEQ ID NO: 7397378 - DNA, 22 bp, Homo sapiens
atcaaattggaatgaaaggctc

SEQ ID NO: 7397379 - DNA, 22 bp, Homo sapiens
atcaaattatgtgctacaagaa

SEQ ID NO: 7397380 - DNA, 22 bp, Homo sapiens
atcaaattatgtgctacaagaa

SEQ ID NO: 7397381 - DNA, 22 bp, Homo sapiens
atcaaattatgtgctacaagaa

SEQ ID NO: 7397382 - DNA, 22 bp, Homo sapiens
atcaaattatgtgctacaagaa

SEQ ID NO: 7397383 - DNA, 22 bp, Homo sapiens
atcaacagagcaaagcctgaac

SEQ ID NO: 7397384 - DNA, 22 bp, Homo sapiens
atcaacagagcaaagcctgaac

SEQ ID NO: 7397385 - DNA, 22 bp, Homo sapiens
atcaacaggtatggatgagatt

SEQ ID NO: 7397386 - DNA, 22 bp, Homo sapiens
atcaacaggtatggatgagatt

SEQ ID NO: 7397387 - DNA, 22 bp, Homo sapiens
atcaacagtgaagagatcaaga

SEQ ID NO: 7397388 - DNA, 22 bp, Homo sapiens
atcaacagtgaagagatcaaga

SEQ ID NO: 7397389 - DNA, 22 bp, Homo sapiens
atcaaatcattgcattaatgtt

SEQ ID NO: 7397390 - DNA, 23 bp, Homo sapiens
atcaaatgattggccattcagtg

SEQ ID NO: 7397391 - DNA, 23 bp, Homo sapiens
atcaaatgattggccattcagtg

SEQ ID NO: 7397392 - DNA, 23 bp, Homo sapiens
atcaaatgattggccattcagtg

SEQ ID NO: 7397393 - DNA, 23 bp, Homo sapiens
atcaaatgattggccattcagtg

SEQ ID NO: 7397394 - DNA, 22 bp, Homo sapiens
atcaaatcattgcattaatgtt

SEQ ID NO: 7397395 - DNA, 22 bp, Homo sapiens
atcaaatcattgcattaatgtt

SEQ ID NO: 7397396 - DNA, 22 bp, Homo sapiens
atcaaatataataattttcgct

SEQ ID NO: 7397397 - DNA, 22 bp, Homo sapiens
atcaaatataataattttcgct

SEQ ID NO: 7397398 - DNA, 22 bp, Homo sapiens
atcaacttgtccttgatgttaa

SEQ ID NO: 7397399 - DNA, 22 bp, Homo sapiens
atcaagaaaagtgctttcggct

SEQ ID NO: 7397400 - DNA, 22 bp, Homo sapiens
atcacattctttcaaagcagtc

SEQ ID NO: 7397401 - DNA, 22 bp, Homo sapiens
atcacattctttcaaagcagtc

SEQ ID NO: 7397402 - DNA, 22 bp, Homo sapiens
atcacattgccagtgattaccc

SEQ ID NO: 7397403 - DNA, 22 bp, Homo sapiens
atcacattgccagtgattaccc

SEQ ID NO: 7397404 - DNA, 22 bp, Homo sapiens
atcacattgccagtgattaccc

SEQ ID NO: 7397405 - DNA, 22 bp, Homo sapiens
atcacattgccagtgattaccc

SEQ ID NO: 7397406 - DNA, 22 bp, Homo sapiens
atcactttggtaccaattcagc

SEQ ID NO: 7397407 - DNA, 22 bp, Homo sapiens
atcacttactcagagatccgag

SEQ ID NO: 7397408 - DNA, 22 bp, Homo sapiens
atcactttggtaccaattcagc

SEQ ID NO: 7397409 - DNA, 22 bp, Homo sapiens
atcactttggtaccaattcagc

SEQ ID NO: 7397410 - DNA, 22 bp, Homo sapiens
atcactttggtaccaattcagc

SEQ ID NO: 7397411 - DNA, 22 bp, Homo sapiens
atcactttggtaccaattcagc

SEQ ID NO: 7397412 - DNA, 22 bp, Homo sapiens
atcactttggtaccaattcagc

SEQ ID NO: 7397413 - DNA, 22 bp, Homo sapiens
atcagaaaaacataatgttatt

SEQ ID NO: 7397414 - DNA, 22 bp, Homo sapiens
atcagaaaaacataatgttatt

SEQ ID NO: 7397415 - DNA, 22 bp, Homo sapiens
atcagaaaaacataatgttatt

SEQ ID NO: 7397416 - DNA, 22 bp, Homo sapiens
atcagaaaaacataatgttatt

SEQ ID NO: 7397417 - DNA, 22 bp, Homo sapiens
atcagaaaaacataatgttatt

SEQ ID NO: 7397418 - DNA, 22 bp, Homo sapiens
atcagaaaaacataatgttatt

SEQ ID NO: 7397419 - DNA, 22 bp, Homo sapiens
atcaacttaaagaaaagatact

SEQ ID NO: 7397420 - DNA, 22 bp, Homo sapiens
atcaacttaaagaaaagatact

SEQ ID NO: 7397421 - DNA, 18 bp, Homo sapiens
atcaactgctgtttcctt

SEQ ID NO: 7397422 - DNA, 22 bp, Homo sapiens
atcaactgccccaaatgtattt

SEQ ID NO: 7397423 - DNA, 22 bp, Homo sapiens
atcaactgccccaaatgtattt

SEQ ID NO: 7397424 - DNA, 22 bp, Homo sapiens
atcaacatttgcatccttccac

SEQ ID NO: 7397425 - DNA, 22 bp, Homo sapiens
atcaacataaagaagtcctcag

SEQ ID NO: 7397426 - DNA, 22 bp, Homo sapiens
atcaacatagccactccttaga

SEQ ID NO: 7397427 - DNA, 22 bp, Homo sapiens
atcaacatgacaggagaagaga

SEQ ID NO: 7397428 - DNA, 22 bp, Homo sapiens
atcaacatgacaggagaagaga

SEQ ID NO: 7397429 - DNA, 22 bp, Homo sapiens
atcaacatggcaatgcccatct

SEQ ID NO: 7397430 - DNA, 22 bp, Homo sapiens
atcaacatgtcataaagtgaaa

SEQ ID NO: 7397431 - DNA, 22 bp, Homo sapiens
atcaacatgtcataaagtgaaa

SEQ ID NO: 7397432 - DNA, 22 bp, Homo sapiens
atcaacatgaatttctctgaag

SEQ ID NO: 7397433 - DNA, 22 bp, Homo sapiens
atcaacatgaatttctctgaag

SEQ ID NO: 7397434 - DNA, 21 bp, Homo sapiens
atcagaaaatgtaatggagca

SEQ ID NO: 7397435 - DNA, 21 bp, Homo sapiens
atcagaaaatgtaatggagca

SEQ ID NO: 7397436 - DNA, 21 bp, Homo sapiens
atcagaaaatgtaatggagca

SEQ ID NO: 7397437 - DNA, 21 bp, Homo sapiens
atcagaaaatgtaatggagca

SEQ ID NO: 7397438 - DNA, 21 bp, Homo sapiens
atcagaaaatgtaatggagca

SEQ ID NO: 7397439 - DNA, 22 bp, Homo sapiens
atcagaaactcttagagcaggg

SEQ ID NO: 7397440 - DNA, 22 bp, Homo sapiens
atcagaaactcttagagcaggg

SEQ ID NO: 7397441 - DNA, 22 bp, Homo sapiens
atcagaaactcttagagcaggg

SEQ ID NO: 7397442 - DNA, 22 bp, Homo sapiens
atcagaaaatacccagtgttta

SEQ ID NO: 7397443 - DNA, 22 bp, Homo sapiens
atcagaaaatacccagtgttta

SEQ ID NO: 7397444 - DNA, 21 bp, Homo sapiens
atcagaaaatgtaatggagca

SEQ ID NO: 7397445 - DNA, 22 bp, Homo sapiens
atcagaaaatacccagtgttta

SEQ ID NO: 7397446 - DNA, 22 bp, Homo sapiens
atcagaaaaatgagaagagctg

SEQ ID NO: 7397447 - DNA, 22 bp, Homo sapiens
atcagaaaaatgagaagagctg

SEQ ID NO: 7397448 - DNA, 22 bp, Homo sapiens
atcagaaaaatgagaagagctg

SEQ ID NO: 7397449 - DNA, 22 bp, Homo sapiens
atcagaaaaacataatgttatt

SEQ ID NO: 7397450 - DNA, 22 bp, Homo sapiens
atcagaaaaacataatgttatt

SEQ ID NO: 7397451 - DNA, 22 bp, Homo sapiens
atcagaaatctaggattcagaa

SEQ ID NO: 7397452 - DNA, 22 bp, Homo sapiens
atcagaaatctaggattcagaa

SEQ ID NO: 7397453 - DNA, 22 bp, Homo sapiens
atcagaaatagtcatgttactt

SEQ ID NO: 7397454 - DNA, 22 bp, Homo sapiens
atcagaaattgcccagctgttt

SEQ ID NO: 7397455 - DNA, 22 bp, Homo sapiens
atcagaaattgcccagctgttt

SEQ ID NO: 7397456 - DNA, 22 bp, Homo sapiens
atcagaaatctaggattcagaa

SEQ ID NO: 7397457 - DNA, 22 bp, Homo sapiens
atcagaaatagtcatgttactt

SEQ ID NO: 7397458 - DNA, 22 bp, Homo sapiens
atcagaaagttcatcatgtttg

SEQ ID NO: 7397459 - DNA, 22 bp, Homo sapiens
atcagaaatagtcatgttactt

SEQ ID NO: 7397460 - DNA, 22 bp, Homo sapiens
atcagaaatagtcatgttactt

SEQ ID NO: 7397461 - DNA, 22 bp, Homo sapiens
atcagaaatagtcatgttactt

SEQ ID NO: 7397462 - DNA, 22 bp, Homo sapiens
atcagaaagttcatcatgtttg

SEQ ID NO: 7397463 - DNA, 22 bp, Homo sapiens
atcagaaaggtgggcaagcaga

SEQ ID NO: 7397464 - DNA, 22 bp, Homo sapiens
atcagaaagttcatcatgtttg

SEQ ID NO: 7397465 - DNA, 22 bp, Homo sapiens
atcagaaagttcatcatgtttg

SEQ ID NO: 7397466 - DNA, 22 bp, Homo sapiens
atcagaaaggtgggcaagcaga

SEQ ID NO: 7397467 - DNA, 22 bp, Homo sapiens
atcagaaaggtgggcaagcaga

SEQ ID NO: 7397468 - DNA, 22 bp, Homo sapiens
atcagaaaggtgggcaagcaga

SEQ ID NO: 7397469 - DNA, 22 bp, Homo sapiens
atcagaaaggtgggcaagcaga

SEQ ID NO: 7397470 - DNA, 22 bp, Homo sapiens
atcagaaactcttagagcaggg

SEQ ID NO: 7397471 - DNA, 22 bp, Homo sapiens
atcagaaaggtgggcaagcaga

SEQ ID NO: 7397472 - DNA, 22 bp, Homo sapiens
atcagaaaggtgggcaagcaga

SEQ ID NO: 7397473 - DNA, 22 bp, Homo sapiens
atcagaatactatcaacagtga

SEQ ID NO: 7397474 - DNA, 22 bp, Homo sapiens
atcagaatagtgggggacagtc

SEQ ID NO: 7397475 - DNA, 22 bp, Homo sapiens
atcagaatcatttcatccctat

SEQ ID NO: 7397476 - DNA, 22 bp, Homo sapiens
atcagaatcatttcatccctat

SEQ ID NO: 7397477 - DNA, 21 bp, Homo sapiens
atcagaatctctagatttgga

SEQ ID NO: 7397478 - DNA, 22 bp, Homo sapiens
atcagaatactatcaacagtga

SEQ ID NO: 7397479 - DNA, 22 bp, Homo sapiens
atcagaatactatcaacagtga

SEQ ID NO: 7397480 - DNA, 22 bp, Homo sapiens
atcagaatactatcaacagtga

SEQ ID NO: 7397481 - DNA, 22 bp, Homo sapiens
atcagaatactatcaacagtga

SEQ ID NO: 7397482 - DNA, 22 bp, Homo sapiens
atcagaataattagatttcaga

SEQ ID NO: 7397483 - DNA, 22 bp, Homo sapiens
atcagaataattagatttcaga

SEQ ID NO: 7397484 - DNA, 22 bp, Homo sapiens
atcagaataattagatttcaga

SEQ ID NO: 7397485 - DNA, 22 bp, Homo sapiens
atcagaagttgtgcatgcatgg

SEQ ID NO: 7397486 - DNA, 21 bp, Homo sapiens
atcagaagttttggtcagtag

SEQ ID NO: 7397487 - DNA, 22 bp, Homo sapiens
atcagaagtgatgtgtgttatt

SEQ ID NO: 7397488 - DNA, 22 bp, Homo sapiens
atcagaagttgtgcatgcatgg

SEQ ID NO: 7397489 - DNA, 20 bp, Homo sapiens
atcagaagtgatattaacca

SEQ ID NO: 7397490 - DNA, 20 bp, Homo sapiens
atcagaagtgatattaacca

SEQ ID NO: 7397491 - DNA, 22 bp, Homo sapiens
atcagaagtgatgtgtgttatt

SEQ ID NO: 7397492 - DNA, 22 bp, Homo sapiens
atcagaaattgctaccagtgga

SEQ ID NO: 7397493 - DNA, 22 bp, Homo sapiens
atcagaaattgcccagctgttt

SEQ ID NO: 7397494 - DNA, 22 bp, Homo sapiens
atcagaaattgctaccagtgga

SEQ ID NO: 7397495 - DNA, 22 bp, Homo sapiens
atcagaaattgcccagctgttt

SEQ ID NO: 7397496 - DNA, 22 bp, Homo sapiens
atcagaaattgcccagctgttt

SEQ ID NO: 7397497 - DNA, 22 bp, Homo sapiens
atcagaagaaatggatgtgact

SEQ ID NO: 7397498 - DNA, 22 bp, Homo sapiens
atcagaacaaaagaacagttta

SEQ ID NO: 7397499 - DNA, 22 bp, Homo sapiens
atcagaacaaaagaacagttta

SEQ ID NO: 7397500 - DNA, 22 bp, Homo sapiens
atcagaaattgctaccagtgga

SEQ ID NO: 7397501 - DNA, 22 bp, Homo sapiens
atcagaagaaatggatgtgact

SEQ ID NO: 7397502 - DNA, 22 bp, Homo sapiens
atcagaagaaatggatgtgact

SEQ ID NO: 7397503 - DNA, 22 bp, Homo sapiens
atcagaagcaggaggaatgaag

SEQ ID NO: 7397504 - DNA, 22 bp, Homo sapiens
atcagaagcaggaggaatgaag

SEQ ID NO: 7397505 - DNA, 22 bp, Homo sapiens
atcagaagcttgtagtctctct

SEQ ID NO: 7397506 - DNA, 22 bp, Homo sapiens
atcagaagcttgtagtctctct

SEQ ID NO: 7397507 - DNA, 22 bp, Homo sapiens
atcagaaggggaggtaaagaag

SEQ ID NO: 7397508 - DNA, 22 bp, Homo sapiens
atcagaaggggaggtaaagaag

SEQ ID NO: 7397509 - DNA, 22 bp, Homo sapiens
atcagaagcttgtagtctctct

SEQ ID NO: 7397510 - DNA, 22 bp, Homo sapiens
atcagaagcttgtagtctctct

SEQ ID NO: 7397511 - DNA, 22 bp, Homo sapiens
atatttaactggtcccaatata

SEQ ID NO: 7397512 - DNA, 22 bp, Homo sapiens
atatttaactggtcccaatata

SEQ ID NO: 7397513 - DNA, 22 bp, Homo sapiens
atatttaactggtcccaatata

SEQ ID NO: 7397514 - DNA, 22 bp, Homo sapiens
atatttaactggtcccaatata

SEQ ID NO: 7397515 - DNA, 22 bp, Homo sapiens
atatttaactggtcccaatata

SEQ ID NO: 7397516 - DNA, 22 bp, Homo sapiens
atatttaactggtcccaatata

SEQ ID NO: 7397517 - DNA, 22 bp, Homo sapiens
atatttaaacagggtaccaata

SEQ ID NO: 7397518 - DNA, 22 bp, Homo sapiens
atatttactgctgtggtgaagg

SEQ ID NO: 7397519 - DNA, 22 bp, Homo sapiens
atatttactgctgtggtgaagg

SEQ ID NO: 7397520 - DNA, 22 bp, Homo sapiens
atatttactgctgtggtgaagg

SEQ ID NO: 7397521 - DNA, 22 bp, Homo sapiens
atatttaactggtcccaatata

SEQ ID NO: 7397522 - DNA, 22 bp, Homo sapiens
atattttggcaaatgtctagat

SEQ ID NO: 7397523 - DNA, 22 bp, Homo sapiens
atattttggcaaatgtctagat

SEQ ID NO: 7397524 - DNA, 22 bp, Homo sapiens
atatttactgctgtggtgaagg

SEQ ID NO: 7397525 - DNA, 22 bp, Homo sapiens
atatttactgctgtggtgaagg

SEQ ID NO: 7397526 - DNA, 22 bp, Homo sapiens
atcaaagaatgtgactgaaata

SEQ ID NO: 7397527 - DNA, 22 bp, Homo sapiens
atcaaagaatgtgactgaaata

SEQ ID NO: 7397528 - DNA, 22 bp, Homo sapiens
atcaaagaatgtgactgaaata

SEQ ID NO: 7397529 - DNA, 22 bp, Homo sapiens
atcaaagaatgtgactgaaata

SEQ ID NO: 7397530 - DNA, 23 bp, Homo sapiens
atcaaactggtgagaatgtcagt

SEQ ID NO: 7397531 - DNA, 23 bp, Homo sapiens
atcaaactggtgagaatgtcagt

SEQ ID NO: 7397532 - DNA, 23 bp, Homo sapiens
atcaaactggtgagaatgtcagt

SEQ ID NO: 7397533 - DNA, 22 bp, Homo sapiens
atcaaaatgctccagtgatggt

SEQ ID NO: 7397534 - DNA, 22 bp, Homo sapiens
atattttggggtgatgtgcatc

SEQ ID NO: 7397535 - DNA, 22 bp, Homo sapiens
atattttggggtgatgtgcatc

SEQ ID NO: 7397536 - DNA, 22 bp, Homo sapiens
atattttggggtgatgtgcatc

SEQ ID NO: 7397537 - DNA, 22 bp, Homo sapiens
atcaaaatggaagaatttggct

SEQ ID NO: 7397538 - DNA, 22 bp, Homo sapiens
atcaaaatggaagaatttggct

SEQ ID NO: 7397539 - DNA, 22 bp, Homo sapiens
atcaaaatggaagaatttggct

SEQ ID NO: 7397540 - DNA, 22 bp, Homo sapiens
atcaaaatggaagaatttggct

SEQ ID NO: 7397541 - DNA, 22 bp, Homo sapiens
atcaaagtgatttgtaaacagg

SEQ ID NO: 7397542 - DNA, 22 bp, Homo sapiens
atcaaagtgatttgtaaacagg

SEQ ID NO: 7397543 - DNA, 22 bp, Homo sapiens
atcaaagtgatttgtaaacagg

SEQ ID NO: 7397544 - DNA, 22 bp, Homo sapiens
atcaaagtgaaaagtgctgatg

SEQ ID NO: 7397545 - DNA, 22 bp, Homo sapiens
atcaaagtgatttgtaaacagg

SEQ ID NO: 7397546 - DNA, 22 bp, Homo sapiens
atcaaagtgaaaagtgctgatg

SEQ ID NO: 7397547 - DNA, 22 bp, Homo sapiens
atcaaagtccatcagaaggtag

SEQ ID NO: 7397548 - DNA, 22 bp, Homo sapiens
atcaaagtccatcagaaggtag

SEQ ID NO: 7397549 - DNA, 22 bp, Homo sapiens
atcaaagtccatcagaaggtag

SEQ ID NO: 7397550 - DNA, 22 bp, Homo sapiens
atcaaagtagtaggttttggac

SEQ ID NO: 7397551 - DNA, 22 bp, Homo sapiens
atcaaagtccatcagaaggtag

SEQ ID NO: 7397552 - DNA, 22 bp, Homo sapiens
atcaaagtccatcagaaggtag

SEQ ID NO: 7397553 - DNA, 22 bp, Homo sapiens
atcaaagtggaagtttactagg

SEQ ID NO: 7397554 - DNA, 23 bp, Homo sapiens
atcaaagtggaaatcaattatct

SEQ ID NO: 7397555 - DNA, 23 bp, Homo sapiens
atcaaagtggaaatcaattatct

SEQ ID NO: 7397556 - DNA, 23 bp, Homo sapiens
atcaaagtggaaatcaattatct

SEQ ID NO: 7397557 - DNA, 23 bp, Homo sapiens
atcaaagtggaaatcaattatct

SEQ ID NO: 7397558 - DNA, 22 bp, Homo sapiens
atcaaagttcgtaactgataac

SEQ ID NO: 7397559 - DNA, 22 bp, Homo sapiens
atcaaagttcgtaactgataac

SEQ ID NO: 7397560 - DNA, 22 bp, Homo sapiens
atcaaagttcgtaactgataac

SEQ ID NO: 7397561 - DNA, 22 bp, Homo sapiens
atcaaagttcgtaactgataac

SEQ ID NO: 7397562 - DNA, 22 bp, Homo sapiens
atcaaagtggaagtttactagg

SEQ ID NO: 7397563 - DNA, 22 bp, Homo sapiens
atcaaagtggaagtttactagg

SEQ ID NO: 7397564 - DNA, 22 bp, Homo sapiens
atcaaagtggttttctgtgctt

SEQ ID NO: 7397565 - DNA, 22 bp, Homo sapiens
atcaaagtaggcatatgttttt

SEQ ID NO: 7397566 - DNA, 22 bp, Homo sapiens
atcaaagtaggcatatgttttt

SEQ ID NO: 7397567 - DNA, 22 bp, Homo sapiens
atcaaagtatctcaatatggta

SEQ ID NO: 7397568 - DNA, 22 bp, Homo sapiens
atcaaagtatctcaatatggta

SEQ ID NO: 7397569 - DNA, 22 bp, Homo sapiens
atcaaagtaattaacactgaga

SEQ ID NO: 7397570 - DNA, 22 bp, Homo sapiens
atcaaagtaattaacactgaga

SEQ ID NO: 7397571 - DNA, 22 bp, Homo sapiens
atcaaagtaattaacactgaga

SEQ ID NO: 7397572 - DNA, 20 bp, Homo sapiens
atcaaaggctgattcagtcc

SEQ ID NO: 7397573 - DNA, 22 bp, Homo sapiens
atcaaagagcttgacaatccta

SEQ ID NO: 7397574 - DNA, 19 bp, Homo sapiens
atcaaagactgcaggattt

SEQ ID NO: 7397575 - DNA, 22 bp, Homo sapiens
atcaaagagtgagatttttact

SEQ ID NO: 7397576 - DNA, 22 bp, Homo sapiens
atcaaagagtgagatttttact

SEQ ID NO: 7397577 - DNA, 22 bp, Homo sapiens
atcaaagagtgagatttttact

SEQ ID NO: 7397578 - DNA, 21 bp, Homo sapiens
atattgtaggtaaagtgcagg

SEQ ID NO: 7397579 - DNA, 21 bp, Homo sapiens
atattgtaggtaaagtgcagg

SEQ ID NO: 7397580 - DNA, 22 bp, Homo sapiens
atattgttagtaatatttcgaa

SEQ ID NO: 7397581 - DNA, 22 bp, Homo sapiens
atattgttagtaatatttcgaa

SEQ ID NO: 7397582 - DNA, 22 bp, Homo sapiens
atattgtgtgtacaagtagtta

SEQ ID NO: 7397583 - DNA, 22 bp, Homo sapiens
atattgttgactataagagtaa

SEQ ID NO: 7397584 - DNA, 22 bp, Homo sapiens
atattgttgactataagagtaa

SEQ ID NO: 7397585 - DNA, 22 bp, Homo sapiens
atattgttgactataagagtaa

SEQ ID NO: 7397586 - DNA, 22 bp, Homo sapiens
atattgttgactataagagtaa

SEQ ID NO: 7397587 - DNA, 22 bp, Homo sapiens
atatttaaacagggtaccaata

SEQ ID NO: 7397588 - DNA, 22 bp, Homo sapiens
atatttaaacagggtaccaata

SEQ ID NO: 7397589 - DNA, 22 bp, Homo sapiens
atatttaaacagggtaccaata

SEQ ID NO: 7397590 - DNA, 22 bp, Homo sapiens
atatttaaacagggtaccaata

SEQ ID NO: 7397591 - DNA, 22 bp, Homo sapiens
atatttaaacagggtaccaata

SEQ ID NO: 7397592 - DNA, 22 bp, Homo sapiens
atattgggcagggaagccagtg

SEQ ID NO: 7397593 - DNA, 22 bp, Homo sapiens
atattgggattttaggttaaag

SEQ ID NO: 7397594 - DNA, 22 bp, Homo sapiens
atattgggatgtttggaaatgc

SEQ ID NO: 7397595 - DNA, 22 bp, Homo sapiens
atattggggataattgtgctgc

SEQ ID NO: 7397596 - DNA, 22 bp, Homo sapiens
atattgggtgtgggcatcaggg

SEQ ID NO: 7397597 - DNA, 22 bp, Homo sapiens
atattggtgaaatgctagcaaa

SEQ ID NO: 7397598 - DNA, 22 bp, Homo sapiens
atattggtgattagccaatgct

SEQ ID NO: 7397599 - DNA, 21 bp, Homo sapiens
atattgtaggtaaagtgcagg

SEQ ID NO: 7397600 - DNA, 21 bp, Homo sapiens
atattgtaggtaaagtgcagg

SEQ ID NO: 7397601 - DNA, 21 bp, Homo sapiens
atattgtaggtaaagtgcagg

SEQ ID NO: 7397602 - DNA, 22 bp, Homo sapiens
atattgtactagggttacatgt

SEQ ID NO: 7397603 - DNA, 22 bp, Homo sapiens
atattgtactagggttacatgt

SEQ ID NO: 7397604 - DNA, 22 bp, Homo sapiens
atattgtactagggttacatgt

SEQ ID NO: 7397605 - DNA, 22 bp, Homo sapiens
atattgtactagggttacatgt

SEQ ID NO: 7397606 - DNA, 22 bp, Homo sapiens
atattgtactagggttacatgt

SEQ ID NO: 7397607 - DNA, 22 bp, Homo sapiens
atattgtactagggttacatgt

SEQ ID NO: 7397608 - DNA, 22 bp, Homo sapiens
atattgcctaggtgaatagaat

SEQ ID NO: 7397609 - DNA, 23 bp, Homo sapiens
atattgggagatagggcctttaa

SEQ ID NO: 7397610 - DNA, 22 bp, Homo sapiens
atattgctagcctatgagttca

SEQ ID NO: 7397611 - DNA, 18 bp, Homo sapiens
atattgggagcaggggca

SEQ ID NO: 7397612 - DNA, 22 bp, Homo sapiens
atattgcttgaggccaggaggt

SEQ ID NO: 7397613 - DNA, 22 bp, Homo sapiens
atattgggagctgagatctatt

SEQ ID NO: 7397614 - DNA, 22 bp, Homo sapiens
atattgcattggctggtcttga

SEQ ID NO: 7397615 - DNA, 22 bp, Homo sapiens
atattgccagcttagtggattc

SEQ ID NO: 7397616 - DNA, 22 bp, Homo sapiens
atattgccctggggtgtaaaat

SEQ ID NO: 7397617 - DNA, 22 bp, Homo sapiens
atattgcatggctttgctggtt

SEQ ID NO: 7397618 - DNA, 22 bp, Homo sapiens
atattgcatggctttgctggtt

SEQ ID NO: 7397619 - DNA, 22 bp, Homo sapiens
atattgcagtgtgtttatgtga

SEQ ID NO: 7397620 - DNA, 22 bp, Homo sapiens
atattgatggaggtgttagaca

SEQ ID NO: 7397621 - DNA, 20 bp, Homo sapiens
atattgcaaggaagctggat

SEQ ID NO: 7397622 - DNA, 20 bp, Homo sapiens
atattgcaaggaagctggat

SEQ ID NO: 7397623 - DNA, 20 bp, Homo sapiens
atattgcaaggaagctggat

SEQ ID NO: 7397624 - DNA, 22 bp, Homo sapiens
atattgcaatagatgcatcatt

SEQ ID NO: 7397625 - DNA, 22 bp, Homo sapiens
atattgcaatagatgcatcatt

SEQ ID NO: 7397626 - DNA, 22 bp, Homo sapiens
atattgcagtgtgtttatgtga

SEQ ID NO: 7397627 - DNA, 22 bp, Homo sapiens
atattgcagggacagtctggat

SEQ ID NO: 7397628 - DNA, 22 bp, Homo sapiens
atattgcagggacagtctggat

SEQ ID NO: 7397629 - DNA, 22 bp, Homo sapiens
atattcttgtgattataaagta

SEQ ID NO: 7397630 - DNA, 22 bp, Homo sapiens
atattcttgtgattataaagta

SEQ ID NO: 7397631 - DNA, 22 bp, Homo sapiens
atattcttgtgattataaagta

SEQ ID NO: 7397632 - DNA, 22 bp, Homo sapiens
atattcttgtgattataaagta

SEQ ID NO: 7397633 - DNA, 22 bp, Homo sapiens
atattcttgtgattataaagta

SEQ ID NO: 7397634 - DNA, 22 bp, Homo sapiens
atattcttgtgattataaagta

SEQ ID NO: 7397635 - DNA, 22 bp, Homo sapiens
atattcttgaagggagattata

SEQ ID NO: 7397636 - DNA, 22 bp, Homo sapiens
atattcttgaagggagattata

SEQ ID NO: 7397637 - DNA, 22 bp, Homo sapiens
atattcttgtgattataaagta

SEQ ID NO: 7397638 - DNA, 22 bp, Homo sapiens
atattcttgtgattataaagta

SEQ ID NO: 7397639 - DNA, 22 bp, Homo sapiens
atattgatcttggaactgattt

SEQ ID NO: 7397640 - DNA, 22 bp, Homo sapiens
atattaaaactatggttttcag

SEQ ID NO: 7397641 - DNA, 22 bp, Homo sapiens
atattaaaactatggttttcag

SEQ ID NO: 7397642 - DNA, 22 bp, Homo sapiens
atattaaaactatggttttcag

SEQ ID NO: 7397643 - DNA, 22 bp, Homo sapiens
atattaaaactatggttttcag

SEQ ID NO: 7397644 - DNA, 22 bp, Homo sapiens
atattaaaactatggttttcag

SEQ ID NO: 7397645 - DNA, 22 bp, Homo sapiens
atattacataaacatgagtgaa

SEQ ID NO: 7397646 - DNA, 22 bp, Homo sapiens
atatgtttttggaaagaacaca

SEQ ID NO: 7397647 - DNA, 22 bp, Homo sapiens
atatgctacaaataaactttta

SEQ ID NO: 7397648 - DNA, 22 bp, Homo sapiens
atatgctatgtatgtaaatgag

SEQ ID NO: 7397649 - DNA, 22 bp, Homo sapiens
atatgtttttggaaagaacaca

SEQ ID NO: 7397650 - DNA, 22 bp, Homo sapiens
atatgtttttggaaagaacaca

SEQ ID NO: 7397651 - DNA, 22 bp, Homo sapiens
atatgctatgttgaataatttg

SEQ ID NO: 7397652 - DNA, 22 bp, Homo sapiens
atatgccattagctagaaataa

SEQ ID NO: 7397653 - DNA, 22 bp, Homo sapiens
atatgccattagctagaaataa

SEQ ID NO: 7397654 - DNA, 22 bp, Homo sapiens
atatgccattagctagaaataa

SEQ ID NO: 7397655 - DNA, 22 bp, Homo sapiens
atatgctagtgtgcttatactt

SEQ ID NO: 7397656 - DNA, 22 bp, Homo sapiens
atatgctacaaataaactttta

SEQ ID NO: 7397657 - DNA, 20 bp, Homo sapiens
atatgctaatttttagtggg

SEQ ID NO: 7397658 - DNA, 22 bp, Homo sapiens
atatgcatgcatgcttgtgaga

SEQ ID NO: 7397659 - DNA, 22 bp, Homo sapiens
atatgcattaacattgtaggag

SEQ ID NO: 7397660 - DNA, 20 bp, Homo sapiens
atatgcatgtgttttcactt

SEQ ID NO: 7397661 - DNA, 22 bp, Homo sapiens
atatgcatctgtgtgcgtgtct

SEQ ID NO: 7397662 - DNA, 22 bp, Homo sapiens
atatgcatatgtcaaaacttat

SEQ ID NO: 7397663 - DNA, 22 bp, Homo sapiens
atatgcatgcatgcttgtgaga

SEQ ID NO: 7397664 - DNA, 22 bp, Homo sapiens
atatgcatatgtcaaaacttat

SEQ ID NO: 7397665 - DNA, 22 bp, Homo sapiens
atatgcatatgtcaaaacttat

SEQ ID NO: 7397666 - DNA, 22 bp, Homo sapiens
atatgcatatacacacatgcgt

SEQ ID NO: 7397667 - DNA, 22 bp, Homo sapiens
atatgcatctgtgtgcgtgtct

SEQ ID NO: 7397668 - DNA, 22 bp, Homo sapiens
atatgccatactgtacaatact

SEQ ID NO: 7397669 - DNA, 22 bp, Homo sapiens
atatgccattagctagaaataa

SEQ ID NO: 7397670 - DNA, 22 bp, Homo sapiens
atatgccatactgtacaatact

SEQ ID NO: 7397671 - DNA, 22 bp, Homo sapiens
atatgccagctccaagtaagag

SEQ ID NO: 7397672 - DNA, 22 bp, Homo sapiens
atatgcatttacctggcatata

SEQ ID NO: 7397673 - DNA, 21 bp, Homo sapiens
atatgccaaatgccagtaacc

SEQ ID NO: 7397674 - DNA, 22 bp, Homo sapiens
atatgcattcatacttagtgga

SEQ ID NO: 7397675 - DNA, 22 bp, Homo sapiens
atatgcatgcatgcttgtgaga

SEQ ID NO: 7397676 - DNA, 22 bp, Homo sapiens
atatgcattaacattgtaggag

SEQ ID NO: 7397677 - DNA, 22 bp, Homo sapiens
atatgcattcatacttagtgga

SEQ ID NO: 7397678 - DNA, 22 bp, Homo sapiens
atatgcattcatacttagtgga

SEQ ID NO: 7397679 - DNA, 22 bp, Homo sapiens
atattataagttatttcaagtt

SEQ ID NO: 7397680 - DNA, 22 bp, Homo sapiens
atattataagttatttcaagtt

SEQ ID NO: 7397681 - DNA, 22 bp, Homo sapiens
atattataagttatttcaagtt

SEQ ID NO: 7397682 - DNA, 22 bp, Homo sapiens
atattagtttggagactacaat

SEQ ID NO: 7397683 - DNA, 22 bp, Homo sapiens
atattataagttatttcaagtt

SEQ ID NO: 7397684 - DNA, 22 bp, Homo sapiens
atattataagttatttcaagtt

SEQ ID NO: 7397685 - DNA, 22 bp, Homo sapiens
atattataagttatttcaagtt

SEQ ID NO: 7397686 - DNA, 22 bp, Homo sapiens
atattataagttatttcaagtt

SEQ ID NO: 7397687 - DNA, 22 bp, Homo sapiens
atattataagttatttcaagtt

SEQ ID NO: 7397688 - DNA, 22 bp, Homo sapiens
atattataagttatttcaagtt

SEQ ID NO: 7397689 - DNA, 22 bp, Homo sapiens
atattagtttggagactacaat

SEQ ID NO: 7397690 - DNA, 22 bp, Homo sapiens
atattagtgtaggtagctaata

SEQ ID NO: 7397691 - DNA, 22 bp, Homo sapiens
atattagtgtaggtagctaata

SEQ ID NO: 7397692 - DNA, 22 bp, Homo sapiens
atattaggtgctcaatacatgc

SEQ ID NO: 7397693 - DNA, 22 bp, Homo sapiens
atattagggtctctaaattcta

SEQ ID NO: 7397694 - DNA, 22 bp, Homo sapiens
atattaggcaaggagattattt

SEQ ID NO: 7397695 - DNA, 22 bp, Homo sapiens
atattacataaacatgagtgaa

SEQ ID NO: 7397696 - DNA, 22 bp, Homo sapiens
atattacataaacatgagtgaa

SEQ ID NO: 7397697 - DNA, 22 bp, Homo sapiens
atattacataaacatgagtgaa

SEQ ID NO: 7397698 - DNA, 22 bp, Homo sapiens
atattaccaatgcttggaaaaa

SEQ ID NO: 7397699 - DNA, 22 bp, Homo sapiens
atattacataaacatgagtgaa

SEQ ID NO: 7397700 - DNA, 22 bp, Homo sapiens
atattacataaacatgagtgaa

SEQ ID NO: 7397701 - DNA, 22 bp, Homo sapiens
atattaggagttaaatgtatta

SEQ ID NO: 7397702 - DNA, 22 bp, Homo sapiens
atattacttcctggtataaaat

SEQ ID NO: 7397703 - DNA, 22 bp, Homo sapiens
atattactctgatttagtaaat

SEQ ID NO: 7397704 - DNA, 22 bp, Homo sapiens
ctgggctgagcctgggctgtgt

SEQ ID NO: 7397705 - DNA, 22 bp, Homo sapiens
ctgggctgaaggctccccacac

SEQ ID NO: 7397706 - DNA, 22 bp, Homo sapiens
ctgggctgagcctgggctgtgt

SEQ ID NO: 7397707 - DNA, 22 bp, Homo sapiens
ctgggctgagcctgggctgtgt

SEQ ID NO: 7397708 - DNA, 22 bp, Homo sapiens
ctgggctgagcctgggctgtgt

SEQ ID NO: 7397709 - DNA, 22 bp, Homo sapiens
ctgggctgagcctgggctgtgt

SEQ ID NO: 7397710 - DNA, 22 bp, Homo sapiens
ctgggctgagcctgggctgtgt

SEQ ID NO: 7397711 - DNA, 22 bp, Homo sapiens
ctgggctgaaggctccccacac

SEQ ID NO: 7397712 - DNA, 22 bp, Homo sapiens
ctgggctgaaggctccccacac

SEQ ID NO: 7397713 - DNA, 22 bp, Homo sapiens
ctgggctgagcctgggctgtgt

SEQ ID NO: 7397714 - DNA, 22 bp, Homo sapiens
ctgggctgagcctgggctgtgt

SEQ ID NO: 7397715 - DNA, 22 bp, Homo sapiens
ctgggctgagcctgggctgtgt

SEQ ID NO: 7397716 - DNA, 22 bp, Homo sapiens
ctgggctgagcctgggctgtgt

SEQ ID NO: 7397717 - DNA, 22 bp, Homo sapiens
ctgggctgagcctgggctgtgt

SEQ ID NO: 7397718 - DNA, 19 bp, Homo sapiens
ctgggctgaggtctgcctt

SEQ ID NO: 7397719 - DNA, 22 bp, Homo sapiens
ctgggctgagctgtggaaactc

SEQ ID NO: 7397720 - DNA, 22 bp, Homo sapiens
ctgggctgagctgtggaaactc

SEQ ID NO: 7397721 - DNA, 22 bp, Homo sapiens
ctgggctgagcctgggctgtgt

SEQ ID NO: 7397722 - DNA, 19 bp, Homo sapiens
ctgggctgaggtctgcctt

SEQ ID NO: 7397723 - DNA, 19 bp, Homo sapiens
ctgggctgaggtctgcctt

SEQ ID NO: 7397724 - DNA, 19 bp, Homo sapiens
ctgggctgaggtctgcctt

SEQ ID NO: 7397725 - DNA, 19 bp, Homo sapiens
ctgggctgaggtctgcctt

SEQ ID NO: 7397726 - DNA, 19 bp, Homo sapiens
ctgggctgaggtctgcctt

SEQ ID NO: 7397727 - DNA, 19 bp, Homo sapiens
ctgggctgaggtctgcctt

SEQ ID NO: 7397728 - DNA, 19 bp, Homo sapiens
ctgggctgaggtctgcctt

SEQ ID NO: 7397729 - DNA, 19 bp, Homo sapiens
ctgggctgaggtctgcctt

SEQ ID NO: 7397730 - DNA, 19 bp, Homo sapiens
ctgggctgaggtctgcctt

SEQ ID NO: 7397731 - DNA, 22 bp, Homo sapiens
ctgggctgatttagtcacgttt

SEQ ID NO: 7397732 - DNA, 22 bp, Homo sapiens
atattcactgggtactaaaaag

SEQ ID NO: 7397733 - DNA, 22 bp, Homo sapiens
atattcactgggtactaaaaag

SEQ ID NO: 7397734 - DNA, 22 bp, Homo sapiens
atattcactgggtactaaaaag

SEQ ID NO: 7397735 - DNA, 22 bp, Homo sapiens
atattcactgggtactaaaaag

SEQ ID NO: 7397736 - DNA, 22 bp, Homo sapiens
atattcactgggtactaaaaag

SEQ ID NO: 7397737 - DNA, 22 bp, Homo sapiens
atattcactgagcataaagcca

SEQ ID NO: 7397738 - DNA, 22 bp, Homo sapiens
atattcactgagcataaagcca

SEQ ID NO: 7397739 - DNA, 22 bp, Homo sapiens
atattcactgggtactaaaaag

SEQ ID NO: 7397740 - DNA, 22 bp, Homo sapiens
atattcactgagcataaagcca

SEQ ID NO: 7397741 - DNA, 22 bp, Homo sapiens
atattcttgaagggagattata

SEQ ID NO: 7397742 - DNA, 22 bp, Homo sapiens
atattcttcttgttcagactat

SEQ ID NO: 7397743 - DNA, 22 bp, Homo sapiens
atattcttcttgttcagactat

SEQ ID NO: 7397744 - DNA, 22 bp, Homo sapiens
atattcttcttgttcagactat

SEQ ID NO: 7397745 - DNA, 22 bp, Homo sapiens
atattcactgggtactaaaaag

SEQ ID NO: 7397746 - DNA, 22 bp, Homo sapiens
atattcttcttgttcagactat

SEQ ID NO: 7397747 - DNA, 22 bp, Homo sapiens
atattatagacagagtcttctg

SEQ ID NO: 7397748 - DNA, 22 bp, Homo sapiens
atattatagacagagtcttctg

SEQ ID NO: 7397749 - DNA, 22 bp, Homo sapiens
atattatagacagagtcttctg

SEQ ID NO: 7397750 - DNA, 22 bp, Homo sapiens
atattatagacagagtcttctg

SEQ ID NO: 7397751 - DNA, 22 bp, Homo sapiens
atattatagacagagtcttctg

SEQ ID NO: 7397752 - DNA, 22 bp, Homo sapiens
atattatagacagagtcttctg

SEQ ID NO: 7397753 - DNA, 22 bp, Homo sapiens
atattataagttatttcaagtt

SEQ ID NO: 7397754 - DNA, 22 bp, Homo sapiens
atattataagttatttcaagtt

SEQ ID NO: 7397755 - DNA, 22 bp, Homo sapiens
atattataagttatttcaagtt

SEQ ID NO: 7397756 - DNA, 22 bp, Homo sapiens
ctgggctctgcggtgtcgctct

SEQ ID NO: 7397757 - DNA, 22 bp, Homo sapiens
ctgggctctgcggtgtcgctct

SEQ ID NO: 7397758 - DNA, 22 bp, Homo sapiens
atattatgctaagggaaataag

SEQ ID NO: 7397759 - DNA, 22 bp, Homo sapiens
ctgggctctggggtcccggtgc

SEQ ID NO: 7397760 - DNA, 22 bp, Homo sapiens
ctgggctctgcggtgtcgctct

SEQ ID NO: 7397761 - DNA, 22 bp, Homo sapiens
ctgggctctggggtcccggtgc

SEQ ID NO: 7397762 - DNA, 22 bp, Homo sapiens
ctgggctctgtgtttcagtttc

SEQ ID NO: 7397763 - DNA, 22 bp, Homo sapiens
ctgggctctgtgtttcagtttc

SEQ ID NO: 7397764 - DNA, 22 bp, Homo sapiens
ctgggctctggggtcccggtgc

SEQ ID NO: 7397765 - DNA, 22 bp, Homo sapiens
ctgggctcttcccagatccaga

SEQ ID NO: 7397766 - DNA, 22 bp, Homo sapiens
ctgggctcttcccagatccaga

SEQ ID NO: 7397767 - DNA, 22 bp, Homo sapiens
ctgggctcttcccagatccaga

SEQ ID NO: 7397768 - DNA, 22 bp, Homo sapiens
ctgggctcttctcaccctgttt

SEQ ID NO: 7397769 - DNA, 22 bp, Homo sapiens
ctgggctcttctcaccctgttt

SEQ ID NO: 7397770 - DNA, 22 bp, Homo sapiens
ctgggctcttcccagatccaga

SEQ ID NO: 7397771 - DNA, 22 bp, Homo sapiens
ctgggctcttctcaccctgttt

SEQ ID NO: 7397772 - DNA, 22 bp, Homo sapiens
ctgggctgaaagtgttccttga

SEQ ID NO: 7397773 - DNA, 22 bp, Homo sapiens
ctgggctgaaagtgttccttga

SEQ ID NO: 7397774 - DNA, 22 bp, Homo sapiens
ctgggctgaaagtgttccttga

SEQ ID NO: 7397775 - DNA, 22 bp, Homo sapiens
ctgggctgaaagtgttccttga

SEQ ID NO: 7397776 - DNA, 22 bp, Homo sapiens
ctgggctgaaggctccccacac

SEQ ID NO: 7397777 - DNA, 22 bp, Homo sapiens
ctgggctgaaggctccccacac

SEQ ID NO: 7397778 - DNA, 22 bp, Homo sapiens
ctgggctgaaggctccccacac

SEQ ID NO: 7397779 - DNA, 22 bp, Homo sapiens
atatgcacatacatacataggt

SEQ ID NO: 7397780 - DNA, 22 bp, Homo sapiens
atatgcacatacatacataggt

SEQ ID NO: 7397781 - DNA, 22 bp, Homo sapiens
atatgcacatacatacataggt

SEQ ID NO: 7397782 - DNA, 22 bp, Homo sapiens
ctgggctcagcaggccaaggcc

SEQ ID NO: 7397783 - DNA, 22 bp, Homo sapiens
ctgggctcagcaggccaaggcc

SEQ ID NO: 7397784 - DNA, 22 bp, Homo sapiens
atatgcacactctgcccacaga

SEQ ID NO: 7397785 - DNA, 22 bp, Homo sapiens
ctgggctcagcaggccaaggcc

SEQ ID NO: 7397786 - DNA, 22 bp, Homo sapiens
atatgcagtctcttgcccttct

SEQ ID NO: 7397787 - DNA, 22 bp, Homo sapiens
atatgcagtctcttgcccttct

SEQ ID NO: 7397788 - DNA, 22 bp, Homo sapiens
atatgcacgcatacacacataa

SEQ ID NO: 7397789 - DNA, 22 bp, Homo sapiens
atatgcagagagcatgaatagg

SEQ ID NO: 7397790 - DNA, 22 bp, Homo sapiens
atatgcacatacatacataggt

SEQ ID NO: 7397791 - DNA, 22 bp, Homo sapiens
atatgcagagagcatgaatagg

SEQ ID NO: 7397792 - DNA, 22 bp, Homo sapiens
atatgcagagagcatgaatagg

SEQ ID NO: 7397793 - DNA, 22 bp, Homo sapiens
atatgcatataaagcttttagt

SEQ ID NO: 7397794 - DNA, 22 bp, Homo sapiens
atatgcatataaagcttttagt

SEQ ID NO: 7397795 - DNA, 22 bp, Homo sapiens
atatgcatatgtcaaaacttat

SEQ ID NO: 7397796 - DNA, 22 bp, Homo sapiens
atatgcagtctcttgcccttct

SEQ ID NO: 7397797 - DNA, 22 bp, Homo sapiens
atatgcagtctcttgcccttct

SEQ ID NO: 7397798 - DNA, 22 bp, Homo sapiens
atatgcagtctcttgcccttct

SEQ ID NO: 7397799 - DNA, 22 bp, Homo sapiens
atatgcagtctcttgcccttct

SEQ ID NO: 7397800 - DNA, 22 bp, Homo sapiens
atatgcagtctcttgcccttct

SEQ ID NO: 7397801 - DNA, 22 bp, Homo sapiens
atatgcataatacaaagagtat

SEQ ID NO: 7397802 - DNA, 22 bp, Homo sapiens
ctgggctcacctgtggctggca

SEQ ID NO: 7397803 - DNA, 22 bp, Homo sapiens
ctgggctcacctgtggctggca

SEQ ID NO: 7397804 - DNA, 22 bp, Homo sapiens
ctgggctcacctgtggctggca

SEQ ID NO: 7397805 - DNA, 20 bp, Homo sapiens
ctgggctcaagtgatcctcc

SEQ ID NO: 7397806 - DNA, 22 bp, Homo sapiens
ctgggctcacctgtggctggca

SEQ ID NO: 7397807 - DNA, 20 bp, Homo sapiens
ctgggctcaagtgatcctcc

SEQ ID NO: 7397808 - DNA, 22 bp, Homo sapiens
ctgggctcagaaccttgttaag

SEQ ID NO: 7397809 - DNA, 22 bp, Homo sapiens
ctgggctcagaaccttgttaag

SEQ ID NO: 7397810 - DNA, 22 bp, Homo sapiens
ctgggctcacctgtggctggca

SEQ ID NO: 7397811 - DNA, 22 bp, Homo sapiens
ctgggctcagatgagaggaagg

SEQ ID NO: 7397812 - DNA, 22 bp, Homo sapiens
ctgggctcagatgagaggaagg

SEQ ID NO: 7397813 - DNA, 22 bp, Homo sapiens
ctgggctcagatgagaggaagg

SEQ ID NO: 7397814 - DNA, 22 bp, Homo sapiens
ctgggctcagatgagaggaagg

SEQ ID NO: 7397815 - DNA, 22 bp, Homo sapiens
ctgggctcagaaccttgttaag

SEQ ID NO: 7397816 - DNA, 22 bp, Homo sapiens
ctgggctcagatgagaggaagg

SEQ ID NO: 7397817 - DNA, 22 bp, Homo sapiens
ctgggctcagatgagaggaagg

SEQ ID NO: 7397818 - DNA, 22 bp, Homo sapiens
ctgggcctggtgtggcacctgc

SEQ ID NO: 7397819 - DNA, 22 bp, Homo sapiens
ctgggcctggtagggcttgaaa

SEQ ID NO: 7397820 - DNA, 22 bp, Homo sapiens
ctgggctcaagaagtcttccct

SEQ ID NO: 7397821 - DNA, 21 bp, Homo sapiens
ctgggctcaagcaatcctttc

SEQ ID NO: 7397822 - DNA, 21 bp, Homo sapiens
ctgggctcaagcaatcctttc

SEQ ID NO: 7397823 - DNA, 21 bp, Homo sapiens
ctgggctcaagcaatcctttc

SEQ ID NO: 7397824 - DNA, 21 bp, Homo sapiens
ctgggctcaagcaatcctttc

SEQ ID NO: 7397825 - DNA, 22 bp, Homo sapiens
ctggcttctgggccagggcaga

SEQ ID NO: 7397826 - DNA, 22 bp, Homo sapiens
ctggcttctgggccagggcaga

SEQ ID NO: 7397827 - DNA, 22 bp, Homo sapiens
ctggcttctgggccagggcaga

SEQ ID NO: 7397828 - DNA, 22 bp, Homo sapiens
ctgggcctggggctgttgagag

SEQ ID NO: 7397829 - DNA, 20 bp, Homo sapiens
ctggcttcgggaactagttt

SEQ ID NO: 7397830 - DNA, 20 bp, Homo sapiens
ctggcttcgggaactagttt

SEQ ID NO: 7397831 - DNA, 20 bp, Homo sapiens
ctggcttcgggaactagttt

SEQ ID NO: 7397832 - DNA, 22 bp, Homo sapiens
ctgggcctggtagggcttgaaa

SEQ ID NO: 7397833 - DNA, 22 bp, Homo sapiens
ctgggcctggtagggcttgaaa

SEQ ID NO: 7397834 - DNA, 22 bp, Homo sapiens
ctgggcctggtagggcttgaaa

SEQ ID NO: 7397835 - DNA, 22 bp, Homo sapiens
ctgggcctggtagggcttgaaa

SEQ ID NO: 7397836 - DNA, 22 bp, Homo sapiens
ctgggcctggtagggcttgaaa

SEQ ID NO: 7397837 - DNA, 21 bp, Homo sapiens
ctgggctcaagcaatcctttc

SEQ ID NO: 7397838 - DNA, 20 bp, Homo sapiens
ctgggctcaagtgagcctcc

SEQ ID NO: 7397839 - DNA, 20 bp, Homo sapiens
ctgggctcaagtgagcctcc

SEQ ID NO: 7397840 - DNA, 20 bp, Homo sapiens
ctgggctcaagtgagcctcc

SEQ ID NO: 7397841 - DNA, 20 bp, Homo sapiens
ctgggctcaagtgagcctcc

SEQ ID NO: 7397842 - DNA, 20 bp, Homo sapiens
ctgggctcaagtgagcctcc

SEQ ID NO: 7397843 - DNA, 20 bp, Homo sapiens
ctgggctcaagtgagcctcc

SEQ ID NO: 7397844 - DNA, 20 bp, Homo sapiens
ctgggctcaagtgagcctcc

SEQ ID NO: 7397845 - DNA, 20 bp, Homo sapiens
ctgggctcaagtgatcctcc

SEQ ID NO: 7397846 - DNA, 20 bp, Homo sapiens
ctgggctcaagtgatcctcc

SEQ ID NO: 7397847 - DNA, 20 bp, Homo sapiens
ctgggctcaagtgatcctcc

SEQ ID NO: 7397848 - DNA, 22 bp, Homo sapiens
ctgggctcaagtgatccaccca

SEQ ID NO: 7397849 - DNA, 20 bp, Homo sapiens
ctgggctcaagtgagcctcc

SEQ ID NO: 7397850 - DNA, 22 bp, Homo sapiens
ctgggctcaagtgatccaccca

SEQ ID NO: 7397851 - DNA, 22 bp, Homo sapiens
ctgggctcaagtgatccaccca

SEQ ID NO: 7397852 - DNA, 20 bp, Homo sapiens
ctgggctcaagtgatcctcc

SEQ ID NO: 7397853 - DNA, 22 bp, Homo sapiens
ctggctgtgtcttggaggagct

SEQ ID NO: 7397854 - DNA, 22 bp, Homo sapiens
ctggctgtgtccacagagtaag

SEQ ID NO: 7397855 - DNA, 22 bp, Homo sapiens
ctggctgtgtccacagagtaag

SEQ ID NO: 7397856 - DNA, 22 bp, Homo sapiens
ctggctgggagcgagctgctca

SEQ ID NO: 7397857 - DNA, 22 bp, Homo sapiens
ctggctgggagctcgcctgcgg

SEQ ID NO: 7397858 - DNA, 22 bp, Homo sapiens
ctggctgtggattatcacaggc

SEQ ID NO: 7397859 - DNA, 22 bp, Homo sapiens
ctggctgtggattatcacaggc

SEQ ID NO: 7397860 - DNA, 22 bp, Homo sapiens
ctggctgtggtcacaggtaact

SEQ ID NO: 7397861 - DNA, 22 bp, Homo sapiens
ctggctgggagcgagctgctca

SEQ ID NO: 7397862 - DNA, 22 bp, Homo sapiens
ctggctgggagcgagctgctca

SEQ ID NO: 7397863 - DNA, 22 bp, Homo sapiens
ctggctgggagcgagctgctca

SEQ ID NO: 7397864 - DNA, 22 bp, Homo sapiens
ctggctgggagcgagctgctca

SEQ ID NO: 7397865 - DNA, 22 bp, Homo sapiens
ctggctgggagcgagctgctca

SEQ ID NO: 7397866 - DNA, 22 bp, Homo sapiens
ctggctgggagcgagctgctca

SEQ ID NO: 7397867 - DNA, 22 bp, Homo sapiens
ctggctggccggaggcatccct

SEQ ID NO: 7397868 - DNA, 22 bp, Homo sapiens
ctggctgggaagtagagtaggt

SEQ ID NO: 7397869 - DNA, 22 bp, Homo sapiens
ctggctgggaagtagagtaggt

SEQ ID NO: 7397870 - DNA, 22 bp, Homo sapiens
ctggctgggaagtagagtaggt

SEQ ID NO: 7397871 - DNA, 22 bp, Homo sapiens
ctggctggctgtgcccctgccg

SEQ ID NO: 7397872 - DNA, 22 bp, Homo sapiens
ctggctggctgtgcccctgccg

SEQ ID NO: 7397873 - DNA, 22 bp, Homo sapiens
ctggctggctgtgcccctgccg

SEQ ID NO: 7397874 - DNA, 22 bp, Homo sapiens
ctggctggccggagcgaggcgg

SEQ ID NO: 7397875 - DNA, 22 bp, Homo sapiens
ctggctggccggaggcatccct

SEQ ID NO: 7397876 - DNA, 22 bp, Homo sapiens
ctggctggccggaggcatccct

SEQ ID NO: 7397877 - DNA, 22 bp, Homo sapiens
ctggctggccggagcgaggcgg

SEQ ID NO: 7397878 - DNA, 22 bp, Homo sapiens
ctggctggccggagcgaggcgg

SEQ ID NO: 7397879 - DNA, 22 bp, Homo sapiens
ctggctggccggagcgaggcgg

SEQ ID NO: 7397880 - DNA, 22 bp, Homo sapiens
ctggctggccggagcgaggcgg

SEQ ID NO: 7397881 - DNA, 22 bp, Homo sapiens
ctggctggccggagcgaggcgg

SEQ ID NO: 7397882 - DNA, 19 bp, Homo sapiens
ctggcttcaagcagtcctc

SEQ ID NO: 7397883 - DNA, 22 bp, Homo sapiens
ctggcttcagctgccatcaatg

SEQ ID NO: 7397884 - DNA, 19 bp, Homo sapiens
ctggcttcaagcagtcctc

SEQ ID NO: 7397885 - DNA, 19 bp, Homo sapiens
ctggcttcaagcagtcctc

SEQ ID NO: 7397886 - DNA, 19 bp, Homo sapiens
ctggcttcaagcagtcctc

SEQ ID NO: 7397887 - DNA, 19 bp, Homo sapiens
ctggcttcaagcagtcctc

SEQ ID NO: 7397888 - DNA, 22 bp, Homo sapiens
ctggctgttttcaatgttgatg

SEQ ID NO: 7397889 - DNA, 22 bp, Homo sapiens
ctggctgtttcaggcagtgtcc

SEQ ID NO: 7397890 - DNA, 22 bp, Homo sapiens
ctggctgtttcaggcagtgtcc

SEQ ID NO: 7397891 - DNA, 22 bp, Homo sapiens
ctggctgtgtcttggaggagct

SEQ ID NO: 7397892 - DNA, 22 bp, Homo sapiens
ctggctgtgtgcccccggcacc

SEQ ID NO: 7397893 - DNA, 22 bp, Homo sapiens
ctggctgtgtgcccccggcacc

SEQ ID NO: 7397894 - DNA, 22 bp, Homo sapiens
ctggctgtgtcttggaggagct

SEQ ID NO: 7397895 - DNA, 22 bp, Homo sapiens
ctggctgtgtcttggaggagct

SEQ ID NO: 7397896 - DNA, 22 bp, Homo sapiens
ctggctgtgtcttggaggagct

SEQ ID NO: 7397897 - DNA, 22 bp, Homo sapiens
ctggcttccatgctgtagtggc

SEQ ID NO: 7397898 - DNA, 22 bp, Homo sapiens
ctggcttccatgctgtagtggc

SEQ ID NO: 7397899 - DNA, 22 bp, Homo sapiens
ctggcttccatgctgtagtggc

SEQ ID NO: 7397900 - DNA, 22 bp, Homo sapiens
ctggcttccatgctgtagtggc

SEQ ID NO: 7397901 - DNA, 22 bp, Homo sapiens
ctggcttccaccatggcccctg

SEQ ID NO: 7397902 - DNA, 22 bp, Homo sapiens
ctggcttccaccatggcccctg

SEQ ID NO: 7397903 - DNA, 22 bp, Homo sapiens
ctggcttccaccatggcccctg

SEQ ID NO: 7397904 - DNA, 22 bp, Homo sapiens
ctggcttcctgagtccattacc

SEQ ID NO: 7397905 - DNA, 22 bp, Homo sapiens
ctggcttcctgagtccattacc

SEQ ID NO: 7397906 - DNA, 22 bp, Homo sapiens
ctggcttcctcaggagcagtgg

SEQ ID NO: 7397907 - DNA, 22 bp, Homo sapiens
ctggcttcctcaggagcagtgg

SEQ ID NO: 7397908 - DNA, 22 bp, Homo sapiens
ctggcttccctgtcttatggaa

SEQ ID NO: 7397909 - DNA, 22 bp, Homo sapiens
ctggcttccctgtcttatggaa

SEQ ID NO: 7397910 - DNA, 22 bp, Homo sapiens
ctggcttccctgtcttatggaa

SEQ ID NO: 7397911 - DNA, 22 bp, Homo sapiens
ctggcttccctgtcttatggaa

SEQ ID NO: 7397912 - DNA, 22 bp, Homo sapiens
ctggcttccctgtcttatggaa

SEQ ID NO: 7397913 - DNA, 22 bp, Homo sapiens
ctggcttccctgtcttatggaa

SEQ ID NO: 7397914 - DNA, 22 bp, Homo sapiens
atccatataggcagatggcaca

SEQ ID NO: 7397915 - DNA, 22 bp, Homo sapiens
atccatcagaagggcaaaattt

SEQ ID NO: 7397916 - DNA, 22 bp, Homo sapiens
ctgtgtgcaacttgcagttttg

SEQ ID NO: 7397917 - DNA, 22 bp, Homo sapiens
ctgtgtgcagggcacaatggaa

SEQ ID NO: 7397918 - DNA, 22 bp, Homo sapiens
atccagttccaaagatcattta

SEQ ID NO: 7397919 - DNA, 22 bp, Homo sapiens
atccagttctcagtgcttacag

SEQ ID NO: 7397920 - DNA, 22 bp, Homo sapiens
atccagttctcagtgcttacag

SEQ ID NO: 7397921 - DNA, 22 bp, Homo sapiens
atccagtctggggtgctgcatg

SEQ ID NO: 7397922 - DNA, 22 bp, Homo sapiens
atccagtttatgtcatattctt

SEQ ID NO: 7397923 - DNA, 22 bp, Homo sapiens
ctgtgtgcaggtgctgggtacc

SEQ ID NO: 7397924 - DNA, 22 bp, Homo sapiens
ctgtgtgcaggtgctgggtacc

SEQ ID NO: 7397925 - DNA, 22 bp, Homo sapiens
ctgtgtgcaggtgctgggtacc

SEQ ID NO: 7397926 - DNA, 22 bp, Homo sapiens
ctgtgtgcaggtgctgggtacc

SEQ ID NO: 7397927 - DNA, 22 bp, Homo sapiens
ctgtgtgcagggcacaatggaa

SEQ ID NO: 7397928 - DNA, 22 bp, Homo sapiens
ctgtgtgcatagttgtgctcaa

SEQ ID NO: 7397929 - DNA, 22 bp, Homo sapiens
ctgtgtgcatagttgtgctcaa

SEQ ID NO: 7397930 - DNA, 22 bp, Homo sapiens
ctgtgtgcatagttgtgctcaa

SEQ ID NO: 7397931 - DNA, 22 bp, Homo sapiens
ctgtgtgcctagagggtggccg

SEQ ID NO: 7397932 - DNA, 22 bp, Homo sapiens
ctgtgtgcatagttgtgctcaa

SEQ ID NO: 7397933 - DNA, 22 bp, Homo sapiens
atccagggtgtggagagagctc

SEQ ID NO: 7397934 - DNA, 22 bp, Homo sapiens
atccaggtatgaattgtgtgac

SEQ ID NO: 7397935 - DNA, 19 bp, Homo sapiens
atccaggtcatgtagttct

SEQ ID NO: 7397936 - DNA, 22 bp, Homo sapiens
atccagtatctgtgatgggtta

SEQ ID NO: 7397937 - DNA, 22 bp, Homo sapiens
atccagtatgaggtagggcttg

SEQ ID NO: 7397938 - DNA, 22 bp, Homo sapiens
atccagtatgaggtagggcttg

SEQ ID NO: 7397939 - DNA, 22 bp, Homo sapiens
atccagtagtgacttttacatt

SEQ ID NO: 7397940 - DNA, 22 bp, Homo sapiens
atccagggtgtggagagagctc

SEQ ID NO: 7397941 - DNA, 22 bp, Homo sapiens
atccagggtgtggagagagctc

SEQ ID NO: 7397942 - DNA, 22 bp, Homo sapiens
atccagggtgtggagagagctc

SEQ ID NO: 7397943 - DNA, 22 bp, Homo sapiens
atccagggtgtggagagagctc

SEQ ID NO: 7397944 - DNA, 22 bp, Homo sapiens
atccagggtgtggagagagctc

SEQ ID NO: 7397945 - DNA, 22 bp, Homo sapiens
atccagtctgtctaccttctca

SEQ ID NO: 7397946 - DNA, 22 bp, Homo sapiens
atccagtctgtctaccttctca

SEQ ID NO: 7397947 - DNA, 22 bp, Homo sapiens
atccagtcccacacatgctctg

SEQ ID NO: 7397948 - DNA, 22 bp, Homo sapiens
atccagtctggggtgctgcatg

SEQ ID NO: 7397949 - DNA, 22 bp, Homo sapiens
atccagtgagtgcagctgttgt

SEQ ID NO: 7397950 - DNA, 22 bp, Homo sapiens
atccagtgagtgcagctgttgt

SEQ ID NO: 7397951 - DNA, 22 bp, Homo sapiens
atccagtctggggtgctgcatg

SEQ ID NO: 7397952 - DNA, 22 bp, Homo sapiens
atccagtgagtgcagctgttgt

SEQ ID NO: 7397953 - DNA, 22 bp, Homo sapiens
atccagtcccacacatgctctg

SEQ ID NO: 7397954 - DNA, 22 bp, Homo sapiens
atccagtccatgacattctgtt

SEQ ID NO: 7397955 - DNA, 22 bp, Homo sapiens
atccagtcaaaattagtaaggt

SEQ ID NO: 7397956 - DNA, 22 bp, Homo sapiens
atccagtccatgacattctgtt

SEQ ID NO: 7397957 - DNA, 22 bp, Homo sapiens
atccagtcaaaattagtaaggt

SEQ ID NO: 7397958 - DNA, 22 bp, Homo sapiens
atccagtcaaaattagtaaggt

SEQ ID NO: 7397959 - DNA, 22 bp, Homo sapiens
atccaggcttcagctgcctact

SEQ ID NO: 7397960 - DNA, 22 bp, Homo sapiens
atccagggataaaagtaaggtt

SEQ ID NO: 7397961 - DNA, 22 bp, Homo sapiens
atccagggataaaagtaaggtt

SEQ ID NO: 7397962 - DNA, 22 bp, Homo sapiens
atccagggataaaagtaaggtt

SEQ ID NO: 7397963 - DNA, 22 bp, Homo sapiens
atccagggataaaagtaaggtt

SEQ ID NO: 7397964 - DNA, 22 bp, Homo sapiens
atccaggcttcagctgcctact

SEQ ID NO: 7397965 - DNA, 22 bp, Homo sapiens
atccaggcttaatgggagccac

SEQ ID NO: 7397966 - DNA, 22 bp, Homo sapiens
atccaggcttaatgggagccac

SEQ ID NO: 7397967 - DNA, 22 bp, Homo sapiens
atccaggcttaatgggagccac

SEQ ID NO: 7397968 - DNA, 22 bp, Homo sapiens
atccaggctgtctaatgggaga

SEQ ID NO: 7397969 - DNA, 22 bp, Homo sapiens
atccaggctgtctaatgggaga

SEQ ID NO: 7397970 - DNA, 22 bp, Homo sapiens
atccaggctgggtgtggctact

SEQ ID NO: 7397971 - DNA, 22 bp, Homo sapiens
atccaggctgggtgtggctact

SEQ ID NO: 7397972 - DNA, 22 bp, Homo sapiens
atccaggctggagtgcattggt

SEQ ID NO: 7397973 - DNA, 22 bp, Homo sapiens
atccaggctggagtgcattggt

SEQ ID NO: 7397974 - DNA, 22 bp, Homo sapiens
atccaggctgctttctatgccc

SEQ ID NO: 7397975 - DNA, 22 bp, Homo sapiens
atccaggctgcgggtctcaagt

SEQ ID NO: 7397976 - DNA, 22 bp, Homo sapiens
atccaggctgcgggtctcaagt

SEQ ID NO: 7397977 - DNA, 22 bp, Homo sapiens
atccaggctgcgggtctcaagt

SEQ ID NO: 7397978 - DNA, 22 bp, Homo sapiens
atccaggctgctttctatgccc

SEQ ID NO: 7397979 - DNA, 22 bp, Homo sapiens
atccaggctgctatgaggatga

SEQ ID NO: 7397980 - DNA, 22 bp, Homo sapiens
atccaggccttgaagtaccagt

SEQ ID NO: 7397981 - DNA, 22 bp, Homo sapiens
atccaggccttgaagtaccagt

SEQ ID NO: 7397982 - DNA, 22 bp, Homo sapiens
atccaggcgaatgcagaaggcc

SEQ ID NO: 7397983 - DNA, 22 bp, Homo sapiens
atccaggcgaatgcagaaggcc

SEQ ID NO: 7397984 - DNA, 22 bp, Homo sapiens
atccaggccccaagaccccgac

SEQ ID NO: 7397985 - DNA, 22 bp, Homo sapiens
atccaggcattctgacttcaag

SEQ ID NO: 7397986 - DNA, 22 bp, Homo sapiens
atccaggcattctgacttcaag

SEQ ID NO: 7397987 - DNA, 22 bp, Homo sapiens
atccaggcctgagtctggtcct

SEQ ID NO: 7397988 - DNA, 22 bp, Homo sapiens
atccaggcctgagtctggtcct

SEQ ID NO: 7397989 - DNA, 22 bp, Homo sapiens
atccaggcctgagtctggtcct

SEQ ID NO: 7397990 - DNA, 22 bp, Homo sapiens
atccactccctaacaccatgtt

SEQ ID NO: 7397991 - DNA, 22 bp, Homo sapiens
atccaccctgtggtggctttct

SEQ ID NO: 7397992 - DNA, 22 bp, Homo sapiens
atccaccctgtggtggctttct

SEQ ID NO: 7397993 - DNA, 22 bp, Homo sapiens
ctgtgtgctcggatggactcgt

SEQ ID NO: 7397994 - DNA, 22 bp, Homo sapiens
ctgtgtgctgaaatgcagtgag

SEQ ID NO: 7397995 - DNA, 22 bp, Homo sapiens
ctgtgtgctcggatggactcgt

SEQ ID NO: 7397996 - DNA, 22 bp, Homo sapiens
ctgtgtgcctagagggtggccg

SEQ ID NO: 7397997 - DNA, 22 bp, Homo sapiens
ctgtgtgcctagagggtggccg

SEQ ID NO: 7397998 - DNA, 22 bp, Homo sapiens
ctgtgtgcctcctgtgatcagg

SEQ ID NO: 7397999 - DNA, 22 bp, Homo sapiens
ctgtgtgcctagagggtggccg

SEQ ID NO: 7398000 - DNA, 22 bp, Homo sapiens
ctgtgtgctcggatggactcgt

SEQ ID NO: 7398001 - DNA, 22 bp, Homo sapiens
ctgtgtgctgttagggagctgc

SEQ ID NO: 7398002 - DNA, 22 bp, Homo sapiens
ctgtgtgctgaaatgcagtgag

SEQ ID NO: 7398003 - DNA, 22 bp, Homo sapiens
ctgtgtgctgttagggagctgc

SEQ ID NO: 7398004 - DNA, 22 bp, Homo sapiens
ctgtgtgctgttagggagctgc

SEQ ID NO: 7398005 - DNA, 22 bp, Homo sapiens
ctgtgtggcctcaagccagcct

SEQ ID NO: 7398006 - DNA, 22 bp, Homo sapiens
ctgtgtggactggttgaggccc

SEQ ID NO: 7398007 - DNA, 22 bp, Homo sapiens
ctgtgtggactggttgaggccc

SEQ ID NO: 7398008 - DNA, 22 bp, Homo sapiens
ctgtgtggcctcaagccagcct

SEQ ID NO: 7398009 - DNA, 22 bp, Homo sapiens
ctgtgtgtcatttgtcaatcct

SEQ ID NO: 7398010 - DNA, 22 bp, Homo sapiens
ctgtgtgtcatttgtcaatcct

SEQ ID NO: 7398011 - DNA, 22 bp, Homo sapiens
ctgtgtgtcatttgtcaatcct

SEQ ID NO: 7398012 - DNA, 22 bp, Homo sapiens
ctgtgtgtcatttgtcaatcct

SEQ ID NO: 7398013 - DNA, 22 bp, Homo sapiens
ctgtgtgtcctcggacgagttt

SEQ ID NO: 7398014 - DNA, 22 bp, Homo sapiens
ctgtgtgtcctcggacgagttt

SEQ ID NO: 7398015 - DNA, 22 bp, Homo sapiens
atcctgaaaacttacgaagtgg

SEQ ID NO: 7398016 - DNA, 22 bp, Homo sapiens
atcctgaaaacttacgaagtgg

SEQ ID NO: 7398017 - DNA, 22 bp, Homo sapiens
ctgtgtgtcctcggacgagttt

SEQ ID NO: 7398018 - DNA, 22 bp, Homo sapiens
ctgtgtgtcctcggacgagttt

SEQ ID NO: 7398019 - DNA, 22 bp, Homo sapiens
ctgtgtgtcctcggacgagttt

SEQ ID NO: 7398020 - DNA, 22 bp, Homo sapiens
ctgtgtgtcctcggacgagttt

SEQ ID NO: 7398021 - DNA, 22 bp, Homo sapiens
atcctgaaaacttacgaagtgg

SEQ ID NO: 7398022 - DNA, 22 bp, Homo sapiens
atcctgggcaaagtatgctgtc

SEQ ID NO: 7398023 - DNA, 22 bp, Homo sapiens
atcctgggcaagtcaatgtccc

SEQ ID NO: 7398024 - DNA, 22 bp, Homo sapiens
atcctgggcaagtcaatgtccc

SEQ ID NO: 7398025 - DNA, 22 bp, Homo sapiens
atcctgggcagtgtgtcactct

SEQ ID NO: 7398026 - DNA, 22 bp, Homo sapiens
atcctgggcagtgtgtcactct

SEQ ID NO: 7398027 - DNA, 22 bp, Homo sapiens
atcctgggcaagtcaatgtccc

SEQ ID NO: 7398028 - DNA, 22 bp, Homo sapiens
atcctgggcagttttgagtgct

SEQ ID NO: 7398029 - DNA, 22 bp, Homo sapiens
atcctgggcagttttgagtgct

SEQ ID NO: 7398030 - DNA, 22 bp, Homo sapiens
atcctgggcagtgtgtcactct

SEQ ID NO: 7398031 - DNA, 18 bp, Homo sapiens
atcctgggccagtctttc

SEQ ID NO: 7398032 - DNA, 18 bp, Homo sapiens
atcctgggccagtctttc

SEQ ID NO: 7398033 - DNA, 18 bp, Homo sapiens
atcctgggccagtctttc

SEQ ID NO: 7398034 - DNA, 22 bp, Homo sapiens
atcctgggtttgtgagtttatg

SEQ ID NO: 7398035 - DNA, 19 bp, Homo sapiens
atcctgggtcctccagctg

SEQ ID NO: 7398036 - DNA, 19 bp, Homo sapiens
atcctgggtcctccagctg

SEQ ID NO: 7398037 - DNA, 19 bp, Homo sapiens
atcctgggtcctccagctg

SEQ ID NO: 7398038 - DNA, 22 bp, Homo sapiens
atcctgtagtctcacagcccca

SEQ ID NO: 7398039 - DNA, 22 bp, Homo sapiens
atcctgtcatcatagtacttga

SEQ ID NO: 7398040 - DNA, 22 bp, Homo sapiens
atcctgtctatgagtagataat

SEQ ID NO: 7398041 - DNA, 22 bp, Homo sapiens
atcctgtctctacccatcggct

SEQ ID NO: 7398042 - DNA, 22 bp, Homo sapiens
atcctgggctgcaccctcagcc

SEQ ID NO: 7398043 - DNA, 22 bp, Homo sapiens
atcctgggctgcaccctcagcc

SEQ ID NO: 7398044 - DNA, 22 bp, Homo sapiens
atcctgggcctcagaggtgtgt

SEQ ID NO: 7398045 - DNA, 19 bp, Homo sapiens
atcctgggtcctccagctg

SEQ ID NO: 7398046 - DNA, 19 bp, Homo sapiens
atcctgggtcctccagctg

SEQ ID NO: 7398047 - DNA, 22 bp, Homo sapiens
atcctgggggcagctggaaaca

SEQ ID NO: 7398048 - DNA, 22 bp, Homo sapiens
atcctgggtaagttccttttaa

SEQ ID NO: 7398049 - DNA, 20 bp, Homo sapiens
atcagacttttaggaacata

SEQ ID NO: 7398050 - DNA, 22 bp, Homo sapiens
atcagagaagtttcactggcat

SEQ ID NO: 7398051 - DNA, 22 bp, Homo sapiens
atcagagaagtttcactggcat

SEQ ID NO: 7398052 - DNA, 22 bp, Homo sapiens
atcagagatggctccagtgctc

SEQ ID NO: 7398053 - DNA, 22 bp, Homo sapiens
atcagagatggctccagtgctc

SEQ ID NO: 7398054 - DNA, 22 bp, Homo sapiens
atcagagaccggtcaagtcatg

SEQ ID NO: 7398055 - DNA, 22 bp, Homo sapiens
atcagagacaaaaccagcactt

SEQ ID NO: 7398056 - DNA, 22 bp, Homo sapiens
atcagagacaaaaccagcactt

SEQ ID NO: 7398057 - DNA, 22 bp, Homo sapiens
atcagagcactgagcaggacac

SEQ ID NO: 7398058 - DNA, 22 bp, Homo sapiens
ctgtggagtgtagatgctgggt

SEQ ID NO: 7398059 - DNA, 22 bp, Homo sapiens
ctgtggagtgtagatgctgggt

SEQ ID NO: 7398060 - DNA, 22 bp, Homo sapiens
ctgtggagtgtagatgctgggt

SEQ ID NO: 7398061 - DNA, 22 bp, Homo sapiens
atcagaatcttctgaacagtgg

SEQ ID NO: 7398062 - DNA, 22 bp, Homo sapiens
atcagaatcttctgaacagtgg

SEQ ID NO: 7398063 - DNA, 22 bp, Homo sapiens
atcagaatgattagtaaccaat

SEQ ID NO: 7398064 - DNA, 22 bp, Homo sapiens
atcagaatgattagtaaccaat

SEQ ID NO: 7398065 - DNA, 22 bp, Homo sapiens
atcagaatgattagtaaccaat

SEQ ID NO: 7398066 - DNA, 22 bp, Homo sapiens
atcagaatgcagccagcagtta

SEQ ID NO: 7398067 - DNA, 22 bp, Homo sapiens
atcagaatgcagccagcagtta

SEQ ID NO: 7398068 - DNA, 22 bp, Homo sapiens
atcagaatgcagccagcagtta

SEQ ID NO: 7398069 - DNA, 22 bp, Homo sapiens
atcagaatggagcccacatggt

SEQ ID NO: 7398070 - DNA, 22 bp, Homo sapiens
atcagaatggagcccacatggt

SEQ ID NO: 7398071 - DNA, 22 bp, Homo sapiens
atcagaattagccagtgaggct

SEQ ID NO: 7398072 - DNA, 22 bp, Homo sapiens
atcagaccatccagcgtggatg

SEQ ID NO: 7398073 - DNA, 20 bp, Homo sapiens
atcagacttgcatttcagga

SEQ ID NO: 7398074 - DNA, 22 bp, Homo sapiens
atcagactctgcattgcagtct

SEQ ID NO: 7398075 - DNA, 22 bp, Homo sapiens
atcagactcagaaatgacgtgg

SEQ ID NO: 7398076 - DNA, 22 bp, Homo sapiens
atcagacctgtctcctcttgcc

SEQ ID NO: 7398077 - DNA, 22 bp, Homo sapiens
atcagacaattgttgagtactg

SEQ ID NO: 7398078 - DNA, 22 bp, Homo sapiens
atcagacaattgttgagtactg

SEQ ID NO: 7398079 - DNA, 22 bp, Homo sapiens
atcagacagggaattatagcag

SEQ ID NO: 7398080 - DNA, 22 bp, Homo sapiens
atcagacagggaattatagcag

SEQ ID NO: 7398081 - DNA, 22 bp, Homo sapiens
atcagaattagccagtgaggct

SEQ ID NO: 7398082 - DNA, 22 bp, Homo sapiens
atcagacaattgttgagtactg

SEQ ID NO: 7398083 - DNA, 19 bp, Homo sapiens
ctgtggcctccaggaggga

SEQ ID NO: 7398084 - DNA, 19 bp, Homo sapiens
ctgtggcctccaggaggga

SEQ ID NO: 7398085 - DNA, 19 bp, Homo sapiens
ctgtggcctccaggaggga

SEQ ID NO: 7398086 - DNA, 19 bp, Homo sapiens
ctgtggcctccaggaggga

SEQ ID NO: 7398087 - DNA, 22 bp, Homo sapiens
ctgtggccctgtgatctggcac

SEQ ID NO: 7398088 - DNA, 22 bp, Homo sapiens
ctgtggccctgtgatctggcac

SEQ ID NO: 7398089 - DNA, 22 bp, Homo sapiens
ctgtggccctgtgatctggcac

SEQ ID NO: 7398090 - DNA, 23 bp, Homo sapiens
ctgtggccctgcttcatgcagcc

SEQ ID NO: 7398091 - DNA, 23 bp, Homo sapiens
ctgtggccctgcttcatgcagcc

SEQ ID NO: 7398092 - DNA, 22 bp, Homo sapiens
ctgtggagttccatcaggggag

SEQ ID NO: 7398093 - DNA, 23 bp, Homo sapiens
ctgtggccctgcttcatgcagcc

SEQ ID NO: 7398094 - DNA, 23 bp, Homo sapiens
ctgtggccctgcttcatgcagcc

SEQ ID NO: 7398095 - DNA, 23 bp, Homo sapiens
ctgtggccctgcttcatgcagcc

SEQ ID NO: 7398096 - DNA, 23 bp, Homo sapiens
ctgtggccctgcttcatgcagcc

SEQ ID NO: 7398097 - DNA, 23 bp, Homo sapiens
ctgtggccctgcttcatgcagcc

SEQ ID NO: 7398098 - DNA, 22 bp, Homo sapiens
ctgtggagttccatcaggggag

SEQ ID NO: 7398099 - DNA, 22 bp, Homo sapiens
ctgtggagttccatcaggggag

SEQ ID NO: 7398100 - DNA, 22 bp, Homo sapiens
ctgtggccttggaccagcatct

SEQ ID NO: 7398101 - DNA, 22 bp, Homo sapiens
ctgtggccttggaccagcatct

SEQ ID NO: 7398102 - DNA, 22 bp, Homo sapiens
ctgtggcctttgttggaggtcc

SEQ ID NO: 7398103 - DNA, 22 bp, Homo sapiens
ctgtggcctttgttggaggtcc

SEQ ID NO: 7398104 - DNA, 22 bp, Homo sapiens
ctgtggcctttgttggaggtcc

SEQ ID NO: 7398105 - DNA, 22 bp, Homo sapiens
ctgtggcctttgttggaggtcc

SEQ ID NO: 7398106 - DNA, 22 bp, Homo sapiens
ctgtggcctttgttggaggtcc

SEQ ID NO: 7398107 - DNA, 22 bp, Homo sapiens
ctgtggcctttgttggaggtcc

SEQ ID NO: 7398108 - DNA, 22 bp, Homo sapiens
ctgtggccttggaccagcatct

SEQ ID NO: 7398109 - DNA, 22 bp, Homo sapiens
ctgtggcctgtgccagaactgg

SEQ ID NO: 7398110 - DNA, 22 bp, Homo sapiens
ctgtggcctggggacactatct

SEQ ID NO: 7398111 - DNA, 21 bp, Homo sapiens
ctgtggcctggctagcaccgt

SEQ ID NO: 7398112 - DNA, 21 bp, Homo sapiens
ctgtggcctggctagcaccgt

SEQ ID NO: 7398113 - DNA, 21 bp, Homo sapiens
ctgtggcctggctagcaccgt

SEQ ID NO: 7398114 - DNA, 21 bp, Homo sapiens
ctgtggcctggctagcaccgt

SEQ ID NO: 7398115 - DNA, 21 bp, Homo sapiens
ctgtggcctggctagcaccgt

SEQ ID NO: 7398116 - DNA, 19 bp, Homo sapiens
ctgtggcctccaggaggga

SEQ ID NO: 7398117 - DNA, 19 bp, Homo sapiens
ctgtggcctccaggaggga

SEQ ID NO: 7398118 - DNA, 18 bp, Homo sapiens
ctgtgggaagagtttggg

SEQ ID NO: 7398119 - DNA, 18 bp, Homo sapiens
ctgtgggaagagtttggg

SEQ ID NO: 7398120 - DNA, 18 bp, Homo sapiens
ctgtgggaagagtttggg

SEQ ID NO: 7398121 - DNA, 22 bp, Homo sapiens
ctgtgggaacactgaggacttc

SEQ ID NO: 7398122 - DNA, 22 bp, Homo sapiens
ctgtgggaacactgaggacttc

SEQ ID NO: 7398123 - DNA, 22 bp, Homo sapiens
ctgtgggaacactgaggacttc

SEQ ID NO: 7398124 - DNA, 22 bp, Homo sapiens
ctgtggcttttccggggagcct

SEQ ID NO: 7398125 - DNA, 22 bp, Homo sapiens
ctgtgggaacactgaggacttc

SEQ ID NO: 7398126 - DNA, 23 bp, Homo sapiens
ctgtgggaagtcggggagcgcgc

SEQ ID NO: 7398127 - DNA, 18 bp, Homo sapiens
ctgtgggaaggctttcta

SEQ ID NO: 7398128 - DNA, 23 bp, Homo sapiens
ctgtgggaagtcggggagcgcgc

SEQ ID NO: 7398129 - DNA, 22 bp, Homo sapiens
ctgtgggaatactgcgagtgta

SEQ ID NO: 7398130 - DNA, 22 bp, Homo sapiens
ctgtgggaatactgcgagtgta

SEQ ID NO: 7398131 - DNA, 23 bp, Homo sapiens
ctgtgggaagtcggggagcgcgc

SEQ ID NO: 7398132 - DNA, 23 bp, Homo sapiens
ctgtgggaagtcggggagcgcgc

SEQ ID NO: 7398133 - DNA, 21 bp, Homo sapiens
ctgtgggaccaagcactggga

SEQ ID NO: 7398134 - DNA, 22 bp, Homo sapiens
ctgtgggactctgaggaaaagc

SEQ ID NO: 7398135 - DNA, 22 bp, Homo sapiens
ctgtgggactctgaggaaaagc

SEQ ID NO: 7398136 - DNA, 21 bp, Homo sapiens
ctgtgggaccaagcactggga

SEQ ID NO: 7398137 - DNA, 22 bp, Homo sapiens
ctgtgggaatactgcgagtgta

SEQ ID NO: 7398138 - DNA, 21 bp, Homo sapiens
ctgtgggaccaagcactggga

SEQ ID NO: 7398139 - DNA, 22 bp, Homo sapiens
ctgtgggagaagttgctggagt

SEQ ID NO: 7398140 - DNA, 22 bp, Homo sapiens
ctgtgggagaggtgcctggatt

SEQ ID NO: 7398141 - DNA, 22 bp, Homo sapiens
ctgtgggagaagttgctggagt

SEQ ID NO: 7398142 - DNA, 22 bp, Homo sapiens
ctgtgggagaagctagcacagg

SEQ ID NO: 7398143 - DNA, 22 bp, Homo sapiens
ctgtgggagaagctagcacagg

SEQ ID NO: 7398144 - DNA, 22 bp, Homo sapiens
ctgtggctatggtgtacatact

SEQ ID NO: 7398145 - DNA, 22 bp, Homo sapiens
ctgtggctaggaagctgtggga

SEQ ID NO: 7398146 - DNA, 22 bp, Homo sapiens
ctgtggctaggaagctgtggga

SEQ ID NO: 7398147 - DNA, 22 bp, Homo sapiens
ctgtggctaggaagctgtggga

SEQ ID NO: 7398148 - DNA, 22 bp, Homo sapiens
ctgtggctaggaagctgtggga

SEQ ID NO: 7398149 - DNA, 22 bp, Homo sapiens
ctgtggctcaaaatcccatgat

SEQ ID NO: 7398150 - DNA, 22 bp, Homo sapiens
ctgtggctcaaaatcccatgat

SEQ ID NO: 7398151 - DNA, 22 bp, Homo sapiens
ctgtggctcaaaatcccatgat

SEQ ID NO: 7398152 - DNA, 22 bp, Homo sapiens
ctgtggctcaattgcctactga

SEQ ID NO: 7398153 - DNA, 22 bp, Homo sapiens
ctgtggctcaattgcctactga

SEQ ID NO: 7398154 - DNA, 22 bp, Homo sapiens
ctgtggctcaaaatcccatgat

SEQ ID NO: 7398155 - DNA, 22 bp, Homo sapiens
ctgtggctttggggcggaggac

SEQ ID NO: 7398156 - DNA, 22 bp, Homo sapiens
ctgtgggaaaggatgagattgc

SEQ ID NO: 7398157 - DNA, 22 bp, Homo sapiens
ctgtggcttttccggggagcct

SEQ ID NO: 7398158 - DNA, 22 bp, Homo sapiens
ctgtgggaaaggatgagattgc

SEQ ID NO: 7398159 - DNA, 22 bp, Homo sapiens
ctgtggctttggggcggaggac

SEQ ID NO: 7398160 - DNA, 22 bp, Homo sapiens
ctgtggctttggggcggaggac

SEQ ID NO: 7398161 - DNA, 22 bp, Homo sapiens
ctgtggctttggggcggaggac

SEQ ID NO: 7398162 - DNA, 22 bp, Homo sapiens
ctgtggctttgcagggcttgtt

SEQ ID NO: 7398163 - DNA, 22 bp, Homo sapiens
ctgtggctttgcagggcttgtt

SEQ ID NO: 7398164 - DNA, 22 bp, Homo sapiens
ctgtggctcaggcctgtaagcc

SEQ ID NO: 7398165 - DNA, 22 bp, Homo sapiens
ctgtggctttgcagggcttgtt

SEQ ID NO: 7398166 - DNA, 22 bp, Homo sapiens
ctgtggctcaggcctgtaagcc

SEQ ID NO: 7398167 - DNA, 22 bp, Homo sapiens
ctgtggctcagcacggggtcag

SEQ ID NO: 7398168 - DNA, 22 bp, Homo sapiens
ctgtggctcaattgcctactga

SEQ ID NO: 7398169 - DNA, 22 bp, Homo sapiens
ctgtggctcaattgcctactga

SEQ ID NO: 7398170 - DNA, 22 bp, Homo sapiens
ctgtggctcaattgcctactga

SEQ ID NO: 7398171 - DNA, 22 bp, Homo sapiens
atctgatttgtaattttagaaa

SEQ ID NO: 7398172 - DNA, 22 bp, Homo sapiens
atctgatgtcagtgcaattatc

SEQ ID NO: 7398173 - DNA, 22 bp, Homo sapiens
atctgattcattgaaatgggtg

SEQ ID NO: 7398174 - DNA, 22 bp, Homo sapiens
atctgcaggaatgtgtgcagag

SEQ ID NO: 7398175 - DNA, 22 bp, Homo sapiens
atctgcagaggacaggcgagga

SEQ ID NO: 7398176 - DNA, 22 bp, Homo sapiens
atctgcaggatgttaggatgat

SEQ ID NO: 7398177 - DNA, 22 bp, Homo sapiens
atctgcaggaatgtgtgcagag

SEQ ID NO: 7398178 - DNA, 18 bp, Homo sapiens
atctgatgcaattcaata

SEQ ID NO: 7398179 - DNA, 22 bp, Homo sapiens
atctgagtgttggatttattgt

SEQ ID NO: 7398180 - DNA, 22 bp, Homo sapiens
atctgaggtatatgactggcta

SEQ ID NO: 7398181 - DNA, 22 bp, Homo sapiens
atctgagtcaaatatttcattt

SEQ ID NO: 7398182 - DNA, 20 bp, Homo sapiens
atctgaggctgtcgctggaa

SEQ ID NO: 7398183 - DNA, 20 bp, Homo sapiens
atctgaggctgtcgctggaa

SEQ ID NO: 7398184 - DNA, 22 bp, Homo sapiens
atctgacatctactagaacaga

SEQ ID NO: 7398185 - DNA, 22 bp, Homo sapiens
atctgacatctactagaacaga

SEQ ID NO: 7398186 - DNA, 22 bp, Homo sapiens
atctgacaagttgtgtgtatag

SEQ ID NO: 7398187 - DNA, 22 bp, Homo sapiens
atctgacaagttgtgtgtatag

SEQ ID NO: 7398188 - DNA, 22 bp, Homo sapiens
atctgacaagttgtgtgtatag

SEQ ID NO: 7398189 - DNA, 22 bp, Homo sapiens
atctgacaaggccacatattct

SEQ ID NO: 7398190 - DNA, 22 bp, Homo sapiens
atctgacaaggccacatattct

SEQ ID NO: 7398191 - DNA, 22 bp, Homo sapiens
atctgacaaggccacatattct

SEQ ID NO: 7398192 - DNA, 22 bp, Homo sapiens
atctgacaaggccacatattct

SEQ ID NO: 7398193 - DNA, 22 bp, Homo sapiens
atctgacaacctattgacttga

SEQ ID NO: 7398194 - DNA, 22 bp, Homo sapiens
atctgacaaggccacatattct

SEQ ID NO: 7398195 - DNA, 22 bp, Homo sapiens
atctgagatgcaggtgggtgga

SEQ ID NO: 7398196 - DNA, 19 bp, Homo sapiens
atctgaggcctcatctggg

SEQ ID NO: 7398197 - DNA, 19 bp, Homo sapiens
atctgagattataaacaga

SEQ ID NO: 7398198 - DNA, 22 bp, Homo sapiens
atctgacatctccctctgacat

SEQ ID NO: 7398199 - DNA, 22 bp, Homo sapiens
atctgacatctccctctgacat

SEQ ID NO: 7398200 - DNA, 22 bp, Homo sapiens
atctgacatctccctctgacat

SEQ ID NO: 7398201 - DNA, 22 bp, Homo sapiens
atctgacatctactagaacaga

SEQ ID NO: 7398202 - DNA, 22 bp, Homo sapiens
atctgcagtttgttttctcttg

SEQ ID NO: 7398203 - DNA, 22 bp, Homo sapiens
atctgcagtttgttttctcttg

SEQ ID NO: 7398204 - DNA, 22 bp, Homo sapiens
atctgcatgctaagtcttggtt

SEQ ID NO: 7398205 - DNA, 22 bp, Homo sapiens
atctgcatgggtaataacacag

SEQ ID NO: 7398206 - DNA, 22 bp, Homo sapiens
atctgcatgggtaataacacag

SEQ ID NO: 7398207 - DNA, 22 bp, Homo sapiens
cttcttaatgcataaactgtgt

SEQ ID NO: 7398208 - DNA, 22 bp, Homo sapiens
cttcttatctgaaagtaatatt

SEQ ID NO: 7398209 - DNA, 22 bp, Homo sapiens
cttcttgattgctttcaaacca

SEQ ID NO: 7398210 - DNA, 22 bp, Homo sapiens
cttcttcaacctgaaagtttca

SEQ ID NO: 7398211 - DNA, 22 bp, Homo sapiens
cttcttattaatccttctctgt

SEQ ID NO: 7398212 - DNA, 22 bp, Homo sapiens
cttcttgcaattttcatcttat

SEQ ID NO: 7398213 - DNA, 22 bp, Homo sapiens
cttcttggaagtcgtccttcca

SEQ ID NO: 7398214 - DNA, 22 bp, Homo sapiens
cttcttgctgggggcctcagtg

SEQ ID NO: 7398215 - DNA, 22 bp, Homo sapiens
cttcttggctgcaagtctctgt

SEQ ID NO: 7398216 - DNA, 20 bp, Homo sapiens
cttcttggagatggtgtttt

SEQ ID NO: 7398217 - DNA, 20 bp, Homo sapiens
cttcttggagatggtgtttt

SEQ ID NO: 7398218 - DNA, 22 bp, Homo sapiens
cttcttggaagtcgtccttcca

SEQ ID NO: 7398219 - DNA, 21 bp, Homo sapiens
cttcttggggagcagctagac

SEQ ID NO: 7398220 - DNA, 22 bp, Homo sapiens
cttcttgtatctgccgccgagc

SEQ ID NO: 7398221 - DNA, 22 bp, Homo sapiens
cttcttggtgatggcttacctg

SEQ ID NO: 7398222 - DNA, 22 bp, Homo sapiens
cttcttggtgatggcttacctg

SEQ ID NO: 7398223 - DNA, 22 bp, Homo sapiens
atctgaagaatgaatggaatta

SEQ ID NO: 7398224 - DNA, 22 bp, Homo sapiens
atctgaagaggtcatggctgac

SEQ ID NO: 7398225 - DNA, 22 bp, Homo sapiens
atctgaagaggtcatggctgac

SEQ ID NO: 7398226 - DNA, 22 bp, Homo sapiens
atctgaagaggtcatggctgac

SEQ ID NO: 7398227 - DNA, 22 bp, Homo sapiens
atctgaagaatgaatggaatta

SEQ ID NO: 7398228 - DNA, 21 bp, Homo sapiens
atctgaaatgtcaaagcagat

SEQ ID NO: 7398229 - DNA, 21 bp, Homo sapiens
atctgaaatgtcaaagcagat

SEQ ID NO: 7398230 - DNA, 22 bp, Homo sapiens
atctgaaatagtcttatctgag

SEQ ID NO: 7398231 - DNA, 22 bp, Homo sapiens
atctgaaagctaggagttctca

SEQ ID NO: 7398232 - DNA, 22 bp, Homo sapiens
atctgaaagctaggagttctca

SEQ ID NO: 7398233 - DNA, 22 bp, Homo sapiens
atctgaaagctaggagttctca

SEQ ID NO: 7398234 - DNA, 21 bp, Homo sapiens
atctgaaaggttagtgttgag

SEQ ID NO: 7398235 - DNA, 21 bp, Homo sapiens
atctgaaaggttagtgttgag

SEQ ID NO: 7398236 - DNA, 22 bp, Homo sapiens
atctgaaagctaggagttctca

SEQ ID NO: 7398237 - DNA, 22 bp, Homo sapiens
atctgaaagctaggagttctca

SEQ ID NO: 7398238 - DNA, 22 bp, Homo sapiens
atctgaaactctgacattgtct

SEQ ID NO: 7398239 - DNA, 21 bp, Homo sapiens
atctgaaaggttagtgttgag

SEQ ID NO: 7398240 - DNA, 22 bp, Homo sapiens
atctgaaagtttagaattcttg

SEQ ID NO: 7398241 - DNA, 22 bp, Homo sapiens
atctgaaagtttagaattcttg

SEQ ID NO: 7398242 - DNA, 22 bp, Homo sapiens
atctgaaatagtcttatctgag

SEQ ID NO: 7398243 - DNA, 22 bp, Homo sapiens
atctgaagtggagaaaaatata

SEQ ID NO: 7398244 - DNA, 22 bp, Homo sapiens
atctgaagtggagaaaaatata

SEQ ID NO: 7398245 - DNA, 21 bp, Homo sapiens
atctgaagtttgagaggaaag

SEQ ID NO: 7398246 - DNA, 22 bp, Homo sapiens
atctgaagtggagaaaaatata

SEQ ID NO: 7398247 - DNA, 22 bp, Homo sapiens
atctgaagtggagaaaaatata

SEQ ID NO: 7398248 - DNA, 22 bp, Homo sapiens
atctgaagtccttataatctga

SEQ ID NO: 7398249 - DNA, 22 bp, Homo sapiens
atctgaagtccttataatctga

SEQ ID NO: 7398250 - DNA, 22 bp, Homo sapiens
atctgaagtccttataatctga

SEQ ID NO: 7398251 - DNA, 22 bp, Homo sapiens
atctgaataaatttcttttagt

SEQ ID NO: 7398252 - DNA, 21 bp, Homo sapiens
atctgaagtttgagaggaaag

SEQ ID NO: 7398253 - DNA, 21 bp, Homo sapiens
atctgaagtttgagaggaaag

SEQ ID NO: 7398254 - DNA, 22 bp, Homo sapiens
atctgaagtccttataatctga

SEQ ID NO: 7398255 - DNA, 19 bp, Homo sapiens
atctgaagtaggtgcagct

SEQ ID NO: 7398256 - DNA, 19 bp, Homo sapiens
atctgaagtaggtgcagct

SEQ ID NO: 7398257 - DNA, 19 bp, Homo sapiens
atctgaagtaggtgcagct

SEQ ID NO: 7398258 - DNA, 22 bp, Homo sapiens
atctgaagggaagtggaaggca

SEQ ID NO: 7398259 - DNA, 22 bp, Homo sapiens
atctgaagggaagtggaaggca

SEQ ID NO: 7398260 - DNA, 22 bp, Homo sapiens
atctgaagctatctgcacttca

SEQ ID NO: 7398261 - DNA, 22 bp, Homo sapiens
atctgaagggaagtggaaggca

SEQ ID NO: 7398262 - DNA, 22 bp, Homo sapiens
atctgaagaggtcatggctgac

SEQ ID NO: 7398263 - DNA, 22 bp, Homo sapiens
atctgaagctatctgcacttca

SEQ ID NO: 7398264 - DNA, 22 bp, Homo sapiens
atctgaaaaatctcctttgtca

SEQ ID NO: 7398265 - DNA, 22 bp, Homo sapiens
atctctgcgtccccagcatcga

SEQ ID NO: 7398266 - DNA, 22 bp, Homo sapiens
atctctgcgtccccagcatcga

SEQ ID NO: 7398267 - DNA, 22 bp, Homo sapiens
atctctttgatggctcctgtga

SEQ ID NO: 7398268 - DNA, 23 bp, Homo sapiens
atctgaaaagcatttgcagtttg

SEQ ID NO: 7398269 - DNA, 23 bp, Homo sapiens
atctgaaaagcatttgcagtttg

SEQ ID NO: 7398270 - DNA, 22 bp, Homo sapiens
atctgaaactctgacattgtct

SEQ ID NO: 7398271 - DNA, 22 bp, Homo sapiens
atctgaaactctgacattgtct

SEQ ID NO: 7398272 - DNA, 22 bp, Homo sapiens
atctgaaactctgacattgtct

SEQ ID NO: 7398273 - DNA, 22 bp, Homo sapiens
atctgaaactctgacattgtct

SEQ ID NO: 7398274 - DNA, 23 bp, Homo sapiens
atctgaaaagcatttgcagtttg

SEQ ID NO: 7398275 - DNA, 22 bp, Homo sapiens
atctgaaaagctttaatgagct

SEQ ID NO: 7398276 - DNA, 23 bp, Homo sapiens
atctgaaaaggcattttcttccc

SEQ ID NO: 7398277 - DNA, 23 bp, Homo sapiens
atctgaaaaggcattttcttccc

SEQ ID NO: 7398278 - DNA, 23 bp, Homo sapiens
atctgaaaaggcattttcttccc

SEQ ID NO: 7398279 - DNA, 22 bp, Homo sapiens
atctctgatttacagcatctct

SEQ ID NO: 7398280 - DNA, 22 bp, Homo sapiens
atctctgatttacagcatctct

SEQ ID NO: 7398281 - DNA, 22 bp, Homo sapiens
cttcctcctccatctcgaaggc

SEQ ID NO: 7398282 - DNA, 22 bp, Homo sapiens
cttcctcctccatctcgaaggc

SEQ ID NO: 7398283 - DNA, 22 bp, Homo sapiens
cttcctcctccatctcgaaggc

SEQ ID NO: 7398284 - DNA, 22 bp, Homo sapiens
cttcctcctccatctcgaaggc

SEQ ID NO: 7398285 - DNA, 22 bp, Homo sapiens
cttcctccgaagaagttgctgg

SEQ ID NO: 7398286 - DNA, 22 bp, Homo sapiens
cttcctccgaagaagttgctgg

SEQ ID NO: 7398287 - DNA, 22 bp, Homo sapiens
cttcctcccggcccatgctctg

SEQ ID NO: 7398288 - DNA, 22 bp, Homo sapiens
cttcctcccggcccatgctctg

SEQ ID NO: 7398289 - DNA, 22 bp, Homo sapiens
cttcctccgaagaagttgctgg

SEQ ID NO: 7398290 - DNA, 22 bp, Homo sapiens
cttcctccgaagaagttgctgg

SEQ ID NO: 7398291 - DNA, 23 bp, Homo sapiens
cttccagtactgcacactcaagg

SEQ ID NO: 7398292 - DNA, 22 bp, Homo sapiens
cttccagtagtatcattctcat

SEQ ID NO: 7398293 - DNA, 22 bp, Homo sapiens
cttccagtagtatcattctcat

SEQ ID NO: 7398294 - DNA, 22 bp, Homo sapiens
cttccagtagtatcattctcat

SEQ ID NO: 7398295 - DNA, 22 bp, Homo sapiens
cttagatacagtagaaagactc

SEQ ID NO: 7398296 - DNA, 23 bp, Homo sapiens
cttccagtactgcacactcaagg

SEQ ID NO: 7398297 - DNA, 22 bp, Homo sapiens
cttccagtctagagctatctgt

SEQ ID NO: 7398298 - DNA, 22 bp, Homo sapiens
cttccagtcttttcagtggagt

SEQ ID NO: 7398299 - DNA, 22 bp, Homo sapiens
cttccagtctagagctatctgt

SEQ ID NO: 7398300 - DNA, 22 bp, Homo sapiens
cttccagtcttttcagtggagt

SEQ ID NO: 7398301 - DNA, 22 bp, Homo sapiens
cttccagtggcaccaacatgca

SEQ ID NO: 7398302 - DNA, 22 bp, Homo sapiens
cttccagtgcataggtagatca

SEQ ID NO: 7398303 - DNA, 22 bp, Homo sapiens
cttcccaagactgtattgcaag

SEQ ID NO: 7398304 - DNA, 22 bp, Homo sapiens
cttccagtggcaccaacatgca

SEQ ID NO: 7398305 - DNA, 22 bp, Homo sapiens
cttcccacagaattcaatcagt

SEQ ID NO: 7398306 - DNA, 21 bp, Homo sapiens
cttcccaaggcttcaaagcct

SEQ ID NO: 7398307 - DNA, 22 bp, Homo sapiens
cttcccaagtaaatttgtattt

SEQ ID NO: 7398308 - DNA, 22 bp, Homo sapiens
cttcccacagaattcaatcagt

SEQ ID NO: 7398309 - DNA, 17 bp, Homo sapiens
cttcccaccatctcctg

SEQ ID NO: 7398310 - DNA, 17 bp, Homo sapiens
cttcccaccatctcctg

SEQ ID NO: 7398311 - DNA, 17 bp, Homo sapiens
cttcccaccatctcctg

SEQ ID NO: 7398312 - DNA, 22 bp, Homo sapiens
cttcccaccaaagcccttgttg

SEQ ID NO: 7398313 - DNA, 22 bp, Homo sapiens
cttcccaccaaagcccttgttg

SEQ ID NO: 7398314 - DNA, 22 bp, Homo sapiens
cttcccaccaaagcccttgttg

SEQ ID NO: 7398315 - DNA, 22 bp, Homo sapiens
cttcccaccaaagcccttgttg

SEQ ID NO: 7398316 - DNA, 22 bp, Homo sapiens
cttcccactaaagcccttgttg

SEQ ID NO: 7398317 - DNA, 22 bp, Homo sapiens
cttcccactaaagcccttgttg

SEQ ID NO: 7398318 - DNA, 17 bp, Homo sapiens
cttcccaccatctcctg

SEQ ID NO: 7398319 - DNA, 22 bp, Homo sapiens
cttcccactaaagcccttgttg

SEQ ID NO: 7398320 - DNA, 22 bp, Homo sapiens
cttcccactaaagcccttgttg

SEQ ID NO: 7398321 - DNA, 22 bp, Homo sapiens
cttcccactagtatcacagagc

SEQ ID NO: 7398322 - DNA, 22 bp, Homo sapiens
cttcccactagtatcacagagc

SEQ ID NO: 7398323 - DNA, 22 bp, Homo sapiens
cttcccactagtatcacagagc

SEQ ID NO: 7398324 - DNA, 22 bp, Homo sapiens
cttcctaaaagcttcaagagaa

SEQ ID NO: 7398325 - DNA, 22 bp, Homo sapiens
cttcctaaaagcttcaagagaa

SEQ ID NO: 7398326 - DNA, 22 bp, Homo sapiens
cttcccagaacaatgtaggctt

SEQ ID NO: 7398327 - DNA, 22 bp, Homo sapiens
cttcccagaacaatgtaggctt

SEQ ID NO: 7398328 - DNA, 22 bp, Homo sapiens
cttcccagaacaatgtaggctt

SEQ ID NO: 7398329 - DNA, 22 bp, Homo sapiens
cttcccagaacaatgtaggctt

SEQ ID NO: 7398330 - DNA, 22 bp, Homo sapiens
cttcctagagccggcagtgagg

SEQ ID NO: 7398331 - DNA, 22 bp, Homo sapiens
cttcctagcttcagagtctgtt

SEQ ID NO: 7398332 - DNA, 22 bp, Homo sapiens
cttcctagcttcagagtctgtt

SEQ ID NO: 7398333 - DNA, 22 bp, Homo sapiens
cttcctcacggtgcaacaggaa

SEQ ID NO: 7398334 - DNA, 22 bp, Homo sapiens
cttcctcaggcattagctggac

SEQ ID NO: 7398335 - DNA, 22 bp, Homo sapiens
cttcctcacggtgcaacaggaa

SEQ ID NO: 7398336 - DNA, 22 bp, Homo sapiens
cttcctcaggcattagctggac

SEQ ID NO: 7398337 - DNA, 18 bp, Homo sapiens
cttcctcatcgctctccc

SEQ ID NO: 7398338 - DNA, 18 bp, Homo sapiens
cttcctcatcgctctccc

SEQ ID NO: 7398339 - DNA, 18 bp, Homo sapiens
cttcctcatcgctctccc

SEQ ID NO: 7398340 - DNA, 22 bp, Homo sapiens
cttcctcccccacacactcact

SEQ ID NO: 7398341 - DNA, 22 bp, Homo sapiens
cttcctcccccacacactcact

SEQ ID NO: 7398342 - DNA, 22 bp, Homo sapiens
cttcctcatgtgcaatgcaagc

SEQ ID NO: 7398343 - DNA, 22 bp, Homo sapiens
cttcctcatgtgcaatgcaagc

SEQ ID NO: 7398344 - DNA, 22 bp, Homo sapiens
cttcctcccggcccatgctctg

SEQ ID NO: 7398345 - DNA, 22 bp, Homo sapiens
cttcctcccccacacactcact

SEQ ID NO: 7398346 - DNA, 22 bp, Homo sapiens
cttcctcccccacacactcact

SEQ ID NO: 7398347 - DNA, 22 bp, Homo sapiens
cttcctcccccacacactcact

SEQ ID NO: 7398348 - DNA, 22 bp, Homo sapiens
cttcctcccggcccatgctctg

SEQ ID NO: 7398349 - DNA, 22 bp, Homo sapiens
cttcctcccggcccatgctctg

SEQ ID NO: 7398350 - DNA, 22 bp, Homo sapiens
cttagaaattgttactcattca

SEQ ID NO: 7398351 - DNA, 22 bp, Homo sapiens
cttagaaattgttactcattca

SEQ ID NO: 7398352 - DNA, 22 bp, Homo sapiens
cttagaaattgttactcattca

SEQ ID NO: 7398353 - DNA, 22 bp, Homo sapiens
atcctgtgttgctactggagga

SEQ ID NO: 7398354 - DNA, 22 bp, Homo sapiens
atcctgtgttgctactggagga

SEQ ID NO: 7398355 - DNA, 22 bp, Homo sapiens
atcctgttagcaccttcaaact

SEQ ID NO: 7398356 - DNA, 22 bp, Homo sapiens
atcctgtttgtcactagaaaat

SEQ ID NO: 7398357 - DNA, 22 bp, Homo sapiens
atcctgtggggcggctgcaggg

SEQ ID NO: 7398358 - DNA, 22 bp, Homo sapiens
atcctgtggctccagggagccg

SEQ ID NO: 7398359 - DNA, 22 bp, Homo sapiens
atcctgtggggcggctgcaggg

SEQ ID NO: 7398360 - DNA, 22 bp, Homo sapiens
atcctgtggccctgcctctgct

SEQ ID NO: 7398361 - DNA, 21 bp, Homo sapiens
atcctgtgagtctcagtcccc

SEQ ID NO: 7398362 - DNA, 22 bp, Homo sapiens
atcctgtggctccagggagccg

SEQ ID NO: 7398363 - DNA, 22 bp, Homo sapiens
atcctgtgcaatgactgcatct

SEQ ID NO: 7398364 - DNA, 22 bp, Homo sapiens
atcctgtgcaatgactgcatct

SEQ ID NO: 7398365 - DNA, 22 bp, Homo sapiens
cttagaaggatgtttgctgttt

SEQ ID NO: 7398366 - DNA, 22 bp, Homo sapiens
cttagaaggatgtttgctgttt

SEQ ID NO: 7398367 - DNA, 22 bp, Homo sapiens
cttagaaggaacagtttagtgc

SEQ ID NO: 7398368 - DNA, 22 bp, Homo sapiens
cttagaacattctgcctgggaa

SEQ ID NO: 7398369 - DNA, 22 bp, Homo sapiens
cttagaaattgttactcattca

SEQ ID NO: 7398370 - DNA, 22 bp, Homo sapiens
cttagaaattgttactcattca

SEQ ID NO: 7398371 - DNA, 22 bp, Homo sapiens
cttagaaattgttactcattca

SEQ ID NO: 7398372 - DNA, 20 bp, Homo sapiens
cttagaaatttttaccctgg

SEQ ID NO: 7398373 - DNA, 20 bp, Homo sapiens
cttagaaatttttaccctgg

SEQ ID NO: 7398374 - DNA, 20 bp, Homo sapiens
cttagaaatttttaccctgg

SEQ ID NO: 7398375 - DNA, 20 bp, Homo sapiens
cttagaaatttttaccctgg

SEQ ID NO: 7398376 - DNA, 22 bp, Homo sapiens
cttagagatgggttttacttag

SEQ ID NO: 7398377 - DNA, 22 bp, Homo sapiens
cttagagatgggttttacttag

SEQ ID NO: 7398378 - DNA, 22 bp, Homo sapiens
cttagagatgggttttacttag

SEQ ID NO: 7398379 - DNA, 22 bp, Homo sapiens
cttagagccttactcttcttgt

SEQ ID NO: 7398380 - DNA, 22 bp, Homo sapiens
cttagagatgggttttacttag

SEQ ID NO: 7398381 - DNA, 22 bp, Homo sapiens
cttagagatgggttttacttag

SEQ ID NO: 7398382 - DNA, 22 bp, Homo sapiens
cttagagatgggttttacttag

SEQ ID NO: 7398383 - DNA, 22 bp, Homo sapiens
cttagagatgggttttacttag

SEQ ID NO: 7398384 - DNA, 22 bp, Homo sapiens
cttagagatgggttttacttag

SEQ ID NO: 7398385 - DNA, 22 bp, Homo sapiens
cttagagatgggttttacttag

SEQ ID NO: 7398386 - DNA, 22 bp, Homo sapiens
cttagagatgggttttacttag

SEQ ID NO: 7398387 - DNA, 22 bp, Homo sapiens
cttagagatgggttttacttag

SEQ ID NO: 7398388 - DNA, 22 bp, Homo sapiens
cttagacatggcagctccaagt

SEQ ID NO: 7398389 - DNA, 22 bp, Homo sapiens
cttagagcttaggctagccatt

SEQ ID NO: 7398390 - DNA, 22 bp, Homo sapiens
cttagagccttactcttcttgt

SEQ ID NO: 7398391 - DNA, 22 bp, Homo sapiens
cttagatgaagtcacagaaccc

SEQ ID NO: 7398392 - DNA, 22 bp, Homo sapiens
cttagatgaagtcacagaaccc

SEQ ID NO: 7398393 - DNA, 22 bp, Homo sapiens
cttcattaaccaaaatgcaata

SEQ ID NO: 7398394 - DNA, 22 bp, Homo sapiens
cttagatgaagtcacagaaccc

SEQ ID NO: 7398395 - DNA, 22 bp, Homo sapiens
cttcattaaccaaaatgcaata

SEQ ID NO: 7398396 - DNA, 22 bp, Homo sapiens
cttcattaaccaaaatgcaata

SEQ ID NO: 7398397 - DNA, 22 bp, Homo sapiens
cttcattaatgtctataagttt

SEQ ID NO: 7398398 - DNA, 22 bp, Homo sapiens
cttcattaactattggaatgca

SEQ ID NO: 7398399 - DNA, 22 bp, Homo sapiens
cttcattaactattggaatgca

SEQ ID NO: 7398400 - DNA, 22 bp, Homo sapiens
cttcattaactattggaatgca

SEQ ID NO: 7398401 - DNA, 22 bp, Homo sapiens
cttcattaatgtctataagttt

SEQ ID NO: 7398402 - DNA, 22 bp, Homo sapiens
cttccaggtccttcttgagaag

SEQ ID NO: 7398403 - DNA, 22 bp, Homo sapiens
cttccaggtgctggcctggcct

SEQ ID NO: 7398404 - DNA, 22 bp, Homo sapiens
cttccaggtgctggcctggcct

SEQ ID NO: 7398405 - DNA, 19 bp, Homo sapiens
atacagatgtatccatgat

SEQ ID NO: 7398406 - DNA, 22 bp, Homo sapiens
ctggagagaatgttcattgcag

SEQ ID NO: 7398407 - DNA, 22 bp, Homo sapiens
ctggagagaccgaaagaggctg

SEQ ID NO: 7398408 - DNA, 22 bp, Homo sapiens
ctggagagaatgttcattgcag

SEQ ID NO: 7398409 - DNA, 22 bp, Homo sapiens
ctggagagaatgttcattgcag

SEQ ID NO: 7398410 - DNA, 22 bp, Homo sapiens
ctggagagaatgtggaatgatt

SEQ ID NO: 7398411 - DNA, 22 bp, Homo sapiens
ctggagagaatgtggaatgatt

SEQ ID NO: 7398412 - DNA, 22 bp, Homo sapiens
ctggagagaatgttcattgcag

SEQ ID NO: 7398413 - DNA, 22 bp, Homo sapiens
ctggagagaatgttcattgcag

SEQ ID NO: 7398414 - DNA, 22 bp, Homo sapiens
atacagatgttaaagcaatttc

SEQ ID NO: 7398415 - DNA, 22 bp, Homo sapiens
atacagatgttaaagcaatttc

SEQ ID NO: 7398416 - DNA, 22 bp, Homo sapiens
atacagtaaccacattctatag

SEQ ID NO: 7398417 - DNA, 19 bp, Homo sapiens
atacagtaaggtgtttgcc

SEQ ID NO: 7398418 - DNA, 19 bp, Homo sapiens
atacagtaaggtgtttgcc

SEQ ID NO: 7398419 - DNA, 22 bp, Homo sapiens
atacagtagggaccatgtctga

SEQ ID NO: 7398420 - DNA, 22 bp, Homo sapiens
atacagtagacaatctcatgaa

SEQ ID NO: 7398421 - DNA, 22 bp, Homo sapiens
atacagtagggaccatgtctga

SEQ ID NO: 7398422 - DNA, 22 bp, Homo sapiens
atacagtagggaccatgtctga

SEQ ID NO: 7398423 - DNA, 22 bp, Homo sapiens
atacagtagggaccatgtctga

SEQ ID NO: 7398424 - DNA, 22 bp, Homo sapiens
atacagtagggaccatgtctga

SEQ ID NO: 7398425 - DNA, 22 bp, Homo sapiens
atacagtagacaatctcatgaa

SEQ ID NO: 7398426 - DNA, 22 bp, Homo sapiens
atacagtagacaatctcatgaa

SEQ ID NO: 7398427 - DNA, 22 bp, Homo sapiens
atacagtaatttgtaactcatc

SEQ ID NO: 7398428 - DNA, 22 bp, Homo sapiens
atacagtagacaatctcatgaa

SEQ ID NO: 7398429 - DNA, 22 bp, Homo sapiens
atacagtagacaatctcatgaa

SEQ ID NO: 7398430 - DNA, 22 bp, Homo sapiens
atacagtagacaatctcatgaa

SEQ ID NO: 7398431 - DNA, 22 bp, Homo sapiens
atacagtaattgcataggcttc

SEQ ID NO: 7398432 - DNA, 22 bp, Homo sapiens
atacagtaagtgtccctgaaac

SEQ ID NO: 7398433 - DNA, 22 bp, Homo sapiens
atacagtaagtgtccctgaaac

SEQ ID NO: 7398434 - DNA, 22 bp, Homo sapiens
atacagtaatttgtaactcatc

SEQ ID NO: 7398435 - DNA, 22 bp, Homo sapiens
atacagtaatttgtaactcatc

SEQ ID NO: 7398436 - DNA, 22 bp, Homo sapiens
atacagtaatttgtaactcatc

SEQ ID NO: 7398437 - DNA, 22 bp, Homo sapiens
atacagtaattgccctgcaatg

SEQ ID NO: 7398438 - DNA, 22 bp, Homo sapiens
atacagtaatttgtaactcatc

SEQ ID NO: 7398439 - DNA, 22 bp, Homo sapiens
atacagtaatttgtaactcatc

SEQ ID NO: 7398440 - DNA, 22 bp, Homo sapiens
atacagtaatttgtaactcatc

SEQ ID NO: 7398441 - DNA, 22 bp, Homo sapiens
atacagtaatttgtaactcatc

SEQ ID NO: 7398442 - DNA, 22 bp, Homo sapiens
atacagtaatttgtaactcatc

SEQ ID NO: 7398443 - DNA, 22 bp, Homo sapiens
ctggaatgtatgtatcttaaga

SEQ ID NO: 7398444 - DNA, 22 bp, Homo sapiens
ctggaatgtctgctcaatgttt

SEQ ID NO: 7398445 - DNA, 22 bp, Homo sapiens
ctggaatgtctgctcaatgttt

SEQ ID NO: 7398446 - DNA, 22 bp, Homo sapiens
ctggagaagccaaactagtcac

SEQ ID NO: 7398447 - DNA, 22 bp, Homo sapiens
ctggagaagccaaactagtcac

SEQ ID NO: 7398448 - DNA, 19 bp, Homo sapiens
ctggaatgtggctggtgca

SEQ ID NO: 7398449 - DNA, 22 bp, Homo sapiens
ctggagaagaggtagtatgtag

SEQ ID NO: 7398450 - DNA, 22 bp, Homo sapiens
ctggagaagcattcaaataatt

SEQ ID NO: 7398451 - DNA, 22 bp, Homo sapiens
ctggagaagcattcaaataatt

SEQ ID NO: 7398452 - DNA, 22 bp, Homo sapiens
ctggagaagtactgagacattt

SEQ ID NO: 7398453 - DNA, 22 bp, Homo sapiens
ctggagaagtactgagacattt

SEQ ID NO: 7398454 - DNA, 22 bp, Homo sapiens
ctggagaagtactgagacattt

SEQ ID NO: 7398455 - DNA, 22 bp, Homo sapiens
ctggagaagtactgagacattt

SEQ ID NO: 7398456 - DNA, 17 bp, Homo sapiens
ctggagaagcctgtgga

SEQ ID NO: 7398457 - DNA, 22 bp, Homo sapiens
ctggagaagtactgagacattt

SEQ ID NO: 7398458 - DNA, 17 bp, Homo sapiens
ctggagaagcctgtgga

SEQ ID NO: 7398459 - DNA, 22 bp, Homo sapiens
ctggagaagccaaactagtcac

SEQ ID NO: 7398460 - DNA, 22 bp, Homo sapiens
ctggagaattctatgaaatatt

SEQ ID NO: 7398461 - DNA, 22 bp, Homo sapiens
ctggagaattctatgaaatatt

SEQ ID NO: 7398462 - DNA, 22 bp, Homo sapiens
ctggagacctctcctgagagtg

SEQ ID NO: 7398463 - DNA, 22 bp, Homo sapiens
ctggagacctctcctgagagtg

SEQ ID NO: 7398464 - DNA, 22 bp, Homo sapiens
ctggagacctctcctgagagtg

SEQ ID NO: 7398465 - DNA, 22 bp, Homo sapiens
ctggagagaaatgacaaagcta

SEQ ID NO: 7398466 - DNA, 22 bp, Homo sapiens
ctggagagaaatgacaaagcta

SEQ ID NO: 7398467 - DNA, 22 bp, Homo sapiens
ctggagacctctcctgagagtg

SEQ ID NO: 7398468 - DNA, 22 bp, Homo sapiens
ctggagacctctcctgagagtg

SEQ ID NO: 7398469 - DNA, 22 bp, Homo sapiens
ctggagagaatgtggaatgatt

SEQ ID NO: 7398470 - DNA, 22 bp, Homo sapiens
ctggagagaatgtggaatgatt

SEQ ID NO: 7398471 - DNA, 22 bp, Homo sapiens
ctggagagaatgtggaatgatt

SEQ ID NO: 7398472 - DNA, 22 bp, Homo sapiens
ctggagagaatgtggaatgatt

SEQ ID NO: 7398473 - DNA, 22 bp, Homo sapiens
ctggagagaatgtggaatgatt

SEQ ID NO: 7398474 - DNA, 22 bp, Homo sapiens
ctggagagaatgtggaatgatt

SEQ ID NO: 7398475 - DNA, 22 bp, Homo sapiens
ctggagagaaatgacaaagcta

SEQ ID NO: 7398476 - DNA, 22 bp, Homo sapiens
ctggagagaatgtggaatgatt

SEQ ID NO: 7398477 - DNA, 22 bp, Homo sapiens
ctggagagaaatgacaaagcta

SEQ ID NO: 7398478 - DNA, 22 bp, Homo sapiens
ctggagagaaatgacaaagcta

SEQ ID NO: 7398479 - DNA, 22 bp, Homo sapiens
ctggaatgaagctatgtacatt

SEQ ID NO: 7398480 - DNA, 22 bp, Homo sapiens
ctggaatgaagctatgtacatt

SEQ ID NO: 7398481 - DNA, 22 bp, Homo sapiens
ctggaatatttgtaggatgaaa

SEQ ID NO: 7398482 - DNA, 22 bp, Homo sapiens
ctggaatctttggagaatgtgg

SEQ ID NO: 7398483 - DNA, 19 bp, Homo sapiens
ctggaatgagaacatgccc

SEQ ID NO: 7398484 - DNA, 19 bp, Homo sapiens
ctggaatgagaacatgccc

SEQ ID NO: 7398485 - DNA, 22 bp, Homo sapiens
ctggaatgagagcccggggatc

SEQ ID NO: 7398486 - DNA, 22 bp, Homo sapiens
ctggaatgagcagggcttatgg

SEQ ID NO: 7398487 - DNA, 22 bp, Homo sapiens
ctggaatgagcagggcttatgg

SEQ ID NO: 7398488 - DNA, 22 bp, Homo sapiens
ctggaatgagcagggcttatgg

SEQ ID NO: 7398489 - DNA, 22 bp, Homo sapiens
ctggaatgcctccctgtcagag

SEQ ID NO: 7398490 - DNA, 22 bp, Homo sapiens
ctggaatgcctccctgtcagag

SEQ ID NO: 7398491 - DNA, 22 bp, Homo sapiens
ctggaatgattgaaaaggaatg

SEQ ID NO: 7398492 - DNA, 19 bp, Homo sapiens
ctggaatgatagagacctc

SEQ ID NO: 7398493 - DNA, 19 bp, Homo sapiens
ctggaatgatagagacctc

SEQ ID NO: 7398494 - DNA, 22 bp, Homo sapiens
ctggaatgagcagggcttatgg

SEQ ID NO: 7398495 - DNA, 19 bp, Homo sapiens
ctggaatgatagagacctc

SEQ ID NO: 7398496 - DNA, 22 bp, Homo sapiens
ctggaatgtagagacagcttag

SEQ ID NO: 7398497 - DNA, 22 bp, Homo sapiens
ctggaatgtatgggaacccaaa

SEQ ID NO: 7398498 - DNA, 22 bp, Homo sapiens
ctggaatgtagagacagcttag

SEQ ID NO: 7398499 - DNA, 22 bp, Homo sapiens
ctggaatgtatgggaacccaaa

SEQ ID NO: 7398500 - DNA, 20 bp, Homo sapiens
ctggaatgggtgtgggttag

SEQ ID NO: 7398501 - DNA, 20 bp, Homo sapiens
ctggaatgggtgtgggttag

SEQ ID NO: 7398502 - DNA, 22 bp, Homo sapiens
ctggaatgggtttcaggcactg

SEQ ID NO: 7398503 - DNA, 22 bp, Homo sapiens
ctggaatgggtttcaggcactg

SEQ ID NO: 7398504 - DNA, 22 bp, Homo sapiens
ctggaatgggccatttgaggcc

SEQ ID NO: 7398505 - DNA, 22 bp, Homo sapiens
ctggaatgggccatttgaggcc

SEQ ID NO: 7398506 - DNA, 22 bp, Homo sapiens
ctggaatgggagtcagacagag

SEQ ID NO: 7398507 - DNA, 22 bp, Homo sapiens
ctggaatgggaatcaggaaaga

SEQ ID NO: 7398508 - DNA, 22 bp, Homo sapiens
ctggaatgggaatcaggaaaga

SEQ ID NO: 7398509 - DNA, 22 bp, Homo sapiens
ctggaatgcggagagttggaga

SEQ ID NO: 7398510 - DNA, 22 bp, Homo sapiens
ctggaatgcggagagttggaga

SEQ ID NO: 7398511 - DNA, 22 bp, Homo sapiens
ctggaatgctggtaaaatagca

SEQ ID NO: 7398512 - DNA, 22 bp, Homo sapiens
ctggaatggcaatgggaagtcc

SEQ ID NO: 7398513 - DNA, 22 bp, Homo sapiens
ctggaagtggggttggcttgaa

SEQ ID NO: 7398514 - DNA, 22 bp, Homo sapiens
ctggaagttggaactgatatga

SEQ ID NO: 7398515 - DNA, 22 bp, Homo sapiens
ctggaagtggggttggcttgaa

SEQ ID NO: 7398516 - DNA, 22 bp, Homo sapiens
ctggaagtggggttggcttgaa

SEQ ID NO: 7398517 - DNA, 22 bp, Homo sapiens
ctggaagtttccttcctggtca

SEQ ID NO: 7398518 - DNA, 22 bp, Homo sapiens
ctggaagtttccttcctggtca

SEQ ID NO: 7398519 - DNA, 22 bp, Homo sapiens
ctggaataaacgatcttcagca

SEQ ID NO: 7398520 - DNA, 22 bp, Homo sapiens
ctggaataaacgatcttcagca

SEQ ID NO: 7398521 - DNA, 22 bp, Homo sapiens
ctggaataaacgatcttcagca

SEQ ID NO: 7398522 - DNA, 22 bp, Homo sapiens
ctgctgccattagggcacagac

SEQ ID NO: 7398523 - DNA, 22 bp, Homo sapiens
ctggaagagcatttgcataggg

SEQ ID NO: 7398524 - DNA, 22 bp, Homo sapiens
ctggaagactcaatggcctgcc

SEQ ID NO: 7398525 - DNA, 22 bp, Homo sapiens
ctgctgccattagggcacagac

SEQ ID NO: 7398526 - DNA, 22 bp, Homo sapiens
ctgctgccattagggcacagac

SEQ ID NO: 7398527 - DNA, 22 bp, Homo sapiens
ctggaagagcatttgcataggg

SEQ ID NO: 7398528 - DNA, 22 bp, Homo sapiens
ctggaagaggaagccagctgga

SEQ ID NO: 7398529 - DNA, 22 bp, Homo sapiens
ctggaagagcatttgcataggg

SEQ ID NO: 7398530 - DNA, 18 bp, Homo sapiens
ctgctgcaggcactcagg

SEQ ID NO: 7398531 - DNA, 18 bp, Homo sapiens
ctgctgcaggcactcagg

SEQ ID NO: 7398532 - DNA, 22 bp, Homo sapiens
ctgctgcaggatgggcactctg

SEQ ID NO: 7398533 - DNA, 22 bp, Homo sapiens
ctgctgcaattatctgggtgtg

SEQ ID NO: 7398534 - DNA, 22 bp, Homo sapiens
ctgctgcagatgacagacccaa

SEQ ID NO: 7398535 - DNA, 22 bp, Homo sapiens
ctgctgcaattatctgggtgtg

SEQ ID NO: 7398536 - DNA, 22 bp, Homo sapiens
ctgctgcaattatctgggtgtg

SEQ ID NO: 7398537 - DNA, 22 bp, Homo sapiens
ctgctgcaattatctgggtgtg

SEQ ID NO: 7398538 - DNA, 22 bp, Homo sapiens
ctgctgcaggatgggcactctg

SEQ ID NO: 7398539 - DNA, 22 bp, Homo sapiens
ctgctgccaagggtgccacagg

SEQ ID NO: 7398540 - DNA, 22 bp, Homo sapiens
ctgctgccaagggtgccacagg

SEQ ID NO: 7398541 - DNA, 22 bp, Homo sapiens
ctgctgccaagggtgccacagg

SEQ ID NO: 7398542 - DNA, 22 bp, Homo sapiens
ctgctgcattcctctttatgag

SEQ ID NO: 7398543 - DNA, 22 bp, Homo sapiens
ctgctgcattactcttctcaag

SEQ ID NO: 7398544 - DNA, 22 bp, Homo sapiens
ctgctgcattactcttctcaag

SEQ ID NO: 7398545 - DNA, 22 bp, Homo sapiens
ctgctgcattactcttctcaag

SEQ ID NO: 7398546 - DNA, 22 bp, Homo sapiens
ctgctgcattactcttctcaag

SEQ ID NO: 7398547 - DNA, 22 bp, Homo sapiens
atacatagcagggtagtagatc

SEQ ID NO: 7398548 - DNA, 22 bp, Homo sapiens
atacatagcagggtagtagatc

SEQ ID NO: 7398549 - DNA, 22 bp, Homo sapiens
atacatagctgaaaacttgtag

SEQ ID NO: 7398550 - DNA, 22 bp, Homo sapiens
atacatagctgaaaacttgtag

SEQ ID NO: 7398551 - DNA, 22 bp, Homo sapiens
atacatagcagggtagtagatc

SEQ ID NO: 7398552 - DNA, 22 bp, Homo sapiens
atacatagcagagtcaattaat

SEQ ID NO: 7398553 - DNA, 22 bp, Homo sapiens
atacatagatagataatctggc

SEQ ID NO: 7398554 - DNA, 22 bp, Homo sapiens
atacatacgtacatacgtatgt

SEQ ID NO: 7398555 - DNA, 22 bp, Homo sapiens
atacatagatagataatctggc

SEQ ID NO: 7398556 - DNA, 22 bp, Homo sapiens
atacatacgtacatacgtatgt

SEQ ID NO: 7398557 - DNA, 22 bp, Homo sapiens
atacatacgtacatacgtatgt

SEQ ID NO: 7398558 - DNA, 22 bp, Homo sapiens
atacatacatgtatgcacatac

SEQ ID NO: 7398559 - DNA, 22 bp, Homo sapiens
atacatacatgtatgcacatac

SEQ ID NO: 7398560 - DNA, 22 bp, Homo sapiens
atacatacatgtatgcacatac

SEQ ID NO: 7398561 - DNA, 22 bp, Homo sapiens
atacatacgtacatacgtatgt

SEQ ID NO: 7398562 - DNA, 22 bp, Homo sapiens
atacatacgtacatacgtatgt

SEQ ID NO: 7398563 - DNA, 22 bp, Homo sapiens
atacatacgtacatacgtatgt

SEQ ID NO: 7398564 - DNA, 22 bp, Homo sapiens
atacatacgtacatacgtatgt

SEQ ID NO: 7398565 - DNA, 22 bp, Homo sapiens
atacatacatgtatgcacatac

SEQ ID NO: 7398566 - DNA, 17 bp, Homo sapiens
atacagtttattttaca

SEQ ID NO: 7398567 - DNA, 17 bp, Homo sapiens
atacagtttattttaca

SEQ ID NO: 7398568 - DNA, 17 bp, Homo sapiens
atacagtttattttaca

SEQ ID NO: 7398569 - DNA, 22 bp, Homo sapiens
atacagttatagtcagggctaa

SEQ ID NO: 7398570 - DNA, 22 bp, Homo sapiens
atacagtttaccacactccttg

SEQ ID NO: 7398571 - DNA, 17 bp, Homo sapiens
atacagtttattttaca

SEQ ID NO: 7398572 - DNA, 22 bp, Homo sapiens
atacataattacttccgatgtt

SEQ ID NO: 7398573 - DNA, 22 bp, Homo sapiens
atacataattacttccgatgtt

SEQ ID NO: 7398574 - DNA, 22 bp, Homo sapiens
atacataattacttccgatgtt

SEQ ID NO: 7398575 - DNA, 23 bp, Homo sapiens
atacatacagtcttactgacttt

SEQ ID NO: 7398576 - DNA, 22 bp, Homo sapiens
atacatacatgtacacataaat

SEQ ID NO: 7398577 - DNA, 22 bp, Homo sapiens
atacatacatgtacacataaat

SEQ ID NO: 7398578 - DNA, 23 bp, Homo sapiens
atacatacagtcttactgacttt

SEQ ID NO: 7398579 - DNA, 23 bp, Homo sapiens
atacatacagtcttactgacttt

SEQ ID NO: 7398580 - DNA, 23 bp, Homo sapiens
atacatacagtcttactgacttt

SEQ ID NO: 7398581 - DNA, 23 bp, Homo sapiens
atacatacagtcttactgacttt

SEQ ID NO: 7398582 - DNA, 22 bp, Homo sapiens
atacatacatgtatgcacatac

SEQ ID NO: 7398583 - DNA, 22 bp, Homo sapiens
atacatacatgtatgcacatac

SEQ ID NO: 7398584 - DNA, 22 bp, Homo sapiens
atacatacatgtatgcacatac

SEQ ID NO: 7398585 - DNA, 22 bp, Homo sapiens
atacatacatgtacacataaat

SEQ ID NO: 7398586 - DNA, 22 bp, Homo sapiens
atacatacatgtacacataaat

SEQ ID NO: 7398587 - DNA, 22 bp, Homo sapiens
atacagtgccccttttcacatg

SEQ ID NO: 7398588 - DNA, 22 bp, Homo sapiens
atacagtgccccttttcacatg

SEQ ID NO: 7398589 - DNA, 22 bp, Homo sapiens
atacagtgcacaacctgtgcag

SEQ ID NO: 7398590 - DNA, 22 bp, Homo sapiens
atacagtggctgtgagctgggc

SEQ ID NO: 7398591 - DNA, 22 bp, Homo sapiens
atacagtgtactatttagcagt

SEQ ID NO: 7398592 - DNA, 22 bp, Homo sapiens
atacagtgtactatttagcagt

SEQ ID NO: 7398593 - DNA, 22 bp, Homo sapiens
atacagttagaaaaaaagcctt

SEQ ID NO: 7398594 - DNA, 22 bp, Homo sapiens
atacagttagaaaaaaagcctt

SEQ ID NO: 7398595 - DNA, 22 bp, Homo sapiens
atacagttagaaaaaaagcctt

SEQ ID NO: 7398596 - DNA, 21 bp, Homo sapiens
atacagtggtatgaatgtagg

SEQ ID NO: 7398597 - DNA, 22 bp, Homo sapiens
atacagtgtactatttagcagt

SEQ ID NO: 7398598 - DNA, 22 bp, Homo sapiens
atacagtgtactatttagcagt

SEQ ID NO: 7398599 - DNA, 22 bp, Homo sapiens
atacagtgagaataattcttag

SEQ ID NO: 7398600 - DNA, 22 bp, Homo sapiens
atacagtgaatacttacagtgt

SEQ ID NO: 7398601 - DNA, 22 bp, Homo sapiens
atacagtgaatacttacagtgt

SEQ ID NO: 7398602 - DNA, 22 bp, Homo sapiens
atacagtgaatacttacagtgt

SEQ ID NO: 7398603 - DNA, 22 bp, Homo sapiens
atacagtgagaataattcttag

SEQ ID NO: 7398604 - DNA, 22 bp, Homo sapiens
atacagtgcacaacctgtgcag

SEQ ID NO: 7398605 - DNA, 22 bp, Homo sapiens
atacagtgccccttttcacatg

SEQ ID NO: 7398606 - DNA, 22 bp, Homo sapiens
atacagtgccccttttcacatg

SEQ ID NO: 7398607 - DNA, 22 bp, Homo sapiens
atacagtgccccttttcacatg

SEQ ID NO: 7398608 - DNA, 22 bp, Homo sapiens
atacagtgaatacttacagtgt

SEQ ID NO: 7398609 - DNA, 22 bp, Homo sapiens
atacagtcagactttagccatt

SEQ ID NO: 7398610 - DNA, 22 bp, Homo sapiens
atacagtcttcatattaagttt

SEQ ID NO: 7398611 - DNA, 22 bp, Homo sapiens
atacagtcttcatattaagttt

SEQ ID NO: 7398612 - DNA, 22 bp, Homo sapiens
atacagtcttcatattaagttt

SEQ ID NO: 7398613 - DNA, 22 bp, Homo sapiens
atacagtcttcatattaagttt

SEQ ID NO: 7398614 - DNA, 22 bp, Homo sapiens
atacagtcagactttagccatt

SEQ ID NO: 7398615 - DNA, 22 bp, Homo sapiens
atacagtcagactttagccatt

SEQ ID NO: 7398616 - DNA, 20 bp, Homo sapiens
atacagtaggtgctcaatat

SEQ ID NO: 7398617 - DNA, 20 bp, Homo sapiens
atacagtaggtgctcaatat

SEQ ID NO: 7398618 - DNA, 20 bp, Homo sapiens
atacagtaggtgctcaatat

SEQ ID NO: 7398619 - DNA, 22 bp, Homo sapiens
atacagtataactaataaaccc

SEQ ID NO: 7398620 - DNA, 22 bp, Homo sapiens
atacagtataactaataaaccc

SEQ ID NO: 7398621 - DNA, 22 bp, Homo sapiens
atacagtataactaataaaccc

SEQ ID NO: 7398622 - DNA, 22 bp, Homo sapiens
atacagtataactaataaaccc

SEQ ID NO: 7398623 - DNA, 22 bp, Homo sapiens
atacagtattacctgttcagga

SEQ ID NO: 7398624 - DNA, 22 bp, Homo sapiens
atacagtattacctgttcagga

SEQ ID NO: 7398625 - DNA, 22 bp, Homo sapiens
atacagtattacctgttcagga

SEQ ID NO: 7398626 - DNA, 22 bp, Homo sapiens
atacagtattacctgttcagga

SEQ ID NO: 7398627 - DNA, 22 bp, Homo sapiens
atacagtattacctgttcagga

SEQ ID NO: 7398628 - DNA, 22 bp, Homo sapiens
atacagtattacctgttcagga

SEQ ID NO: 7398629 - DNA, 22 bp, Homo sapiens
atacagtattacctgttcagga

SEQ ID NO: 7398630 - DNA, 22 bp, Homo sapiens
atacagtataactaataaaccc

SEQ ID NO: 7398631 - DNA, 22 bp, Homo sapiens
atacagtataactaataaaccc

SEQ ID NO: 7398632 - DNA, 22 bp, Homo sapiens
atacagtataactaataaaccc

SEQ ID NO: 7398633 - DNA, 22 bp, Homo sapiens
atacagtatgtaggcttttcag

SEQ ID NO: 7398634 - DNA, 22 bp, Homo sapiens
atacagtatgtaggcttttcag

SEQ ID NO: 7398635 - DNA, 22 bp, Homo sapiens
atacagtatgtaggcttttcag

SEQ ID NO: 7398636 - DNA, 22 bp, Homo sapiens
atacataggatatgtacgtgca

SEQ ID NO: 7398637 - DNA, 22 bp, Homo sapiens
atacataggatatgtacgtgca

SEQ ID NO: 7398638 - DNA, 22 bp, Homo sapiens
atacatagctgaaaacttgtag

SEQ ID NO: 7398639 - DNA, 22 bp, Homo sapiens
atacatagttctgtgaaaagta

SEQ ID NO: 7398640 - DNA, 22 bp, Homo sapiens
atacatagttctgtgaaaagta

SEQ ID NO: 7398641 - DNA, 22 bp, Homo sapiens
atacatagtaccacatttgaca

SEQ ID NO: 7398642 - DNA, 22 bp, Homo sapiens
atacatagttctgtgaaaagta

SEQ ID NO: 7398643 - DNA, 22 bp, Homo sapiens
atacatagtaccacatttgaca

SEQ ID NO: 7398644 - DNA, 22 bp, Homo sapiens
atacatatatggtacttcctgg

SEQ ID NO: 7398645 - DNA, 22 bp, Homo sapiens
atacatgtgtgtgcatacatgt

SEQ ID NO: 7398646 - DNA, 22 bp, Homo sapiens
atacatgtgtgtgcatacatgt

SEQ ID NO: 7398647 - DNA, 22 bp, Homo sapiens
atacatgtgtgtgcatacatgt

SEQ ID NO: 7398648 - DNA, 22 bp, Homo sapiens
atacatgttcgtgtacatgttc

SEQ ID NO: 7398649 - DNA, 22 bp, Homo sapiens
atacatgttcgtgtacatgttc

SEQ ID NO: 7398650 - DNA, 22 bp, Homo sapiens
atacatgttcgtgtacatgttc

SEQ ID NO: 7398651 - DNA, 22 bp, Homo sapiens
atacatgtgtgtgcatacatgt

SEQ ID NO: 7398652 - DNA, 22 bp, Homo sapiens
atacatgttcgtgtacatgttc

SEQ ID NO: 7398653 - DNA, 22 bp, Homo sapiens
atacatgttcgtgtacatgttc

SEQ ID NO: 7398654 - DNA, 22 bp, Homo sapiens
atacattcatcacttttggtcc

SEQ ID NO: 7398655 - DNA, 16 bp, Homo sapiens
atacattcattcccag

SEQ ID NO: 7398656 - DNA, 22 bp, Homo sapiens
atacattcctactgactagcta

SEQ ID NO: 7398657 - DNA, 21 bp, Homo sapiens
atacattctattaagcattta

SEQ ID NO: 7398658 - DNA, 21 bp, Homo sapiens
atacattctattaagcattta

SEQ ID NO: 7398659 - DNA, 21 bp, Homo sapiens
atacattctattaagcattta

SEQ ID NO: 7398660 - DNA, 22 bp, Homo sapiens
atacattcagcagtgctcatga

SEQ ID NO: 7398661 - DNA, 22 bp, Homo sapiens
atacattcatcacttttggtcc

SEQ ID NO: 7398662 - DNA, 22 bp, Homo sapiens
atacattcagcagtgctcatga

SEQ ID NO: 7398663 - DNA, 22 bp, Homo sapiens
atacattcagcagtgctcatga

SEQ ID NO: 7398664 - DNA, 22 bp, Homo sapiens
atacattcagcagtgctcatga

SEQ ID NO: 7398665 - DNA, 22 bp, Homo sapiens
atacattgagttttgatgttct

SEQ ID NO: 7398666 - DNA, 22 bp, Homo sapiens
atacattcctactgactagcta

SEQ ID NO: 7398667 - DNA, 17 bp, Homo sapiens
atacattgttaaagtat

SEQ ID NO: 7398668 - DNA, 17 bp, Homo sapiens
atacattgttaaagtat

SEQ ID NO: 7398669 - DNA, 22 bp, Homo sapiens
ataccaaagcacatactgtttg

SEQ ID NO: 7398670 - DNA, 22 bp, Homo sapiens
ataccacaacatggctcagagg

SEQ ID NO: 7398671 - DNA, 22 bp, Homo sapiens
ataccaaagcacatactgtttg

SEQ ID NO: 7398672 - DNA, 22 bp, Homo sapiens
ataccaaagcacatactgtttg

SEQ ID NO: 7398673 - DNA, 22 bp, Homo sapiens
ataccaattagagtttgttgca

SEQ ID NO: 7398674 - DNA, 22 bp, Homo sapiens
atacctgtgtatccacaagcgt

SEQ ID NO: 7398675 - DNA, 22 bp, Homo sapiens
ataccttttactcattatccat

SEQ ID NO: 7398676 - DNA, 22 bp, Homo sapiens
ataccttttactcattatccat

SEQ ID NO: 7398677 - DNA, 22 bp, Homo sapiens
ataccttttagacatgtagttg

SEQ ID NO: 7398678 - DNA, 22 bp, Homo sapiens
atacctatgtgacagtattatt

SEQ ID NO: 7398679 - DNA, 22 bp, Homo sapiens
atacctctggcactcaagactt

SEQ ID NO: 7398680 - DNA, 22 bp, Homo sapiens
atacctctgcttgttttttagt

SEQ ID NO: 7398681 - DNA, 22 bp, Homo sapiens
atacctgatcaaggcaaaaatg

SEQ ID NO: 7398682 - DNA, 22 bp, Homo sapiens
atacctgatcaaggcaaaaatg

SEQ ID NO: 7398683 - DNA, 22 bp, Homo sapiens
atacctgtgtatccacaagcgt

SEQ ID NO: 7398684 - DNA, 22 bp, Homo sapiens
atacctgtgtatccacaagcgt

SEQ ID NO: 7398685 - DNA, 22 bp, Homo sapiens
atacctgtgtatccacaagcgt

SEQ ID NO: 7398686 - DNA, 22 bp, Homo sapiens
atacctgtgtatccacaagcgt

SEQ ID NO: 7398687 - DNA, 22 bp, Homo sapiens
atacctgtgtatccacaagcgt

SEQ ID NO: 7398688 - DNA, 22 bp, Homo sapiens
atacccattccttgtgttcagt

SEQ ID NO: 7398689 - DNA, 22 bp, Homo sapiens
ataccctgttctggagtgaatg

SEQ ID NO: 7398690 - DNA, 22 bp, Homo sapiens
ataccctgttctggagtgaatg

SEQ ID NO: 7398691 - DNA, 22 bp, Homo sapiens
ataccctttacaggaacagcaa

SEQ ID NO: 7398692 - DNA, 22 bp, Homo sapiens
ataccctttacaggaacagcaa

SEQ ID NO: 7398693 - DNA, 21 bp, Homo sapiens
ataccatttgccaaaaggatc

SEQ ID NO: 7398694 - DNA, 21 bp, Homo sapiens
ataccatttgccaaaaggatc

SEQ ID NO: 7398695 - DNA, 22 bp, Homo sapiens
ataccatttccatgttacatta

SEQ ID NO: 7398696 - DNA, 22 bp, Homo sapiens
ataccatttatcaagtacagtg

SEQ ID NO: 7398697 - DNA, 22 bp, Homo sapiens
ataccatttccatgttacatta

SEQ ID NO: 7398698 - DNA, 22 bp, Homo sapiens
atacccagccccagctgcagga

SEQ ID NO: 7398699 - DNA, 22 bp, Homo sapiens
ataccaccatctatgaaaggta

SEQ ID NO: 7398700 - DNA, 22 bp, Homo sapiens
ataccataggaaaggatcagcc

SEQ ID NO: 7398701 - DNA, 22 bp, Homo sapiens
ataccagaacaaatgagatcct

SEQ ID NO: 7398702 - DNA, 20 bp, Homo sapiens
ataccagagtacagtttatg

SEQ ID NO: 7398703 - DNA, 22 bp, Homo sapiens
ataccatggcagtttattcacg

SEQ ID NO: 7398704 - DNA, 22 bp, Homo sapiens
ataccatttccatgttacatta

SEQ ID NO: 7398705 - DNA, 22 bp, Homo sapiens
ataccatggcagtttattcacg

SEQ ID NO: 7398706 - DNA, 22 bp, Homo sapiens
atagcaaagcctggcacaatga

SEQ ID NO: 7398707 - DNA, 22 bp, Homo sapiens
atagcaaagcctggcacaatga

SEQ ID NO: 7398708 - DNA, 22 bp, Homo sapiens
atagcaaagcctggcacaatga

SEQ ID NO: 7398709 - DNA, 22 bp, Homo sapiens
atagcaaaggacaatagtcagt

SEQ ID NO: 7398710 - DNA, 22 bp, Homo sapiens
atagcaaagatgtcaattcccc

SEQ ID NO: 7398711 - DNA, 22 bp, Homo sapiens
atagcaaagatcacttccttga

SEQ ID NO: 7398712 - DNA, 22 bp, Homo sapiens
atagcaaagatcacttccttga

SEQ ID NO: 7398713 - DNA, 22 bp, Homo sapiens
atagcaaagatgtcaattcccc

SEQ ID NO: 7398714 - DNA, 22 bp, Homo sapiens
atagcaaaggacaatagtcagt

SEQ ID NO: 7398715 - DNA, 22 bp, Homo sapiens
atagcaaaggacaatagtcagt

SEQ ID NO: 7398716 - DNA, 22 bp, Homo sapiens
atagcaaaggacaatagtcagt

SEQ ID NO: 7398717 - DNA, 22 bp, Homo sapiens
atagcaaaggacaatagtcagt

SEQ ID NO: 7398718 - DNA, 22 bp, Homo sapiens
atagcaaaggacaatagtcagt

SEQ ID NO: 7398719 - DNA, 22 bp, Homo sapiens
atagcaaaggacaatagtcagt

SEQ ID NO: 7398720 - DNA, 22 bp, Homo sapiens
atagcaaaggacaatagtcagt

SEQ ID NO: 7398721 - DNA, 22 bp, Homo sapiens
ctggcccagttctgcgttttgc

SEQ ID NO: 7398722 - DNA, 22 bp, Homo sapiens
ctggcccagttctgcgttttgc

SEQ ID NO: 7398723 - DNA, 22 bp, Homo sapiens
atagcaaaggacaatagtcagt

SEQ ID NO: 7398724 - DNA, 22 bp, Homo sapiens
atagcaaaggacaatagtcagt

SEQ ID NO: 7398725 - DNA, 22 bp, Homo sapiens
atagcaaactggcagcttgtgg

SEQ ID NO: 7398726 - DNA, 22 bp, Homo sapiens
atagcaaactggcagcttgtgg

SEQ ID NO: 7398727 - DNA, 22 bp, Homo sapiens
atagcaaactggcagcttgtgg

SEQ ID NO: 7398728 - DNA, 22 bp, Homo sapiens
atagcaaactggcagcttgtgg

SEQ ID NO: 7398729 - DNA, 22 bp, Homo sapiens
atagcaaactggcagcttgtgg

SEQ ID NO: 7398730 - DNA, 22 bp, Homo sapiens
atagcaaagatcacttccttga

SEQ ID NO: 7398731 - DNA, 22 bp, Homo sapiens
atagcaaagatcacttccttga

SEQ ID NO: 7398732 - DNA, 22 bp, Homo sapiens
atagcaaactggcagcttgtgg

SEQ ID NO: 7398733 - DNA, 22 bp, Homo sapiens
atagcaaactggcagcttgtgg

SEQ ID NO: 7398734 - DNA, 22 bp, Homo sapiens
atagcaaactggagcttgcttt

SEQ ID NO: 7398735 - DNA, 22 bp, Homo sapiens
atagcaaactggagcttgcttt

SEQ ID NO: 7398736 - DNA, 22 bp, Homo sapiens
atagcaaactggagcttgcttt

SEQ ID NO: 7398737 - DNA, 22 bp, Homo sapiens
atagcaaaaggcaccagagtga

SEQ ID NO: 7398738 - DNA, 22 bp, Homo sapiens
atagcaaaagcatgtgcaatac

SEQ ID NO: 7398739 - DNA, 22 bp, Homo sapiens
atagcaaaaggcaccagagtga

SEQ ID NO: 7398740 - DNA, 22 bp, Homo sapiens
atagcaaaagcatgtgcaatac

SEQ ID NO: 7398741 - DNA, 22 bp, Homo sapiens
atagcaaaagcatgtgcaatac

SEQ ID NO: 7398742 - DNA, 22 bp, Homo sapiens
atagcaaaagcatgtgcaatac

SEQ ID NO: 7398743 - DNA, 22 bp, Homo sapiens
atagcaaaaggcaccagagtga

SEQ ID NO: 7398744 - DNA, 22 bp, Homo sapiens
atagcaaaaggcaccagagtga

SEQ ID NO: 7398745 - DNA, 22 bp, Homo sapiens
atagcaaaacccactgcattac

SEQ ID NO: 7398746 - DNA, 22 bp, Homo sapiens
atagcaaaacccactgcattac

SEQ ID NO: 7398747 - DNA, 22 bp, Homo sapiens
atagcaaaaatgaacaaagctt

SEQ ID NO: 7398748 - DNA, 22 bp, Homo sapiens
atagcaaaaatgaacaaagctt

SEQ ID NO: 7398749 - DNA, 22 bp, Homo sapiens
ctggcccattgccttctctctc

SEQ ID NO: 7398750 - DNA, 20 bp, Homo sapiens
ctggcccatctaccgctctg

SEQ ID NO: 7398751 - DNA, 22 bp, Homo sapiens
ctggcccattgccttctctctc

SEQ ID NO: 7398752 - DNA, 22 bp, Homo sapiens
ctggcccattgccttctctctc

SEQ ID NO: 7398753 - DNA, 22 bp, Homo sapiens
ctggccccagagtttcacttgg

SEQ ID NO: 7398754 - DNA, 22 bp, Homo sapiens
ctggccccaggcagcctgctgg

SEQ ID NO: 7398755 - DNA, 22 bp, Homo sapiens
ctggcccattgccttctctctc

SEQ ID NO: 7398756 - DNA, 22 bp, Homo sapiens
ctggcccatggtgagctctggg

SEQ ID NO: 7398757 - DNA, 22 bp, Homo sapiens
ctggcccatggtgagctctggg

SEQ ID NO: 7398758 - DNA, 22 bp, Homo sapiens
ctggcccatggtgagctctggg

SEQ ID NO: 7398759 - DNA, 22 bp, Homo sapiens
ctggcccatggtgagctctggg

SEQ ID NO: 7398760 - DNA, 22 bp, Homo sapiens
ctggcccatggtgagctctggg

SEQ ID NO: 7398761 - DNA, 20 bp, Homo sapiens
ctggcccatctaccgctctg

SEQ ID NO: 7398762 - DNA, 20 bp, Homo sapiens
ctggcccatctaccgctctg

SEQ ID NO: 7398763 - DNA, 20 bp, Homo sapiens
ctggcccatctaccgctctg

SEQ ID NO: 7398764 - DNA, 22 bp, Homo sapiens
ctggcccatggtgagctctggg

SEQ ID NO: 7398765 - DNA, 22 bp, Homo sapiens
ctggcccatggtgagctctggg

SEQ ID NO: 7398766 - DNA, 22 bp, Homo sapiens
ctggcccatggtgagctctggg

SEQ ID NO: 7398767 - DNA, 22 bp, Homo sapiens
ctggcccatggtgagctctggg

SEQ ID NO: 7398768 - DNA, 22 bp, Homo sapiens
ctggcccatggtgagctctggg

SEQ ID NO: 7398769 - DNA, 22 bp, Homo sapiens
ctggccccatctggagtctgag

SEQ ID NO: 7398770 - DNA, 22 bp, Homo sapiens
ctggccccatctggagtctgag

SEQ ID NO: 7398771 - DNA, 22 bp, Homo sapiens
ctggccccaggcagcctgctgg

SEQ ID NO: 7398772 - DNA, 22 bp, Homo sapiens
ctggccccaggcagcctgctgg

SEQ ID NO: 7398773 - DNA, 22 bp, Homo sapiens
ctggccccaggcagcctgctgg

SEQ ID NO: 7398774 - DNA, 22 bp, Homo sapiens
ctggccccaggcagcctgctgg

SEQ ID NO: 7398775 - DNA, 22 bp, Homo sapiens
ctggcccccacacctgtcaggg

SEQ ID NO: 7398776 - DNA, 22 bp, Homo sapiens
ctggcccccacacctgtcaggg

SEQ ID NO: 7398777 - DNA, 22 bp, Homo sapiens
ctggcccccacacctgtcaggg

SEQ ID NO: 7398778 - DNA, 22 bp, Homo sapiens
ctggcccccacacctgtcaggg

SEQ ID NO: 7398779 - DNA, 22 bp, Homo sapiens
ctggccccggttcctaaaaacc

SEQ ID NO: 7398780 - DNA, 22 bp, Homo sapiens
ctggcccccacacctgtcaggg

SEQ ID NO: 7398781 - DNA, 23 bp, Homo sapiens
atagactgatttggatgtgaaag

SEQ ID NO: 7398782 - DNA, 22 bp, Homo sapiens
atagacttgaggatataatgaa

SEQ ID NO: 7398783 - DNA, 22 bp, Homo sapiens
atactatattaccttctcaact

SEQ ID NO: 7398784 - DNA, 22 bp, Homo sapiens
atactatattaccttctcaact

SEQ ID NO: 7398785 - DNA, 22 bp, Homo sapiens
atactagactgttctgttatca

SEQ ID NO: 7398786 - DNA, 18 bp, Homo sapiens
atactagagctctttgcc

SEQ ID NO: 7398787 - DNA, 22 bp, Homo sapiens
atactatattaccttctcaact

SEQ ID NO: 7398788 - DNA, 22 bp, Homo sapiens
atagagactatagagcacttac

SEQ ID NO: 7398789 - DNA, 22 bp, Homo sapiens
atagagatgggtttagttataa

SEQ ID NO: 7398790 - DNA, 22 bp, Homo sapiens
atagagctataagaattttgtg

SEQ ID NO: 7398791 - DNA, 22 bp, Homo sapiens
atagatgttcaatcagatattt

SEQ ID NO: 7398792 - DNA, 22 bp, Homo sapiens
atagatgtgtgtaagtacataa

SEQ ID NO: 7398793 - DNA, 22 bp, Homo sapiens
atagatgttcaatcagatattt

SEQ ID NO: 7398794 - DNA, 22 bp, Homo sapiens
atagattatttgctcattactt

SEQ ID NO: 7398795 - DNA, 22 bp, Homo sapiens
atagattatttgctcattactt

SEQ ID NO: 7398796 - DNA, 22 bp, Homo sapiens
atagattatttgctcattactt

SEQ ID NO: 7398797 - DNA, 22 bp, Homo sapiens
atagattagccctatagtttta

SEQ ID NO: 7398798 - DNA, 22 bp, Homo sapiens
atagatgttttagtaatactgt

SEQ ID NO: 7398799 - DNA, 22 bp, Homo sapiens
atagatgttttagtaatactgt

SEQ ID NO: 7398800 - DNA, 22 bp, Homo sapiens
atagattagccctatagtttta

SEQ ID NO: 7398801 - DNA, 22 bp, Homo sapiens
atagattagccctatagtttta

SEQ ID NO: 7398802 - DNA, 22 bp, Homo sapiens
atagattcattctatttctccg

SEQ ID NO: 7398803 - DNA, 22 bp, Homo sapiens
atagattgctagttttaaaatt

SEQ ID NO: 7398804 - DNA, 22 bp, Homo sapiens
atagattgctagttttaaaatt

SEQ ID NO: 7398805 - DNA, 22 bp, Homo sapiens
atagatttgaatttaagacttg

SEQ ID NO: 7398806 - DNA, 22 bp, Homo sapiens
atagatttgaatttaagacttg

SEQ ID NO: 7398807 - DNA, 22 bp, Homo sapiens
atagatttgaatttaagacttg

SEQ ID NO: 7398808 - DNA, 22 bp, Homo sapiens
atagatttgaatttaagacttg

SEQ ID NO: 7398809 - DNA, 22 bp, Homo sapiens
atagcaaaaatgaacaaagctt

SEQ ID NO: 7398810 - DNA, 22 bp, Homo sapiens
atagcaaaaatgaacaaagctt

SEQ ID NO: 7398811 - DNA, 22 bp, Homo sapiens
atagcaaaaatgaacaaagctt

SEQ ID NO: 7398812 - DNA, 22 bp, Homo sapiens
atactacacattgactatattt

SEQ ID NO: 7398813 - DNA, 22 bp, Homo sapiens
atactacacattgactatattt

SEQ ID NO: 7398814 - DNA, 22 bp, Homo sapiens
atactacaatcataattgtaca

SEQ ID NO: 7398815 - DNA, 22 bp, Homo sapiens
atactacaatcataattgtaca

SEQ ID NO: 7398816 - DNA, 22 bp, Homo sapiens
atactacaatcataattgtaca

SEQ ID NO: 7398817 - DNA, 22 bp, Homo sapiens
atactacaatcataattgtaca

SEQ ID NO: 7398818 - DNA, 22 bp, Homo sapiens
atactacaatcataattgtaca

SEQ ID NO: 7398819 - DNA, 22 bp, Homo sapiens
atactacaatcataattgtaca

SEQ ID NO: 7398820 - DNA, 22 bp, Homo sapiens
atactaaagtatagaacttagt

SEQ ID NO: 7398821 - DNA, 22 bp, Homo sapiens
atactaaagtatagaacttagt

SEQ ID NO: 7398822 - DNA, 22 bp, Homo sapiens
atactaaagtatagaacttagt

SEQ ID NO: 7398823 - DNA, 22 bp, Homo sapiens
atactaaagtatagaacttagt

SEQ ID NO: 7398824 - DNA, 22 bp, Homo sapiens
atactaagcccaagaacacatg

SEQ ID NO: 7398825 - DNA, 22 bp, Homo sapiens
atactaagctcattacattttg

SEQ ID NO: 7398826 - DNA, 22 bp, Homo sapiens
atactacaaggtatgtgctaaa

SEQ ID NO: 7398827 - DNA, 22 bp, Homo sapiens
atactacaaggtatgtgctaaa

SEQ ID NO: 7398828 - DNA, 22 bp, Homo sapiens
atactaagctcattacattttg

SEQ ID NO: 7398829 - DNA, 22 bp, Homo sapiens
atactaagcccaagaacacatg

SEQ ID NO: 7398830 - DNA, 22 bp, Homo sapiens
atactaagctcattacattttg

SEQ ID NO: 7398831 - DNA, 22 bp, Homo sapiens
atactacatactatgtaaacat

SEQ ID NO: 7398832 - DNA, 22 bp, Homo sapiens
atactacatcacagccaagaag

SEQ ID NO: 7398833 - DNA, 22 bp, Homo sapiens
atactacatactatgtaaacat

SEQ ID NO: 7398834 - DNA, 21 bp, Homo sapiens
atactacatttctctgacttt

SEQ ID NO: 7398835 - DNA, 22 bp, Homo sapiens
atactacatttgaaaattgcag

SEQ ID NO: 7398836 - DNA, 22 bp, Homo sapiens
atactacatttgaaaattgcag

SEQ ID NO: 7398837 - DNA, 22 bp, Homo sapiens
atactagactgttctgttatca

SEQ ID NO: 7398838 - DNA, 21 bp, Homo sapiens
atactacatttctctgacttt

SEQ ID NO: 7398839 - DNA, 21 bp, Homo sapiens
atactacatttctctgacttt

SEQ ID NO: 7398840 - DNA, 22 bp, Homo sapiens
atactacattattagagcctgg

SEQ ID NO: 7398841 - DNA, 22 bp, Homo sapiens
atactacacattgactatattt

SEQ ID NO: 7398842 - DNA, 22 bp, Homo sapiens
atactacacattgactatattt

SEQ ID NO: 7398843 - DNA, 22 bp, Homo sapiens
atactacacattgactatattt

SEQ ID NO: 7398844 - DNA, 22 bp, Homo sapiens
atactacacattgactatattt

SEQ ID NO: 7398845 - DNA, 22 bp, Homo sapiens
atactacacattgactatattt

SEQ ID NO: 7398846 - DNA, 22 bp, Homo sapiens
atactacacattgactatattt

SEQ ID NO: 7398847 - DNA, 22 bp, Homo sapiens
atactacacattgactatattt

SEQ ID NO: 7398848 - DNA, 22 bp, Homo sapiens
atactacactatgcatggatgt

SEQ ID NO: 7398849 - DNA, 22 bp, Homo sapiens
atactacatactatgtaaacat

SEQ ID NO: 7398850 - DNA, 22 bp, Homo sapiens
atactacatactatgtaaacat

SEQ ID NO: 7398851 - DNA, 22 bp, Homo sapiens
atactacatactatgtaaacat

SEQ ID NO: 7398852 - DNA, 22 bp, Homo sapiens
ctggctcccagctttcagggag

SEQ ID NO: 7398853 - DNA, 22 bp, Homo sapiens
ctggctcccagctttcagggag

SEQ ID NO: 7398854 - DNA, 22 bp, Homo sapiens
ctggctcccagctttcagggag

SEQ ID NO: 7398855 - DNA, 22 bp, Homo sapiens
ctggctcccagctttcagggag

SEQ ID NO: 7398856 - DNA, 22 bp, Homo sapiens
ctggctcccatgagctctcacg

SEQ ID NO: 7398857 - DNA, 22 bp, Homo sapiens
ctggctcccatgagctctcacg

SEQ ID NO: 7398858 - DNA, 22 bp, Homo sapiens
ctggctcccatgagctctcacg

SEQ ID NO: 7398859 - DNA, 22 bp, Homo sapiens
ctggctcccatgagctctcacg

SEQ ID NO: 7398860 - DNA, 22 bp, Homo sapiens
ctggctcccatgagctctcacg

SEQ ID NO: 7398861 - DNA, 22 bp, Homo sapiens
ctggctcccatgagctctcacg

SEQ ID NO: 7398862 - DNA, 22 bp, Homo sapiens
ctggctcccatgagctctcacg

SEQ ID NO: 7398863 - DNA, 22 bp, Homo sapiens
ctggctcccatgagctctcacg

SEQ ID NO: 7398864 - DNA, 22 bp, Homo sapiens
ctggctcccgaagccctcagtg

SEQ ID NO: 7398865 - DNA, 22 bp, Homo sapiens
ctggctcccgaagccctcagtg

SEQ ID NO: 7398866 - DNA, 22 bp, Homo sapiens
ctggctcccgaagccctcagtg

SEQ ID NO: 7398867 - DNA, 22 bp, Homo sapiens
ctggctcccgaagccctcagtg

SEQ ID NO: 7398868 - DNA, 22 bp, Homo sapiens
ctggctcccgaagccctcagtg

SEQ ID NO: 7398869 - DNA, 22 bp, Homo sapiens
ctggctcccgaagccctcagtg

SEQ ID NO: 7398870 - DNA, 22 bp, Homo sapiens
ctggctcccgaagccctcagtg

SEQ ID NO: 7398871 - DNA, 22 bp, Homo sapiens
ctggctcccggggatcgagcac

SEQ ID NO: 7398872 - DNA, 22 bp, Homo sapiens
ctggctcccggggatcgagcac

SEQ ID NO: 7398873 - DNA, 22 bp, Homo sapiens
ctggctcccggggatcgagcac

SEQ ID NO: 7398874 - DNA, 22 bp, Homo sapiens
ctggctcccgaagccctcagtg

SEQ ID NO: 7398875 - DNA, 22 bp, Homo sapiens
ctggctcccgtctggtggccat

SEQ ID NO: 7398876 - DNA, 22 bp, Homo sapiens
ctggctcccgtctggtggccat

SEQ ID NO: 7398877 - DNA, 22 bp, Homo sapiens
ctggctcccggggatcgagcac

SEQ ID NO: 7398878 - DNA, 22 bp, Homo sapiens
ctggctcccgtctggtggccat

SEQ ID NO: 7398879 - DNA, 22 bp, Homo sapiens
ctggctcccgtctggtggccat

SEQ ID NO: 7398880 - DNA, 22 bp, Homo sapiens
atagcaaagtgcaggggcagca

SEQ ID NO: 7398881 - DNA, 22 bp, Homo sapiens
atagcaaatattttaatgagca

SEQ ID NO: 7398882 - DNA, 22 bp, Homo sapiens
atagcaaatattttaatgagca

SEQ ID NO: 7398883 - DNA, 22 bp, Homo sapiens
ctggctccctcgctgaggtgct

SEQ ID NO: 7398884 - DNA, 22 bp, Homo sapiens
ctggctccctcgctgaggtgct

SEQ ID NO: 7398885 - DNA, 22 bp, Homo sapiens
ctggctccctcgctgaggtgct

SEQ ID NO: 7398886 - DNA, 22 bp, Homo sapiens
ctggctccctcgctgaggtgct

SEQ ID NO: 7398887 - DNA, 22 bp, Homo sapiens
ctggctccctcgctgaggtgct

SEQ ID NO: 7398888 - DNA, 22 bp, Homo sapiens
ctggctcccgttgtccttgaag

SEQ ID NO: 7398889 - DNA, 22 bp, Homo sapiens
ctggctccctcgctgaggtgct

SEQ ID NO: 7398890 - DNA, 22 bp, Homo sapiens
ctggctcccgttgtccttgaag

SEQ ID NO: 7398891 - DNA, 22 bp, Homo sapiens
ctggctcccgttgtccttgaag

SEQ ID NO: 7398892 - DNA, 22 bp, Homo sapiens
ctggctccatccttgagctctg

SEQ ID NO: 7398893 - DNA, 22 bp, Homo sapiens
ctggctccatccttgagctctg

SEQ ID NO: 7398894 - DNA, 22 bp, Homo sapiens
ctggctccatccttgagctctg

SEQ ID NO: 7398895 - DNA, 22 bp, Homo sapiens
ctggctccatccttgagctctg

SEQ ID NO: 7398896 - DNA, 22 bp, Homo sapiens
ctggctccatctttgcttcctg

SEQ ID NO: 7398897 - DNA, 22 bp, Homo sapiens
ctggctccatctttgcttcctg

SEQ ID NO: 7398898 - DNA, 22 bp, Homo sapiens
ctggctccatctttgcttcctg

SEQ ID NO: 7398899 - DNA, 22 bp, Homo sapiens
ctggctccatctttgcttcctg

SEQ ID NO: 7398900 - DNA, 22 bp, Homo sapiens
ctggctccatccttgagctctg

SEQ ID NO: 7398901 - DNA, 22 bp, Homo sapiens
ctggctccattactcagcatct

SEQ ID NO: 7398902 - DNA, 22 bp, Homo sapiens
ctggctccattactcagcatct

SEQ ID NO: 7398903 - DNA, 22 bp, Homo sapiens
ctggctccattactcagcatct

SEQ ID NO: 7398904 - DNA, 22 bp, Homo sapiens
ctggctccattactcagcatct

SEQ ID NO: 7398905 - DNA, 22 bp, Homo sapiens
ctggctccattactcagcatct

SEQ ID NO: 7398906 - DNA, 22 bp, Homo sapiens
ctggctccattactcagcatct

SEQ ID NO: 7398907 - DNA, 22 bp, Homo sapiens
ctggctccatctttgcttcctg

SEQ ID NO: 7398908 - DNA, 22 bp, Homo sapiens
ctggctccatctttgcttcctg

SEQ ID NO: 7398909 - DNA, 22 bp, Homo sapiens
ctggctccatctttgcttcctg

SEQ ID NO: 7398910 - DNA, 22 bp, Homo sapiens
ctggctccatctttgcttcctg

SEQ ID NO: 7398911 - DNA, 22 bp, Homo sapiens
ctggctccatctttgcttcctg

SEQ ID NO: 7398912 - DNA, 22 bp, Homo sapiens
ctggctccatcctaggcaaatg

SEQ ID NO: 7398913 - DNA, 22 bp, Homo sapiens
ctggctccatcctaggcaaatg

SEQ ID NO: 7398914 - DNA, 22 bp, Homo sapiens
ctggctccatcctaggcaaatg

SEQ ID NO: 7398915 - DNA, 22 bp, Homo sapiens
ctggctccatcactgggtgatg

SEQ ID NO: 7398916 - DNA, 22 bp, Homo sapiens
ctggctccatcactgggtgatg

SEQ ID NO: 7398917 - DNA, 22 bp, Homo sapiens
ctggctccatcactgggtgatg

SEQ ID NO: 7398918 - DNA, 22 bp, Homo sapiens
ctggctccatcactgggtgatg

SEQ ID NO: 7398919 - DNA, 22 bp, Homo sapiens
ctggctccagtgacaagtcgat

SEQ ID NO: 7398920 - DNA, 22 bp, Homo sapiens
ctggctccagtgacaagtcgat

SEQ ID NO: 7398921 - DNA, 22 bp, Homo sapiens
ctggctccatcactgggtgatg

SEQ ID NO: 7398922 - DNA, 22 bp, Homo sapiens
ctggctcacctccgctccagca

SEQ ID NO: 7398923 - DNA, 22 bp, Homo sapiens
ctggctcacctccgctccagca

SEQ ID NO: 7398924 - DNA, 22 bp, Homo sapiens
ctggctcacaggtgagatgcat

SEQ ID NO: 7398925 - DNA, 22 bp, Homo sapiens
ctggctcacaggtgagatgcat

SEQ ID NO: 7398926 - DNA, 22 bp, Homo sapiens
ctggcccctgtggctaaaatca

SEQ ID NO: 7398927 - DNA, 22 bp, Homo sapiens
ctggccctaggcaaacacagat

SEQ ID NO: 7398928 - DNA, 22 bp, Homo sapiens
ctggctcacaggtgagatgcat

SEQ ID NO: 7398929 - DNA, 22 bp, Homo sapiens
ctggctcacaggtgagatgcat

SEQ ID NO: 7398930 - DNA, 22 bp, Homo sapiens
ctggctcacaggtgagatgcat

SEQ ID NO: 7398931 - DNA, 22 bp, Homo sapiens
atagcaaattctttaggtgctt

SEQ ID NO: 7398932 - DNA, 22 bp, Homo sapiens
atagcaaatattttaatgagca

SEQ ID NO: 7398933 - DNA, 22 bp, Homo sapiens
atagcaaatattttaatgagca

SEQ ID NO: 7398934 - DNA, 22 bp, Homo sapiens
atagcaaatattttaatgagca

SEQ ID NO: 7398935 - DNA, 22 bp, Homo sapiens
atagcaaatattttaatgagca

SEQ ID NO: 7398936 - DNA, 22 bp, Homo sapiens
atagcaaggtatgactggagcc

SEQ ID NO: 7398937 - DNA, 22 bp, Homo sapiens
atagcaaattctttaggtgctt

SEQ ID NO: 7398938 - DNA, 22 bp, Homo sapiens
atagcaaggtatgactggagcc

SEQ ID NO: 7398939 - DNA, 22 bp, Homo sapiens
atagcaatggcaacaactaagc

SEQ ID NO: 7398940 - DNA, 22 bp, Homo sapiens
atagcaatggcaacaactaagc

SEQ ID NO: 7398941 - DNA, 22 bp, Homo sapiens
atagcaatggcaacaactaagc

SEQ ID NO: 7398942 - DNA, 22 bp, Homo sapiens
atagcaattaagctccagaatt

SEQ ID NO: 7398943 - DNA, 22 bp, Homo sapiens
atagcaattaagctccagaatt

SEQ ID NO: 7398944 - DNA, 22 bp, Homo sapiens
atagcagcatttcttccaagga

SEQ ID NO: 7398945 - DNA, 22 bp, Homo sapiens
atagcagcatttcttccaagga

SEQ ID NO: 7398946 - DNA, 22 bp, Homo sapiens
atagcagcatcagtttatctcc

SEQ ID NO: 7398947 - DNA, 22 bp, Homo sapiens
atagcagaaaccaagcttcttc

SEQ ID NO: 7398948 - DNA, 22 bp, Homo sapiens
atagcagcatcagtttatctcc

SEQ ID NO: 7398949 - DNA, 22 bp, Homo sapiens
atagcacttatagatttggtct

SEQ ID NO: 7398950 - DNA, 22 bp, Homo sapiens
atagcacttattgtatgctgag

SEQ ID NO: 7398951 - DNA, 22 bp, Homo sapiens
atagcactggtttttcttggtt

SEQ ID NO: 7398952 - DNA, 22 bp, Homo sapiens
atagcaccatgactaaacaatt

SEQ ID NO: 7398953 - DNA, 22 bp, Homo sapiens
atagcacctcctcagggaagtc

SEQ ID NO: 7398954 - DNA, 22 bp, Homo sapiens
atagcacctcctcagggaagtc

SEQ ID NO: 7398955 - DNA, 22 bp, Homo sapiens
atagcacctgtgatgggatgag

SEQ ID NO: 7398956 - DNA, 22 bp, Homo sapiens
atagcaatttgcccaattacct

SEQ ID NO: 7398957 - DNA, 22 bp, Homo sapiens
ctggctggccggagcgaggcgg

SEQ ID NO: 7398958 - DNA, 22 bp, Homo sapiens
ctggctggccggagcgaggcgg

SEQ ID NO: 7398959 - DNA, 22 bp, Homo sapiens
ctggctggccggagcgaggcgg

SEQ ID NO: 7398960 - DNA, 22 bp, Homo sapiens
ctggctggccggagcgaggcgg

SEQ ID NO: 7398961 - DNA, 22 bp, Homo sapiens
ctggctggccggagcgaggcgg

SEQ ID NO: 7398962 - DNA, 22 bp, Homo sapiens
ctggctggccggagcgaggcgg

SEQ ID NO: 7398963 - DNA, 22 bp, Homo sapiens
ctggctggccatgtagagatga

SEQ ID NO: 7398964 - DNA, 22 bp, Homo sapiens
ctggctggccatgtagagatga

SEQ ID NO: 7398965 - DNA, 22 bp, Homo sapiens
ctggctggccatgcagcgccag

SEQ ID NO: 7398966 - DNA, 22 bp, Homo sapiens
ctggctggccatgcagcgccag

SEQ ID NO: 7398967 - DNA, 22 bp, Homo sapiens
ctggctggcagatgctcttgct

SEQ ID NO: 7398968 - DNA, 22 bp, Homo sapiens
ctggctggcagatgctcttgct

SEQ ID NO: 7398969 - DNA, 22 bp, Homo sapiens
ctggctggcagatgctcttgct

SEQ ID NO: 7398970 - DNA, 22 bp, Homo sapiens
ctggctggcagatgctcttgct

SEQ ID NO: 7398971 - DNA, 22 bp, Homo sapiens
ctggctggcagatgctcttgct

SEQ ID NO: 7398972 - DNA, 22 bp, Homo sapiens
ctggctggccatgcagcgccag

SEQ ID NO: 7398973 - DNA, 22 bp, Homo sapiens
ctggctggcagatgctcttgct

SEQ ID NO: 7398974 - DNA, 22 bp, Homo sapiens
ctggctggccatgcagcgccag

SEQ ID NO: 7398975 - DNA, 22 bp, Homo sapiens
ctggctggccatgcagcgccag

SEQ ID NO: 7398976 - DNA, 22 bp, Homo sapiens
ctggctggccatgcagcgccag

SEQ ID NO: 7398977 - DNA, 22 bp, Homo sapiens
ctggctggccatgcagcgccag

SEQ ID NO: 7398978 - DNA, 19 bp, Homo sapiens
atagcagctatacccagat

SEQ ID NO: 7398979 - DNA, 22 bp, Homo sapiens
atagcagggatgtcagcaagta

SEQ ID NO: 7398980 - DNA, 19 bp, Homo sapiens
atagcagctatacccagat

SEQ ID NO: 7398981 - DNA, 22 bp, Homo sapiens
atagcagtaacactgacatttt

SEQ ID NO: 7398982 - DNA, 19 bp, Homo sapiens
ctggctgcaatgccagggt

SEQ ID NO: 7398983 - DNA, 22 bp, Homo sapiens
atagcagtaacactgacatttt

SEQ ID NO: 7398984 - DNA, 22 bp, Homo sapiens
ctggctgcagctccgaggaaga

SEQ ID NO: 7398985 - DNA, 22 bp, Homo sapiens
ctggctgcagctccgaggaaga

SEQ ID NO: 7398986 - DNA, 22 bp, Homo sapiens
ctggctgcaggaaggagtgggc

SEQ ID NO: 7398987 - DNA, 22 bp, Homo sapiens
ctggctgcaggaaggagtgggc

SEQ ID NO: 7398988 - DNA, 22 bp, Homo sapiens
ctggctggagtgcaggtgagtg

SEQ ID NO: 7398989 - DNA, 22 bp, Homo sapiens
ctggctggagtgcaggtgagtg

SEQ ID NO: 7398990 - DNA, 22 bp, Homo sapiens
ctggctggcaagtagaacacaa

SEQ ID NO: 7398991 - DNA, 22 bp, Homo sapiens
ctggctggagtgcaggtgagtg

SEQ ID NO: 7398992 - DNA, 22 bp, Homo sapiens
ctggctggcaagtagaacacaa

SEQ ID NO: 7398993 - DNA, 22 bp, Homo sapiens
ctggctggcaagtagaacacaa

SEQ ID NO: 7398994 - DNA, 22 bp, Homo sapiens
atacaactttacatgcaattcc

SEQ ID NO: 7398995 - DNA, 22 bp, Homo sapiens
atacaactttacatgcaattcc

SEQ ID NO: 7398996 - DNA, 22 bp, Homo sapiens
atacaactttacatgcaattcc

SEQ ID NO: 7398997 - DNA, 22 bp, Homo sapiens
atacaactttatctgtaatgag

SEQ ID NO: 7398998 - DNA, 22 bp, Homo sapiens
atacaactttacatgcaattcc

SEQ ID NO: 7398999 - DNA, 22 bp, Homo sapiens
atacaactgctctcagataagt

SEQ ID NO: 7399000 - DNA, 22 bp, Homo sapiens
atacaactgccttagaaggaaa

SEQ ID NO: 7399001 - DNA, 22 bp, Homo sapiens
atacaactgccttagaaggaaa

SEQ ID NO: 7399002 - DNA, 22 bp, Homo sapiens
atacaactgccttagaaggaaa

SEQ ID NO: 7399003 - DNA, 22 bp, Homo sapiens
atacaactgctctcagataagt

SEQ ID NO: 7399004 - DNA, 22 bp, Homo sapiens
atacaactgctctcagataagt

SEQ ID NO: 7399005 - DNA, 22 bp, Homo sapiens
atacaactgctctcagataagt

SEQ ID NO: 7399006 - DNA, 22 bp, Homo sapiens
atacaactttatctgtaatgag

SEQ ID NO: 7399007 - DNA, 22 bp, Homo sapiens
atacaactttacatgcaattcc

SEQ ID NO: 7399008 - DNA, 22 bp, Homo sapiens
ctgctgaggccttccctgtcct

SEQ ID NO: 7399009 - DNA, 22 bp, Homo sapiens
ctgctgaggtatactatgtgac

SEQ ID NO: 7399010 - DNA, 22 bp, Homo sapiens
ctgctgaggtatactatgtgac

SEQ ID NO: 7399011 - DNA, 22 bp, Homo sapiens
ctgctgaggtatactatgtgac

SEQ ID NO: 7399012 - DNA, 22 bp, Homo sapiens
ctgctgaggtccttgctcagac

SEQ ID NO: 7399013 - DNA, 22 bp, Homo sapiens
ctgctgaggtccttgctcagac

SEQ ID NO: 7399014 - DNA, 22 bp, Homo sapiens
ctgctgaggtccttgctcagac

SEQ ID NO: 7399015 - DNA, 22 bp, Homo sapiens
ctgctgaggtccttgctcagac

SEQ ID NO: 7399016 - DNA, 22 bp, Homo sapiens
ctgctgaggtggagattgcagt

SEQ ID NO: 7399017 - DNA, 22 bp, Homo sapiens
ctgctgaggtccttgctcagac

SEQ ID NO: 7399018 - DNA, 22 bp, Homo sapiens
ctgctgattcttaaatgtggtt

SEQ ID NO: 7399019 - DNA, 22 bp, Homo sapiens
ctgctgattcttaaatgtggtt

SEQ ID NO: 7399020 - DNA, 22 bp, Homo sapiens
ctgctgcaactctttagagggt

SEQ ID NO: 7399021 - DNA, 22 bp, Homo sapiens
ctgctgcaatctggcttccatg

SEQ ID NO: 7399022 - DNA, 22 bp, Homo sapiens
ctgctgcaatctggcttccatg

SEQ ID NO: 7399023 - DNA, 22 bp, Homo sapiens
ctgctgcaatctggcttccatg

SEQ ID NO: 7399024 - DNA, 22 bp, Homo sapiens
ctgctgatcagggcaaagcaaa

SEQ ID NO: 7399025 - DNA, 22 bp, Homo sapiens
ctgctgatcagggcaaagcaaa

SEQ ID NO: 7399026 - DNA, 22 bp, Homo sapiens
ctgctgatcgaatcagtcaccc

SEQ ID NO: 7399027 - DNA, 22 bp, Homo sapiens
ctgctgatgacctcaaactctt

SEQ ID NO: 7399028 - DNA, 22 bp, Homo sapiens
ctgctgatgtaagccatgctct

SEQ ID NO: 7399029 - DNA, 22 bp, Homo sapiens
atacaaattataggccccatcc

SEQ ID NO: 7399030 - DNA, 22 bp, Homo sapiens
atacaaattataggccccatcc

SEQ ID NO: 7399031 - DNA, 22 bp, Homo sapiens
atacaaattataggccccatcc

SEQ ID NO: 7399032 - DNA, 22 bp, Homo sapiens
atacaaatcctctgggatggta

SEQ ID NO: 7399033 - DNA, 22 bp, Homo sapiens
atacaaatcctctgggatggta

SEQ ID NO: 7399034 - DNA, 22 bp, Homo sapiens
atacaaatcctctgggatggta

SEQ ID NO: 7399035 - DNA, 22 bp, Homo sapiens
atacaaagtattgatcctgagt

SEQ ID NO: 7399036 - DNA, 22 bp, Homo sapiens
atacaaagtattgatcctgagt

SEQ ID NO: 7399037 - DNA, 22 bp, Homo sapiens
atacaaagtattaatcctggat

SEQ ID NO: 7399038 - DNA, 22 bp, Homo sapiens
atacaaaggaacacaggcatgt

SEQ ID NO: 7399039 - DNA, 22 bp, Homo sapiens
atacaaaggaacacaggcatgt

SEQ ID NO: 7399040 - DNA, 22 bp, Homo sapiens
atacaaagctttctgtctggta

SEQ ID NO: 7399041 - DNA, 22 bp, Homo sapiens
atacaaaggaacacaggcatgt

SEQ ID NO: 7399042 - DNA, 22 bp, Homo sapiens
atacaaaggaacacaggcatgt

SEQ ID NO: 7399043 - DNA, 22 bp, Homo sapiens
atacaaatttatagatgcattt

SEQ ID NO: 7399044 - DNA, 22 bp, Homo sapiens
atacaaatttatagatgcattt

SEQ ID NO: 7399045 - DNA, 22 bp, Homo sapiens
atacaaatttatagatgcattt

SEQ ID NO: 7399046 - DNA, 22 bp, Homo sapiens
atacaaatttatagatgcattt

SEQ ID NO: 7399047 - DNA, 22 bp, Homo sapiens
atacaaatttatagatgcattt

SEQ ID NO: 7399048 - DNA, 22 bp, Homo sapiens
atacaaatttatagatgcattt

SEQ ID NO: 7399049 - DNA, 22 bp, Homo sapiens
atacaaattataggccccatcc

SEQ ID NO: 7399050 - DNA, 22 bp, Homo sapiens
atacaaatttatagatgcattt

SEQ ID NO: 7399051 - DNA, 22 bp, Homo sapiens
atacaaatttatagatgcattt

SEQ ID NO: 7399052 - DNA, 22 bp, Homo sapiens
atacaaatttatagatgcattt

SEQ ID NO: 7399053 - DNA, 22 bp, Homo sapiens
atacaaatttatagatgcattt

SEQ ID NO: 7399054 - DNA, 22 bp, Homo sapiens
atacaacagaaaatgattattc

SEQ ID NO: 7399055 - DNA, 22 bp, Homo sapiens
atacaacagaaaatgattattc

SEQ ID NO: 7399056 - DNA, 22 bp, Homo sapiens
atacaacagaaaatgattattc

SEQ ID NO: 7399057 - DNA, 22 bp, Homo sapiens
atacaacagaaaatgattattc

SEQ ID NO: 7399058 - DNA, 22 bp, Homo sapiens
atacaacagaaaatgattattc

SEQ ID NO: 7399059 - DNA, 22 bp, Homo sapiens
atacaacagaaaatgattattc

SEQ ID NO: 7399060 - DNA, 22 bp, Homo sapiens
atacaaatttatagatgcattt

SEQ ID NO: 7399061 - DNA, 22 bp, Homo sapiens
ataagaaacattattctttcca

SEQ ID NO: 7399062 - DNA, 22 bp, Homo sapiens
ataagaaacattattctttcca

SEQ ID NO: 7399063 - DNA, 22 bp, Homo sapiens
ataagaaacattattctttcca

SEQ ID NO: 7399064 - DNA, 22 bp, Homo sapiens
ataagaaacattattctttcca

SEQ ID NO: 7399065 - DNA, 22 bp, Homo sapiens
ataagaaacattattctttcca

SEQ ID NO: 7399066 - DNA, 22 bp, Homo sapiens
ataagaaacattattctttcca

SEQ ID NO: 7399067 - DNA, 22 bp, Homo sapiens
ataagaaacattattctttcca

SEQ ID NO: 7399068 - DNA, 22 bp, Homo sapiens
ataagaaacattattctttcca

SEQ ID NO: 7399069 - DNA, 22 bp, Homo sapiens
ataagaataattaagttagtcc

SEQ ID NO: 7399070 - DNA, 22 bp, Homo sapiens
ataagaataattaagttagtcc

SEQ ID NO: 7399071 - DNA, 22 bp, Homo sapiens
ataagaataattaagttagtcc

SEQ ID NO: 7399072 - DNA, 22 bp, Homo sapiens
ataagaataattaagttagtcc

SEQ ID NO: 7399073 - DNA, 22 bp, Homo sapiens
ataagaaacattattctttcca

SEQ ID NO: 7399074 - DNA, 22 bp, Homo sapiens
ataagaataattaagttagtcc

SEQ ID NO: 7399075 - DNA, 22 bp, Homo sapiens
ataagaataattaagttagtcc

SEQ ID NO: 7399076 - DNA, 22 bp, Homo sapiens
ataagaataattaagttagtcc

SEQ ID NO: 7399077 - DNA, 22 bp, Homo sapiens
ataagaataattaagttagtcc

SEQ ID NO: 7399078 - DNA, 22 bp, Homo sapiens
ataagacacgcaaataggtacg

SEQ ID NO: 7399079 - DNA, 22 bp, Homo sapiens
ataagacacgccccactcactc

SEQ ID NO: 7399080 - DNA, 17 bp, Homo sapiens
ataagacagaagacaat

SEQ ID NO: 7399081 - DNA, 17 bp, Homo sapiens
ataagacagaagacaat

SEQ ID NO: 7399082 - DNA, 17 bp, Homo sapiens
ataagacagaagacaat

SEQ ID NO: 7399083 - DNA, 22 bp, Homo sapiens
ataagagctacagccagttctg

SEQ ID NO: 7399084 - DNA, 22 bp, Homo sapiens
ataacttcagtttctgtgtcct

SEQ ID NO: 7399085 - DNA, 22 bp, Homo sapiens
ataacttcagggctgtgacaga

SEQ ID NO: 7399086 - DNA, 22 bp, Homo sapiens
ataacttcagtttctgtgtcct

SEQ ID NO: 7399087 - DNA, 22 bp, Homo sapiens
ataacttgatgttatttgtcca

SEQ ID NO: 7399088 - DNA, 23 bp, Homo sapiens
ataagaaaacagtaggctcagag

SEQ ID NO: 7399089 - DNA, 23 bp, Homo sapiens
ataagaaaacagtaggctcagag

SEQ ID NO: 7399090 - DNA, 22 bp, Homo sapiens
ataacttgatgttatttgtcca

SEQ ID NO: 7399091 - DNA, 22 bp, Homo sapiens
ataacttcatcaaataggcaca

SEQ ID NO: 7399092 - DNA, 22 bp, Homo sapiens
ataactttcttcacccttgctg

SEQ ID NO: 7399093 - DNA, 22 bp, Homo sapiens
ataactttcttcacccttgctg

SEQ ID NO: 7399094 - DNA, 22 bp, Homo sapiens
ataacttattagattggagctg

SEQ ID NO: 7399095 - DNA, 22 bp, Homo sapiens
ataacttagagtaggcaaaagt

SEQ ID NO: 7399096 - DNA, 23 bp, Homo sapiens
ataactgagccgaggcttaagaa

SEQ ID NO: 7399097 - DNA, 22 bp, Homo sapiens
ataacttaatgggtcatgctct

SEQ ID NO: 7399098 - DNA, 22 bp, Homo sapiens
ataacttaatgggtcatgctct

SEQ ID NO: 7399099 - DNA, 22 bp, Homo sapiens
ataacttaatgggtcatgctct

SEQ ID NO: 7399100 - DNA, 22 bp, Homo sapiens
ataactggaaggacacgtgtgt

SEQ ID NO: 7399101 - DNA, 22 bp, Homo sapiens
ataactggaaggacacgtgtgt

SEQ ID NO: 7399102 - DNA, 22 bp, Homo sapiens
atacaaagctttctgtctggta

SEQ ID NO: 7399103 - DNA, 22 bp, Homo sapiens
atacaaagctttctgtctggta

SEQ ID NO: 7399104 - DNA, 22 bp, Homo sapiens
ataatttggcttcctagatgta

SEQ ID NO: 7399105 - DNA, 22 bp, Homo sapiens
atacaaagctaaatatggtttc

SEQ ID NO: 7399106 - DNA, 22 bp, Homo sapiens
atacaaagctaaatatggtttc

SEQ ID NO: 7399107 - DNA, 22 bp, Homo sapiens
atacaaagctaaatatggtttc

SEQ ID NO: 7399108 - DNA, 22 bp, Homo sapiens
ataatttactaagctctacctt

SEQ ID NO: 7399109 - DNA, 22 bp, Homo sapiens
ataatttggcttcctagatgta

SEQ ID NO: 7399110 - DNA, 22 bp, Homo sapiens
ataatttggcttcctagatgta

SEQ ID NO: 7399111 - DNA, 22 bp, Homo sapiens
ataatttactaagctctacctt

SEQ ID NO: 7399112 - DNA, 22 bp, Homo sapiens
ataatttactaagctctacctt

SEQ ID NO: 7399113 - DNA, 22 bp, Homo sapiens
ataagcatgttagaatatttga

SEQ ID NO: 7399114 - DNA, 21 bp, Homo sapiens
ataagcatgctgattacattt

SEQ ID NO: 7399115 - DNA, 22 bp, Homo sapiens
ataagagctatggtgggagttg

SEQ ID NO: 7399116 - DNA, 22 bp, Homo sapiens
ataagaggaattacagaagagg

SEQ ID NO: 7399117 - DNA, 22 bp, Homo sapiens
ataagaggaattacagaagagg

SEQ ID NO: 7399118 - DNA, 22 bp, Homo sapiens
ataagaggaattacagaagagg

SEQ ID NO: 7399119 - DNA, 22 bp, Homo sapiens
ataagagtcttgttttcttatt

SEQ ID NO: 7399120 - DNA, 22 bp, Homo sapiens
ataagaggaattacagaagagg

SEQ ID NO: 7399121 - DNA, 22 bp, Homo sapiens
ataagagtcttgttttcttatt

SEQ ID NO: 7399122 - DNA, 22 bp, Homo sapiens
ataagatgagatcagctttctg

SEQ ID NO: 7399123 - DNA, 21 bp, Homo sapiens
ataagcatgctgattacattt

SEQ ID NO: 7399124 - DNA, 21 bp, Homo sapiens
ataagcatgctgattacattt

SEQ ID NO: 7399125 - DNA, 21 bp, Homo sapiens
ataagcatgctgattacattt

SEQ ID NO: 7399126 - DNA, 22 bp, Homo sapiens
ataagcacacaaatacatatat

SEQ ID NO: 7399127 - DNA, 22 bp, Homo sapiens
ataagattgtcatagtatggac

SEQ ID NO: 7399128 - DNA, 22 bp, Homo sapiens
ataagcagggtcaaatgcctac

SEQ ID NO: 7399129 - DNA, 22 bp, Homo sapiens
ataagcagggtcaaatgcctac

SEQ ID NO: 7399130 - DNA, 22 bp, Homo sapiens
ataagcagggtcaaatgcctac

SEQ ID NO: 7399131 - DNA, 22 bp, Homo sapiens
ataagcatgattaccgggagca

SEQ ID NO: 7399132 - DNA, 22 bp, Homo sapiens
ataaattaggatctggggttcc

SEQ ID NO: 7399133 - DNA, 22 bp, Homo sapiens
ataaattaggatctggggttcc

SEQ ID NO: 7399134 - DNA, 22 bp, Homo sapiens
ataaattaggatctggggttcc

SEQ ID NO: 7399135 - DNA, 22 bp, Homo sapiens
ataaattaggatctggggttcc

SEQ ID NO: 7399136 - DNA, 22 bp, Homo sapiens
ataaattaggatctggggttcc

SEQ ID NO: 7399137 - DNA, 22 bp, Homo sapiens
ataaattaggatctggggttcc

SEQ ID NO: 7399138 - DNA, 22 bp, Homo sapiens
ataaattaggatctggggttcc

SEQ ID NO: 7399139 - DNA, 22 bp, Homo sapiens
ataaattaggatctggggttcc

SEQ ID NO: 7399140 - DNA, 22 bp, Homo sapiens
ataaattaggatctggggttcc

SEQ ID NO: 7399141 - DNA, 22 bp, Homo sapiens
ataaattaggatctggggttcc

SEQ ID NO: 7399142 - DNA, 23 bp, Homo sapiens
ataaattactatctccctagagc

SEQ ID NO: 7399143 - DNA, 23 bp, Homo sapiens
ataaattactatctccctagagc

SEQ ID NO: 7399144 - DNA, 22 bp, Homo sapiens
ataacagatactctctgtgagg

SEQ ID NO: 7399145 - DNA, 22 bp, Homo sapiens
ataacagatactctctgtgagg

SEQ ID NO: 7399146 - DNA, 22 bp, Homo sapiens
ataacagagttgggaagtgaaa

SEQ ID NO: 7399147 - DNA, 22 bp, Homo sapiens
ataacagatactctctgtgagg

SEQ ID NO: 7399148 - DNA, 22 bp, Homo sapiens
ataacagatactctctgtgagg

SEQ ID NO: 7399149 - DNA, 22 bp, Homo sapiens
ataaattatgaatggccctttt

SEQ ID NO: 7399150 - DNA, 22 bp, Homo sapiens
ataaattatgaatggccctttt

SEQ ID NO: 7399151 - DNA, 22 bp, Homo sapiens
ataaattatgaatggccctttt

SEQ ID NO: 7399152 - DNA, 22 bp, Homo sapiens
ataacagagttgggaagtgaaa

SEQ ID NO: 7399153 - DNA, 22 bp, Homo sapiens
ataacagagttgggaagtgaaa

SEQ ID NO: 7399154 - DNA, 22 bp, Homo sapiens
ataacagagttgggaagtgaaa

SEQ ID NO: 7399155 - DNA, 23 bp, Homo sapiens
ataaattactatctccctagagc

SEQ ID NO: 7399156 - DNA, 23 bp, Homo sapiens
ataaattactatctccctagagc

SEQ ID NO: 7399157 - DNA, 23 bp, Homo sapiens
ataaattactatctccctagagc

SEQ ID NO: 7399158 - DNA, 23 bp, Homo sapiens
ataaattactatctccctagagc

SEQ ID NO: 7399159 - DNA, 23 bp, Homo sapiens
ataaattactatctccctagagc

SEQ ID NO: 7399160 - DNA, 22 bp, Homo sapiens
ataaatgtttgttgaatgaata

SEQ ID NO: 7399161 - DNA, 22 bp, Homo sapiens
ataaatgtttgttgaatgaata

SEQ ID NO: 7399162 - DNA, 22 bp, Homo sapiens
ataaatgtttgttgaatgaata

SEQ ID NO: 7399163 - DNA, 23 bp, Homo sapiens
ataaattactatctccctagagc

SEQ ID NO: 7399164 - DNA, 23 bp, Homo sapiens
ataaattactatctccctagagc

SEQ ID NO: 7399165 - DNA, 22 bp, Homo sapiens
ataaatgtgaattagagctttg

SEQ ID NO: 7399166 - DNA, 22 bp, Homo sapiens
ataaatgtgaattagagctttg

SEQ ID NO: 7399167 - DNA, 22 bp, Homo sapiens
ataaatgtgaaatgagcagtta

SEQ ID NO: 7399168 - DNA, 22 bp, Homo sapiens
ataaatgtgaaatgagcagtta

SEQ ID NO: 7399169 - DNA, 22 bp, Homo sapiens
ataaatgtgaattagagctttg

SEQ ID NO: 7399170 - DNA, 22 bp, Homo sapiens
ataaatgtgaattagagctttg

SEQ ID NO: 7399171 - DNA, 22 bp, Homo sapiens
ataaatgtgaattagagctttg

SEQ ID NO: 7399172 - DNA, 22 bp, Homo sapiens
ataaatgtgaattagagctttg

SEQ ID NO: 7399173 - DNA, 22 bp, Homo sapiens
ataaatgtgaattagagctttg

SEQ ID NO: 7399174 - DNA, 22 bp, Homo sapiens
ataacgaaggctgatgcgggat

SEQ ID NO: 7399175 - DNA, 22 bp, Homo sapiens
ataacctgtttcagacatttgt

SEQ ID NO: 7399176 - DNA, 22 bp, Homo sapiens
ataacctggtagtattaaatgt

SEQ ID NO: 7399177 - DNA, 22 bp, Homo sapiens
ataactctgtttttttcatgca

SEQ ID NO: 7399178 - DNA, 19 bp, Homo sapiens
ataactacattggctcagt

SEQ ID NO: 7399179 - DNA, 22 bp, Homo sapiens
ataactctgtttttttcatgca

SEQ ID NO: 7399180 - DNA, 22 bp, Homo sapiens
ataaccatgattaatctaagaa

SEQ ID NO: 7399181 - DNA, 22 bp, Homo sapiens
ataacctaggagggtagaggta

SEQ ID NO: 7399182 - DNA, 22 bp, Homo sapiens
ataacctggtagtattaaatgt

SEQ ID NO: 7399183 - DNA, 22 bp, Homo sapiens
ataacctggtagtattaaatgt

SEQ ID NO: 7399184 - DNA, 22 bp, Homo sapiens
ataacattttgacaactggtga

SEQ ID NO: 7399185 - DNA, 22 bp, Homo sapiens
ataacattttgacaactggtga

SEQ ID NO: 7399186 - DNA, 22 bp, Homo sapiens
ataacatggagtttgtcattta

SEQ ID NO: 7399187 - DNA, 22 bp, Homo sapiens
ataacattttgacaactggtga

SEQ ID NO: 7399188 - DNA, 22 bp, Homo sapiens
ataacaggttgaatccgaatgt

SEQ ID NO: 7399189 - DNA, 22 bp, Homo sapiens
ataacagtgacctctcagcacc

SEQ ID NO: 7399190 - DNA, 22 bp, Homo sapiens
ataacagtgacctctcagcacc

SEQ ID NO: 7399191 - DNA, 22 bp, Homo sapiens
ataacatgacctgtgcttcaca

SEQ ID NO: 7399192 - DNA, 22 bp, Homo sapiens
ataacatgacctgtgcttcaca

SEQ ID NO: 7399193 - DNA, 22 bp, Homo sapiens
ataacagtgacctctcagcacc

SEQ ID NO: 7399194 - DNA, 22 bp, Homo sapiens
ataacatggagtttgtcattta

SEQ ID NO: 7399195 - DNA, 22 bp, Homo sapiens
ataacatggagtttgtcattta

SEQ ID NO: 7399196 - DNA, 22 bp, Homo sapiens
ataacatggagtttgtcattta

SEQ ID NO: 7399197 - DNA, 22 bp, Homo sapiens
ataacatggagtttgtcattta

SEQ ID NO: 7399198 - DNA, 22 bp, Homo sapiens
ataacatgacctgtgcttcaca

SEQ ID NO: 7399199 - DNA, 22 bp, Homo sapiens
ataacatgagccagattgaaag

SEQ ID NO: 7399200 - DNA, 22 bp, Homo sapiens
ataacagatgtgaagtgctaat

SEQ ID NO: 7399201 - DNA, 22 bp, Homo sapiens
ataacagatgtgaagtgctaat

SEQ ID NO: 7399202 - DNA, 22 bp, Homo sapiens
ataacagatgtgaagtgctaat

SEQ ID NO: 7399203 - DNA, 22 bp, Homo sapiens
ataacagatgcttcagcataaa

SEQ ID NO: 7399204 - DNA, 22 bp, Homo sapiens
ataacagatgcttcagcataaa

SEQ ID NO: 7399205 - DNA, 22 bp, Homo sapiens
ataacagatgcttcagcataaa

SEQ ID NO: 7399206 - DNA, 22 bp, Homo sapiens
ataacagatgcttcagcataaa

SEQ ID NO: 7399207 - DNA, 22 bp, Homo sapiens
ataacagatgtgaagtgctaat

SEQ ID NO: 7399208 - DNA, 22 bp, Homo sapiens
ataacagatgcttcagcataaa

SEQ ID NO: 7399209 - DNA, 22 bp, Homo sapiens
ataacagatgcttcagcataaa

SEQ ID NO: 7399210 - DNA, 22 bp, Homo sapiens
ataacagatgtgaagtgctaat

SEQ ID NO: 7399211 - DNA, 22 bp, Homo sapiens
ataacagatgtgaagtgctaat

SEQ ID NO: 7399212 - DNA, 22 bp, Homo sapiens
ctgcctctccccagagtggccc

SEQ ID NO: 7399213 - DNA, 22 bp, Homo sapiens
ctgcctctccccagagtggccc

SEQ ID NO: 7399214 - DNA, 22 bp, Homo sapiens
ctgcctctccccagagtggccc

SEQ ID NO: 7399215 - DNA, 22 bp, Homo sapiens
ctgcctctcaggtccctgagat

SEQ ID NO: 7399216 - DNA, 22 bp, Homo sapiens
ctgcctctccccagagtggccc

SEQ ID NO: 7399217 - DNA, 22 bp, Homo sapiens
ctgcctctccccagagtggccc

SEQ ID NO: 7399218 - DNA, 22 bp, Homo sapiens
ctgcctctcaggtccctgagat

SEQ ID NO: 7399219 - DNA, 22 bp, Homo sapiens
ctgcctctcaggtccctgagat

SEQ ID NO: 7399220 - DNA, 22 bp, Homo sapiens
ctgcctctcaggtccctgagat

SEQ ID NO: 7399221 - DNA, 22 bp, Homo sapiens
ctgcctctcaggtccctgagat

SEQ ID NO: 7399222 - DNA, 22 bp, Homo sapiens
ctgcctctcaggtccctgagat

SEQ ID NO: 7399223 - DNA, 22 bp, Homo sapiens
ctgcctctcaggtccctgagat

SEQ ID NO: 7399224 - DNA, 22 bp, Homo sapiens
ctgcctctcaggtccctgagat

SEQ ID NO: 7399225 - DNA, 22 bp, Homo sapiens
ctgcctctcaggtccctgagat

SEQ ID NO: 7399226 - DNA, 22 bp, Homo sapiens
ctgcctctcagcctgaccgcca

SEQ ID NO: 7399227 - DNA, 22 bp, Homo sapiens
ctgcctctcagcctgaccgcca

SEQ ID NO: 7399228 - DNA, 22 bp, Homo sapiens
ctgcctctattcactgaggcag

SEQ ID NO: 7399229 - DNA, 22 bp, Homo sapiens
ctgcctctcagcctgaccgcca

SEQ ID NO: 7399230 - DNA, 22 bp, Homo sapiens
ctgcctctcagcctgaccgcca

SEQ ID NO: 7399231 - DNA, 22 bp, Homo sapiens
ctgcctctcagcctgaccgcca

SEQ ID NO: 7399232 - DNA, 22 bp, Homo sapiens
ctgcatttcacatttaaacttt

SEQ ID NO: 7399233 - DNA, 22 bp, Homo sapiens
ctgcatttcacatttaaacttt

SEQ ID NO: 7399234 - DNA, 22 bp, Homo sapiens
ctgccctttatttcacaaagta

SEQ ID NO: 7399235 - DNA, 23 bp, Homo sapiens
ctgcattgtctcctgggagcatg

SEQ ID NO: 7399236 - DNA, 23 bp, Homo sapiens
ctgcattgtctcctgggagcatg

SEQ ID NO: 7399237 - DNA, 22 bp, Homo sapiens
ctgcatttcacatttaaacttt

SEQ ID NO: 7399238 - DNA, 20 bp, Homo sapiens
ctgccgaccacagccatgga

SEQ ID NO: 7399239 - DNA, 22 bp, Homo sapiens
ctgccctttatttcacaaagta

SEQ ID NO: 7399240 - DNA, 22 bp, Homo sapiens
ctgccctttgaaagaacgtctt

SEQ ID NO: 7399241 - DNA, 22 bp, Homo sapiens
ctgccctttgaaagaacgtctt

SEQ ID NO: 7399242 - DNA, 22 bp, Homo sapiens
ctgccctttgaaagaacgtctt

SEQ ID NO: 7399243 - DNA, 22 bp, Homo sapiens
ataaatctcttaagactcaaca

SEQ ID NO: 7399244 - DNA, 22 bp, Homo sapiens
ataaatctcttaagactcaaca

SEQ ID NO: 7399245 - DNA, 22 bp, Homo sapiens
ctgcctctggcctcaggcccag

SEQ ID NO: 7399246 - DNA, 22 bp, Homo sapiens
ctgcctctgcgtcccacagagt

SEQ ID NO: 7399247 - DNA, 22 bp, Homo sapiens
ataaatctattggacatgtgtg

SEQ ID NO: 7399248 - DNA, 22 bp, Homo sapiens
ctgcctctgcgtcccacagagt

SEQ ID NO: 7399249 - DNA, 22 bp, Homo sapiens
ataaatgaacattcacagagct

SEQ ID NO: 7399250 - DNA, 22 bp, Homo sapiens
ataaatgaacattcacagagct

SEQ ID NO: 7399251 - DNA, 22 bp, Homo sapiens
ataaatgaacattcacagagct

SEQ ID NO: 7399252 - DNA, 22 bp, Homo sapiens
ataaatgaacattcacagagct

SEQ ID NO: 7399253 - DNA, 22 bp, Homo sapiens
ataaatctcttaagactcaaca

SEQ ID NO: 7399254 - DNA, 22 bp, Homo sapiens
ataaatctcttaagactcaaca

SEQ ID NO: 7399255 - DNA, 22 bp, Homo sapiens
ctgcctctccccagagtggccc

SEQ ID NO: 7399256 - DNA, 22 bp, Homo sapiens
ctgcctctccccagagtggccc

SEQ ID NO: 7399257 - DNA, 22 bp, Homo sapiens
ctgcctctccccagagtggccc

SEQ ID NO: 7399258 - DNA, 22 bp, Homo sapiens
ctgcctctgcgtcccacagagt

SEQ ID NO: 7399259 - DNA, 22 bp, Homo sapiens
ctgcctctgcgtcccacagagt

SEQ ID NO: 7399260 - DNA, 22 bp, Homo sapiens
ctgcctctgcgtcccacagagt

SEQ ID NO: 7399261 - DNA, 22 bp, Homo sapiens
ctgcctctccccagagtggccc

SEQ ID NO: 7399262 - DNA, 22 bp, Homo sapiens
ctgcctctgcgtcccacagagt

SEQ ID NO: 7399263 - DNA, 22 bp, Homo sapiens
ctgcctctgcgtcccacagagt

SEQ ID NO: 7399264 - DNA, 22 bp, Homo sapiens
ctgcctctgcgtcccacagagt

SEQ ID NO: 7399265 - DNA, 22 bp, Homo sapiens
ataaatgattcagcaggaaata

SEQ ID NO: 7399266 - DNA, 22 bp, Homo sapiens
ataaatgaacattcacagagct

SEQ ID NO: 7399267 - DNA, 22 bp, Homo sapiens
ataaatgaacattcacagagct

SEQ ID NO: 7399268 - DNA, 22 bp, Homo sapiens
ataaatgaacattcacagagct

SEQ ID NO: 7399269 - DNA, 22 bp, Homo sapiens
ataaatgattcagcaggaaata

SEQ ID NO: 7399270 - DNA, 22 bp, Homo sapiens
ataaatgattcagcaggaaata

SEQ ID NO: 7399271 - DNA, 22 bp, Homo sapiens
ataaatgattcagcaggaaata

SEQ ID NO: 7399272 - DNA, 22 bp, Homo sapiens
ataaatgattcagcaggaaata

SEQ ID NO: 7399273 - DNA, 22 bp, Homo sapiens
ataaatgtgaaatgagcagtta

SEQ ID NO: 7399274 - DNA, 22 bp, Homo sapiens
ataaatgtgaaatgagcagtta

SEQ ID NO: 7399275 - DNA, 22 bp, Homo sapiens
ataaatggctttcattcctagg

SEQ ID NO: 7399276 - DNA, 22 bp, Homo sapiens
ataaatgcctcagaatcatccc

SEQ ID NO: 7399277 - DNA, 22 bp, Homo sapiens
ataaatgcctcagaatcatccc

SEQ ID NO: 7399278 - DNA, 22 bp, Homo sapiens
ataaatgattcagcaggaaata

SEQ ID NO: 7399279 - DNA, 22 bp, Homo sapiens
ataaatgattcagcaggaaata

SEQ ID NO: 7399280 - DNA, 23 bp, Homo sapiens
ctgatccaggaggtctgtcgtga

SEQ ID NO: 7399281 - DNA, 22 bp, Homo sapiens
ctgatccagagccaaccaaggc

SEQ ID NO: 7399282 - DNA, 22 bp, Homo sapiens
ctgatccagagccaaccaaggc

SEQ ID NO: 7399283 - DNA, 21 bp, Homo sapiens
ctgatcccaaacctctgccct

SEQ ID NO: 7399284 - DNA, 22 bp, Homo sapiens
ctgatcccattggcagtccagt

SEQ ID NO: 7399285 - DNA, 22 bp, Homo sapiens
ctgatcccaggcactgtcgcaa

SEQ ID NO: 7399286 - DNA, 21 bp, Homo sapiens
ctgatcccaaacctctgccct

SEQ ID NO: 7399287 - DNA, 16 bp, Homo sapiens
ctgatcccacatcctt

SEQ ID NO: 7399288 - DNA, 22 bp, Homo sapiens
ctgcaaataggggtgtgaataa

SEQ ID NO: 7399289 - DNA, 22 bp, Homo sapiens
ctgcaaataggggtgtgaataa

SEQ ID NO: 7399290 - DNA, 22 bp, Homo sapiens
ctgcaaataggggtgtgaataa

SEQ ID NO: 7399291 - DNA, 22 bp, Homo sapiens
ctgatcccattggcagtccagt

SEQ ID NO: 7399292 - DNA, 21 bp, Homo sapiens
ctgatcccaaacctctgccct

SEQ ID NO: 7399293 - DNA, 22 bp, Homo sapiens
ctgatcccctggaaagttgaat

SEQ ID NO: 7399294 - DNA, 22 bp, Homo sapiens
agttatttactcctttgtctct

SEQ ID NO: 7399295 - DNA, 22 bp, Homo sapiens
agttatttactcctttgtctct

SEQ ID NO: 7399296 - DNA, 22 bp, Homo sapiens
agttatttcagtaacataatag

SEQ ID NO: 7399297 - DNA, 22 bp, Homo sapiens
agttatttactcctttgtctct

SEQ ID NO: 7399298 - DNA, 22 bp, Homo sapiens
agttatttcagtaacataatag

SEQ ID NO: 7399299 - DNA, 22 bp, Homo sapiens
agttatttcagtaacataatag

SEQ ID NO: 7399300 - DNA, 22 bp, Homo sapiens
agttatttcagtaacataatag

SEQ ID NO: 7399301 - DNA, 22 bp, Homo sapiens
agttatttactcctttgtctct

SEQ ID NO: 7399302 - DNA, 22 bp, Homo sapiens
ctgatcatgtgggaggatatgt

SEQ ID NO: 7399303 - DNA, 22 bp, Homo sapiens
ctgatcatgtgggaggatatgt

SEQ ID NO: 7399304 - DNA, 22 bp, Homo sapiens
ctgatcatgtgggaggatatgt

SEQ ID NO: 7399305 - DNA, 22 bp, Homo sapiens
ctgcaaatcaagttcttataat

SEQ ID NO: 7399306 - DNA, 22 bp, Homo sapiens
ctgcaaatcaagttcttataat

SEQ ID NO: 7399307 - DNA, 22 bp, Homo sapiens
ctgcaaatcaagttcttataat

SEQ ID NO: 7399308 - DNA, 22 bp, Homo sapiens
ctgcaaatccctactgggcaca

SEQ ID NO: 7399309 - DNA, 22 bp, Homo sapiens
ctgcaaatccctactgggcaca

SEQ ID NO: 7399310 - DNA, 22 bp, Homo sapiens
ctgcaaatccctactgggcaca

SEQ ID NO: 7399311 - DNA, 22 bp, Homo sapiens
ctgcaaatccctactgggcaca

SEQ ID NO: 7399312 - DNA, 22 bp, Homo sapiens
ctgcaaatcaagttcttataat

SEQ ID NO: 7399313 - DNA, 21 bp, Homo sapiens
ctgcaaatgcaaggtgaccag

SEQ ID NO: 7399314 - DNA, 22 bp, Homo sapiens
ctgcaaatcctcagaaagggtt

SEQ ID NO: 7399315 - DNA, 22 bp, Homo sapiens
ctgcaaatcctcagaaagggtt

SEQ ID NO: 7399316 - DNA, 22 bp, Homo sapiens
ctgcaaattggtggtgaggcaa

SEQ ID NO: 7399317 - DNA, 23 bp, Homo sapiens
ctgcaactcagtctggagcagtt

SEQ ID NO: 7399318 - DNA, 23 bp, Homo sapiens
ctgcaactcagtctggagcagtt

SEQ ID NO: 7399319 - DNA, 23 bp, Homo sapiens
ctgcaactcagtctggagcagtt

SEQ ID NO: 7399320 - DNA, 22 bp, Homo sapiens
ctgcaaattggtggtgaggcaa

SEQ ID NO: 7399321 - DNA, 21 bp, Homo sapiens
ctgcaaatgtaatgagtttgg

SEQ ID NO: 7399322 - DNA, 21 bp, Homo sapiens
ctgcaaatgtaatgagtttgg

SEQ ID NO: 7399323 - DNA, 22 bp, Homo sapiens
ctgcaaatgggctttaggtggc

SEQ ID NO: 7399324 - DNA, 22 bp, Homo sapiens
ctgcaaatgggctttaggtggc

SEQ ID NO: 7399325 - DNA, 22 bp, Homo sapiens
ctgcaaatgcctcggtgtgcgg

SEQ ID NO: 7399326 - DNA, 22 bp, Homo sapiens
ctgcaaatgcctcggtgtgcgg

SEQ ID NO: 7399327 - DNA, 22 bp, Homo sapiens
ctgcaaatgccgtgagagcagg

SEQ ID NO: 7399328 - DNA, 22 bp, Homo sapiens
ctgcaaatgccgtgagagcagg

SEQ ID NO: 7399329 - DNA, 21 bp, Homo sapiens
ctgcaaatgcaaggtgaccag

SEQ ID NO: 7399330 - DNA, 22 bp, Homo sapiens
ctgcaaatgccgtgagagcagg

SEQ ID NO: 7399331 - DNA, 22 bp, Homo sapiens
ctgcaagattggaagatgcaat

SEQ ID NO: 7399332 - DNA, 22 bp, Homo sapiens
ctgcaagattggaagatgcaat

SEQ ID NO: 7399333 - DNA, 22 bp, Homo sapiens
ctgcaagattggaagatgcaat

SEQ ID NO: 7399334 - DNA, 20 bp, Homo sapiens
ctgcaagcaggttattccag

SEQ ID NO: 7399335 - DNA, 20 bp, Homo sapiens
ctgcaagcaggttattccag

SEQ ID NO: 7399336 - DNA, 22 bp, Homo sapiens
ctgcaagcaaatcaactctttg

SEQ ID NO: 7399337 - DNA, 21 bp, Homo sapiens
ctgcaagacatgctgttcttg

SEQ ID NO: 7399338 - DNA, 22 bp, Homo sapiens
ctgcaagattggaagatgcaat

SEQ ID NO: 7399339 - DNA, 22 bp, Homo sapiens
ctgcaactctagtccagggctg

SEQ ID NO: 7399340 - DNA, 22 bp, Homo sapiens
ctgcaactctagtccagggctg

SEQ ID NO: 7399341 - DNA, 22 bp, Homo sapiens
ctgcaactctctccagaggctg

SEQ ID NO: 7399342 - DNA, 22 bp, Homo sapiens
ctgcaagctacccctagcatca

SEQ ID NO: 7399343 - DNA, 20 bp, Homo sapiens
ctgcaagcaggttattccag

SEQ ID NO: 7399344 - DNA, 22 bp, Homo sapiens
ctgcaagccaagctgagagcct

SEQ ID NO: 7399345 - DNA, 22 bp, Homo sapiens
ctgcaagctggtaataagcaga

SEQ ID NO: 7399346 - DNA, 22 bp, Homo sapiens
ctgcaaggagttgacattgtct

SEQ ID NO: 7399347 - DNA, 22 bp, Homo sapiens
ctgcaaggagttgacattgtct

SEQ ID NO: 7399348 - DNA, 22 bp, Homo sapiens
ctgcaaggctgaattcagctga

SEQ ID NO: 7399349 - DNA, 22 bp, Homo sapiens
ctgcaaggctgaattcagctga

SEQ ID NO: 7399350 - DNA, 22 bp, Homo sapiens
ctgcaaggctggggtgagctgg

SEQ ID NO: 7399351 - DNA, 22 bp, Homo sapiens
ctgcaaggtccacctgctacat

SEQ ID NO: 7399352 - DNA, 22 bp, Homo sapiens
ctgcaaggtccacctgctacat

SEQ ID NO: 7399353 - DNA, 22 bp, Homo sapiens
ctgcaaggtccacctgctacat

SEQ ID NO: 7399354 - DNA, 22 bp, Homo sapiens
ctgcaatatgatgtctgagaaa

SEQ ID NO: 7399355 - DNA, 22 bp, Homo sapiens
ctgcaatagtttagaataattg

SEQ ID NO: 7399356 - DNA, 22 bp, Homo sapiens
ctgcaatatgatgtctgagaaa

SEQ ID NO: 7399357 - DNA, 22 bp, Homo sapiens
ctgcaatagtttagaataattg

SEQ ID NO: 7399358 - DNA, 22 bp, Homo sapiens
ctgcaatatgatgtctgagaaa

SEQ ID NO: 7399359 - DNA, 22 bp, Homo sapiens
ctgcaatatgatgtctgagaaa

SEQ ID NO: 7399360 - DNA, 22 bp, Homo sapiens
ctgcaatctccatgcttgattt

SEQ ID NO: 7399361 - DNA, 22 bp, Homo sapiens
ctgcaagggatcttcaggtagc

SEQ ID NO: 7399362 - DNA, 22 bp, Homo sapiens
ctgcaagggatcttcaggtagc

SEQ ID NO: 7399363 - DNA, 22 bp, Homo sapiens
ctgcaagggatcttcaggtagc

SEQ ID NO: 7399364 - DNA, 22 bp, Homo sapiens
ctgcaaggctggggtgagctgg

SEQ ID NO: 7399365 - DNA, 22 bp, Homo sapiens
ctgcaaggctggggtgagctgg

SEQ ID NO: 7399366 - DNA, 23 bp, Homo sapiens
ctgcaaggtacaagatgctggat

SEQ ID NO: 7399367 - DNA, 23 bp, Homo sapiens
ctgcaaggtacaagatgctggat

SEQ ID NO: 7399368 - DNA, 23 bp, Homo sapiens
ctgcaaggtacaagatgctggat

SEQ ID NO: 7399369 - DNA, 23 bp, Homo sapiens
ctgcaaggtacaagatgctggat

SEQ ID NO: 7399370 - DNA, 22 bp, Homo sapiens
ctgcaaggtcatgactctctgg

SEQ ID NO: 7399371 - DNA, 22 bp, Homo sapiens
ctgcaaggtcatgactctctgg

SEQ ID NO: 7399372 - DNA, 22 bp, Homo sapiens
ctgcaaggtcatgactctctgg

SEQ ID NO: 7399373 - DNA, 23 bp, Homo sapiens
ctgcaaggtacaagatgctggat

SEQ ID NO: 7399374 - DNA, 22 bp, Homo sapiens
ctgcaaggtatatgttatcata

SEQ ID NO: 7399375 - DNA, 22 bp, Homo sapiens
ctgcaaggtatatgttatcata

SEQ ID NO: 7399376 - DNA, 22 bp, Homo sapiens
ctgcaaggtatatgttatcata

SEQ ID NO: 7399377 - DNA, 22 bp, Homo sapiens
agttatttactcctttgtctct

SEQ ID NO: 7399378 - DNA, 22 bp, Homo sapiens
agttatttactcctttgtctct

SEQ ID NO: 7399379 - DNA, 22 bp, Homo sapiens
agttatttactcctttgtctct

SEQ ID NO: 7399380 - DNA, 22 bp, Homo sapiens
agttatttaaaatgattgtcct

SEQ ID NO: 7399381 - DNA, 22 bp, Homo sapiens
agttattgttcagtacaatgtc

SEQ ID NO: 7399382 - DNA, 22 bp, Homo sapiens
agttattgggttaaaattgcat

SEQ ID NO: 7399383 - DNA, 22 bp, Homo sapiens
agttattgggttaaaattgcat

SEQ ID NO: 7399384 - DNA, 22 bp, Homo sapiens
agttattgtcctcctcacctta

SEQ ID NO: 7399385 - DNA, 22 bp, Homo sapiens
agttattgttcagtacaatgtc

SEQ ID NO: 7399386 - DNA, 19 bp, Homo sapiens
agttattgatctattcagg

SEQ ID NO: 7399387 - DNA, 19 bp, Homo sapiens
agttattgatctattcagg

SEQ ID NO: 7399388 - DNA, 19 bp, Homo sapiens
agttattgatctattcagg

SEQ ID NO: 7399389 - DNA, 22 bp, Homo sapiens
agttattgagtgcagagcaggg

SEQ ID NO: 7399390 - DNA, 22 bp, Homo sapiens
agttattgagtatctataatgt

SEQ ID NO: 7399391 - DNA, 22 bp, Homo sapiens
agttattgagtgcagagcaggg

SEQ ID NO: 7399392 - DNA, 22 bp, Homo sapiens
agttattgaggtcccttccagt

SEQ ID NO: 7399393 - DNA, 22 bp, Homo sapiens
agttattgagtatctataatgt

SEQ ID NO: 7399394 - DNA, 22 bp, Homo sapiens
agttattgagtatctataatgt

SEQ ID NO: 7399395 - DNA, 22 bp, Homo sapiens
agttattcatttattctgtaca

SEQ ID NO: 7399396 - DNA, 22 bp, Homo sapiens
agttattcatttattctgtaca

SEQ ID NO: 7399397 - DNA, 22 bp, Homo sapiens
agttattcatttattctgtaca

SEQ ID NO: 7399398 - DNA, 22 bp, Homo sapiens
agttatattccatagattcaga

SEQ ID NO: 7399399 - DNA, 22 bp, Homo sapiens
agttatcaggtgttttcatgga

SEQ ID NO: 7399400 - DNA, 22 bp, Homo sapiens
agttatattccatagattcaga

SEQ ID NO: 7399401 - DNA, 22 bp, Homo sapiens
agttatattccatagattcaga

SEQ ID NO: 7399402 - DNA, 22 bp, Homo sapiens
agttatattccatagattcaga

SEQ ID NO: 7399403 - DNA, 22 bp, Homo sapiens
agttatcatcccttacactttg

SEQ ID NO: 7399404 - DNA, 22 bp, Homo sapiens
agttatcatcccttacactttg

SEQ ID NO: 7399405 - DNA, 22 bp, Homo sapiens
agttatcatcccttacactttg

SEQ ID NO: 7399406 - DNA, 22 bp, Homo sapiens
agttatcatcccttacactttg

SEQ ID NO: 7399407 - DNA, 22 bp, Homo sapiens
agttatcaggtgttttcatgga

SEQ ID NO: 7399408 - DNA, 22 bp, Homo sapiens
agttatgtcctcagcaaatcaa

SEQ ID NO: 7399409 - DNA, 22 bp, Homo sapiens
agttattactctttaacatatt

SEQ ID NO: 7399410 - DNA, 22 bp, Homo sapiens
agttattactctttaacatatt

SEQ ID NO: 7399411 - DNA, 22 bp, Homo sapiens
agttattactctttaacatatt

SEQ ID NO: 7399412 - DNA, 22 bp, Homo sapiens
agttatcatcccttacactttg

SEQ ID NO: 7399413 - DNA, 22 bp, Homo sapiens
agttattaagtcctgttttgag

SEQ ID NO: 7399414 - DNA, 22 bp, Homo sapiens
agttatgtcctcagcaaatcaa

SEQ ID NO: 7399415 - DNA, 22 bp, Homo sapiens
ctgaggagctgaaggccctcca

SEQ ID NO: 7399416 - DNA, 22 bp, Homo sapiens
ctgaggagctgaaggccctcca

SEQ ID NO: 7399417 - DNA, 22 bp, Homo sapiens
ctgaggagctgaaggccctcca

SEQ ID NO: 7399418 - DNA, 22 bp, Homo sapiens
ctgaggagctgaaggccctcca

SEQ ID NO: 7399419 - DNA, 22 bp, Homo sapiens
agttatattccatagattcaga

SEQ ID NO: 7399420 - DNA, 22 bp, Homo sapiens
agttatattccatagattcaga

SEQ ID NO: 7399421 - DNA, 22 bp, Homo sapiens
agttatatgtgaaaacacgtat

SEQ ID NO: 7399422 - DNA, 22 bp, Homo sapiens
ctgaggagcgttggtcacgtgt

SEQ ID NO: 7399423 - DNA, 22 bp, Homo sapiens
agttatatgtgaaaacacgtat

SEQ ID NO: 7399424 - DNA, 22 bp, Homo sapiens
ctgaggagccccctctcagcat

SEQ ID NO: 7399425 - DNA, 22 bp, Homo sapiens
ctgaggagccccctctcagcat

SEQ ID NO: 7399426 - DNA, 22 bp, Homo sapiens
ctgaggagccccctctcagcat

SEQ ID NO: 7399427 - DNA, 22 bp, Homo sapiens
ctgaggagccccctctcagcat

SEQ ID NO: 7399428 - DNA, 22 bp, Homo sapiens
ctgaggagccccctctcagcat

SEQ ID NO: 7399429 - DNA, 22 bp, Homo sapiens
ctgaggagcaaccccgtgccct

SEQ ID NO: 7399430 - DNA, 22 bp, Homo sapiens
ctgaggagccccctctcagcat

SEQ ID NO: 7399431 - DNA, 22 bp, Homo sapiens
ctgaggagccccctctcagcat

SEQ ID NO: 7399432 - DNA, 22 bp, Homo sapiens
ctgaggagccccctctcagcat

SEQ ID NO: 7399433 - DNA, 22 bp, Homo sapiens
ctgaggagcgttggtcacgtgt

SEQ ID NO: 7399434 - DNA, 22 bp, Homo sapiens
ctgaggagcgttggtcacgtgt

SEQ ID NO: 7399435 - DNA, 22 bp, Homo sapiens
ctgaggagctgaaggccctcca

SEQ ID NO: 7399436 - DNA, 22 bp, Homo sapiens
ctgaggagctgaaggccctcca

SEQ ID NO: 7399437 - DNA, 22 bp, Homo sapiens
ctgaggagcgttggtcacgtgt

SEQ ID NO: 7399438 - DNA, 22 bp, Homo sapiens
ctgaggagctgaaggccctcca

SEQ ID NO: 7399439 - DNA, 22 bp, Homo sapiens
ctgaggagcaaccccgtgccct

SEQ ID NO: 7399440 - DNA, 22 bp, Homo sapiens
ctgaggagcaaccccgtgccct

SEQ ID NO: 7399441 - DNA, 22 bp, Homo sapiens
ctgaggagcaaccccgtgccct

SEQ ID NO: 7399442 - DNA, 22 bp, Homo sapiens
ctgaggagcagctggcccgcta

SEQ ID NO: 7399443 - DNA, 22 bp, Homo sapiens
ctgaggagcagctggcccgcta

SEQ ID NO: 7399444 - DNA, 22 bp, Homo sapiens
ctgaggagcagctggcccgcta

SEQ ID NO: 7399445 - DNA, 22 bp, Homo sapiens
ctgaggagcagctggcccgcta

SEQ ID NO: 7399446 - DNA, 22 bp, Homo sapiens
ctgaggagcagctggcccgcta

SEQ ID NO: 7399447 - DNA, 22 bp, Homo sapiens
ctgaggagatccccccagaagt

SEQ ID NO: 7399448 - DNA, 22 bp, Homo sapiens
ctgaggagatccccccagaagt

SEQ ID NO: 7399449 - DNA, 22 bp, Homo sapiens
ctgaggagatccccccagaagt

SEQ ID NO: 7399450 - DNA, 22 bp, Homo sapiens
ctgaggagaggtggcctgtgtt

SEQ ID NO: 7399451 - DNA, 22 bp, Homo sapiens
ctgaggagatccccccagaagt

SEQ ID NO: 7399452 - DNA, 22 bp, Homo sapiens
ctgaggagatccccccagaagt

SEQ ID NO: 7399453 - DNA, 22 bp, Homo sapiens
ctgaggagatgggctttttagg

SEQ ID NO: 7399454 - DNA, 22 bp, Homo sapiens
ctgaggagatgggctttttagg

SEQ ID NO: 7399455 - DNA, 22 bp, Homo sapiens
ctgaggagatgataatgtcatt

SEQ ID NO: 7399456 - DNA, 22 bp, Homo sapiens
ctgaggagatgataatgtcatt

SEQ ID NO: 7399457 - DNA, 22 bp, Homo sapiens
ctgaggagatgataatgtcatt

SEQ ID NO: 7399458 - DNA, 22 bp, Homo sapiens
ctgaggagatgataatgtcatt

SEQ ID NO: 7399459 - DNA, 22 bp, Homo sapiens
ctgcattgatcaggcagaatct

SEQ ID NO: 7399460 - DNA, 22 bp, Homo sapiens
ctgcattattctagtccaagcc

SEQ ID NO: 7399461 - DNA, 22 bp, Homo sapiens
ctgcatgttttcttaattgtga

SEQ ID NO: 7399462 - DNA, 22 bp, Homo sapiens
ctgcatgtttacatttttgaga

SEQ ID NO: 7399463 - DNA, 22 bp, Homo sapiens
ctgcattacagcctccttagga

SEQ ID NO: 7399464 - DNA, 22 bp, Homo sapiens
ctgcattacagcctccttagga

SEQ ID NO: 7399465 - DNA, 22 bp, Homo sapiens
ctgcatgtgtttctgctgggtt

SEQ ID NO: 7399466 - DNA, 22 bp, Homo sapiens
ctgcatgtgtttctgctgggtt

SEQ ID NO: 7399467 - DNA, 22 bp, Homo sapiens
ctgcatgtttacatttttgaga

SEQ ID NO: 7399468 - DNA, 22 bp, Homo sapiens
ctgcatgtgttatatttggttc

SEQ ID NO: 7399469 - DNA, 22 bp, Homo sapiens
ctgcatgtcactctgctgtccc

SEQ ID NO: 7399470 - DNA, 22 bp, Homo sapiens
ctgcatgtcactctgctgtccc

SEQ ID NO: 7399471 - DNA, 21 bp, Homo sapiens
ctgcatctcatagaacatgtc

SEQ ID NO: 7399472 - DNA, 22 bp, Homo sapiens
ctgcatctcaggagacgggtct

SEQ ID NO: 7399473 - DNA, 21 bp, Homo sapiens
ctgcatctcatagaacatgtc

SEQ ID NO: 7399474 - DNA, 22 bp, Homo sapiens
ctgcatctctgctagtcagtca

SEQ ID NO: 7399475 - DNA, 22 bp, Homo sapiens
ctgcatctctgtgccagagggc

SEQ ID NO: 7399476 - DNA, 22 bp, Homo sapiens
ctgcatctctgtgccagagggc

SEQ ID NO: 7399477 - DNA, 22 bp, Homo sapiens
ctgcatctgcataatcaacttc

SEQ ID NO: 7399478 - DNA, 22 bp, Homo sapiens
ctgcatggttcaaatgagctaa

SEQ ID NO: 7399479 - DNA, 22 bp, Homo sapiens
ctgcatggttcaaatgagctaa

SEQ ID NO: 7399480 - DNA, 22 bp, Homo sapiens
ctgcatgctgagccaacagtga

SEQ ID NO: 7399481 - DNA, 23 bp, Homo sapiens
ctgcatgcttgaggtcaggtgtg

SEQ ID NO: 7399482 - DNA, 22 bp, Homo sapiens
ctgcatgaagtcttttttatag

SEQ ID NO: 7399483 - DNA, 22 bp, Homo sapiens
ctgcatgagctgtcagtggagg

SEQ ID NO: 7399484 - DNA, 22 bp, Homo sapiens
ctgcatgcaacagtgccctgga

SEQ ID NO: 7399485 - DNA, 22 bp, Homo sapiens
ctgcatcctaacctccatgcag

SEQ ID NO: 7399486 - DNA, 22 bp, Homo sapiens
ctgcatcccagggagcaatggg

SEQ ID NO: 7399487 - DNA, 22 bp, Homo sapiens
ctgcatcccagggagcaatggg

SEQ ID NO: 7399488 - DNA, 22 bp, Homo sapiens
ctgcatccatgttgctgcaaag

SEQ ID NO: 7399489 - DNA, 22 bp, Homo sapiens
ctgcagggttttaacaatggac

SEQ ID NO: 7399490 - DNA, 22 bp, Homo sapiens
ctgcagggtttttcaaggacaa

SEQ ID NO: 7399491 - DNA, 22 bp, Homo sapiens
ctgcagggttttaacaatggac

SEQ ID NO: 7399492 - DNA, 22 bp, Homo sapiens
ctgcagggtttttcaaggacaa

SEQ ID NO: 7399493 - DNA, 22 bp, Homo sapiens
ctgcagggtttcgccagttgtg

SEQ ID NO: 7399494 - DNA, 22 bp, Homo sapiens
ctgcagggttttaacaatggac

SEQ ID NO: 7399495 - DNA, 20 bp, Homo sapiens
ctgcagggttagaggctcca

SEQ ID NO: 7399496 - DNA, 20 bp, Homo sapiens
ctgcagggttagaggctcca

SEQ ID NO: 7399497 - DNA, 20 bp, Homo sapiens
ctgcagggttagaggctcca

SEQ ID NO: 7399498 - DNA, 20 bp, Homo sapiens
ctgcagggttagaggctcca

SEQ ID NO: 7399499 - DNA, 20 bp, Homo sapiens
ctgcagggttagaggctcca

SEQ ID NO: 7399500 - DNA, 22 bp, Homo sapiens
ctgcagggttcggagagttccc

SEQ ID NO: 7399501 - DNA, 22 bp, Homo sapiens
ctgcagggttcggagagttccc

SEQ ID NO: 7399502 - DNA, 22 bp, Homo sapiens
ctgcagggttcggagagttccc

SEQ ID NO: 7399503 - DNA, 22 bp, Homo sapiens
ctgcagggtttcgccagttgtg

SEQ ID NO: 7399504 - DNA, 22 bp, Homo sapiens
ctgcagggttcggagagttccc

SEQ ID NO: 7399505 - DNA, 22 bp, Homo sapiens
ctgcagggttcggagagttccc

SEQ ID NO: 7399506 - DNA, 22 bp, Homo sapiens
ctgcagggttcggagagttccc

SEQ ID NO: 7399507 - DNA, 22 bp, Homo sapiens
ctgcagggttcggagagttccc

SEQ ID NO: 7399508 - DNA, 22 bp, Homo sapiens
ctgcagggtttcgccagttgtg

SEQ ID NO: 7399509 - DNA, 22 bp, Homo sapiens
ctgcagggtttcgccagttgtg

SEQ ID NO: 7399510 - DNA, 22 bp, Homo sapiens
ctgcagggtttcgccagttgtg

SEQ ID NO: 7399511 - DNA, 22 bp, Homo sapiens
ctgcagggtttcgccagttgtg

SEQ ID NO: 7399512 - DNA, 22 bp, Homo sapiens
ctgcagagacctaggtcaggtt

SEQ ID NO: 7399513 - DNA, 22 bp, Homo sapiens
ctgcagagacctaggtcaggtt

SEQ ID NO: 7399514 - DNA, 22 bp, Homo sapiens
ctgcagagacctaggtcaggtt

SEQ ID NO: 7399515 - DNA, 22 bp, Homo sapiens
ctgcagagacctaggtcaggtt

SEQ ID NO: 7399516 - DNA, 22 bp, Homo sapiens
ctgcagagaattgtggggcttc

SEQ ID NO: 7399517 - DNA, 22 bp, Homo sapiens
ctgcagagaattgtggggcttc

SEQ ID NO: 7399518 - DNA, 22 bp, Homo sapiens
ctgcagagaattgtggggcttc

SEQ ID NO: 7399519 - DNA, 22 bp, Homo sapiens
ctgcagagacctaggtcaggtt

SEQ ID NO: 7399520 - DNA, 22 bp, Homo sapiens
ctgcagagaattgtggggcttc

SEQ ID NO: 7399521 - DNA, 22 bp, Homo sapiens
ctgcagagaattgtggggcttc

SEQ ID NO: 7399522 - DNA, 22 bp, Homo sapiens
ctgcacacatatggcttctctc

SEQ ID NO: 7399523 - DNA, 22 bp, Homo sapiens
ctgcacacatatggcttctctc

SEQ ID NO: 7399524 - DNA, 22 bp, Homo sapiens
ctgcacacatatggcttctctc

SEQ ID NO: 7399525 - DNA, 22 bp, Homo sapiens
ctgcacaactagggcgtttgat

SEQ ID NO: 7399526 - DNA, 22 bp, Homo sapiens
ctgcacaatgcaccatcaagtt

SEQ ID NO: 7399527 - DNA, 22 bp, Homo sapiens
ctgcaatggacagctctgagca

SEQ ID NO: 7399528 - DNA, 22 bp, Homo sapiens
ctgcaatggacagctctgagca

SEQ ID NO: 7399529 - DNA, 23 bp, Homo sapiens
ctgcaattgcctgatctcattgg

SEQ ID NO: 7399530 - DNA, 22 bp, Homo sapiens
ctgcacaaattaatcagttaat

SEQ ID NO: 7399531 - DNA, 22 bp, Homo sapiens
ctgcacaaattaatcagttaat

SEQ ID NO: 7399532 - DNA, 23 bp, Homo sapiens
ctgcagagaactgagggacagcc

SEQ ID NO: 7399533 - DNA, 23 bp, Homo sapiens
ctgcagagaactgagggacagcc

SEQ ID NO: 7399534 - DNA, 22 bp, Homo sapiens
ctgcagagagtgccgggcagcc

SEQ ID NO: 7399535 - DNA, 22 bp, Homo sapiens
ctgcagagagtgccgggcagcc

SEQ ID NO: 7399536 - DNA, 22 bp, Homo sapiens
ctgcagagagtgccgggcagcc

SEQ ID NO: 7399537 - DNA, 22 bp, Homo sapiens
ctgcagagagtgccgggcagcc

SEQ ID NO: 7399538 - DNA, 22 bp, Homo sapiens
ctgcagagagtaactgaaatat

SEQ ID NO: 7399539 - DNA, 22 bp, Homo sapiens
ctgcagagagtaactgaaatat

SEQ ID NO: 7399540 - DNA, 22 bp, Homo sapiens
ctgcagagacctaggtcaggtt

SEQ ID NO: 7399541 - DNA, 22 bp, Homo sapiens
ctgcagagatgaagaaggtggc

SEQ ID NO: 7399542 - DNA, 22 bp, Homo sapiens
ctgcagagatgaagaaggtggc

SEQ ID NO: 7399543 - DNA, 22 bp, Homo sapiens
ctgcagagatgaagaaggtggc

SEQ ID NO: 7399544 - DNA, 22 bp, Homo sapiens
ctgcagagatgaagaaggtggc

SEQ ID NO: 7399545 - DNA, 22 bp, Homo sapiens
ctgcagagatgaagaaggtggc

SEQ ID NO: 7399546 - DNA, 22 bp, Homo sapiens
ctgcagagagtgccgggcagcc

SEQ ID NO: 7399547 - DNA, 22 bp, Homo sapiens
ctgcagagagtgccgggcagcc

SEQ ID NO: 7399548 - DNA, 22 bp, Homo sapiens
ctgcagagcaagtaacatcctc

SEQ ID NO: 7399549 - DNA, 22 bp, Homo sapiens
ctgcagagcaagtaacatcctc

SEQ ID NO: 7399550 - DNA, 22 bp, Homo sapiens
ctgcagagatgaagaaggtggc

SEQ ID NO: 7399551 - DNA, 22 bp, Homo sapiens
ctgcagagatgaagaaggtggc

SEQ ID NO: 7399552 - DNA, 22 bp, Homo sapiens
ctgcagagatgaagaaggtggc

SEQ ID NO: 7399553 - DNA, 22 bp, Homo sapiens
ctgcagagatgaagaaggtggc

SEQ ID NO: 7399554 - DNA, 22 bp, Homo sapiens
ctgcagagcaagtaacatcctc

SEQ ID NO: 7399555 - DNA, 22 bp, Homo sapiens
ctgcagggagaggggacagcct

SEQ ID NO: 7399556 - DNA, 22 bp, Homo sapiens
ctgcagggagaggggacagcct

SEQ ID NO: 7399557 - DNA, 22 bp, Homo sapiens
ctgcaggggtgtcctgtattgg

SEQ ID NO: 7399558 - DNA, 22 bp, Homo sapiens
ctgcagggagaggggacagcct

SEQ ID NO: 7399559 - DNA, 22 bp, Homo sapiens
ctgcagggagaggggacagcct

SEQ ID NO: 7399560 - DNA, 20 bp, Homo sapiens
ctgcagggtgagtgggcgat

SEQ ID NO: 7399561 - DNA, 20 bp, Homo sapiens
ctgcagggttagaggctcca

SEQ ID NO: 7399562 - DNA, 20 bp, Homo sapiens
ctgcagggtgagtgggcgat

SEQ ID NO: 7399563 - DNA, 20 bp, Homo sapiens
ctgcagggtgagtgggcgat

SEQ ID NO: 7399564 - DNA, 22 bp, Homo sapiens
ctgcagggagaggggacagcct

SEQ ID NO: 7399565 - DNA, 20 bp, Homo sapiens
ctgcagggttagaggctcca

SEQ ID NO: 7399566 - DNA, 20 bp, Homo sapiens
ctgcagggttagaggctcca

SEQ ID NO: 7399567 - DNA, 20 bp, Homo sapiens
ctgcagggttagaggctcca

SEQ ID NO: 7399568 - DNA, 22 bp, Homo sapiens
ctgcaggggtgtcctgtattgg

SEQ ID NO: 7399569 - DNA, 22 bp, Homo sapiens
ctgcaggggtgtcctgtattgg

SEQ ID NO: 7399570 - DNA, 22 bp, Homo sapiens
ctgcagggtgacgttgcccacc

SEQ ID NO: 7399571 - DNA, 22 bp, Homo sapiens
ctgcagggtgacgttgcccacc

SEQ ID NO: 7399572 - DNA, 20 bp, Homo sapiens
ctgcagggtgagtgggcgat

SEQ ID NO: 7399573 - DNA, 20 bp, Homo sapiens
ctgcagggtgagtgggcgat

SEQ ID NO: 7399574 - DNA, 20 bp, Homo sapiens
ctgcagggtgagtgggcgat

SEQ ID NO: 7399575 - DNA, 20 bp, Homo sapiens
ctgcagggtgagtgggcgat

SEQ ID NO: 7399576 - DNA, 22 bp, Homo sapiens
agtccctttagtctggagagct

SEQ ID NO: 7399577 - DNA, 22 bp, Homo sapiens
agtccctgtactttccactgcc

SEQ ID NO: 7399578 - DNA, 22 bp, Homo sapiens
agtcccttctcaaagtgtgcgg

SEQ ID NO: 7399579 - DNA, 22 bp, Homo sapiens
agtccctgtactttccactgcc

SEQ ID NO: 7399580 - DNA, 22 bp, Homo sapiens
agtccctggattgtctctgtca

SEQ ID NO: 7399581 - DNA, 22 bp, Homo sapiens
agtccctgtactttccactgcc

SEQ ID NO: 7399582 - DNA, 22 bp, Homo sapiens
agtccctgtactttccactgcc

SEQ ID NO: 7399583 - DNA, 22 bp, Homo sapiens
agtccggtcagggggctgctgt

SEQ ID NO: 7399584 - DNA, 22 bp, Homo sapiens
agtccgtggccagactcaagag

SEQ ID NO: 7399585 - DNA, 22 bp, Homo sapiens
agtccgtcctgtcaagcagctg

SEQ ID NO: 7399586 - DNA, 22 bp, Homo sapiens
agtccggggtctggacacctgg

SEQ ID NO: 7399587 - DNA, 22 bp, Homo sapiens
agtccgcctgctgccgtggcag

SEQ ID NO: 7399588 - DNA, 22 bp, Homo sapiens
agtccgcctgctgccgtggcag

SEQ ID NO: 7399589 - DNA, 22 bp, Homo sapiens
agtcccccgtcctgcttgtcta

SEQ ID NO: 7399590 - DNA, 22 bp, Homo sapiens
agtccccctctgagcccaggga

SEQ ID NO: 7399591 - DNA, 23 bp, Homo sapiens
agtcccctacatagttcctgggg

SEQ ID NO: 7399592 - DNA, 23 bp, Homo sapiens
agtcccctacatagttcctgggg

SEQ ID NO: 7399593 - DNA, 22 bp, Homo sapiens
agtcccctctaacccaacttta

SEQ ID NO: 7399594 - DNA, 22 bp, Homo sapiens
agtcccctggcaggagggacgt

SEQ ID NO: 7399595 - DNA, 22 bp, Homo sapiens
agtcccctctaacccaacttta

SEQ ID NO: 7399596 - DNA, 22 bp, Homo sapiens
agtcccctctcgcttggctgag

SEQ ID NO: 7399597 - DNA, 22 bp, Homo sapiens
agtccctccaacacagtattag

SEQ ID NO: 7399598 - DNA, 22 bp, Homo sapiens
agtcccctggcaggagggacgt

SEQ ID NO: 7399599 - DNA, 21 bp, Homo sapiens
agtcccctgtccttacttcta

SEQ ID NO: 7399600 - DNA, 21 bp, Homo sapiens
agtcccctgtccttacttcta

SEQ ID NO: 7399601 - DNA, 22 bp, Homo sapiens
agtccctggattgtctctgtca

SEQ ID NO: 7399602 - DNA, 22 bp, Homo sapiens
agtccctggattgtctctgtca

SEQ ID NO: 7399603 - DNA, 22 bp, Homo sapiens
agtccctgtactttccactgcc

SEQ ID NO: 7399604 - DNA, 22 bp, Homo sapiens
agtccctggattgtctctgtca

SEQ ID NO: 7399605 - DNA, 22 bp, Homo sapiens
agtccctggattgtctctgtca

SEQ ID NO: 7399606 - DNA, 22 bp, Homo sapiens
agtcctctgctgtgcgtctttg

SEQ ID NO: 7399607 - DNA, 22 bp, Homo sapiens
agtcctctgctgtgcgtctttg

SEQ ID NO: 7399608 - DNA, 22 bp, Homo sapiens
agtcctctggagtatgccttat

SEQ ID NO: 7399609 - DNA, 22 bp, Homo sapiens
agtcctctggagtatgccttat

SEQ ID NO: 7399610 - DNA, 22 bp, Homo sapiens
agtcctagacgtttgacaatgt

SEQ ID NO: 7399611 - DNA, 22 bp, Homo sapiens
agtccctgtactttccactgcc

SEQ ID NO: 7399612 - DNA, 22 bp, Homo sapiens
agtcctaggccctgctccagat

SEQ ID NO: 7399613 - DNA, 22 bp, Homo sapiens
agtcctagggtctgcgggctgg

SEQ ID NO: 7399614 - DNA, 22 bp, Homo sapiens
agtcctgcatccagttacatct

SEQ ID NO: 7399615 - DNA, 22 bp, Homo sapiens
agtcctgcatccagttacatct

SEQ ID NO: 7399616 - DNA, 22 bp, Homo sapiens
agtcctgccttggtggggtggt

SEQ ID NO: 7399617 - DNA, 22 bp, Homo sapiens
agtcctgccttggtggggtggt

SEQ ID NO: 7399618 - DNA, 22 bp, Homo sapiens
agtcctgatgctctggcaggag

SEQ ID NO: 7399619 - DNA, 22 bp, Homo sapiens
agtcctgatgctctggcaggag

SEQ ID NO: 7399620 - DNA, 22 bp, Homo sapiens
agtcctgatgctctggcaggag

SEQ ID NO: 7399621 - DNA, 22 bp, Homo sapiens
agtcctggacttggagtcaggg

SEQ ID NO: 7399622 - DNA, 22 bp, Homo sapiens
agtcctggacttggagtcaggg

SEQ ID NO: 7399623 - DNA, 22 bp, Homo sapiens
agtcctggacttggagtcaggg

SEQ ID NO: 7399624 - DNA, 22 bp, Homo sapiens
agtcctggacttggagtcaggg

SEQ ID NO: 7399625 - DNA, 22 bp, Homo sapiens
agtcctggccccaaggaaggat

SEQ ID NO: 7399626 - DNA, 22 bp, Homo sapiens
agtcctggcatggaattgtccc

SEQ ID NO: 7399627 - DNA, 22 bp, Homo sapiens
agtcctggccccaaggaaggat

SEQ ID NO: 7399628 - DNA, 22 bp, Homo sapiens
agtcctggccccaaggaaggat

SEQ ID NO: 7399629 - DNA, 22 bp, Homo sapiens
agtcctggcatataggtcctca

SEQ ID NO: 7399630 - DNA, 22 bp, Homo sapiens
agtcctggcatataggtcctca

SEQ ID NO: 7399631 - DNA, 22 bp, Homo sapiens
agtcctggcatataggtcctca

SEQ ID NO: 7399632 - DNA, 22 bp, Homo sapiens
agtcctggcatataggtcctca

SEQ ID NO: 7399633 - DNA, 22 bp, Homo sapiens
agtcctggacttggagtcaggg

SEQ ID NO: 7399634 - DNA, 18 bp, Homo sapiens
agtcctggagatcaccaa

SEQ ID NO: 7399635 - DNA, 18 bp, Homo sapiens
agtcctggagatcaccaa

SEQ ID NO: 7399636 - DNA, 22 bp, Homo sapiens
agtcctggacttggagtcaggg

SEQ ID NO: 7399637 - DNA, 22 bp, Homo sapiens
agtcctggcatataggtcctca

SEQ ID NO: 7399638 - DNA, 18 bp, Homo sapiens
agtcctggagatcaccaa

SEQ ID NO: 7399639 - DNA, 22 bp, Homo sapiens
agtcctggcatataggtcctca

SEQ ID NO: 7399640 - DNA, 22 bp, Homo sapiens
agtcctggcatataggtcctca

SEQ ID NO: 7399641 - DNA, 18 bp, Homo sapiens
ctcagtgtttgctgaaaa

SEQ ID NO: 7399642 - DNA, 18 bp, Homo sapiens
ctcagtgtttgctgaaaa

SEQ ID NO: 7399643 - DNA, 22 bp, Homo sapiens
ctcatctgtctgggctggtttt

SEQ ID NO: 7399644 - DNA, 22 bp, Homo sapiens
ctcatgatccaccgatgtcagc

SEQ ID NO: 7399645 - DNA, 22 bp, Homo sapiens
ctcatgatttgagtagtaaact

SEQ ID NO: 7399646 - DNA, 22 bp, Homo sapiens
ctcatgcattctttttgtgtgt

SEQ ID NO: 7399647 - DNA, 22 bp, Homo sapiens
ctcatgcccagagccactgttg

SEQ ID NO: 7399648 - DNA, 22 bp, Homo sapiens
ctcatggaagacactccttcac

SEQ ID NO: 7399649 - DNA, 22 bp, Homo sapiens
ctcagtgttggagaccttcagg

SEQ ID NO: 7399650 - DNA, 22 bp, Homo sapiens
ctcagtgttggagaccttcagg

SEQ ID NO: 7399651 - DNA, 22 bp, Homo sapiens
agtcctgggtccagcaggtcct

SEQ ID NO: 7399652 - DNA, 22 bp, Homo sapiens
ctcagtgttggagaccttcagg

SEQ ID NO: 7399653 - DNA, 22 bp, Homo sapiens
ctcagtgttggagaccttcagg

SEQ ID NO: 7399654 - DNA, 18 bp, Homo sapiens
ctcagtgtttgctgaaaa

SEQ ID NO: 7399655 - DNA, 18 bp, Homo sapiens
ctcagtgtttgctgaaaa

SEQ ID NO: 7399656 - DNA, 18 bp, Homo sapiens
ctcagtgtttgctgaaaa

SEQ ID NO: 7399657 - DNA, 22 bp, Homo sapiens
agtcctgggtccagcaggtcct

SEQ ID NO: 7399658 - DNA, 22 bp, Homo sapiens
agtcctgggtccagcaggtcct

SEQ ID NO: 7399659 - DNA, 22 bp, Homo sapiens
agtcctgggtccagcaggtcct

SEQ ID NO: 7399660 - DNA, 19 bp, Homo sapiens
agtcctggcctgggggacc

SEQ ID NO: 7399661 - DNA, 18 bp, Homo sapiens
agtcctggctctaccacc

SEQ ID NO: 7399662 - DNA, 22 bp, Homo sapiens
agtcctggctctacgggcttca

SEQ ID NO: 7399663 - DNA, 18 bp, Homo sapiens
agtcctggctctaccacc

SEQ ID NO: 7399664 - DNA, 22 bp, Homo sapiens
agtcctgggtccagcaggtcct

SEQ ID NO: 7399665 - DNA, 22 bp, Homo sapiens
agtcctgggtccagcaggtcct

SEQ ID NO: 7399666 - DNA, 22 bp, Homo sapiens
agtcctgggtccagcaggtcct

SEQ ID NO: 7399667 - DNA, 22 bp, Homo sapiens
agtcctggctctacgggcttca

SEQ ID NO: 7399668 - DNA, 19 bp, Homo sapiens
agtcctggcctgggggacc

SEQ ID NO: 7399669 - DNA, 19 bp, Homo sapiens
agtcctggcctgggggacc

SEQ ID NO: 7399670 - DNA, 22 bp, Homo sapiens
agtcctggccccaaggaaggat

SEQ ID NO: 7399671 - DNA, 22 bp, Homo sapiens
agtcctggccccaaggaaggat

SEQ ID NO: 7399672 - DNA, 22 bp, Homo sapiens
agtcctggccccaaggaaggat

SEQ ID NO: 7399673 - DNA, 22 bp, Homo sapiens
agtcctggccccaaggaaggat

SEQ ID NO: 7399674 - DNA, 22 bp, Homo sapiens
agtcctggccccaaggaaggat

SEQ ID NO: 7399675 - DNA, 22 bp, Homo sapiens
agtcctggccccaaggaaggat

SEQ ID NO: 7399676 - DNA, 22 bp, Homo sapiens
ctcattgcaacctccgcctccc

SEQ ID NO: 7399677 - DNA, 22 bp, Homo sapiens
ctcattgcaacctccgcctccc

SEQ ID NO: 7399678 - DNA, 22 bp, Homo sapiens
ctcattgcaacctccgcctccc

SEQ ID NO: 7399679 - DNA, 22 bp, Homo sapiens
ctcattgcaacctccgcctccc

SEQ ID NO: 7399680 - DNA, 22 bp, Homo sapiens
ctcattcattcccgcagccacc

SEQ ID NO: 7399681 - DNA, 22 bp, Homo sapiens
ctcattcattcccgcagccacc

SEQ ID NO: 7399682 - DNA, 22 bp, Homo sapiens
ctcattgcaacctccgcctccc

SEQ ID NO: 7399683 - DNA, 22 bp, Homo sapiens
ctcattgcaacctccgcctccc

SEQ ID NO: 7399684 - DNA, 22 bp, Homo sapiens
ctcattgcagctgcattactgt

SEQ ID NO: 7399685 - DNA, 22 bp, Homo sapiens
ctcattgcccagatccccacag

SEQ ID NO: 7399686 - DNA, 22 bp, Homo sapiens
ctcattgcccagatccccacag

SEQ ID NO: 7399687 - DNA, 22 bp, Homo sapiens
ctcattgcagctgcattactgt

SEQ ID NO: 7399688 - DNA, 22 bp, Homo sapiens
ctcattgcccagatccccacag

SEQ ID NO: 7399689 - DNA, 22 bp, Homo sapiens
ctcattgcccagatccccacag

SEQ ID NO: 7399690 - DNA, 22 bp, Homo sapiens
ctcatggcagagtcacctgtcc

SEQ ID NO: 7399691 - DNA, 22 bp, Homo sapiens
ctcatggcagagtcacctgtcc

SEQ ID NO: 7399692 - DNA, 22 bp, Homo sapiens
ctcatggatataagaactgttt

SEQ ID NO: 7399693 - DNA, 22 bp, Homo sapiens
ctcatggagggagtgctcttcc

SEQ ID NO: 7399694 - DNA, 22 bp, Homo sapiens
ctcatggagggagtgctcttcc

SEQ ID NO: 7399695 - DNA, 22 bp, Homo sapiens
ctcatgtcttcacccattctaa

SEQ ID NO: 7399696 - DNA, 22 bp, Homo sapiens
ctcatgtcccagacttaatcag

SEQ ID NO: 7399697 - DNA, 22 bp, Homo sapiens
ctcatgtcaggggtgtcaatgt

SEQ ID NO: 7399698 - DNA, 22 bp, Homo sapiens
ctcatgtagctctcaggccaca

SEQ ID NO: 7399699 - DNA, 22 bp, Homo sapiens
ctcattagacaggtatacttta

SEQ ID NO: 7399700 - DNA, 22 bp, Homo sapiens
ctcatgtgtctggtaggagctt

SEQ ID NO: 7399701 - DNA, 22 bp, Homo sapiens
ctcattaaaggaaatcacctgc

SEQ ID NO: 7399702 - DNA, 22 bp, Homo sapiens
ctcatgtcggcaggactcgccc

SEQ ID NO: 7399703 - DNA, 22 bp, Homo sapiens
ctccaggcttcaagggccggcc

SEQ ID NO: 7399704 - DNA, 22 bp, Homo sapiens
ctccaggcttcaagggccggcc

SEQ ID NO: 7399705 - DNA, 22 bp, Homo sapiens
ctccaggcttcaagggccggcc

SEQ ID NO: 7399706 - DNA, 22 bp, Homo sapiens
ctccaggcttcaagggccggcc

SEQ ID NO: 7399707 - DNA, 22 bp, Homo sapiens
ctccagggaaaggggcgtccgc

SEQ ID NO: 7399708 - DNA, 22 bp, Homo sapiens
ctccagggaaaggggcgtccgc

SEQ ID NO: 7399709 - DNA, 22 bp, Homo sapiens
ctccagggaaaggggcgtccgc

SEQ ID NO: 7399710 - DNA, 22 bp, Homo sapiens
ctccagggaaaggggcgtccgc

SEQ ID NO: 7399711 - DNA, 22 bp, Homo sapiens
ctccaggctggggtgcaggttg

SEQ ID NO: 7399712 - DNA, 22 bp, Homo sapiens
ctccaggctggggtgcaggttg

SEQ ID NO: 7399713 - DNA, 22 bp, Homo sapiens
ctccaggctggatccaagtcaa

SEQ ID NO: 7399714 - DNA, 22 bp, Homo sapiens
ctccaggctggatccaagtcaa

SEQ ID NO: 7399715 - DNA, 22 bp, Homo sapiens
ctccaggctggggtgcaggttg

SEQ ID NO: 7399716 - DNA, 22 bp, Homo sapiens
ctccaggctggggtgcaggttg

SEQ ID NO: 7399717 - DNA, 22 bp, Homo sapiens
ctccaggctggggtgcaggttg

SEQ ID NO: 7399718 - DNA, 22 bp, Homo sapiens
ctccaggctggggtgcaggttg

SEQ ID NO: 7399719 - DNA, 22 bp, Homo sapiens
ctccaggaacagcaccctgctg

SEQ ID NO: 7399720 - DNA, 22 bp, Homo sapiens
ctccaggaacagcaccctgctg

SEQ ID NO: 7399721 - DNA, 22 bp, Homo sapiens
ctccaggaacagcaccctgctg

SEQ ID NO: 7399722 - DNA, 22 bp, Homo sapiens
ctccaggaaagcctgaggcccg

SEQ ID NO: 7399723 - DNA, 22 bp, Homo sapiens
ctccaggaaagtcaggcttaga

SEQ ID NO: 7399724 - DNA, 22 bp, Homo sapiens
ctccaggaaagtcaggcttaga

SEQ ID NO: 7399725 - DNA, 22 bp, Homo sapiens
ctccaggaaagtcaggcttaga

SEQ ID NO: 7399726 - DNA, 22 bp, Homo sapiens
ctccaggcgggaggcggttcca

SEQ ID NO: 7399727 - DNA, 22 bp, Homo sapiens
ctccaggcgcttaccaagcgct

SEQ ID NO: 7399728 - DNA, 22 bp, Homo sapiens
ctccaggcgggaggcggttcca

SEQ ID NO: 7399729 - DNA, 22 bp, Homo sapiens
ctccaggcgggaggcggttcca

SEQ ID NO: 7399730 - DNA, 22 bp, Homo sapiens
ctccaggacactaacccaggct

SEQ ID NO: 7399731 - DNA, 22 bp, Homo sapiens
ctccaggacactaacccaggct

SEQ ID NO: 7399732 - DNA, 22 bp, Homo sapiens
ctccaggacactaacccaggct

SEQ ID NO: 7399733 - DNA, 22 bp, Homo sapiens
ctccaggctcgtccaagatcga

SEQ ID NO: 7399734 - DNA, 22 bp, Homo sapiens
ctccaggctcgtccaagatcga

SEQ ID NO: 7399735 - DNA, 22 bp, Homo sapiens
ctccaggctcgtccaagatcga

SEQ ID NO: 7399736 - DNA, 22 bp, Homo sapiens
ctccaggctggatccaagtcaa

SEQ ID NO: 7399737 - DNA, 22 bp, Homo sapiens
ctccaggctggatccaagtcaa

SEQ ID NO: 7399738 - DNA, 22 bp, Homo sapiens
ctccaggctggatccaagtcaa

SEQ ID NO: 7399739 - DNA, 22 bp, Homo sapiens
ctccaggctggatccaagtcaa

SEQ ID NO: 7399740 - DNA, 22 bp, Homo sapiens
ctccaggctggatccaagtcaa

SEQ ID NO: 7399741 - DNA, 22 bp, Homo sapiens
ctccaggctcgtccaagatcga

SEQ ID NO: 7399742 - DNA, 22 bp, Homo sapiens
ctccagctttagctctccaggg

SEQ ID NO: 7399743 - DNA, 22 bp, Homo sapiens
ctccagctttttcccagttggc

SEQ ID NO: 7399744 - DNA, 22 bp, Homo sapiens
ctccagctttttcccagttggc

SEQ ID NO: 7399745 - DNA, 22 bp, Homo sapiens
ctccagctttttcccagttggc

SEQ ID NO: 7399746 - DNA, 22 bp, Homo sapiens
ctccagctttttcccagttggc

SEQ ID NO: 7399747 - DNA, 22 bp, Homo sapiens
ctccaggaaaatagggaatgag

SEQ ID NO: 7399748 - DNA, 22 bp, Homo sapiens
ctccagctttagctctccaggg

SEQ ID NO: 7399749 - DNA, 22 bp, Homo sapiens
ctccagctttagctctccaggg

SEQ ID NO: 7399750 - DNA, 22 bp, Homo sapiens
ctccagctttagctctccaggg

SEQ ID NO: 7399751 - DNA, 22 bp, Homo sapiens
ctccagctttagctctccaggg

SEQ ID NO: 7399752 - DNA, 22 bp, Homo sapiens
ctccagctttagctctccaggg

SEQ ID NO: 7399753 - DNA, 22 bp, Homo sapiens
ctccaggaaaatagggaatgag

SEQ ID NO: 7399754 - DNA, 22 bp, Homo sapiens
ctccaggaaaatagggaatgag

SEQ ID NO: 7399755 - DNA, 22 bp, Homo sapiens
ctccaggaaaatagggaatgag

SEQ ID NO: 7399756 - DNA, 22 bp, Homo sapiens
ctccaggaaagcctgaggcccg

SEQ ID NO: 7399757 - DNA, 22 bp, Homo sapiens
ctccaggaaagcctgaggcccg

SEQ ID NO: 7399758 - DNA, 22 bp, Homo sapiens
ctccaggaaagcctgaggcccg

SEQ ID NO: 7399759 - DNA, 22 bp, Homo sapiens
ctccagcttctgcccagagact

SEQ ID NO: 7399760 - DNA, 22 bp, Homo sapiens
ctccagcttccctcagctgtgg

SEQ ID NO: 7399761 - DNA, 22 bp, Homo sapiens
ctccagcttccctcagctgtgg

SEQ ID NO: 7399762 - DNA, 22 bp, Homo sapiens
ctccagcttccctcagctgtgg

SEQ ID NO: 7399763 - DNA, 22 bp, Homo sapiens
ctccagcttctgcccagagact

SEQ ID NO: 7399764 - DNA, 22 bp, Homo sapiens
ctccagctttagctctccaggg

SEQ ID NO: 7399765 - DNA, 22 bp, Homo sapiens
ctccagcttctgcccagagact

SEQ ID NO: 7399766 - DNA, 22 bp, Homo sapiens
ctccagcttctgcccagagact

SEQ ID NO: 7399767 - DNA, 22 bp, Homo sapiens
ctccagcttctgcccagagact

SEQ ID NO: 7399768 - DNA, 22 bp, Homo sapiens
ctccagcttccctcagctgtgg

SEQ ID NO: 7399769 - DNA, 22 bp, Homo sapiens
ctccagcttctgcccagagact

SEQ ID NO: 7399770 - DNA, 22 bp, Homo sapiens
ctccagcttccctcagctgtgg

SEQ ID NO: 7399771 - DNA, 22 bp, Homo sapiens
ctccagcttccctcagctgtgg

SEQ ID NO: 7399772 - DNA, 22 bp, Homo sapiens
ctccagctgctggtctgagact

SEQ ID NO: 7399773 - DNA, 22 bp, Homo sapiens
ctccagctgctggtctgagact

SEQ ID NO: 7399774 - DNA, 22 bp, Homo sapiens
ctccagctgctggtctgagact

SEQ ID NO: 7399775 - DNA, 22 bp, Homo sapiens
ctccagctgctggtctgagact

SEQ ID NO: 7399776 - DNA, 22 bp, Homo sapiens
ctccagctgccaccagatgttt

SEQ ID NO: 7399777 - DNA, 22 bp, Homo sapiens
ctccagctgccaccagatgttt

SEQ ID NO: 7399778 - DNA, 22 bp, Homo sapiens
ctccagctgccaccagatgttt

SEQ ID NO: 7399779 - DNA, 22 bp, Homo sapiens
ctccagctgccaccagatgttt

SEQ ID NO: 7399780 - DNA, 22 bp, Homo sapiens
ctccagctgccaccagatgttt

SEQ ID NO: 7399781 - DNA, 22 bp, Homo sapiens
agtcttatgtttgtgaagaact

SEQ ID NO: 7399782 - DNA, 22 bp, Homo sapiens
agtcttatgtgatttatctttc

SEQ ID NO: 7399783 - DNA, 22 bp, Homo sapiens
agtcttcacatcagtctaaaga

SEQ ID NO: 7399784 - DNA, 22 bp, Homo sapiens
agtcttcacatcagtctaaaga

SEQ ID NO: 7399785 - DNA, 22 bp, Homo sapiens
agtcttcactcttcactactat

SEQ ID NO: 7399786 - DNA, 22 bp, Homo sapiens
agtcttcactcttcactactat

SEQ ID NO: 7399787 - DNA, 22 bp, Homo sapiens
agtcttcagagaaattaactct

SEQ ID NO: 7399788 - DNA, 22 bp, Homo sapiens
agtcttcagcagccttctcagg

SEQ ID NO: 7399789 - DNA, 22 bp, Homo sapiens
agtcttcagagaaattaactct

SEQ ID NO: 7399790 - DNA, 22 bp, Homo sapiens
agtcttcagagaaattaactct

SEQ ID NO: 7399791 - DNA, 22 bp, Homo sapiens
agtcttcagcagggttaaaccc

SEQ ID NO: 7399792 - DNA, 22 bp, Homo sapiens
agtcttcatttagttgatccag

SEQ ID NO: 7399793 - DNA, 23 bp, Homo sapiens
agtcttcattgtatttccagacc

SEQ ID NO: 7399794 - DNA, 19 bp, Homo sapiens
agtcttcatctgccaggcc

SEQ ID NO: 7399795 - DNA, 19 bp, Homo sapiens
agtcttcatctgccaggcc

SEQ ID NO: 7399796 - DNA, 23 bp, Homo sapiens
agtcttcattgtatttccagacc

SEQ ID NO: 7399797 - DNA, 22 bp, Homo sapiens
agtcttcagcagggttaaaccc

SEQ ID NO: 7399798 - DNA, 22 bp, Homo sapiens
agtcttcagcatagcatatggc

SEQ ID NO: 7399799 - DNA, 22 bp, Homo sapiens
agtcttcagcagccttctcagg

SEQ ID NO: 7399800 - DNA, 22 bp, Homo sapiens
agtcttcagcagccttctcagg

SEQ ID NO: 7399801 - DNA, 21 bp, Homo sapiens
agtcttaggcacagctgtgtc

SEQ ID NO: 7399802 - DNA, 22 bp, Homo sapiens
agtcttatgtgatttatctttc

SEQ ID NO: 7399803 - DNA, 22 bp, Homo sapiens
agtcttatgtgatttatctttc

SEQ ID NO: 7399804 - DNA, 22 bp, Homo sapiens
agtcttatggttaaatagatgc

SEQ ID NO: 7399805 - DNA, 22 bp, Homo sapiens
agtcttatggttaaatagatgc

SEQ ID NO: 7399806 - DNA, 22 bp, Homo sapiens
agtcttatggttaaatagatgc

SEQ ID NO: 7399807 - DNA, 22 bp, Homo sapiens
agtcttatatcactatgctctg

SEQ ID NO: 7399808 - DNA, 22 bp, Homo sapiens
agtcttaggctccattagtaga

SEQ ID NO: 7399809 - DNA, 22 bp, Homo sapiens
agtcttatggttaaatagatgc

SEQ ID NO: 7399810 - DNA, 22 bp, Homo sapiens
agtcttatggccatctctgatt

SEQ ID NO: 7399811 - DNA, 22 bp, Homo sapiens
agtcttatggccatctctgatt

SEQ ID NO: 7399812 - DNA, 22 bp, Homo sapiens
agtcttatatcactatgctctg

SEQ ID NO: 7399813 - DNA, 22 bp, Homo sapiens
agtcttagtatggttttaggtt

SEQ ID NO: 7399814 - DNA, 22 bp, Homo sapiens
agtcttagtctctattgtgttt

SEQ ID NO: 7399815 - DNA, 22 bp, Homo sapiens
agtcttagtctctattgtgttt

SEQ ID NO: 7399816 - DNA, 22 bp, Homo sapiens
agtcttagaactacagtgccta

SEQ ID NO: 7399817 - DNA, 22 bp, Homo sapiens
ctcattgcccagatccccacag

SEQ ID NO: 7399818 - DNA, 22 bp, Homo sapiens
agtcttagaactacagtgccta

SEQ ID NO: 7399819 - DNA, 22 bp, Homo sapiens
agtcttagaactacagtgccta

SEQ ID NO: 7399820 - DNA, 21 bp, Homo sapiens
agtcttaggcacagctgtgtc

SEQ ID NO: 7399821 - DNA, 22 bp, Homo sapiens
agtcttagataagtgaccaatg

SEQ ID NO: 7399822 - DNA, 22 bp, Homo sapiens
agtcttagataagtgaccaatg

SEQ ID NO: 7399823 - DNA, 22 bp, Homo sapiens
agtcttagagtctgtgtcatga

SEQ ID NO: 7399824 - DNA, 22 bp, Homo sapiens
agtcttagattttattttggtc

SEQ ID NO: 7399825 - DNA, 22 bp, Homo sapiens
agtcttagattttattttggtc

SEQ ID NO: 7399826 - DNA, 21 bp, Homo sapiens
agtcttaggcacagctgtgtc

SEQ ID NO: 7399827 - DNA, 22 bp, Homo sapiens
agtcttaggctccattagtaga

SEQ ID NO: 7399828 - DNA, 22 bp, Homo sapiens
agtcttctgaataagaatcact

SEQ ID NO: 7399829 - DNA, 22 bp, Homo sapiens
agtcttctgaataagaatcact

SEQ ID NO: 7399830 - DNA, 18 bp, Homo sapiens
agtcttctgatccatttt

SEQ ID NO: 7399831 - DNA, 22 bp, Homo sapiens
agtcttctgaataagaatcact

SEQ ID NO: 7399832 - DNA, 22 bp, Homo sapiens
agtcttctgaataagaatcact

SEQ ID NO: 7399833 - DNA, 21 bp, Homo sapiens
agtcttctccagaggctgggg

SEQ ID NO: 7399834 - DNA, 21 bp, Homo sapiens
agtcttctccagaggctgggg

SEQ ID NO: 7399835 - DNA, 22 bp, Homo sapiens
agtcttctcatttcacatgctt

SEQ ID NO: 7399836 - DNA, 22 bp, Homo sapiens
agtcttctcatttcacatgctt

SEQ ID NO: 7399837 - DNA, 20 bp, Homo sapiens
agtcttcccccagaagaggg

SEQ ID NO: 7399838 - DNA, 22 bp, Homo sapiens
agtcttccctgtgccagagtgt

SEQ ID NO: 7399839 - DNA, 22 bp, Homo sapiens
agtcttcctgcccagcaggagg

SEQ ID NO: 7399840 - DNA, 22 bp, Homo sapiens
agtcttctagctgggtttggtt

SEQ ID NO: 7399841 - DNA, 22 bp, Homo sapiens
agtcttctcatttcacatgctt

SEQ ID NO: 7399842 - DNA, 22 bp, Homo sapiens
agtcttctcatttcacatgctt

SEQ ID NO: 7399843 - DNA, 22 bp, Homo sapiens
agtcttccctgtgccagagtgt

SEQ ID NO: 7399844 - DNA, 22 bp, Homo sapiens
agtcttcccagaggaggtgcca

SEQ ID NO: 7399845 - DNA, 22 bp, Homo sapiens
ctccagcctcatctcctggctg

SEQ ID NO: 7399846 - DNA, 18 bp, Homo sapiens
ctccagagctgtgagaca

SEQ ID NO: 7399847 - DNA, 22 bp, Homo sapiens
ctccagagagtccagctctggg

SEQ ID NO: 7399848 - DNA, 22 bp, Homo sapiens
ctccagagatacacggtcttgc

SEQ ID NO: 7399849 - DNA, 22 bp, Homo sapiens
ctccagagatccattgaatgta

SEQ ID NO: 7399850 - DNA, 22 bp, Homo sapiens
ctccagagatccattgaatgta

SEQ ID NO: 7399851 - DNA, 22 bp, Homo sapiens
ctccagagccagtgcttttcca

SEQ ID NO: 7399852 - DNA, 22 bp, Homo sapiens
ctccagagccagtgcttttcca

SEQ ID NO: 7399853 - DNA, 22 bp, Homo sapiens
ctccagctcgcgagctctgctc

SEQ ID NO: 7399854 - DNA, 22 bp, Homo sapiens
ctccagctcttaactgcggaag

SEQ ID NO: 7399855 - DNA, 22 bp, Homo sapiens
ctccagctcttaactgcggaag

SEQ ID NO: 7399856 - DNA, 22 bp, Homo sapiens
ctccagctcttaactgcggaag

SEQ ID NO: 7399857 - DNA, 22 bp, Homo sapiens
ctccagctgagtaagaacacta

SEQ ID NO: 7399858 - DNA, 22 bp, Homo sapiens
ctccagctgccaccagatgttt

SEQ ID NO: 7399859 - DNA, 22 bp, Homo sapiens
ctccagctgagtaagaacacta

SEQ ID NO: 7399860 - DNA, 22 bp, Homo sapiens
ctccagctcttaactgcggaag

SEQ ID NO: 7399861 - DNA, 22 bp, Homo sapiens
ctccagctcttaactgcggaag

SEQ ID NO: 7399862 - DNA, 22 bp, Homo sapiens
ctccagctcttaactgcggaag

SEQ ID NO: 7399863 - DNA, 22 bp, Homo sapiens
ctccctctctaaggcaaagaga

SEQ ID NO: 7399864 - DNA, 22 bp, Homo sapiens
ctccctctgtccgaggccggct

SEQ ID NO: 7399865 - DNA, 22 bp, Homo sapiens
ctccctctgaggctttgagcct

SEQ ID NO: 7399866 - DNA, 22 bp, Homo sapiens
ctccctctgtccgaggccggct

SEQ ID NO: 7399867 - DNA, 22 bp, Homo sapiens
ctcctacattccaccttggact

SEQ ID NO: 7399868 - DNA, 22 bp, Homo sapiens
ctcctagatgtcttcagagaaa

SEQ ID NO: 7399869 - DNA, 22 bp, Homo sapiens
ctcctacagtgtttgagtccag

SEQ ID NO: 7399870 - DNA, 22 bp, Homo sapiens
ctcctacagtgtttgagtccag

SEQ ID NO: 7399871 - DNA, 22 bp, Homo sapiens
ctccggaggggcgctcatgctt

SEQ ID NO: 7399872 - DNA, 22 bp, Homo sapiens
ctccgggtagctgaggccctgg

SEQ ID NO: 7399873 - DNA, 22 bp, Homo sapiens
ctccgtgctattttagtatcgc

SEQ ID NO: 7399874 - DNA, 22 bp, Homo sapiens
ctccgtggctgtggacgcagcc

SEQ ID NO: 7399875 - DNA, 22 bp, Homo sapiens
ctccgtggctgtggacgcagcc

SEQ ID NO: 7399876 - DNA, 22 bp, Homo sapiens
ctccggccgcggtgcccagcgc

SEQ ID NO: 7399877 - DNA, 22 bp, Homo sapiens
ctcctacagtgtttgagtccag

SEQ ID NO: 7399878 - DNA, 22 bp, Homo sapiens
ctcctcagaacagccttggctg

SEQ ID NO: 7399879 - DNA, 22 bp, Homo sapiens
ctcctcagaacagccttggctg

SEQ ID NO: 7399880 - DNA, 22 bp, Homo sapiens
ctcctcactttccagactgggc

SEQ ID NO: 7399881 - DNA, 22 bp, Homo sapiens
ctcctcactttccagactgggc

SEQ ID NO: 7399882 - DNA, 22 bp, Homo sapiens
ctcctcactttccagactgggc

SEQ ID NO: 7399883 - DNA, 22 bp, Homo sapiens
ctcctcacacccactgcaacca

SEQ ID NO: 7399884 - DNA, 22 bp, Homo sapiens
ctcctcacacccactgcaacca

SEQ ID NO: 7399885 - DNA, 22 bp, Homo sapiens
ctcctcaaggtctcaggaataa

SEQ ID NO: 7399886 - DNA, 22 bp, Homo sapiens
ctcctcacacccactgcaacca

SEQ ID NO: 7399887 - DNA, 22 bp, Homo sapiens
ctcctaggacgccgctgctcct

SEQ ID NO: 7399888 - DNA, 22 bp, Homo sapiens
ctcctaggacgccgctgctcct

SEQ ID NO: 7399889 - DNA, 22 bp, Homo sapiens
ctcctaggtaacagggtggttt

SEQ ID NO: 7399890 - DNA, 22 bp, Homo sapiens
ctcctaggtgctcactggggtc

SEQ ID NO: 7399891 - DNA, 22 bp, Homo sapiens
ctcctaggtgctcactggggtc

SEQ ID NO: 7399892 - DNA, 22 bp, Homo sapiens
ctcctaggtgctcactggggtc

SEQ ID NO: 7399893 - DNA, 22 bp, Homo sapiens
ctcctagtgcacacctgtccac

SEQ ID NO: 7399894 - DNA, 22 bp, Homo sapiens
ctcctagtgcacacctgtccac

SEQ ID NO: 7399895 - DNA, 22 bp, Homo sapiens
ctcctgcctgtgggactgagga

SEQ ID NO: 7399896 - DNA, 22 bp, Homo sapiens
ctcctgcctgtgggactgagga

SEQ ID NO: 7399897 - DNA, 22 bp, Homo sapiens
ctcctgcccacgtgctacttct

SEQ ID NO: 7399898 - DNA, 22 bp, Homo sapiens
ctcctggctcgcccccagctga

SEQ ID NO: 7399899 - DNA, 22 bp, Homo sapiens
ctcctggctctgccacttacta

SEQ ID NO: 7399900 - DNA, 22 bp, Homo sapiens
ctcctggctcgcccccagctga

SEQ ID NO: 7399901 - DNA, 22 bp, Homo sapiens
ctcctggctcgcccccagctga

SEQ ID NO: 7399902 - DNA, 22 bp, Homo sapiens
ctcctggctctctgtttagtgt

SEQ ID NO: 7399903 - DNA, 18 bp, Homo sapiens
ctcctggctgatggtgag

SEQ ID NO: 7399904 - DNA, 18 bp, Homo sapiens
ctcctggctgatggtgag

SEQ ID NO: 7399905 - DNA, 19 bp, Homo sapiens
ctcctggctctgtcatttt

SEQ ID NO: 7399906 - DNA, 18 bp, Homo sapiens
ctcctggctgatggtgag

SEQ ID NO: 7399907 - DNA, 19 bp, Homo sapiens
ctcctggctctgtcatttt

SEQ ID NO: 7399908 - DNA, 19 bp, Homo sapiens
ctcctggctctgtcatttt

SEQ ID NO: 7399909 - DNA, 22 bp, Homo sapiens
ctcctcagactttccttgtccg

SEQ ID NO: 7399910 - DNA, 22 bp, Homo sapiens
ctcctcagactttccttgtccg

SEQ ID NO: 7399911 - DNA, 22 bp, Homo sapiens
ctcctcagagagcagcttgggg

SEQ ID NO: 7399912 - DNA, 22 bp, Homo sapiens
ctcctcagactttccttgtccg

SEQ ID NO: 7399913 - DNA, 22 bp, Homo sapiens
ctcctgcccacgtgctacttct

SEQ ID NO: 7399914 - DNA, 22 bp, Homo sapiens
ctcctgcccacgtgctacttct

SEQ ID NO: 7399915 - DNA, 22 bp, Homo sapiens
ctcctgccaccgcggtgtcctg

SEQ ID NO: 7399916 - DNA, 22 bp, Homo sapiens
ctcctgccaccgcggtgtcctg

SEQ ID NO: 7399917 - DNA, 22 bp, Homo sapiens
ctcctgccaccgcggtgtcctg

SEQ ID NO: 7399918 - DNA, 22 bp, Homo sapiens
ctcctcagaagagggtaacaca

SEQ ID NO: 7399919 - DNA, 22 bp, Homo sapiens
ctcctcagaacagccttggctg

SEQ ID NO: 7399920 - DNA, 22 bp, Homo sapiens
ctcctcagaacagccttggctg

SEQ ID NO: 7399921 - DNA, 22 bp, Homo sapiens
ctcctcagaacagccttggctg

SEQ ID NO: 7399922 - DNA, 22 bp, Homo sapiens
ctcctcagaacagccttggctg

SEQ ID NO: 7399923 - DNA, 22 bp, Homo sapiens
ctcctcagaacagccttggctg

SEQ ID NO: 7399924 - DNA, 22 bp, Homo sapiens
ctcctcagaagagggtaacaca

SEQ ID NO: 7399925 - DNA, 22 bp, Homo sapiens
ctcctcagaagagggtaacaca

SEQ ID NO: 7399926 - DNA, 22 bp, Homo sapiens
ctcctcagaagagggtaacaca

SEQ ID NO: 7399927 - DNA, 22 bp, Homo sapiens
ctcctcagaagagggtaacaca

SEQ ID NO: 7399928 - DNA, 18 bp, Homo sapiens
ctccagggaactcagtca

SEQ ID NO: 7399929 - DNA, 20 bp, Homo sapiens
ctccagggaacagactggag

SEQ ID NO: 7399930 - DNA, 20 bp, Homo sapiens
ctccagggaacagactggag

SEQ ID NO: 7399931 - DNA, 18 bp, Homo sapiens
ctccagggaactcagtca

SEQ ID NO: 7399932 - DNA, 18 bp, Homo sapiens
ctccagggaactcagtca

SEQ ID NO: 7399933 - DNA, 18 bp, Homo sapiens
ctccagggaactcagtca

SEQ ID NO: 7399934 - DNA, 18 bp, Homo sapiens
ctccagggaactcagtca

SEQ ID NO: 7399935 - DNA, 18 bp, Homo sapiens
ctccagggaactcagtca

SEQ ID NO: 7399936 - DNA, 20 bp, Homo sapiens
ctccagggaacagactggag

SEQ ID NO: 7399937 - DNA, 20 bp, Homo sapiens
ctccagggaacagactggag

SEQ ID NO: 7399938 - DNA, 20 bp, Homo sapiens
ctccagggaacagactggag

SEQ ID NO: 7399939 - DNA, 20 bp, Homo sapiens
ctccagggaacagactggag

SEQ ID NO: 7399940 - DNA, 20 bp, Homo sapiens
ctccagggaacagactggag

SEQ ID NO: 7399941 - DNA, 20 bp, Homo sapiens
ctccagggaacagactggag

SEQ ID NO: 7399942 - DNA, 22 bp, Homo sapiens
ctccctcagaggagcacctgtt

SEQ ID NO: 7399943 - DNA, 22 bp, Homo sapiens
ctccctcagaggagcacctgtt

SEQ ID NO: 7399944 - DNA, 22 bp, Homo sapiens
ctccctcagaggagcacctgtt

SEQ ID NO: 7399945 - DNA, 22 bp, Homo sapiens
ctccctcagaggagcacctgtt

SEQ ID NO: 7399946 - DNA, 22 bp, Homo sapiens
ctccctcagaggagcacctgtt

SEQ ID NO: 7399947 - DNA, 22 bp, Homo sapiens
ctccctcaccatgacccgctgt

SEQ ID NO: 7399948 - DNA, 22 bp, Homo sapiens
ctccctcaccatgacccgctgt

SEQ ID NO: 7399949 - DNA, 22 bp, Homo sapiens
ctccctcaggccttagccctgc

SEQ ID NO: 7399950 - DNA, 22 bp, Homo sapiens
ctccctcaggccttagccctgc

SEQ ID NO: 7399951 - DNA, 22 bp, Homo sapiens
ctccctcagaggagcacctgtt

SEQ ID NO: 7399952 - DNA, 22 bp, Homo sapiens
ctccctcagaggagcacctgtt

SEQ ID NO: 7399953 - DNA, 22 bp, Homo sapiens
ctccctcagaggagcacctgtt

SEQ ID NO: 7399954 - DNA, 22 bp, Homo sapiens
ctccctcagaggagcacctgtt

SEQ ID NO: 7399955 - DNA, 22 bp, Homo sapiens
ctcccaggttgattctttccct

SEQ ID NO: 7399956 - DNA, 22 bp, Homo sapiens
ctccctcaccatgacccgctgt

SEQ ID NO: 7399957 - DNA, 22 bp, Homo sapiens
ctccctcaccatgacccgctgt

SEQ ID NO: 7399958 - DNA, 22 bp, Homo sapiens
ctccctcaccatgacccgctgt

SEQ ID NO: 7399959 - DNA, 22 bp, Homo sapiens
ctccctcaccatgacccgctgt

SEQ ID NO: 7399960 - DNA, 22 bp, Homo sapiens
ctccctcacacccttgcccaga

SEQ ID NO: 7399961 - DNA, 22 bp, Homo sapiens
ctccctcaggccttagccctgc

SEQ ID NO: 7399962 - DNA, 22 bp, Homo sapiens
ctccctcaggccttagccctgc

SEQ ID NO: 7399963 - DNA, 22 bp, Homo sapiens
ctccctcaggccttagccctgc

SEQ ID NO: 7399964 - DNA, 22 bp, Homo sapiens
ctccctcaggccttagccctgc

SEQ ID NO: 7399965 - DNA, 22 bp, Homo sapiens
ctccctcatatacccagcgaga

SEQ ID NO: 7399966 - DNA, 22 bp, Homo sapiens
ctccctcatatacccagcgaga

SEQ ID NO: 7399967 - DNA, 22 bp, Homo sapiens
ctccctcatatacccagcgaga

SEQ ID NO: 7399968 - DNA, 22 bp, Homo sapiens
ctccctcatatacccagcgaga

SEQ ID NO: 7399969 - DNA, 22 bp, Homo sapiens
ctccctccctacgtgagctcac

SEQ ID NO: 7399970 - DNA, 22 bp, Homo sapiens
ctccctccctacgtgagctcac

SEQ ID NO: 7399971 - DNA, 22 bp, Homo sapiens
ctccctccaaataagactcggg

SEQ ID NO: 7399972 - DNA, 22 bp, Homo sapiens
ctccctccctacgtgagctcac

SEQ ID NO: 7399973 - DNA, 22 bp, Homo sapiens
ctccctcatatacccagcgaga

SEQ ID NO: 7399974 - DNA, 22 bp, Homo sapiens
ctccctcatatacccagcgaga

SEQ ID NO: 7399975 - DNA, 22 bp, Homo sapiens
ctccctccaaataagactcggg

SEQ ID NO: 7399976 - DNA, 22 bp, Homo sapiens
ctccctccaaataagactcggg

SEQ ID NO: 7399977 - DNA, 22 bp, Homo sapiens
ctccctccaaataagactcggg

SEQ ID NO: 7399978 - DNA, 22 bp, Homo sapiens
ctccctctcaccggagccctgg

SEQ ID NO: 7399979 - DNA, 22 bp, Homo sapiens
ctccctctcaccggagccctgg

SEQ ID NO: 7399980 - DNA, 22 bp, Homo sapiens
ctccctctcaccggagccctgg

SEQ ID NO: 7399981 - DNA, 22 bp, Homo sapiens
ctccctctcaccggagccctgg

SEQ ID NO: 7399982 - DNA, 22 bp, Homo sapiens
ctccctctcaccggagccctgg

SEQ ID NO: 7399983 - DNA, 22 bp, Homo sapiens
ctccctctcaccggagccctgg

SEQ ID NO: 7399984 - DNA, 22 bp, Homo sapiens
ctccctcgagaacgcccctctc

SEQ ID NO: 7399985 - DNA, 22 bp, Homo sapiens
ctccctcgagaacgcccctctc

SEQ ID NO: 7399986 - DNA, 22 bp, Homo sapiens
ctccctcctcaaatatctttgt

SEQ ID NO: 7399987 - DNA, 22 bp, Homo sapiens
ctccctcctcaaatatctttgt

SEQ ID NO: 7399988 - DNA, 22 bp, Homo sapiens
ctccctccctacgtgagctcac

SEQ ID NO: 7399989 - DNA, 22 bp, Homo sapiens
ctccctccctacgtgagctcac

SEQ ID NO: 7399990 - DNA, 22 bp, Homo sapiens
ctccctccctacgtgagctcac

SEQ ID NO: 7399991 - DNA, 22 bp, Homo sapiens
ctccctccctacgtgagctcac

SEQ ID NO: 7399992 - DNA, 22 bp, Homo sapiens
ctccctccctacgtgagctcac

SEQ ID NO: 7399993 - DNA, 22 bp, Homo sapiens
ctccctccctacgtgagctcac

SEQ ID NO: 7399994 - DNA, 22 bp, Homo sapiens
ctccctccctacgtgagctcac

SEQ ID NO: 7399995 - DNA, 22 bp, Homo sapiens
ctccctccctacgtgagctcac

SEQ ID NO: 7399996 - DNA, 22 bp, Homo sapiens
ctcctgggaaaggctggacaca

SEQ ID NO: 7399997 - DNA, 22 bp, Homo sapiens
ctcctgggaaaggctggacaca

SEQ ID NO: 7399998 - DNA, 22 bp, Homo sapiens
ctcctgggaaaggctggacaca

SEQ ID NO: 7399999 - DNA, 22 bp, Homo sapiens
ctcctgggaaaggctggacaca

SEQ ID NO: 7400000 - DNA, 22 bp, Homo sapiens
ctcctgggaaaggctggacaca

SEQ ID NO: 7400001 - DNA, 22 bp, Homo sapiens
ctcctgggaaaggctggacaca

SEQ ID NO: 7400002 - DNA, 22 bp, Homo sapiens
ctcctgggaaaggctggacaca

SEQ ID NO: 7400003 - DNA, 22 bp, Homo sapiens
ctcctggctttcccagaccagg

SEQ ID NO: 7400004 - DNA, 22 bp, Homo sapiens
ctcctggctttcccagaccagg

SEQ ID NO: 7400005 - DNA, 22 bp, Homo sapiens
ctcctggcttctgaaatcgtgg

SEQ ID NO: 7400006 - DNA, 22 bp, Homo sapiens
ctcctggctttcccagaccagg

SEQ ID NO: 7400007 - DNA, 22 bp, Homo sapiens
ctcctggctttcccagaccagg

SEQ ID NO: 7400008 - DNA, 22 bp, Homo sapiens
ctcctgggaaaggctggacaca

SEQ ID NO: 7400009 - DNA, 22 bp, Homo sapiens
ctcctgggaaatgaaggggcag

SEQ ID NO: 7400010 - DNA, 22 bp, Homo sapiens
ctcctgggaatttagttgtgag

SEQ ID NO: 7400011 - DNA, 22 bp, Homo sapiens
ctcctgggaaatgaaggggcag

SEQ ID NO: 7400012 - DNA, 20 bp, Homo sapiens
ctcctgggactgctggttat

SEQ ID NO: 7400013 - DNA, 20 bp, Homo sapiens
ctcctgggactgctggttat

SEQ ID NO: 7400014 - DNA, 20 bp, Homo sapiens
ctcctgggactgctggttat

SEQ ID NO: 7400015 - DNA, 22 bp, Homo sapiens
ctcctgggaatttagttgtgag

SEQ ID NO: 7400016 - DNA, 22 bp, Homo sapiens
ctcctgggaatttagttgtgag

SEQ ID NO: 7400017 - DNA, 22 bp, Homo sapiens
ctcctgggggacagcggcaggg

SEQ ID NO: 7400018 - DNA, 22 bp, Homo sapiens
ctcctgggggacagcggcaggg

SEQ ID NO: 7400019 - DNA, 22 bp, Homo sapiens
ctcctgggggacagcggcaggg

SEQ ID NO: 7400020 - DNA, 22 bp, Homo sapiens
ctcctgggggacagcggcaggg

SEQ ID NO: 7400021 - DNA, 22 bp, Homo sapiens
ctcctgggggacagcggcaggg

SEQ ID NO: 7400022 - DNA, 22 bp, Homo sapiens
ctcctgggggacagcggcaggg

SEQ ID NO: 7400023 - DNA, 22 bp, Homo sapiens
ctcctgggggacagcggcaggg

SEQ ID NO: 7400024 - DNA, 22 bp, Homo sapiens
ctcctgggggacagcggcaggg

SEQ ID NO: 7400025 - DNA, 22 bp, Homo sapiens
ctcctgggggacagcggcaggg

SEQ ID NO: 7400026 - DNA, 22 bp, Homo sapiens
ctcctgggtcattgccagcaaa

SEQ ID NO: 7400027 - DNA, 22 bp, Homo sapiens
ctcctgggtcattgccagcaaa

SEQ ID NO: 7400028 - DNA, 22 bp, Homo sapiens
ctcctgggtcattgccagcaaa

SEQ ID NO: 7400029 - DNA, 22 bp, Homo sapiens
ctcctgggtcattgccagcaaa

SEQ ID NO: 7400030 - DNA, 22 bp, Homo sapiens
ctcctgggtcattgccagcaaa

SEQ ID NO: 7400031 - DNA, 22 bp, Homo sapiens
ctcctggggcacttagaagcaa

SEQ ID NO: 7400032 - DNA, 22 bp, Homo sapiens
ctcctggggcacttagaagcaa

SEQ ID NO: 7400033 - DNA, 22 bp, Homo sapiens
ctcctggggcacttagaagcaa

SEQ ID NO: 7400034 - DNA, 22 bp, Homo sapiens
ctcctggggcacttagaagcaa

SEQ ID NO: 7400035 - DNA, 22 bp, Homo sapiens
ctcctgggcttcgaaggctccc

SEQ ID NO: 7400036 - DNA, 20 bp, Homo sapiens
ctcctgggactgctggttat

SEQ ID NO: 7400037 - DNA, 20 bp, Homo sapiens
ctcctgggactgctggttat

SEQ ID NO: 7400038 - DNA, 22 bp, Homo sapiens
ctcctgggagcagggatggatg

SEQ ID NO: 7400039 - DNA, 22 bp, Homo sapiens
ctcctggggccatggaaggaac

SEQ ID NO: 7400040 - DNA, 22 bp, Homo sapiens
ctcctggggccatggaaggaac

SEQ ID NO: 7400041 - DNA, 22 bp, Homo sapiens
ctcctggggccatggaaggaac

SEQ ID NO: 7400042 - DNA, 22 bp, Homo sapiens
ctcctggggccatggaaggaac

SEQ ID NO: 7400043 - DNA, 22 bp, Homo sapiens
ctcctggggcacttagaagcaa

SEQ ID NO: 7400044 - DNA, 22 bp, Homo sapiens
ctcctggggccatggaaggaac

SEQ ID NO: 7400045 - DNA, 22 bp, Homo sapiens
agtggcagagctgtgtcttgaa

SEQ ID NO: 7400046 - DNA, 22 bp, Homo sapiens
agtggcagaggttgactgcagt

SEQ ID NO: 7400047 - DNA, 22 bp, Homo sapiens
agtggcagagctgtgtcttgaa

SEQ ID NO: 7400048 - DNA, 22 bp, Homo sapiens
agtggcagagctgtgtcttgaa

SEQ ID NO: 7400049 - DNA, 22 bp, Homo sapiens
agtggcagaagtcactgggtag

SEQ ID NO: 7400050 - DNA, 22 bp, Homo sapiens
agtggcagaagtcactgggtag

SEQ ID NO: 7400051 - DNA, 22 bp, Homo sapiens
agtggcagaagtcactgggtag

SEQ ID NO: 7400052 - DNA, 22 bp, Homo sapiens
agtggcagaagccaagtctgca

SEQ ID NO: 7400053 - DNA, 22 bp, Homo sapiens
agtggcagaagccaagtctgca

SEQ ID NO: 7400054 - DNA, 22 bp, Homo sapiens
agtggcagaagccaagtctgca

SEQ ID NO: 7400055 - DNA, 22 bp, Homo sapiens
agtggcagaagccaagtctgca

SEQ ID NO: 7400056 - DNA, 22 bp, Homo sapiens
agtggcagaagccaagtctgca

SEQ ID NO: 7400057 - DNA, 22 bp, Homo sapiens
ctcctgggtcattgccagcaaa

SEQ ID NO: 7400058 - DNA, 22 bp, Homo sapiens
ctcctgggtcattgccagcaaa

SEQ ID NO: 7400059 - DNA, 20 bp, Homo sapiens
ctcctggtccaggagcctga

SEQ ID NO: 7400060 - DNA, 20 bp, Homo sapiens
ctcctggtccaggagcctga

SEQ ID NO: 7400061 - DNA, 22 bp, Homo sapiens
ctcctggtgctggggctgccgc

SEQ ID NO: 7400062 - DNA, 22 bp, Homo sapiens
ctcctggtgctggggctgccgc

SEQ ID NO: 7400063 - DNA, 23 bp, Homo sapiens
ctcctggtgctgctatcaggggt

SEQ ID NO: 7400064 - DNA, 22 bp, Homo sapiens
ctcctggtgactcccagataaa

SEQ ID NO: 7400065 - DNA, 20 bp, Homo sapiens
ctcctggtccaggagcctga

SEQ ID NO: 7400066 - DNA, 20 bp, Homo sapiens
ctcctggtccaggagcctga

SEQ ID NO: 7400067 - DNA, 22 bp, Homo sapiens
agtggcagaggttgactgcagt

SEQ ID NO: 7400068 - DNA, 22 bp, Homo sapiens
agtggcagaggttgactgcagt

SEQ ID NO: 7400069 - DNA, 22 bp, Homo sapiens
agtggcagaggttgactgcagt

SEQ ID NO: 7400070 - DNA, 22 bp, Homo sapiens
agtggcagaggttgactgcagt

SEQ ID NO: 7400071 - DNA, 22 bp, Homo sapiens
agtggcagaggttgactgcagt

SEQ ID NO: 7400072 - DNA, 22 bp, Homo sapiens
agtggcagaggttgactgcagt

SEQ ID NO: 7400073 - DNA, 22 bp, Homo sapiens
agtggcagaggttgactgcagt

SEQ ID NO: 7400074 - DNA, 22 bp, Homo sapiens
agtggcagagtcagggtttgga

SEQ ID NO: 7400075 - DNA, 22 bp, Homo sapiens
agtggcagagtgcactcaggca

SEQ ID NO: 7400076 - DNA, 22 bp, Homo sapiens
agtggcagagtcagggtttgga

SEQ ID NO: 7400077 - DNA, 22 bp, Homo sapiens
agtggcagagtcagggtttgga

SEQ ID NO: 7400078 - DNA, 22 bp, Homo sapiens
agtggcagagtcagggtttgga

SEQ ID NO: 7400079 - DNA, 22 bp, Homo sapiens
agtggcagagtcagggtttgga

SEQ ID NO: 7400080 - DNA, 22 bp, Homo sapiens
agtggcagagtgcactcaggca

SEQ ID NO: 7400081 - DNA, 22 bp, Homo sapiens
agtggcagagtgcactcaggca

SEQ ID NO: 7400082 - DNA, 22 bp, Homo sapiens
agtggcagagtgcactcaggca

SEQ ID NO: 7400083 - DNA, 22 bp, Homo sapiens
agtggcagagtgcactcaggca

SEQ ID NO: 7400084 - DNA, 22 bp, Homo sapiens
agtggcagagtgcactcaggca

SEQ ID NO: 7400085 - DNA, 22 bp, Homo sapiens
agtggcagagtgcactcaggca

SEQ ID NO: 7400086 - DNA, 22 bp, Homo sapiens
agtggcagagtgcactcaggca

SEQ ID NO: 7400087 - DNA, 22 bp, Homo sapiens
ctctcagaagtagcacgtgggc

SEQ ID NO: 7400088 - DNA, 22 bp, Homo sapiens
agtggcagccgagcaggagatg

SEQ ID NO: 7400089 - DNA, 22 bp, Homo sapiens
agtggcagccgagcaggagatg

SEQ ID NO: 7400090 - DNA, 22 bp, Homo sapiens
ctctcagaagtagcacgtgggc

SEQ ID NO: 7400091 - DNA, 19 bp, Homo sapiens
agtggcagatctggaagta

SEQ ID NO: 7400092 - DNA, 19 bp, Homo sapiens
agtggcagatctggaagta

SEQ ID NO: 7400093 - DNA, 22 bp, Homo sapiens
agtggcagccgagcaggagatg

SEQ ID NO: 7400094 - DNA, 22 bp, Homo sapiens
agtggcagccgagcaggagatg

SEQ ID NO: 7400095 - DNA, 22 bp, Homo sapiens
ctctcagaagtttatgtcagaa

SEQ ID NO: 7400096 - DNA, 22 bp, Homo sapiens
ctctcagaagtagcacgtgggc

SEQ ID NO: 7400097 - DNA, 22 bp, Homo sapiens
ctctcagaagtttatgtcagaa

SEQ ID NO: 7400098 - DNA, 22 bp, Homo sapiens
ctctcagaagtttatgtcagaa

SEQ ID NO: 7400099 - DNA, 22 bp, Homo sapiens
ctctcagacacccatttggaaa

SEQ ID NO: 7400100 - DNA, 22 bp, Homo sapiens
ctctcagacacccatttggaaa

SEQ ID NO: 7400101 - DNA, 22 bp, Homo sapiens
ctctcagatggagtgtgaatgg

SEQ ID NO: 7400102 - DNA, 22 bp, Homo sapiens
ctctcagactgaagggcctgtg

SEQ ID NO: 7400103 - DNA, 22 bp, Homo sapiens
ctctcagatggagtgtgaatgg

SEQ ID NO: 7400104 - DNA, 22 bp, Homo sapiens
ctctcagcaggaaagcatgcaa

SEQ ID NO: 7400105 - DNA, 22 bp, Homo sapiens
ctctcagcaggaaagcatgcaa

SEQ ID NO: 7400106 - DNA, 22 bp, Homo sapiens
ctctcagcaggaaagcatgcaa

SEQ ID NO: 7400107 - DNA, 22 bp, Homo sapiens
agtggcagagtgcactcaggca

SEQ ID NO: 7400108 - DNA, 22 bp, Homo sapiens
agtggcagagtgcactcaggca

SEQ ID NO: 7400109 - DNA, 22 bp, Homo sapiens
agtggcagagttgaataattga

SEQ ID NO: 7400110 - DNA, 22 bp, Homo sapiens
agtggcagagttgaataattga

SEQ ID NO: 7400111 - DNA, 22 bp, Homo sapiens
agtggcagatctctggtctgga

SEQ ID NO: 7400112 - DNA, 16 bp, Homo sapiens
agtggcagataatacc

SEQ ID NO: 7400113 - DNA, 22 bp, Homo sapiens
agtggcagatctctggtctgga

SEQ ID NO: 7400114 - DNA, 22 bp, Homo sapiens
agtggcagatctctggtctgga

SEQ ID NO: 7400115 - DNA, 19 bp, Homo sapiens
agtggcagatctggaagta

SEQ ID NO: 7400116 - DNA, 19 bp, Homo sapiens
agtggcagatctggaagta

SEQ ID NO: 7400117 - DNA, 19 bp, Homo sapiens
agtggcagatctggaagta

SEQ ID NO: 7400118 - DNA, 19 bp, Homo sapiens
agtggcagatctggaagta

SEQ ID NO: 7400119 - DNA, 19 bp, Homo sapiens
agtggcagatctggaagta

SEQ ID NO: 7400120 - DNA, 19 bp, Homo sapiens
agtggcagatctggaagta

SEQ ID NO: 7400121 - DNA, 19 bp, Homo sapiens
agtggcagatctggaagta

SEQ ID NO: 7400122 - DNA, 22 bp, Homo sapiens
agtggcagatctctggtctgga

SEQ ID NO: 7400123 - DNA, 22 bp, Homo sapiens
agtggcagatctctggtctgga

SEQ ID NO: 7400124 - DNA, 22 bp, Homo sapiens
agtggcagatctctggtctgga

SEQ ID NO: 7400125 - DNA, 22 bp, Homo sapiens
agtggcagatctctggtctgga

SEQ ID NO: 7400126 - DNA, 22 bp, Homo sapiens
agtggcagatctctggtctgga

SEQ ID NO: 7400127 - DNA, 23 bp, Homo sapiens
ctctgcaggagagtgggcagggc

SEQ ID NO: 7400128 - DNA, 21 bp, Homo sapiens
ctctgcagccctgcttccagg

SEQ ID NO: 7400129 - DNA, 23 bp, Homo sapiens
ctctgcaggagagtgggcagggc

SEQ ID NO: 7400130 - DNA, 21 bp, Homo sapiens
ctctgcagccctgcttccagg

SEQ ID NO: 7400131 - DNA, 23 bp, Homo sapiens
ctctgcaggagagtgggcagggc

SEQ ID NO: 7400132 - DNA, 23 bp, Homo sapiens
ctctgcaggagagtgggcagggc

SEQ ID NO: 7400133 - DNA, 22 bp, Homo sapiens
ctctgcaggcctgtgaagggtg

SEQ ID NO: 7400134 - DNA, 22 bp, Homo sapiens
ctctgcaggcctgtgaagggtg

SEQ ID NO: 7400135 - DNA, 22 bp, Homo sapiens
ctctgcaggcctgtgaagggtg

SEQ ID NO: 7400136 - DNA, 22 bp, Homo sapiens
ctctgcaggcctgtgaagggtg

SEQ ID NO: 7400137 - DNA, 22 bp, Homo sapiens
ctctgcaggcacccagggtggg

SEQ ID NO: 7400138 - DNA, 22 bp, Homo sapiens
ctctgcaggcacccagggtggg

SEQ ID NO: 7400139 - DNA, 22 bp, Homo sapiens
ctctgcaggcacccagggtggg

SEQ ID NO: 7400140 - DNA, 22 bp, Homo sapiens
ctctgcaggcacccagggtggg

SEQ ID NO: 7400141 - DNA, 22 bp, Homo sapiens
ctctgcaggcacccagggtggg

SEQ ID NO: 7400142 - DNA, 22 bp, Homo sapiens
ctctgcaggggaggcatgcact

SEQ ID NO: 7400143 - DNA, 17 bp, Homo sapiens
ctctgcagtgcatggct

SEQ ID NO: 7400144 - DNA, 17 bp, Homo sapiens
ctctgcagtgcatggct

SEQ ID NO: 7400145 - DNA, 17 bp, Homo sapiens
ctctgcagtgcatggct

SEQ ID NO: 7400146 - DNA, 22 bp, Homo sapiens
ctctgcaggggaggcatgcact

SEQ ID NO: 7400147 - DNA, 22 bp, Homo sapiens
ctctgcaggccttgagtgtggt

SEQ ID NO: 7400148 - DNA, 22 bp, Homo sapiens
ctctgcaggccttgagtgtggt

SEQ ID NO: 7400149 - DNA, 22 bp, Homo sapiens
ctctgcaggccttgagtgtggt

SEQ ID NO: 7400150 - DNA, 17 bp, Homo sapiens
ctctgcagtgcatggct

SEQ ID NO: 7400151 - DNA, 17 bp, Homo sapiens
ctctgcagtgcatggct

SEQ ID NO: 7400152 - DNA, 17 bp, Homo sapiens
ctctgcagtgcatggct

SEQ ID NO: 7400153 - DNA, 22 bp, Homo sapiens
ctctgcagtgtaacagcgcttg

SEQ ID NO: 7400154 - DNA, 22 bp, Homo sapiens
ctctgcagtgtaacagcgcttg

SEQ ID NO: 7400155 - DNA, 22 bp, Homo sapiens
ctctgcagtgtaacagcgcttg

SEQ ID NO: 7400156 - DNA, 21 bp, Homo sapiens
ctctgcagtgcccaccttgcc

SEQ ID NO: 7400157 - DNA, 21 bp, Homo sapiens
ctctgcagtgcccaccttgcc

SEQ ID NO: 7400158 - DNA, 21 bp, Homo sapiens
ctctgcagtgcccaccttgcc

SEQ ID NO: 7400159 - DNA, 15 bp, Homo sapiens
ctctcaggcaggcag

SEQ ID NO: 7400160 - DNA, 19 bp, Homo sapiens
ctctcagcctgtctccttg

SEQ ID NO: 7400161 - DNA, 22 bp, Homo sapiens
ctctcaggcttgggtcgtggca

SEQ ID NO: 7400162 - DNA, 22 bp, Homo sapiens
ctctcagggacccagccagcct

SEQ ID NO: 7400163 - DNA, 22 bp, Homo sapiens
ctctcagggacccagccagcct

SEQ ID NO: 7400164 - DNA, 22 bp, Homo sapiens
ctctcagggacccagccagcct

SEQ ID NO: 7400165 - DNA, 22 bp, Homo sapiens
ctctcagcaggaaagcatgcaa

SEQ ID NO: 7400166 - DNA, 19 bp, Homo sapiens
ctctcagcctgtctccttg

SEQ ID NO: 7400167 - DNA, 19 bp, Homo sapiens
ctctcagcctgtctccttg

SEQ ID NO: 7400168 - DNA, 19 bp, Homo sapiens
ctctcagcctgtctccttg

SEQ ID NO: 7400169 - DNA, 22 bp, Homo sapiens
ctctcaggtagagcccaagaat

SEQ ID NO: 7400170 - DNA, 22 bp, Homo sapiens
ctctcagtgccacacagccatt

SEQ ID NO: 7400171 - DNA, 22 bp, Homo sapiens
ctctcagtcctgcgcgcctctg

SEQ ID NO: 7400172 - DNA, 22 bp, Homo sapiens
ctctcagggcaggtggcctttc

SEQ ID NO: 7400173 - DNA, 22 bp, Homo sapiens
ctctcagggtccctgcggagga

SEQ ID NO: 7400174 - DNA, 22 bp, Homo sapiens
ctctcagggcaggtggcctttc

SEQ ID NO: 7400175 - DNA, 22 bp, Homo sapiens
ctctgagcccgctgcagcccca

SEQ ID NO: 7400176 - DNA, 22 bp, Homo sapiens
ctctgagcccgctgcagcccca

SEQ ID NO: 7400177 - DNA, 22 bp, Homo sapiens
ctctgagcccgctgcagcccca

SEQ ID NO: 7400178 - DNA, 22 bp, Homo sapiens
ctctgagctccaaaagtcagca

SEQ ID NO: 7400179 - DNA, 22 bp, Homo sapiens
ctctgagctccaaaagtcagca

SEQ ID NO: 7400180 - DNA, 21 bp, Homo sapiens
ctctgcagccctgcttccagg

SEQ ID NO: 7400181 - DNA, 21 bp, Homo sapiens
ctctgcagccctgcttccagg

SEQ ID NO: 7400182 - DNA, 22 bp, Homo sapiens
ctctgagcccgctgcagcccca

SEQ ID NO: 7400183 - DNA, 22 bp, Homo sapiens
ctctgagcagcggtgccgaagt

SEQ ID NO: 7400184 - DNA, 22 bp, Homo sapiens
ctctccaagttatcaagatgaa

SEQ ID NO: 7400185 - DNA, 22 bp, Homo sapiens
ctctccaagttatcaagatgaa

SEQ ID NO: 7400186 - DNA, 22 bp, Homo sapiens
ctctcatgagcattcctaaggg

SEQ ID NO: 7400187 - DNA, 22 bp, Homo sapiens
ctctcagtttcctcaactgtaa

SEQ ID NO: 7400188 - DNA, 22 bp, Homo sapiens
ctctcagtgccacacagccatt

SEQ ID NO: 7400189 - DNA, 22 bp, Homo sapiens
ctctcagtgccacacagccatt

SEQ ID NO: 7400190 - DNA, 22 bp, Homo sapiens
ctctcagtgccacacagccatt

SEQ ID NO: 7400191 - DNA, 22 bp, Homo sapiens
ctctcagtgcctgccctaggct

SEQ ID NO: 7400192 - DNA, 22 bp, Homo sapiens
ctctcagtgcctgccctaggct

SEQ ID NO: 7400193 - DNA, 22 bp, Homo sapiens
ctctcagtttcctcaactgtaa

SEQ ID NO: 7400194 - DNA, 22 bp, Homo sapiens
ctctgccaagatgacaggtaag

SEQ ID NO: 7400195 - DNA, 22 bp, Homo sapiens
ctctgcattttaacagatgatt

SEQ ID NO: 7400196 - DNA, 22 bp, Homo sapiens
ctctgcattttaacagatgatt

SEQ ID NO: 7400197 - DNA, 22 bp, Homo sapiens
ctctgcattttaacagatgatt

SEQ ID NO: 7400198 - DNA, 22 bp, Homo sapiens
ctctgcctgccactgttcaggc

SEQ ID NO: 7400199 - DNA, 22 bp, Homo sapiens
ctctgccaagatgacaggtaag

SEQ ID NO: 7400200 - DNA, 22 bp, Homo sapiens
ctctgcctgccactgttcaggc

SEQ ID NO: 7400201 - DNA, 22 bp, Homo sapiens
ctctgcatgccacatgagtgac

SEQ ID NO: 7400202 - DNA, 22 bp, Homo sapiens
ctctgcatgccacatgagtgac

SEQ ID NO: 7400203 - DNA, 22 bp, Homo sapiens
ctctgcatgccttgctcagaca

SEQ ID NO: 7400204 - DNA, 22 bp, Homo sapiens
ctctgcatgccttgctcagaca

SEQ ID NO: 7400205 - DNA, 22 bp, Homo sapiens
ctctgcatgccacatgagtgac

SEQ ID NO: 7400206 - DNA, 22 bp, Homo sapiens
ctctgcagtgtaacagcgcttg

SEQ ID NO: 7400207 - DNA, 22 bp, Homo sapiens
ctctgcagtgtaacagcgcttg

SEQ ID NO: 7400208 - DNA, 22 bp, Homo sapiens
ctctgcatcagcttcattctgt

SEQ ID NO: 7400209 - DNA, 22 bp, Homo sapiens
ctctgcctgtctcatcctgcaa

SEQ ID NO: 7400210 - DNA, 22 bp, Homo sapiens
ctctgcctgtctcatcctgcaa

SEQ ID NO: 7400211 - DNA, 22 bp, Homo sapiens
ctctgcctgtctcatcctgcaa

SEQ ID NO: 7400212 - DNA, 22 bp, Homo sapiens
ctctgcctgcccaccgacccat

SEQ ID NO: 7400213 - DNA, 22 bp, Homo sapiens
ctctgcctgcccaccgacccat

SEQ ID NO: 7400214 - DNA, 22 bp, Homo sapiens
ctctgcctgcccaccgacccat

SEQ ID NO: 7400215 - DNA, 22 bp, Homo sapiens
ctctgcctgcccaccgacccat

SEQ ID NO: 7400216 - DNA, 22 bp, Homo sapiens
ctctgcctgtgtcgccaccaca

SEQ ID NO: 7400217 - DNA, 22 bp, Homo sapiens
ctctgcctgtgtcgccaccaca

SEQ ID NO: 7400218 - DNA, 22 bp, Homo sapiens
ctctgcctgtgtcgccaccaca

SEQ ID NO: 7400219 - DNA, 22 bp, Homo sapiens
ctctgcctgtgtcgccaccaca

SEQ ID NO: 7400220 - DNA, 22 bp, Homo sapiens
ctctgcctgtgtcgccaccaca

SEQ ID NO: 7400221 - DNA, 22 bp, Homo sapiens
ctctgcctgtgtcgccaccaca

SEQ ID NO: 7400222 - DNA, 22 bp, Homo sapiens
ctctgcctgtgtcgccaccaca

SEQ ID NO: 7400223 - DNA, 22 bp, Homo sapiens
ctctgcctgtctcatcctgcaa

SEQ ID NO: 7400224 - DNA, 22 bp, Homo sapiens
ctctgcctgtgtcgccaccaca

SEQ ID NO: 7400225 - DNA, 21 bp, Homo sapiens
ctctgctgagtcctaggattc

SEQ ID NO: 7400226 - DNA, 21 bp, Homo sapiens
ctctgctgagtcctaggattc

SEQ ID NO: 7400227 - DNA, 21 bp, Homo sapiens
ctctgctgagtcctaggattc

SEQ ID NO: 7400228 - DNA, 22 bp, Homo sapiens
ctctgctgatatagcttttcaa

SEQ ID NO: 7400229 - DNA, 22 bp, Homo sapiens
ctctgctgatctcagctgggct

SEQ ID NO: 7400230 - DNA, 22 bp, Homo sapiens
ctctgctgatctcagctgggct

SEQ ID NO: 7400231 - DNA, 22 bp, Homo sapiens
ctctgctgatctcagctgggct

SEQ ID NO: 7400232 - DNA, 22 bp, Homo sapiens
ctctgctgatctcagctgggct

SEQ ID NO: 7400233 - DNA, 22 bp, Homo sapiens
ctctgctgatctcagctgggct

SEQ ID NO: 7400234 - DNA, 22 bp, Homo sapiens
ctctgctgatctcagctgggct

SEQ ID NO: 7400235 - DNA, 22 bp, Homo sapiens
ctctgctgatctcagctgggct

SEQ ID NO: 7400236 - DNA, 22 bp, Homo sapiens
ctctgctgatctcagctgggct

SEQ ID NO: 7400237 - DNA, 22 bp, Homo sapiens
ctctgctgcaggaaggcgtgca

SEQ ID NO: 7400238 - DNA, 20 bp, Homo sapiens
ctctggcaaaggatgcctat

SEQ ID NO: 7400239 - DNA, 22 bp, Homo sapiens
ctctggcttctaccttgcagtt

SEQ ID NO: 7400240 - DNA, 22 bp, Homo sapiens
ctctggattgctgtgagatgct

SEQ ID NO: 7400241 - DNA, 23 bp, Homo sapiens
ctctggatcctgtagctcctggc

SEQ ID NO: 7400242 - DNA, 23 bp, Homo sapiens
ctctggatcctgtagctcctggc

SEQ ID NO: 7400243 - DNA, 22 bp, Homo sapiens
ctctggatctgccctgacgcca

SEQ ID NO: 7400244 - DNA, 22 bp, Homo sapiens
ctctgcgccaccctcgcctgct

SEQ ID NO: 7400245 - DNA, 22 bp, Homo sapiens
ctctgcgccaccctcgcctgct

SEQ ID NO: 7400246 - DNA, 18 bp, Homo sapiens
ctctgctaatgggcagct

SEQ ID NO: 7400247 - DNA, 22 bp, Homo sapiens
ctctgctagggctgaggtgttc

SEQ ID NO: 7400248 - DNA, 22 bp, Homo sapiens
ctctgctagggctgaggtgttc

SEQ ID NO: 7400249 - DNA, 22 bp, Homo sapiens
ctctgctagggctgaggtgttc

SEQ ID NO: 7400250 - DNA, 22 bp, Homo sapiens
ctctgctactgttaaaccattt

SEQ ID NO: 7400251 - DNA, 22 bp, Homo sapiens
ctctgctcaccagccatgtgat

SEQ ID NO: 7400252 - DNA, 22 bp, Homo sapiens
ctctgctgagccagagtcccca

SEQ ID NO: 7400253 - DNA, 22 bp, Homo sapiens
ctctgctcagatgatttatcaa

SEQ ID NO: 7400254 - DNA, 22 bp, Homo sapiens
ctctgctcaccagccatgtgat

SEQ ID NO: 7400255 - DNA, 21 bp, Homo sapiens
ctctgctgagctccattttca

SEQ ID NO: 7400256 - DNA, 22 bp, Homo sapiens
ctctgctgagccagagtcccca

SEQ ID NO: 7400257 - DNA, 22 bp, Homo sapiens
ctctgctgagccagagtcccca

SEQ ID NO: 7400258 - DNA, 22 bp, Homo sapiens
ctctgggaaagattgtgcaggc

SEQ ID NO: 7400259 - DNA, 22 bp, Homo sapiens
ctctgggaaagattgtgcaggc

SEQ ID NO: 7400260 - DNA, 22 bp, Homo sapiens
ctctgggaagggctgagcactg

SEQ ID NO: 7400261 - DNA, 22 bp, Homo sapiens
ctctgggaagggctgagcactg

SEQ ID NO: 7400262 - DNA, 22 bp, Homo sapiens
ctctgggaagggctgagcactg

SEQ ID NO: 7400263 - DNA, 22 bp, Homo sapiens
ctctgggaaagattgtgcaggc

SEQ ID NO: 7400264 - DNA, 22 bp, Homo sapiens
ctctgggaaagattgtgcaggc

SEQ ID NO: 7400265 - DNA, 22 bp, Homo sapiens
ctctgggaagggctgagcactg

SEQ ID NO: 7400266 - DNA, 22 bp, Homo sapiens
ctctgggaagggctgagcactg

SEQ ID NO: 7400267 - DNA, 22 bp, Homo sapiens
ctctgggaattctgagcaagca

SEQ ID NO: 7400268 - DNA, 22 bp, Homo sapiens
ctctgggaattctgagcaagca

SEQ ID NO: 7400269 - DNA, 22 bp, Homo sapiens
ctctgggaattctgagcaagca

SEQ ID NO: 7400270 - DNA, 22 bp, Homo sapiens
ctctggcttgttaatgcatatt

SEQ ID NO: 7400271 - DNA, 22 bp, Homo sapiens
ctctggcttggtaaaaacttct

SEQ ID NO: 7400272 - DNA, 22 bp, Homo sapiens
ctctggcttgttaatgcatatt

SEQ ID NO: 7400273 - DNA, 22 bp, Homo sapiens
ctctggcttgttaatgcatatt

SEQ ID NO: 7400274 - DNA, 22 bp, Homo sapiens
ctctggcttgttaatgcatatt

SEQ ID NO: 7400275 - DNA, 22 bp, Homo sapiens
ctctggctttaaggatgccaca

SEQ ID NO: 7400276 - DNA, 22 bp, Homo sapiens
ctctggctttaaggatgccaca

SEQ ID NO: 7400277 - DNA, 22 bp, Homo sapiens
ctctggctttaaggatgccaca

SEQ ID NO: 7400278 - DNA, 22 bp, Homo sapiens
ctctggctttcccagggaggag

SEQ ID NO: 7400279 - DNA, 22 bp, Homo sapiens
ctctggctttcccagggaggag

SEQ ID NO: 7400280 - DNA, 22 bp, Homo sapiens
ctctggctttgctcatgcatcc

SEQ ID NO: 7400281 - DNA, 22 bp, Homo sapiens
ctctggctttcccagggaggag

SEQ ID NO: 7400282 - DNA, 22 bp, Homo sapiens
ctctggctttgctcatgcatcc

SEQ ID NO: 7400283 - DNA, 22 bp, Homo sapiens
ctctggctttcccagggaggag

SEQ ID NO: 7400284 - DNA, 22 bp, Homo sapiens
ctctggctttgctcatgcatcc

SEQ ID NO: 7400285 - DNA, 22 bp, Homo sapiens
ctctggctttgctcatgcatcc

SEQ ID NO: 7400286 - DNA, 22 bp, Homo sapiens
ctctggctttgctcatgcatcc

SEQ ID NO: 7400287 - DNA, 22 bp, Homo sapiens
ctctgggaccacgtgactctgc

SEQ ID NO: 7400288 - DNA, 21 bp, Homo sapiens
ctctgggacatttcttagcag

SEQ ID NO: 7400289 - DNA, 22 bp, Homo sapiens
ctctgggaccacgtgactctgc

SEQ ID NO: 7400290 - DNA, 22 bp, Homo sapiens
ctctgggaccacgtgactctgc

SEQ ID NO: 7400291 - DNA, 22 bp, Homo sapiens
ctctgggacatcccttggccta

SEQ ID NO: 7400292 - DNA, 22 bp, Homo sapiens
ctctgggacatcccttggccta

SEQ ID NO: 7400293 - DNA, 22 bp, Homo sapiens
ctctgggacatcccttggccta

SEQ ID NO: 7400294 - DNA, 22 bp, Homo sapiens
ctctgggacatcccttggccta

SEQ ID NO: 7400295 - DNA, 22 bp, Homo sapiens
ctctgggaccatggcaagtgcg

SEQ ID NO: 7400296 - DNA, 22 bp, Homo sapiens
ctctgggaccatggcaagtgcg

SEQ ID NO: 7400297 - DNA, 22 bp, Homo sapiens
ctctgggaccatggcaagtgcg

SEQ ID NO: 7400298 - DNA, 22 bp, Homo sapiens
ctctgggactagaaccccaggg

SEQ ID NO: 7400299 - DNA, 22 bp, Homo sapiens
ctctgggaccatggcaagtgcg

SEQ ID NO: 7400300 - DNA, 18 bp, Homo sapiens
ctctgggagaggcataca

SEQ ID NO: 7400301 - DNA, 22 bp, Homo sapiens
ctctgggagaggacacttggag

SEQ ID NO: 7400302 - DNA, 22 bp, Homo sapiens
ctctgggactagaaccccaggg

SEQ ID NO: 7400303 - DNA, 22 bp, Homo sapiens
ctctgggagaggacacttggag

SEQ ID NO: 7400304 - DNA, 22 bp, Homo sapiens
ctctgggcttcaagtcagattt

SEQ ID NO: 7400305 - DNA, 22 bp, Homo sapiens
ctctgggcttacctgcttcctg

SEQ ID NO: 7400306 - DNA, 22 bp, Homo sapiens
ctctgggcttcaagtcagattt

SEQ ID NO: 7400307 - DNA, 22 bp, Homo sapiens
ctctgggcttcaagtcagattt

SEQ ID NO: 7400308 - DNA, 22 bp, Homo sapiens
ctctgggcttgttgacctgcac

SEQ ID NO: 7400309 - DNA, 22 bp, Homo sapiens
ctctgggcttgttgacctgcac

SEQ ID NO: 7400310 - DNA, 22 bp, Homo sapiens
ctctgggcttgttgacctgcac

SEQ ID NO: 7400311 - DNA, 20 bp, Homo sapiens
ctctgggctgcgttgcaaac

SEQ ID NO: 7400312 - DNA, 22 bp, Homo sapiens
ctctgggctgccttttagctct

SEQ ID NO: 7400313 - DNA, 18 bp, Homo sapiens
ctctgggagaggcataca

SEQ ID NO: 7400314 - DNA, 22 bp, Homo sapiens
ctctgggcttacctgcttcctg

SEQ ID NO: 7400315 - DNA, 22 bp, Homo sapiens
ctctgggcttacctgcttcctg

SEQ ID NO: 7400316 - DNA, 22 bp, Homo sapiens
ctctttggttaatcacacagat

SEQ ID NO: 7400317 - DNA, 22 bp, Homo sapiens
ctgaaaggcagtgggtagtgtg

SEQ ID NO: 7400318 - DNA, 22 bp, Homo sapiens
ctgaaagggagaacaccaagag

SEQ ID NO: 7400319 - DNA, 22 bp, Homo sapiens
ctgaaagggttacatagtaagt

SEQ ID NO: 7400320 - DNA, 22 bp, Homo sapiens
ctgaaaggcagtgggtagtgtg

SEQ ID NO: 7400321 - DNA, 22 bp, Homo sapiens
ctgaaagggagaacaccaagag

SEQ ID NO: 7400322 - DNA, 22 bp, Homo sapiens
ctgaaaggtataaataagactt

SEQ ID NO: 7400323 - DNA, 23 bp, Homo sapiens
ctgaaataccagaaaatcagtgt

SEQ ID NO: 7400324 - DNA, 22 bp, Homo sapiens
ctgaaataaagttgctaaaatt

SEQ ID NO: 7400325 - DNA, 22 bp, Homo sapiens
ctgaaataaagttgctaaaatt

SEQ ID NO: 7400326 - DNA, 22 bp, Homo sapiens
ctgaaataaagttgctaaaatt

SEQ ID NO: 7400327 - DNA, 23 bp, Homo sapiens
ctgaaataccagaaaatcagtgt

SEQ ID NO: 7400328 - DNA, 22 bp, Homo sapiens
ctgaaataaagttgctaaaatt

SEQ ID NO: 7400329 - DNA, 23 bp, Homo sapiens
ctgaaataccagaaaatcagtgt

SEQ ID NO: 7400330 - DNA, 23 bp, Homo sapiens
ctgaaataccagaaaatcagtgt

SEQ ID NO: 7400331 - DNA, 23 bp, Homo sapiens
ctgaaataccagaaaatcagtgt

SEQ ID NO: 7400332 - DNA, 17 bp, Homo sapiens
ctgaaatattatgataa

SEQ ID NO: 7400333 - DNA, 17 bp, Homo sapiens
ctgaaatattatgataa

SEQ ID NO: 7400334 - DNA, 17 bp, Homo sapiens
ctgaaatattatgataa

SEQ ID NO: 7400335 - DNA, 22 bp, Homo sapiens
ctgaaatattttaatctcagga

SEQ ID NO: 7400336 - DNA, 22 bp, Homo sapiens
ctgaaatattttaatctcagga

SEQ ID NO: 7400337 - DNA, 22 bp, Homo sapiens
ctgaaatattttaatctcagga

SEQ ID NO: 7400338 - DNA, 22 bp, Homo sapiens
ctgaaatgggcaaaagtagatt

SEQ ID NO: 7400339 - DNA, 22 bp, Homo sapiens
ctgaaatgggcaaaagtagatt

SEQ ID NO: 7400340 - DNA, 22 bp, Homo sapiens
ctgaaatgggcaaaagtagatt

SEQ ID NO: 7400341 - DNA, 22 bp, Homo sapiens
ctgaaatcaattttgattatct

SEQ ID NO: 7400342 - DNA, 22 bp, Homo sapiens
ctgaaatcaattttgattatct

SEQ ID NO: 7400343 - DNA, 22 bp, Homo sapiens
ctgaaatgacggtttggggcaa

SEQ ID NO: 7400344 - DNA, 17 bp, Homo sapiens
ctgaaatattatgataa

SEQ ID NO: 7400345 - DNA, 17 bp, Homo sapiens
ctgaaatattatgataa

SEQ ID NO: 7400346 - DNA, 17 bp, Homo sapiens
ctgaaatattatgataa

SEQ ID NO: 7400347 - DNA, 17 bp, Homo sapiens
ctgaaatattatgataa

SEQ ID NO: 7400348 - DNA, 17 bp, Homo sapiens
ctgaaatattatgataa

SEQ ID NO: 7400349 - DNA, 22 bp, Homo sapiens
ctgaaatatatactgggaaaaa

SEQ ID NO: 7400350 - DNA, 22 bp, Homo sapiens
ctgaaatatagatgtgaacagt

SEQ ID NO: 7400351 - DNA, 22 bp, Homo sapiens
ctgaaatagtttcatagaactt

SEQ ID NO: 7400352 - DNA, 22 bp, Homo sapiens
ctgaaatagtttcatagaactt

SEQ ID NO: 7400353 - DNA, 23 bp, Homo sapiens
ctgaaataccagaaaatcagtgt

SEQ ID NO: 7400354 - DNA, 22 bp, Homo sapiens
ctgaaatagtttcatagaactt

SEQ ID NO: 7400355 - DNA, 22 bp, Homo sapiens
ctctggggttaagcttccatgg

SEQ ID NO: 7400356 - DNA, 22 bp, Homo sapiens
ctctggggttaagcttccatgg

SEQ ID NO: 7400357 - DNA, 22 bp, Homo sapiens
ctctggggttaagcttccatgg

SEQ ID NO: 7400358 - DNA, 22 bp, Homo sapiens
ctctggggttaagcttccatgg

SEQ ID NO: 7400359 - DNA, 22 bp, Homo sapiens
ctctggggttaagcttccatgg

SEQ ID NO: 7400360 - DNA, 22 bp, Homo sapiens
ctctttggttaatcacacagat

SEQ ID NO: 7400361 - DNA, 22 bp, Homo sapiens
ctctttggtgcaccttgcagtc

SEQ ID NO: 7400362 - DNA, 22 bp, Homo sapiens
ctctggggtgcttcgacacttc

SEQ ID NO: 7400363 - DNA, 22 bp, Homo sapiens
ctctggggtggaggaggctgac

SEQ ID NO: 7400364 - DNA, 22 bp, Homo sapiens
ctctggggtggaggaggctgac

SEQ ID NO: 7400365 - DNA, 22 bp, Homo sapiens
ctctggggtggaggaggctgac

SEQ ID NO: 7400366 - DNA, 22 bp, Homo sapiens
ctctggggtggaggaggctgac

SEQ ID NO: 7400367 - DNA, 22 bp, Homo sapiens
ctctggggtggaggaggctgac

SEQ ID NO: 7400368 - DNA, 22 bp, Homo sapiens
ctctggggtggaggaggctgac

SEQ ID NO: 7400369 - DNA, 22 bp, Homo sapiens
ctctggggtggaggaggctgac

SEQ ID NO: 7400370 - DNA, 22 bp, Homo sapiens
ctctggggtggaggaggctgac

SEQ ID NO: 7400371 - DNA, 22 bp, Homo sapiens
ctctggggtggaggaggctgac

SEQ ID NO: 7400372 - DNA, 22 bp, Homo sapiens
ctctggggtggaggaggctgac

SEQ ID NO: 7400373 - DNA, 22 bp, Homo sapiens
ctctggggaagcagccagctgg

SEQ ID NO: 7400374 - DNA, 22 bp, Homo sapiens
ctctggggaaatggatatgtac

SEQ ID NO: 7400375 - DNA, 22 bp, Homo sapiens
ctctggggaaatggatatgtac

SEQ ID NO: 7400376 - DNA, 22 bp, Homo sapiens
ctctggggaagcagccagctgg

SEQ ID NO: 7400377 - DNA, 22 bp, Homo sapiens
ctctggggaagcagccagctgg

SEQ ID NO: 7400378 - DNA, 22 bp, Homo sapiens
ctctggggaagcagccagctgg

SEQ ID NO: 7400379 - DNA, 22 bp, Homo sapiens
ctctggggaagcagccagctgg

SEQ ID NO: 7400380 - DNA, 22 bp, Homo sapiens
ctctggggaaatggatatgtac

SEQ ID NO: 7400381 - DNA, 22 bp, Homo sapiens
ctctggggaaatggatatgtac

SEQ ID NO: 7400382 - DNA, 17 bp, Homo sapiens
ctctggggacagttcta

SEQ ID NO: 7400383 - DNA, 17 bp, Homo sapiens
ctctggggacagttcta

SEQ ID NO: 7400384 - DNA, 17 bp, Homo sapiens
ctctggggacagttcta

SEQ ID NO: 7400385 - DNA, 22 bp, Homo sapiens
ctctggggaagcagccagctgg

SEQ ID NO: 7400386 - DNA, 22 bp, Homo sapiens
ctctggggaagcagccagctgg

SEQ ID NO: 7400387 - DNA, 22 bp, Homo sapiens
ctctggggaagcagccagctgg

SEQ ID NO: 7400388 - DNA, 22 bp, Homo sapiens
ctctggggaagcagccagctgg

SEQ ID NO: 7400389 - DNA, 22 bp, Homo sapiens
ctctggggtgcttcgacacttc

SEQ ID NO: 7400390 - DNA, 22 bp, Homo sapiens
ctctggggtgcttcgacacttc

SEQ ID NO: 7400391 - DNA, 22 bp, Homo sapiens
ctctggggtgcttcgacacttc

SEQ ID NO: 7400392 - DNA, 22 bp, Homo sapiens
ctctggggtgcttcgacacttc

SEQ ID NO: 7400393 - DNA, 22 bp, Homo sapiens
ctctggggtgcttcgacacttc

SEQ ID NO: 7400394 - DNA, 17 bp, Homo sapiens
ctctggggacagttcta

SEQ ID NO: 7400395 - DNA, 17 bp, Homo sapiens
ctctggggacagttcta

SEQ ID NO: 7400396 - DNA, 17 bp, Homo sapiens
ctctggggacagttcta

SEQ ID NO: 7400397 - DNA, 22 bp, Homo sapiens
ctgacttttttcagccacagtg

SEQ ID NO: 7400398 - DNA, 22 bp, Homo sapiens
ctgacttttttcagccacagtg

SEQ ID NO: 7400399 - DNA, 22 bp, Homo sapiens
ctgacttttttcagccacagtg

SEQ ID NO: 7400400 - DNA, 22 bp, Homo sapiens
ctgactttgctcataggtcaaa

SEQ ID NO: 7400401 - DNA, 22 bp, Homo sapiens
ctgacttttccaaataatactt

SEQ ID NO: 7400402 - DNA, 22 bp, Homo sapiens
ctgacttttccaaataatactt

SEQ ID NO: 7400403 - DNA, 22 bp, Homo sapiens
ctgactttgctcataggtcaaa

SEQ ID NO: 7400404 - DNA, 22 bp, Homo sapiens
ctgactttgacttggtcattga

SEQ ID NO: 7400405 - DNA, 22 bp, Homo sapiens
ctgactttgctcataggtcaaa

SEQ ID NO: 7400406 - DNA, 22 bp, Homo sapiens
ctgacttttccaaataatactt

SEQ ID NO: 7400407 - DNA, 22 bp, Homo sapiens
ctgacagatacttatgacataa

SEQ ID NO: 7400408 - DNA, 20 bp, Homo sapiens
ctgacagaaaatatttcatc

SEQ ID NO: 7400409 - DNA, 22 bp, Homo sapiens
ctgacagaatcattaagaccat

SEQ ID NO: 7400410 - DNA, 22 bp, Homo sapiens
ctgacagaatcattaagaccat

SEQ ID NO: 7400411 - DNA, 20 bp, Homo sapiens
ctgacagaaaatatttcatc

SEQ ID NO: 7400412 - DNA, 20 bp, Homo sapiens
ctgacagaaaatatttcatc

SEQ ID NO: 7400413 - DNA, 22 bp, Homo sapiens
ctgactttgacttggtcattga

SEQ ID NO: 7400414 - DNA, 22 bp, Homo sapiens
ctgacagatacttatgacataa

SEQ ID NO: 7400415 - DNA, 22 bp, Homo sapiens
ctgacagatacttatgacataa

SEQ ID NO: 7400416 - DNA, 22 bp, Homo sapiens
ctgactttagaacccaaaaagt

SEQ ID NO: 7400417 - DNA, 22 bp, Homo sapiens
ctgactttagaacccaaaaagt

SEQ ID NO: 7400418 - DNA, 22 bp, Homo sapiens
ctgactttagaacccaaaaagt

SEQ ID NO: 7400419 - DNA, 22 bp, Homo sapiens
ctgagaaaagacatttctagat

SEQ ID NO: 7400420 - DNA, 22 bp, Homo sapiens
ctgagaaaagacatttctagat

SEQ ID NO: 7400421 - DNA, 22 bp, Homo sapiens
ctgagaaaagacatttctagat

SEQ ID NO: 7400422 - DNA, 22 bp, Homo sapiens
ctgacttttttcagccacagtg

SEQ ID NO: 7400423 - DNA, 22 bp, Homo sapiens
ctgagaaaagctttcttataca

SEQ ID NO: 7400424 - DNA, 22 bp, Homo sapiens
ctgagaaaagctttcttataca

SEQ ID NO: 7400425 - DNA, 22 bp, Homo sapiens
ctgagaaaagctttcttataca

SEQ ID NO: 7400426 - DNA, 22 bp, Homo sapiens
ctgagaaaagctttcttataca

SEQ ID NO: 7400427 - DNA, 22 bp, Homo sapiens
ctgagaaaatttcaggaagtgt

SEQ ID NO: 7400428 - DNA, 22 bp, Homo sapiens
ctgagaaaatttcaggaagtgt

SEQ ID NO: 7400429 - DNA, 22 bp, Homo sapiens
ctgagaaaagtatgagctctgg

SEQ ID NO: 7400430 - DNA, 22 bp, Homo sapiens
ctgagaaaatttcaggaagtgt

SEQ ID NO: 7400431 - DNA, 22 bp, Homo sapiens
ctgagaaaatttcaggaagtgt

SEQ ID NO: 7400432 - DNA, 22 bp, Homo sapiens
ctgagaaaatttcaggaagtgt

SEQ ID NO: 7400433 - DNA, 22 bp, Homo sapiens
ctgagaaaagtatgagctctgg

SEQ ID NO: 7400434 - DNA, 22 bp, Homo sapiens
ctgagaaaagtatgagctctgg

SEQ ID NO: 7400435 - DNA, 22 bp, Homo sapiens
ctgagaaaagtatgagctctgg

SEQ ID NO: 7400436 - DNA, 22 bp, Homo sapiens
ctgagaaaagtatgagctctgg

SEQ ID NO: 7400437 - DNA, 22 bp, Homo sapiens
ctgagaaaagtatgagctctgg

SEQ ID NO: 7400438 - DNA, 22 bp, Homo sapiens
ctgaatgatataagatctttct

SEQ ID NO: 7400439 - DNA, 22 bp, Homo sapiens
ctgaatgcctgcagagccagag

SEQ ID NO: 7400440 - DNA, 22 bp, Homo sapiens
ctgaatgctttggttctaaaag

SEQ ID NO: 7400441 - DNA, 22 bp, Homo sapiens
ctgaattaagcattacatacat

SEQ ID NO: 7400442 - DNA, 22 bp, Homo sapiens
ctgaattaagcattacatacat

SEQ ID NO: 7400443 - DNA, 22 bp, Homo sapiens
ctgaatgtcgatcagcttgggt

SEQ ID NO: 7400444 - DNA, 18 bp, Homo sapiens
ctgaattatctcatcatt

SEQ ID NO: 7400445 - DNA, 18 bp, Homo sapiens
ctgaattatctcatcatt

SEQ ID NO: 7400446 - DNA, 21 bp, Homo sapiens
ctgaattatgtgcttaccttt

SEQ ID NO: 7400447 - DNA, 21 bp, Homo sapiens
ctgaattatgtgcttaccttt

SEQ ID NO: 7400448 - DNA, 18 bp, Homo sapiens
ctgaattatctcatcatt

SEQ ID NO: 7400449 - DNA, 22 bp, Homo sapiens
ctgaattagatgaaaaaggctc

SEQ ID NO: 7400450 - DNA, 22 bp, Homo sapiens
ctgaattagatgaaaaaggctc

SEQ ID NO: 7400451 - DNA, 22 bp, Homo sapiens
ctgaattaatacacagaatggc

SEQ ID NO: 7400452 - DNA, 22 bp, Homo sapiens
ctgaattagatgaaaaaggctc

SEQ ID NO: 7400453 - DNA, 18 bp, Homo sapiens
ctgaattatctcatcatt

SEQ ID NO: 7400454 - DNA, 22 bp, Homo sapiens
ctgaatgtcgatcagcttgggt

SEQ ID NO: 7400455 - DNA, 22 bp, Homo sapiens
ctgaattaagcattacatacat

SEQ ID NO: 7400456 - DNA, 22 bp, Homo sapiens
ctgaattaatacacagaatggc

SEQ ID NO: 7400457 - DNA, 22 bp, Homo sapiens
ctgaattaatacacagaatggc

SEQ ID NO: 7400458 - DNA, 22 bp, Homo sapiens
ctgaattaatacacagaatggc

SEQ ID NO: 7400459 - DNA, 22 bp, Homo sapiens
ctgaattaatacacagaatggc

SEQ ID NO: 7400460 - DNA, 22 bp, Homo sapiens
ctgaattactgaaggtcaactt

SEQ ID NO: 7400461 - DNA, 22 bp, Homo sapiens
ctgaattactgaaggtcaactt

SEQ ID NO: 7400462 - DNA, 22 bp, Homo sapiens
ctgaattacttattagtgggga

SEQ ID NO: 7400463 - DNA, 22 bp, Homo sapiens
ctgaattacttattagtgggga

SEQ ID NO: 7400464 - DNA, 22 bp, Homo sapiens
ctgacaaacttaattttctgaa

SEQ ID NO: 7400465 - DNA, 22 bp, Homo sapiens
ctgacaaacttaattttctgaa

SEQ ID NO: 7400466 - DNA, 22 bp, Homo sapiens
ctgacaaaccactgctccagct

SEQ ID NO: 7400467 - DNA, 18 bp, Homo sapiens
ctgaattatctcatcatt

SEQ ID NO: 7400468 - DNA, 22 bp, Homo sapiens
ctgacaaaccactgctccagct

SEQ ID NO: 7400469 - DNA, 22 bp, Homo sapiens
ctgaattatttaaggtgaaggg

SEQ ID NO: 7400470 - DNA, 22 bp, Homo sapiens
ctgaattatttaaggtgaaggg

SEQ ID NO: 7400471 - DNA, 22 bp, Homo sapiens
ctgaattctgccttgaggcctt

SEQ ID NO: 7400472 - DNA, 22 bp, Homo sapiens
ctgacaaaccactgctccagct

SEQ ID NO: 7400473 - DNA, 22 bp, Homo sapiens
ctgacaaaccactgctccagct

SEQ ID NO: 7400474 - DNA, 20 bp, Homo sapiens
ctgacagaaaatatttcatc

SEQ ID NO: 7400475 - DNA, 22 bp, Homo sapiens
ctgacacccagcagaactggga

SEQ ID NO: 7400476 - DNA, 22 bp, Homo sapiens
ctgacaaggttgaattgtccca

SEQ ID NO: 7400477 - DNA, 22 bp, Homo sapiens
ctgacacactgagcatttgata

SEQ ID NO: 7400478 - DNA, 22 bp, Homo sapiens
ctgacaaaggcaaggcaggggg

SEQ ID NO: 7400479 - DNA, 22 bp, Homo sapiens
ctgacaaaggcaaggcaggggg

SEQ ID NO: 7400480 - DNA, 22 bp, Homo sapiens
ctgacaaaggcaaggcaggggg

SEQ ID NO: 7400481 - DNA, 22 bp, Homo sapiens
ctgaatgaatggtttgtcttat

SEQ ID NO: 7400482 - DNA, 22 bp, Homo sapiens
ctgaatgactgaagtcacaatt

SEQ ID NO: 7400483 - DNA, 22 bp, Homo sapiens
ctgaatgagggattctgagggc

SEQ ID NO: 7400484 - DNA, 22 bp, Homo sapiens
ctgaagctttacttcaaataca

SEQ ID NO: 7400485 - DNA, 22 bp, Homo sapiens
ctgaagctttacttcaaataca

SEQ ID NO: 7400486 - DNA, 20 bp, Homo sapiens
agtgtctgggcctcaggccc

SEQ ID NO: 7400487 - DNA, 20 bp, Homo sapiens
agtgtctggattttgtaacc

SEQ ID NO: 7400488 - DNA, 20 bp, Homo sapiens
agtgtctgggcctcaggccc

SEQ ID NO: 7400489 - DNA, 22 bp, Homo sapiens
ctgaaggaagcagaagcgaggt

SEQ ID NO: 7400490 - DNA, 22 bp, Homo sapiens
ctgaaggaagcaggtggcctgt

SEQ ID NO: 7400491 - DNA, 20 bp, Homo sapiens
agtgtctggattttgtaacc

SEQ ID NO: 7400492 - DNA, 18 bp, Homo sapiens
agtgtctggatatttggg

SEQ ID NO: 7400493 - DNA, 20 bp, Homo sapiens
agtgtctgggcctcaggccc

SEQ ID NO: 7400494 - DNA, 20 bp, Homo sapiens
agtgtctggattttgtaacc

SEQ ID NO: 7400495 - DNA, 22 bp, Homo sapiens
agtgtctggaggcattcttggt

SEQ ID NO: 7400496 - DNA, 18 bp, Homo sapiens
agtgtctggatatttggg

SEQ ID NO: 7400497 - DNA, 18 bp, Homo sapiens
agtgtctggatatttggg

SEQ ID NO: 7400498 - DNA, 22 bp, Homo sapiens
agtgtctggaggcattcttggt

SEQ ID NO: 7400499 - DNA, 22 bp, Homo sapiens
agtgtctgctttgagtcaggtg

SEQ ID NO: 7400500 - DNA, 22 bp, Homo sapiens
agtgtctgcttatcagttcttg

SEQ ID NO: 7400501 - DNA, 22 bp, Homo sapiens
agtgtctgcttatcagttcttg

SEQ ID NO: 7400502 - DNA, 22 bp, Homo sapiens
agtgtctgctttgagtcaggtg

SEQ ID NO: 7400503 - DNA, 22 bp, Homo sapiens
agtgtctgctttgagtcaggtg

SEQ ID NO: 7400504 - DNA, 22 bp, Homo sapiens
agtgtctgctttgagtcaggtg

SEQ ID NO: 7400505 - DNA, 22 bp, Homo sapiens
agtgtctgctttgagtcaggtg

SEQ ID NO: 7400506 - DNA, 22 bp, Homo sapiens
agtgtctgctttgagtcaggtg

SEQ ID NO: 7400507 - DNA, 22 bp, Homo sapiens
agtgtctgctttgagtcaggtg

SEQ ID NO: 7400508 - DNA, 22 bp, Homo sapiens
agtgtctgctttgagtcaggtg

SEQ ID NO: 7400509 - DNA, 22 bp, Homo sapiens
agtgtctgctttgagtcaggtg

SEQ ID NO: 7400510 - DNA, 22 bp, Homo sapiens
agtgtctgctttgagtcaggtg

SEQ ID NO: 7400511 - DNA, 22 bp, Homo sapiens
ctgaaattattgtttaatcaaa

SEQ ID NO: 7400512 - DNA, 22 bp, Homo sapiens
ctgaaattattgtttaatcaaa

SEQ ID NO: 7400513 - DNA, 22 bp, Homo sapiens
ctgaaattactggccctggagc

SEQ ID NO: 7400514 - DNA, 22 bp, Homo sapiens
ctgaaatgttaaatacttggct

SEQ ID NO: 7400515 - DNA, 22 bp, Homo sapiens
ctgaaattattgtttaatcaaa

SEQ ID NO: 7400516 - DNA, 22 bp, Homo sapiens
ctgaaattattgtttaatcaaa

SEQ ID NO: 7400517 - DNA, 22 bp, Homo sapiens
ctgaaatgttaaatacttggct

SEQ ID NO: 7400518 - DNA, 22 bp, Homo sapiens
ctgaaatggttgcctggagaat

SEQ ID NO: 7400519 - DNA, 22 bp, Homo sapiens
ctgaaatgttaaatacttggct

SEQ ID NO: 7400520 - DNA, 22 bp, Homo sapiens
ctgaaatggttgcctggagaat

SEQ ID NO: 7400521 - DNA, 22 bp, Homo sapiens
ctgaaatggttgcctggagaat

SEQ ID NO: 7400522 - DNA, 22 bp, Homo sapiens
ctgaaattctgcctctgcacaa

SEQ ID NO: 7400523 - DNA, 22 bp, Homo sapiens
agtgtctgcctgggaggagcat

SEQ ID NO: 7400524 - DNA, 22 bp, Homo sapiens
agtgtctgcctgggaggagcat

SEQ ID NO: 7400525 - DNA, 22 bp, Homo sapiens
agtgtctgcctgggaggagcat

SEQ ID NO: 7400526 - DNA, 22 bp, Homo sapiens
agtgtctgcctgggaggagcat

SEQ ID NO: 7400527 - DNA, 22 bp, Homo sapiens
agtgtctgcctgggaggagcat

SEQ ID NO: 7400528 - DNA, 23 bp, Homo sapiens
ctgaaattcagatgctaaagata

SEQ ID NO: 7400529 - DNA, 23 bp, Homo sapiens
ctgaaattcagatgctaaagata

SEQ ID NO: 7400530 - DNA, 23 bp, Homo sapiens
ctgaaattcagatgctaaagata

SEQ ID NO: 7400531 - DNA, 22 bp, Homo sapiens
ctgaaattccatttcagccaca

SEQ ID NO: 7400532 - DNA, 22 bp, Homo sapiens
ctgaaattccatttcagccaca

SEQ ID NO: 7400533 - DNA, 22 bp, Homo sapiens
agtgtctgctcagacagctaca

SEQ ID NO: 7400534 - DNA, 22 bp, Homo sapiens
agtgtctgctcagacagctaca

SEQ ID NO: 7400535 - DNA, 22 bp, Homo sapiens
agtgtctgctcagacagctaca

SEQ ID NO: 7400536 - DNA, 22 bp, Homo sapiens
agtgtctgcttatcagttcttg

SEQ ID NO: 7400537 - DNA, 22 bp, Homo sapiens
agtgtctgctcagacagctaca

SEQ ID NO: 7400538 - DNA, 22 bp, Homo sapiens
agtgtctgcttatcagttcttg

SEQ ID NO: 7400539 - DNA, 22 bp, Homo sapiens
agtgtctgcttatcagttcttg

SEQ ID NO: 7400540 - DNA, 22 bp, Homo sapiens
agtgtctgctaggttcatcaac

SEQ ID NO: 7400541 - DNA, 22 bp, Homo sapiens
agtgtctgctcagacagctaca

SEQ ID NO: 7400542 - DNA, 22 bp, Homo sapiens
agtgtctgctaggttcatcaac

SEQ ID NO: 7400543 - DNA, 22 bp, Homo sapiens
agtgtctgctaggttcatcaac

SEQ ID NO: 7400544 - DNA, 22 bp, Homo sapiens
agtgtctgctaggttcatcaac

SEQ ID NO: 7400545 - DNA, 22 bp, Homo sapiens
agtgtctgcgggcagaggagcg

SEQ ID NO: 7400546 - DNA, 22 bp, Homo sapiens
agtgtctgcgggcagaggagcg

SEQ ID NO: 7400547 - DNA, 22 bp, Homo sapiens
agtgtctgcgggcagaggagcg

SEQ ID NO: 7400548 - DNA, 22 bp, Homo sapiens
agtgtctgcgggcagaggagcg

SEQ ID NO: 7400549 - DNA, 22 bp, Homo sapiens
agtgtctgcggcggggaggcgg

SEQ ID NO: 7400550 - DNA, 22 bp, Homo sapiens
agtgtctgcctgggaggagcat

SEQ ID NO: 7400551 - DNA, 22 bp, Homo sapiens
agtgtctgcgggcagaggagcg

SEQ ID NO: 7400552 - DNA, 22 bp, Homo sapiens
agtgtctgcgggcagaggagcg

SEQ ID NO: 7400553 - DNA, 22 bp, Homo sapiens
agtgtctgcggcggggaggcgg

SEQ ID NO: 7400554 - DNA, 22 bp, Homo sapiens
ctgaggagaggtggcctgtgtt

SEQ ID NO: 7400555 - DNA, 22 bp, Homo sapiens
ctgaggagaggtggcctgtgtt

SEQ ID NO: 7400556 - DNA, 22 bp, Homo sapiens
ctgaggagagatcacgtggtgt

SEQ ID NO: 7400557 - DNA, 22 bp, Homo sapiens
ctgaggagaggtggcctgtgtt

SEQ ID NO: 7400558 - DNA, 22 bp, Homo sapiens
ctgaggagagatcacgtggtgt

SEQ ID NO: 7400559 - DNA, 22 bp, Homo sapiens
ctgaggagaggtggcctgtgtt

SEQ ID NO: 7400560 - DNA, 22 bp, Homo sapiens
ctgaggagaggtggcctgtgtt

SEQ ID NO: 7400561 - DNA, 22 bp, Homo sapiens
ctgaggagaggtggcctgtgtt

SEQ ID NO: 7400562 - DNA, 22 bp, Homo sapiens
ctgaggagaggtggcctgtgtt

SEQ ID NO: 7400563 - DNA, 22 bp, Homo sapiens
ctgaggagaggtggcctgtgtt

SEQ ID NO: 7400564 - DNA, 22 bp, Homo sapiens
ctgaggagaggtggcctgtgtt

SEQ ID NO: 7400565 - DNA, 22 bp, Homo sapiens
ctgaggagaccatcaactaatt

SEQ ID NO: 7400566 - DNA, 22 bp, Homo sapiens
ctgaggagaccatcaactaatt

SEQ ID NO: 7400567 - DNA, 22 bp, Homo sapiens
ctgaggagaccatcaactaatt

SEQ ID NO: 7400568 - DNA, 22 bp, Homo sapiens
ctgaggagacagaagccaaata

SEQ ID NO: 7400569 - DNA, 22 bp, Homo sapiens
ctgaggagaccatcaactaatt

SEQ ID NO: 7400570 - DNA, 22 bp, Homo sapiens
ctgaggagacagaagccaaata

SEQ ID NO: 7400571 - DNA, 22 bp, Homo sapiens
ctgaggagacagaagccaaata

SEQ ID NO: 7400572 - DNA, 22 bp, Homo sapiens
ctgaggagagatcacgtggtgt

SEQ ID NO: 7400573 - DNA, 22 bp, Homo sapiens
ctgaggagagatcacgtggtgt

SEQ ID NO: 7400574 - DNA, 22 bp, Homo sapiens
ctgaggagaccatcaactaatt

SEQ ID NO: 7400575 - DNA, 22 bp, Homo sapiens
ctgaggagagatcacgtggtgt

SEQ ID NO: 7400576 - DNA, 22 bp, Homo sapiens
ctgaggagagatcacgtggtgt

SEQ ID NO: 7400577 - DNA, 22 bp, Homo sapiens
ctgaggagacagaagccaaata

SEQ ID NO: 7400578 - DNA, 22 bp, Homo sapiens
ctgaggagacagaagccaaata

SEQ ID NO: 7400579 - DNA, 17 bp, Homo sapiens
ctgaggagaacagaaag

SEQ ID NO: 7400580 - DNA, 17 bp, Homo sapiens
ctgaggagaacagaaag

SEQ ID NO: 7400581 - DNA, 17 bp, Homo sapiens
ctgaggagaacagaaag

SEQ ID NO: 7400582 - DNA, 17 bp, Homo sapiens
ctgaggagaacagaaag

SEQ ID NO: 7400583 - DNA, 22 bp, Homo sapiens
ctgagctgggactcagtagcaa

SEQ ID NO: 7400584 - DNA, 22 bp, Homo sapiens
ctgaggagaacaatgagatcaa

SEQ ID NO: 7400585 - DNA, 22 bp, Homo sapiens
ctgaggagaacaatgagatcaa

SEQ ID NO: 7400586 - DNA, 22 bp, Homo sapiens
ctgaggagaacaatgagatcaa

SEQ ID NO: 7400587 - DNA, 22 bp, Homo sapiens
ctgaggagaacaatgagatcaa

SEQ ID NO: 7400588 - DNA, 22 bp, Homo sapiens
ctgagcagccccaccagccatt

SEQ ID NO: 7400589 - DNA, 22 bp, Homo sapiens
ctgagctgggactcagtagcaa

SEQ ID NO: 7400590 - DNA, 22 bp, Homo sapiens
ctgagcagcagggagactggtg

SEQ ID NO: 7400591 - DNA, 22 bp, Homo sapiens
ctgagcagcagggagactggtg

SEQ ID NO: 7400592 - DNA, 22 bp, Homo sapiens
ctgagctgggactcagtagcaa

SEQ ID NO: 7400593 - DNA, 22 bp, Homo sapiens
ctgagctgggactcagtagcaa

SEQ ID NO: 7400594 - DNA, 22 bp, Homo sapiens
ctgagcagatgaccagccccag

SEQ ID NO: 7400595 - DNA, 22 bp, Homo sapiens
ctgagcagatgaccagccccag

SEQ ID NO: 7400596 - DNA, 22 bp, Homo sapiens
agttatataactatctagatgc

SEQ ID NO: 7400597 - DNA, 22 bp, Homo sapiens
ctgagcagaggtcaagatactt

SEQ ID NO: 7400598 - DNA, 22 bp, Homo sapiens
ctgagcagaggtcaagatactt

SEQ ID NO: 7400599 - DNA, 19 bp, Homo sapiens
ctgagcagagggaggaact

SEQ ID NO: 7400600 - DNA, 19 bp, Homo sapiens
ctgagcagagggaggaact

SEQ ID NO: 7400601 - DNA, 19 bp, Homo sapiens
ctgagcagagggaggaact

SEQ ID NO: 7400602 - DNA, 22 bp, Homo sapiens
agttatataactatctagatgc

SEQ ID NO: 7400603 - DNA, 22 bp, Homo sapiens
ctgagcagcaacccagagcctc

SEQ ID NO: 7400604 - DNA, 22 bp, Homo sapiens
ctgagcagcaacccagagcctc

SEQ ID NO: 7400605 - DNA, 22 bp, Homo sapiens
ctgagcagcaacccagagcctc

SEQ ID NO: 7400606 - DNA, 22 bp, Homo sapiens
ctgagcagcaacccagagcctc

SEQ ID NO: 7400607 - DNA, 22 bp, Homo sapiens
ctgagcagcaacccagagcctc

SEQ ID NO: 7400608 - DNA, 22 bp, Homo sapiens
ctgagcagcaacccagagcctc

SEQ ID NO: 7400609 - DNA, 22 bp, Homo sapiens
ctgagcagcaacccagagcctc

SEQ ID NO: 7400610 - DNA, 22 bp, Homo sapiens
ctgagcagatgttgcccagaag

SEQ ID NO: 7400611 - DNA, 22 bp, Homo sapiens
ctgagcagatgttgcccagaag

SEQ ID NO: 7400612 - DNA, 22 bp, Homo sapiens
ctgagcagcaattgctggccca

SEQ ID NO: 7400613 - DNA, 22 bp, Homo sapiens
ctgagcagcaacccagagcctc

SEQ ID NO: 7400614 - DNA, 22 bp, Homo sapiens
ctgagcagcaattgctggccca

SEQ ID NO: 7400615 - DNA, 22 bp, Homo sapiens
ctgagcagcacagggcgccagg

SEQ ID NO: 7400616 - DNA, 22 bp, Homo sapiens
ctgagcagcacagggcgccagg

SEQ ID NO: 7400617 - DNA, 22 bp, Homo sapiens
ctgagcagcaattgctggccca

SEQ ID NO: 7400618 - DNA, 22 bp, Homo sapiens
ctgagcagcaattgctggccca

SEQ ID NO: 7400619 - DNA, 22 bp, Homo sapiens
ctgagcagcacagggcgccagg

SEQ ID NO: 7400620 - DNA, 22 bp, Homo sapiens
ctgagcagcaccttcaagaaac

SEQ ID NO: 7400621 - DNA, 22 bp, Homo sapiens
ctgagcagcacagggcgccagg

SEQ ID NO: 7400622 - DNA, 22 bp, Homo sapiens
ctgagcagcacagggcgccagg

SEQ ID NO: 7400623 - DNA, 22 bp, Homo sapiens
ctgagcagcagggagactggtg

SEQ ID NO: 7400624 - DNA, 22 bp, Homo sapiens
ctgagcagcacagggcgccagg

SEQ ID NO: 7400625 - DNA, 22 bp, Homo sapiens
ctgagcagcaccttcaagaaac

SEQ ID NO: 7400626 - DNA, 22 bp, Homo sapiens
ctgagcagcaccttcaagaaac

SEQ ID NO: 7400627 - DNA, 22 bp, Homo sapiens
ctgagcagcaccttcaagaaac

SEQ ID NO: 7400628 - DNA, 22 bp, Homo sapiens
ctgagcagcaccttcaagaaac

SEQ ID NO: 7400629 - DNA, 22 bp, Homo sapiens
agttagagacacatgcacatgc

SEQ ID NO: 7400630 - DNA, 22 bp, Homo sapiens
agttagaatataattatgttaa

SEQ ID NO: 7400631 - DNA, 22 bp, Homo sapiens
agttagaatggatgttgagagc

SEQ ID NO: 7400632 - DNA, 22 bp, Homo sapiens
agttagtatacaaagtaacagc

SEQ ID NO: 7400633 - DNA, 23 bp, Homo sapiens
agttaggtcaagttaggtcaatt

SEQ ID NO: 7400634 - DNA, 22 bp, Homo sapiens
agttaggagcaaaataagatag

SEQ ID NO: 7400635 - DNA, 22 bp, Homo sapiens
agttaggagtataggaatgcct

SEQ ID NO: 7400636 - DNA, 23 bp, Homo sapiens
agttaggtcaagttaggtcaatt

SEQ ID NO: 7400637 - DNA, 22 bp, Homo sapiens
agttaggacacttgagggctaa

SEQ ID NO: 7400638 - DNA, 22 bp, Homo sapiens
agttagcagcttattagaaaca

SEQ ID NO: 7400639 - DNA, 22 bp, Homo sapiens
agttataaaaggagcactgatt

SEQ ID NO: 7400640 - DNA, 22 bp, Homo sapiens
agttataatctgctactgatat

SEQ ID NO: 7400641 - DNA, 22 bp, Homo sapiens
agttataatctgctactgatat

SEQ ID NO: 7400642 - DNA, 22 bp, Homo sapiens
agttataatctgctactgatat

SEQ ID NO: 7400643 - DNA, 22 bp, Homo sapiens
agttagtatttgttgttctcca

SEQ ID NO: 7400644 - DNA, 20 bp, Homo sapiens
agttagtgagtaattgagct

SEQ ID NO: 7400645 - DNA, 22 bp, Homo sapiens
agttataatctgctactgatat

SEQ ID NO: 7400646 - DNA, 22 bp, Homo sapiens
agttataccttatacacatatg

SEQ ID NO: 7400647 - DNA, 22 bp, Homo sapiens
agttataccttatacacatatg

SEQ ID NO: 7400648 - DNA, 22 bp, Homo sapiens
agttatataactatctagatgc

SEQ ID NO: 7400649 - DNA, 22 bp, Homo sapiens
agttatagccatattctaagat

SEQ ID NO: 7400650 - DNA, 22 bp, Homo sapiens
agttataggtggttttgagaat

SEQ ID NO: 7400651 - DNA, 22 bp, Homo sapiens
agttaactctgaaaagacattt

SEQ ID NO: 7400652 - DNA, 22 bp, Homo sapiens
agttaactcattttataatgcc

SEQ ID NO: 7400653 - DNA, 22 bp, Homo sapiens
ctgagaaaggacctcaaacagg

SEQ ID NO: 7400654 - DNA, 22 bp, Homo sapiens
ctgagaaaggacctcaaacagg

SEQ ID NO: 7400655 - DNA, 22 bp, Homo sapiens
ctgagaaaggacctcaaacagg

SEQ ID NO: 7400656 - DNA, 22 bp, Homo sapiens
ctgagaaagatttgcctccgtg

SEQ ID NO: 7400657 - DNA, 22 bp, Homo sapiens
ctgagaaagatttgcctccgtg

SEQ ID NO: 7400658 - DNA, 22 bp, Homo sapiens
ctgagaaaggacctcaaacagg

SEQ ID NO: 7400659 - DNA, 22 bp, Homo sapiens
ctgagaaacaatgaattgtgat

SEQ ID NO: 7400660 - DNA, 22 bp, Homo sapiens
ctgagaaaatttcaggaagtgt

SEQ ID NO: 7400661 - DNA, 22 bp, Homo sapiens
ctgagaaacaatgaattgtgat

SEQ ID NO: 7400662 - DNA, 22 bp, Homo sapiens
ctgagaaacatatttccatcta

SEQ ID NO: 7400663 - DNA, 22 bp, Homo sapiens
ctgagaaacatatttccatcta

SEQ ID NO: 7400664 - DNA, 22 bp, Homo sapiens
ctgagaaaccaggtgctctgat

SEQ ID NO: 7400665 - DNA, 22 bp, Homo sapiens
ctgagaaaccaggtgctctgat

SEQ ID NO: 7400666 - DNA, 22 bp, Homo sapiens
ctgagaaaccaggtgctctgat

SEQ ID NO: 7400667 - DNA, 22 bp, Homo sapiens
ctgagaaaccaggtgctctgat

SEQ ID NO: 7400668 - DNA, 22 bp, Homo sapiens
agttaaggataccaggccaaaa

SEQ ID NO: 7400669 - DNA, 22 bp, Homo sapiens
agttaaggatggctggaggcgt

SEQ ID NO: 7400670 - DNA, 22 bp, Homo sapiens
agttactcactgagggtttatt

SEQ ID NO: 7400671 - DNA, 22 bp, Homo sapiens
agttacttgagacgtttatgaa

SEQ ID NO: 7400672 - DNA, 22 bp, Homo sapiens
agttacttgagacgtttatgaa

SEQ ID NO: 7400673 - DNA, 22 bp, Homo sapiens
agttagaaagtaaatcatttga

SEQ ID NO: 7400674 - DNA, 22 bp, Homo sapiens
agttactttctgatcagtgtgt

SEQ ID NO: 7400675 - DNA, 18 bp, Homo sapiens
agttagaaatgaaggcca

SEQ ID NO: 7400676 - DNA, 22 bp, Homo sapiens
agttagaagtgtgtcatctgtg

SEQ ID NO: 7400677 - DNA, 22 bp, Homo sapiens
agttagaatagtcagattgtag

SEQ ID NO: 7400678 - DNA, 22 bp, Homo sapiens
aggtccctcgcacatgcagggt

SEQ ID NO: 7400679 - DNA, 22 bp, Homo sapiens
aggtccctcgcacatgcagggt

SEQ ID NO: 7400680 - DNA, 22 bp, Homo sapiens
aggtccctgagtcagcggcgct

SEQ ID NO: 7400681 - DNA, 22 bp, Homo sapiens
aggtccctcagaggcctcaccg

SEQ ID NO: 7400682 - DNA, 22 bp, Homo sapiens
aggtccctgcagcagactgcca

SEQ ID NO: 7400683 - DNA, 22 bp, Homo sapiens
aggtccctggctagcactggaa

SEQ ID NO: 7400684 - DNA, 22 bp, Homo sapiens
aggtccctggctagcactggaa

SEQ ID NO: 7400685 - DNA, 22 bp, Homo sapiens
aggtccctggctagcactggaa

SEQ ID NO: 7400686 - DNA, 22 bp, Homo sapiens
aggtccctggctagcactggaa

SEQ ID NO: 7400687 - DNA, 22 bp, Homo sapiens
aggtccctggctagcactggaa

SEQ ID NO: 7400688 - DNA, 22 bp, Homo sapiens
aggtccctgggacagggcgatt

SEQ ID NO: 7400689 - DNA, 21 bp, Homo sapiens
aggtcccaggtttgggcagca

SEQ ID NO: 7400690 - DNA, 22 bp, Homo sapiens
aggtcccaggcatagctggtct

SEQ ID NO: 7400691 - DNA, 21 bp, Homo sapiens
aggtcccaggtttgggcagca

SEQ ID NO: 7400692 - DNA, 22 bp, Homo sapiens
aggtccatggcagcgggtactt

SEQ ID NO: 7400693 - DNA, 22 bp, Homo sapiens
aggtcccaggcatagctggtct

SEQ ID NO: 7400694 - DNA, 22 bp, Homo sapiens
aggtccagttttctgacaaggg

SEQ ID NO: 7400695 - DNA, 22 bp, Homo sapiens
aggtccagttttctgacaaggg

SEQ ID NO: 7400696 - DNA, 22 bp, Homo sapiens
aggtcccagtctgtgatgactc

SEQ ID NO: 7400697 - DNA, 22 bp, Homo sapiens
aggtcccagtgttagggtgaca

SEQ ID NO: 7400698 - DNA, 21 bp, Homo sapiens
aggtcccaggtttgggcagca

SEQ ID NO: 7400699 - DNA, 22 bp, Homo sapiens
aggtcccagtgttagggtgaca

SEQ ID NO: 7400700 - DNA, 22 bp, Homo sapiens
aggtccctaatcatttcacttt

SEQ ID NO: 7400701 - DNA, 21 bp, Homo sapiens
aggtccctaattaattgacct

SEQ ID NO: 7400702 - DNA, 22 bp, Homo sapiens
aggtccctaggagagtaggaag

SEQ ID NO: 7400703 - DNA, 19 bp, Homo sapiens
aggtccctgtcacctctca

SEQ ID NO: 7400704 - DNA, 22 bp, Homo sapiens
aggtcctcctcctccaggaagg

SEQ ID NO: 7400705 - DNA, 22 bp, Homo sapiens
aggtcctccaccaggtctcctg

SEQ ID NO: 7400706 - DNA, 19 bp, Homo sapiens
aggtcctcaggatgaccct

SEQ ID NO: 7400707 - DNA, 22 bp, Homo sapiens
aggtcctccaccaggtctcctg

SEQ ID NO: 7400708 - DNA, 22 bp, Homo sapiens
aggtcctccaccaggtctcctg

SEQ ID NO: 7400709 - DNA, 19 bp, Homo sapiens
aggtcctcaggatgaccct

SEQ ID NO: 7400710 - DNA, 22 bp, Homo sapiens
aggtcctctgtgcctgctggcg

SEQ ID NO: 7400711 - DNA, 22 bp, Homo sapiens
aggtcctgaagattttactaga

SEQ ID NO: 7400712 - DNA, 21 bp, Homo sapiens
aggtcctctatccaagttaag

SEQ ID NO: 7400713 - DNA, 22 bp, Homo sapiens
aggtcctctcccagggtactgc

SEQ ID NO: 7400714 - DNA, 21 bp, Homo sapiens
aggtcctctatccaagttaag

SEQ ID NO: 7400715 - DNA, 22 bp, Homo sapiens
aggtcctcgtcgtgctgggcca

SEQ ID NO: 7400716 - DNA, 22 bp, Homo sapiens
aggtcctgacgccctttgaaat

SEQ ID NO: 7400717 - DNA, 22 bp, Homo sapiens
aggtcctgactccacgttctag

SEQ ID NO: 7400718 - DNA, 22 bp, Homo sapiens
aggtcctgactccacgttctag

SEQ ID NO: 7400719 - DNA, 22 bp, Homo sapiens
aggtcctgagggttcgtctgca

SEQ ID NO: 7400720 - DNA, 22 bp, Homo sapiens
aggtcctgagggttcgtctgca

SEQ ID NO: 7400721 - DNA, 22 bp, Homo sapiens
aggtcctgagggttcgtctgca

SEQ ID NO: 7400722 - DNA, 22 bp, Homo sapiens
cctggctctgaggtatgcctgg

SEQ ID NO: 7400723 - DNA, 22 bp, Homo sapiens
cctggctctgcagccactccag

SEQ ID NO: 7400724 - DNA, 22 bp, Homo sapiens
cctggctctgcagccactccag

SEQ ID NO: 7400725 - DNA, 22 bp, Homo sapiens
cctggctctgaggtatgcctgg

SEQ ID NO: 7400726 - DNA, 22 bp, Homo sapiens
cctggctctgaggtatgcctgg

SEQ ID NO: 7400727 - DNA, 22 bp, Homo sapiens
cctggctctgcagccactccag

SEQ ID NO: 7400728 - DNA, 22 bp, Homo sapiens
cctggctctgcagccactccag

SEQ ID NO: 7400729 - DNA, 22 bp, Homo sapiens
cctggctctgcagccactccag

SEQ ID NO: 7400730 - DNA, 22 bp, Homo sapiens
cctggctctgcagccactccag

SEQ ID NO: 7400731 - DNA, 22 bp, Homo sapiens
cctggctctgcagccactccag

SEQ ID NO: 7400732 - DNA, 22 bp, Homo sapiens
cctggctctgcgtgcagctccg

SEQ ID NO: 7400733 - DNA, 22 bp, Homo sapiens
cctggctctgcgtgcagctccg

SEQ ID NO: 7400734 - DNA, 22 bp, Homo sapiens
cctggctctgccgtaaccacca

SEQ ID NO: 7400735 - DNA, 22 bp, Homo sapiens
cctggctctgccgtaaccacca

SEQ ID NO: 7400736 - DNA, 22 bp, Homo sapiens
cctggctctgccgtaaccacca

SEQ ID NO: 7400737 - DNA, 22 bp, Homo sapiens
cctggctctgccacttactgcc

SEQ ID NO: 7400738 - DNA, 22 bp, Homo sapiens
cctggctctgcagccactccag

SEQ ID NO: 7400739 - DNA, 22 bp, Homo sapiens
cctggctctgcagccactccag

SEQ ID NO: 7400740 - DNA, 22 bp, Homo sapiens
cctggctctgccacttactgcc

SEQ ID NO: 7400741 - DNA, 22 bp, Homo sapiens
cctggctctgccacttactgcc

SEQ ID NO: 7400742 - DNA, 22 bp, Homo sapiens
cctggatagctactggccaggc

SEQ ID NO: 7400743 - DNA, 22 bp, Homo sapiens
cctggatcagtcactgttgctg

SEQ ID NO: 7400744 - DNA, 22 bp, Homo sapiens
cctggatcagtcactgttgctg

SEQ ID NO: 7400745 - DNA, 22 bp, Homo sapiens
cctggatctcctctattcatat

SEQ ID NO: 7400746 - DNA, 22 bp, Homo sapiens
cctggatgatccatgtcatgga

SEQ ID NO: 7400747 - DNA, 22 bp, Homo sapiens
cctggatcccgatggctgtgag

SEQ ID NO: 7400748 - DNA, 22 bp, Homo sapiens
cctggatctaaggaagctggga

SEQ ID NO: 7400749 - DNA, 22 bp, Homo sapiens
cctggagtgacaggtgtagcct

SEQ ID NO: 7400750 - DNA, 22 bp, Homo sapiens
cctggagtggggtccgtgcatg

SEQ ID NO: 7400751 - DNA, 22 bp, Homo sapiens
cctggagttgaaggaaggtggg

SEQ ID NO: 7400752 - DNA, 22 bp, Homo sapiens
cctggagttgaaggaaggtggg

SEQ ID NO: 7400753 - DNA, 22 bp, Homo sapiens
cctggagttgaaggaaggtggg

SEQ ID NO: 7400754 - DNA, 22 bp, Homo sapiens
cctggagtaccgtggccatcca

SEQ ID NO: 7400755 - DNA, 22 bp, Homo sapiens
aggtagtggtcatgctggggag

SEQ ID NO: 7400756 - DNA, 22 bp, Homo sapiens
cctggaggtggaggttgcagtg

SEQ ID NO: 7400757 - DNA, 22 bp, Homo sapiens
aggtagtgtagctgagtgggat

SEQ ID NO: 7400758 - DNA, 22 bp, Homo sapiens
aggtagtagcatgtatcagtac

SEQ ID NO: 7400759 - DNA, 23 bp, Homo sapiens
aggtaggttattgctgctacctg

SEQ ID NO: 7400760 - DNA, 22 bp, Homo sapiens
cctggagtaccgtggccatcca

SEQ ID NO: 7400761 - DNA, 22 bp, Homo sapiens
cctggagtaccgtggccatcca

SEQ ID NO: 7400762 - DNA, 23 bp, Homo sapiens
cctggagtactaaggggatggaa

SEQ ID NO: 7400763 - DNA, 23 bp, Homo sapiens
cctggagtactaaggggatggaa

SEQ ID NO: 7400764 - DNA, 22 bp, Homo sapiens
aggtagtggtcatgctggggag

SEQ ID NO: 7400765 - DNA, 23 bp, Homo sapiens
cctggagtactaaggggatggaa

SEQ ID NO: 7400766 - DNA, 19 bp, Homo sapiens
cctggagtcgcgctgcctc

SEQ ID NO: 7400767 - DNA, 22 bp, Homo sapiens
cctggagtgacaggtgtagcct

SEQ ID NO: 7400768 - DNA, 22 bp, Homo sapiens
cctggagtgacaggtgtagcct

SEQ ID NO: 7400769 - DNA, 22 bp, Homo sapiens
cctggagtctgtgactttcctc

SEQ ID NO: 7400770 - DNA, 19 bp, Homo sapiens
cctggagtcgcgctgcctc

SEQ ID NO: 7400771 - DNA, 22 bp, Homo sapiens
aggtcattaaagttaaatgagg

SEQ ID NO: 7400772 - DNA, 19 bp, Homo sapiens
aggtcattgatagtgcagg

SEQ ID NO: 7400773 - DNA, 22 bp, Homo sapiens
aggtccagttttctgacaaggg

SEQ ID NO: 7400774 - DNA, 22 bp, Homo sapiens
aggtccagttttctgacaaggg

SEQ ID NO: 7400775 - DNA, 18 bp, Homo sapiens
aggtcatggtcatgggcg

SEQ ID NO: 7400776 - DNA, 22 bp, Homo sapiens
aggtcatgggctggagcactgc

SEQ ID NO: 7400777 - DNA, 22 bp, Homo sapiens
aggtcataatcagttattcaaa

SEQ ID NO: 7400778 - DNA, 22 bp, Homo sapiens
aggtcatagagatgctgtttca

SEQ ID NO: 7400779 - DNA, 22 bp, Homo sapiens
cctggcacagagcggtggtcac

SEQ ID NO: 7400780 - DNA, 22 bp, Homo sapiens
cctggcacagagcggtggtcac

SEQ ID NO: 7400781 - DNA, 22 bp, Homo sapiens
cctggcacagagcggtggtcac

SEQ ID NO: 7400782 - DNA, 18 bp, Homo sapiens
cctggcacactggctcat

SEQ ID NO: 7400783 - DNA, 18 bp, Homo sapiens
cctggcacactggctcat

SEQ ID NO: 7400784 - DNA, 18 bp, Homo sapiens
cctggcacactggctcat

SEQ ID NO: 7400785 - DNA, 22 bp, Homo sapiens
cctggcacacggtggcattcaa

SEQ ID NO: 7400786 - DNA, 22 bp, Homo sapiens
cctggcacacggtggcattcaa

SEQ ID NO: 7400787 - DNA, 22 bp, Homo sapiens
cctggcacacggtggcattcaa

SEQ ID NO: 7400788 - DNA, 22 bp, Homo sapiens
cctggcaagtcagaaccagcac

SEQ ID NO: 7400789 - DNA, 23 bp, Homo sapiens
cctggcacacagttgacatggaa

SEQ ID NO: 7400790 - DNA, 23 bp, Homo sapiens
cctggcacacaaggggtgctgca

SEQ ID NO: 7400791 - DNA, 22 bp, Homo sapiens
cctggcacaagagcagcattgg

SEQ ID NO: 7400792 - DNA, 23 bp, Homo sapiens
cctggcacacaaggggtgctgca

SEQ ID NO: 7400793 - DNA, 23 bp, Homo sapiens
cctggcacacagttgacatggaa

SEQ ID NO: 7400794 - DNA, 23 bp, Homo sapiens
cctggcacacagttgacatggaa

SEQ ID NO: 7400795 - DNA, 22 bp, Homo sapiens
cctggcacaagagcagcattgg

SEQ ID NO: 7400796 - DNA, 22 bp, Homo sapiens
cctggcacaagagcagcattgg

SEQ ID NO: 7400797 - DNA, 22 bp, Homo sapiens
cctggcaagtgggctcccagat

SEQ ID NO: 7400798 - DNA, 22 bp, Homo sapiens
cctggcacaagagcagcattgg

SEQ ID NO: 7400799 - DNA, 22 bp, Homo sapiens
cctggcacaagagcagcattgg

SEQ ID NO: 7400800 - DNA, 22 bp, Homo sapiens
cctggcaagtcagaaccagcac

SEQ ID NO: 7400801 - DNA, 22 bp, Homo sapiens
cctggcaacatttcaaggtctt

SEQ ID NO: 7400802 - DNA, 22 bp, Homo sapiens
cctggcaacatttcaaggtctt

SEQ ID NO: 7400803 - DNA, 22 bp, Homo sapiens
cctggcaacatttcaaggtctt

SEQ ID NO: 7400804 - DNA, 22 bp, Homo sapiens
cctggattggctgcccatgctc

SEQ ID NO: 7400805 - DNA, 22 bp, Homo sapiens
cctggattataggccctctgaa

SEQ ID NO: 7400806 - DNA, 22 bp, Homo sapiens
cctggatgatccatgtcatgga

SEQ ID NO: 7400807 - DNA, 22 bp, Homo sapiens
cctgccagcatcttcagcccct

SEQ ID NO: 7400808 - DNA, 22 bp, Homo sapiens
cctgccagcatcttcagcccct

SEQ ID NO: 7400809 - DNA, 22 bp, Homo sapiens
cctgccagattttactatcgta

SEQ ID NO: 7400810 - DNA, 22 bp, Homo sapiens
cctgccagatcccctgagctga

SEQ ID NO: 7400811 - DNA, 22 bp, Homo sapiens
cctgccagcatggcttatctcc

SEQ ID NO: 7400812 - DNA, 22 bp, Homo sapiens
cctgccagcatcttcagcccct

SEQ ID NO: 7400813 - DNA, 22 bp, Homo sapiens
cctgccagccagatcactcgcc

SEQ ID NO: 7400814 - DNA, 22 bp, Homo sapiens
cctgccagcatggcttatctcc

SEQ ID NO: 7400815 - DNA, 22 bp, Homo sapiens
cctgccagcccgcgttcatgcc

SEQ ID NO: 7400816 - DNA, 22 bp, Homo sapiens
cctgccagcccccatagagaca

SEQ ID NO: 7400817 - DNA, 22 bp, Homo sapiens
cctgccagcccgcgttcatgcc

SEQ ID NO: 7400818 - DNA, 22 bp, Homo sapiens
cctgccagcccgcgttcatgcc

SEQ ID NO: 7400819 - DNA, 22 bp, Homo sapiens
cctgccagcccgcgttcatgcc

SEQ ID NO: 7400820 - DNA, 22 bp, Homo sapiens
cctgccagcccccatagagaca

SEQ ID NO: 7400821 - DNA, 22 bp, Homo sapiens
cctgccagcccccatagagaca

SEQ ID NO: 7400822 - DNA, 22 bp, Homo sapiens
cctgccagccagatcactcgcc

SEQ ID NO: 7400823 - DNA, 22 bp, Homo sapiens
cctgccagcccccatagagaca

SEQ ID NO: 7400824 - DNA, 22 bp, Homo sapiens
cctgccagccagatcactcgcc

SEQ ID NO: 7400825 - DNA, 22 bp, Homo sapiens
cctgccagccagatcactcgcc

SEQ ID NO: 7400826 - DNA, 22 bp, Homo sapiens
cctgccagatcccctgagctga

SEQ ID NO: 7400827 - DNA, 22 bp, Homo sapiens
cctgccagatcccctgagctga

SEQ ID NO: 7400828 - DNA, 22 bp, Homo sapiens
cctgccagaggcaaagttttag

SEQ ID NO: 7400829 - DNA, 22 bp, Homo sapiens
cctgccagatcccctgagctga

SEQ ID NO: 7400830 - DNA, 22 bp, Homo sapiens
cctgccagatcccctgagctga

SEQ ID NO: 7400831 - DNA, 23 bp, Homo sapiens
cctgcagctgctggggctccacc

SEQ ID NO: 7400832 - DNA, 23 bp, Homo sapiens
cctgcagctgctggggctccacc

SEQ ID NO: 7400833 - DNA, 23 bp, Homo sapiens
cctgcagctgctggggctccacc

SEQ ID NO: 7400834 - DNA, 23 bp, Homo sapiens
cctgcagctgctggggctccacc

SEQ ID NO: 7400835 - DNA, 23 bp, Homo sapiens
cctgcagctgccacgccctgctc

SEQ ID NO: 7400836 - DNA, 23 bp, Homo sapiens
cctgcagctgccacgccctgctc

SEQ ID NO: 7400837 - DNA, 22 bp, Homo sapiens
cctgcagccgtcctgtttgtct

SEQ ID NO: 7400838 - DNA, 22 bp, Homo sapiens
cctgcagcctcttctgaaaatc

SEQ ID NO: 7400839 - DNA, 22 bp, Homo sapiens
cctgcagcctcttctgaaaatc

SEQ ID NO: 7400840 - DNA, 22 bp, Homo sapiens
cctgcagcctcttctgaaaatc

SEQ ID NO: 7400841 - DNA, 23 bp, Homo sapiens
cctgcagctgccacgccctgctc

SEQ ID NO: 7400842 - DNA, 23 bp, Homo sapiens
cctgcagctgccacgccctgctc

SEQ ID NO: 7400843 - DNA, 23 bp, Homo sapiens
cctgcagctgccacgccctgctc

SEQ ID NO: 7400844 - DNA, 22 bp, Homo sapiens
cctgcagctccggatttctggg

SEQ ID NO: 7400845 - DNA, 22 bp, Homo sapiens
cctgcagagcaggagaggcatc

SEQ ID NO: 7400846 - DNA, 22 bp, Homo sapiens
cctgcagagcaggagaggcatc

SEQ ID NO: 7400847 - DNA, 22 bp, Homo sapiens
cctgcagagcaggagaggcatc

SEQ ID NO: 7400848 - DNA, 22 bp, Homo sapiens
cctgcagaccacactcagtcct

SEQ ID NO: 7400849 - DNA, 22 bp, Homo sapiens
cctgcagagccacgtgccagcg

SEQ ID NO: 7400850 - DNA, 22 bp, Homo sapiens
cctgcagagccacgtgccagcg

SEQ ID NO: 7400851 - DNA, 22 bp, Homo sapiens
cctgcagagcaggagaggcatc

SEQ ID NO: 7400852 - DNA, 22 bp, Homo sapiens
cctgcagagcaggagaggcatc

SEQ ID NO: 7400853 - DNA, 22 bp, Homo sapiens
cctgcagagggactggcaggaa

SEQ ID NO: 7400854 - DNA, 22 bp, Homo sapiens
cctgcagagggactggcaggaa

SEQ ID NO: 7400855 - DNA, 22 bp, Homo sapiens
cctgcagagggactggcaggaa

SEQ ID NO: 7400856 - DNA, 22 bp, Homo sapiens
cctgcagagccacgtgccagcg

SEQ ID NO: 7400857 - DNA, 22 bp, Homo sapiens
cctgcagagccacgtgccagcg

SEQ ID NO: 7400858 - DNA, 22 bp, Homo sapiens
cctgcagaggtcaggccagaaa

SEQ ID NO: 7400859 - DNA, 22 bp, Homo sapiens
cctgcagaggtcaggccagaaa

SEQ ID NO: 7400860 - DNA, 22 bp, Homo sapiens
cctgcagagggagggccttatt

SEQ ID NO: 7400861 - DNA, 22 bp, Homo sapiens
cctgcagagggagggccttatt

SEQ ID NO: 7400862 - DNA, 22 bp, Homo sapiens
cctgcagagggactggcaggaa

SEQ ID NO: 7400863 - DNA, 22 bp, Homo sapiens
cctgcagagggactggcaggaa

SEQ ID NO: 7400864 - DNA, 22 bp, Homo sapiens
cctgcagagggactggcaggaa

SEQ ID NO: 7400865 - DNA, 21 bp, Homo sapiens
cctgcagcaccagaaggagat

SEQ ID NO: 7400866 - DNA, 21 bp, Homo sapiens
cctgcagcaccagaaggagat

SEQ ID NO: 7400867 - DNA, 22 bp, Homo sapiens
cctgcagatgtgggacagctgt

SEQ ID NO: 7400868 - DNA, 22 bp, Homo sapiens
cctgcagatgtgggacagctgt

SEQ ID NO: 7400869 - DNA, 22 bp, Homo sapiens
cctgcagatgtgggacagctgt

SEQ ID NO: 7400870 - DNA, 22 bp, Homo sapiens
cctgcagagtccctttgttcag

SEQ ID NO: 7400871 - DNA, 22 bp, Homo sapiens
cctgcagaggtcaggccagaaa

SEQ ID NO: 7400872 - DNA, 22 bp, Homo sapiens
cctgcagaggtcaggccagaaa

SEQ ID NO: 7400873 - DNA, 18 bp, Homo sapiens
cctgcagcccaggaggcc

SEQ ID NO: 7400874 - DNA, 21 bp, Homo sapiens
cctgcagcaccagaaggagat

SEQ ID NO: 7400875 - DNA, 21 bp, Homo sapiens
cctgcagcaccagaaggagat

SEQ ID NO: 7400876 - DNA, 22 bp, Homo sapiens
cctgcagcagctgaaatcacag

SEQ ID NO: 7400877 - DNA, 18 bp, Homo sapiens
cctgcagcccaggaggcc

SEQ ID NO: 7400878 - DNA, 18 bp, Homo sapiens
cctgcagcccaggaggcc

SEQ ID NO: 7400879 - DNA, 18 bp, Homo sapiens
cctgcagcccaggaggcc

SEQ ID NO: 7400880 - DNA, 18 bp, Homo sapiens
cctgcagcccaggaggcc

SEQ ID NO: 7400881 - DNA, 22 bp, Homo sapiens
cctgcagcccttcaaaggctga

SEQ ID NO: 7400882 - DNA, 22 bp, Homo sapiens
cctgcagcccttcaaaggctga

SEQ ID NO: 7400883 - DNA, 22 bp, Homo sapiens
aggtagggaagaaggcatgaaa

SEQ ID NO: 7400884 - DNA, 22 bp, Homo sapiens
aggtagggaagaaggcatgaaa

SEQ ID NO: 7400885 - DNA, 22 bp, Homo sapiens
aggtagggaagaaggcatgaaa

SEQ ID NO: 7400886 - DNA, 22 bp, Homo sapiens
aggtaggcctgacgctggggtg

SEQ ID NO: 7400887 - DNA, 22 bp, Homo sapiens
aggtagggaagaaggcatgaaa

SEQ ID NO: 7400888 - DNA, 22 bp, Homo sapiens
aggtagggaagaaggcatgaaa

SEQ ID NO: 7400889 - DNA, 22 bp, Homo sapiens
aggtagggaagaaggcatgaaa

SEQ ID NO: 7400890 - DNA, 22 bp, Homo sapiens
aggtagggaagaaggcatgaaa

SEQ ID NO: 7400891 - DNA, 22 bp, Homo sapiens
aggtagggaagaaggcatgaaa

SEQ ID NO: 7400892 - DNA, 22 bp, Homo sapiens
aggtagggaagaaggcatgaaa

SEQ ID NO: 7400893 - DNA, 22 bp, Homo sapiens
aggtagggaagaaggcatgaaa

SEQ ID NO: 7400894 - DNA, 22 bp, Homo sapiens
aggtagggaagaaggcatgaaa

SEQ ID NO: 7400895 - DNA, 22 bp, Homo sapiens
aggtagggaagaaggcatgaaa

SEQ ID NO: 7400896 - DNA, 22 bp, Homo sapiens
aggtaggcctgacgctggggtg

SEQ ID NO: 7400897 - DNA, 22 bp, Homo sapiens
aggtagggaagaaggcatgaaa

SEQ ID NO: 7400898 - DNA, 22 bp, Homo sapiens
aggtagggaagaaggcatgaaa

SEQ ID NO: 7400899 - DNA, 22 bp, Homo sapiens
aggtaggcctgaaagtgacagc

SEQ ID NO: 7400900 - DNA, 22 bp, Homo sapiens
aggtaggccctgagtgctgttg

SEQ ID NO: 7400901 - DNA, 22 bp, Homo sapiens
aggtaggcctgaaagtgacagc

SEQ ID NO: 7400902 - DNA, 19 bp, Homo sapiens
aggtaggcagtggcatgga

SEQ ID NO: 7400903 - DNA, 19 bp, Homo sapiens
aggtaggcagtggcatgga

SEQ ID NO: 7400904 - DNA, 22 bp, Homo sapiens
aggtaggccctgagtgctgttg

SEQ ID NO: 7400905 - DNA, 19 bp, Homo sapiens
aggtaggcagtggcatgga

SEQ ID NO: 7400906 - DNA, 19 bp, Homo sapiens
aggtaggcagtggcatgga

SEQ ID NO: 7400907 - DNA, 22 bp, Homo sapiens
aggtagggttaatggagatata

SEQ ID NO: 7400908 - DNA, 22 bp, Homo sapiens
aggtagggggtttgggaactgc

SEQ ID NO: 7400909 - DNA, 22 bp, Homo sapiens
aggtagggttaatggagatata

SEQ ID NO: 7400910 - DNA, 22 bp, Homo sapiens
aggtagggttaatggagatata

SEQ ID NO: 7400911 - DNA, 22 bp, Homo sapiens
aggtagggttaatggagatata

SEQ ID NO: 7400912 - DNA, 22 bp, Homo sapiens
aggtaggttaaatttctttatc

SEQ ID NO: 7400913 - DNA, 23 bp, Homo sapiens
aggtaggttattgctgctacctg

SEQ ID NO: 7400914 - DNA, 23 bp, Homo sapiens
aggtaggttattgctgctacctg

SEQ ID NO: 7400915 - DNA, 23 bp, Homo sapiens
aggtaggttattgctgctacctg

SEQ ID NO: 7400916 - DNA, 23 bp, Homo sapiens
aggtaggttattgctgctacctg

SEQ ID NO: 7400917 - DNA, 23 bp, Homo sapiens
aggtaggttattgctgctacctg

SEQ ID NO: 7400918 - DNA, 22 bp, Homo sapiens
aggtagggaagaaggcatgaaa

SEQ ID NO: 7400919 - DNA, 22 bp, Homo sapiens
aggtagggctaggctgcgtctg

SEQ ID NO: 7400920 - DNA, 22 bp, Homo sapiens
aggtagggctaggctgcgtctg

SEQ ID NO: 7400921 - DNA, 22 bp, Homo sapiens
aggtagggggtttgggaactgc

SEQ ID NO: 7400922 - DNA, 22 bp, Homo sapiens
aggtagggggtttgggaactgc

SEQ ID NO: 7400923 - DNA, 22 bp, Homo sapiens
aggtagggggtttgggaactgc

SEQ ID NO: 7400924 - DNA, 22 bp, Homo sapiens
aggtagggctaggctgcgtctg

SEQ ID NO: 7400925 - DNA, 22 bp, Homo sapiens
aggtagggggtttgggaactgc

SEQ ID NO: 7400926 - DNA, 22 bp, Homo sapiens
aggtagggttaatggagatata

SEQ ID NO: 7400927 - DNA, 22 bp, Homo sapiens
aggtagggttaatggagatata

SEQ ID NO: 7400928 - DNA, 22 bp, Homo sapiens
aggtagggttaatggagatata

SEQ ID NO: 7400929 - DNA, 22 bp, Homo sapiens
aggtagggggtttgggaactgc

SEQ ID NO: 7400930 - DNA, 22 bp, Homo sapiens
cctgccagctgggtaccttcat

SEQ ID NO: 7400931 - DNA, 22 bp, Homo sapiens
cctgccagctgggtaccttcat

SEQ ID NO: 7400932 - DNA, 22 bp, Homo sapiens
cctgccagctgtgggccagcct

SEQ ID NO: 7400933 - DNA, 22 bp, Homo sapiens
cctgccagctgtgggccagcct

SEQ ID NO: 7400934 - DNA, 22 bp, Homo sapiens
cctgccagctgtgggccagcct

SEQ ID NO: 7400935 - DNA, 22 bp, Homo sapiens
cctgccagctgtgggccagcct

SEQ ID NO: 7400936 - DNA, 22 bp, Homo sapiens
cctgccagcgcttatctctcgg

SEQ ID NO: 7400937 - DNA, 22 bp, Homo sapiens
cctgccagcatggcttatctcc

SEQ ID NO: 7400938 - DNA, 22 bp, Homo sapiens
cctgccagcgcttatctctcgg

SEQ ID NO: 7400939 - DNA, 21 bp, Homo sapiens
cctgccaggaaactgagtgtc

SEQ ID NO: 7400940 - DNA, 21 bp, Homo sapiens
cctgccaggaaactgagtgtc

SEQ ID NO: 7400941 - DNA, 21 bp, Homo sapiens
cctgccaggaaactgagtgtc

SEQ ID NO: 7400942 - DNA, 21 bp, Homo sapiens
cctgccaggaaactgagtgtc

SEQ ID NO: 7400943 - DNA, 22 bp, Homo sapiens
cctgccagctgtgggccagcct

SEQ ID NO: 7400944 - DNA, 21 bp, Homo sapiens
cctgccaggaaactgagtgtc

SEQ ID NO: 7400945 - DNA, 21 bp, Homo sapiens
cctgccaggaaactgagtgtc

SEQ ID NO: 7400946 - DNA, 22 bp, Homo sapiens
aggtaggatagataggaagacc

SEQ ID NO: 7400947 - DNA, 22 bp, Homo sapiens
aggtaggatagataggaagacc

SEQ ID NO: 7400948 - DNA, 22 bp, Homo sapiens
aggtaggatagataggaagacc

SEQ ID NO: 7400949 - DNA, 22 bp, Homo sapiens
aggtacaggaggttggggctac

SEQ ID NO: 7400950 - DNA, 22 bp, Homo sapiens
aggtacaggaggttggggctac

SEQ ID NO: 7400951 - DNA, 22 bp, Homo sapiens
aggtacagcaatataagaggtc

SEQ ID NO: 7400952 - DNA, 22 bp, Homo sapiens
aggtacagggtgaaagtttatg

SEQ ID NO: 7400953 - DNA, 22 bp, Homo sapiens
aggtacagggtgaaagtttatg

SEQ ID NO: 7400954 - DNA, 21 bp, Homo sapiens
aggtacaggtcttgtgagtct

SEQ ID NO: 7400955 - DNA, 21 bp, Homo sapiens
aggtacaggtcttgtgagtct

SEQ ID NO: 7400956 - DNA, 22 bp, Homo sapiens
aggtaggatgggtggagatgat

SEQ ID NO: 7400957 - DNA, 20 bp, Homo sapiens
aggtaggatcggtgtcataa

SEQ ID NO: 7400958 - DNA, 22 bp, Homo sapiens
aggtaggatgggtggagatgat

SEQ ID NO: 7400959 - DNA, 22 bp, Homo sapiens
aggtaggatgggtggagatgat

SEQ ID NO: 7400960 - DNA, 22 bp, Homo sapiens
aggtaggatgggtggagatgat

SEQ ID NO: 7400961 - DNA, 22 bp, Homo sapiens
cctgtgccaaaaggctgcttat

SEQ ID NO: 7400962 - DNA, 22 bp, Homo sapiens
cctgtgcattgcagggtgttca

SEQ ID NO: 7400963 - DNA, 22 bp, Homo sapiens
cctgtgcattgagtttgcaccc

SEQ ID NO: 7400964 - DNA, 22 bp, Homo sapiens
cctgtgcattgagtttgcaccc

SEQ ID NO: 7400965 - DNA, 22 bp, Homo sapiens
cctgtgcatgccagggtacacc

SEQ ID NO: 7400966 - DNA, 22 bp, Homo sapiens
cctgtgcatgccagggtacacc

SEQ ID NO: 7400967 - DNA, 22 bp, Homo sapiens
cctgtgcattgaccacactctc

SEQ ID NO: 7400968 - DNA, 22 bp, Homo sapiens
cctgtgcattgaccacactctc

SEQ ID NO: 7400969 - DNA, 21 bp, Homo sapiens
cctgtgccaaagtgtgttagg

SEQ ID NO: 7400970 - DNA, 22 bp, Homo sapiens
cctgtgccagccccttctgctg

SEQ ID NO: 7400971 - DNA, 22 bp, Homo sapiens
cctgtgccagccccttctgctg

SEQ ID NO: 7400972 - DNA, 22 bp, Homo sapiens
cctgtgccagccccttctgctg

SEQ ID NO: 7400973 - DNA, 22 bp, Homo sapiens
cctgtgccagccccttctgctg

SEQ ID NO: 7400974 - DNA, 22 bp, Homo sapiens
aggtgggcaatgaggcctgagt

SEQ ID NO: 7400975 - DNA, 22 bp, Homo sapiens
aggtgggcaatgaggcctgagt

SEQ ID NO: 7400976 - DNA, 22 bp, Homo sapiens
cctgtgccaaaatctaggcagt

SEQ ID NO: 7400977 - DNA, 22 bp, Homo sapiens
cctgtgccaaaaggctgcttat

SEQ ID NO: 7400978 - DNA, 22 bp, Homo sapiens
cctgtgccaaaatctaggcagt

SEQ ID NO: 7400979 - DNA, 22 bp, Homo sapiens
cctgtgccaaaatctaggcagt

SEQ ID NO: 7400980 - DNA, 22 bp, Homo sapiens
cctgtgccaaaatctaggcagt

SEQ ID NO: 7400981 - DNA, 21 bp, Homo sapiens
cctgtgccaaagtgtgttagg

SEQ ID NO: 7400982 - DNA, 22 bp, Homo sapiens
cctgtgccaaaatctaggcagt

SEQ ID NO: 7400983 - DNA, 22 bp, Homo sapiens
cctgtgccaaaatctaggcagt

SEQ ID NO: 7400984 - DNA, 22 bp, Homo sapiens
aggtgggcaatgaggcctgagt

SEQ ID NO: 7400985 - DNA, 22 bp, Homo sapiens
aggtgggcaatgaggcctgagt

SEQ ID NO: 7400986 - DNA, 22 bp, Homo sapiens
aggtgggcacacctcccttctc

SEQ ID NO: 7400987 - DNA, 22 bp, Homo sapiens
aggtgggcacacctcccttctc

SEQ ID NO: 7400988 - DNA, 22 bp, Homo sapiens
aggtgggcacacctcccttctc

SEQ ID NO: 7400989 - DNA, 22 bp, Homo sapiens
aggtgggcaatgaggcctgagt

SEQ ID NO: 7400990 - DNA, 22 bp, Homo sapiens
aggtgggcacagatggagaagt

SEQ ID NO: 7400991 - DNA, 22 bp, Homo sapiens
aggtgggcacagatggagaagt

SEQ ID NO: 7400992 - DNA, 22 bp, Homo sapiens
aggtgggcacagatggagaagt

SEQ ID NO: 7400993 - DNA, 22 bp, Homo sapiens
aggtggggaggagtgtctcttt

SEQ ID NO: 7400994 - DNA, 22 bp, Homo sapiens
aggtggggaggagtgtctcttt

SEQ ID NO: 7400995 - DNA, 22 bp, Homo sapiens
aggtggggaggagtgtctcttt

SEQ ID NO: 7400996 - DNA, 22 bp, Homo sapiens
aggtggggaggagtgtctcttt

SEQ ID NO: 7400997 - DNA, 22 bp, Homo sapiens
aggtggggaggagtgtctcttt

SEQ ID NO: 7400998 - DNA, 22 bp, Homo sapiens
aggtggggaggagtgtctcttt

SEQ ID NO: 7400999 - DNA, 22 bp, Homo sapiens
aggtggggaggagtgtctcttt

SEQ ID NO: 7401000 - DNA, 22 bp, Homo sapiens
aggtggggaggagtgtctcttt

SEQ ID NO: 7401001 - DNA, 22 bp, Homo sapiens
aggtggggcccaccaatttgca

SEQ ID NO: 7401002 - DNA, 22 bp, Homo sapiens
aggtggggcccaccaatttgca

SEQ ID NO: 7401003 - DNA, 22 bp, Homo sapiens
aggtggggcccaccaatttgca

SEQ ID NO: 7401004 - DNA, 21 bp, Homo sapiens
aggtggggctgcacctctgct

SEQ ID NO: 7401005 - DNA, 22 bp, Homo sapiens
aggtggggcccaccaatttgca

SEQ ID NO: 7401006 - DNA, 21 bp, Homo sapiens
aggtggggctgcacctctgct

SEQ ID NO: 7401007 - DNA, 21 bp, Homo sapiens
aggtggggctgcacctctgct

SEQ ID NO: 7401008 - DNA, 21 bp, Homo sapiens
aggtggggctgcacctctgct

SEQ ID NO: 7401009 - DNA, 21 bp, Homo sapiens
aggtggggctgcacctctgct

SEQ ID NO: 7401010 - DNA, 21 bp, Homo sapiens
aggtggggctgcacctctgct

SEQ ID NO: 7401011 - DNA, 21 bp, Homo sapiens
aggtggggctgcacctctgct

SEQ ID NO: 7401012 - DNA, 21 bp, Homo sapiens
aggtggggctgcacctctgct

SEQ ID NO: 7401013 - DNA, 21 bp, Homo sapiens
aggtggggctgcacctctgct

SEQ ID NO: 7401014 - DNA, 22 bp, Homo sapiens
aggtggggagtatatgtaattg

SEQ ID NO: 7401015 - DNA, 22 bp, Homo sapiens
aggtggggagtatatgtaattg

SEQ ID NO: 7401016 - DNA, 22 bp, Homo sapiens
aggtggggagtatatgtaattg

SEQ ID NO: 7401017 - DNA, 22 bp, Homo sapiens
aggtggggaggagtgtctcttt

SEQ ID NO: 7401018 - DNA, 22 bp, Homo sapiens
aggtggggagtatatgtaattg

SEQ ID NO: 7401019 - DNA, 22 bp, Homo sapiens
aggtggggccaaatgctacagt

SEQ ID NO: 7401020 - DNA, 22 bp, Homo sapiens
aggtggggccaaatgctacagt

SEQ ID NO: 7401021 - DNA, 22 bp, Homo sapiens
aggtggggccaaatgctacagt

SEQ ID NO: 7401022 - DNA, 22 bp, Homo sapiens
aggtggggccaaatgctacagt

SEQ ID NO: 7401023 - DNA, 22 bp, Homo sapiens
aggtggggccaaatgctacagt

SEQ ID NO: 7401024 - DNA, 22 bp, Homo sapiens
aggtggggccaaatgctacagt

SEQ ID NO: 7401025 - DNA, 22 bp, Homo sapiens
aggtggggccaaatgctacagt

SEQ ID NO: 7401026 - DNA, 22 bp, Homo sapiens
aggtggggccaaatgctacagt

SEQ ID NO: 7401027 - DNA, 22 bp, Homo sapiens
cctgtctccctggcatggctca

SEQ ID NO: 7401028 - DNA, 22 bp, Homo sapiens
cctgtctccctggcatggctca

SEQ ID NO: 7401029 - DNA, 22 bp, Homo sapiens
cctgtctatcaagacatcttca

SEQ ID NO: 7401030 - DNA, 20 bp, Homo sapiens
cctgtctcacgttccgcccc

SEQ ID NO: 7401031 - DNA, 22 bp, Homo sapiens
cctgtctccctggcatggctca

SEQ ID NO: 7401032 - DNA, 20 bp, Homo sapiens
cctgtctcctcttacctggc

SEQ ID NO: 7401033 - DNA, 22 bp, Homo sapiens
cctgtctccctggcatggctca

SEQ ID NO: 7401034 - DNA, 22 bp, Homo sapiens
cctgtcctccaagagcacatct

SEQ ID NO: 7401035 - DNA, 22 bp, Homo sapiens
cctgtcctccaagagcacatct

SEQ ID NO: 7401036 - DNA, 22 bp, Homo sapiens
cctgtcctccaagagcacatct

SEQ ID NO: 7401037 - DNA, 22 bp, Homo sapiens
cctgtcctccggagcgggctgt

SEQ ID NO: 7401038 - DNA, 22 bp, Homo sapiens
cctgtctaccagtcacttagcg

SEQ ID NO: 7401039 - DNA, 22 bp, Homo sapiens
cctgtcctccggagcgggctgt

SEQ ID NO: 7401040 - DNA, 22 bp, Homo sapiens
cctgtctatcaagacatcttca

SEQ ID NO: 7401041 - DNA, 20 bp, Homo sapiens
cctgtctcacgttccgcccc

SEQ ID NO: 7401042 - DNA, 22 bp, Homo sapiens
cctgtcctccggagcgggctgt

SEQ ID NO: 7401043 - DNA, 20 bp, Homo sapiens
cctgtcatcccagcattttg

SEQ ID NO: 7401044 - DNA, 22 bp, Homo sapiens
cctgtcatatacatacctcctc

SEQ ID NO: 7401045 - DNA, 22 bp, Homo sapiens
cctgtcataatgtccgatgtca

SEQ ID NO: 7401046 - DNA, 22 bp, Homo sapiens
cctgtccagggactgagggaga

SEQ ID NO: 7401047 - DNA, 22 bp, Homo sapiens
cctgtccagggactgagggaga

SEQ ID NO: 7401048 - DNA, 22 bp, Homo sapiens
cctgtcccaagcagggctggcc

SEQ ID NO: 7401049 - DNA, 22 bp, Homo sapiens
cctgtcccaagcagggctggcc

SEQ ID NO: 7401050 - DNA, 20 bp, Homo sapiens
cctgtccaagctccacccca

SEQ ID NO: 7401051 - DNA, 22 bp, Homo sapiens
cctgtcattttctcctgtcagc

SEQ ID NO: 7401052 - DNA, 20 bp, Homo sapiens
cctgtcatcccagcattttg

SEQ ID NO: 7401053 - DNA, 22 bp, Homo sapiens
cctgtcccccaggcctgtacca

SEQ ID NO: 7401054 - DNA, 22 bp, Homo sapiens
cctgtcccaagcagggctggcc

SEQ ID NO: 7401055 - DNA, 22 bp, Homo sapiens
cctgtcccaagcagggctggcc

SEQ ID NO: 7401056 - DNA, 22 bp, Homo sapiens
cctgtcccctcacaatgccact

SEQ ID NO: 7401057 - DNA, 22 bp, Homo sapiens
cctgtcccccaggcctgtacca

SEQ ID NO: 7401058 - DNA, 22 bp, Homo sapiens
cctgtcccctcacaatgccact

SEQ ID NO: 7401059 - DNA, 22 bp, Homo sapiens
cctgtcccctcacaatgccact

SEQ ID NO: 7401060 - DNA, 22 bp, Homo sapiens
cctgtcccccaggcctgtacca

SEQ ID NO: 7401061 - DNA, 22 bp, Homo sapiens
cctgtcctccaagagcacatct

SEQ ID NO: 7401062 - DNA, 22 bp, Homo sapiens
cctgtgagtcaacccctccttg

SEQ ID NO: 7401063 - DNA, 22 bp, Homo sapiens
cctgtgatccataggcatccag

SEQ ID NO: 7401064 - DNA, 22 bp, Homo sapiens
cctgtgagtttacattctggcc

SEQ ID NO: 7401065 - DNA, 22 bp, Homo sapiens
cctgtgcaatgttgaggtttca

SEQ ID NO: 7401066 - DNA, 22 bp, Homo sapiens
cctgtgatggtgttacactgtt

SEQ ID NO: 7401067 - DNA, 19 bp, Homo sapiens
cctgtgcacatgtgtcctt

SEQ ID NO: 7401068 - DNA, 22 bp, Homo sapiens
cctgtgcaatgttgaggtttca

SEQ ID NO: 7401069 - DNA, 22 bp, Homo sapiens
cctgtgcactatctgcattttt

SEQ ID NO: 7401070 - DNA, 19 bp, Homo sapiens
cctgtgcacatgtgtcctt

SEQ ID NO: 7401071 - DNA, 19 bp, Homo sapiens
cctgtgcacatgtgtcctt

SEQ ID NO: 7401072 - DNA, 22 bp, Homo sapiens
cctgtgcatccggtggtcattg

SEQ ID NO: 7401073 - DNA, 22 bp, Homo sapiens
cctgtgcatgccagggtacacc

SEQ ID NO: 7401074 - DNA, 22 bp, Homo sapiens
cctgtgcatgccagggtacacc

SEQ ID NO: 7401075 - DNA, 22 bp, Homo sapiens
cctgtgcatccggtggtcattg

SEQ ID NO: 7401076 - DNA, 22 bp, Homo sapiens
cctgtgcagcccttgccagttt

SEQ ID NO: 7401077 - DNA, 22 bp, Homo sapiens
cctgtgcactatctgcattttt

SEQ ID NO: 7401078 - DNA, 22 bp, Homo sapiens
cctgtgcagcccttgccagttt

SEQ ID NO: 7401079 - DNA, 22 bp, Homo sapiens
cctgtgcagcccttgccagttt

SEQ ID NO: 7401080 - DNA, 22 bp, Homo sapiens
cctgtgcaggctccataataga

SEQ ID NO: 7401081 - DNA, 22 bp, Homo sapiens
cctgtgcaggctccataataga

SEQ ID NO: 7401082 - DNA, 22 bp, Homo sapiens
cctgtgcaggctccataataga

SEQ ID NO: 7401083 - DNA, 22 bp, Homo sapiens
cctgtgacattagaatttcatt

SEQ ID NO: 7401084 - DNA, 20 bp, Homo sapiens
cctgtctcctcttacctggc

SEQ ID NO: 7401085 - DNA, 22 bp, Homo sapiens
cctgtgaccactctggttctgc

SEQ ID NO: 7401086 - DNA, 22 bp, Homo sapiens
cctgtgacccttccagtctact

SEQ ID NO: 7401087 - DNA, 22 bp, Homo sapiens
cctgtgagagggcgagtgtaga

SEQ ID NO: 7401088 - DNA, 22 bp, Homo sapiens
cctgtgaggtcatctgtggtaa

SEQ ID NO: 7401089 - DNA, 22 bp, Homo sapiens
cctgtgaggtcttgcatgtgaa

SEQ ID NO: 7401090 - DNA, 22 bp, Homo sapiens
cctgtgaggtcttgcatgtgaa

SEQ ID NO: 7401091 - DNA, 22 bp, Homo sapiens
cctgtgaggtcatctgtggtaa

SEQ ID NO: 7401092 - DNA, 19 bp, Homo sapiens
cctgtgagaggacaggtgt

SEQ ID NO: 7401093 - DNA, 22 bp, Homo sapiens
cctgtgactctgtctgatggtc

SEQ ID NO: 7401094 - DNA, 22 bp, Homo sapiens
cctgtgacttggcaaacctcca

SEQ ID NO: 7401095 - DNA, 22 bp, Homo sapiens
cctgggctcaggcttgggcagc

SEQ ID NO: 7401096 - DNA, 22 bp, Homo sapiens
cctgggctcaggcttgggcagc

SEQ ID NO: 7401097 - DNA, 22 bp, Homo sapiens
cctgggctcaggcttgggcagc

SEQ ID NO: 7401098 - DNA, 22 bp, Homo sapiens
cctgggctcaccatgccttgga

SEQ ID NO: 7401099 - DNA, 22 bp, Homo sapiens
cctgggctcaggcttgggcagc

SEQ ID NO: 7401100 - DNA, 22 bp, Homo sapiens
cctgggctcaggcttgggcagc

SEQ ID NO: 7401101 - DNA, 22 bp, Homo sapiens
cctgggctcaggcttgggcagc

SEQ ID NO: 7401102 - DNA, 22 bp, Homo sapiens
cctgggctccactccaagagca

SEQ ID NO: 7401103 - DNA, 22 bp, Homo sapiens
cctgggctcaggcttgggcagc

SEQ ID NO: 7401104 - DNA, 22 bp, Homo sapiens
cctgggctccactccaagagca

SEQ ID NO: 7401105 - DNA, 22 bp, Homo sapiens
cctgggctccactccaagagca

SEQ ID NO: 7401106 - DNA, 22 bp, Homo sapiens
cctgggctccactccaagagca

SEQ ID NO: 7401107 - DNA, 22 bp, Homo sapiens
cctgggctccactccaagagca

SEQ ID NO: 7401108 - DNA, 20 bp, Homo sapiens
cctgggctccaggagccccg

SEQ ID NO: 7401109 - DNA, 22 bp, Homo sapiens
cctgggctccactccaagagca

SEQ ID NO: 7401110 - DNA, 22 bp, Homo sapiens
cctgggctccactccaagagca

SEQ ID NO: 7401111 - DNA, 22 bp, Homo sapiens
cctgggctcaagtgatggtccc

SEQ ID NO: 7401112 - DNA, 22 bp, Homo sapiens
cctgggctcacagccaaggctc

SEQ ID NO: 7401113 - DNA, 22 bp, Homo sapiens
cctgggctcacagccaaggctc

SEQ ID NO: 7401114 - DNA, 22 bp, Homo sapiens
cctgggctcacagccaaggctc

SEQ ID NO: 7401115 - DNA, 22 bp, Homo sapiens
cctgggctcaagtgatggtccc

SEQ ID NO: 7401116 - DNA, 22 bp, Homo sapiens
cctgggctcaagtgatggtccc

SEQ ID NO: 7401117 - DNA, 22 bp, Homo sapiens
cctgggctcaagtgatggtccc

SEQ ID NO: 7401118 - DNA, 22 bp, Homo sapiens
cctgggctcaagtgatggtccc

SEQ ID NO: 7401119 - DNA, 22 bp, Homo sapiens
cctgggctcaagtgatggtccc

SEQ ID NO: 7401120 - DNA, 22 bp, Homo sapiens
cctgggctcaagtgatggtccc

SEQ ID NO: 7401121 - DNA, 22 bp, Homo sapiens
cctgggctcaccatgccttgga

SEQ ID NO: 7401122 - DNA, 22 bp, Homo sapiens
cctgggctcaccatgccttgga

SEQ ID NO: 7401123 - DNA, 22 bp, Homo sapiens
cctgggctcaccatgccttgga

SEQ ID NO: 7401124 - DNA, 22 bp, Homo sapiens
cctgggctcacagccaaggctc

SEQ ID NO: 7401125 - DNA, 22 bp, Homo sapiens
cctgggctcacagccaaggctc

SEQ ID NO: 7401126 - DNA, 22 bp, Homo sapiens
cctgggctcacagccaaggctc

SEQ ID NO: 7401127 - DNA, 22 bp, Homo sapiens
cctgggctcacagccaaggctc

SEQ ID NO: 7401128 - DNA, 22 bp, Homo sapiens
cctgggctcacagccaaggctc

SEQ ID NO: 7401129 - DNA, 22 bp, Homo sapiens
cctgggctcacagccaaggctc

SEQ ID NO: 7401130 - DNA, 22 bp, Homo sapiens
cctgggctcacagccaaggctc

SEQ ID NO: 7401131 - DNA, 22 bp, Homo sapiens
cctggctctgggatcttcgctt

SEQ ID NO: 7401132 - DNA, 22 bp, Homo sapiens
cctggctctgggatcttcgctt

SEQ ID NO: 7401133 - DNA, 22 bp, Homo sapiens
cctggctctgcgtgcagctccg

SEQ ID NO: 7401134 - DNA, 22 bp, Homo sapiens
cctggctctgcgtgcagctccg

SEQ ID NO: 7401135 - DNA, 22 bp, Homo sapiens
cctggctctgcgtgcagctccg

SEQ ID NO: 7401136 - DNA, 22 bp, Homo sapiens
cctggctctgcgtgcagctccg

SEQ ID NO: 7401137 - DNA, 22 bp, Homo sapiens
cctggctctgcgtgcagctccg

SEQ ID NO: 7401138 - DNA, 22 bp, Homo sapiens
cctggctctgcgtgcagctccg

SEQ ID NO: 7401139 - DNA, 22 bp, Homo sapiens
cctggctctgcgtgcagctccg

SEQ ID NO: 7401140 - DNA, 22 bp, Homo sapiens
cctggctctggttccctcagct

SEQ ID NO: 7401141 - DNA, 22 bp, Homo sapiens
cctggctctggttccctcagct

SEQ ID NO: 7401142 - DNA, 22 bp, Homo sapiens
cctggctctggttccctcagct

SEQ ID NO: 7401143 - DNA, 22 bp, Homo sapiens
cctggctctggtgaggagaagt

SEQ ID NO: 7401144 - DNA, 22 bp, Homo sapiens
cctggctctggtgaggagaagt

SEQ ID NO: 7401145 - DNA, 22 bp, Homo sapiens
cctggctctggtgaggagaagt

SEQ ID NO: 7401146 - DNA, 22 bp, Homo sapiens
cctggctctggggcggacagct

SEQ ID NO: 7401147 - DNA, 22 bp, Homo sapiens
cctggctctggggcggacagct

SEQ ID NO: 7401148 - DNA, 22 bp, Homo sapiens
cctggctctggggcggacagct

SEQ ID NO: 7401149 - DNA, 22 bp, Homo sapiens
cctggctctgggatcttcgctt

SEQ ID NO: 7401150 - DNA, 22 bp, Homo sapiens
cctggctctgggatcttcgctt

SEQ ID NO: 7401151 - DNA, 22 bp, Homo sapiens
cctgggcataaatcactccaag

SEQ ID NO: 7401152 - DNA, 22 bp, Homo sapiens
cctgggctcaagtgatggtccc

SEQ ID NO: 7401153 - DNA, 22 bp, Homo sapiens
cctgggcataaatcactccaag

SEQ ID NO: 7401154 - DNA, 22 bp, Homo sapiens
cctggctctgtcctcgcgcaaa

SEQ ID NO: 7401155 - DNA, 22 bp, Homo sapiens
cctggctctgtcctcgcgcaaa

SEQ ID NO: 7401156 - DNA, 22 bp, Homo sapiens
cctggctctgtcctcgcgcaaa

SEQ ID NO: 7401157 - DNA, 22 bp, Homo sapiens
cctggctctggttccctcagct

SEQ ID NO: 7401158 - DNA, 22 bp, Homo sapiens
cctggctctggttccctcagct

SEQ ID NO: 7401159 - DNA, 22 bp, Homo sapiens
cctggctctgtcctcgcgcaaa

SEQ ID NO: 7401160 - DNA, 22 bp, Homo sapiens
cctggctctgtcctcgcgcaaa

SEQ ID NO: 7401161 - DNA, 22 bp, Homo sapiens
cctggctctggttccctcagct

SEQ ID NO: 7401162 - DNA, 22 bp, Homo sapiens
cctggctctggttccctcagct

SEQ ID NO: 7401163 - DNA, 22 bp, Homo sapiens
cctggctctggttccctcagct

SEQ ID NO: 7401164 - DNA, 22 bp, Homo sapiens
cctgggcttctgtctagatgtt

SEQ ID NO: 7401165 - DNA, 22 bp, Homo sapiens
cctgggcttctgtctagatgtt

SEQ ID NO: 7401166 - DNA, 22 bp, Homo sapiens
cctgggcttctgtctagatgtt

SEQ ID NO: 7401167 - DNA, 22 bp, Homo sapiens
cctgggcttctgtctagatgtt

SEQ ID NO: 7401168 - DNA, 22 bp, Homo sapiens
cctgggcttctgtctagatgtt

SEQ ID NO: 7401169 - DNA, 22 bp, Homo sapiens
cctgggctcgcgcacttcaccc

SEQ ID NO: 7401170 - DNA, 22 bp, Homo sapiens
cctgggcttctgtctagatgtt

SEQ ID NO: 7401171 - DNA, 22 bp, Homo sapiens
cctgggcttctgtctagatgtt

SEQ ID NO: 7401172 - DNA, 22 bp, Homo sapiens
cctgggctcgcgcacttcaccc

SEQ ID NO: 7401173 - DNA, 22 bp, Homo sapiens
cctgggcttctgtctagatgtt

SEQ ID NO: 7401174 - DNA, 22 bp, Homo sapiens
cctgggctcgcgcacttcaccc

SEQ ID NO: 7401175 - DNA, 22 bp, Homo sapiens
cctgggctcgcgcacttcaccc

SEQ ID NO: 7401176 - DNA, 22 bp, Homo sapiens
cctgggctcgcgcacttcaccc

SEQ ID NO: 7401177 - DNA, 20 bp, Homo sapiens
cctgggctccaggagccccg

SEQ ID NO: 7401178 - DNA, 20 bp, Homo sapiens
cctgggctccaggagccccg

SEQ ID NO: 7401179 - DNA, 20 bp, Homo sapiens
cctgggctccaggagccccg

SEQ ID NO: 7401180 - DNA, 20 bp, Homo sapiens
cctgggctccaggagccccg

SEQ ID NO: 7401181 - DNA, 20 bp, Homo sapiens
cctgggctccaggagccccg

SEQ ID NO: 7401182 - DNA, 20 bp, Homo sapiens
cctgggctccaggagccccg

SEQ ID NO: 7401183 - DNA, 22 bp, Homo sapiens
cctgggcttggttgttgagaac

SEQ ID NO: 7401184 - DNA, 22 bp, Homo sapiens
cctgggcttggttgttgagaac

SEQ ID NO: 7401185 - DNA, 22 bp, Homo sapiens
cctgggcttggttgttgagaac

SEQ ID NO: 7401186 - DNA, 22 bp, Homo sapiens
cctgggcttggttgttgagaac

SEQ ID NO: 7401187 - DNA, 22 bp, Homo sapiens
cctgggcttgcatctgtgctgg

SEQ ID NO: 7401188 - DNA, 22 bp, Homo sapiens
cctgggcttggttgttgagaac

SEQ ID NO: 7401189 - DNA, 22 bp, Homo sapiens
cctgggcttgcatctgtgctgg

SEQ ID NO: 7401190 - DNA, 22 bp, Homo sapiens
cctgggcttgcatctgtgctgg

SEQ ID NO: 7401191 - DNA, 22 bp, Homo sapiens
cctgggcttgcatctgtgctgg

SEQ ID NO: 7401192 - DNA, 22 bp, Homo sapiens
cctgggcttgcatctgtgctgg

SEQ ID NO: 7401193 - DNA, 22 bp, Homo sapiens
cctgggcttgcatctgtgctgg

SEQ ID NO: 7401194 - DNA, 22 bp, Homo sapiens
cctgggcttgcatctgtgctgg

SEQ ID NO: 7401195 - DNA, 22 bp, Homo sapiens
cctgggcttgcatctgtgctgg

SEQ ID NO: 7401196 - DNA, 22 bp, Homo sapiens
cctgggctttgagggcaggatg

SEQ ID NO: 7401197 - DNA, 22 bp, Homo sapiens
cctgggctttgagggcaggatg

SEQ ID NO: 7401198 - DNA, 22 bp, Homo sapiens
cctggtgccggtagacgcgcag

SEQ ID NO: 7401199 - DNA, 22 bp, Homo sapiens
cctggtgccggtagacgcgcag

SEQ ID NO: 7401200 - DNA, 22 bp, Homo sapiens
cctgtcagggtttgcctcagaa

SEQ ID NO: 7401201 - DNA, 22 bp, Homo sapiens
cctgtcagggtttgcctcagaa

SEQ ID NO: 7401202 - DNA, 22 bp, Homo sapiens
cctggtgctgctatcaggggta

SEQ ID NO: 7401203 - DNA, 22 bp, Homo sapiens
cctggtgcttaccagagctttt

SEQ ID NO: 7401204 - DNA, 22 bp, Homo sapiens
cctgtcagttgctgtcagggat

SEQ ID NO: 7401205 - DNA, 22 bp, Homo sapiens
cctgtcataatgtccgatgtca

SEQ ID NO: 7401206 - DNA, 22 bp, Homo sapiens
cctgtcagttgctgtcagggat

SEQ ID NO: 7401207 - DNA, 22 bp, Homo sapiens
cctgtcagttgctgtcagggat

SEQ ID NO: 7401208 - DNA, 22 bp, Homo sapiens
cctgtcagggtttgcctcagaa

SEQ ID NO: 7401209 - DNA, 22 bp, Homo sapiens
cctgtcagttgctgtcagggat

SEQ ID NO: 7401210 - DNA, 22 bp, Homo sapiens
cctgtcagttgctgtcagggat

SEQ ID NO: 7401211 - DNA, 22 bp, Homo sapiens
cctgtcagttgctgtcagggat

SEQ ID NO: 7401212 - DNA, 22 bp, Homo sapiens
cctgggctttgagggcaggatg

SEQ ID NO: 7401213 - DNA, 22 bp, Homo sapiens
cctgggctttgagggcaggatg

SEQ ID NO: 7401214 - DNA, 22 bp, Homo sapiens
cctgggctttgagggcaggatg

SEQ ID NO: 7401215 - DNA, 22 bp, Homo sapiens
cctgggctttgagggcaggatg

SEQ ID NO: 7401216 - DNA, 22 bp, Homo sapiens
cctgggctttgagggcaggatg

SEQ ID NO: 7401217 - DNA, 22 bp, Homo sapiens
cctgggctttcggcggcttcct

SEQ ID NO: 7401218 - DNA, 22 bp, Homo sapiens
cctgggctttcggcggcttcct

SEQ ID NO: 7401219 - DNA, 22 bp, Homo sapiens
cctgggctttcggcggcttcct

SEQ ID NO: 7401220 - DNA, 22 bp, Homo sapiens
cctgggctttcggcggcttcct

SEQ ID NO: 7401221 - DNA, 22 bp, Homo sapiens
cctgggctttcggcggcttcct

SEQ ID NO: 7401222 - DNA, 22 bp, Homo sapiens
cctgggctttcaaaaccagcct

SEQ ID NO: 7401223 - DNA, 22 bp, Homo sapiens
cctgggctttcggcggcttcct

SEQ ID NO: 7401224 - DNA, 22 bp, Homo sapiens
cctgggctttcggcggcttcct

SEQ ID NO: 7401225 - DNA, 22 bp, Homo sapiens
cctgggctttcggcggcttcct

SEQ ID NO: 7401226 - DNA, 22 bp, Homo sapiens
cctgggctttcggcggcttcct

SEQ ID NO: 7401227 - DNA, 22 bp, Homo sapiens
cctgggctttcaaaaccagcct

SEQ ID NO: 7401228 - DNA, 22 bp, Homo sapiens
cctgggctttcaaaaccagcct

SEQ ID NO: 7401229 - DNA, 22 bp, Homo sapiens
cctgggctttcaaaaccagcct

SEQ ID NO: 7401230 - DNA, 22 bp, Homo sapiens
cctgggctttcaaaaccagcct

SEQ ID NO: 7401231 - DNA, 22 bp, Homo sapiens
cctgggctttcaaaaccagcct

SEQ ID NO: 7401232 - DNA, 22 bp, Homo sapiens
agtccaggtggaccttggccag

SEQ ID NO: 7401233 - DNA, 22 bp, Homo sapiens
agtccaggtctctgagtcacaa

SEQ ID NO: 7401234 - DNA, 22 bp, Homo sapiens
agtccagtcggcctggagaaat

SEQ ID NO: 7401235 - DNA, 22 bp, Homo sapiens
agtccagtcggcctggagaaat

SEQ ID NO: 7401236 - DNA, 22 bp, Homo sapiens
agtccaggtggaccttggccag

SEQ ID NO: 7401237 - DNA, 22 bp, Homo sapiens
agtccagggctctctgtgggat

SEQ ID NO: 7401238 - DNA, 22 bp, Homo sapiens
agtccagtctcactcttggcag

SEQ ID NO: 7401239 - DNA, 22 bp, Homo sapiens
agtccagtctcactcttggcag

SEQ ID NO: 7401240 - DNA, 22 bp, Homo sapiens
agtccagtcttgttggcacggt

SEQ ID NO: 7401241 - DNA, 22 bp, Homo sapiens
agtccagtctcttctggtgagt

SEQ ID NO: 7401242 - DNA, 22 bp, Homo sapiens
agtccagtctcttctggtgagt

SEQ ID NO: 7401243 - DNA, 22 bp, Homo sapiens
agtccagtctcttctggtgagt

SEQ ID NO: 7401244 - DNA, 22 bp, Homo sapiens
agtccagtctcttctggtgagt

SEQ ID NO: 7401245 - DNA, 22 bp, Homo sapiens
agtccagtgtgttctggcagca

SEQ ID NO: 7401246 - DNA, 22 bp, Homo sapiens
agtccatacattgagaataaca

SEQ ID NO: 7401247 - DNA, 22 bp, Homo sapiens
agtccataacttcagagtgtca

SEQ ID NO: 7401248 - DNA, 22 bp, Homo sapiens
agtccagtgtgttctggcagca

SEQ ID NO: 7401249 - DNA, 22 bp, Homo sapiens
agtccagtgtgttctggcagca

SEQ ID NO: 7401250 - DNA, 22 bp, Homo sapiens
agtccagtcttgttggcacggt

SEQ ID NO: 7401251 - DNA, 22 bp, Homo sapiens
agtccagtgtcaaggtgccatt

SEQ ID NO: 7401252 - DNA, 22 bp, Homo sapiens
agtccagtgtcaaggtgccatt

SEQ ID NO: 7401253 - DNA, 22 bp, Homo sapiens
agtccagtgaactgtaaatagg

SEQ ID NO: 7401254 - DNA, 22 bp, Homo sapiens
agtccagtcttgttggcacggt

SEQ ID NO: 7401255 - DNA, 22 bp, Homo sapiens
agtccagtgaactgtaaatagg

SEQ ID NO: 7401256 - DNA, 22 bp, Homo sapiens
agtccagtgaactgtaaatagg

SEQ ID NO: 7401257 - DNA, 22 bp, Homo sapiens
agtccagggcttagtcagcggg

SEQ ID NO: 7401258 - DNA, 22 bp, Homo sapiens
agtccagggcttagtcagcggg

SEQ ID NO: 7401259 - DNA, 22 bp, Homo sapiens
agtccagggctctctgtgggat

SEQ ID NO: 7401260 - DNA, 22 bp, Homo sapiens
agtccaggtctctgagtcacaa

SEQ ID NO: 7401261 - DNA, 22 bp, Homo sapiens
agtccaggtctctgagtcacaa

SEQ ID NO: 7401262 - DNA, 22 bp, Homo sapiens
agtccagggcttagtcagcggg

SEQ ID NO: 7401263 - DNA, 22 bp, Homo sapiens
agtccagggcttagtcagcggg

SEQ ID NO: 7401264 - DNA, 22 bp, Homo sapiens
agtccaggtctctgagtcacaa

SEQ ID NO: 7401265 - DNA, 22 bp, Homo sapiens
agtccaggtctctgagtcacaa

SEQ ID NO: 7401266 - DNA, 22 bp, Homo sapiens
agtccagggctctctgtgggat

SEQ ID NO: 7401267 - DNA, 22 bp, Homo sapiens
agtccagggctctctgtgggat

SEQ ID NO: 7401268 - DNA, 22 bp, Homo sapiens
agtccagggctctctgtgggat

SEQ ID NO: 7401269 - DNA, 22 bp, Homo sapiens
agtccagggctctctgtgggat

SEQ ID NO: 7401270 - DNA, 22 bp, Homo sapiens
agtccaggctcttcctgaagaa

SEQ ID NO: 7401271 - DNA, 22 bp, Homo sapiens
agtccaggctcttcctgaagaa

SEQ ID NO: 7401272 - DNA, 22 bp, Homo sapiens
agtccagggagcccaggctttg

SEQ ID NO: 7401273 - DNA, 22 bp, Homo sapiens
ctagaagcaactagatctgttt

SEQ ID NO: 7401274 - DNA, 22 bp, Homo sapiens
ctagaagcaactagatctgttt

SEQ ID NO: 7401275 - DNA, 22 bp, Homo sapiens
ctagaacagaaagtacaggaaa

SEQ ID NO: 7401276 - DNA, 22 bp, Homo sapiens
ctagaacagaaagtacaggaaa

SEQ ID NO: 7401277 - DNA, 22 bp, Homo sapiens
ctagaacagtcaaagtgagctc

SEQ ID NO: 7401278 - DNA, 22 bp, Homo sapiens
ctagaacagtcaaagtgagctc

SEQ ID NO: 7401279 - DNA, 20 bp, Homo sapiens
ctagaagtgcctcatctaga

SEQ ID NO: 7401280 - DNA, 20 bp, Homo sapiens
ctagaagtgcctcatctaga

SEQ ID NO: 7401281 - DNA, 22 bp, Homo sapiens
ctagaagttggggctagggata

SEQ ID NO: 7401282 - DNA, 22 bp, Homo sapiens
ctagaagttggggctagggata

SEQ ID NO: 7401283 - DNA, 22 bp, Homo sapiens
ctagaagtttgggtccattaag

SEQ ID NO: 7401284 - DNA, 22 bp, Homo sapiens
ctagaatactcgtattattccc

SEQ ID NO: 7401285 - DNA, 22 bp, Homo sapiens
ctagaaggtctgggcctgggaa

SEQ ID NO: 7401286 - DNA, 20 bp, Homo sapiens
ctagaagcagaattgctgat

SEQ ID NO: 7401287 - DNA, 22 bp, Homo sapiens
ctagaagcaatgtaggggagac

SEQ ID NO: 7401288 - DNA, 20 bp, Homo sapiens
ctagaagcagaattgctgat

SEQ ID NO: 7401289 - DNA, 22 bp, Homo sapiens
agtccaaggttcatggcacaga

SEQ ID NO: 7401290 - DNA, 22 bp, Homo sapiens
ctagaatctatgtcaggaactc

SEQ ID NO: 7401291 - DNA, 22 bp, Homo sapiens
ctagaatctccaagtttactca

SEQ ID NO: 7401292 - DNA, 22 bp, Homo sapiens
ctagaatctgggatttctgact

SEQ ID NO: 7401293 - DNA, 22 bp, Homo sapiens
ctagaatctgggatttctgact

SEQ ID NO: 7401294 - DNA, 22 bp, Homo sapiens
ctagaatcccaaatggactggg

SEQ ID NO: 7401295 - DNA, 22 bp, Homo sapiens
ctagaatatcatatgaagagac

SEQ ID NO: 7401296 - DNA, 22 bp, Homo sapiens
ctagaatatcatatgaagagac

SEQ ID NO: 7401297 - DNA, 22 bp, Homo sapiens
ctagaatatcatatgaagagac

SEQ ID NO: 7401298 - DNA, 22 bp, Homo sapiens
agtccacagctcatagtttttt

SEQ ID NO: 7401299 - DNA, 22 bp, Homo sapiens
ctagaattgcattctatgaata

SEQ ID NO: 7401300 - DNA, 22 bp, Homo sapiens
agtccaaggttcatggcacaga

SEQ ID NO: 7401301 - DNA, 22 bp, Homo sapiens
agtccaaggttcatggcacaga

SEQ ID NO: 7401302 - DNA, 22 bp, Homo sapiens
agtccactgccccagctcctcg

SEQ ID NO: 7401303 - DNA, 22 bp, Homo sapiens
agtccagaacttcagctagttt

SEQ ID NO: 7401304 - DNA, 22 bp, Homo sapiens
agtccagaacttcagctagttt

SEQ ID NO: 7401305 - DNA, 22 bp, Homo sapiens
agtccagaacttcagctagttt

SEQ ID NO: 7401306 - DNA, 22 bp, Homo sapiens
agtccaggctcttcctgaagaa

SEQ ID NO: 7401307 - DNA, 22 bp, Homo sapiens
agtccaggctcttcctgaagaa

SEQ ID NO: 7401308 - DNA, 22 bp, Homo sapiens
ctaggggcatgaaatagagaat

SEQ ID NO: 7401309 - DNA, 22 bp, Homo sapiens
ctagggtcaggggcctgcgtcg

SEQ ID NO: 7401310 - DNA, 22 bp, Homo sapiens
ctagggtcaggggcctgcgtcg

SEQ ID NO: 7401311 - DNA, 22 bp, Homo sapiens
ctagggtcaggggcctgcgtcg

SEQ ID NO: 7401312 - DNA, 22 bp, Homo sapiens
ctagggtctgttttccaggtgt

SEQ ID NO: 7401313 - DNA, 22 bp, Homo sapiens
ctagggtctgttttccaggtgt

SEQ ID NO: 7401314 - DNA, 22 bp, Homo sapiens
ctagggtcaggggcctgcgtcg

SEQ ID NO: 7401315 - DNA, 22 bp, Homo sapiens
ctagggtcaggggcctgcgtcg

SEQ ID NO: 7401316 - DNA, 22 bp, Homo sapiens
ctagggtcaggggcctgcgtcg

SEQ ID NO: 7401317 - DNA, 22 bp, Homo sapiens
ctagggtggatttgtgcagagt

SEQ ID NO: 7401318 - DNA, 22 bp, Homo sapiens
ctagggtggatttgtgcagagt

SEQ ID NO: 7401319 - DNA, 22 bp, Homo sapiens
ctagggtctgttttccaggtgt

SEQ ID NO: 7401320 - DNA, 22 bp, Homo sapiens
ctaggtgatccactgctctctt

SEQ ID NO: 7401321 - DNA, 22 bp, Homo sapiens
ctagggtgtgcagattttgcct

SEQ ID NO: 7401322 - DNA, 22 bp, Homo sapiens
ctaggtgatccactgctctctt

SEQ ID NO: 7401323 - DNA, 22 bp, Homo sapiens
ctaggtgatccactgctctctt

SEQ ID NO: 7401324 - DNA, 22 bp, Homo sapiens
agtcccaacagcttacaaggaa

SEQ ID NO: 7401325 - DNA, 22 bp, Homo sapiens
agtcccaacagcttacaaggaa

SEQ ID NO: 7401326 - DNA, 22 bp, Homo sapiens
agtcccaacagcttacaaggaa

SEQ ID NO: 7401327 - DNA, 22 bp, Homo sapiens
agtccatggttgtagttctctc

SEQ ID NO: 7401328 - DNA, 22 bp, Homo sapiens
agtccattaactgtgttaacag

SEQ ID NO: 7401329 - DNA, 22 bp, Homo sapiens
agtcccaacagcttacaaggaa

SEQ ID NO: 7401330 - DNA, 22 bp, Homo sapiens
agtcccaacagcttacaaggaa

SEQ ID NO: 7401331 - DNA, 22 bp, Homo sapiens
agtccatgctgtctacagaatc

SEQ ID NO: 7401332 - DNA, 18 bp, Homo sapiens
agtccatgcatggctata

SEQ ID NO: 7401333 - DNA, 19 bp, Homo sapiens
agtccatgaatggaggatg

SEQ ID NO: 7401334 - DNA, 22 bp, Homo sapiens
agtccatgatgaaaccagatcc

SEQ ID NO: 7401335 - DNA, 19 bp, Homo sapiens
agtccatgaatggaggatg

SEQ ID NO: 7401336 - DNA, 19 bp, Homo sapiens
agtccatgaatggaggatg

SEQ ID NO: 7401337 - DNA, 22 bp, Homo sapiens
agtccatcttctcttgctggtc

SEQ ID NO: 7401338 - DNA, 22 bp, Homo sapiens
agtccatagtttacattacagc

SEQ ID NO: 7401339 - DNA, 22 bp, Homo sapiens
ctagtattaagtgtgagtaaaa

SEQ ID NO: 7401340 - DNA, 22 bp, Homo sapiens
ctagtcacgtctttcagttacc

SEQ ID NO: 7401341 - DNA, 22 bp, Homo sapiens
ctagtaaggaataaattatgat

SEQ ID NO: 7401342 - DNA, 22 bp, Homo sapiens
ctagtacaattttagcaagatg

SEQ ID NO: 7401343 - DNA, 22 bp, Homo sapiens
ctagtagacagaaatgtccagt

SEQ ID NO: 7401344 - DNA, 22 bp, Homo sapiens
ctagtaaagtactcaaatagcc

SEQ ID NO: 7401345 - DNA, 22 bp, Homo sapiens
ctagtaaagtactcaaatagcc

SEQ ID NO: 7401346 - DNA, 22 bp, Homo sapiens
ctagtaaagtactcaaatagcc

SEQ ID NO: 7401347 - DNA, 22 bp, Homo sapiens
ctaggttaaagcggttttatgt

SEQ ID NO: 7401348 - DNA, 22 bp, Homo sapiens
ctagtaaagctatgattctgcc

SEQ ID NO: 7401349 - DNA, 22 bp, Homo sapiens
ctaggtggtggtgggttgacat

SEQ ID NO: 7401350 - DNA, 22 bp, Homo sapiens
ctaggtgatccactgctctctt

SEQ ID NO: 7401351 - DNA, 22 bp, Homo sapiens
ctaggtgatccactgctctctt

SEQ ID NO: 7401352 - DNA, 22 bp, Homo sapiens
ctaggtgatccactgctctctt

SEQ ID NO: 7401353 - DNA, 22 bp, Homo sapiens
agtccccaggggatgcccacgc

SEQ ID NO: 7401354 - DNA, 22 bp, Homo sapiens
agtcccagctactcaagaggct

SEQ ID NO: 7401355 - DNA, 22 bp, Homo sapiens
agtcccagctactcaagaggct

SEQ ID NO: 7401356 - DNA, 22 bp, Homo sapiens
agtcccagctactcaagaggct

SEQ ID NO: 7401357 - DNA, 22 bp, Homo sapiens
agtcccagctactcaagaggct

SEQ ID NO: 7401358 - DNA, 22 bp, Homo sapiens
agtcccagctactcaagaggct

SEQ ID NO: 7401359 - DNA, 22 bp, Homo sapiens
ctagtctctggaggtcagggct

SEQ ID NO: 7401360 - DNA, 20 bp, Homo sapiens
ctagtctcacatccctggca

SEQ ID NO: 7401361 - DNA, 22 bp, Homo sapiens
ctagtccagtctcaaaatgcta

SEQ ID NO: 7401362 - DNA, 22 bp, Homo sapiens
ctagtccagtctcaaaatgcta

SEQ ID NO: 7401363 - DNA, 22 bp, Homo sapiens
ctagtccactgtcctgcctcca

SEQ ID NO: 7401364 - DNA, 22 bp, Homo sapiens
ctagtccactgtcctgcctcca

SEQ ID NO: 7401365 - DNA, 22 bp, Homo sapiens
ctagtcactcagcactgacaaa

SEQ ID NO: 7401366 - DNA, 22 bp, Homo sapiens
ctagtcactcagcactgacaaa

SEQ ID NO: 7401367 - DNA, 22 bp, Homo sapiens
ctacattttaataagctgctta

SEQ ID NO: 7401368 - DNA, 22 bp, Homo sapiens
ctacattttaataagctgctta

SEQ ID NO: 7401369 - DNA, 22 bp, Homo sapiens
ctacattttaataagctgctta

SEQ ID NO: 7401370 - DNA, 22 bp, Homo sapiens
ctacattttaataagctgctta

SEQ ID NO: 7401371 - DNA, 22 bp, Homo sapiens
ctacattttgtgattatgaaat

SEQ ID NO: 7401372 - DNA, 22 bp, Homo sapiens
ctacattttgtgattatgaaat

SEQ ID NO: 7401373 - DNA, 22 bp, Homo sapiens
ctacattttgtgattatgaaat

SEQ ID NO: 7401374 - DNA, 22 bp, Homo sapiens
ctacattttgtgattatgaaat

SEQ ID NO: 7401375 - DNA, 22 bp, Homo sapiens
ctacattttgtgattatgaaat

SEQ ID NO: 7401376 - DNA, 22 bp, Homo sapiens
ctacattttgtgattatgaaat

SEQ ID NO: 7401377 - DNA, 22 bp, Homo sapiens
ctacatttgttctatagctttt

SEQ ID NO: 7401378 - DNA, 22 bp, Homo sapiens
ctacatttgttctatagctttt

SEQ ID NO: 7401379 - DNA, 22 bp, Homo sapiens
ctacatttgttctatagctttt

SEQ ID NO: 7401380 - DNA, 22 bp, Homo sapiens
ctacatttgttctatagctttt

SEQ ID NO: 7401381 - DNA, 22 bp, Homo sapiens
ctacatttgttctatagctttt

SEQ ID NO: 7401382 - DNA, 22 bp, Homo sapiens
ctacatttgttctatagctttt

SEQ ID NO: 7401383 - DNA, 22 bp, Homo sapiens
ctacattttaataagctgctta

SEQ ID NO: 7401384 - DNA, 22 bp, Homo sapiens
ctacattttaataagctgctta

SEQ ID NO: 7401385 - DNA, 22 bp, Homo sapiens
ctacatttcccagctgccttcc

SEQ ID NO: 7401386 - DNA, 22 bp, Homo sapiens
ctacatttcccagctgccttcc

SEQ ID NO: 7401387 - DNA, 22 bp, Homo sapiens
ctacatttggagagtataggaa

SEQ ID NO: 7401388 - DNA, 22 bp, Homo sapiens
ctacatttggagagtataggaa

SEQ ID NO: 7401389 - DNA, 22 bp, Homo sapiens
ctacatttggagagtataggaa

SEQ ID NO: 7401390 - DNA, 22 bp, Homo sapiens
ctacagaattcaacaaatggtt

SEQ ID NO: 7401391 - DNA, 22 bp, Homo sapiens
ctacagaattcaacaaatggtt

SEQ ID NO: 7401392 - DNA, 22 bp, Homo sapiens
ctacagaattcaacaaatggtt

SEQ ID NO: 7401393 - DNA, 22 bp, Homo sapiens
ctacagaatggagggtcagaga

SEQ ID NO: 7401394 - DNA, 22 bp, Homo sapiens
ctacatttcccagctgccttcc

SEQ ID NO: 7401395 - DNA, 22 bp, Homo sapiens
ctacagaattcaacaaatggtt

SEQ ID NO: 7401396 - DNA, 22 bp, Homo sapiens
ctacatttgttcaaataagctg

SEQ ID NO: 7401397 - DNA, 22 bp, Homo sapiens
ctacatttgttcaaataagctg

SEQ ID NO: 7401398 - DNA, 22 bp, Homo sapiens
ctacatttgttcaaataagctg

SEQ ID NO: 7401399 - DNA, 22 bp, Homo sapiens
ctacatttgttcaaataagctg

SEQ ID NO: 7401400 - DNA, 22 bp, Homo sapiens
ctacatttgttcaaataagctg

SEQ ID NO: 7401401 - DNA, 22 bp, Homo sapiens
ctacatttgttcaaataagctg

SEQ ID NO: 7401402 - DNA, 22 bp, Homo sapiens
ctacatttggagagtataggaa

SEQ ID NO: 7401403 - DNA, 22 bp, Homo sapiens
ctacatttggagagtataggaa

SEQ ID NO: 7401404 - DNA, 22 bp, Homo sapiens
ctacatttttcaccgagcctct

SEQ ID NO: 7401405 - DNA, 22 bp, Homo sapiens
ctacatttttcaccgagcctct

SEQ ID NO: 7401406 - DNA, 22 bp, Homo sapiens
ctacatttttcaccgagcctct

SEQ ID NO: 7401407 - DNA, 22 bp, Homo sapiens
ctacatttttcaccgagcctct

SEQ ID NO: 7401408 - DNA, 22 bp, Homo sapiens
ctaccagaattttggatcaact

SEQ ID NO: 7401409 - DNA, 22 bp, Homo sapiens
ctaccagcttctttgtctggga

SEQ ID NO: 7401410 - DNA, 22 bp, Homo sapiens
ctaccagcttctttgtctggga

SEQ ID NO: 7401411 - DNA, 22 bp, Homo sapiens
ctacccagatccaggatggcta

SEQ ID NO: 7401412 - DNA, 22 bp, Homo sapiens
ctacccagatccaggatggcta

SEQ ID NO: 7401413 - DNA, 22 bp, Homo sapiens
ctacccagatccaggatggcta

SEQ ID NO: 7401414 - DNA, 22 bp, Homo sapiens
ctacccagcacctaggctgcct

SEQ ID NO: 7401415 - DNA, 22 bp, Homo sapiens
ctagaaatctctgtttacatca

SEQ ID NO: 7401416 - DNA, 22 bp, Homo sapiens
ctagaaatctctgtttacatca

SEQ ID NO: 7401417 - DNA, 22 bp, Homo sapiens
ctagaaatattttacagtcaag

SEQ ID NO: 7401418 - DNA, 22 bp, Homo sapiens
ctacccaggctggagtgcagta

SEQ ID NO: 7401419 - DNA, 22 bp, Homo sapiens
ctacccaggctggagtgcagta

SEQ ID NO: 7401420 - DNA, 22 bp, Homo sapiens
ctagaaatattttacagtcaag

SEQ ID NO: 7401421 - DNA, 22 bp, Homo sapiens
ctagaaatgtagattcttagtg

SEQ ID NO: 7401422 - DNA, 22 bp, Homo sapiens
ctagaaatgtagattcttagtg

SEQ ID NO: 7401423 - DNA, 22 bp, Homo sapiens
ctagaaatgtagattcttagtg

SEQ ID NO: 7401424 - DNA, 22 bp, Homo sapiens
ctagaaattctgattcagtagg

SEQ ID NO: 7401425 - DNA, 22 bp, Homo sapiens
ctagaaattctgattcagtagg

SEQ ID NO: 7401426 - DNA, 22 bp, Homo sapiens
ctagaaattctgattcagtagg

SEQ ID NO: 7401427 - DNA, 22 bp, Homo sapiens
ctagaaattctgattcagtagg

SEQ ID NO: 7401428 - DNA, 22 bp, Homo sapiens
ctagaacagaaagtacaggaaa

SEQ ID NO: 7401429 - DNA, 22 bp, Homo sapiens
ctagaacaaattaggaggcata

SEQ ID NO: 7401430 - DNA, 22 bp, Homo sapiens
ctagaaattctgattcagtagg

SEQ ID NO: 7401431 - DNA, 22 bp, Homo sapiens
ctagaaatgctcaagagaaagt

SEQ ID NO: 7401432 - DNA, 22 bp, Homo sapiens
ctagaaatgctcaagagaaagt

SEQ ID NO: 7401433 - DNA, 22 bp, Homo sapiens
ctagaaatgctcaagagaaagt

SEQ ID NO: 7401434 - DNA, 22 bp, Homo sapiens
ctagaaatgctcaagagaaagt

SEQ ID NO: 7401435 - DNA, 22 bp, Homo sapiens
ctagaaatgctcaagagaaagt

SEQ ID NO: 7401436 - DNA, 22 bp, Homo sapiens
ctagaaatgctcaagagaaagt

SEQ ID NO: 7401437 - DNA, 22 bp, Homo sapiens
ctagaaatctctgtttacatca

SEQ ID NO: 7401438 - DNA, 22 bp, Homo sapiens
ctagaaatctctgtttacatca

SEQ ID NO: 7401439 - DNA, 22 bp, Homo sapiens
ctagaaatctctgtttacatca

SEQ ID NO: 7401440 - DNA, 22 bp, Homo sapiens
agtatttagagacacaagatgg

SEQ ID NO: 7401441 - DNA, 22 bp, Homo sapiens
agtatttagagacacaagatgg

SEQ ID NO: 7401442 - DNA, 22 bp, Homo sapiens
agtatttagagacacaagacgg

SEQ ID NO: 7401443 - DNA, 22 bp, Homo sapiens
agtatttagagacacaagatgg

SEQ ID NO: 7401444 - DNA, 22 bp, Homo sapiens
agtatttagagacacaagatgg

SEQ ID NO: 7401445 - DNA, 22 bp, Homo sapiens
agtatttagagacacaagatgg

SEQ ID NO: 7401446 - DNA, 22 bp, Homo sapiens
agtatttagagacacaagacgg

SEQ ID NO: 7401447 - DNA, 22 bp, Homo sapiens
agtatttagagacacaagacgg

SEQ ID NO: 7401448 - DNA, 22 bp, Homo sapiens
agtatgtgtccccccaggagcc

SEQ ID NO: 7401449 - DNA, 21 bp, Homo sapiens
agtatgtgttagggataattt

SEQ ID NO: 7401450 - DNA, 22 bp, Homo sapiens
agtatgttgagttttgctttag

SEQ ID NO: 7401451 - DNA, 22 bp, Homo sapiens
agtattacatggccaatctcct

SEQ ID NO: 7401452 - DNA, 22 bp, Homo sapiens
agtattaccctcagaacttgat

SEQ ID NO: 7401453 - DNA, 22 bp, Homo sapiens
agtattcagcaaacgtgaacag

SEQ ID NO: 7401454 - DNA, 23 bp, Homo sapiens
agtattcaaaaggcaagctatat

SEQ ID NO: 7401455 - DNA, 23 bp, Homo sapiens
agtattcaaaaggcaagctatat

SEQ ID NO: 7401456 - DNA, 23 bp, Homo sapiens
agtattcaaaaggcaagctatat

SEQ ID NO: 7401457 - DNA, 23 bp, Homo sapiens
agtattcaaaaggcaagctatat

SEQ ID NO: 7401458 - DNA, 22 bp, Homo sapiens
ctacagaatggagggtcagaga

SEQ ID NO: 7401459 - DNA, 22 bp, Homo sapiens
ctacagaatggagggtcagaga

SEQ ID NO: 7401460 - DNA, 22 bp, Homo sapiens
ctacagaatggagggtcagaga

SEQ ID NO: 7401461 - DNA, 22 bp, Homo sapiens
ctacagaatctacctcaagcca

SEQ ID NO: 7401462 - DNA, 22 bp, Homo sapiens
ctacagaatctacctcaagcca

SEQ ID NO: 7401463 - DNA, 22 bp, Homo sapiens
ctacagaatctacctcaagcca

SEQ ID NO: 7401464 - DNA, 22 bp, Homo sapiens
ctacagaatctacctcaagcca

SEQ ID NO: 7401465 - DNA, 22 bp, Homo sapiens
ctacagaatctacctcaagcca

SEQ ID NO: 7401466 - DNA, 21 bp, Homo sapiens
ctacagaatcgagcattctgg

SEQ ID NO: 7401467 - DNA, 22 bp, Homo sapiens
agtatttagagacacaagatgg

SEQ ID NO: 7401468 - DNA, 22 bp, Homo sapiens
agtatttagagacacaagatgg

SEQ ID NO: 7401469 - DNA, 22 bp, Homo sapiens
agtatttagagacacaagatgg

SEQ ID NO: 7401470 - DNA, 22 bp, Homo sapiens
agtatttagcatagtggttagt

SEQ ID NO: 7401471 - DNA, 22 bp, Homo sapiens
agtatttagctgactcgctaca

SEQ ID NO: 7401472 - DNA, 22 bp, Homo sapiens
agtatttagctgactcgctaca

SEQ ID NO: 7401473 - DNA, 22 bp, Homo sapiens
agtatttagctgactcgctaca

SEQ ID NO: 7401474 - DNA, 22 bp, Homo sapiens
agtatttagctgactcgctaca

SEQ ID NO: 7401475 - DNA, 22 bp, Homo sapiens
agtatgtcagagtgaaaatggt

SEQ ID NO: 7401476 - DNA, 19 bp, Homo sapiens
agtatgtctatgagtcttt

SEQ ID NO: 7401477 - DNA, 22 bp, Homo sapiens
agtatgtggcacagaatttctt

SEQ ID NO: 7401478 - DNA, 22 bp, Homo sapiens
agtatgtcagagtgaaaatggt

SEQ ID NO: 7401479 - DNA, 22 bp, Homo sapiens
agtatgtcagagtgaaaatggt

SEQ ID NO: 7401480 - DNA, 22 bp, Homo sapiens
agtatgtagtgcaatcagtcag

SEQ ID NO: 7401481 - DNA, 22 bp, Homo sapiens
agtatgtagtgcaatcagtcag

SEQ ID NO: 7401482 - DNA, 22 bp, Homo sapiens
agtatgtattttatacttacag

SEQ ID NO: 7401483 - DNA, 22 bp, Homo sapiens
agtatggggctgtgtgtgcaca

SEQ ID NO: 7401484 - DNA, 22 bp, Homo sapiens
agtatgtaattttcaatgtgtt

SEQ ID NO: 7401485 - DNA, 22 bp, Homo sapiens
agtatgtaattttcaatgtgtt

SEQ ID NO: 7401486 - DNA, 22 bp, Homo sapiens
agtatgcatatttcaaagtaag

SEQ ID NO: 7401487 - DNA, 22 bp, Homo sapiens
agtatgcacctcactgtcaggc

SEQ ID NO: 7401488 - DNA, 22 bp, Homo sapiens
agtatgcagggtaggatcatct

SEQ ID NO: 7401489 - DNA, 22 bp, Homo sapiens
agtatgcatatttcaaagtaag

SEQ ID NO: 7401490 - DNA, 22 bp, Homo sapiens
agtatgcatatttcaaagtaag

SEQ ID NO: 7401491 - DNA, 22 bp, Homo sapiens
agtatggggctgtgtgtgcaca

SEQ ID NO: 7401492 - DNA, 22 bp, Homo sapiens
agtatgcaaatgtcataagcat

SEQ ID NO: 7401493 - DNA, 22 bp, Homo sapiens
agtatgcaaattatttcattgt

SEQ ID NO: 7401494 - DNA, 22 bp, Homo sapiens
agtatgcaaattatttcattgt

SEQ ID NO: 7401495 - DNA, 22 bp, Homo sapiens
ctaaggaattggagcatgtgtt

SEQ ID NO: 7401496 - DNA, 22 bp, Homo sapiens
ctaaggaattggagcatgtgtt

SEQ ID NO: 7401497 - DNA, 22 bp, Homo sapiens
ctaaggaattggagcatgtgtt

SEQ ID NO: 7401498 - DNA, 22 bp, Homo sapiens
ctaaggaattggagcatgtgtt

SEQ ID NO: 7401499 - DNA, 22 bp, Homo sapiens
ctaaggaattggagcatgtgtt

SEQ ID NO: 7401500 - DNA, 22 bp, Homo sapiens
ctaaggaacagatgtcagcaga

SEQ ID NO: 7401501 - DNA, 22 bp, Homo sapiens
ctaaggaacatcacaggccgtc

SEQ ID NO: 7401502 - DNA, 22 bp, Homo sapiens
ctaaggaacatcacaggccgtc

SEQ ID NO: 7401503 - DNA, 22 bp, Homo sapiens
ctaaggaacatcacaggccgtc

SEQ ID NO: 7401504 - DNA, 22 bp, Homo sapiens
ctaaggaagtgacagtgggatt

SEQ ID NO: 7401505 - DNA, 22 bp, Homo sapiens
ctaaggaagtgacagtgggatt

SEQ ID NO: 7401506 - DNA, 22 bp, Homo sapiens
ctaaggaagtgacagtgggatt

SEQ ID NO: 7401507 - DNA, 22 bp, Homo sapiens
ctaaggaaatatgtcacttgct

SEQ ID NO: 7401508 - DNA, 22 bp, Homo sapiens
ctaaggaacaccaggagatggt

SEQ ID NO: 7401509 - DNA, 22 bp, Homo sapiens
ctaaggaacaccaggagatggt

SEQ ID NO: 7401510 - DNA, 22 bp, Homo sapiens
ctaaggaacaccaggagatggt

SEQ ID NO: 7401511 - DNA, 22 bp, Homo sapiens
ctaaggaacagatgtcagcaga

SEQ ID NO: 7401512 - DNA, 22 bp, Homo sapiens
ctaaggaacagatgtcagcaga

SEQ ID NO: 7401513 - DNA, 22 bp, Homo sapiens
ctaaggaatcctaaaacagctg

SEQ ID NO: 7401514 - DNA, 22 bp, Homo sapiens
ctaaggaatcctaaaacagctg

SEQ ID NO: 7401515 - DNA, 22 bp, Homo sapiens
ctaaggaattcaaatagttagt

SEQ ID NO: 7401516 - DNA, 22 bp, Homo sapiens
ctaaggaattcaaatagttagt

SEQ ID NO: 7401517 - DNA, 22 bp, Homo sapiens
ctaaggaattcaaatagttagt

SEQ ID NO: 7401518 - DNA, 22 bp, Homo sapiens
ctaaggaattcaaatagttagt

SEQ ID NO: 7401519 - DNA, 22 bp, Homo sapiens
ctaaggaagtgacagtgggatt

SEQ ID NO: 7401520 - DNA, 22 bp, Homo sapiens
ctaaggaagtgacagtgggatt

SEQ ID NO: 7401521 - DNA, 22 bp, Homo sapiens
ctaaggaatcctaaaacagctg

SEQ ID NO: 7401522 - DNA, 22 bp, Homo sapiens
ctaaggaatcctaaaacagctg

SEQ ID NO: 7401523 - DNA, 22 bp, Homo sapiens
ctaaggaagtgacagtgggatt

SEQ ID NO: 7401524 - DNA, 22 bp, Homo sapiens
ctaagcacaatgctttgagtat

SEQ ID NO: 7401525 - DNA, 22 bp, Homo sapiens
ctaagcataatggtgctttaag

SEQ ID NO: 7401526 - DNA, 22 bp, Homo sapiens
ctaaggaaaaggatatatatgt

SEQ ID NO: 7401527 - DNA, 22 bp, Homo sapiens
ctaaggaaaaggatatatatgt

SEQ ID NO: 7401528 - DNA, 22 bp, Homo sapiens
ctaagcatccatctcttcttca

SEQ ID NO: 7401529 - DNA, 22 bp, Homo sapiens
ctaaggaaaaggatatatatgt

SEQ ID NO: 7401530 - DNA, 22 bp, Homo sapiens
ctaaggaaaaggatatatatgt

SEQ ID NO: 7401531 - DNA, 22 bp, Homo sapiens
ctaaggaaaggaaatacagtaa

SEQ ID NO: 7401532 - DNA, 22 bp, Homo sapiens
ctaaggaaaggaaatacagtaa

SEQ ID NO: 7401533 - DNA, 22 bp, Homo sapiens
ctaaggaaaggaaatacagtaa

SEQ ID NO: 7401534 - DNA, 22 bp, Homo sapiens
ctaaggaaaggaaatacagtaa

SEQ ID NO: 7401535 - DNA, 22 bp, Homo sapiens
ctaaggaaatatgtcacttgct

SEQ ID NO: 7401536 - DNA, 22 bp, Homo sapiens
ctaaggaaatatgtcacttgct

SEQ ID NO: 7401537 - DNA, 22 bp, Homo sapiens
ctaaggaaatatgtcacttgct

SEQ ID NO: 7401538 - DNA, 22 bp, Homo sapiens
ctaaggaaatatgtcacttgct

SEQ ID NO: 7401539 - DNA, 22 bp, Homo sapiens
ctaagaaatgttgtgaatgcca

SEQ ID NO: 7401540 - DNA, 22 bp, Homo sapiens
ctaagaaatgttgtgaatgcca

SEQ ID NO: 7401541 - DNA, 22 bp, Homo sapiens
ctaagaaatgttgtgaatgcca

SEQ ID NO: 7401542 - DNA, 22 bp, Homo sapiens
ctaaacttttataacattgaga

SEQ ID NO: 7401543 - DNA, 22 bp, Homo sapiens
agtacagtggtcataatataaa

SEQ ID NO: 7401544 - DNA, 19 bp, Homo sapiens
ctaaacttatgtgaccaca

SEQ ID NO: 7401545 - DNA, 22 bp, Homo sapiens
ctaagaaggaggaaaagtgcca

SEQ ID NO: 7401546 - DNA, 22 bp, Homo sapiens
ctaagaagtcaggggacagagg

SEQ ID NO: 7401547 - DNA, 22 bp, Homo sapiens
ctaagaaatgttgtgaatgcca

SEQ ID NO: 7401548 - DNA, 22 bp, Homo sapiens
ctaagaaatgttgtgaatgcca

SEQ ID NO: 7401549 - DNA, 22 bp, Homo sapiens
ctaagaaatgttgtgaatgcca

SEQ ID NO: 7401550 - DNA, 21 bp, Homo sapiens
ctaagcaaggagcaggggtag

SEQ ID NO: 7401551 - DNA, 21 bp, Homo sapiens
ctaagcaaggagcaggggtag

SEQ ID NO: 7401552 - DNA, 21 bp, Homo sapiens
ctaagcaaggagcaggggtag

SEQ ID NO: 7401553 - DNA, 22 bp, Homo sapiens
ctaagcacaatgctttgagtat

SEQ ID NO: 7401554 - DNA, 22 bp, Homo sapiens
ctaagcaagaatgagtgcaaca

SEQ ID NO: 7401555 - DNA, 22 bp, Homo sapiens
ctaagcaagaatgagtgcaaca

SEQ ID NO: 7401556 - DNA, 22 bp, Homo sapiens
ctaagcaagaatgagtgcaaca

SEQ ID NO: 7401557 - DNA, 22 bp, Homo sapiens
ctaagaggaagtactctgttat

SEQ ID NO: 7401558 - DNA, 22 bp, Homo sapiens
ctaagactctgcaaatcagctt

SEQ ID NO: 7401559 - DNA, 22 bp, Homo sapiens
ctaagaggaagtactctgttat

SEQ ID NO: 7401560 - DNA, 22 bp, Homo sapiens
ctaagaggaagtactctgttat

SEQ ID NO: 7401561 - DNA, 20 bp, Homo sapiens
ctaagaggaggactaggttt

SEQ ID NO: 7401562 - DNA, 20 bp, Homo sapiens
ctaagaggtccttccacatc

SEQ ID NO: 7401563 - DNA, 20 bp, Homo sapiens
ctaagaggtccttccacatc

SEQ ID NO: 7401564 - DNA, 18 bp, Homo sapiens
ctaagaggtcgtttctca

SEQ ID NO: 7401565 - DNA, 22 bp, Homo sapiens
agtacacacagtagaatagagt

SEQ ID NO: 7401566 - DNA, 22 bp, Homo sapiens
agtacacacagtagaatagagt

SEQ ID NO: 7401567 - DNA, 22 bp, Homo sapiens
agtacacacagtagaatagagt

SEQ ID NO: 7401568 - DNA, 22 bp, Homo sapiens
agtacacagaattctacttgtt

SEQ ID NO: 7401569 - DNA, 22 bp, Homo sapiens
agtacacagaattctacttgtt

SEQ ID NO: 7401570 - DNA, 22 bp, Homo sapiens
agtacacagtagactttctcat

SEQ ID NO: 7401571 - DNA, 22 bp, Homo sapiens
agtacacagtagactttctcat

SEQ ID NO: 7401572 - DNA, 22 bp, Homo sapiens
agtacacaagacacatttaaaa

SEQ ID NO: 7401573 - DNA, 22 bp, Homo sapiens
agtacacaagacacatttaaaa

SEQ ID NO: 7401574 - DNA, 22 bp, Homo sapiens
agtacacaagacacatttaaaa

SEQ ID NO: 7401575 - DNA, 22 bp, Homo sapiens
agtacaatttaatgaagatagc

SEQ ID NO: 7401576 - DNA, 22 bp, Homo sapiens
agtacaattatatttagatggt

SEQ ID NO: 7401577 - DNA, 22 bp, Homo sapiens
agtacaatttaatgaagatagc

SEQ ID NO: 7401578 - DNA, 22 bp, Homo sapiens
agtacaattatatttagatggt

SEQ ID NO: 7401579 - DNA, 22 bp, Homo sapiens
agtacacagtatatggtgagat

SEQ ID NO: 7401580 - DNA, 22 bp, Homo sapiens
agtacactatggtaactggagt

SEQ ID NO: 7401581 - DNA, 22 bp, Homo sapiens
agtacactggcaaatgtggtgg

SEQ ID NO: 7401582 - DNA, 22 bp, Homo sapiens
agtacactcaagaaaccggtaa

SEQ ID NO: 7401583 - DNA, 19 bp, Homo sapiens
agtacagaaaagagccctg

SEQ ID NO: 7401584 - DNA, 19 bp, Homo sapiens
agtacagaaaagagccctg

SEQ ID NO: 7401585 - DNA, 22 bp, Homo sapiens
agtacagatttagacacgatag

SEQ ID NO: 7401586 - DNA, 22 bp, Homo sapiens
agtacagatttagacacgatag

SEQ ID NO: 7401587 - DNA, 22 bp, Homo sapiens
agtacagatttagacacgatag

SEQ ID NO: 7401588 - DNA, 22 bp, Homo sapiens
agtacactggcaaatgtggtgg

SEQ ID NO: 7401589 - DNA, 22 bp, Homo sapiens
agtacagacctgtctcttcctg

SEQ ID NO: 7401590 - DNA, 22 bp, Homo sapiens
agtacagcccaggccaggctgg

SEQ ID NO: 7401591 - DNA, 22 bp, Homo sapiens
agtacagatttctgggccctac

SEQ ID NO: 7401592 - DNA, 22 bp, Homo sapiens
agtacagcaccatgagcacagg

SEQ ID NO: 7401593 - DNA, 22 bp, Homo sapiens
agtacagtgctcagtaatctaa

SEQ ID NO: 7401594 - DNA, 22 bp, Homo sapiens
agtacagtgctcagtaatctaa

SEQ ID NO: 7401595 - DNA, 22 bp, Homo sapiens
agtacagtcaggaagctgctgt

SEQ ID NO: 7401596 - DNA, 22 bp, Homo sapiens
agtacagtcaggaagctgctgt

SEQ ID NO: 7401597 - DNA, 22 bp, Homo sapiens
agtacagtagggtgctgttagt

SEQ ID NO: 7401598 - DNA, 22 bp, Homo sapiens
agtacagtagatgtaggaatag

SEQ ID NO: 7401599 - DNA, 22 bp, Homo sapiens
cgggcaaggcgagactaggccc

SEQ ID NO: 7401600 - DNA, 22 bp, Homo sapiens
cgggcaaggcgagactaggccc

SEQ ID NO: 7401601 - DNA, 22 bp, Homo sapiens
cggctcaggccacaggacggca

SEQ ID NO: 7401602 - DNA, 22 bp, Homo sapiens
cgggcactgcctttgttgattt

SEQ ID NO: 7401603 - DNA, 22 bp, Homo sapiens
cgggcactttgaaaatccattt

SEQ ID NO: 7401604 - DNA, 22 bp, Homo sapiens
cgggcactccatatccacactg

SEQ ID NO: 7401605 - DNA, 22 bp, Homo sapiens
cgggcactgccaggcttcccag

SEQ ID NO: 7401606 - DNA, 22 bp, Homo sapiens
cgggcactcagggtcgaggtgg

SEQ ID NO: 7401607 - DNA, 22 bp, Homo sapiens
cgggcactccagcagaaatctt

SEQ ID NO: 7401608 - DNA, 22 bp, Homo sapiens
cgggcacacacttgacaggttc

SEQ ID NO: 7401609 - DNA, 22 bp, Homo sapiens
cgggcagatcacacagggcttg

SEQ ID NO: 7401610 - DNA, 22 bp, Homo sapiens
cgggcagatcacacagggcttg

SEQ ID NO: 7401611 - DNA, 22 bp, Homo sapiens
cgggcagattgggaaggttcat

SEQ ID NO: 7401612 - DNA, 22 bp, Homo sapiens
cgggcagtgtggctccagagtc

SEQ ID NO: 7401613 - DNA, 22 bp, Homo sapiens
cgggcagtgtggctccagagtc

SEQ ID NO: 7401614 - DNA, 22 bp, Homo sapiens
cgggcagtgtggctccagagtc

SEQ ID NO: 7401615 - DNA, 22 bp, Homo sapiens
cgggcagcggcgtggccatggt

SEQ ID NO: 7401616 - DNA, 22 bp, Homo sapiens
cgggcagcggcgtggccatggt

SEQ ID NO: 7401617 - DNA, 22 bp, Homo sapiens
cgggcagcggcgtggccatggt

SEQ ID NO: 7401618 - DNA, 22 bp, Homo sapiens
cgggcagattgggaaggttcat

SEQ ID NO: 7401619 - DNA, 22 bp, Homo sapiens
cgggcagtgtggctccagagtc

SEQ ID NO: 7401620 - DNA, 17 bp, Homo sapiens
cgggcatggagggcagg

SEQ ID NO: 7401621 - DNA, 17 bp, Homo sapiens
cgggcatggagggcagg

SEQ ID NO: 7401622 - DNA, 17 bp, Homo sapiens
cgggcatggagggcagg

SEQ ID NO: 7401623 - DNA, 17 bp, Homo sapiens
cgggcatggagggcagg

SEQ ID NO: 7401624 - DNA, 17 bp, Homo sapiens
cgggcatggagggcagg

SEQ ID NO: 7401625 - DNA, 17 bp, Homo sapiens
cgggcatggagggcagg

SEQ ID NO: 7401626 - DNA, 17 bp, Homo sapiens
cgggcatggagggcagg

SEQ ID NO: 7401627 - DNA, 17 bp, Homo sapiens
cgggcatggagggcagg

SEQ ID NO: 7401628 - DNA, 17 bp, Homo sapiens
cgggcatggagggcagg

SEQ ID NO: 7401629 - DNA, 17 bp, Homo sapiens
cgggcatggagggcagg

SEQ ID NO: 7401630 - DNA, 22 bp, Homo sapiens
cgggccctttaaggatgtgtcg

SEQ ID NO: 7401631 - DNA, 22 bp, Homo sapiens
cgggccctttaaggatgtgtcg

SEQ ID NO: 7401632 - DNA, 22 bp, Homo sapiens
cgggccctttaaggatgtgtcg

SEQ ID NO: 7401633 - DNA, 22 bp, Homo sapiens
cgggccctactcaaagcttgca

SEQ ID NO: 7401634 - DNA, 22 bp, Homo sapiens
cgggccctactcaaagcttgca

SEQ ID NO: 7401635 - DNA, 17 bp, Homo sapiens
cgggcccgcggccgctc

SEQ ID NO: 7401636 - DNA, 17 bp, Homo sapiens
cgggcatggagggcagg

SEQ ID NO: 7401637 - DNA, 17 bp, Homo sapiens
cgggcatggagggcagg

SEQ ID NO: 7401638 - DNA, 17 bp, Homo sapiens
cgggcatggagggcagg

SEQ ID NO: 7401639 - DNA, 17 bp, Homo sapiens
cgggcatggagggcagg

SEQ ID NO: 7401640 - DNA, 23 bp, Homo sapiens
agtacaataagtataattctttc

SEQ ID NO: 7401641 - DNA, 23 bp, Homo sapiens
agtacaataagtataattctttc

SEQ ID NO: 7401642 - DNA, 22 bp, Homo sapiens
agtacaagtgatgtggtaaaaa

SEQ ID NO: 7401643 - DNA, 22 bp, Homo sapiens
agtacaatgtctgacacagtag

SEQ ID NO: 7401644 - DNA, 22 bp, Homo sapiens
agtacaatgtctgacacagtag

SEQ ID NO: 7401645 - DNA, 20 bp, Homo sapiens
agtacaatgtatgattcaga

SEQ ID NO: 7401646 - DNA, 20 bp, Homo sapiens
agtacaatgtatgattcaga

SEQ ID NO: 7401647 - DNA, 20 bp, Homo sapiens
agtacaatgtatgattcaga

SEQ ID NO: 7401648 - DNA, 21 bp, Homo sapiens
cgggctggccgggccctcacc

SEQ ID NO: 7401649 - DNA, 21 bp, Homo sapiens
cgggctggccgggccctcacc

SEQ ID NO: 7401650 - DNA, 21 bp, Homo sapiens
cgggctggccgggccctcacc

SEQ ID NO: 7401651 - DNA, 21 bp, Homo sapiens
cgggctggccgggccctcacc

SEQ ID NO: 7401652 - DNA, 22 bp, Homo sapiens
agtacaaattatagcgcttgga

SEQ ID NO: 7401653 - DNA, 22 bp, Homo sapiens
agtacaagtagaatgctacaag

SEQ ID NO: 7401654 - DNA, 22 bp, Homo sapiens
agtacaagtagaatgctacaag

SEQ ID NO: 7401655 - DNA, 22 bp, Homo sapiens
agtacaagtagaatgctacaag

SEQ ID NO: 7401656 - DNA, 22 bp, Homo sapiens
agtacaaattatagcgcttgga

SEQ ID NO: 7401657 - DNA, 22 bp, Homo sapiens
agtacaagtagaatgctacaag

SEQ ID NO: 7401658 - DNA, 22 bp, Homo sapiens
cgggcgcactccgggcagctgt

SEQ ID NO: 7401659 - DNA, 18 bp, Homo sapiens
cgggcgggcgcctggccc

SEQ ID NO: 7401660 - DNA, 18 bp, Homo sapiens
cgggcgggcgcctggccc

SEQ ID NO: 7401661 - DNA, 18 bp, Homo sapiens
cgggcgggcgcctggccc

SEQ ID NO: 7401662 - DNA, 18 bp, Homo sapiens
cgggcgggcgcctggccc

SEQ ID NO: 7401663 - DNA, 22 bp, Homo sapiens
cgggcgcactccgggcagctgt

SEQ ID NO: 7401664 - DNA, 22 bp, Homo sapiens
cgggcgcactccgggcagctgt

SEQ ID NO: 7401665 - DNA, 17 bp, Homo sapiens
cgggcccgcggccgctc

SEQ ID NO: 7401666 - DNA, 22 bp, Homo sapiens
cgggcgcactccgggcagctgt

SEQ ID NO: 7401667 - DNA, 22 bp, Homo sapiens
cgggcgcactccgggcagctgt

SEQ ID NO: 7401668 - DNA, 21 bp, Homo sapiens
cgggctggccgggccctcacc

SEQ ID NO: 7401669 - DNA, 22 bp, Homo sapiens
cgggctccgggtctttgcagtc

SEQ ID NO: 7401670 - DNA, 22 bp, Homo sapiens
cgggctctactggtatactgca

SEQ ID NO: 7401671 - DNA, 22 bp, Homo sapiens
cgggctctcgccgagctatgtg

SEQ ID NO: 7401672 - DNA, 22 bp, Homo sapiens
cgggctgctctggaccgacagc

SEQ ID NO: 7401673 - DNA, 22 bp, Homo sapiens
cgggctcagctccacccacccc

SEQ ID NO: 7401674 - DNA, 22 bp, Homo sapiens
cgggctcaggaggaaacaggag

SEQ ID NO: 7401675 - DNA, 22 bp, Homo sapiens
cgggctcaggaggaaacaggag

SEQ ID NO: 7401676 - DNA, 22 bp, Homo sapiens
cgggctcagcccggcccctcgc

SEQ ID NO: 7401677 - DNA, 22 bp, Homo sapiens
cgggctcagccagcccattctt

SEQ ID NO: 7401678 - DNA, 22 bp, Homo sapiens
cctgttctgtagtgagtttgag

SEQ ID NO: 7401679 - DNA, 22 bp, Homo sapiens
cctgttctaatcttggggcaga

SEQ ID NO: 7401680 - DNA, 22 bp, Homo sapiens
cctgttctaatcttggggcaga

SEQ ID NO: 7401681 - DNA, 22 bp, Homo sapiens
cctgttcccaaaccatctttct

SEQ ID NO: 7401682 - DNA, 22 bp, Homo sapiens
cctgttctgttaattaaacttt

SEQ ID NO: 7401683 - DNA, 22 bp, Homo sapiens
cctgttctgtggctctcaaagg

SEQ ID NO: 7401684 - DNA, 19 bp, Homo sapiens
cctgttcttggctgaggct

SEQ ID NO: 7401685 - DNA, 19 bp, Homo sapiens
cctgttcttggctgaggct

SEQ ID NO: 7401686 - DNA, 19 bp, Homo sapiens
cctgttcttggctgaggct

SEQ ID NO: 7401687 - DNA, 22 bp, Homo sapiens
cctgttcattttttgactctgc

SEQ ID NO: 7401688 - DNA, 22 bp, Homo sapiens
cctgttcatttgtatttgtctt

SEQ ID NO: 7401689 - DNA, 22 bp, Homo sapiens
cctgttcagagctaagcatcat

SEQ ID NO: 7401690 - DNA, 20 bp, Homo sapiens
cctgttcactgcgcagtttc

SEQ ID NO: 7401691 - DNA, 22 bp, Homo sapiens
cctgttcagagctaagcatcat

SEQ ID NO: 7401692 - DNA, 19 bp, Homo sapiens
cctgttcatgactctgtcc

SEQ ID NO: 7401693 - DNA, 22 bp, Homo sapiens
cctgttcactttgacttctcca

SEQ ID NO: 7401694 - DNA, 22 bp, Homo sapiens
cctgttcactttgacttctcca

SEQ ID NO: 7401695 - DNA, 22 bp, Homo sapiens
cctgttcactgcacagtttccg

SEQ ID NO: 7401696 - DNA, 20 bp, Homo sapiens
cctgttcactgcgcagtttc

SEQ ID NO: 7401697 - DNA, 22 bp, Homo sapiens
cctgttcacggtgtgttgttag

SEQ ID NO: 7401698 - DNA, 22 bp, Homo sapiens
cctgttcactgcacagtttccg

SEQ ID NO: 7401699 - DNA, 22 bp, Homo sapiens
cctgttcaccatggtcacgtgc

SEQ ID NO: 7401700 - DNA, 22 bp, Homo sapiens
cctgttcaccctccatgcacag

SEQ ID NO: 7401701 - DNA, 22 bp, Homo sapiens
cctgttcaccctccatgcacag

SEQ ID NO: 7401702 - DNA, 21 bp, Homo sapiens
cctgttcacagatctgtaact

SEQ ID NO: 7401703 - DNA, 22 bp, Homo sapiens
cctgttcaatgccctggcttca

SEQ ID NO: 7401704 - DNA, 21 bp, Homo sapiens
cctgttcacagatctgtaact

SEQ ID NO: 7401705 - DNA, 21 bp, Homo sapiens
cctgttcacagatctgtaact

SEQ ID NO: 7401706 - DNA, 22 bp, Homo sapiens
cctgttcaatattcttccttgt

SEQ ID NO: 7401707 - DNA, 22 bp, Homo sapiens
cctgttcaatattcttccttgt

SEQ ID NO: 7401708 - DNA, 22 bp, Homo sapiens
cctgttcaagttgcagggctgg

SEQ ID NO: 7401709 - DNA, 18 bp, Homo sapiens
cctgttacacactggggt

SEQ ID NO: 7401710 - DNA, 18 bp, Homo sapiens
cctgttacacactggggt

SEQ ID NO: 7401711 - DNA, 22 bp, Homo sapiens
cctgttcaagggatgattgacc

SEQ ID NO: 7401712 - DNA, 17 bp, Homo sapiens
cctgtgtttgctccttc

SEQ ID NO: 7401713 - DNA, 19 bp, Homo sapiens
cctgtgttgggagtgtgag

SEQ ID NO: 7401714 - DNA, 22 bp, Homo sapiens
cctgtgtttagatatgatgctg

SEQ ID NO: 7401715 - DNA, 22 bp, Homo sapiens
cctgtgttctaatccatctcag

SEQ ID NO: 7401716 - DNA, 22 bp, Homo sapiens
cctgtgttagttatgggtctct

SEQ ID NO: 7401717 - DNA, 22 bp, Homo sapiens
cctgtgttagttatgggtctct

SEQ ID NO: 7401718 - DNA, 22 bp, Homo sapiens
cctgtgttagttatgggtctct

SEQ ID NO: 7401719 - DNA, 18 bp, Homo sapiens
cctgtgtgtgttgcaggc

SEQ ID NO: 7401720 - DNA, 22 bp, Homo sapiens
cgcagctgtccatgtgtggggg

SEQ ID NO: 7401721 - DNA, 22 bp, Homo sapiens
cgaggcggcggaagtgcccgta

SEQ ID NO: 7401722 - DNA, 22 bp, Homo sapiens
cgaggccatgcatgctgaggac

SEQ ID NO: 7401723 - DNA, 22 bp, Homo sapiens
cgaggccatgcatgctgaggac

SEQ ID NO: 7401724 - DNA, 22 bp, Homo sapiens
cgaggccatgcatgctgaggac

SEQ ID NO: 7401725 - DNA, 22 bp, Homo sapiens
cgaggccatgcatgctgaggac

SEQ ID NO: 7401726 - DNA, 22 bp, Homo sapiens
cctgttcttgtctcattggcta

SEQ ID NO: 7401727 - DNA, 22 bp, Homo sapiens
cctgttgagagagctcactgag

SEQ ID NO: 7401728 - DNA, 22 bp, Homo sapiens
cctgttggaaggtgtaggcccc

SEQ ID NO: 7401729 - DNA, 22 bp, Homo sapiens
cctgttgagagagctcactgag

SEQ ID NO: 7401730 - DNA, 22 bp, Homo sapiens
cctgttggaaggtgtaggcccc

SEQ ID NO: 7401731 - DNA, 22 bp, Homo sapiens
cctgttgctctgcatgagttta

SEQ ID NO: 7401732 - DNA, 20 bp, Homo sapiens
cctgttggatgaggtccaga

SEQ ID NO: 7401733 - DNA, 22 bp, Homo sapiens
cctgttggaaggtgtaggcccc

SEQ ID NO: 7401734 - DNA, 22 bp, Homo sapiens
cctgttggaaggtgtaggcccc

SEQ ID NO: 7401735 - DNA, 20 bp, Homo sapiens
cctgttggatgaggtccaga

SEQ ID NO: 7401736 - DNA, 22 bp, Homo sapiens
cctgttgtggaaaaagcctgat

SEQ ID NO: 7401737 - DNA, 19 bp, Homo sapiens
cgcaggagccgaggtgacc

SEQ ID NO: 7401738 - DNA, 19 bp, Homo sapiens
cgcaggagccgaggtgacc

SEQ ID NO: 7401739 - DNA, 19 bp, Homo sapiens
cgcaggagccgaggtgacc

SEQ ID NO: 7401740 - DNA, 22 bp, Homo sapiens
cgcagctgtccatgtgtggggg

SEQ ID NO: 7401741 - DNA, 22 bp, Homo sapiens
cgcaggaagacaagggtggaaa

SEQ ID NO: 7401742 - DNA, 22 bp, Homo sapiens
cgcaggaagacaagggtggaaa

SEQ ID NO: 7401743 - DNA, 22 bp, Homo sapiens
cgcaggaagacaagggtggaaa

SEQ ID NO: 7401744 - DNA, 22 bp, Homo sapiens
cgcaggcaagagagtacagtta

SEQ ID NO: 7401745 - DNA, 19 bp, Homo sapiens
cgcaggagccgaggtgacc

SEQ ID NO: 7401746 - DNA, 19 bp, Homo sapiens
cgcaggagccgaggtgacc

SEQ ID NO: 7401747 - DNA, 19 bp, Homo sapiens
cgcaggagccgaggtgacc

SEQ ID NO: 7401748 - DNA, 19 bp, Homo sapiens
cgcaggagccgaggtgacc

SEQ ID NO: 7401749 - DNA, 22 bp, Homo sapiens
cgcaggcaagagagtacagtta

SEQ ID NO: 7401750 - DNA, 22 bp, Homo sapiens
cgcaggcaagagagtacagtta

SEQ ID NO: 7401751 - DNA, 22 bp, Homo sapiens
cgcaggcacagagtggacagcg

SEQ ID NO: 7401752 - DNA, 22 bp, Homo sapiens
cgcaggcaatgctccgcggggg

SEQ ID NO: 7401753 - DNA, 22 bp, Homo sapiens
cgcaggcaatgctccgcggggg

SEQ ID NO: 7401754 - DNA, 22 bp, Homo sapiens
cgcaggctcggttcacagagca

SEQ ID NO: 7401755 - DNA, 22 bp, Homo sapiens
cgcaggcacagagtggacagcg

SEQ ID NO: 7401756 - DNA, 22 bp, Homo sapiens
cgcaggcacagagtggacagcg

SEQ ID NO: 7401757 - DNA, 22 bp, Homo sapiens
aggtttcttcttaggaatatgt

SEQ ID NO: 7401758 - DNA, 22 bp, Homo sapiens
aggtttctttatgctgctagaa

SEQ ID NO: 7401759 - DNA, 21 bp, Homo sapiens
aggtttctgtgagcagagcag

SEQ ID NO: 7401760 - DNA, 22 bp, Homo sapiens
aggtttctggaaaggttttgct

SEQ ID NO: 7401761 - DNA, 22 bp, Homo sapiens
aggtttctggatttattatggc

SEQ ID NO: 7401762 - DNA, 18 bp, Homo sapiens
aggtttggtggaaacata

SEQ ID NO: 7401763 - DNA, 22 bp, Homo sapiens
aggtttggtttgacaagactga

SEQ ID NO: 7401764 - DNA, 22 bp, Homo sapiens
aggtttggtttgacaagactga

SEQ ID NO: 7401765 - DNA, 22 bp, Homo sapiens
aggtttgggagtagaaatcaga

SEQ ID NO: 7401766 - DNA, 22 bp, Homo sapiens
aggtttgggagtagaaatcaga

SEQ ID NO: 7401767 - DNA, 22 bp, Homo sapiens
aggtttgggagtagaaatcaga

SEQ ID NO: 7401768 - DNA, 22 bp, Homo sapiens
aggtttgggagtagaaatcaga

SEQ ID NO: 7401769 - DNA, 22 bp, Homo sapiens
aggtttgggttcattgctggct

SEQ ID NO: 7401770 - DNA, 22 bp, Homo sapiens
aggtttgggttcattgctggct

SEQ ID NO: 7401771 - DNA, 23 bp, Homo sapiens
aggtttgtctcagaggcagagtt

SEQ ID NO: 7401772 - DNA, 22 bp, Homo sapiens
aggtttgtgtcttgcttaaggt

SEQ ID NO: 7401773 - DNA, 22 bp, Homo sapiens
aggtttgttaaaccagattgct

SEQ ID NO: 7401774 - DNA, 22 bp, Homo sapiens
aggtttgtttatgtatcattgg

SEQ ID NO: 7401775 - DNA, 22 bp, Homo sapiens
aggtttgtttatgtatcattgg

SEQ ID NO: 7401776 - DNA, 22 bp, Homo sapiens
aggtttgttttggaaagatcat

SEQ ID NO: 7401777 - DNA, 22 bp, Homo sapiens
aggtttgttttggaaagatcat

SEQ ID NO: 7401778 - DNA, 22 bp, Homo sapiens
agtaaaaatatgcttgtggcta

SEQ ID NO: 7401779 - DNA, 22 bp, Homo sapiens
agtaaaaatatgcttgtggcta

SEQ ID NO: 7401780 - DNA, 22 bp, Homo sapiens
agtaaaaatatgcttgtggcta

SEQ ID NO: 7401781 - DNA, 22 bp, Homo sapiens
agtaaaaagttcagaatggttg

SEQ ID NO: 7401782 - DNA, 22 bp, Homo sapiens
agtaaaaagttcagaatggttg

SEQ ID NO: 7401783 - DNA, 22 bp, Homo sapiens
cggctcagctagcttggcccca

SEQ ID NO: 7401784 - DNA, 22 bp, Homo sapiens
cggctcagctagcttggcccca

SEQ ID NO: 7401785 - DNA, 18 bp, Homo sapiens
aggttttcaggatatgtg

SEQ ID NO: 7401786 - DNA, 22 bp, Homo sapiens
agtaaaaagttcagaatggttg

SEQ ID NO: 7401787 - DNA, 22 bp, Homo sapiens
agtaaaaagttcagaatggttg

SEQ ID NO: 7401788 - DNA, 22 bp, Homo sapiens
agtaaaaagttcagaatggttg

SEQ ID NO: 7401789 - DNA, 22 bp, Homo sapiens
agtaaaaagttcagaatggttg

SEQ ID NO: 7401790 - DNA, 18 bp, Homo sapiens
aggttttcagagtttcca

SEQ ID NO: 7401791 - DNA, 22 bp, Homo sapiens
aggttttcagctgtatcctgag

SEQ ID NO: 7401792 - DNA, 22 bp, Homo sapiens
aggttttcacaggaagtatgtt

SEQ ID NO: 7401793 - DNA, 22 bp, Homo sapiens
aggttttcacaggaagtatgtt

SEQ ID NO: 7401794 - DNA, 15 bp, Homo sapiens
aggttttcagagtaa

SEQ ID NO: 7401795 - DNA, 22 bp, Homo sapiens
aggttttcacaggaagtatgtt

SEQ ID NO: 7401796 - DNA, 22 bp, Homo sapiens
aggtttctgcagcatagtggca

SEQ ID NO: 7401797 - DNA, 22 bp, Homo sapiens
aggtttctgctgtcctccttct

SEQ ID NO: 7401798 - DNA, 22 bp, Homo sapiens
cgcaggtgaactgttctgcagt

SEQ ID NO: 7401799 - DNA, 22 bp, Homo sapiens
aggtttctgcactgtcactggt

SEQ ID NO: 7401800 - DNA, 22 bp, Homo sapiens
cgcaggtgaactgttctgcagt

SEQ ID NO: 7401801 - DNA, 22 bp, Homo sapiens
aggtttctgcaatgtgtgtaca

SEQ ID NO: 7401802 - DNA, 22 bp, Homo sapiens
cgcaggtgaaagaggctgggca

SEQ ID NO: 7401803 - DNA, 22 bp, Homo sapiens
cgcaggggaggaaggtacacct

SEQ ID NO: 7401804 - DNA, 22 bp, Homo sapiens
cgcaggggaggaaggtacacct

SEQ ID NO: 7401805 - DNA, 22 bp, Homo sapiens
cgcagggccgcgagcgggacca

SEQ ID NO: 7401806 - DNA, 22 bp, Homo sapiens
cgcagggccgcgagcgggacca

SEQ ID NO: 7401807 - DNA, 22 bp, Homo sapiens
cgcagggccgcgagcgggacca

SEQ ID NO: 7401808 - DNA, 19 bp, Homo sapiens
cgcaggcttcgggtcgctc

SEQ ID NO: 7401809 - DNA, 19 bp, Homo sapiens
cgcaggcttcgggtcgctc

SEQ ID NO: 7401810 - DNA, 22 bp, Homo sapiens
cgcaggctggcgcggagtggca

SEQ ID NO: 7401811 - DNA, 22 bp, Homo sapiens
cgcaggctggcgcggagtggca

SEQ ID NO: 7401812 - DNA, 22 bp, Homo sapiens
cgcagggatttcaaggggcctt

SEQ ID NO: 7401813 - DNA, 22 bp, Homo sapiens
cgcaggctcggttcacagagca

SEQ ID NO: 7401814 - DNA, 22 bp, Homo sapiens
cgcaggctcggttcacagagca

SEQ ID NO: 7401815 - DNA, 22 bp, Homo sapiens
cgcaggctgcagccaagaagag

SEQ ID NO: 7401816 - DNA, 22 bp, Homo sapiens
cgcaggctcggttcacagagca

SEQ ID NO: 7401817 - DNA, 22 bp, Homo sapiens
cgcaggctggcgcggagtggca

SEQ ID NO: 7401818 - DNA, 22 bp, Homo sapiens
cgcaggctggcgcggagtggca

SEQ ID NO: 7401819 - DNA, 22 bp, Homo sapiens
cgcaggctgcagccaagaagag

SEQ ID NO: 7401820 - DNA, 20 bp, Homo sapiens
cctctgtttacaacacaccc

SEQ ID NO: 7401821 - DNA, 22 bp, Homo sapiens
cctctgtgtgtgcatgcatgcg

SEQ ID NO: 7401822 - DNA, 22 bp, Homo sapiens
cctctgtgtgtgcatgcatgcg

SEQ ID NO: 7401823 - DNA, 22 bp, Homo sapiens
cctctgtgtgtgcatgcatgcg

SEQ ID NO: 7401824 - DNA, 22 bp, Homo sapiens
cctctgttgaaaattacaaaca

SEQ ID NO: 7401825 - DNA, 22 bp, Homo sapiens
cctctgtgtgtgcatgcatgcg

SEQ ID NO: 7401826 - DNA, 22 bp, Homo sapiens
cctctgtgtgtgcatgcatgcg

SEQ ID NO: 7401827 - DNA, 22 bp, Homo sapiens
cctctgtgtgtgcatgcatgcg

SEQ ID NO: 7401828 - DNA, 22 bp, Homo sapiens
cctctgtgtgtgcatgcatgcg

SEQ ID NO: 7401829 - DNA, 20 bp, Homo sapiens
cctctgtgtcctgtgtcata

SEQ ID NO: 7401830 - DNA, 22 bp, Homo sapiens
cctctgtgtctccaagaggcct

SEQ ID NO: 7401831 - DNA, 22 bp, Homo sapiens
cctctgtgtctccaagaggcct

SEQ ID NO: 7401832 - DNA, 22 bp, Homo sapiens
cctctgtgtctccaagaggcct

SEQ ID NO: 7401833 - DNA, 22 bp, Homo sapiens
cctctgtgtctccaagaggcct

SEQ ID NO: 7401834 - DNA, 22 bp, Homo sapiens
cctctgtgtctccaagaggcct

SEQ ID NO: 7401835 - DNA, 22 bp, Homo sapiens
cctctgtgtctccaagaggcct

SEQ ID NO: 7401836 - DNA, 22 bp, Homo sapiens
cctctgtgtcttggtttcaaga

SEQ ID NO: 7401837 - DNA, 22 bp, Homo sapiens
cctctgtgtcttggtttcaaga

SEQ ID NO: 7401838 - DNA, 22 bp, Homo sapiens
cctctgtgtgatgcgcaaagta

SEQ ID NO: 7401839 - DNA, 22 bp, Homo sapiens
cctctgtgtgatgcgcaaagta

SEQ ID NO: 7401840 - DNA, 22 bp, Homo sapiens
cctctgtgtgatgcgcaaagta

SEQ ID NO: 7401841 - DNA, 22 bp, Homo sapiens
cctctgtgtcctggtcattgaa

SEQ ID NO: 7401842 - DNA, 22 bp, Homo sapiens
cctctgtgtcctggtcattgaa

SEQ ID NO: 7401843 - DNA, 22 bp, Homo sapiens
cctctgtgtcctggtcattgaa

SEQ ID NO: 7401844 - DNA, 20 bp, Homo sapiens
cctctgtgtcctgtgtcata

SEQ ID NO: 7401845 - DNA, 20 bp, Homo sapiens
cctctgtgtcctgtgtcata

SEQ ID NO: 7401846 - DNA, 20 bp, Homo sapiens
cctctgtgtcctgtgtcata

SEQ ID NO: 7401847 - DNA, 20 bp, Homo sapiens
cctctgtgtcctgtgtcata

SEQ ID NO: 7401848 - DNA, 22 bp, Homo sapiens
cctctgtgggccgggcctgctg

SEQ ID NO: 7401849 - DNA, 22 bp, Homo sapiens
cctctgtggtctgtctaatgca

SEQ ID NO: 7401850 - DNA, 22 bp, Homo sapiens
cctctgtggtctgtctaatgca

SEQ ID NO: 7401851 - DNA, 22 bp, Homo sapiens
cctctgtgtcagggaagagact

SEQ ID NO: 7401852 - DNA, 22 bp, Homo sapiens
cctctgtgtcagggaagagact

SEQ ID NO: 7401853 - DNA, 22 bp, Homo sapiens
cctctgtgtcctggtcattgaa

SEQ ID NO: 7401854 - DNA, 22 bp, Homo sapiens
agggggagcttggctactcctg

SEQ ID NO: 7401855 - DNA, 22 bp, Homo sapiens
agggggagcttggctactcctg

SEQ ID NO: 7401856 - DNA, 22 bp, Homo sapiens
agggggagcttggctactcctg

SEQ ID NO: 7401857 - DNA, 22 bp, Homo sapiens
agggggagcttggctactcctg

SEQ ID NO: 7401858 - DNA, 22 bp, Homo sapiens
cctcttcacctcgggcacactg

SEQ ID NO: 7401859 - DNA, 22 bp, Homo sapiens
cctcttcacctcgggcacactg

SEQ ID NO: 7401860 - DNA, 22 bp, Homo sapiens
cctcttcagcaaagttcggccc

SEQ ID NO: 7401861 - DNA, 22 bp, Homo sapiens
agggggagacatgtgtgtgttt

SEQ ID NO: 7401862 - DNA, 22 bp, Homo sapiens
agggggagacatgtgtgtgttt

SEQ ID NO: 7401863 - DNA, 22 bp, Homo sapiens
agggggctccttggtgtgcaga

SEQ ID NO: 7401864 - DNA, 22 bp, Homo sapiens
agggggctccttggtgtgcaga

SEQ ID NO: 7401865 - DNA, 22 bp, Homo sapiens
agggggctcctccggtgcttcc

SEQ ID NO: 7401866 - DNA, 22 bp, Homo sapiens
agggggctgccaaggaatgtaa

SEQ ID NO: 7401867 - DNA, 22 bp, Homo sapiens
agggggctgccaaggaatgtaa

SEQ ID NO: 7401868 - DNA, 22 bp, Homo sapiens
agggggctgccaaggaatgtaa

SEQ ID NO: 7401869 - DNA, 22 bp, Homo sapiens
agggggctggagacacctcctc

SEQ ID NO: 7401870 - DNA, 22 bp, Homo sapiens
agggggctggagacacctcctc

SEQ ID NO: 7401871 - DNA, 22 bp, Homo sapiens
aggggggtggatcacctgaggt

SEQ ID NO: 7401872 - DNA, 22 bp, Homo sapiens
agggggctggagacacctcctc

SEQ ID NO: 7401873 - DNA, 22 bp, Homo sapiens
agggggctggagacacctcctc

SEQ ID NO: 7401874 - DNA, 22 bp, Homo sapiens
agggggctggagacacctcctc

SEQ ID NO: 7401875 - DNA, 22 bp, Homo sapiens
agggggtctcctatcatggaag

SEQ ID NO: 7401876 - DNA, 22 bp, Homo sapiens
agggggtctcctatcatggaag

SEQ ID NO: 7401877 - DNA, 22 bp, Homo sapiens
agggggtcgtccggaagacctg

SEQ ID NO: 7401878 - DNA, 22 bp, Homo sapiens
agggggtcgtccggaagacctg

SEQ ID NO: 7401879 - DNA, 22 bp, Homo sapiens
agggggtcgtccggaagacctg

SEQ ID NO: 7401880 - DNA, 22 bp, Homo sapiens
agggggtcgtccggaagacctg

SEQ ID NO: 7401881 - DNA, 22 bp, Homo sapiens
agggggtgatcaaggtgcggcg

SEQ ID NO: 7401882 - DNA, 22 bp, Homo sapiens
agggggtgatcaaggtgcggcg

SEQ ID NO: 7401883 - DNA, 22 bp, Homo sapiens
agggggtgatcaaggtgcggcg

SEQ ID NO: 7401884 - DNA, 22 bp, Homo sapiens
agggggtgaatgtctgtctaca

SEQ ID NO: 7401885 - DNA, 22 bp, Homo sapiens
agggggtgaatgtctgtctaca

SEQ ID NO: 7401886 - DNA, 22 bp, Homo sapiens
agggggtgaatgtctgtctaca

SEQ ID NO: 7401887 - DNA, 22 bp, Homo sapiens
agggggtgaatgtctgtctaca

SEQ ID NO: 7401888 - DNA, 22 bp, Homo sapiens
agggggtgaatgtctgtctaca

SEQ ID NO: 7401889 - DNA, 22 bp, Homo sapiens
agggggtgaatgtctgtctaca

SEQ ID NO: 7401890 - DNA, 22 bp, Homo sapiens
agggggtgaatgtctgtctaca

SEQ ID NO: 7401891 - DNA, 22 bp, Homo sapiens
agggggtgaatgtctgtctaca

SEQ ID NO: 7401892 - DNA, 22 bp, Homo sapiens
agggggtgcatttgtgaatgaa

SEQ ID NO: 7401893 - DNA, 22 bp, Homo sapiens
agggggtgcatttgtgaatgaa

SEQ ID NO: 7401894 - DNA, 22 bp, Homo sapiens
agggggtgatcaaggtgcggcg

SEQ ID NO: 7401895 - DNA, 22 bp, Homo sapiens
agggggtgatcaaggtgcggcg

SEQ ID NO: 7401896 - DNA, 22 bp, Homo sapiens
agggggtgatcaaggtgcggcg

SEQ ID NO: 7401897 - DNA, 22 bp, Homo sapiens
agggggtgatcaaggtgcggcg

SEQ ID NO: 7401898 - DNA, 22 bp, Homo sapiens
agggggtgcccagatgaaggat

SEQ ID NO: 7401899 - DNA, 22 bp, Homo sapiens
agggggtgcccagatgaaggat

SEQ ID NO: 7401900 - DNA, 22 bp, Homo sapiens
agggggtgcccagatgaaggat

SEQ ID NO: 7401901 - DNA, 22 bp, Homo sapiens
agggggtgcccagatgaaggat

SEQ ID NO: 7401902 - DNA, 22 bp, Homo sapiens
agggggtgcccagatgaaggat

SEQ ID NO: 7401903 - DNA, 22 bp, Homo sapiens
agggggtgcccagatgaaggat

SEQ ID NO: 7401904 - DNA, 22 bp, Homo sapiens
agggggtgcatttgtgaatgaa

SEQ ID NO: 7401905 - DNA, 22 bp, Homo sapiens
agggggtgcatttgtgaatgaa

SEQ ID NO: 7401906 - DNA, 22 bp, Homo sapiens
agggggtgcatttgtgaatgaa

SEQ ID NO: 7401907 - DNA, 22 bp, Homo sapiens
agggggtgcatttgtgaatgaa

SEQ ID NO: 7401908 - DNA, 22 bp, Homo sapiens
agggggtgctacttccagagtt

SEQ ID NO: 7401909 - DNA, 22 bp, Homo sapiens
agggggtgctacttccagagtt

SEQ ID NO: 7401910 - DNA, 22 bp, Homo sapiens
agggggtgctacttccagagtt

SEQ ID NO: 7401911 - DNA, 22 bp, Homo sapiens
agggggtgctacttccagagtt

SEQ ID NO: 7401912 - DNA, 22 bp, Homo sapiens
agggggtgctacttccagagtt

SEQ ID NO: 7401913 - DNA, 22 bp, Homo sapiens
agggggtgctacttccagagtt

SEQ ID NO: 7401914 - DNA, 22 bp, Homo sapiens
agggggtgggaagtctagaatc

SEQ ID NO: 7401915 - DNA, 22 bp, Homo sapiens
agggggtgggaagtctagaatc

SEQ ID NO: 7401916 - DNA, 22 bp, Homo sapiens
agggggtgggaagtctagaatc

SEQ ID NO: 7401917 - DNA, 22 bp, Homo sapiens
agggggtgctacttccagagtt

SEQ ID NO: 7401918 - DNA, 22 bp, Homo sapiens
agggggtgtctctgattgggtt

SEQ ID NO: 7401919 - DNA, 22 bp, Homo sapiens
agggggtgtctctgattgggtt

SEQ ID NO: 7401920 - DNA, 22 bp, Homo sapiens
agggggtgtctctgattgggtt

SEQ ID NO: 7401921 - DNA, 22 bp, Homo sapiens
agggggtgtctctgattgggtt

SEQ ID NO: 7401922 - DNA, 22 bp, Homo sapiens
agggggtgtctctgattgggtt

SEQ ID NO: 7401923 - DNA, 22 bp, Homo sapiens
agggggtgtctctgattgggtt

SEQ ID NO: 7401924 - DNA, 22 bp, Homo sapiens
agggggtgtctctgattgggtt

SEQ ID NO: 7401925 - DNA, 22 bp, Homo sapiens
aggggtgaaagagggccctcaa

SEQ ID NO: 7401926 - DNA, 22 bp, Homo sapiens
aggggtgaaggcccgataggag

SEQ ID NO: 7401927 - DNA, 22 bp, Homo sapiens
cctgagtcccctcattcactct

SEQ ID NO: 7401928 - DNA, 22 bp, Homo sapiens
cctgagtcccctcattcactct

SEQ ID NO: 7401929 - DNA, 22 bp, Homo sapiens
cctgagtcccctcattcactct

SEQ ID NO: 7401930 - DNA, 22 bp, Homo sapiens
cctgcagaccacactcagtcct

SEQ ID NO: 7401931 - DNA, 21 bp, Homo sapiens
cctgagtccctgttacagaca

SEQ ID NO: 7401932 - DNA, 21 bp, Homo sapiens
cctgagtccctgttacagaca

SEQ ID NO: 7401933 - DNA, 22 bp, Homo sapiens
cctgagtctgtgttttcctaag

SEQ ID NO: 7401934 - DNA, 22 bp, Homo sapiens
aggggtctttaggaacgtcggg

SEQ ID NO: 7401935 - DNA, 22 bp, Homo sapiens
aggggtcttgggagtcctggct

SEQ ID NO: 7401936 - DNA, 22 bp, Homo sapiens
aggggtctttaggaacgtcggg

SEQ ID NO: 7401937 - DNA, 22 bp, Homo sapiens
aggggtctttaggaacgtcggg

SEQ ID NO: 7401938 - DNA, 22 bp, Homo sapiens
aggggtgaaagagggccctcaa

SEQ ID NO: 7401939 - DNA, 22 bp, Homo sapiens
aggggtgaaagagggccctcaa

SEQ ID NO: 7401940 - DNA, 22 bp, Homo sapiens
aggggtcttgaggactccagca

SEQ ID NO: 7401941 - DNA, 22 bp, Homo sapiens
aggggtcttgaggactccagca

SEQ ID NO: 7401942 - DNA, 22 bp, Homo sapiens
aggggtcttgaggactccagca

SEQ ID NO: 7401943 - DNA, 22 bp, Homo sapiens
aggggtcttgaggactccagca

SEQ ID NO: 7401944 - DNA, 22 bp, Homo sapiens
aggggtcttgggagtcctggct

SEQ ID NO: 7401945 - DNA, 22 bp, Homo sapiens
aggggtcttgggagtcctggct

SEQ ID NO: 7401946 - DNA, 22 bp, Homo sapiens
aggggtcttgggagtcctggct

SEQ ID NO: 7401947 - DNA, 22 bp, Homo sapiens
aggggtagtaggataacaaatt

SEQ ID NO: 7401948 - DNA, 22 bp, Homo sapiens
aggggtagagattgctggtgta

SEQ ID NO: 7401949 - DNA, 22 bp, Homo sapiens
aggggtagagattgctggtgta

SEQ ID NO: 7401950 - DNA, 22 bp, Homo sapiens
aggggtagagattgctggtgta

SEQ ID NO: 7401951 - DNA, 22 bp, Homo sapiens
aggggtagagattgctggtgta

SEQ ID NO: 7401952 - DNA, 22 bp, Homo sapiens
aggggtagagattgctggtgta

SEQ ID NO: 7401953 - DNA, 22 bp, Homo sapiens
aggggtagagattgctggtgta

SEQ ID NO: 7401954 - DNA, 20 bp, Homo sapiens
aggggtctagcagcagtgct

SEQ ID NO: 7401955 - DNA, 20 bp, Homo sapiens
aggggtctagcagcagtgct

SEQ ID NO: 7401956 - DNA, 22 bp, Homo sapiens
aggggtcagtgaccattgagga

SEQ ID NO: 7401957 - DNA, 22 bp, Homo sapiens
aggggtcagtgaccattgagga

SEQ ID NO: 7401958 - DNA, 22 bp, Homo sapiens
aggggtcagtgaccattgagga

SEQ ID NO: 7401959 - DNA, 22 bp, Homo sapiens
agggggtgtctctgattgggtt

SEQ ID NO: 7401960 - DNA, 22 bp, Homo sapiens
aggggtctatcctgagatggtc

SEQ ID NO: 7401961 - DNA, 22 bp, Homo sapiens
aggggtctatcctgagatggtc

SEQ ID NO: 7401962 - DNA, 22 bp, Homo sapiens
aggggtctatcctgagatggtc

SEQ ID NO: 7401963 - DNA, 22 bp, Homo sapiens
aggggtctatcctgagatggtc

SEQ ID NO: 7401964 - DNA, 20 bp, Homo sapiens
aggggtctagcagcagtgct

SEQ ID NO: 7401965 - DNA, 20 bp, Homo sapiens
aggggtctagcagcagtgct

SEQ ID NO: 7401966 - DNA, 20 bp, Homo sapiens
aggggtctagcagcagtgct

SEQ ID NO: 7401967 - DNA, 22 bp, Homo sapiens
aggggtctatcctgagatggtc

SEQ ID NO: 7401968 - DNA, 22 bp, Homo sapiens
aggggtctatcctgagatggtc

SEQ ID NO: 7401969 - DNA, 22 bp, Homo sapiens
aggggtctatcctgagatggtc

SEQ ID NO: 7401970 - DNA, 22 bp, Homo sapiens
aggggaatgggtagactgttga

SEQ ID NO: 7401971 - DNA, 22 bp, Homo sapiens
aggggaatgggtagactgttga

SEQ ID NO: 7401972 - DNA, 22 bp, Homo sapiens
aggggaatgggtagactgttga

SEQ ID NO: 7401973 - DNA, 22 bp, Homo sapiens
aggggaatgggtagactgttga

SEQ ID NO: 7401974 - DNA, 21 bp, Homo sapiens
aggggaagtagagttttgatt

SEQ ID NO: 7401975 - DNA, 21 bp, Homo sapiens
aggggaagtagagttttgatt

SEQ ID NO: 7401976 - DNA, 21 bp, Homo sapiens
aggggaagtagagttttgatt

SEQ ID NO: 7401977 - DNA, 22 bp, Homo sapiens
aggggaaggccagcctgtagag

SEQ ID NO: 7401978 - DNA, 21 bp, Homo sapiens
aggggaagtagagttttgatt

SEQ ID NO: 7401979 - DNA, 21 bp, Homo sapiens
aggggaagtagagttttgatt

SEQ ID NO: 7401980 - DNA, 21 bp, Homo sapiens
aggggaagtagagttttgatt

SEQ ID NO: 7401981 - DNA, 22 bp, Homo sapiens
cctcctggtgacaaggcaaagc

SEQ ID NO: 7401982 - DNA, 22 bp, Homo sapiens
cctcctggtgacaaggcaaagc

SEQ ID NO: 7401983 - DNA, 22 bp, Homo sapiens
aggggaatgggtagactgttga

SEQ ID NO: 7401984 - DNA, 22 bp, Homo sapiens
cctcctggtgacaaggcaaagc

SEQ ID NO: 7401985 - DNA, 22 bp, Homo sapiens
cctcctggtgacaaggcaaagc

SEQ ID NO: 7401986 - DNA, 22 bp, Homo sapiens
aggggaagattatacttttgaa

SEQ ID NO: 7401987 - DNA, 22 bp, Homo sapiens
aggggaagagccctttacatgg

SEQ ID NO: 7401988 - DNA, 22 bp, Homo sapiens
aggggaagagccctttacatgg

SEQ ID NO: 7401989 - DNA, 22 bp, Homo sapiens
aggggaagagccctttacatgg

SEQ ID NO: 7401990 - DNA, 22 bp, Homo sapiens
aggggaagagccctttacatgg

SEQ ID NO: 7401991 - DNA, 22 bp, Homo sapiens
aggggaaatgccttggtggtac

SEQ ID NO: 7401992 - DNA, 22 bp, Homo sapiens
aggggaaatgccttggtggtac

SEQ ID NO: 7401993 - DNA, 22 bp, Homo sapiens
aggggaaagaacagtcttcagg

SEQ ID NO: 7401994 - DNA, 22 bp, Homo sapiens
aggggaagattatacttttgaa

SEQ ID NO: 7401995 - DNA, 22 bp, Homo sapiens
aggggaaggccagcctgtagag

SEQ ID NO: 7401996 - DNA, 22 bp, Homo sapiens
aggggaagattatacttttgaa

SEQ ID NO: 7401997 - DNA, 22 bp, Homo sapiens
aggggaagattatacttttgaa

SEQ ID NO: 7401998 - DNA, 22 bp, Homo sapiens
aggggaagattatacttttgaa

SEQ ID NO: 7401999 - DNA, 22 bp, Homo sapiens
aggggaagattatacttttgaa

SEQ ID NO: 7402000 - DNA, 22 bp, Homo sapiens
aggggaaggccagcctgtagag

SEQ ID NO: 7402001 - DNA, 22 bp, Homo sapiens
aggggaaggccagcctgtagag

SEQ ID NO: 7402002 - DNA, 22 bp, Homo sapiens
aggggaaggccagcctgtagag

SEQ ID NO: 7402003 - DNA, 22 bp, Homo sapiens
aggggaaggccagcctgtagag

SEQ ID NO: 7402004 - DNA, 22 bp, Homo sapiens
aggggaaggccagcctgtagag

SEQ ID NO: 7402005 - DNA, 22 bp, Homo sapiens
aggggaaggccagcctgtagag

SEQ ID NO: 7402006 - DNA, 22 bp, Homo sapiens
cctcctttcctgttttcctgag

SEQ ID NO: 7402007 - DNA, 22 bp, Homo sapiens
cctcgacctccccaggctcagg

SEQ ID NO: 7402008 - DNA, 22 bp, Homo sapiens
cctccttctggggccttctgct

SEQ ID NO: 7402009 - DNA, 22 bp, Homo sapiens
cctccttctggggccttctgct

SEQ ID NO: 7402010 - DNA, 22 bp, Homo sapiens
cctcgacctccccaggctcagg

SEQ ID NO: 7402011 - DNA, 22 bp, Homo sapiens
cctccttcctgggacagagctg

SEQ ID NO: 7402012 - DNA, 22 bp, Homo sapiens
cctccttcctgggacagagctg

SEQ ID NO: 7402013 - DNA, 22 bp, Homo sapiens
cctcctgttgtcctgctggggc

SEQ ID NO: 7402014 - DNA, 22 bp, Homo sapiens
cctccttcctgggacagagctg

SEQ ID NO: 7402015 - DNA, 22 bp, Homo sapiens
cctcctgttgtcaccaggcgtg

SEQ ID NO: 7402016 - DNA, 22 bp, Homo sapiens
cctccttctggggccttctgct

SEQ ID NO: 7402017 - DNA, 22 bp, Homo sapiens
cctccttctggggccttctgct

SEQ ID NO: 7402018 - DNA, 22 bp, Homo sapiens
cctccttctctttttgcagagc

SEQ ID NO: 7402019 - DNA, 22 bp, Homo sapiens
cctcctggtgggcgcttctggc

SEQ ID NO: 7402020 - DNA, 22 bp, Homo sapiens
cctcctggtgggcgcttctggc

SEQ ID NO: 7402021 - DNA, 22 bp, Homo sapiens
cctcctggtgggcgcttctggc

SEQ ID NO: 7402022 - DNA, 22 bp, Homo sapiens
cctcctggtgggcgcttctggc

SEQ ID NO: 7402023 - DNA, 22 bp, Homo sapiens
cctcctggtgggcgcttctggc

SEQ ID NO: 7402024 - DNA, 22 bp, Homo sapiens
cctcctggttgcaatgaaatgg

SEQ ID NO: 7402025 - DNA, 22 bp, Homo sapiens
cctcctggtgggcgcttctggc

SEQ ID NO: 7402026 - DNA, 22 bp, Homo sapiens
cctcctggtgggcgcttctggc

SEQ ID NO: 7402027 - DNA, 22 bp, Homo sapiens
cctcctggttgcaatgaaatgg

SEQ ID NO: 7402028 - DNA, 22 bp, Homo sapiens
cctcctgttgtcctgctggggc

SEQ ID NO: 7402029 - DNA, 22 bp, Homo sapiens
cctcctgtctccttcctatatt

SEQ ID NO: 7402030 - DNA, 19 bp, Homo sapiens
cctcctgtggcgggtgggg

SEQ ID NO: 7402031 - DNA, 18 bp, Homo sapiens
aggggcagcttgtgtgga

SEQ ID NO: 7402032 - DNA, 18 bp, Homo sapiens
aggggcagcttgtgtgga

SEQ ID NO: 7402033 - DNA, 18 bp, Homo sapiens
aggggcagcttgtgtgga

SEQ ID NO: 7402034 - DNA, 18 bp, Homo sapiens
aggggcagcttgtgtgga

SEQ ID NO: 7402035 - DNA, 18 bp, Homo sapiens
aggggcagcttgtgtgga

SEQ ID NO: 7402036 - DNA, 22 bp, Homo sapiens
cctcgacctccccaggctcagg

SEQ ID NO: 7402037 - DNA, 22 bp, Homo sapiens
aggggcctggttggcctctgtt

SEQ ID NO: 7402038 - DNA, 22 bp, Homo sapiens
aggggcctggttggcctctgtt

SEQ ID NO: 7402039 - DNA, 22 bp, Homo sapiens
aggggcctggttggcctctgtt

SEQ ID NO: 7402040 - DNA, 22 bp, Homo sapiens
aggggcctggttggcctctgtt

SEQ ID NO: 7402041 - DNA, 22 bp, Homo sapiens
aggggcctggttggcctctgtt

SEQ ID NO: 7402042 - DNA, 22 bp, Homo sapiens
aggggcgggacatgcactgagc

SEQ ID NO: 7402043 - DNA, 22 bp, Homo sapiens
aggggcggcctgcctgaagcag

SEQ ID NO: 7402044 - DNA, 22 bp, Homo sapiens
aggggcggcctgcctgaagcag

SEQ ID NO: 7402045 - DNA, 22 bp, Homo sapiens
aggggcctggttggcctctgtt

SEQ ID NO: 7402046 - DNA, 22 bp, Homo sapiens
aggggcctggttggcctctgtt

SEQ ID NO: 7402047 - DNA, 22 bp, Homo sapiens
aggggcgctgcggtcctcagcc

SEQ ID NO: 7402048 - DNA, 22 bp, Homo sapiens
aggggcgctgcggtcctcagcc

SEQ ID NO: 7402049 - DNA, 22 bp, Homo sapiens
aggggcgaggggagccgtgcca

SEQ ID NO: 7402050 - DNA, 22 bp, Homo sapiens
aggggcgagtctgtccagccgg

SEQ ID NO: 7402051 - DNA, 22 bp, Homo sapiens
aggggctccaaggaagtttggg

SEQ ID NO: 7402052 - DNA, 22 bp, Homo sapiens
aggggctcagttactttggcag

SEQ ID NO: 7402053 - DNA, 22 bp, Homo sapiens
aggggctcagttactttggcag

SEQ ID NO: 7402054 - DNA, 22 bp, Homo sapiens
aggggctcagttactttggcag

SEQ ID NO: 7402055 - DNA, 22 bp, Homo sapiens
aggggctcagttactttggcag

SEQ ID NO: 7402056 - DNA, 22 bp, Homo sapiens
aggggctcaaagtgtgcaggga

SEQ ID NO: 7402057 - DNA, 22 bp, Homo sapiens
aggggctcaagcagtgtggtct

SEQ ID NO: 7402058 - DNA, 22 bp, Homo sapiens
aggggctcaagcagtgtggtct

SEQ ID NO: 7402059 - DNA, 22 bp, Homo sapiens
aggggctagaggtgccccagag

SEQ ID NO: 7402060 - DNA, 22 bp, Homo sapiens
aggggctagaggtgccccagag

SEQ ID NO: 7402061 - DNA, 22 bp, Homo sapiens
aggggcgtgctcttccccgacg

SEQ ID NO: 7402062 - DNA, 22 bp, Homo sapiens
aggggcgtctgtaggcagtggg

SEQ ID NO: 7402063 - DNA, 22 bp, Homo sapiens
aggggcgtctgtaggcagtggg

SEQ ID NO: 7402064 - DNA, 22 bp, Homo sapiens
aggggcgtctgtaggcagtggg

SEQ ID NO: 7402065 - DNA, 22 bp, Homo sapiens
aggggctagctttatgccttca

SEQ ID NO: 7402066 - DNA, 22 bp, Homo sapiens
aggggctcaaagtgtgcaggga

SEQ ID NO: 7402067 - DNA, 22 bp, Homo sapiens
aggggctcaaagtgtgcaggga

SEQ ID NO: 7402068 - DNA, 22 bp, Homo sapiens
aggggctcaaagtgtgcaggga

SEQ ID NO: 7402069 - DNA, 22 bp, Homo sapiens
aggggctcaaagtgtgcaggga

SEQ ID NO: 7402070 - DNA, 22 bp, Homo sapiens
aggggctctgagtgggccagga

SEQ ID NO: 7402071 - DNA, 22 bp, Homo sapiens
aggggctgactggaaagtgcca

SEQ ID NO: 7402072 - DNA, 22 bp, Homo sapiens
aggggctgactggaaagtgcca

SEQ ID NO: 7402073 - DNA, 22 bp, Homo sapiens
aggggctgactggaaagtgcca

SEQ ID NO: 7402074 - DNA, 22 bp, Homo sapiens
aggggctgactggaaagtgcca

SEQ ID NO: 7402075 - DNA, 22 bp, Homo sapiens
aggggctctgagtgggccagga

SEQ ID NO: 7402076 - DNA, 22 bp, Homo sapiens
aggggctctgagtgggccagga

SEQ ID NO: 7402077 - DNA, 22 bp, Homo sapiens
aggggctctgagtgggccagga

SEQ ID NO: 7402078 - DNA, 22 bp, Homo sapiens
aggggctctgagtgggccagga

SEQ ID NO: 7402079 - DNA, 22 bp, Homo sapiens
aggggctctgagtgggccagga

SEQ ID NO: 7402080 - DNA, 22 bp, Homo sapiens
aggggctctgagtgggccagga

SEQ ID NO: 7402081 - DNA, 22 bp, Homo sapiens
aggggctctgagtgggccagga

SEQ ID NO: 7402082 - DNA, 22 bp, Homo sapiens
aggggctgcctggcttggcact

SEQ ID NO: 7402083 - DNA, 22 bp, Homo sapiens
aggggctgcctggcttggcact

SEQ ID NO: 7402084 - DNA, 22 bp, Homo sapiens
aggggctgcctggcttggcact

SEQ ID NO: 7402085 - DNA, 22 bp, Homo sapiens
aggggctgcctggcttggcact

SEQ ID NO: 7402086 - DNA, 22 bp, Homo sapiens
aggggctgcctggcttggcact

SEQ ID NO: 7402087 - DNA, 22 bp, Homo sapiens
aggggctgcctggcttggcact

SEQ ID NO: 7402088 - DNA, 22 bp, Homo sapiens
cctctgtgggccgggcctgctg

SEQ ID NO: 7402089 - DNA, 22 bp, Homo sapiens
cctctgtgggccgggcctgctg

SEQ ID NO: 7402090 - DNA, 22 bp, Homo sapiens
cctctgtgggccgggcctgctg

SEQ ID NO: 7402091 - DNA, 22 bp, Homo sapiens
aggggctcctggcctggagagc

SEQ ID NO: 7402092 - DNA, 22 bp, Homo sapiens
aggggctcctggcctggagagc

SEQ ID NO: 7402093 - DNA, 22 bp, Homo sapiens
aggggctcctggcctggagagc

SEQ ID NO: 7402094 - DNA, 22 bp, Homo sapiens
aggggctcctggcctggagagc

SEQ ID NO: 7402095 - DNA, 22 bp, Homo sapiens
aggggctcctggcctggagagc

SEQ ID NO: 7402096 - DNA, 22 bp, Homo sapiens
aggggctcctctctgagagtag

SEQ ID NO: 7402097 - DNA, 22 bp, Homo sapiens
aggggctccaaggaagtttggg

SEQ ID NO: 7402098 - DNA, 22 bp, Homo sapiens
aggggctcctctctgagagtag

SEQ ID NO: 7402099 - DNA, 22 bp, Homo sapiens
aggggctcctctctgagagtag

SEQ ID NO: 7402100 - DNA, 22 bp, Homo sapiens
aggggctcctttgtgctgcgtc

SEQ ID NO: 7402101 - DNA, 22 bp, Homo sapiens
aggggctcctttgtgctgcgtc

SEQ ID NO: 7402102 - DNA, 22 bp, Homo sapiens
aggggctcctttgtgctgcgtc

SEQ ID NO: 7402103 - DNA, 22 bp, Homo sapiens
aggggctcctttgtgctgcgtc

SEQ ID NO: 7402104 - DNA, 22 bp, Homo sapiens
aggggctcctttgtgctgcgtc

SEQ ID NO: 7402105 - DNA, 22 bp, Homo sapiens
aggggctctaaagatcatggaa

SEQ ID NO: 7402106 - DNA, 22 bp, Homo sapiens
aggggctctaaagatcatggaa

SEQ ID NO: 7402107 - DNA, 22 bp, Homo sapiens
aggggctctaaagatcatggaa

SEQ ID NO: 7402108 - DNA, 22 bp, Homo sapiens
aggggctctaaagatcatggaa

SEQ ID NO: 7402109 - DNA, 22 bp, Homo sapiens
aggggctctaaagatcatggaa

SEQ ID NO: 7402110 - DNA, 22 bp, Homo sapiens
cctcagggtctctcacagcacc

SEQ ID NO: 7402111 - DNA, 22 bp, Homo sapiens
cctcagggtctctcacagcacc

SEQ ID NO: 7402112 - DNA, 22 bp, Homo sapiens
cctcagggtctctcacagcacc

SEQ ID NO: 7402113 - DNA, 23 bp, Homo sapiens
cctcagggtctagcagagagaag

SEQ ID NO: 7402114 - DNA, 23 bp, Homo sapiens
cctcagggtctagcagagagaag

SEQ ID NO: 7402115 - DNA, 23 bp, Homo sapiens
cctcagggtctagcagagagaag

SEQ ID NO: 7402116 - DNA, 22 bp, Homo sapiens
cctcagggtcatcctagtaata

SEQ ID NO: 7402117 - DNA, 22 bp, Homo sapiens
cctcaggggtgcccacagctgc

SEQ ID NO: 7402118 - DNA, 22 bp, Homo sapiens
cctcagggtctgaggagaccgt

SEQ ID NO: 7402119 - DNA, 22 bp, Homo sapiens
cctcagggtctgaggagaccgt

SEQ ID NO: 7402120 - DNA, 22 bp, Homo sapiens
cctcagggtctgaggagaccgt

SEQ ID NO: 7402121 - DNA, 22 bp, Homo sapiens
cctcagggttcggatgagaaca

SEQ ID NO: 7402122 - DNA, 22 bp, Homo sapiens
cctcagggtggcatcagatctt

SEQ ID NO: 7402123 - DNA, 22 bp, Homo sapiens
cctcaggggtgcccacagctgc

SEQ ID NO: 7402124 - DNA, 22 bp, Homo sapiens
cctcaggggtcactgtgaggag

SEQ ID NO: 7402125 - DNA, 22 bp, Homo sapiens
cctcaggggtcactgtgaggag

SEQ ID NO: 7402126 - DNA, 22 bp, Homo sapiens
cctcaggggtcactgtgaggag

SEQ ID NO: 7402127 - DNA, 22 bp, Homo sapiens
cctcaggggtcactgtgaggag

SEQ ID NO: 7402128 - DNA, 22 bp, Homo sapiens
cctcaggggtcactgtgaggag

SEQ ID NO: 7402129 - DNA, 22 bp, Homo sapiens
cctcaggggcttttcgttgttg

SEQ ID NO: 7402130 - DNA, 23 bp, Homo sapiens
cctcaggggacctgtgagcctga

SEQ ID NO: 7402131 - DNA, 18 bp, Homo sapiens
cctcaggggacctggcag

SEQ ID NO: 7402132 - DNA, 18 bp, Homo sapiens
cctcaggggacctggcag

SEQ ID NO: 7402133 - DNA, 23 bp, Homo sapiens
cctcaggggacctgtgagcctga

SEQ ID NO: 7402134 - DNA, 23 bp, Homo sapiens
cctcaggggacctgtgagcctga

SEQ ID NO: 7402135 - DNA, 18 bp, Homo sapiens
cctcaggggacctggcag

SEQ ID NO: 7402136 - DNA, 22 bp, Homo sapiens
aggggaaagaacagtcttcagg

SEQ ID NO: 7402137 - DNA, 22 bp, Homo sapiens
aggggaaagaacagtcttcagg

SEQ ID NO: 7402138 - DNA, 22 bp, Homo sapiens
aggggaaaatgagttagtgtgt

SEQ ID NO: 7402139 - DNA, 22 bp, Homo sapiens
aggggaaaagtgttgtctctag

SEQ ID NO: 7402140 - DNA, 22 bp, Homo sapiens
agggctttgtttaggtgaccac

SEQ ID NO: 7402141 - DNA, 22 bp, Homo sapiens
agggcttttgagcgcacgtctg

SEQ ID NO: 7402142 - DNA, 22 bp, Homo sapiens
agggcttttgcaatccaagtct

SEQ ID NO: 7402143 - DNA, 22 bp, Homo sapiens
agggctttgcaatgcacagtgg

SEQ ID NO: 7402144 - DNA, 22 bp, Homo sapiens
agggctttgcaatgcacagtgg

SEQ ID NO: 7402145 - DNA, 22 bp, Homo sapiens
agggctttggccccctgctgca

SEQ ID NO: 7402146 - DNA, 22 bp, Homo sapiens
agggctttggccccctgctgca

SEQ ID NO: 7402147 - DNA, 22 bp, Homo sapiens
agggctttgtggcagtcactat

SEQ ID NO: 7402148 - DNA, 19 bp, Homo sapiens
agggctttgtgtgctgctc

SEQ ID NO: 7402149 - DNA, 22 bp, Homo sapiens
agggctggtatgtccatgaaag

SEQ ID NO: 7402150 - DNA, 22 bp, Homo sapiens
agggctgggctgcttgttgtca

SEQ ID NO: 7402151 - DNA, 22 bp, Homo sapiens
agggctttgatgtccatgagga

SEQ ID NO: 7402152 - DNA, 21 bp, Homo sapiens
cctcagtctccctgctccact

SEQ ID NO: 7402153 - DNA, 22 bp, Homo sapiens
agggctgggctgcttgttgtca

SEQ ID NO: 7402154 - DNA, 22 bp, Homo sapiens
agggctgggctgcttgttgtca

SEQ ID NO: 7402155 - DNA, 22 bp, Homo sapiens
agggctgggctgcttgttgtca

SEQ ID NO: 7402156 - DNA, 22 bp, Homo sapiens
agggctgggctgcttgttgtca

SEQ ID NO: 7402157 - DNA, 22 bp, Homo sapiens
agggctgggctgcttgttgtca

SEQ ID NO: 7402158 - DNA, 22 bp, Homo sapiens
cctcagtcattggcctacactt

SEQ ID NO: 7402159 - DNA, 22 bp, Homo sapiens
cctcaggtgtgggccagctgtc

SEQ ID NO: 7402160 - DNA, 22 bp, Homo sapiens
cctcagtcattggcctacactt

SEQ ID NO: 7402161 - DNA, 22 bp, Homo sapiens
cctcagtcattggcctacactt

SEQ ID NO: 7402162 - DNA, 22 bp, Homo sapiens
cctcagtctatttccagcaggt

SEQ ID NO: 7402163 - DNA, 22 bp, Homo sapiens
agggctgggctgcttgttgtca

SEQ ID NO: 7402164 - DNA, 22 bp, Homo sapiens
cctcagtctatttccagcaggt

SEQ ID NO: 7402165 - DNA, 22 bp, Homo sapiens
cctcagtctatttccagcaggt

SEQ ID NO: 7402166 - DNA, 22 bp, Homo sapiens
cctacagttatattcttgattg

SEQ ID NO: 7402167 - DNA, 22 bp, Homo sapiens
cctacagttatattcttgattg

SEQ ID NO: 7402168 - DNA, 22 bp, Homo sapiens
cctacataacactgccaaactg

SEQ ID NO: 7402169 - DNA, 22 bp, Homo sapiens
cctacagttatattcttgattg

SEQ ID NO: 7402170 - DNA, 18 bp, Homo sapiens
cctacatcattgtgagag

SEQ ID NO: 7402171 - DNA, 19 bp, Homo sapiens
cctacatgagtaagcttgg

SEQ ID NO: 7402172 - DNA, 22 bp, Homo sapiens
cctaccacactatggagaagtg

SEQ ID NO: 7402173 - DNA, 22 bp, Homo sapiens
cctaccagtaggaggccagaga

SEQ ID NO: 7402174 - DNA, 22 bp, Homo sapiens
cctaccagtaggaggccagaga

SEQ ID NO: 7402175 - DNA, 22 bp, Homo sapiens
cctactccctttctagagtatg

SEQ ID NO: 7402176 - DNA, 22 bp, Homo sapiens
cctactctgagcgcctccgcat

SEQ ID NO: 7402177 - DNA, 22 bp, Homo sapiens
cctactctgagcgcctccgcat

SEQ ID NO: 7402178 - DNA, 22 bp, Homo sapiens
cctactctgagcgcctccgcat

SEQ ID NO: 7402179 - DNA, 22 bp, Homo sapiens
cctactctgagcgcctccgcat

SEQ ID NO: 7402180 - DNA, 22 bp, Homo sapiens
cctactgcccttcagtccagca

SEQ ID NO: 7402181 - DNA, 22 bp, Homo sapiens
cctacttagcatattttctctt

SEQ ID NO: 7402182 - DNA, 22 bp, Homo sapiens
cctactgcccttcagtccagca

SEQ ID NO: 7402183 - DNA, 22 bp, Homo sapiens
cctactctgagcgcctccgcat

SEQ ID NO: 7402184 - DNA, 22 bp, Homo sapiens
cctactctgagcgcctccgcat

SEQ ID NO: 7402185 - DNA, 22 bp, Homo sapiens
cctagaacacaacctatattag

SEQ ID NO: 7402186 - DNA, 22 bp, Homo sapiens
cctagaatgtacttaatagatg

SEQ ID NO: 7402187 - DNA, 22 bp, Homo sapiens
agggctcttcctttgcctctca

SEQ ID NO: 7402188 - DNA, 22 bp, Homo sapiens
agggctgaaacataatccttct

SEQ ID NO: 7402189 - DNA, 22 bp, Homo sapiens
agggctgacagtggcgtggcgt

SEQ ID NO: 7402190 - DNA, 22 bp, Homo sapiens
agggctgacagtggcgtggcgt

SEQ ID NO: 7402191 - DNA, 22 bp, Homo sapiens
agggctgacagtggcgtggcgt

SEQ ID NO: 7402192 - DNA, 22 bp, Homo sapiens
agggctgacagtggcgtggcgt

SEQ ID NO: 7402193 - DNA, 22 bp, Homo sapiens
agggctgacctaagctccactt

SEQ ID NO: 7402194 - DNA, 22 bp, Homo sapiens
agggctctttaggccgaggcca

SEQ ID NO: 7402195 - DNA, 22 bp, Homo sapiens
agggctctttaggccgaggcca

SEQ ID NO: 7402196 - DNA, 22 bp, Homo sapiens
agggctgacagtggcgtggcgt

SEQ ID NO: 7402197 - DNA, 22 bp, Homo sapiens
agggctgacagtggcgtggcgt

SEQ ID NO: 7402198 - DNA, 22 bp, Homo sapiens
agggctgagcccaggcatgtag

SEQ ID NO: 7402199 - DNA, 22 bp, Homo sapiens
agggctgagcccaggcatgtag

SEQ ID NO: 7402200 - DNA, 22 bp, Homo sapiens
agggctgagcccaggcatgtag

SEQ ID NO: 7402201 - DNA, 22 bp, Homo sapiens
agggctgagcccaggcatgtag

SEQ ID NO: 7402202 - DNA, 22 bp, Homo sapiens
agggctgagactaaggccagat

SEQ ID NO: 7402203 - DNA, 22 bp, Homo sapiens
agggctgagcccaggcatgtag

SEQ ID NO: 7402204 - DNA, 22 bp, Homo sapiens
agggctgagcccaggcatgtag

SEQ ID NO: 7402205 - DNA, 22 bp, Homo sapiens
agggctgaggcgagggagatgc

SEQ ID NO: 7402206 - DNA, 22 bp, Homo sapiens
agggctgaggcgagggagatgc

SEQ ID NO: 7402207 - DNA, 22 bp, Homo sapiens
agggctgaggcgagggagatgc

SEQ ID NO: 7402208 - DNA, 18 bp, Homo sapiens
cctcagggagatccagtg

SEQ ID NO: 7402209 - DNA, 18 bp, Homo sapiens
cctcagggagatccagtg

SEQ ID NO: 7402210 - DNA, 22 bp, Homo sapiens
cctcagggaggcctctgtggct

SEQ ID NO: 7402211 - DNA, 22 bp, Homo sapiens
cctcagggaggcctctgtggct

SEQ ID NO: 7402212 - DNA, 22 bp, Homo sapiens
agggctgagactaaggccagat

SEQ ID NO: 7402213 - DNA, 22 bp, Homo sapiens
agggctgagactaaggccagat

SEQ ID NO: 7402214 - DNA, 22 bp, Homo sapiens
agggctgagactaaggccagat

SEQ ID NO: 7402215 - DNA, 22 bp, Homo sapiens
agggctgagactaaggccagat

SEQ ID NO: 7402216 - DNA, 22 bp, Homo sapiens
agggctgagaatgacagggccg

SEQ ID NO: 7402217 - DNA, 22 bp, Homo sapiens
agggctgagactaaggccagat

SEQ ID NO: 7402218 - DNA, 22 bp, Homo sapiens
agggctgagactaaggccagat

SEQ ID NO: 7402219 - DNA, 22 bp, Homo sapiens
agggctgagaatgacagggccg

SEQ ID NO: 7402220 - DNA, 22 bp, Homo sapiens
agggctgagaatgacagggccg

SEQ ID NO: 7402221 - DNA, 22 bp, Homo sapiens
agggctgagactaaggccagat

SEQ ID NO: 7402222 - DNA, 22 bp, Homo sapiens
agggctgagaatgacagggccg

SEQ ID NO: 7402223 - DNA, 20 bp, Homo sapiens
agggctgagaagggactagc

SEQ ID NO: 7402224 - DNA, 20 bp, Homo sapiens
agggctgagaagggactagc

SEQ ID NO: 7402225 - DNA, 22 bp, Homo sapiens
agggctgagaatgacagggccg

SEQ ID NO: 7402226 - DNA, 20 bp, Homo sapiens
agggctgagaagggactagc

SEQ ID NO: 7402227 - DNA, 20 bp, Homo sapiens
agggctgagaagggactagc

SEQ ID NO: 7402228 - DNA, 20 bp, Homo sapiens
agggctgagaagggactagc

SEQ ID NO: 7402229 - DNA, 20 bp, Homo sapiens
agggctgagaagggactagc

SEQ ID NO: 7402230 - DNA, 22 bp, Homo sapiens
agggctgacctaagctccactt

SEQ ID NO: 7402231 - DNA, 22 bp, Homo sapiens
agggctgacctaagctccactt

SEQ ID NO: 7402232 - DNA, 20 bp, Homo sapiens
agggctgagaagggactagc

SEQ ID NO: 7402233 - DNA, 22 bp, Homo sapiens
agggcctgtgctgagtagacga

SEQ ID NO: 7402234 - DNA, 22 bp, Homo sapiens
agggcctgtgctgagtagacga

SEQ ID NO: 7402235 - DNA, 22 bp, Homo sapiens
agggcctgtgctgagtagacga

SEQ ID NO: 7402236 - DNA, 22 bp, Homo sapiens
agggcctgtgctgagtagacga

SEQ ID NO: 7402237 - DNA, 22 bp, Homo sapiens
agggcctgtgctgagtagacga

SEQ ID NO: 7402238 - DNA, 21 bp, Homo sapiens
agggcctgtgctctccaggtc

SEQ ID NO: 7402239 - DNA, 22 bp, Homo sapiens
agggcctgtgctgagtagacga

SEQ ID NO: 7402240 - DNA, 22 bp, Homo sapiens
agggcctgtgcttcctgagata

SEQ ID NO: 7402241 - DNA, 22 bp, Homo sapiens
agggcctgtgcttcctgagata

SEQ ID NO: 7402242 - DNA, 22 bp, Homo sapiens
agggcctgtgcttcctgagata

SEQ ID NO: 7402243 - DNA, 22 bp, Homo sapiens
agggcctgtgcttcctgagata

SEQ ID NO: 7402244 - DNA, 20 bp, Homo sapiens
agggcctgttgcaagcgttt

SEQ ID NO: 7402245 - DNA, 22 bp, Homo sapiens
agggcctgtgcttcctgagata

SEQ ID NO: 7402246 - DNA, 20 bp, Homo sapiens
agggcctgttgcaagcgttt

SEQ ID NO: 7402247 - DNA, 20 bp, Homo sapiens
agggcctgttgcaagcgttt

SEQ ID NO: 7402248 - DNA, 20 bp, Homo sapiens
agggcctgttgcaagcgttt

SEQ ID NO: 7402249 - DNA, 22 bp, Homo sapiens
cctaagtaagttgactttcaga

SEQ ID NO: 7402250 - DNA, 22 bp, Homo sapiens
cctaatttgattttaaatagcc

SEQ ID NO: 7402251 - DNA, 22 bp, Homo sapiens
cctaatttgattttaaatagcc

SEQ ID NO: 7402252 - DNA, 22 bp, Homo sapiens
cctacacatctcacctcacagg

SEQ ID NO: 7402253 - DNA, 22 bp, Homo sapiens
cctaattatctcccaaagatcc

SEQ ID NO: 7402254 - DNA, 22 bp, Homo sapiens
cctaagtattttcagtgttaac

SEQ ID NO: 7402255 - DNA, 22 bp, Homo sapiens
cctaagtattttcagtgttaac

SEQ ID NO: 7402256 - DNA, 22 bp, Homo sapiens
cctacaggaaattgtatcaaaa

SEQ ID NO: 7402257 - DNA, 21 bp, Homo sapiens
cctacagatggatatatattc

SEQ ID NO: 7402258 - DNA, 22 bp, Homo sapiens
cctacaggaaattgtatcaaaa

SEQ ID NO: 7402259 - DNA, 22 bp, Homo sapiens
cctacagacaaaccagtgacta

SEQ ID NO: 7402260 - DNA, 22 bp, Homo sapiens
cctacagacaaaccagtgacta

SEQ ID NO: 7402261 - DNA, 22 bp, Homo sapiens
cctacagagcagcaggaccaga

SEQ ID NO: 7402262 - DNA, 22 bp, Homo sapiens
cctacagttatattcttgattg

SEQ ID NO: 7402263 - DNA, 22 bp, Homo sapiens
cctacagttatattcttgattg

SEQ ID NO: 7402264 - DNA, 22 bp, Homo sapiens
cctacaggaaattgtatcaaaa

SEQ ID NO: 7402265 - DNA, 22 bp, Homo sapiens
cctacaggaaattgtatcaaaa

SEQ ID NO: 7402266 - DNA, 22 bp, Homo sapiens
cctacagttatattcttgattg

SEQ ID NO: 7402267 - DNA, 22 bp, Homo sapiens
cctacagttatattcttgattg

SEQ ID NO: 7402268 - DNA, 22 bp, Homo sapiens
cctacagttatattcttgattg

SEQ ID NO: 7402269 - DNA, 22 bp, Homo sapiens
agggcctgtgctgagtagacga

SEQ ID NO: 7402270 - DNA, 21 bp, Homo sapiens
agggcctgtgctctccaggtc

SEQ ID NO: 7402271 - DNA, 21 bp, Homo sapiens
agggcctgtgctctccaggtc

SEQ ID NO: 7402272 - DNA, 21 bp, Homo sapiens
agggcctgtgctctccaggtc

SEQ ID NO: 7402273 - DNA, 21 bp, Homo sapiens
agggcctgtgctctccaggtc

SEQ ID NO: 7402274 - DNA, 21 bp, Homo sapiens
agggcctgtgctctccaggtc

SEQ ID NO: 7402275 - DNA, 21 bp, Homo sapiens
agggcctgtgctctccaggtc

SEQ ID NO: 7402276 - DNA, 22 bp, Homo sapiens
agggcctgtgaattctccctgc

SEQ ID NO: 7402277 - DNA, 22 bp, Homo sapiens
agggcctgtgaattctccctgc

SEQ ID NO: 7402278 - DNA, 22 bp, Homo sapiens
agggcctgtgaattctccctgc

SEQ ID NO: 7402279 - DNA, 22 bp, Homo sapiens
agggcctgtgaattctccctgc

SEQ ID NO: 7402280 - DNA, 22 bp, Homo sapiens
agggcctgtgaattctccctgc

SEQ ID NO: 7402281 - DNA, 22 bp, Homo sapiens
agggcctgtctgtagaactgaa

SEQ ID NO: 7402282 - DNA, 21 bp, Homo sapiens
agggcctgtgctctccaggtc

SEQ ID NO: 7402283 - DNA, 22 bp, Homo sapiens
agggcctgtgaattctccctgc

SEQ ID NO: 7402284 - DNA, 22 bp, Homo sapiens
agggcctgtctgtagaactgaa

SEQ ID NO: 7402285 - DNA, 22 bp, Homo sapiens
agggcctgtccgctcccgcccg

SEQ ID NO: 7402286 - DNA, 22 bp, Homo sapiens
agggcctgtccgctcccgcccg

SEQ ID NO: 7402287 - DNA, 22 bp, Homo sapiens
agggcctgtctgtagaactgaa

SEQ ID NO: 7402288 - DNA, 22 bp, Homo sapiens
agggcctgtctgtagaactgaa

SEQ ID NO: 7402289 - DNA, 22 bp, Homo sapiens
agggcctgtctgtagaactgaa

SEQ ID NO: 7402290 - DNA, 22 bp, Homo sapiens
agggcctgggaagaggaaccct

SEQ ID NO: 7402291 - DNA, 22 bp, Homo sapiens
agggcctggcttcactttctca

SEQ ID NO: 7402292 - DNA, 22 bp, Homo sapiens
agggcctgtcagcggtgtcctg

SEQ ID NO: 7402293 - DNA, 22 bp, Homo sapiens
agggcctgtcagcggtgtcctg

SEQ ID NO: 7402294 - DNA, 22 bp, Homo sapiens
agggcctggcttcactttctca

SEQ ID NO: 7402295 - DNA, 22 bp, Homo sapiens
ccctggccagggcacagggagg

SEQ ID NO: 7402296 - DNA, 22 bp, Homo sapiens
ccctggccagggcacagggagg

SEQ ID NO: 7402297 - DNA, 22 bp, Homo sapiens
ccctggccagctcatgtctgag

SEQ ID NO: 7402298 - DNA, 22 bp, Homo sapiens
ccctggccagggcacagggagg

SEQ ID NO: 7402299 - DNA, 22 bp, Homo sapiens
ccctggccagggcacagggagg

SEQ ID NO: 7402300 - DNA, 22 bp, Homo sapiens
ccctggccagggcacagggagg

SEQ ID NO: 7402301 - DNA, 22 bp, Homo sapiens
ccctggccagctcatgtctgag

SEQ ID NO: 7402302 - DNA, 22 bp, Homo sapiens
ccctggcatgcatgtccctggc

SEQ ID NO: 7402303 - DNA, 22 bp, Homo sapiens
ccctggcatgcatgtccctggc

SEQ ID NO: 7402304 - DNA, 22 bp, Homo sapiens
ccctggcatgcatgtccctggc

SEQ ID NO: 7402305 - DNA, 22 bp, Homo sapiens
ccctggccagctcatgtctgag

SEQ ID NO: 7402306 - DNA, 22 bp, Homo sapiens
ccctggccagctcatgtctgag

SEQ ID NO: 7402307 - DNA, 22 bp, Homo sapiens
ccctggccagctcatgtctgag

SEQ ID NO: 7402308 - DNA, 22 bp, Homo sapiens
ccctggcatgcatgtccctggc

SEQ ID NO: 7402309 - DNA, 22 bp, Homo sapiens
ccctggcataaaacttctccag

SEQ ID NO: 7402310 - DNA, 22 bp, Homo sapiens
ccctggcataaaacttctccag

SEQ ID NO: 7402311 - DNA, 22 bp, Homo sapiens
ccctggcagtgctcctttagac

SEQ ID NO: 7402312 - DNA, 22 bp, Homo sapiens
ccctggcataaaacttctccag

SEQ ID NO: 7402313 - DNA, 19 bp, Homo sapiens
ccctggcaggcaagcctgg

SEQ ID NO: 7402314 - DNA, 22 bp, Homo sapiens
ccctggcagcaatcactggtgt

SEQ ID NO: 7402315 - DNA, 19 bp, Homo sapiens
ccctggcaggcaagcctgg

SEQ ID NO: 7402316 - DNA, 22 bp, Homo sapiens
ccctggcagcaatcactggtgt

SEQ ID NO: 7402317 - DNA, 22 bp, Homo sapiens
ccctggcagagggggcaggtgc

SEQ ID NO: 7402318 - DNA, 22 bp, Homo sapiens
ccctggcagagggggcaggtgc

SEQ ID NO: 7402319 - DNA, 22 bp, Homo sapiens
ccctggcagagggggcaggtgc

SEQ ID NO: 7402320 - DNA, 22 bp, Homo sapiens
ccctggcagaatgtctctgggc

SEQ ID NO: 7402321 - DNA, 22 bp, Homo sapiens
ccctggcagagggggcaggtgc

SEQ ID NO: 7402322 - DNA, 22 bp, Homo sapiens
ccctggcagagggggcaggtgc

SEQ ID NO: 7402323 - DNA, 22 bp, Homo sapiens
ccctggcagagggggcaggtgc

SEQ ID NO: 7402324 - DNA, 22 bp, Homo sapiens
ccctggcagaatgtctctgggc

SEQ ID NO: 7402325 - DNA, 22 bp, Homo sapiens
agggccccagtaagattacatg

SEQ ID NO: 7402326 - DNA, 22 bp, Homo sapiens
agggccccagtaagattacatg

SEQ ID NO: 7402327 - DNA, 22 bp, Homo sapiens
agggccccagtaagattacatg

SEQ ID NO: 7402328 - DNA, 22 bp, Homo sapiens
agggccccatagtcactgcccg

SEQ ID NO: 7402329 - DNA, 22 bp, Homo sapiens
agggccccatagtcactgcccg

SEQ ID NO: 7402330 - DNA, 22 bp, Homo sapiens
agggccccatagtcactgcccg

SEQ ID NO: 7402331 - DNA, 17 bp, Homo sapiens
ccctggcaaagaatggc

SEQ ID NO: 7402332 - DNA, 22 bp, Homo sapiens
agggcccatgtgggagcacttg

SEQ ID NO: 7402333 - DNA, 22 bp, Homo sapiens
agggcccatgtgggagcacttg

SEQ ID NO: 7402334 - DNA, 22 bp, Homo sapiens
agggcccatgtgggagcacttg

SEQ ID NO: 7402335 - DNA, 22 bp, Homo sapiens
agggcccatgtgggagcacttg

SEQ ID NO: 7402336 - DNA, 22 bp, Homo sapiens
agggcccatgtgggagcacttg

SEQ ID NO: 7402337 - DNA, 22 bp, Homo sapiens
ccctggcactagcgacggccat

SEQ ID NO: 7402338 - DNA, 22 bp, Homo sapiens
ccctggcagaatgtctctgggc

SEQ ID NO: 7402339 - DNA, 22 bp, Homo sapiens
ccctggcactagcgacggccat

SEQ ID NO: 7402340 - DNA, 22 bp, Homo sapiens
ccctggcactagcgacggccat

SEQ ID NO: 7402341 - DNA, 22 bp, Homo sapiens
ccctggcactagcgacggccat

SEQ ID NO: 7402342 - DNA, 22 bp, Homo sapiens
ccctggcactagcgacggccat

SEQ ID NO: 7402343 - DNA, 22 bp, Homo sapiens
ccctggcactagcgacggccat

SEQ ID NO: 7402344 - DNA, 22 bp, Homo sapiens
ccctggcacatgcgctgtgtgg

SEQ ID NO: 7402345 - DNA, 22 bp, Homo sapiens
ccctggcacatgcgctgtgtgg

SEQ ID NO: 7402346 - DNA, 22 bp, Homo sapiens
ccctggcacatgcgctgtgtgg

SEQ ID NO: 7402347 - DNA, 22 bp, Homo sapiens
agggcccatgtcgggcgctctg

SEQ ID NO: 7402348 - DNA, 22 bp, Homo sapiens
agggcccatgtcgggcgctctg

SEQ ID NO: 7402349 - DNA, 22 bp, Homo sapiens
agggcccatgtcgggcgctctg

SEQ ID NO: 7402350 - DNA, 22 bp, Homo sapiens
agggcccatgtgggagcacttg

SEQ ID NO: 7402351 - DNA, 22 bp, Homo sapiens
agggcccatgtgggagcacttg

SEQ ID NO: 7402352 - DNA, 22 bp, Homo sapiens
agggcccatgtgggagcacttg

SEQ ID NO: 7402353 - DNA, 22 bp, Homo sapiens
agggcccatgtgggagcacttg

SEQ ID NO: 7402354 - DNA, 22 bp, Homo sapiens
agggcccatagatcgtcagctt

SEQ ID NO: 7402355 - DNA, 22 bp, Homo sapiens
agggcccatagatcgtcagctt

SEQ ID NO: 7402356 - DNA, 22 bp, Homo sapiens
agggcccatagatcgtcagctt

SEQ ID NO: 7402357 - DNA, 22 bp, Homo sapiens
agggcccatagatcgtcagctt

SEQ ID NO: 7402358 - DNA, 22 bp, Homo sapiens
agggcccatagatcgtcagctt

SEQ ID NO: 7402359 - DNA, 22 bp, Homo sapiens
agggcccatagatcgtcagctt

SEQ ID NO: 7402360 - DNA, 22 bp, Homo sapiens
agggcccatagatcgtcagctt

SEQ ID NO: 7402361 - DNA, 22 bp, Homo sapiens
agggcccagtggagagctgagc

SEQ ID NO: 7402362 - DNA, 22 bp, Homo sapiens
agggcccagtggagagctgagc

SEQ ID NO: 7402363 - DNA, 22 bp, Homo sapiens
agggcccagtggagagctgagc

SEQ ID NO: 7402364 - DNA, 22 bp, Homo sapiens
agggcccaggacagcatcaggg

SEQ ID NO: 7402365 - DNA, 22 bp, Homo sapiens
agggcccaggacagcatcaggg

SEQ ID NO: 7402366 - DNA, 22 bp, Homo sapiens
agggcccagtggagagctgagc

SEQ ID NO: 7402367 - DNA, 22 bp, Homo sapiens
agggcccagtggagagctgagc

SEQ ID NO: 7402368 - DNA, 22 bp, Homo sapiens
agggcccagtggagagctgagc

SEQ ID NO: 7402369 - DNA, 22 bp, Homo sapiens
agggagctgtggtcagctcagt

SEQ ID NO: 7402370 - DNA, 22 bp, Homo sapiens
agggagctgtggtcagctcagt

SEQ ID NO: 7402371 - DNA, 22 bp, Homo sapiens
agggagctgtggtcagctcagt

SEQ ID NO: 7402372 - DNA, 22 bp, Homo sapiens
agggagctgtggtcagctcagt

SEQ ID NO: 7402373 - DNA, 22 bp, Homo sapiens
agggagctgtggtcagctcagt

SEQ ID NO: 7402374 - DNA, 22 bp, Homo sapiens
agggagctgtggtcagctcagt

SEQ ID NO: 7402375 - DNA, 22 bp, Homo sapiens
agggagcttccgaactacagct

SEQ ID NO: 7402376 - DNA, 22 bp, Homo sapiens
agggagcttctacttcaaggca

SEQ ID NO: 7402377 - DNA, 22 bp, Homo sapiens
agggagcttctacttcaaggca

SEQ ID NO: 7402378 - DNA, 22 bp, Homo sapiens
agggagcttccgaactacagct

SEQ ID NO: 7402379 - DNA, 22 bp, Homo sapiens
agggagcttctacttcaaggca

SEQ ID NO: 7402380 - DNA, 22 bp, Homo sapiens
agggagcttctggcctcagcct

SEQ ID NO: 7402381 - DNA, 22 bp, Homo sapiens
agggagcttctggcctcagcct

SEQ ID NO: 7402382 - DNA, 22 bp, Homo sapiens
agggagcttctggcctcagcct

SEQ ID NO: 7402383 - DNA, 22 bp, Homo sapiens
agggagcttctggcctcagcct

SEQ ID NO: 7402384 - DNA, 22 bp, Homo sapiens
agggagctggtatttataatga

SEQ ID NO: 7402385 - DNA, 22 bp, Homo sapiens
agggagctgggccacactgatc

SEQ ID NO: 7402386 - DNA, 21 bp, Homo sapiens
agggagctggccacacagcct

SEQ ID NO: 7402387 - DNA, 21 bp, Homo sapiens
agggagctggccacacagcct

SEQ ID NO: 7402388 - DNA, 21 bp, Homo sapiens
agggagctggccacacagcct

SEQ ID NO: 7402389 - DNA, 21 bp, Homo sapiens
agggagctggccacacagcct

SEQ ID NO: 7402390 - DNA, 21 bp, Homo sapiens
agggagctggccacacagcct

SEQ ID NO: 7402391 - DNA, 22 bp, Homo sapiens
agggagctgctctgcttccgtg

SEQ ID NO: 7402392 - DNA, 22 bp, Homo sapiens
agggagctgctctgcttccgtg

SEQ ID NO: 7402393 - DNA, 22 bp, Homo sapiens
agggagctgctctgcttccgtg

SEQ ID NO: 7402394 - DNA, 21 bp, Homo sapiens
agggagctggccacacagcct

SEQ ID NO: 7402395 - DNA, 21 bp, Homo sapiens
agggagctgcgtcttgaaaga

SEQ ID NO: 7402396 - DNA, 22 bp, Homo sapiens
agggagctgagagctactattt

SEQ ID NO: 7402397 - DNA, 22 bp, Homo sapiens
agggagctgagctgtgagcagc

SEQ ID NO: 7402398 - DNA, 22 bp, Homo sapiens
agggagctgagctgtgagcagc

SEQ ID NO: 7402399 - DNA, 22 bp, Homo sapiens
cccaggcctggtctgggccagt

SEQ ID NO: 7402400 - DNA, 22 bp, Homo sapiens
cccaggcctggtctgggccagt

SEQ ID NO: 7402401 - DNA, 22 bp, Homo sapiens
cccaggcctggtctgggccagt

SEQ ID NO: 7402402 - DNA, 22 bp, Homo sapiens
cccaggcctggtctgggccagt

SEQ ID NO: 7402403 - DNA, 17 bp, Homo sapiens
cccaggccgccgggagc

SEQ ID NO: 7402404 - DNA, 17 bp, Homo sapiens
cccaggccgccgggagc

SEQ ID NO: 7402405 - DNA, 17 bp, Homo sapiens
cccaggccgccgggagc

SEQ ID NO: 7402406 - DNA, 17 bp, Homo sapiens
cccaggccgccgggagc

SEQ ID NO: 7402407 - DNA, 17 bp, Homo sapiens
cccaggccgccgggagc

SEQ ID NO: 7402408 - DNA, 17 bp, Homo sapiens
cccaggccgccgggagc

SEQ ID NO: 7402409 - DNA, 17 bp, Homo sapiens
cccaggccgccgggagc

SEQ ID NO: 7402410 - DNA, 17 bp, Homo sapiens
cccaggccgccgggagc

SEQ ID NO: 7402411 - DNA, 22 bp, Homo sapiens
cccaggccctggcagagcttgt

SEQ ID NO: 7402412 - DNA, 22 bp, Homo sapiens
cccaggccctggcagagcttgt

SEQ ID NO: 7402413 - DNA, 22 bp, Homo sapiens
cccaggccctggcagagcttgt

SEQ ID NO: 7402414 - DNA, 22 bp, Homo sapiens
cccaggccccagggcttgtcag

SEQ ID NO: 7402415 - DNA, 22 bp, Homo sapiens
cccaggccctggcagagcttgt

SEQ ID NO: 7402416 - DNA, 22 bp, Homo sapiens
cccaggccctggcagagcttgt

SEQ ID NO: 7402417 - DNA, 22 bp, Homo sapiens
cccaggccctggcagagcttgt

SEQ ID NO: 7402418 - DNA, 22 bp, Homo sapiens
cccaggcctggtctgggccagt

SEQ ID NO: 7402419 - DNA, 22 bp, Homo sapiens
cccaggcctggtctgggccagt

SEQ ID NO: 7402420 - DNA, 22 bp, Homo sapiens
agggagccctgaaccagagggt

SEQ ID NO: 7402421 - DNA, 22 bp, Homo sapiens
agggagccctgaaccagagggt

SEQ ID NO: 7402422 - DNA, 22 bp, Homo sapiens
cccaggcctggtctgggccagt

SEQ ID NO: 7402423 - DNA, 22 bp, Homo sapiens
cccaggcctggtctgggccagt

SEQ ID NO: 7402424 - DNA, 22 bp, Homo sapiens
agggagctgagagctactattt

SEQ ID NO: 7402425 - DNA, 22 bp, Homo sapiens
agggagctgactggctgccatt

SEQ ID NO: 7402426 - DNA, 22 bp, Homo sapiens
agggagctgagctgtgagcagc

SEQ ID NO: 7402427 - DNA, 22 bp, Homo sapiens
agggagctgagctgtgagcagc

SEQ ID NO: 7402428 - DNA, 22 bp, Homo sapiens
agggagccttcctggctgtggt

SEQ ID NO: 7402429 - DNA, 22 bp, Homo sapiens
agggagccctgaaccagagggt

SEQ ID NO: 7402430 - DNA, 22 bp, Homo sapiens
agggagccttcctggctgtggt

SEQ ID NO: 7402431 - DNA, 22 bp, Homo sapiens
agggactatttacccatctcac

SEQ ID NO: 7402432 - DNA, 22 bp, Homo sapiens
agggactatttacccatctcac

SEQ ID NO: 7402433 - DNA, 22 bp, Homo sapiens
agggactatttacccatctcac

SEQ ID NO: 7402434 - DNA, 22 bp, Homo sapiens
agggacgccgtgcgggaccgtg

SEQ ID NO: 7402435 - DNA, 22 bp, Homo sapiens
agggactatttacccatctcac

SEQ ID NO: 7402436 - DNA, 22 bp, Homo sapiens
agggactatttacccatctcac

SEQ ID NO: 7402437 - DNA, 22 bp, Homo sapiens
agggacctcttcttgcagctga

SEQ ID NO: 7402438 - DNA, 22 bp, Homo sapiens
agggacctgctcactgcctggc

SEQ ID NO: 7402439 - DNA, 22 bp, Homo sapiens
agggacctgctcactgcctggc

SEQ ID NO: 7402440 - DNA, 22 bp, Homo sapiens
agggacctgtcaatgacagtta

SEQ ID NO: 7402441 - DNA, 22 bp, Homo sapiens
agggaccttgatgggtttggga

SEQ ID NO: 7402442 - DNA, 22 bp, Homo sapiens
agggaccaggggtagctgagat

SEQ ID NO: 7402443 - DNA, 22 bp, Homo sapiens
agggaccaggggtagctgagat

SEQ ID NO: 7402444 - DNA, 22 bp, Homo sapiens
agggaccaggggtagctgagat

SEQ ID NO: 7402445 - DNA, 22 bp, Homo sapiens
agggacccatagagagaccagt

SEQ ID NO: 7402446 - DNA, 22 bp, Homo sapiens
agggacccatagagagaccagt

SEQ ID NO: 7402447 - DNA, 22 bp, Homo sapiens
agggacccatagagagaccagt

SEQ ID NO: 7402448 - DNA, 22 bp, Homo sapiens
agggacccatagagagaccagt

SEQ ID NO: 7402449 - DNA, 22 bp, Homo sapiens
agggaccctgatgactgaggag

SEQ ID NO: 7402450 - DNA, 22 bp, Homo sapiens
agggaccctgatgactgaggag

SEQ ID NO: 7402451 - DNA, 22 bp, Homo sapiens
cccaggccagaacttggttgct

SEQ ID NO: 7402452 - DNA, 22 bp, Homo sapiens
cccaggccagaacttggttgct

SEQ ID NO: 7402453 - DNA, 22 bp, Homo sapiens
cccaggcattttcaactttagt

SEQ ID NO: 7402454 - DNA, 22 bp, Homo sapiens
agggactccgtgcacagtggtt

SEQ ID NO: 7402455 - DNA, 22 bp, Homo sapiens
cccaggccccagggcttgtcag

SEQ ID NO: 7402456 - DNA, 22 bp, Homo sapiens
cccaggccccagggcttgtcag

SEQ ID NO: 7402457 - DNA, 22 bp, Homo sapiens
cccaggccccagggcttgtcag

SEQ ID NO: 7402458 - DNA, 22 bp, Homo sapiens
cccaggccccagggcttgtcag

SEQ ID NO: 7402459 - DNA, 22 bp, Homo sapiens
cccaggccagaacttggttgct

SEQ ID NO: 7402460 - DNA, 22 bp, Homo sapiens
agggaccagcgtgagtctgagg

SEQ ID NO: 7402461 - DNA, 22 bp, Homo sapiens
agggaccagcgtgagtctgagg

SEQ ID NO: 7402462 - DNA, 22 bp, Homo sapiens
agggaccaggggtagctgagat

SEQ ID NO: 7402463 - DNA, 22 bp, Homo sapiens
agggaccagcgtgagtctgagg

SEQ ID NO: 7402464 - DNA, 22 bp, Homo sapiens
agggaccacatcccctctgtgg

SEQ ID NO: 7402465 - DNA, 22 bp, Homo sapiens
agggaccagcctgcccagggct

SEQ ID NO: 7402466 - DNA, 22 bp, Homo sapiens
agggaccacatcccctctgtgg

SEQ ID NO: 7402467 - DNA, 22 bp, Homo sapiens
agggaccaatcaccgacaggct

SEQ ID NO: 7402468 - DNA, 22 bp, Homo sapiens
agggaccacatcccctctgtgg

SEQ ID NO: 7402469 - DNA, 22 bp, Homo sapiens
agggaccaatcaccgacaggct

SEQ ID NO: 7402470 - DNA, 22 bp, Homo sapiens
agggaccaatcaccgacaggct

SEQ ID NO: 7402471 - DNA, 22 bp, Homo sapiens
agggaccaatcaccgacaggct

SEQ ID NO: 7402472 - DNA, 22 bp, Homo sapiens
agggacagttacatcatcagac

SEQ ID NO: 7402473 - DNA, 22 bp, Homo sapiens
agggacagttacatcatcagac

SEQ ID NO: 7402474 - DNA, 22 bp, Homo sapiens
agggacatctcacaaacaactt

SEQ ID NO: 7402475 - DNA, 22 bp, Homo sapiens
agggacagttacatcatcagac

SEQ ID NO: 7402476 - DNA, 22 bp, Homo sapiens
agggacagttacatcatcagac

SEQ ID NO: 7402477 - DNA, 22 bp, Homo sapiens
agggacagttacatcatcagac

SEQ ID NO: 7402478 - DNA, 22 bp, Homo sapiens
agggacagttacatcatcagac

SEQ ID NO: 7402479 - DNA, 22 bp, Homo sapiens
agggacagttacatcatcagac

SEQ ID NO: 7402480 - DNA, 22 bp, Homo sapiens
cccaggaatgagcaggcagggg

SEQ ID NO: 7402481 - DNA, 22 bp, Homo sapiens
cccaggaatgagcaggcagggg

SEQ ID NO: 7402482 - DNA, 22 bp, Homo sapiens
agggacagtctactgttcactg

SEQ ID NO: 7402483 - DNA, 22 bp, Homo sapiens
agggacagtctactgttcactg

SEQ ID NO: 7402484 - DNA, 22 bp, Homo sapiens
agggaatggatgatggcaggtt

SEQ ID NO: 7402485 - DNA, 22 bp, Homo sapiens
agggaatggatgatggcaggtt

SEQ ID NO: 7402486 - DNA, 22 bp, Homo sapiens
agggacagtctactgttcactg

SEQ ID NO: 7402487 - DNA, 22 bp, Homo sapiens
agggacagtctactgttcactg

SEQ ID NO: 7402488 - DNA, 22 bp, Homo sapiens
agggacagtctactgttcactg

SEQ ID NO: 7402489 - DNA, 22 bp, Homo sapiens
agggacagtctactgttcactg

SEQ ID NO: 7402490 - DNA, 22 bp, Homo sapiens
agggacagtctactgttcactg

SEQ ID NO: 7402491 - DNA, 22 bp, Homo sapiens
agggacagtctactgttcactg

SEQ ID NO: 7402492 - DNA, 22 bp, Homo sapiens
agggacagttacatcatcagac

SEQ ID NO: 7402493 - DNA, 22 bp, Homo sapiens
agggacagttacatcatcagac

SEQ ID NO: 7402494 - DNA, 22 bp, Homo sapiens
agggacagtctactgttcactg

SEQ ID NO: 7402495 - DNA, 22 bp, Homo sapiens
agggacagttacatcatcagac

SEQ ID NO: 7402496 - DNA, 22 bp, Homo sapiens
agggacagttacatcatcagac

SEQ ID NO: 7402497 - DNA, 22 bp, Homo sapiens
agggacagttacatcatcagac

SEQ ID NO: 7402498 - DNA, 22 bp, Homo sapiens
agggacagtctactgttcactg

SEQ ID NO: 7402499 - DNA, 22 bp, Homo sapiens
cccaggaagttgagactgcagt

SEQ ID NO: 7402500 - DNA, 22 bp, Homo sapiens
cccaggaagttgagactgcagt

SEQ ID NO: 7402501 - DNA, 22 bp, Homo sapiens
cccaggaagttgagactgcagt

SEQ ID NO: 7402502 - DNA, 22 bp, Homo sapiens
cccaggaaggtggtctgtggct

SEQ ID NO: 7402503 - DNA, 22 bp, Homo sapiens
cccaggaagtggaggttgcagt

SEQ ID NO: 7402504 - DNA, 22 bp, Homo sapiens
cccaggaagtggaggttgcagt

SEQ ID NO: 7402505 - DNA, 22 bp, Homo sapiens
cccaggaagggatgccaaggaa

SEQ ID NO: 7402506 - DNA, 22 bp, Homo sapiens
cccaggaagggatgccaaggaa

SEQ ID NO: 7402507 - DNA, 22 bp, Homo sapiens
cccaggaagttgagactgcagt

SEQ ID NO: 7402508 - DNA, 22 bp, Homo sapiens
cccaggaagttgagactgcagt

SEQ ID NO: 7402509 - DNA, 22 bp, Homo sapiens
cccaggaagttgagactgcagt

SEQ ID NO: 7402510 - DNA, 22 bp, Homo sapiens
cccaggaagttgatgcagagga

SEQ ID NO: 7402511 - DNA, 22 bp, Homo sapiens
cccaggaagttgatgcagagga

SEQ ID NO: 7402512 - DNA, 22 bp, Homo sapiens
cccaggaagttgatgcagagga

SEQ ID NO: 7402513 - DNA, 22 bp, Homo sapiens
cccaggaatgagcaggcagggg

SEQ ID NO: 7402514 - DNA, 22 bp, Homo sapiens
cccaggaatgagcaggcagggg

SEQ ID NO: 7402515 - DNA, 22 bp, Homo sapiens
cccaggaagttgatgcagagga

SEQ ID NO: 7402516 - DNA, 22 bp, Homo sapiens
cccaggaagttgatgcagagga

SEQ ID NO: 7402517 - DNA, 22 bp, Homo sapiens
cccaggaagttgatgcagagga

SEQ ID NO: 7402518 - DNA, 22 bp, Homo sapiens
cccaggaagttgatgcagagga

SEQ ID NO: 7402519 - DNA, 22 bp, Homo sapiens
cccaggaagggatgccaaggaa

SEQ ID NO: 7402520 - DNA, 22 bp, Homo sapiens
cccaggaagggatgccaaggaa

SEQ ID NO: 7402521 - DNA, 22 bp, Homo sapiens
cccaggaagggatgccaaggaa

SEQ ID NO: 7402522 - DNA, 22 bp, Homo sapiens
cccaggaaggagctgtgtattt

SEQ ID NO: 7402523 - DNA, 22 bp, Homo sapiens
cccaggaaggagctgtgtattt

SEQ ID NO: 7402524 - DNA, 19 bp, Homo sapiens
cccaggaagcggaggttgc

SEQ ID NO: 7402525 - DNA, 19 bp, Homo sapiens
cccaggaagcggaggttgc

SEQ ID NO: 7402526 - DNA, 22 bp, Homo sapiens
cccaggaagcggagattgcaga

SEQ ID NO: 7402527 - DNA, 22 bp, Homo sapiens
cccaggaagcggagattgcaga

SEQ ID NO: 7402528 - DNA, 22 bp, Homo sapiens
cccaggaagcggagattgcaga

SEQ ID NO: 7402529 - DNA, 22 bp, Homo sapiens
cccaggaagcggagattgcaga

SEQ ID NO: 7402530 - DNA, 23 bp, Homo sapiens
cccaggaagccaaagaaatatag

SEQ ID NO: 7402531 - DNA, 23 bp, Homo sapiens
cccaggaagccaaagaaatatag

SEQ ID NO: 7402532 - DNA, 22 bp, Homo sapiens
cccaggaagcccagaattctgg

SEQ ID NO: 7402533 - DNA, 22 bp, Homo sapiens
cccaggaagcccagaattctgg

SEQ ID NO: 7402534 - DNA, 22 bp, Homo sapiens
cccaggaagcccagaattctgg

SEQ ID NO: 7402535 - DNA, 22 bp, Homo sapiens
cccaggaagagtgagtggcatt

SEQ ID NO: 7402536 - DNA, 22 bp, Homo sapiens
cccaggaagagtgagtggcatt

SEQ ID NO: 7402537 - DNA, 22 bp, Homo sapiens
cccaggaagagtgagtggcatt

SEQ ID NO: 7402538 - DNA, 22 bp, Homo sapiens
cccaggaagagtgagtggcatt

SEQ ID NO: 7402539 - DNA, 22 bp, Homo sapiens
cccaggaagaggggtcaggtgt

SEQ ID NO: 7402540 - DNA, 22 bp, Homo sapiens
cccaggaagaggggtcaggtgt

SEQ ID NO: 7402541 - DNA, 22 bp, Homo sapiens
cccaggaagaaattctgatttg

SEQ ID NO: 7402542 - DNA, 22 bp, Homo sapiens
cccaggaagagtgagtggcatt

SEQ ID NO: 7402543 - DNA, 22 bp, Homo sapiens
cccaggaacagcacagaacagc

SEQ ID NO: 7402544 - DNA, 22 bp, Homo sapiens
cccaggaacagcacagaacagc

SEQ ID NO: 7402545 - DNA, 22 bp, Homo sapiens
cccaggaacagcacagaacagc

SEQ ID NO: 7402546 - DNA, 22 bp, Homo sapiens
cccaggaacagcacagaacagc

SEQ ID NO: 7402547 - DNA, 22 bp, Homo sapiens
cccaggaacagcacagaacagc

SEQ ID NO: 7402548 - DNA, 22 bp, Homo sapiens
cccaggaacagcacagaacagc

SEQ ID NO: 7402549 - DNA, 22 bp, Homo sapiens
cccaggaaatgaacttctgatt

SEQ ID NO: 7402550 - DNA, 22 bp, Homo sapiens
cccaggaaatgaacttctgatt

SEQ ID NO: 7402551 - DNA, 22 bp, Homo sapiens
cccaggaaatgaacttctgatt

SEQ ID NO: 7402552 - DNA, 22 bp, Homo sapiens
cccaggaaatgggctcttgcct

SEQ ID NO: 7402553 - DNA, 22 bp, Homo sapiens
cccaggaaatgggctcttgcct

SEQ ID NO: 7402554 - DNA, 22 bp, Homo sapiens
cccaggaaatgggctcttgcct

SEQ ID NO: 7402555 - DNA, 22 bp, Homo sapiens
cccaggaaatgggctcttgcct

SEQ ID NO: 7402556 - DNA, 22 bp, Homo sapiens
cccaggaactccagagctcctc

SEQ ID NO: 7402557 - DNA, 22 bp, Homo sapiens
cccaggaagaaattctgatttg

SEQ ID NO: 7402558 - DNA, 22 bp, Homo sapiens
cccaggaactccagagctcctc

SEQ ID NO: 7402559 - DNA, 22 bp, Homo sapiens
cccaggaactccagagctcctc

SEQ ID NO: 7402560 - DNA, 22 bp, Homo sapiens
cccaggaacagggctcagaccc

SEQ ID NO: 7402561 - DNA, 22 bp, Homo sapiens
cccaggaacagggctcagaccc

SEQ ID NO: 7402562 - DNA, 22 bp, Homo sapiens
cccaggaacagggctcagaccc

SEQ ID NO: 7402563 - DNA, 22 bp, Homo sapiens
cccaggaacctaccagctcgag

SEQ ID NO: 7402564 - DNA, 22 bp, Homo sapiens
cccaggaacctaccagctcgag

SEQ ID NO: 7402565 - DNA, 22 bp, Homo sapiens
cccaggaacagggctcagaccc

SEQ ID NO: 7402566 - DNA, 23 bp, Homo sapiens
agggaaagtagtaatggcctttg

SEQ ID NO: 7402567 - DNA, 23 bp, Homo sapiens
agggaaagtagtaatggcctttg

SEQ ID NO: 7402568 - DNA, 22 bp, Homo sapiens
agggaaagtaagcatttcatta

SEQ ID NO: 7402569 - DNA, 22 bp, Homo sapiens
agggaaagtaagcatttcatta

SEQ ID NO: 7402570 - DNA, 22 bp, Homo sapiens
agggaaagtaagcatttcatta

SEQ ID NO: 7402571 - DNA, 22 bp, Homo sapiens
agggaaaggtagtgaggtcaca

SEQ ID NO: 7402572 - DNA, 22 bp, Homo sapiens
agggaaagtaagcatttcatta

SEQ ID NO: 7402573 - DNA, 22 bp, Homo sapiens
cccaggaaatcaggctttctag

SEQ ID NO: 7402574 - DNA, 22 bp, Homo sapiens
cccaggaaatatgtttcttaac

SEQ ID NO: 7402575 - DNA, 22 bp, Homo sapiens
cccaggaaatcaggctttctag

SEQ ID NO: 7402576 - DNA, 22 bp, Homo sapiens
cccaggaaatcaggctttctag

SEQ ID NO: 7402577 - DNA, 22 bp, Homo sapiens
agggaaataatctattctgagg

SEQ ID NO: 7402578 - DNA, 22 bp, Homo sapiens
cccaggaaatatgtttcttaac

SEQ ID NO: 7402579 - DNA, 23 bp, Homo sapiens
agggaaagtagtaatggcctttg

SEQ ID NO: 7402580 - DNA, 23 bp, Homo sapiens
agggaaagtagtaatggcctttg

SEQ ID NO: 7402581 - DNA, 23 bp, Homo sapiens
agggaaagtagtaatggcctttg

SEQ ID NO: 7402582 - DNA, 22 bp, Homo sapiens
aggctttcctgtcactcatgct

SEQ ID NO: 7402583 - DNA, 22 bp, Homo sapiens
aggctttcgatgaacgcttgct

SEQ ID NO: 7402584 - DNA, 22 bp, Homo sapiens
aggctttgaacatctacctgag

SEQ ID NO: 7402585 - DNA, 22 bp, Homo sapiens
aggcttggctggcagccctggg

SEQ ID NO: 7402586 - DNA, 22 bp, Homo sapiens
aggctttggaatcagagttctg

SEQ ID NO: 7402587 - DNA, 22 bp, Homo sapiens
aggctttggaatcagagttctg

SEQ ID NO: 7402588 - DNA, 22 bp, Homo sapiens
aggctttggaatcagagttctg

SEQ ID NO: 7402589 - DNA, 21 bp, Homo sapiens
aggctttgaatcatccttcga

SEQ ID NO: 7402590 - DNA, 22 bp, Homo sapiens
aggctttgcaaaaaagctcata

SEQ ID NO: 7402591 - DNA, 22 bp, Homo sapiens
aggctttgcaaaaaagctcata

SEQ ID NO: 7402592 - DNA, 22 bp, Homo sapiens
aggctttgcaaaaaagctcata

SEQ ID NO: 7402593 - DNA, 22 bp, Homo sapiens
aggctttgcaaaaaagctcata

SEQ ID NO: 7402594 - DNA, 22 bp, Homo sapiens
aggcttggctggcagccctggg

SEQ ID NO: 7402595 - DNA, 22 bp, Homo sapiens
aggcttggctgcacgcctcgct

SEQ ID NO: 7402596 - DNA, 22 bp, Homo sapiens
aggcttggctggcagccctggg

SEQ ID NO: 7402597 - DNA, 22 bp, Homo sapiens
cccagagttggtcaggggaccc

SEQ ID NO: 7402598 - DNA, 22 bp, Homo sapiens
cccagatgcaggttcaagagta

SEQ ID NO: 7402599 - DNA, 22 bp, Homo sapiens
cccagatgcaggttcaagagta

SEQ ID NO: 7402600 - DNA, 19 bp, Homo sapiens
aggcttggctagatttact

SEQ ID NO: 7402601 - DNA, 19 bp, Homo sapiens
aggcttggctagatttact

SEQ ID NO: 7402602 - DNA, 22 bp, Homo sapiens
aggcttggctctcctatgagaa

SEQ ID NO: 7402603 - DNA, 22 bp, Homo sapiens
cccagagtggagggtgcagaat

SEQ ID NO: 7402604 - DNA, 22 bp, Homo sapiens
cccagagtggagggtgcagaat

SEQ ID NO: 7402605 - DNA, 22 bp, Homo sapiens
cccagagtggagggtgcagaat

SEQ ID NO: 7402606 - DNA, 22 bp, Homo sapiens
cccagagtggacggtggcccct

SEQ ID NO: 7402607 - DNA, 22 bp, Homo sapiens
cccagagtggacggtggcccct

SEQ ID NO: 7402608 - DNA, 22 bp, Homo sapiens
cccagagttcaaaccctgcgtc

SEQ ID NO: 7402609 - DNA, 22 bp, Homo sapiens
cccagagttcaaaccctgcgtc

SEQ ID NO: 7402610 - DNA, 22 bp, Homo sapiens
cccagagttggtcaggggaccc

SEQ ID NO: 7402611 - DNA, 22 bp, Homo sapiens
cccagagttggtcaggggaccc

SEQ ID NO: 7402612 - DNA, 22 bp, Homo sapiens
cccagagttggtcaggggaccc

SEQ ID NO: 7402613 - DNA, 22 bp, Homo sapiens
cccagagttcaaaccctgcgtc

SEQ ID NO: 7402614 - DNA, 22 bp, Homo sapiens
cccagagtatttgtgatgttag

SEQ ID NO: 7402615 - DNA, 22 bp, Homo sapiens
cccagagtatttgtgatgttag

SEQ ID NO: 7402616 - DNA, 22 bp, Homo sapiens
cccagagtcaagcttaccatta

SEQ ID NO: 7402617 - DNA, 22 bp, Homo sapiens
cccagagtcaagcttaccatta

SEQ ID NO: 7402618 - DNA, 23 bp, Homo sapiens
cccagagtcatctgtagctgtgg

SEQ ID NO: 7402619 - DNA, 23 bp, Homo sapiens
cccagagtcatctgtagctgtgg

SEQ ID NO: 7402620 - DNA, 22 bp, Homo sapiens
cccagagtcacatggggtgttc

SEQ ID NO: 7402621 - DNA, 22 bp, Homo sapiens
cccagagtcacatggggtgttc

SEQ ID NO: 7402622 - DNA, 22 bp, Homo sapiens
cccagagtctctgctcttgcct

SEQ ID NO: 7402623 - DNA, 22 bp, Homo sapiens
cccagagtctctgctcttgcct

SEQ ID NO: 7402624 - DNA, 22 bp, Homo sapiens
aggcttttctccagaatgtact

SEQ ID NO: 7402625 - DNA, 22 bp, Homo sapiens
aggcttttgctctggctcctct

SEQ ID NO: 7402626 - DNA, 22 bp, Homo sapiens
aggcttttggagaagcatatgc

SEQ ID NO: 7402627 - DNA, 21 bp, Homo sapiens
agggaaaaggctgagtgaggg

SEQ ID NO: 7402628 - DNA, 21 bp, Homo sapiens
agggaaaaggctgagtgaggg

SEQ ID NO: 7402629 - DNA, 22 bp, Homo sapiens
aggcttttggagaagcatatgc

SEQ ID NO: 7402630 - DNA, 22 bp, Homo sapiens
aggcttttgtggtgtggaatgg

SEQ ID NO: 7402631 - DNA, 21 bp, Homo sapiens
agggaaaaggctgagtgaggg

SEQ ID NO: 7402632 - DNA, 21 bp, Homo sapiens
agggaaagaaaatgagctaat

SEQ ID NO: 7402633 - DNA, 21 bp, Homo sapiens
agggaaagaaaatgagctaat

SEQ ID NO: 7402634 - DNA, 21 bp, Homo sapiens
agggaaaaggctgagtgaggg

SEQ ID NO: 7402635 - DNA, 22 bp, Homo sapiens
aggcttttctccagaatgtact

SEQ ID NO: 7402636 - DNA, 22 bp, Homo sapiens
aggcttttatacattgctgacc

SEQ ID NO: 7402637 - DNA, 22 bp, Homo sapiens
aggcttttatacattgctgacc

SEQ ID NO: 7402638 - DNA, 22 bp, Homo sapiens
aggcttttctccagaatgtact

SEQ ID NO: 7402639 - DNA, 22 bp, Homo sapiens
aggcttttatacattgctgacc

SEQ ID NO: 7402640 - DNA, 22 bp, Homo sapiens
aggcttttagaatcttatttct

SEQ ID NO: 7402641 - DNA, 22 bp, Homo sapiens
aggcttttagaatcttatttct

SEQ ID NO: 7402642 - DNA, 22 bp, Homo sapiens
aggcttttagaatcttatttct

SEQ ID NO: 7402643 - DNA, 22 bp, Homo sapiens
aggctttgttttatctcattta

SEQ ID NO: 7402644 - DNA, 22 bp, Homo sapiens
aggctttgttttatctcattta

SEQ ID NO: 7402645 - DNA, 22 bp, Homo sapiens
aggctttggggcattctgtgtt

SEQ ID NO: 7402646 - DNA, 22 bp, Homo sapiens
aggctttgtacctggggtctta

SEQ ID NO: 7402647 - DNA, 22 bp, Homo sapiens
agggaaaggtagtgaggtcaca

SEQ ID NO: 7402648 - DNA, 22 bp, Homo sapiens
agggaaaggtagtgaggtcaca

SEQ ID NO: 7402649 - DNA, 22 bp, Homo sapiens
agggaaaggtagtgaggtcaca

SEQ ID NO: 7402650 - DNA, 22 bp, Homo sapiens
agggaaaggtagtgaggtcaca

SEQ ID NO: 7402651 - DNA, 22 bp, Homo sapiens
agggaaaggtagtgaggtcaca

SEQ ID NO: 7402652 - DNA, 22 bp, Homo sapiens
agggaaaggtagtgaggtcaca

SEQ ID NO: 7402653 - DNA, 22 bp, Homo sapiens
agggaaaggctgatgctgtggg

SEQ ID NO: 7402654 - DNA, 22 bp, Homo sapiens
agggaaaggctgatgctgtggg

SEQ ID NO: 7402655 - DNA, 21 bp, Homo sapiens
agggaaagaaaatgagctaat

SEQ ID NO: 7402656 - DNA, 21 bp, Homo sapiens
agggaaagaaaatgagctaat

SEQ ID NO: 7402657 - DNA, 21 bp, Homo sapiens
agggaaagaaaatgagctaat

SEQ ID NO: 7402658 - DNA, 21 bp, Homo sapiens
agggaaagaaaatgagctaat

SEQ ID NO: 7402659 - DNA, 22 bp, Homo sapiens
agggaaaggctgatgctgtggg

SEQ ID NO: 7402660 - DNA, 22 bp, Homo sapiens
agggaaaggctgatgctgtggg

SEQ ID NO: 7402661 - DNA, 22 bp, Homo sapiens
agggaaaggctgatgctgtggg

SEQ ID NO: 7402662 - DNA, 22 bp, Homo sapiens
agggaaaggctgatgctgtggg

SEQ ID NO: 7402663 - DNA, 22 bp, Homo sapiens
agggcagagaaatgtagttgag

SEQ ID NO: 7402664 - DNA, 22 bp, Homo sapiens
agggcagagaaatgtagttgag

SEQ ID NO: 7402665 - DNA, 22 bp, Homo sapiens
agggcagagaaatgtagttgag

SEQ ID NO: 7402666 - DNA, 22 bp, Homo sapiens
agggcagagaaatgtagttgag

SEQ ID NO: 7402667 - DNA, 22 bp, Homo sapiens
cccctgaagacaatggagaggt

SEQ ID NO: 7402668 - DNA, 22 bp, Homo sapiens
cccctgaagacaatggagaggt

SEQ ID NO: 7402669 - DNA, 22 bp, Homo sapiens
cccctgaagacaatggagaggt

SEQ ID NO: 7402670 - DNA, 22 bp, Homo sapiens
agggcagagaaatgtagttgag

SEQ ID NO: 7402671 - DNA, 22 bp, Homo sapiens
cccctcttgtgggctcaggtca

SEQ ID NO: 7402672 - DNA, 22 bp, Homo sapiens
agggcagagaaatgtagttgag

SEQ ID NO: 7402673 - DNA, 22 bp, Homo sapiens
agggcagagaaatgtagttgag

SEQ ID NO: 7402674 - DNA, 22 bp, Homo sapiens
cccctgccagctatccctgaac

SEQ ID NO: 7402675 - DNA, 22 bp, Homo sapiens
cccctgccagctatccctgaac

SEQ ID NO: 7402676 - DNA, 22 bp, Homo sapiens
cccctgccagctatccctgaac

SEQ ID NO: 7402677 - DNA, 22 bp, Homo sapiens
cccctgccagctatccctgaac

SEQ ID NO: 7402678 - DNA, 22 bp, Homo sapiens
cccctgccagctatccctgaac

SEQ ID NO: 7402679 - DNA, 22 bp, Homo sapiens
cccctgccagctatccctgaac

SEQ ID NO: 7402680 - DNA, 22 bp, Homo sapiens
cccctgccagctatccctgaac

SEQ ID NO: 7402681 - DNA, 22 bp, Homo sapiens
cccctgccagctatccctgaac

SEQ ID NO: 7402682 - DNA, 22 bp, Homo sapiens
cccctgagattctggcttggga

SEQ ID NO: 7402683 - DNA, 22 bp, Homo sapiens
cccctgagattctggcttggga

SEQ ID NO: 7402684 - DNA, 22 bp, Homo sapiens
cccctgccagctatccctgaac

SEQ ID NO: 7402685 - DNA, 22 bp, Homo sapiens
cccctgagattctggcttggga

SEQ ID NO: 7402686 - DNA, 22 bp, Homo sapiens
cccctgccatagtcaaatctaa

SEQ ID NO: 7402687 - DNA, 22 bp, Homo sapiens
cccctgccatagtcaaatctaa

SEQ ID NO: 7402688 - DNA, 22 bp, Homo sapiens
cccctgccatagtcaaatctaa

SEQ ID NO: 7402689 - DNA, 22 bp, Homo sapiens
cccctgcgaggacagtgggaca

SEQ ID NO: 7402690 - DNA, 22 bp, Homo sapiens
cccctgcgaggacagtgggaca

SEQ ID NO: 7402691 - DNA, 22 bp, Homo sapiens
cccctgccatagtcaaatctaa

SEQ ID NO: 7402692 - DNA, 22 bp, Homo sapiens
cccctgctggcctgctggtttc

SEQ ID NO: 7402693 - DNA, 22 bp, Homo sapiens
cccctgctggcctgctggtttc

SEQ ID NO: 7402694 - DNA, 22 bp, Homo sapiens
cccctgctggtcgaaacaattt

SEQ ID NO: 7402695 - DNA, 21 bp, Homo sapiens
cccctgggagccctgtcagta

SEQ ID NO: 7402696 - DNA, 21 bp, Homo sapiens
cccctgggagccctgtcagta

SEQ ID NO: 7402697 - DNA, 22 bp, Homo sapiens
cccctgctggtcgaaacaattt

SEQ ID NO: 7402698 - DNA, 21 bp, Homo sapiens
cccctgggagccctgtcagta

SEQ ID NO: 7402699 - DNA, 21 bp, Homo sapiens
cccctgggagccctgtcagta

SEQ ID NO: 7402700 - DNA, 21 bp, Homo sapiens
cccctgggagccctgtcagta

SEQ ID NO: 7402701 - DNA, 22 bp, Homo sapiens
agggcagaagtacagacactta

SEQ ID NO: 7402702 - DNA, 22 bp, Homo sapiens
agggcagaagtacagacactta

SEQ ID NO: 7402703 - DNA, 22 bp, Homo sapiens
agggcagaagtacagacactta

SEQ ID NO: 7402704 - DNA, 22 bp, Homo sapiens
agggcagaagtacagacactta

SEQ ID NO: 7402705 - DNA, 22 bp, Homo sapiens
agggcagaaatcgattacacct

SEQ ID NO: 7402706 - DNA, 22 bp, Homo sapiens
agggcagaaatcgattacacct

SEQ ID NO: 7402707 - DNA, 22 bp, Homo sapiens
agggcagaaatattgatactgt

SEQ ID NO: 7402708 - DNA, 22 bp, Homo sapiens
agggcagaaatattgatactgt

SEQ ID NO: 7402709 - DNA, 22 bp, Homo sapiens
agggcagaaatattgatactgt

SEQ ID NO: 7402710 - DNA, 22 bp, Homo sapiens
agggcagaaatattgatactgt

SEQ ID NO: 7402711 - DNA, 22 bp, Homo sapiens
agggcagaaatattgatactgt

SEQ ID NO: 7402712 - DNA, 22 bp, Homo sapiens
agggcagaaatcgattacacct

SEQ ID NO: 7402713 - DNA, 22 bp, Homo sapiens
agggcagaaatcgattacacct

SEQ ID NO: 7402714 - DNA, 22 bp, Homo sapiens
agggcagaccacgtgcaaggat

SEQ ID NO: 7402715 - DNA, 22 bp, Homo sapiens
agggcagaccacgtgcaaggat

SEQ ID NO: 7402716 - DNA, 22 bp, Homo sapiens
agggcagaagtacagacactta

SEQ ID NO: 7402717 - DNA, 22 bp, Homo sapiens
agggcagaccacgtgcaaggat

SEQ ID NO: 7402718 - DNA, 22 bp, Homo sapiens
agggcagaccacgtgcaaggat

SEQ ID NO: 7402719 - DNA, 22 bp, Homo sapiens
agggcagaccacgtgcaaggat

SEQ ID NO: 7402720 - DNA, 22 bp, Homo sapiens
agggcagaagtacagacactta

SEQ ID NO: 7402721 - DNA, 22 bp, Homo sapiens
agggcagaagtacagacactta

SEQ ID NO: 7402722 - DNA, 22 bp, Homo sapiens
agggcagaccacgtgcaaggat

SEQ ID NO: 7402723 - DNA, 22 bp, Homo sapiens
agggcagactaggatggaagtg

SEQ ID NO: 7402724 - DNA, 22 bp, Homo sapiens
agggcagactaggatggaagtg

SEQ ID NO: 7402725 - DNA, 22 bp, Homo sapiens
agggcagaccacgtgcaaggat

SEQ ID NO: 7402726 - DNA, 22 bp, Homo sapiens
agggcagactaggatggaagtg

SEQ ID NO: 7402727 - DNA, 22 bp, Homo sapiens
agggcagactaggatggaagtg

SEQ ID NO: 7402728 - DNA, 22 bp, Homo sapiens
agggcagactaggatggaagtg

SEQ ID NO: 7402729 - DNA, 22 bp, Homo sapiens
agggcagaccacgtgcaaggat

SEQ ID NO: 7402730 - DNA, 22 bp, Homo sapiens
agggcagaccacgtgcaaggat

SEQ ID NO: 7402731 - DNA, 22 bp, Homo sapiens
agggcagaccacgtgcaaggat

SEQ ID NO: 7402732 - DNA, 22 bp, Homo sapiens
agggcagaccacgtgcaaggat

SEQ ID NO: 7402733 - DNA, 22 bp, Homo sapiens
agggcagactaggatggaagtg

SEQ ID NO: 7402734 - DNA, 22 bp, Homo sapiens
agggcagactaggatggaagtg

SEQ ID NO: 7402735 - DNA, 22 bp, Homo sapiens
agggcagactaggatggaagtg

SEQ ID NO: 7402736 - DNA, 22 bp, Homo sapiens
agggcagactaggatggaagtg

SEQ ID NO: 7402737 - DNA, 22 bp, Homo sapiens
agggcagactaggatggaagtg

SEQ ID NO: 7402738 - DNA, 22 bp, Homo sapiens
agggcagactaggatggaagtg

SEQ ID NO: 7402739 - DNA, 22 bp, Homo sapiens
agggcagactaggatggaagtg

SEQ ID NO: 7402740 - DNA, 22 bp, Homo sapiens
agggcagactaggatggaagtg

SEQ ID NO: 7402741 - DNA, 22 bp, Homo sapiens
agggcagactaggatggaagtg

SEQ ID NO: 7402742 - DNA, 22 bp, Homo sapiens
cccaggtgtttgtggcagaggt

SEQ ID NO: 7402743 - DNA, 19 bp, Homo sapiens
cccaggtgtttgaggctgc

SEQ ID NO: 7402744 - DNA, 22 bp, Homo sapiens
cccaggtgtttgtggcagaggt

SEQ ID NO: 7402745 - DNA, 19 bp, Homo sapiens
cccaggtgtttgaggctgc

SEQ ID NO: 7402746 - DNA, 19 bp, Homo sapiens
cccaggtgtttgaggctgc

SEQ ID NO: 7402747 - DNA, 19 bp, Homo sapiens
cccaggtgtttgaggctgc

SEQ ID NO: 7402748 - DNA, 22 bp, Homo sapiens
cccaggtgtttgtggcagaggt

SEQ ID NO: 7402749 - DNA, 22 bp, Homo sapiens
cccaggtgtttgtggcagaggt

SEQ ID NO: 7402750 - DNA, 22 bp, Homo sapiens
cccaggtgtttgtggcagaggt

SEQ ID NO: 7402751 - DNA, 20 bp, Homo sapiens
cccaggtgtctgaagctctg

SEQ ID NO: 7402752 - DNA, 22 bp, Homo sapiens
cccaggtgggttggcctctgtc

SEQ ID NO: 7402753 - DNA, 20 bp, Homo sapiens
cccaggtgtctgaagctctg

SEQ ID NO: 7402754 - DNA, 20 bp, Homo sapiens
cccaggtgtctgaagctctg

SEQ ID NO: 7402755 - DNA, 20 bp, Homo sapiens
cccaggtgtctgaagctctg

SEQ ID NO: 7402756 - DNA, 23 bp, Homo sapiens
cccaggtgtggaggcggtggcag

SEQ ID NO: 7402757 - DNA, 23 bp, Homo sapiens
cccaggtgtggaggcggtggcag

SEQ ID NO: 7402758 - DNA, 23 bp, Homo sapiens
cccaggtgtggaggcggtggcag

SEQ ID NO: 7402759 - DNA, 19 bp, Homo sapiens
cccaggtgtttgaggctgc

SEQ ID NO: 7402760 - DNA, 23 bp, Homo sapiens
cccaggtgtggaggcggtggcag

SEQ ID NO: 7402761 - DNA, 19 bp, Homo sapiens
cccaggtgtttgaggctgc

SEQ ID NO: 7402762 - DNA, 22 bp, Homo sapiens
agggcagaaaccaccttgatgg

SEQ ID NO: 7402763 - DNA, 22 bp, Homo sapiens
agggcagaaatattgatactgt

SEQ ID NO: 7402764 - DNA, 22 bp, Homo sapiens
agggcagaaaccaccttgatgg

SEQ ID NO: 7402765 - DNA, 22 bp, Homo sapiens
agggcagaaaccaccttgatgg

SEQ ID NO: 7402766 - DNA, 20 bp, Homo sapiens
agggcacttttgctggagca

SEQ ID NO: 7402767 - DNA, 20 bp, Homo sapiens
agggcacttttgctggagca

SEQ ID NO: 7402768 - DNA, 20 bp, Homo sapiens
agggcacttttgctggagca

SEQ ID NO: 7402769 - DNA, 22 bp, Homo sapiens
agggcagaaaccaccttgatgg

SEQ ID NO: 7402770 - DNA, 22 bp, Homo sapiens
agggcagaaaccaccttgatgg

SEQ ID NO: 7402771 - DNA, 20 bp, Homo sapiens
agggcacttttgctggagca

SEQ ID NO: 7402772 - DNA, 22 bp, Homo sapiens
agggatgggtctaacccagaac

SEQ ID NO: 7402773 - DNA, 22 bp, Homo sapiens
agggatgggtctaacccagaac

SEQ ID NO: 7402774 - DNA, 22 bp, Homo sapiens
agggatggtggaggttgcaagt

SEQ ID NO: 7402775 - DNA, 22 bp, Homo sapiens
agggatggtggaggttgcaagt

SEQ ID NO: 7402776 - DNA, 22 bp, Homo sapiens
agggatggtggaggaatttcaa

SEQ ID NO: 7402777 - DNA, 22 bp, Homo sapiens
agggatggtggaggaatttcaa

SEQ ID NO: 7402778 - DNA, 22 bp, Homo sapiens
agggatggtggaggaatttcaa

SEQ ID NO: 7402779 - DNA, 22 bp, Homo sapiens
agggatggtggaggttgcaagt

SEQ ID NO: 7402780 - DNA, 20 bp, Homo sapiens
agggcacttttgctggagca

SEQ ID NO: 7402781 - DNA, 22 bp, Homo sapiens
agggatggtggaggttgcaagt

SEQ ID NO: 7402782 - DNA, 22 bp, Homo sapiens
agggatggtggaggttgcaagt

SEQ ID NO: 7402783 - DNA, 22 bp, Homo sapiens
agggagcttgtgtttcttttag

SEQ ID NO: 7402784 - DNA, 22 bp, Homo sapiens
agggagctttaccccagatcac

SEQ ID NO: 7402785 - DNA, 22 bp, Homo sapiens
agggagctttcaggtagcttaa

SEQ ID NO: 7402786 - DNA, 22 bp, Homo sapiens
agggagctttaccccagatcac

SEQ ID NO: 7402787 - DNA, 21 bp, Homo sapiens
agggagctttaggtagaagtt

SEQ ID NO: 7402788 - DNA, 21 bp, Homo sapiens
agggagctttaggtagaagtt

SEQ ID NO: 7402789 - DNA, 22 bp, Homo sapiens
cccaggtctgtgccagctctga

SEQ ID NO: 7402790 - DNA, 22 bp, Homo sapiens
cccaggtgctgaaggaggccgc

SEQ ID NO: 7402791 - DNA, 22 bp, Homo sapiens
cccaggtgctgaaggaggccgc

SEQ ID NO: 7402792 - DNA, 22 bp, Homo sapiens
cccaggtgctgcgtgaagcctc

SEQ ID NO: 7402793 - DNA, 22 bp, Homo sapiens
cccaggtgctgaaggaggccgc

SEQ ID NO: 7402794 - DNA, 22 bp, Homo sapiens
cccaggtgctgaaggaggccgc

SEQ ID NO: 7402795 - DNA, 22 bp, Homo sapiens
agggagctttcaggtagcttaa

SEQ ID NO: 7402796 - DNA, 22 bp, Homo sapiens
cccaggtgctgaaggaggccgc

SEQ ID NO: 7402797 - DNA, 22 bp, Homo sapiens
cccaggtggcagaagctgcagt

SEQ ID NO: 7402798 - DNA, 22 bp, Homo sapiens
cccaggtggcagaagctgcagt

SEQ ID NO: 7402799 - DNA, 22 bp, Homo sapiens
cccaggtgctgcgtgaagcctc

SEQ ID NO: 7402800 - DNA, 22 bp, Homo sapiens
cccaggtggcagaagctgcagt

SEQ ID NO: 7402801 - DNA, 21 bp, Homo sapiens
cccaggtgggatggttgcctc

SEQ ID NO: 7402802 - DNA, 22 bp, Homo sapiens
cccaggtggcagaagctgcagt

SEQ ID NO: 7402803 - DNA, 21 bp, Homo sapiens
cccaggtgggatggttgcctc

SEQ ID NO: 7402804 - DNA, 22 bp, Homo sapiens
cccaggtggcagaagctgcagt

SEQ ID NO: 7402805 - DNA, 22 bp, Homo sapiens
cccaggtggcagaagctgcagt

SEQ ID NO: 7402806 - DNA, 21 bp, Homo sapiens
cccaggtgggatggttgcctc

SEQ ID NO: 7402807 - DNA, 22 bp, Homo sapiens
cccaggtgggcacctcgaggaa

SEQ ID NO: 7402808 - DNA, 22 bp, Homo sapiens
cccaggtgggcacctcgaggaa

SEQ ID NO: 7402809 - DNA, 21 bp, Homo sapiens
cccaggtgggatggttgcctc

SEQ ID NO: 7402810 - DNA, 22 bp, Homo sapiens
cccaggtgggttggcctctgtc

SEQ ID NO: 7402811 - DNA, 22 bp, Homo sapiens
cccaggtgggcacctcgaggaa

SEQ ID NO: 7402812 - DNA, 22 bp, Homo sapiens
cccaggtgggcacctcgaggaa

SEQ ID NO: 7402813 - DNA, 22 bp, Homo sapiens
cccaggtgggcacctcgaggaa

SEQ ID NO: 7402814 - DNA, 22 bp, Homo sapiens
cccaggtgggttggcctctgtc

SEQ ID NO: 7402815 - DNA, 22 bp, Homo sapiens
agggcccaggacagcatcaggg

SEQ ID NO: 7402816 - DNA, 22 bp, Homo sapiens
agggcccaggacagcatcaggg

SEQ ID NO: 7402817 - DNA, 22 bp, Homo sapiens
agggcccaggacagcatcaggg

SEQ ID NO: 7402818 - DNA, 22 bp, Homo sapiens
agggcccaggacagcatcaggg

SEQ ID NO: 7402819 - DNA, 22 bp, Homo sapiens
agggcccaggacagcatcaggg

SEQ ID NO: 7402820 - DNA, 22 bp, Homo sapiens
agggcccaggacagcatcaggg

SEQ ID NO: 7402821 - DNA, 20 bp, Homo sapiens
agggcccaggaagagagtta

SEQ ID NO: 7402822 - DNA, 20 bp, Homo sapiens
agggcccaggaagagagtta

SEQ ID NO: 7402823 - DNA, 20 bp, Homo sapiens
agggcccaggaagagagtta

SEQ ID NO: 7402824 - DNA, 20 bp, Homo sapiens
agggcccaggaagagagtta

SEQ ID NO: 7402825 - DNA, 20 bp, Homo sapiens
agggcccaggaagagagtta

SEQ ID NO: 7402826 - DNA, 20 bp, Homo sapiens
agggcccaggaagagagtta

SEQ ID NO: 7402827 - DNA, 22 bp, Homo sapiens
agggcccagcccttgctggtct

SEQ ID NO: 7402828 - DNA, 22 bp, Homo sapiens
agggcccaccttggtgctgagg

SEQ ID NO: 7402829 - DNA, 22 bp, Homo sapiens
agggcccagcagcatttcagtg

SEQ ID NO: 7402830 - DNA, 22 bp, Homo sapiens
agggcccagcagcatttcagtg

SEQ ID NO: 7402831 - DNA, 22 bp, Homo sapiens
agggcccagcccttgctggtct

SEQ ID NO: 7402832 - DNA, 22 bp, Homo sapiens
agggcccagcccttgctggtct

SEQ ID NO: 7402833 - DNA, 22 bp, Homo sapiens
agggcccagcagcatttcagtg

SEQ ID NO: 7402834 - DNA, 22 bp, Homo sapiens
agggcccacagttcctatggcc

SEQ ID NO: 7402835 - DNA, 22 bp, Homo sapiens
agggcccaccttggtgctgagg

SEQ ID NO: 7402836 - DNA, 22 bp, Homo sapiens
agggcccacagttcctatggcc

SEQ ID NO: 7402837 - DNA, 22 bp, Homo sapiens
agggcccaccttggtgctgagg

SEQ ID NO: 7402838 - DNA, 22 bp, Homo sapiens
agggcccacagttcctatggcc

SEQ ID NO: 7402839 - DNA, 22 bp, Homo sapiens
agggcccacagttcctatggcc

SEQ ID NO: 7402840 - DNA, 22 bp, Homo sapiens
agggcccacagttcctatggcc

SEQ ID NO: 7402841 - DNA, 22 bp, Homo sapiens
agggcccacagttcctatggcc

SEQ ID NO: 7402842 - DNA, 22 bp, Homo sapiens
agggcccacagttcctatggcc

SEQ ID NO: 7402843 - DNA, 23 bp, Homo sapiens
agggcccaagcctggacagcagg

SEQ ID NO: 7402844 - DNA, 23 bp, Homo sapiens
agggcccaagcctggacagcagg

SEQ ID NO: 7402845 - DNA, 23 bp, Homo sapiens
agggcccaagcctggacagcagg

SEQ ID NO: 7402846 - DNA, 22 bp, Homo sapiens
agggccagtaaatgtttcctca

SEQ ID NO: 7402847 - DNA, 23 bp, Homo sapiens
agggcccaagcctggacagcagg

SEQ ID NO: 7402848 - DNA, 23 bp, Homo sapiens
agggcccaagcctggacagcagg

SEQ ID NO: 7402849 - DNA, 22 bp, Homo sapiens
ccctgatggcacagtggcaggc

SEQ ID NO: 7402850 - DNA, 23 bp, Homo sapiens
agggccaggtgcggaaacagctc

SEQ ID NO: 7402851 - DNA, 23 bp, Homo sapiens
agggccaggtgcggaaacagctc

SEQ ID NO: 7402852 - DNA, 23 bp, Homo sapiens
agggccaggtgcggaaacagctc

SEQ ID NO: 7402853 - DNA, 23 bp, Homo sapiens
agggccaggtgcggaaacagctc

SEQ ID NO: 7402854 - DNA, 23 bp, Homo sapiens
agggccaggtgcggaaacagctc

SEQ ID NO: 7402855 - DNA, 22 bp, Homo sapiens
agggccagggaagctgtatttt

SEQ ID NO: 7402856 - DNA, 22 bp, Homo sapiens
ccctgatgacacgggcatcagg

SEQ ID NO: 7402857 - DNA, 22 bp, Homo sapiens
ccctgatggcacagtggcaggc

SEQ ID NO: 7402858 - DNA, 22 bp, Homo sapiens
ccctgatgacacgggcatcagg

SEQ ID NO: 7402859 - DNA, 22 bp, Homo sapiens
ccctgatgacacgggcatcagg

SEQ ID NO: 7402860 - DNA, 22 bp, Homo sapiens
ccctgatagcccctatcatcag

SEQ ID NO: 7402861 - DNA, 22 bp, Homo sapiens
ccctgagttagtacagttgagt

SEQ ID NO: 7402862 - DNA, 22 bp, Homo sapiens
ccctgagttagtacagttgagt

SEQ ID NO: 7402863 - DNA, 22 bp, Homo sapiens
ccctgagtcatcattgcggaag

SEQ ID NO: 7402864 - DNA, 22 bp, Homo sapiens
ccctgaggggcttactttgccc

SEQ ID NO: 7402865 - DNA, 22 bp, Homo sapiens
ccctgagtcatcattgcggaag

SEQ ID NO: 7402866 - DNA, 22 bp, Homo sapiens
ccctgaggggagtggtgaggtg

SEQ ID NO: 7402867 - DNA, 22 bp, Homo sapiens
ccctgaggggcttactttgccc

SEQ ID NO: 7402868 - DNA, 22 bp, Homo sapiens
ccctgaggggcttactttgccc

SEQ ID NO: 7402869 - DNA, 22 bp, Homo sapiens
ccctgaggctgaggataggtgg

SEQ ID NO: 7402870 - DNA, 18 bp, Homo sapiens
ccctgaggctagcatgct

SEQ ID NO: 7402871 - DNA, 18 bp, Homo sapiens
ccctgaggctagcatgct

SEQ ID NO: 7402872 - DNA, 22 bp, Homo sapiens
ccctgaggctgaggataggtgg

SEQ ID NO: 7402873 - DNA, 22 bp, Homo sapiens
ccctgaggctgaggataggtgg

SEQ ID NO: 7402874 - DNA, 22 bp, Homo sapiens
ccctgaggctgaggataggtgg

SEQ ID NO: 7402875 - DNA, 22 bp, Homo sapiens
ccctgaggggagtggtgaggtg

SEQ ID NO: 7402876 - DNA, 22 bp, Homo sapiens
ccctgaggctgaggataggtgg

SEQ ID NO: 7402877 - DNA, 22 bp, Homo sapiens
ccctgaggggagtggtgaggtg

SEQ ID NO: 7402878 - DNA, 22 bp, Homo sapiens
ccctgaggggagtggtgaggtg

SEQ ID NO: 7402879 - DNA, 22 bp, Homo sapiens
ccctgaggggagtggtgaggtg

SEQ ID NO: 7402880 - DNA, 22 bp, Homo sapiens
ccctgaggcaaaggctagagtt

SEQ ID NO: 7402881 - DNA, 22 bp, Homo sapiens
ccctgaggatgtctccttcctg

SEQ ID NO: 7402882 - DNA, 22 bp, Homo sapiens
ccctgaggatgtctccttcctg

SEQ ID NO: 7402883 - DNA, 22 bp, Homo sapiens
ccctgaggcaaaggctagagtt

SEQ ID NO: 7402884 - DNA, 19 bp, Homo sapiens
ccctgaggcaaaagccttt

SEQ ID NO: 7402885 - DNA, 19 bp, Homo sapiens
ccctgaggcaaaagccttt

SEQ ID NO: 7402886 - DNA, 22 bp, Homo sapiens
ccctgaggcaaaggctagagtt

SEQ ID NO: 7402887 - DNA, 22 bp, Homo sapiens
ccctgaggcacaggccacgtat

SEQ ID NO: 7402888 - DNA, 22 bp, Homo sapiens
ccctgaggcacaggccacgtat

SEQ ID NO: 7402889 - DNA, 22 bp, Homo sapiens
ccctgaggcaaaggctagagtt

SEQ ID NO: 7402890 - DNA, 22 bp, Homo sapiens
ccctgaggcaaaggctagagtt

SEQ ID NO: 7402891 - DNA, 18 bp, Homo sapiens
ccctgaggctagcatgct

SEQ ID NO: 7402892 - DNA, 22 bp, Homo sapiens
ccctgaggcctcaggttcattg

SEQ ID NO: 7402893 - DNA, 22 bp, Homo sapiens
ccctgaggcctcaggttcattg

SEQ ID NO: 7402894 - DNA, 18 bp, Homo sapiens
ccctgaggctagcatgct

SEQ ID NO: 7402895 - DNA, 22 bp, Homo sapiens
ccctgaggcagtaggagctttt

SEQ ID NO: 7402896 - DNA, 22 bp, Homo sapiens
ccctgaggccctcctggggtct

SEQ ID NO: 7402897 - DNA, 22 bp, Homo sapiens
ccctgaggccctcctggggtct

SEQ ID NO: 7402898 - DNA, 22 bp, Homo sapiens
ccctgaggcagtaggagctttt

SEQ ID NO: 7402899 - DNA, 22 bp, Homo sapiens
ccctgaggcagtaggagctttt

SEQ ID NO: 7402900 - DNA, 22 bp, Homo sapiens
ccctgaggcacaggccacgtat

SEQ ID NO: 7402901 - DNA, 22 bp, Homo sapiens
ccctgaggcacaggccacgtat

SEQ ID NO: 7402902 - DNA, 22 bp, Homo sapiens
ccctgaggcagtaggagctttt

SEQ ID NO: 7402903 - DNA, 22 bp, Homo sapiens
ccctgaggcagtaggagctttt

SEQ ID NO: 7402904 - DNA, 22 bp, Homo sapiens
agggcagctgtgagccactgtg

SEQ ID NO: 7402905 - DNA, 22 bp, Homo sapiens
agggcagcttccatagtctggc

SEQ ID NO: 7402906 - DNA, 22 bp, Homo sapiens
agggcagcttccatagtctggc

SEQ ID NO: 7402907 - DNA, 22 bp, Homo sapiens
agggcatggggttaacctggga

SEQ ID NO: 7402908 - DNA, 22 bp, Homo sapiens
agggcatggggttaacctggga

SEQ ID NO: 7402909 - DNA, 22 bp, Homo sapiens
agggcatggggttaacctggga

SEQ ID NO: 7402910 - DNA, 22 bp, Homo sapiens
agggcatggggttaacctggga

SEQ ID NO: 7402911 - DNA, 22 bp, Homo sapiens
agggcatgtgggagaggagcct

SEQ ID NO: 7402912 - DNA, 22 bp, Homo sapiens
agggcatgtgggagaggagcct

SEQ ID NO: 7402913 - DNA, 22 bp, Homo sapiens
agggcatgtgggagaggagcct

SEQ ID NO: 7402914 - DNA, 22 bp, Homo sapiens
agggcatgtgggagaggagcct

SEQ ID NO: 7402915 - DNA, 22 bp, Homo sapiens
agggcatgtgggagaggagcct

SEQ ID NO: 7402916 - DNA, 22 bp, Homo sapiens
agggcatgtgggagaggagcct

SEQ ID NO: 7402917 - DNA, 22 bp, Homo sapiens
agggcatgtgggagaggagcct

SEQ ID NO: 7402918 - DNA, 22 bp, Homo sapiens
agggcatgtgggagaggagcct

SEQ ID NO: 7402919 - DNA, 22 bp, Homo sapiens
agggcatgtgggagaggagcct

SEQ ID NO: 7402920 - DNA, 22 bp, Homo sapiens
agggcatgtgggagaggagcct

SEQ ID NO: 7402921 - DNA, 22 bp, Homo sapiens
agggcatgtgggagaggagcct

SEQ ID NO: 7402922 - DNA, 22 bp, Homo sapiens
agggcatgtgggagaggagcct

SEQ ID NO: 7402923 - DNA, 22 bp, Homo sapiens
cccctgggtccaggcttctctg

SEQ ID NO: 7402924 - DNA, 22 bp, Homo sapiens
cccctgggtccaggcttctctg

SEQ ID NO: 7402925 - DNA, 22 bp, Homo sapiens
cccctggggatcagctggaatt

SEQ ID NO: 7402926 - DNA, 22 bp, Homo sapiens
cccctggggatcagctggaatt

SEQ ID NO: 7402927 - DNA, 22 bp, Homo sapiens
cccctggggatcagctggaatt

SEQ ID NO: 7402928 - DNA, 21 bp, Homo sapiens
cccctgggagccctgtcagta

SEQ ID NO: 7402929 - DNA, 22 bp, Homo sapiens
cccctgtgttgttcaagggtca

SEQ ID NO: 7402930 - DNA, 22 bp, Homo sapiens
cccctgtgttgttcaagggtca

SEQ ID NO: 7402931 - DNA, 22 bp, Homo sapiens
ccccttcagagtagccacatta

SEQ ID NO: 7402932 - DNA, 22 bp, Homo sapiens
ccccttcagagtagccacatta

SEQ ID NO: 7402933 - DNA, 22 bp, Homo sapiens
ccccttcagagtagccacatta

SEQ ID NO: 7402934 - DNA, 20 bp, Homo sapiens
ccccttcatctacagcctga

SEQ ID NO: 7402935 - DNA, 20 bp, Homo sapiens
ccccttcatctacagcctga

SEQ ID NO: 7402936 - DNA, 22 bp, Homo sapiens
ccctgaggatagggcaggaccc

SEQ ID NO: 7402937 - DNA, 22 bp, Homo sapiens
ccctgaggagagcgcttcccga

SEQ ID NO: 7402938 - DNA, 22 bp, Homo sapiens
ccctgaggatagggcaggaccc

SEQ ID NO: 7402939 - DNA, 22 bp, Homo sapiens
ccctgaggatagggcaggaccc

SEQ ID NO: 7402940 - DNA, 22 bp, Homo sapiens
ccctgaggatagggcaggaccc

SEQ ID NO: 7402941 - DNA, 22 bp, Homo sapiens
ccctgaggatagggcaggaccc

SEQ ID NO: 7402942 - DNA, 22 bp, Homo sapiens
ccctgaggatagggcaggaccc

SEQ ID NO: 7402943 - DNA, 22 bp, Homo sapiens
ccctgaggatagggcaggaccc

SEQ ID NO: 7402944 - DNA, 22 bp, Homo sapiens
ccctgaggatagggcaggaccc

SEQ ID NO: 7402945 - DNA, 23 bp, Homo sapiens
agggccactgggaaggattactg

SEQ ID NO: 7402946 - DNA, 22 bp, Homo sapiens
agggccactggctgacggctgc

SEQ ID NO: 7402947 - DNA, 22 bp, Homo sapiens
agggccactggctgacggctgc

SEQ ID NO: 7402948 - DNA, 22 bp, Homo sapiens
agggccactggctgacggctgc

SEQ ID NO: 7402949 - DNA, 19 bp, Homo sapiens
agggccacggggaggtatt

SEQ ID NO: 7402950 - DNA, 22 bp, Homo sapiens
agggccacctctctgggttccc

SEQ ID NO: 7402951 - DNA, 22 bp, Homo sapiens
agggccacctctctgggttccc

SEQ ID NO: 7402952 - DNA, 22 bp, Homo sapiens
agggccaccagggagtctcagg

SEQ ID NO: 7402953 - DNA, 22 bp, Homo sapiens
agggccacagctcaattaaaag

SEQ ID NO: 7402954 - DNA, 22 bp, Homo sapiens
agggccacagtggggcctgaga

SEQ ID NO: 7402955 - DNA, 22 bp, Homo sapiens
agggccacagtggggcctgaga

SEQ ID NO: 7402956 - DNA, 22 bp, Homo sapiens
agggccacagtaatgctgagta

SEQ ID NO: 7402957 - DNA, 22 bp, Homo sapiens
agggccaaagcaagcccaactg

SEQ ID NO: 7402958 - DNA, 22 bp, Homo sapiens
agggcattggcacagatctgct

SEQ ID NO: 7402959 - DNA, 22 bp, Homo sapiens
agggccacagtaatgctgagta

SEQ ID NO: 7402960 - DNA, 22 bp, Homo sapiens
agggccacagtaatgctgagta

SEQ ID NO: 7402961 - DNA, 22 bp, Homo sapiens
agggccaagtccaggacctcgg

SEQ ID NO: 7402962 - DNA, 22 bp, Homo sapiens
agggccaagtccaggacctcgg

SEQ ID NO: 7402963 - DNA, 22 bp, Homo sapiens
agggccaccagagcagggcagt

SEQ ID NO: 7402964 - DNA, 22 bp, Homo sapiens
agggccacagtggggcctgaga

SEQ ID NO: 7402965 - DNA, 22 bp, Homo sapiens
agggccaccagagcagggcagt

SEQ ID NO: 7402966 - DNA, 22 bp, Homo sapiens
agggccacagtggggcctgaga

SEQ ID NO: 7402967 - DNA, 22 bp, Homo sapiens
agggccacagtggggcctgaga

SEQ ID NO: 7402968 - DNA, 22 bp, Homo sapiens
agggccaccagagcagggcagt

SEQ ID NO: 7402969 - DNA, 22 bp, Homo sapiens
agggccaccagggagtctcagg

SEQ ID NO: 7402970 - DNA, 22 bp, Homo sapiens
agggccaccagagcagggcagt

SEQ ID NO: 7402971 - DNA, 22 bp, Homo sapiens
agggccaccagagcagggcagt

SEQ ID NO: 7402972 - DNA, 22 bp, Homo sapiens
cccacgtcgaacttgctccaga

SEQ ID NO: 7402973 - DNA, 22 bp, Homo sapiens
cccacgtcgaacttgctccaga

SEQ ID NO: 7402974 - DNA, 22 bp, Homo sapiens
cccacgtcgaacttgctccaga

SEQ ID NO: 7402975 - DNA, 22 bp, Homo sapiens
cccacgtcgaacttgctccaga

SEQ ID NO: 7402976 - DNA, 22 bp, Homo sapiens
cccacgtcgaacttgctccaga

SEQ ID NO: 7402977 - DNA, 22 bp, Homo sapiens
cccacgtcgaacttgctccaga

SEQ ID NO: 7402978 - DNA, 22 bp, Homo sapiens
cccacgtcgaacttgctccaga

SEQ ID NO: 7402979 - DNA, 22 bp, Homo sapiens
cccacgtcgaacttgctccaga

SEQ ID NO: 7402980 - DNA, 17 bp, Homo sapiens
cccacggaggtgtgaaa

SEQ ID NO: 7402981 - DNA, 22 bp, Homo sapiens
cccacgtcgaacttgctccaga

SEQ ID NO: 7402982 - DNA, 22 bp, Homo sapiens
cccactccctacgacacgctcc

SEQ ID NO: 7402983 - DNA, 22 bp, Homo sapiens
cccactccctacgacacgctcc

SEQ ID NO: 7402984 - DNA, 22 bp, Homo sapiens
cccactccctgcacgcctgccg

SEQ ID NO: 7402985 - DNA, 22 bp, Homo sapiens
cccactccctgcacgcctgccg

SEQ ID NO: 7402986 - DNA, 22 bp, Homo sapiens
cccaccctgggaagctaggcag

SEQ ID NO: 7402987 - DNA, 18 bp, Homo sapiens
cccaccctggctcttagt

SEQ ID NO: 7402988 - DNA, 22 bp, Homo sapiens
cccaccctgggaagctaggcag

SEQ ID NO: 7402989 - DNA, 22 bp, Homo sapiens
cccaccctgggaagctaggcag

SEQ ID NO: 7402990 - DNA, 22 bp, Homo sapiens
cccaccctgggaagctaggcag

SEQ ID NO: 7402991 - DNA, 22 bp, Homo sapiens
cccaccctgggaagctaggcag

SEQ ID NO: 7402992 - DNA, 22 bp, Homo sapiens
cccacactcagttccccttggg

SEQ ID NO: 7402993 - DNA, 22 bp, Homo sapiens
cccacactctgagaaatgctga

SEQ ID NO: 7402994 - DNA, 18 bp, Homo sapiens
cccaccctggctcttagt

SEQ ID NO: 7402995 - DNA, 18 bp, Homo sapiens
cccaccctggctcttagt

SEQ ID NO: 7402996 - DNA, 22 bp, Homo sapiens
cccaccctgggctacacatcca

SEQ ID NO: 7402997 - DNA, 22 bp, Homo sapiens
cccaccctgggctacacatcca

SEQ ID NO: 7402998 - DNA, 22 bp, Homo sapiens
cccaccctgggctacacatcca

SEQ ID NO: 7402999 - DNA, 22 bp, Homo sapiens
cccaccctgggctacacatcca

SEQ ID NO: 7403000 - DNA, 21 bp, Homo sapiens
cccacggaatgatgaggcact

SEQ ID NO: 7403001 - DNA, 22 bp, Homo sapiens
cccacctctcagagagccttgc

SEQ ID NO: 7403002 - DNA, 22 bp, Homo sapiens
cccacctctcagagagccttgc

SEQ ID NO: 7403003 - DNA, 22 bp, Homo sapiens
cccactctggctcccttctagt

SEQ ID NO: 7403004 - DNA, 22 bp, Homo sapiens
cccactctggctcccttctagt

SEQ ID NO: 7403005 - DNA, 22 bp, Homo sapiens
cccactgagcctatacaaacag

SEQ ID NO: 7403006 - DNA, 22 bp, Homo sapiens
cccactgagggttaatgcctgc

SEQ ID NO: 7403007 - DNA, 22 bp, Homo sapiens
cccactgagggttaatgcctgc

SEQ ID NO: 7403008 - DNA, 22 bp, Homo sapiens
aggctgtgacagggtcatggag

SEQ ID NO: 7403009 - DNA, 22 bp, Homo sapiens
cccactgctgctctccatggca

SEQ ID NO: 7403010 - DNA, 22 bp, Homo sapiens
cccactgctgcgccgggcgccg

SEQ ID NO: 7403011 - DNA, 22 bp, Homo sapiens
cccactgctgcgccgggcgccg

SEQ ID NO: 7403012 - DNA, 22 bp, Homo sapiens
cccactcctggagctagggctc

SEQ ID NO: 7403013 - DNA, 22 bp, Homo sapiens
cccactctggctcccttctagt

SEQ ID NO: 7403014 - DNA, 22 bp, Homo sapiens
cccactctccatgaggttccca

SEQ ID NO: 7403015 - DNA, 22 bp, Homo sapiens
cccactcctggagctagggctc

SEQ ID NO: 7403016 - DNA, 22 bp, Homo sapiens
cccactcctggagctagggctc

SEQ ID NO: 7403017 - DNA, 21 bp, Homo sapiens
aggctgtgacttacactatct

SEQ ID NO: 7403018 - DNA, 22 bp, Homo sapiens
aggctgtgactacgcagggaag

SEQ ID NO: 7403019 - DNA, 22 bp, Homo sapiens
aggctgtgcacagggcacctgc

SEQ ID NO: 7403020 - DNA, 22 bp, Homo sapiens
aggctgtgactacgcagggaag

SEQ ID NO: 7403021 - DNA, 22 bp, Homo sapiens
aggctgtgacagggtcatggag

SEQ ID NO: 7403022 - DNA, 22 bp, Homo sapiens
aggctgtgactacgcagggaag

SEQ ID NO: 7403023 - DNA, 22 bp, Homo sapiens
aggctgtgactacgcagggaag

SEQ ID NO: 7403024 - DNA, 22 bp, Homo sapiens
aggctgtgacagggtcatggag

SEQ ID NO: 7403025 - DNA, 22 bp, Homo sapiens
aggctgtgcacagggcacctgc

SEQ ID NO: 7403026 - DNA, 22 bp, Homo sapiens
aggctgtgcacagggcacctgc

SEQ ID NO: 7403027 - DNA, 22 bp, Homo sapiens
aggctgtgcacagggcacctgc

SEQ ID NO: 7403028 - DNA, 22 bp, Homo sapiens
aggctgtgcattttggagggcc

SEQ ID NO: 7403029 - DNA, 22 bp, Homo sapiens
aggctgtgcattttggagggcc

SEQ ID NO: 7403030 - DNA, 22 bp, Homo sapiens
aggctgtgcattttggagggcc

SEQ ID NO: 7403031 - DNA, 22 bp, Homo sapiens
aggctgtgcattttggagggcc

SEQ ID NO: 7403032 - DNA, 20 bp, Homo sapiens
cccagaggttgcggcaggag

SEQ ID NO: 7403033 - DNA, 20 bp, Homo sapiens
cccagaggttgcggcaggag

SEQ ID NO: 7403034 - DNA, 20 bp, Homo sapiens
cccagaggttgcggcaggag

SEQ ID NO: 7403035 - DNA, 20 bp, Homo sapiens
cccagaggttgcggcaggag

SEQ ID NO: 7403036 - DNA, 20 bp, Homo sapiens
cccagaggttgcggcaggag

SEQ ID NO: 7403037 - DNA, 20 bp, Homo sapiens
cccagaggttgcggcaggag

SEQ ID NO: 7403038 - DNA, 20 bp, Homo sapiens
cccagaggttgcggcaggag

SEQ ID NO: 7403039 - DNA, 20 bp, Homo sapiens
cccagaggttgcggcaggag

SEQ ID NO: 7403040 - DNA, 22 bp, Homo sapiens
cccagaggttccttagggacca

SEQ ID NO: 7403041 - DNA, 22 bp, Homo sapiens
cccagaggttccttagggacca

SEQ ID NO: 7403042 - DNA, 22 bp, Homo sapiens
cccagaggttccttagggacca

SEQ ID NO: 7403043 - DNA, 22 bp, Homo sapiens
cccagaggttccttagggacca

SEQ ID NO: 7403044 - DNA, 22 bp, Homo sapiens
cccagaggtgcttcagaggtgc

SEQ ID NO: 7403045 - DNA, 22 bp, Homo sapiens
cccagaggtgcttcagaggtgc

SEQ ID NO: 7403046 - DNA, 22 bp, Homo sapiens
cccagaggttccttagggacca

SEQ ID NO: 7403047 - DNA, 22 bp, Homo sapiens
cccagaggttccttagggacca

SEQ ID NO: 7403048 - DNA, 22 bp, Homo sapiens
cccagaggttccttagggacca

SEQ ID NO: 7403049 - DNA, 22 bp, Homo sapiens
cccagaggttccttagggacca

SEQ ID NO: 7403050 - DNA, 22 bp, Homo sapiens
cccagaggttccttagggacca

SEQ ID NO: 7403051 - DNA, 22 bp, Homo sapiens
cccagaggttccttagggacca

SEQ ID NO: 7403052 - DNA, 22 bp, Homo sapiens
cccagaggtgcttcagaggtgc

SEQ ID NO: 7403053 - DNA, 22 bp, Homo sapiens
cccagaggtgcttcagaggtgc

SEQ ID NO: 7403054 - DNA, 22 bp, Homo sapiens
cccagaggtgcttcagaggtgc

SEQ ID NO: 7403055 - DNA, 22 bp, Homo sapiens
aggctgtggtgctgaaggaggg

SEQ ID NO: 7403056 - DNA, 22 bp, Homo sapiens
aggctgtggtgctgaaggaggg

SEQ ID NO: 7403057 - DNA, 22 bp, Homo sapiens
aggctgtggtgctgaaggaggg

SEQ ID NO: 7403058 - DNA, 22 bp, Homo sapiens
aggctgtgggtgatttactgtg

SEQ ID NO: 7403059 - DNA, 22 bp, Homo sapiens
aggctgtggtgatgattgggtc

SEQ ID NO: 7403060 - DNA, 22 bp, Homo sapiens
aggctgtggtgatgattgggtc

SEQ ID NO: 7403061 - DNA, 22 bp, Homo sapiens
aggctgtggtgctgaaggaggg

SEQ ID NO: 7403062 - DNA, 22 bp, Homo sapiens
cccagaggtgcttcagaggtgc

SEQ ID NO: 7403063 - DNA, 22 bp, Homo sapiens
cccagaggtgcttcagaggtgc

SEQ ID NO: 7403064 - DNA, 22 bp, Homo sapiens
cccagaggtgcttcagaggtgc

SEQ ID NO: 7403065 - DNA, 22 bp, Homo sapiens
cccagaggtgcttcagaggtgc

SEQ ID NO: 7403066 - DNA, 22 bp, Homo sapiens
cccagaggtgacatcccattct

SEQ ID NO: 7403067 - DNA, 22 bp, Homo sapiens
cccagaggtgacatcccattct

SEQ ID NO: 7403068 - DNA, 22 bp, Homo sapiens
cccagaggtgacatcccattct

SEQ ID NO: 7403069 - DNA, 22 bp, Homo sapiens
cccagaggtgacatcccattct

SEQ ID NO: 7403070 - DNA, 22 bp, Homo sapiens
cccagaggtgacatcccattct

SEQ ID NO: 7403071 - DNA, 22 bp, Homo sapiens
cccagaggtgaaggaggtggga

SEQ ID NO: 7403072 - DNA, 22 bp, Homo sapiens
cccagaggtgaaggaggtggga

SEQ ID NO: 7403073 - DNA, 22 bp, Homo sapiens
aggctgtgcgaggtctcagagt

SEQ ID NO: 7403074 - DNA, 22 bp, Homo sapiens
aggctgtgctcagccaatggga

SEQ ID NO: 7403075 - DNA, 22 bp, Homo sapiens
aggctgtgcgaggtctcagagt

SEQ ID NO: 7403076 - DNA, 22 bp, Homo sapiens
aggctgtgcgaggtctcagagt

SEQ ID NO: 7403077 - DNA, 22 bp, Homo sapiens
aggctgtgcgaggtctcagagt

SEQ ID NO: 7403078 - DNA, 22 bp, Homo sapiens
aggctgtggccctggtctagca

SEQ ID NO: 7403079 - DNA, 22 bp, Homo sapiens
aggctgtggccctggtctagca

SEQ ID NO: 7403080 - DNA, 22 bp, Homo sapiens
aggctgtggcatcacatcagga

SEQ ID NO: 7403081 - DNA, 22 bp, Homo sapiens
aggctgtggcatcacatcagga

SEQ ID NO: 7403082 - DNA, 22 bp, Homo sapiens
aggctgtggatgcttaacaaat

SEQ ID NO: 7403083 - DNA, 22 bp, Homo sapiens
aggctgtgggaatggctgcttg

SEQ ID NO: 7403084 - DNA, 22 bp, Homo sapiens
aggctgtgggaatggctgcttg

SEQ ID NO: 7403085 - DNA, 22 bp, Homo sapiens
aggctgtgggaatggctgcttg

SEQ ID NO: 7403086 - DNA, 22 bp, Homo sapiens
aggctgtggccctggtctagca

SEQ ID NO: 7403087 - DNA, 22 bp, Homo sapiens
aggctgtggccctggtctagca

SEQ ID NO: 7403088 - DNA, 22 bp, Homo sapiens
aggctgtgggaatggctgcttg

SEQ ID NO: 7403089 - DNA, 22 bp, Homo sapiens
aggctgtgggagttgagagtct

SEQ ID NO: 7403090 - DNA, 22 bp, Homo sapiens
aggctgtgggagttgagagtct

SEQ ID NO: 7403091 - DNA, 22 bp, Homo sapiens
aggctgtgggagttgagagtct

SEQ ID NO: 7403092 - DNA, 22 bp, Homo sapiens
aggctgtgggacagttaggaga

SEQ ID NO: 7403093 - DNA, 22 bp, Homo sapiens
aggctgtgggacagttaggaga

SEQ ID NO: 7403094 - DNA, 22 bp, Homo sapiens
ccagtgtatttttgggacctgc

SEQ ID NO: 7403095 - DNA, 22 bp, Homo sapiens
ccagtgtatttttgggacctgc

SEQ ID NO: 7403096 - DNA, 22 bp, Homo sapiens
ccagtgtcagaaagattatcct

SEQ ID NO: 7403097 - DNA, 22 bp, Homo sapiens
ccagtgtcagaaagattatcct

SEQ ID NO: 7403098 - DNA, 22 bp, Homo sapiens
ccagtgtccttcctttccatgg

SEQ ID NO: 7403099 - DNA, 22 bp, Homo sapiens
ccagtgtctagcagatgacagg

SEQ ID NO: 7403100 - DNA, 22 bp, Homo sapiens
ccagtgtctagcagatgacagg

SEQ ID NO: 7403101 - DNA, 22 bp, Homo sapiens
ccagtgtctagcagatgacagg

SEQ ID NO: 7403102 - DNA, 22 bp, Homo sapiens
ccagtgtccttcctttccatgg

SEQ ID NO: 7403103 - DNA, 22 bp, Homo sapiens
ccagtgtctactgtggcatatc

SEQ ID NO: 7403104 - DNA, 22 bp, Homo sapiens
ccagtgtctactgtggcatatc

SEQ ID NO: 7403105 - DNA, 22 bp, Homo sapiens
ccagtgtctactgtggcatatc

SEQ ID NO: 7403106 - DNA, 22 bp, Homo sapiens
ccagtgtgaaaggtcatttatc

SEQ ID NO: 7403107 - DNA, 22 bp, Homo sapiens
ccagtgtgaaaggtcatttatc

SEQ ID NO: 7403108 - DNA, 22 bp, Homo sapiens
ccagtgtcttcagagtaaatct

SEQ ID NO: 7403109 - DNA, 22 bp, Homo sapiens
ccagtgtcttcagagtaaatct

SEQ ID NO: 7403110 - DNA, 22 bp, Homo sapiens
ccagtgtcttcagagtaaatct

SEQ ID NO: 7403111 - DNA, 22 bp, Homo sapiens
ccagtgtgaaaggtcatttatc

SEQ ID NO: 7403112 - DNA, 22 bp, Homo sapiens
ccagtgtgaaaggtcatttatc

SEQ ID NO: 7403113 - DNA, 19 bp, Homo sapiens
ccagtgtctagcgcacagc

SEQ ID NO: 7403114 - DNA, 19 bp, Homo sapiens
ccagtgtctagcgcacagc

SEQ ID NO: 7403115 - DNA, 22 bp, Homo sapiens
ccagtgtctagtcacaggtact

SEQ ID NO: 7403116 - DNA, 22 bp, Homo sapiens
ccagtgtctagtcacaggtact

SEQ ID NO: 7403117 - DNA, 22 bp, Homo sapiens
ccagtgtctagtcacaggtact

SEQ ID NO: 7403118 - DNA, 22 bp, Homo sapiens
ccagtgtctgtggtatagaaag

SEQ ID NO: 7403119 - DNA, 22 bp, Homo sapiens
ccagtgtctgtggtatagaaag

SEQ ID NO: 7403120 - DNA, 22 bp, Homo sapiens
ccagtgtctgtggtatagaaag

SEQ ID NO: 7403121 - DNA, 22 bp, Homo sapiens
ccattttctgcagctgccgcgg

SEQ ID NO: 7403122 - DNA, 22 bp, Homo sapiens
ccattttgtctcctgaaatcta

SEQ ID NO: 7403123 - DNA, 22 bp, Homo sapiens
ccattttgtctgacttcttgct

SEQ ID NO: 7403124 - DNA, 22 bp, Homo sapiens
ccattttgtctgacttcttgct

SEQ ID NO: 7403125 - DNA, 22 bp, Homo sapiens
cccaagtctggcagaattaaac

SEQ ID NO: 7403126 - DNA, 22 bp, Homo sapiens
cccaagttgcttgttccaagac

SEQ ID NO: 7403127 - DNA, 22 bp, Homo sapiens
ccagtgtgattgttgcaagaat

SEQ ID NO: 7403128 - DNA, 22 bp, Homo sapiens
ccagtgtgattgttgcaagaat

SEQ ID NO: 7403129 - DNA, 22 bp, Homo sapiens
ccagtgtgaccatctgttagct

SEQ ID NO: 7403130 - DNA, 22 bp, Homo sapiens
ccagtgtgaacctcaccaccct

SEQ ID NO: 7403131 - DNA, 22 bp, Homo sapiens
ccagtgtgaacctcaccaccct

SEQ ID NO: 7403132 - DNA, 22 bp, Homo sapiens
ccagtgtgaccatctgttagct

SEQ ID NO: 7403133 - DNA, 22 bp, Homo sapiens
ccagtgtgaccatctgttagct

SEQ ID NO: 7403134 - DNA, 22 bp, Homo sapiens
ccagtgtgaacctcaccaccct

SEQ ID NO: 7403135 - DNA, 22 bp, Homo sapiens
ccagtgtgcaatctctggctta

SEQ ID NO: 7403136 - DNA, 22 bp, Homo sapiens
ccagtgtgcaatctctggctta

SEQ ID NO: 7403137 - DNA, 22 bp, Homo sapiens
ccagtgtgattgttgcaagaat

SEQ ID NO: 7403138 - DNA, 22 bp, Homo sapiens
ccagtgtgattgttgcaagaat

SEQ ID NO: 7403139 - DNA, 22 bp, Homo sapiens
ccattttattagtgacatttag

SEQ ID NO: 7403140 - DNA, 22 bp, Homo sapiens
cccacacatttttcacttaccg

SEQ ID NO: 7403141 - DNA, 22 bp, Homo sapiens
cccacacatttttcacttaccg

SEQ ID NO: 7403142 - DNA, 22 bp, Homo sapiens
cccacacatttttcacttaccg

SEQ ID NO: 7403143 - DNA, 22 bp, Homo sapiens
cccacacatttttcacttaccg

SEQ ID NO: 7403144 - DNA, 22 bp, Homo sapiens
cccacacatttttcacttaccg

SEQ ID NO: 7403145 - DNA, 22 bp, Homo sapiens
cccacacatttttcacttaccg

SEQ ID NO: 7403146 - DNA, 22 bp, Homo sapiens
cccacacatttttcacttaccg

SEQ ID NO: 7403147 - DNA, 20 bp, Homo sapiens
cccacacccttcccacttgg

SEQ ID NO: 7403148 - DNA, 22 bp, Homo sapiens
cccacacatttttcacttaccg

SEQ ID NO: 7403149 - DNA, 18 bp, Homo sapiens
cccacacagcagtagctc

SEQ ID NO: 7403150 - DNA, 18 bp, Homo sapiens
cccacacagcagtagctc

SEQ ID NO: 7403151 - DNA, 18 bp, Homo sapiens
cccacacagcagtagctc

SEQ ID NO: 7403152 - DNA, 18 bp, Homo sapiens
cccacacagcagtagctc

SEQ ID NO: 7403153 - DNA, 18 bp, Homo sapiens
cccacacagcagtagctc

SEQ ID NO: 7403154 - DNA, 18 bp, Homo sapiens
cccacacagcagtagctc

SEQ ID NO: 7403155 - DNA, 18 bp, Homo sapiens
cccacacagcagtagctc

SEQ ID NO: 7403156 - DNA, 22 bp, Homo sapiens
cccacacacatttatgatagga

SEQ ID NO: 7403157 - DNA, 22 bp, Homo sapiens
cccacacaaatcatggggagaa

SEQ ID NO: 7403158 - DNA, 22 bp, Homo sapiens
cccacacaaatcatggggagaa

SEQ ID NO: 7403159 - DNA, 22 bp, Homo sapiens
cccaataaaattcattttcatt

SEQ ID NO: 7403160 - DNA, 22 bp, Homo sapiens
cccaataaaattcattttcatt

SEQ ID NO: 7403161 - DNA, 22 bp, Homo sapiens
cccaatggctggatggagggat

SEQ ID NO: 7403162 - DNA, 22 bp, Homo sapiens
cccaatggctggatggagggat

SEQ ID NO: 7403163 - DNA, 22 bp, Homo sapiens
cccacacacatttatgatagga

SEQ ID NO: 7403164 - DNA, 22 bp, Homo sapiens
cccacacacatttatgatagga

SEQ ID NO: 7403165 - DNA, 22 bp, Homo sapiens
cccacacactggctgctgccaa

SEQ ID NO: 7403166 - DNA, 22 bp, Homo sapiens
cccacacactggctgctgccaa

SEQ ID NO: 7403167 - DNA, 22 bp, Homo sapiens
cccacacactggctgctgccaa

SEQ ID NO: 7403168 - DNA, 22 bp, Homo sapiens
aggctgccctgccgccagtggg

SEQ ID NO: 7403169 - DNA, 22 bp, Homo sapiens
aggctgccctgccgccagtggg

SEQ ID NO: 7403170 - DNA, 22 bp, Homo sapiens
aggctgccctgccgccagtggg

SEQ ID NO: 7403171 - DNA, 22 bp, Homo sapiens
aggctgccctgccgccagtggg

SEQ ID NO: 7403172 - DNA, 22 bp, Homo sapiens
aggctgccctgccgccagtggg

SEQ ID NO: 7403173 - DNA, 22 bp, Homo sapiens
aggctgccctgccgccagtggg

SEQ ID NO: 7403174 - DNA, 22 bp, Homo sapiens
aggctgccctgccgccagtggg

SEQ ID NO: 7403175 - DNA, 22 bp, Homo sapiens
aggctgccgcagccaatggttg

SEQ ID NO: 7403176 - DNA, 22 bp, Homo sapiens
aggctgccgcagccaatggttg

SEQ ID NO: 7403177 - DNA, 22 bp, Homo sapiens
aggctgccgcagccaatggttg

SEQ ID NO: 7403178 - DNA, 22 bp, Homo sapiens
aggctgccgcagccaatggttg

SEQ ID NO: 7403179 - DNA, 22 bp, Homo sapiens
aggctgccgcagccaatggttg

SEQ ID NO: 7403180 - DNA, 22 bp, Homo sapiens
aggctgccatagggaactgcat

SEQ ID NO: 7403181 - DNA, 22 bp, Homo sapiens
aggctgccatagggaactgcat

SEQ ID NO: 7403182 - DNA, 20 bp, Homo sapiens
aggctgccaggtctcacatc

SEQ ID NO: 7403183 - DNA, 19 bp, Homo sapiens
aggctgcccagtctctgcc

SEQ ID NO: 7403184 - DNA, 19 bp, Homo sapiens
aggctgcccagtctctgcc

SEQ ID NO: 7403185 - DNA, 19 bp, Homo sapiens
aggctgcccagtctctgcc

SEQ ID NO: 7403186 - DNA, 19 bp, Homo sapiens
aggctgcccagtctctgcc

SEQ ID NO: 7403187 - DNA, 19 bp, Homo sapiens
aggctgcccagtctctgcc

SEQ ID NO: 7403188 - DNA, 19 bp, Homo sapiens
aggctgcccagtctctgcc

SEQ ID NO: 7403189 - DNA, 19 bp, Homo sapiens
aggctgcccagtctctgcc

SEQ ID NO: 7403190 - DNA, 22 bp, Homo sapiens
ccagtgggtaggccatggtgag

SEQ ID NO: 7403191 - DNA, 22 bp, Homo sapiens
ccagtgggtgctgggctctgcc

SEQ ID NO: 7403192 - DNA, 22 bp, Homo sapiens
ccagtgtagctcaggactgggc

SEQ ID NO: 7403193 - DNA, 22 bp, Homo sapiens
ccagtgtattatttgagaaatt

SEQ ID NO: 7403194 - DNA, 22 bp, Homo sapiens
ccagtgtattatttgagaaatt

SEQ ID NO: 7403195 - DNA, 22 bp, Homo sapiens
ccagtggtgaatccagggatgt

SEQ ID NO: 7403196 - DNA, 22 bp, Homo sapiens
ccagtggtgaatccagggatgt

SEQ ID NO: 7403197 - DNA, 22 bp, Homo sapiens
ccagtggtgaatccagggatgt

SEQ ID NO: 7403198 - DNA, 22 bp, Homo sapiens
ccagtggtgaatccagggatgt

SEQ ID NO: 7403199 - DNA, 22 bp, Homo sapiens
ccagtgggagggagctaggcca

SEQ ID NO: 7403200 - DNA, 22 bp, Homo sapiens
ccagtgggagggagctaggcca

SEQ ID NO: 7403201 - DNA, 22 bp, Homo sapiens
ccagtgggtaggccatggtgag

SEQ ID NO: 7403202 - DNA, 22 bp, Homo sapiens
ccagtgggtaggccatggtgag

SEQ ID NO: 7403203 - DNA, 22 bp, Homo sapiens
ccagtgggtaggccatggtgag

SEQ ID NO: 7403204 - DNA, 20 bp, Homo sapiens
ccagtgggaagtgattaggt

SEQ ID NO: 7403205 - DNA, 22 bp, Homo sapiens
aggctgccgcagccaatggttg

SEQ ID NO: 7403206 - DNA, 22 bp, Homo sapiens
ccagtgggagggagctaggcca

SEQ ID NO: 7403207 - DNA, 22 bp, Homo sapiens
ccagtgggagggagctaggcca

SEQ ID NO: 7403208 - DNA, 20 bp, Homo sapiens
aggctgcctaaggctctgca

SEQ ID NO: 7403209 - DNA, 22 bp, Homo sapiens
ccagtgggagggagctaggcca

SEQ ID NO: 7403210 - DNA, 22 bp, Homo sapiens
aggctgcaggtctgggtcatgt

SEQ ID NO: 7403211 - DNA, 22 bp, Homo sapiens
aggctgcaggtctgggtcatgt

SEQ ID NO: 7403212 - DNA, 22 bp, Homo sapiens
aggctgcaggtctgggtcatgt

SEQ ID NO: 7403213 - DNA, 22 bp, Homo sapiens
aggctgcagtgcaggtaggatt

SEQ ID NO: 7403214 - DNA, 22 bp, Homo sapiens
aggctgcagtgcaggtaggatt

SEQ ID NO: 7403215 - DNA, 22 bp, Homo sapiens
aggctgcagtgcaggtaggatt

SEQ ID NO: 7403216 - DNA, 22 bp, Homo sapiens
aggctgcagtgcaggtaggatt

SEQ ID NO: 7403217 - DNA, 22 bp, Homo sapiens
aggctgcagtgcaggtaggatt

SEQ ID NO: 7403218 - DNA, 23 bp, Homo sapiens
aggctgcagaagaatagggtcat

SEQ ID NO: 7403219 - DNA, 22 bp, Homo sapiens
aggctgagtgctcccctagatg

SEQ ID NO: 7403220 - DNA, 20 bp, Homo sapiens
aggctgccaggtctcacatc

SEQ ID NO: 7403221 - DNA, 20 bp, Homo sapiens
aggctgccaggtctcacatc

SEQ ID NO: 7403222 - DNA, 20 bp, Homo sapiens
aggctgccaggtctcacatc

SEQ ID NO: 7403223 - DNA, 20 bp, Homo sapiens
aggctgccaggtctcacatc

SEQ ID NO: 7403224 - DNA, 20 bp, Homo sapiens
aggctgccaggtctcacatc

SEQ ID NO: 7403225 - DNA, 23 bp, Homo sapiens
aggctgccagaaattgggtaagg

SEQ ID NO: 7403226 - DNA, 22 bp, Homo sapiens
aggctgccagaagccttcagga

SEQ ID NO: 7403227 - DNA, 22 bp, Homo sapiens
aggctgccagaagccttcagga

SEQ ID NO: 7403228 - DNA, 22 bp, Homo sapiens
aggctgccagaagccttcagga

SEQ ID NO: 7403229 - DNA, 22 bp, Homo sapiens
aggctgccagaagccttcagga

SEQ ID NO: 7403230 - DNA, 23 bp, Homo sapiens
aggctgccagaaattgggtaagg

SEQ ID NO: 7403231 - DNA, 23 bp, Homo sapiens
aggctgccagaaattgggtaagg

SEQ ID NO: 7403232 - DNA, 21 bp, Homo sapiens
aggctgcatttatatggtgtg

SEQ ID NO: 7403233 - DNA, 22 bp, Homo sapiens
aggctgccaaagcttctgtctc

SEQ ID NO: 7403234 - DNA, 22 bp, Homo sapiens
aggctgccaaagcttctgtctc

SEQ ID NO: 7403235 - DNA, 21 bp, Homo sapiens
aggctgcatgcatgagtgtgg

SEQ ID NO: 7403236 - DNA, 22 bp, Homo sapiens
aggctgcagtgcaggtaggatt

SEQ ID NO: 7403237 - DNA, 22 bp, Homo sapiens
ccagggcagccaacccagatgc

SEQ ID NO: 7403238 - DNA, 22 bp, Homo sapiens
ccagggcagccaacccagatgc

SEQ ID NO: 7403239 - DNA, 22 bp, Homo sapiens
ccagggcagcagaattggggca

SEQ ID NO: 7403240 - DNA, 22 bp, Homo sapiens
ccagggcagcagaattggggca

SEQ ID NO: 7403241 - DNA, 22 bp, Homo sapiens
ccagggcagcgcccctccacgc

SEQ ID NO: 7403242 - DNA, 22 bp, Homo sapiens
ccagggcagcgcccctccacgc

SEQ ID NO: 7403243 - DNA, 22 bp, Homo sapiens
ccagggcagcgcccctccacgc

SEQ ID NO: 7403244 - DNA, 22 bp, Homo sapiens
ccagggcagccaacccagatgc

SEQ ID NO: 7403245 - DNA, 22 bp, Homo sapiens
ccagggcagccaacccagatgc

SEQ ID NO: 7403246 - DNA, 22 bp, Homo sapiens
ccagggcagccaacccagatgc

SEQ ID NO: 7403247 - DNA, 22 bp, Homo sapiens
ccagggcagccaacccagatgc

SEQ ID NO: 7403248 - DNA, 16 bp, Homo sapiens
ccaggtggggctgtga

SEQ ID NO: 7403249 - DNA, 22 bp, Homo sapiens
ccaggtggtgaaagtgggccct

SEQ ID NO: 7403250 - DNA, 22 bp, Homo sapiens
ccaggtggtgaaagtgggccct

SEQ ID NO: 7403251 - DNA, 16 bp, Homo sapiens
ccaggtggggctgtga

SEQ ID NO: 7403252 - DNA, 22 bp, Homo sapiens
ccaggtggtgaaagtgggccct

SEQ ID NO: 7403253 - DNA, 16 bp, Homo sapiens
ccaggtggggctgtga

SEQ ID NO: 7403254 - DNA, 22 bp, Homo sapiens
ccaggtgggcgtgtcttcacct

SEQ ID NO: 7403255 - DNA, 22 bp, Homo sapiens
ccaggtgggcgtgtcttcacct

SEQ ID NO: 7403256 - DNA, 22 bp, Homo sapiens
ccaggtgggcgtgtcttcacct

SEQ ID NO: 7403257 - DNA, 22 bp, Homo sapiens
ccaggtgctagcaatcactgtc

SEQ ID NO: 7403258 - DNA, 22 bp, Homo sapiens
ccaggtgctagcaatcactgtc

SEQ ID NO: 7403259 - DNA, 22 bp, Homo sapiens
ccaggtgctagcaatcactgtc

SEQ ID NO: 7403260 - DNA, 22 bp, Homo sapiens
ccaggtgcctccagtcacagtg

SEQ ID NO: 7403261 - DNA, 22 bp, Homo sapiens
ccaggtgcaaactcccagcagg

SEQ ID NO: 7403262 - DNA, 22 bp, Homo sapiens
ccaggtgcaaactcccagcagg

SEQ ID NO: 7403263 - DNA, 22 bp, Homo sapiens
ccaggtgcaaactcccagcagg

SEQ ID NO: 7403264 - DNA, 22 bp, Homo sapiens
ccaggtgcactcaagacctgct

SEQ ID NO: 7403265 - DNA, 22 bp, Homo sapiens
ccaggtgcactcaagacctgct

SEQ ID NO: 7403266 - DNA, 22 bp, Homo sapiens
ccaggtgcctccagtcacagtg

SEQ ID NO: 7403267 - DNA, 22 bp, Homo sapiens
ccagggcagaaaaagagggaat

SEQ ID NO: 7403268 - DNA, 22 bp, Homo sapiens
ccagggcagaaaaagagggaat

SEQ ID NO: 7403269 - DNA, 22 bp, Homo sapiens
ccagggcagaaaaagagggaat

SEQ ID NO: 7403270 - DNA, 22 bp, Homo sapiens
ccagggcagaaaaagagggaat

SEQ ID NO: 7403271 - DNA, 22 bp, Homo sapiens
ccagggcagaaaaagagggaat

SEQ ID NO: 7403272 - DNA, 22 bp, Homo sapiens
ccagggcacttaggcccagccc

SEQ ID NO: 7403273 - DNA, 22 bp, Homo sapiens
ccagggcacttaggcccagccc

SEQ ID NO: 7403274 - DNA, 22 bp, Homo sapiens
ccagggcacttaggcccagccc

SEQ ID NO: 7403275 - DNA, 22 bp, Homo sapiens
ccagggcacttaggcccagccc

SEQ ID NO: 7403276 - DNA, 22 bp, Homo sapiens
ccagggcagcagaattggggca

SEQ ID NO: 7403277 - DNA, 22 bp, Homo sapiens
ccagggcagaaaaagagggaat

SEQ ID NO: 7403278 - DNA, 22 bp, Homo sapiens
ccagggcagaaaaagagggaat

SEQ ID NO: 7403279 - DNA, 22 bp, Homo sapiens
ccagggcagaaaaagagggaat

SEQ ID NO: 7403280 - DNA, 22 bp, Homo sapiens
ccagggcagaaaaagagggaat

SEQ ID NO: 7403281 - DNA, 22 bp, Homo sapiens
ccagggcagaaaaagagggaat

SEQ ID NO: 7403282 - DNA, 19 bp, Homo sapiens
aggctctgtaggagagggc

SEQ ID NO: 7403283 - DNA, 22 bp, Homo sapiens
aggctctggttggcaagtaaag

SEQ ID NO: 7403284 - DNA, 19 bp, Homo sapiens
aggctctgtaggagagggc

SEQ ID NO: 7403285 - DNA, 22 bp, Homo sapiens
aggctctgtatgaaggtttggg

SEQ ID NO: 7403286 - DNA, 19 bp, Homo sapiens
aggctctgtaggagagggc

SEQ ID NO: 7403287 - DNA, 19 bp, Homo sapiens
aggctctgtaggagagggc

SEQ ID NO: 7403288 - DNA, 22 bp, Homo sapiens
aggctctgtatgaaggtttggg

SEQ ID NO: 7403289 - DNA, 22 bp, Homo sapiens
aggctctgtcaggcggagcagc

SEQ ID NO: 7403290 - DNA, 22 bp, Homo sapiens
aggctctgtcaggcggagcagc

SEQ ID NO: 7403291 - DNA, 22 bp, Homo sapiens
aggctctgtcaggcggagcagc

SEQ ID NO: 7403292 - DNA, 22 bp, Homo sapiens
aggctctgtcaggcggagcagc

SEQ ID NO: 7403293 - DNA, 22 bp, Homo sapiens
ccagggcacttaggcccagccc

SEQ ID NO: 7403294 - DNA, 22 bp, Homo sapiens
ccagggcacttaggcccagccc

SEQ ID NO: 7403295 - DNA, 22 bp, Homo sapiens
ccagggcacttaggcccagccc

SEQ ID NO: 7403296 - DNA, 22 bp, Homo sapiens
ccagggcacttaggcccagccc

SEQ ID NO: 7403297 - DNA, 22 bp, Homo sapiens
ccagggcacttaggcccagccc

SEQ ID NO: 7403298 - DNA, 22 bp, Homo sapiens
ccagggcacttaggcccagccc

SEQ ID NO: 7403299 - DNA, 22 bp, Homo sapiens
ccaggttcaaatagctgtgtga

SEQ ID NO: 7403300 - DNA, 22 bp, Homo sapiens
ccaggtgtttggcctgcatgat

SEQ ID NO: 7403301 - DNA, 22 bp, Homo sapiens
ccaggttcaaatagctgtgtga

SEQ ID NO: 7403302 - DNA, 23 bp, Homo sapiens
ccagtaaacccttcctcagtgtc

SEQ ID NO: 7403303 - DNA, 23 bp, Homo sapiens
ccagtaaacccttcctcagtgtc

SEQ ID NO: 7403304 - DNA, 22 bp, Homo sapiens
ccagtaaaccaagtgtttacta

SEQ ID NO: 7403305 - DNA, 22 bp, Homo sapiens
ccagtaaaaagcgacaggaagt

SEQ ID NO: 7403306 - DNA, 22 bp, Homo sapiens
ccagtaaaaagcgacaggaagt

SEQ ID NO: 7403307 - DNA, 22 bp, Homo sapiens
ccagtacatcgcatggtgacca

SEQ ID NO: 7403308 - DNA, 18 bp, Homo sapiens
ccagtacctcctcctctc

SEQ ID NO: 7403309 - DNA, 18 bp, Homo sapiens
ccagtacctcctcctctc

SEQ ID NO: 7403310 - DNA, 22 bp, Homo sapiens
ccagtactgtctccaatattcc

SEQ ID NO: 7403311 - DNA, 22 bp, Homo sapiens
ccagtactgtctccaatattcc

SEQ ID NO: 7403312 - DNA, 22 bp, Homo sapiens
ccagtactttgtgcaacaaatg

SEQ ID NO: 7403313 - DNA, 22 bp, Homo sapiens
ccagtacacctcacttcccttt

SEQ ID NO: 7403314 - DNA, 22 bp, Homo sapiens
ccagtacatcgcatggtgacca

SEQ ID NO: 7403315 - DNA, 22 bp, Homo sapiens
ccagtaatggaaatagcagttc

SEQ ID NO: 7403316 - DNA, 22 bp, Homo sapiens
ccagtaaattacttgatgtcat

SEQ ID NO: 7403317 - DNA, 22 bp, Homo sapiens
ccagtaaattacttgatgtcat

SEQ ID NO: 7403318 - DNA, 23 bp, Homo sapiens
ccagtaaacccttcctcagtgtc

SEQ ID NO: 7403319 - DNA, 21 bp, Homo sapiens
ccagtattatttctctatgta

SEQ ID NO: 7403320 - DNA, 21 bp, Homo sapiens
ccagtattatttctctatgta

SEQ ID NO: 7403321 - DNA, 22 bp, Homo sapiens
ccagtattcgatctggccagtt

SEQ ID NO: 7403322 - DNA, 22 bp, Homo sapiens
ccagtattgtgaaattgatgtc

SEQ ID NO: 7403323 - DNA, 17 bp, Homo sapiens
ccagtcacaccaccctt

SEQ ID NO: 7403324 - DNA, 22 bp, Homo sapiens
ccagtattgtgaaattgatgtc

SEQ ID NO: 7403325 - DNA, 22 bp, Homo sapiens
ccagtattgtgaaattgatgtc

SEQ ID NO: 7403326 - DNA, 22 bp, Homo sapiens
aggctgagtcgggaggatcact

SEQ ID NO: 7403327 - DNA, 17 bp, Homo sapiens
ccagtcacaccaccctt

SEQ ID NO: 7403328 - DNA, 17 bp, Homo sapiens
ccagtcacaccaccctt

SEQ ID NO: 7403329 - DNA, 22 bp, Homo sapiens
aggctgagtgctcccctagatg

SEQ ID NO: 7403330 - DNA, 22 bp, Homo sapiens
ccagtcacaggtgtgtttatat

SEQ ID NO: 7403331 - DNA, 22 bp, Homo sapiens
ccagtagttggacaaatagatt

SEQ ID NO: 7403332 - DNA, 22 bp, Homo sapiens
ccagtagttccaggaacctcct

SEQ ID NO: 7403333 - DNA, 22 bp, Homo sapiens
ccagtagttccaggaacctcct

SEQ ID NO: 7403334 - DNA, 22 bp, Homo sapiens
ccagtagttggacaaatagatt

SEQ ID NO: 7403335 - DNA, 22 bp, Homo sapiens
ccagtagttggacaaatagatt

SEQ ID NO: 7403336 - DNA, 19 bp, Homo sapiens
ccagtagtatagcacagtc

SEQ ID NO: 7403337 - DNA, 22 bp, Homo sapiens
ccagtagtagctctttgtgctc

SEQ ID NO: 7403338 - DNA, 22 bp, Homo sapiens
ccagtagtagtttgttctttaa

SEQ ID NO: 7403339 - DNA, 19 bp, Homo sapiens
ccagtagtatagcacagtc

SEQ ID NO: 7403340 - DNA, 19 bp, Homo sapiens
ccagtagtatagcacagtc

SEQ ID NO: 7403341 - DNA, 17 bp, Homo sapiens
ccagtagcctgagatgt

SEQ ID NO: 7403342 - DNA, 17 bp, Homo sapiens
ccagtagcctgagatgt

SEQ ID NO: 7403343 - DNA, 22 bp, Homo sapiens
ccagtagaaagcaacgtggcat

SEQ ID NO: 7403344 - DNA, 17 bp, Homo sapiens
ccagtagcctgagatgt

SEQ ID NO: 7403345 - DNA, 19 bp, Homo sapiens
ccagtagagacagctgcag

SEQ ID NO: 7403346 - DNA, 22 bp, Homo sapiens
ccagtagaaagcaacgtggcat

SEQ ID NO: 7403347 - DNA, 20 bp, Homo sapiens
ccaggtggtgcctggagagg

SEQ ID NO: 7403348 - DNA, 20 bp, Homo sapiens
ccaggtggtgcctggagagg

SEQ ID NO: 7403349 - DNA, 20 bp, Homo sapiens
ccaggtggtgcctggagagg

SEQ ID NO: 7403350 - DNA, 22 bp, Homo sapiens
ccaggtggttcaggtcaccata

SEQ ID NO: 7403351 - DNA, 22 bp, Homo sapiens
ccaggtggttcaggtcaccata

SEQ ID NO: 7403352 - DNA, 22 bp, Homo sapiens
ccaggtgtttggcctgcatgat

SEQ ID NO: 7403353 - DNA, 22 bp, Homo sapiens
ccaggtgttctttgtccctgtt

SEQ ID NO: 7403354 - DNA, 22 bp, Homo sapiens
ccaggtgttctttgtccctgtt

SEQ ID NO: 7403355 - DNA, 22 bp, Homo sapiens
ccaggtgttctttgtccctgtt

SEQ ID NO: 7403356 - DNA, 22 bp, Homo sapiens
ccaggtgttacacgagtgttaa

SEQ ID NO: 7403357 - DNA, 22 bp, Homo sapiens
ccaggtgttctttgtccctgtt

SEQ ID NO: 7403358 - DNA, 22 bp, Homo sapiens
ccaggtgtgtctggccccgaag

SEQ ID NO: 7403359 - DNA, 22 bp, Homo sapiens
ccaggtggtgaaagtgggccct

SEQ ID NO: 7403360 - DNA, 18 bp, Homo sapiens
ccaggtggtgacagagat

SEQ ID NO: 7403361 - DNA, 18 bp, Homo sapiens
ccaggtggtgacagagat

SEQ ID NO: 7403362 - DNA, 18 bp, Homo sapiens
ccaggtggtgacagagat

SEQ ID NO: 7403363 - DNA, 22 bp, Homo sapiens
ccaggtggtgaaagtgggccct

SEQ ID NO: 7403364 - DNA, 18 bp, Homo sapiens
ccaggtggtgacagagat

SEQ ID NO: 7403365 - DNA, 18 bp, Homo sapiens
ccaggtggtgacagagat

SEQ ID NO: 7403366 - DNA, 20 bp, Homo sapiens
ccaggtggtgcctggagagg

SEQ ID NO: 7403367 - DNA, 22 bp, Homo sapiens
ccaggtggtgcctctgttcgca

SEQ ID NO: 7403368 - DNA, 18 bp, Homo sapiens
ccaggtggtgacagagat

SEQ ID NO: 7403369 - DNA, 18 bp, Homo sapiens
ccaggtggtgacagagat

SEQ ID NO: 7403370 - DNA, 20 bp, Homo sapiens
ccaggtggtgcctggagagg

SEQ ID NO: 7403371 - DNA, 22 bp, Homo sapiens
ccaggtggtgcctctgttcgca

SEQ ID NO: 7403372 - DNA, 20 bp, Homo sapiens
ccaggtggtgcctggagagg

SEQ ID NO: 7403373 - DNA, 20 bp, Homo sapiens
ccaggtggtgcctggagagg

SEQ ID NO: 7403374 - DNA, 20 bp, Homo sapiens
ccaggcctgggcctgctcta

SEQ ID NO: 7403375 - DNA, 20 bp, Homo sapiens
ccaggcctgggcctgctcta

SEQ ID NO: 7403376 - DNA, 20 bp, Homo sapiens
ccaggcctgggcctgctcta

SEQ ID NO: 7403377 - DNA, 20 bp, Homo sapiens
ccaggcctgggcctgctcta

SEQ ID NO: 7403378 - DNA, 20 bp, Homo sapiens
ccaggcctgggcctgctcta

SEQ ID NO: 7403379 - DNA, 20 bp, Homo sapiens
ccaggcctgggcctgctcta

SEQ ID NO: 7403380 - DNA, 20 bp, Homo sapiens
ccaggcctgggcctgctcta

SEQ ID NO: 7403381 - DNA, 20 bp, Homo sapiens
ccaggcctgggcctgctcta

SEQ ID NO: 7403382 - DNA, 22 bp, Homo sapiens
ccaggcctcccttttccagcca

SEQ ID NO: 7403383 - DNA, 22 bp, Homo sapiens
ccaggcctcccttttccagcca

SEQ ID NO: 7403384 - DNA, 22 bp, Homo sapiens
ccaggcctcccttttccagcca

SEQ ID NO: 7403385 - DNA, 22 bp, Homo sapiens
ccaggcctcacctgcccaccta

SEQ ID NO: 7403386 - DNA, 22 bp, Homo sapiens
ccaggcctcccttttccagcca

SEQ ID NO: 7403387 - DNA, 22 bp, Homo sapiens
ccaggcctcacctgcccaccta

SEQ ID NO: 7403388 - DNA, 22 bp, Homo sapiens
ccaggccttccagtacgcagaa

SEQ ID NO: 7403389 - DNA, 22 bp, Homo sapiens
ccaggccttccagtacgcagaa

SEQ ID NO: 7403390 - DNA, 22 bp, Homo sapiens
ccaggccttccagtacgcagaa

SEQ ID NO: 7403391 - DNA, 22 bp, Homo sapiens
ccaggcctgtgcaaggagggag

SEQ ID NO: 7403392 - DNA, 22 bp, Homo sapiens
ccaggcctgtgttgtgtggagg

SEQ ID NO: 7403393 - DNA, 22 bp, Homo sapiens
ccaggcctgtgttgtgtggagg

SEQ ID NO: 7403394 - DNA, 22 bp, Homo sapiens
ccaggcctgtgttgtgtggagg

SEQ ID NO: 7403395 - DNA, 22 bp, Homo sapiens
ccaggcctgtgcaaggagggag

SEQ ID NO: 7403396 - DNA, 22 bp, Homo sapiens
ccaggcctgtgcaaggagggag

SEQ ID NO: 7403397 - DNA, 22 bp, Homo sapiens
ccaggcctgtgcaaggagggag

SEQ ID NO: 7403398 - DNA, 22 bp, Homo sapiens
ccaggcctgtgttgtgtggagg

SEQ ID NO: 7403399 - DNA, 22 bp, Homo sapiens
ccaggcctgtgcaaggagggag

SEQ ID NO: 7403400 - DNA, 22 bp, Homo sapiens
ccaggcctgtgcaaggagggag

SEQ ID NO: 7403401 - DNA, 22 bp, Homo sapiens
ccaggcctgtgcaaggagggag

SEQ ID NO: 7403402 - DNA, 22 bp, Homo sapiens
ccaggcgtggcttcagcagccc

SEQ ID NO: 7403403 - DNA, 22 bp, Homo sapiens
ccaggcctttcttcttggtctg

SEQ ID NO: 7403404 - DNA, 22 bp, Homo sapiens
ccaggcctttcttcttggtctg

SEQ ID NO: 7403405 - DNA, 22 bp, Homo sapiens
aggctcagatccttgtgtcctg

SEQ ID NO: 7403406 - DNA, 22 bp, Homo sapiens
ccaggcctttcttcttggtctg

SEQ ID NO: 7403407 - DNA, 22 bp, Homo sapiens
ccaggcgtggcttcagcagccc

SEQ ID NO: 7403408 - DNA, 20 bp, Homo sapiens
aggctcagatacccagggaa

SEQ ID NO: 7403409 - DNA, 22 bp, Homo sapiens
aggctcagattcacatttggtt

SEQ ID NO: 7403410 - DNA, 22 bp, Homo sapiens
aggctcagattcacatttggtt

SEQ ID NO: 7403411 - DNA, 22 bp, Homo sapiens
aggctcagatccttgtgtcctg

SEQ ID NO: 7403412 - DNA, 22 bp, Homo sapiens
aggctcagatccttgtgtcctg

SEQ ID NO: 7403413 - DNA, 22 bp, Homo sapiens
aggctcagatccttgtgtcctg

SEQ ID NO: 7403414 - DNA, 22 bp, Homo sapiens
aggctcagatccttgtgtcctg

SEQ ID NO: 7403415 - DNA, 22 bp, Homo sapiens
aggctcagatccttgtgtcctg

SEQ ID NO: 7403416 - DNA, 22 bp, Homo sapiens
aggctcagatccttgtgtcctg

SEQ ID NO: 7403417 - DNA, 22 bp, Homo sapiens
ccaggccttctgaggacactct

SEQ ID NO: 7403418 - DNA, 22 bp, Homo sapiens
ccaggccttccagtacgcagaa

SEQ ID NO: 7403419 - DNA, 22 bp, Homo sapiens
ccaggccttccagtacgcagaa

SEQ ID NO: 7403420 - DNA, 22 bp, Homo sapiens
ccaggccttctgaggacactct

SEQ ID NO: 7403421 - DNA, 22 bp, Homo sapiens
ccaggccttctgaggacactct

SEQ ID NO: 7403422 - DNA, 22 bp, Homo sapiens
ccaggccttctgaggacactct

SEQ ID NO: 7403423 - DNA, 22 bp, Homo sapiens
ccaggccttctgaggacactct

SEQ ID NO: 7403424 - DNA, 22 bp, Homo sapiens
ccaggcctttcttcttggtctg

SEQ ID NO: 7403425 - DNA, 22 bp, Homo sapiens
ccaggcctttcttcttggtctg

SEQ ID NO: 7403426 - DNA, 22 bp, Homo sapiens
ccaggcctttcttcttggtctg

SEQ ID NO: 7403427 - DNA, 22 bp, Homo sapiens
ccaggcctttcttcttggtctg

SEQ ID NO: 7403428 - DNA, 22 bp, Homo sapiens
ccaggccttctgaggacactct

SEQ ID NO: 7403429 - DNA, 22 bp, Homo sapiens
ccaggccttctgaggacactct

SEQ ID NO: 7403430 - DNA, 22 bp, Homo sapiens
ccaggccttctgaggacactct

SEQ ID NO: 7403431 - DNA, 21 bp, Homo sapiens
aggctcagcaggtgtataaag

SEQ ID NO: 7403432 - DNA, 22 bp, Homo sapiens
aggctcagattcacatttggtt

SEQ ID NO: 7403433 - DNA, 21 bp, Homo sapiens
aggctcagcaggtgtataaag

SEQ ID NO: 7403434 - DNA, 21 bp, Homo sapiens
aggctcagcaggtgtataaag

SEQ ID NO: 7403435 - DNA, 22 bp, Homo sapiens
aggctcagcatctgattcatat

SEQ ID NO: 7403436 - DNA, 22 bp, Homo sapiens
aggctcagcatctgattcatat

SEQ ID NO: 7403437 - DNA, 21 bp, Homo sapiens
aggctcagcaggtgtataaag

SEQ ID NO: 7403438 - DNA, 22 bp, Homo sapiens
aggctcagcatctgattcatat

SEQ ID NO: 7403439 - DNA, 22 bp, Homo sapiens
aggctcagcccaaggtggagag

SEQ ID NO: 7403440 - DNA, 22 bp, Homo sapiens
aggctcagcccaaggtggagag

SEQ ID NO: 7403441 - DNA, 22 bp, Homo sapiens
aggctcagcccaaggtggagag

SEQ ID NO: 7403442 - DNA, 22 bp, Homo sapiens
aggctcagcccaaggtggagag

SEQ ID NO: 7403443 - DNA, 22 bp, Homo sapiens
aggctcagcccaaggtggagag

SEQ ID NO: 7403444 - DNA, 22 bp, Homo sapiens
aggctcagcccaaggtggagag

SEQ ID NO: 7403445 - DNA, 22 bp, Homo sapiens
aggctcagcccaaggtggagag

SEQ ID NO: 7403446 - DNA, 22 bp, Homo sapiens
aggctcagcatctgattcatat

SEQ ID NO: 7403447 - DNA, 22 bp, Homo sapiens
aggctcagcatctgattcatat

SEQ ID NO: 7403448 - DNA, 22 bp, Homo sapiens
aggctcagcccaaggtggagag

SEQ ID NO: 7403449 - DNA, 22 bp, Homo sapiens
aggctcagcccctgggaggaga

SEQ ID NO: 7403450 - DNA, 22 bp, Homo sapiens
aggctcagcccctgggaggaga

SEQ ID NO: 7403451 - DNA, 22 bp, Homo sapiens
aggctcagcccctgggaggaga

SEQ ID NO: 7403452 - DNA, 22 bp, Homo sapiens
aggctcagcccctgggaggaga

SEQ ID NO: 7403453 - DNA, 22 bp, Homo sapiens
aggctcagcccctgggaggaga

SEQ ID NO: 7403454 - DNA, 22 bp, Homo sapiens
aggctcagcccaaggtggagag

SEQ ID NO: 7403455 - DNA, 22 bp, Homo sapiens
aggctcagcccctgggaggaga

SEQ ID NO: 7403456 - DNA, 22 bp, Homo sapiens
aggctcagcccctgggaggaga

SEQ ID NO: 7403457 - DNA, 22 bp, Homo sapiens
aggctcagcccctgggaggaga

SEQ ID NO: 7403458 - DNA, 22 bp, Homo sapiens
aggctcagcccctgggaggaga

SEQ ID NO: 7403459 - DNA, 22 bp, Homo sapiens
aggctcagcctgggcctagagc

SEQ ID NO: 7403460 - DNA, 22 bp, Homo sapiens
aggctcagcctgggcctagagc

SEQ ID NO: 7403461 - DNA, 22 bp, Homo sapiens
aggctcagcctgggcctagagc

SEQ ID NO: 7403462 - DNA, 22 bp, Homo sapiens
aggctctgcttttctggatata

SEQ ID NO: 7403463 - DNA, 22 bp, Homo sapiens
aggctctgcttttctggatata

SEQ ID NO: 7403464 - DNA, 20 bp, Homo sapiens
aggctctgcctgcaggccca

SEQ ID NO: 7403465 - DNA, 22 bp, Homo sapiens
aggctctggttcatcatgatgg

SEQ ID NO: 7403466 - DNA, 22 bp, Homo sapiens
aggctctggtgcagctgtaact

SEQ ID NO: 7403467 - DNA, 22 bp, Homo sapiens
aggctctggtgcagctgtaact

SEQ ID NO: 7403468 - DNA, 22 bp, Homo sapiens
aggctctggtgcagctgtaact

SEQ ID NO: 7403469 - DNA, 22 bp, Homo sapiens
aggctctgggctctagattttg

SEQ ID NO: 7403470 - DNA, 22 bp, Homo sapiens
aggctctgggaagcagtgagtt

SEQ ID NO: 7403471 - DNA, 22 bp, Homo sapiens
aggctctgggaagcagtgagtt

SEQ ID NO: 7403472 - DNA, 19 bp, Homo sapiens
aggctctgtaggagagggc

SEQ ID NO: 7403473 - DNA, 19 bp, Homo sapiens
aggctctgtaggagagggc

SEQ ID NO: 7403474 - DNA, 22 bp, Homo sapiens
aggctctggttggcaagtaaag

SEQ ID NO: 7403475 - DNA, 22 bp, Homo sapiens
aggctctggttggcaagtaaag

SEQ ID NO: 7403476 - DNA, 22 bp, Homo sapiens
aggctctggttggcaagtaaag

SEQ ID NO: 7403477 - DNA, 22 bp, Homo sapiens
aggctctgggctctagattttg

SEQ ID NO: 7403478 - DNA, 22 bp, Homo sapiens
aggctctgggaacagacgggtg

SEQ ID NO: 7403479 - DNA, 22 bp, Homo sapiens
aggctctgggaacagacgggtg

SEQ ID NO: 7403480 - DNA, 22 bp, Homo sapiens
aggctctgggaacagacgggtg

SEQ ID NO: 7403481 - DNA, 22 bp, Homo sapiens
aggctctgcttttctggatata

SEQ ID NO: 7403482 - DNA, 22 bp, Homo sapiens
aggctctgcttttctggatata

SEQ ID NO: 7403483 - DNA, 22 bp, Homo sapiens
aggctctgggaacagacgggtg

SEQ ID NO: 7403484 - DNA, 22 bp, Homo sapiens
aggctctgggaagcagtgagtt

SEQ ID NO: 7403485 - DNA, 22 bp, Homo sapiens
aggctctgggaagcagtgagtt

SEQ ID NO: 7403486 - DNA, 22 bp, Homo sapiens
aggctctgggaagcagtgagtt

SEQ ID NO: 7403487 - DNA, 22 bp, Homo sapiens
aggctctgggaagcagtgagtt

SEQ ID NO: 7403488 - DNA, 22 bp, Homo sapiens
aggctctgggaagcagtgagtt

SEQ ID NO: 7403489 - DNA, 22 bp, Homo sapiens
aggctctgggaagcagtgagtt

SEQ ID NO: 7403490 - DNA, 22 bp, Homo sapiens
aggctctgggaagcagtgagtt

SEQ ID NO: 7403491 - DNA, 22 bp, Homo sapiens
aggctctgggaagcagtgagtt

SEQ ID NO: 7403492 - DNA, 22 bp, Homo sapiens
aggctctgggaagcagtgagtt

SEQ ID NO: 7403493 - DNA, 22 bp, Homo sapiens
ccaggaggtctgagtgtggaca

SEQ ID NO: 7403494 - DNA, 22 bp, Homo sapiens
ccaggagggtggttactcaatc

SEQ ID NO: 7403495 - DNA, 22 bp, Homo sapiens
ccaggagggtggttactcaatc

SEQ ID NO: 7403496 - DNA, 22 bp, Homo sapiens
ccaggagggtggttactcaatc

SEQ ID NO: 7403497 - DNA, 22 bp, Homo sapiens
ccaggagggtggttactcaatc

SEQ ID NO: 7403498 - DNA, 22 bp, Homo sapiens
ccaggagggtggttactcaatc

SEQ ID NO: 7403499 - DNA, 22 bp, Homo sapiens
ccaggaggggtctctgtctccc

SEQ ID NO: 7403500 - DNA, 22 bp, Homo sapiens
ccaggaggtctgagtgtggaca

SEQ ID NO: 7403501 - DNA, 22 bp, Homo sapiens
ccaggaggtctgagtgtggaca

SEQ ID NO: 7403502 - DNA, 22 bp, Homo sapiens
ccaggaggtctgagtgtggaca

SEQ ID NO: 7403503 - DNA, 22 bp, Homo sapiens
ccaggaggtctgagtgtggaca

SEQ ID NO: 7403504 - DNA, 22 bp, Homo sapiens
ccaggaggtctgagtgtggaca

SEQ ID NO: 7403505 - DNA, 22 bp, Homo sapiens
ccaggaggtctgagtgtggaca

SEQ ID NO: 7403506 - DNA, 22 bp, Homo sapiens
ccaggaggtgaaacttcaccag

SEQ ID NO: 7403507 - DNA, 22 bp, Homo sapiens
ccaggaggtgaaacttcaccag

SEQ ID NO: 7403508 - DNA, 22 bp, Homo sapiens
ccaggaggtgaaacttcaccag

SEQ ID NO: 7403509 - DNA, 22 bp, Homo sapiens
ccaggaggtgaaacttcaccag

SEQ ID NO: 7403510 - DNA, 22 bp, Homo sapiens
ccaggaggatgaggggcataga

SEQ ID NO: 7403511 - DNA, 22 bp, Homo sapiens
ccaggaggatgaggggcataga

SEQ ID NO: 7403512 - DNA, 22 bp, Homo sapiens
ccaggaggatgaggggcataga

SEQ ID NO: 7403513 - DNA, 22 bp, Homo sapiens
ccaggaggatgaggggcataga

SEQ ID NO: 7403514 - DNA, 22 bp, Homo sapiens
ccaggaggatgaggggcataga

SEQ ID NO: 7403515 - DNA, 22 bp, Homo sapiens
ccagctccgggagttgctgctg

SEQ ID NO: 7403516 - DNA, 22 bp, Homo sapiens
ccaggaggatgaggggcataga

SEQ ID NO: 7403517 - DNA, 22 bp, Homo sapiens
ccaggaggggtctctgtctccc

SEQ ID NO: 7403518 - DNA, 22 bp, Homo sapiens
ccaggaggggtctctgtctccc

SEQ ID NO: 7403519 - DNA, 22 bp, Homo sapiens
ccaggaggggtctctgtctccc

SEQ ID NO: 7403520 - DNA, 22 bp, Homo sapiens
ccaggaggggtctctgtctccc

SEQ ID NO: 7403521 - DNA, 22 bp, Homo sapiens
ccaggaggggtctctgtctccc

SEQ ID NO: 7403522 - DNA, 22 bp, Homo sapiens
ccaggagggaggagttcctgag

SEQ ID NO: 7403523 - DNA, 22 bp, Homo sapiens
ccaggaggatgaggggcataga

SEQ ID NO: 7403524 - DNA, 22 bp, Homo sapiens
ccaggagggaggagttcctgag

SEQ ID NO: 7403525 - DNA, 22 bp, Homo sapiens
ccaggagggaggagttcctgag

SEQ ID NO: 7403526 - DNA, 22 bp, Homo sapiens
ccaggagggaggagttcctgag

SEQ ID NO: 7403527 - DNA, 22 bp, Homo sapiens
ccaggaggggtctctgtctccc

SEQ ID NO: 7403528 - DNA, 22 bp, Homo sapiens
ccaggaggtggcaggacttgcc

SEQ ID NO: 7403529 - DNA, 22 bp, Homo sapiens
ccaggaggtggcaggacttgcc

SEQ ID NO: 7403530 - DNA, 22 bp, Homo sapiens
ccaggaggtggcaggacttgcc

SEQ ID NO: 7403531 - DNA, 22 bp, Homo sapiens
ccaggaggtggcaggacttgcc

SEQ ID NO: 7403532 - DNA, 22 bp, Homo sapiens
ccaggaggtggcaggacttgcc

SEQ ID NO: 7403533 - DNA, 22 bp, Homo sapiens
ccaggaggtggcaggacttgcc

SEQ ID NO: 7403534 - DNA, 22 bp, Homo sapiens
ccaggaggtggcaggacttgcc

SEQ ID NO: 7403535 - DNA, 22 bp, Homo sapiens
aggcctgggacgggagccgtga

SEQ ID NO: 7403536 - DNA, 22 bp, Homo sapiens
aggcctgggcaagaaggggcgt

SEQ ID NO: 7403537 - DNA, 22 bp, Homo sapiens
ccaggaggttgaggctgcagtg

SEQ ID NO: 7403538 - DNA, 22 bp, Homo sapiens
ccaggaggttgaggctgcagtg

SEQ ID NO: 7403539 - DNA, 22 bp, Homo sapiens
ccaggaggtggcaggacttgcc

SEQ ID NO: 7403540 - DNA, 22 bp, Homo sapiens
ccaggaggtggcaggacttgcc

SEQ ID NO: 7403541 - DNA, 22 bp, Homo sapiens
ccaggaggtggcaggacttgcc

SEQ ID NO: 7403542 - DNA, 22 bp, Homo sapiens
ccaggaggtgctggaagaaagc

SEQ ID NO: 7403543 - DNA, 22 bp, Homo sapiens
ccaggaggtgctggaagaaagc

SEQ ID NO: 7403544 - DNA, 22 bp, Homo sapiens
ccaggaggtgctggaagaaagc

SEQ ID NO: 7403545 - DNA, 22 bp, Homo sapiens
ccaggaggtgctggaagaaagc

SEQ ID NO: 7403546 - DNA, 22 bp, Homo sapiens
ccaggaggtgaaacttcaccag

SEQ ID NO: 7403547 - DNA, 22 bp, Homo sapiens
ccaggaggtgctggaagaaagc

SEQ ID NO: 7403548 - DNA, 22 bp, Homo sapiens
ccaggaggtgctggaagaaagc

SEQ ID NO: 7403549 - DNA, 22 bp, Homo sapiens
ccaggaggtggagattgcagtg

SEQ ID NO: 7403550 - DNA, 22 bp, Homo sapiens
ccaggaggtggagattgcagtg

SEQ ID NO: 7403551 - DNA, 22 bp, Homo sapiens
ccaggaggtggagattgcagtg

SEQ ID NO: 7403552 - DNA, 22 bp, Homo sapiens
ccaggaggtggagattgcagtg

SEQ ID NO: 7403553 - DNA, 22 bp, Homo sapiens
ccaggaggtggaggttgcggtg

SEQ ID NO: 7403554 - DNA, 22 bp, Homo sapiens
ccaggaggtggaggttgcggtg

SEQ ID NO: 7403555 - DNA, 22 bp, Homo sapiens
ccaggaggtggaggttgcggtg

SEQ ID NO: 7403556 - DNA, 22 bp, Homo sapiens
ccaggaggtggaggttgcggtg

SEQ ID NO: 7403557 - DNA, 22 bp, Homo sapiens
ccaggaggtggagattgcagtg

SEQ ID NO: 7403558 - DNA, 22 bp, Homo sapiens
ccaggaggtggagattgcagtg

SEQ ID NO: 7403559 - DNA, 22 bp, Homo sapiens
ccaggaggtggagattgcagtg

SEQ ID NO: 7403560 - DNA, 21 bp, Homo sapiens
aggccctggaggtcagagaaa

SEQ ID NO: 7403561 - DNA, 21 bp, Homo sapiens
aggccctggaggtcagagaaa

SEQ ID NO: 7403562 - DNA, 22 bp, Homo sapiens
aggccctggacactcaagccgg

SEQ ID NO: 7403563 - DNA, 21 bp, Homo sapiens
aggccctggaggtcagagaaa

SEQ ID NO: 7403564 - DNA, 21 bp, Homo sapiens
aggccctggaggtcagagaaa

SEQ ID NO: 7403565 - DNA, 21 bp, Homo sapiens
aggccctggaggtcagagaaa

SEQ ID NO: 7403566 - DNA, 21 bp, Homo sapiens
aggccctggaggtcagagaaa

SEQ ID NO: 7403567 - DNA, 22 bp, Homo sapiens
aggccctggcactgcctgggag

SEQ ID NO: 7403568 - DNA, 22 bp, Homo sapiens
ccagctccaggactgggagctg

SEQ ID NO: 7403569 - DNA, 22 bp, Homo sapiens
ccagctccaggtagatgggcag

SEQ ID NO: 7403570 - DNA, 22 bp, Homo sapiens
ccagctccaggtagatgggcag

SEQ ID NO: 7403571 - DNA, 22 bp, Homo sapiens
ccagctccaggtagatgggcag

SEQ ID NO: 7403572 - DNA, 22 bp, Homo sapiens
ccagctccattgcttagtgtaa

SEQ ID NO: 7403573 - DNA, 22 bp, Homo sapiens
ccagctccattgcttagtgtaa

SEQ ID NO: 7403574 - DNA, 22 bp, Homo sapiens
ccagctccattgcttagtgtaa

SEQ ID NO: 7403575 - DNA, 22 bp, Homo sapiens
ccagctccattgcttagtgtaa

SEQ ID NO: 7403576 - DNA, 22 bp, Homo sapiens
ccagctccaggtagatgggcag

SEQ ID NO: 7403577 - DNA, 22 bp, Homo sapiens
ccagctccaggtagatgggcag

SEQ ID NO: 7403578 - DNA, 22 bp, Homo sapiens
aggccctgctttccagagctca

SEQ ID NO: 7403579 - DNA, 22 bp, Homo sapiens
aggccctgctttccagagctca

SEQ ID NO: 7403580 - DNA, 22 bp, Homo sapiens
aggccctgctttccagagctca

SEQ ID NO: 7403581 - DNA, 22 bp, Homo sapiens
aggccctgctttccagagctca

SEQ ID NO: 7403582 - DNA, 22 bp, Homo sapiens
aggccctgctttccagagctca

SEQ ID NO: 7403583 - DNA, 22 bp, Homo sapiens
aggccctgctttccagagctca

SEQ ID NO: 7403584 - DNA, 22 bp, Homo sapiens
aggccctgctttccagagctca

SEQ ID NO: 7403585 - DNA, 22 bp, Homo sapiens
aggccctgctttccagagctca

SEQ ID NO: 7403586 - DNA, 22 bp, Homo sapiens
aggccctgctgaggcctccctc

SEQ ID NO: 7403587 - DNA, 22 bp, Homo sapiens
aggccctgcggaaatgatcatt

SEQ ID NO: 7403588 - DNA, 22 bp, Homo sapiens
aggccctgctgaggcctccctc

SEQ ID NO: 7403589 - DNA, 22 bp, Homo sapiens
aggccctggacactcaagccgg

SEQ ID NO: 7403590 - DNA, 22 bp, Homo sapiens
aggccctggacactcaagccgg

SEQ ID NO: 7403591 - DNA, 22 bp, Homo sapiens
aggccctgctttccagagctca

SEQ ID NO: 7403592 - DNA, 22 bp, Homo sapiens
aggccctgctttccagagctca

SEQ ID NO: 7403593 - DNA, 22 bp, Homo sapiens
aggccctgctttccagagctca

SEQ ID NO: 7403594 - DNA, 22 bp, Homo sapiens
ccagctcccgcaggctgcacag

SEQ ID NO: 7403595 - DNA, 22 bp, Homo sapiens
ccagctcccgcaggctgcacag

SEQ ID NO: 7403596 - DNA, 22 bp, Homo sapiens
ccagctccctgaagcctggtct

SEQ ID NO: 7403597 - DNA, 22 bp, Homo sapiens
ccagctcccgcaggctgcacag

SEQ ID NO: 7403598 - DNA, 22 bp, Homo sapiens
ccagctcccgcaggctgcacag

SEQ ID NO: 7403599 - DNA, 22 bp, Homo sapiens
ccagctcccgcaggctgcacag

SEQ ID NO: 7403600 - DNA, 22 bp, Homo sapiens
ccagctcccgcaggctgcacag

SEQ ID NO: 7403601 - DNA, 22 bp, Homo sapiens
ccagctcccgcaggctgcacag

SEQ ID NO: 7403602 - DNA, 22 bp, Homo sapiens
ccagctccctgaagcctggtct

SEQ ID NO: 7403603 - DNA, 22 bp, Homo sapiens
ccagctccctgaagcctggtct

SEQ ID NO: 7403604 - DNA, 22 bp, Homo sapiens
ccagctccctgaagcctggtct

SEQ ID NO: 7403605 - DNA, 22 bp, Homo sapiens
ccagctccctgaagcctggtct

SEQ ID NO: 7403606 - DNA, 22 bp, Homo sapiens
ccagctccctgaagcctggtct

SEQ ID NO: 7403607 - DNA, 22 bp, Homo sapiens
ccagctccgggagttgctgctg

SEQ ID NO: 7403608 - DNA, 22 bp, Homo sapiens
ccagctccgggagttgctgctg

SEQ ID NO: 7403609 - DNA, 22 bp, Homo sapiens
ccagctccgggagttgctgctg

SEQ ID NO: 7403610 - DNA, 22 bp, Homo sapiens
ccagctccgggagttgctgctg

SEQ ID NO: 7403611 - DNA, 22 bp, Homo sapiens
ccagctccgggagttgctgctg

SEQ ID NO: 7403612 - DNA, 23 bp, Homo sapiens
ccagctcccaggtctgaggactg

SEQ ID NO: 7403613 - DNA, 23 bp, Homo sapiens
ccagctcccaggtctgaggactg

SEQ ID NO: 7403614 - DNA, 23 bp, Homo sapiens
ccagctcccaggtctgaggactg

SEQ ID NO: 7403615 - DNA, 23 bp, Homo sapiens
ccagctcccaggtctgaggactg

SEQ ID NO: 7403616 - DNA, 22 bp, Homo sapiens
ccagctcccattcttcacctgt

SEQ ID NO: 7403617 - DNA, 23 bp, Homo sapiens
ccagctcccaggtctgaggactg

SEQ ID NO: 7403618 - DNA, 22 bp, Homo sapiens
ccagctcccctcagcaggtaat

SEQ ID NO: 7403619 - DNA, 22 bp, Homo sapiens
ccagctcccattcttcacctgt

SEQ ID NO: 7403620 - DNA, 22 bp, Homo sapiens
ccagctcccctcagcaggtaat

SEQ ID NO: 7403621 - DNA, 22 bp, Homo sapiens
ccagctcccgcaggctgcacag

SEQ ID NO: 7403622 - DNA, 22 bp, Homo sapiens
ccagctcccgcaggctgcacag

SEQ ID NO: 7403623 - DNA, 22 bp, Homo sapiens
ccaggcactggctgggttcttt

SEQ ID NO: 7403624 - DNA, 22 bp, Homo sapiens
ccaggcactggctgggttcttt

SEQ ID NO: 7403625 - DNA, 20 bp, Homo sapiens
ccaggcactgtcccatgcag

SEQ ID NO: 7403626 - DNA, 22 bp, Homo sapiens
ccaggcactggctgggttcttt

SEQ ID NO: 7403627 - DNA, 22 bp, Homo sapiens
ccaggcactggctgggttcttt

SEQ ID NO: 7403628 - DNA, 20 bp, Homo sapiens
ccaggcactgtcccatgcag

SEQ ID NO: 7403629 - DNA, 20 bp, Homo sapiens
ccaggcactgtcccatgcag

SEQ ID NO: 7403630 - DNA, 20 bp, Homo sapiens
ccaggcactgtcccatgcag

SEQ ID NO: 7403631 - DNA, 20 bp, Homo sapiens
ccaggcactgtcccatgcag

SEQ ID NO: 7403632 - DNA, 20 bp, Homo sapiens
ccaggcactgtcccatgcag

SEQ ID NO: 7403633 - DNA, 22 bp, Homo sapiens
ccaggcactgctcgaggtgcta

SEQ ID NO: 7403634 - DNA, 22 bp, Homo sapiens
ccaggcactgctcgaggtgcta

SEQ ID NO: 7403635 - DNA, 22 bp, Homo sapiens
ccaggcactgctcgaggtgcta

SEQ ID NO: 7403636 - DNA, 22 bp, Homo sapiens
ccaggcactgctcgaggtgcta

SEQ ID NO: 7403637 - DNA, 22 bp, Homo sapiens
ccaggcactgctcgaggtgcta

SEQ ID NO: 7403638 - DNA, 22 bp, Homo sapiens
ccaggcactcagagactgggac

SEQ ID NO: 7403639 - DNA, 22 bp, Homo sapiens
ccaggcactcagagactgggac

SEQ ID NO: 7403640 - DNA, 22 bp, Homo sapiens
ccaggcactcagagactgggac

SEQ ID NO: 7403641 - DNA, 22 bp, Homo sapiens
ccaggcactcagagactgggac

SEQ ID NO: 7403642 - DNA, 22 bp, Homo sapiens
ccaggcactcagagactgggac

SEQ ID NO: 7403643 - DNA, 22 bp, Homo sapiens
ccaggcactcacggggcactgg

SEQ ID NO: 7403644 - DNA, 22 bp, Homo sapiens
ccaggcactcacggggcactgg

SEQ ID NO: 7403645 - DNA, 22 bp, Homo sapiens
ccaggcacggtggctcatgcct

SEQ ID NO: 7403646 - DNA, 22 bp, Homo sapiens
ccaggcactcacggggcactgg

SEQ ID NO: 7403647 - DNA, 22 bp, Homo sapiens
ccaggcactcacggggcactgg

SEQ ID NO: 7403648 - DNA, 22 bp, Homo sapiens
ccaggcactcacggggcactgg

SEQ ID NO: 7403649 - DNA, 22 bp, Homo sapiens
ccaggcacggtggctcatgcct

SEQ ID NO: 7403650 - DNA, 22 bp, Homo sapiens
ccaggcacggtggctcatgcct

SEQ ID NO: 7403651 - DNA, 22 bp, Homo sapiens
ccaggcacggtggctcatgcct

SEQ ID NO: 7403652 - DNA, 22 bp, Homo sapiens
ccaggcacggtggctcatgcct

SEQ ID NO: 7403653 - DNA, 22 bp, Homo sapiens
ccaggcaccaaagtatgcttta

SEQ ID NO: 7403654 - DNA, 22 bp, Homo sapiens
ccaggcaccaaagtatgcttta

SEQ ID NO: 7403655 - DNA, 22 bp, Homo sapiens
ccaggcaccaaagtatgcttta

SEQ ID NO: 7403656 - DNA, 22 bp, Homo sapiens
ccaggcaccatgttcttaggac

SEQ ID NO: 7403657 - DNA, 22 bp, Homo sapiens
ccaggcaccatgttcttaggac

SEQ ID NO: 7403658 - DNA, 22 bp, Homo sapiens
ccaggcaccatgttcttaggac

SEQ ID NO: 7403659 - DNA, 22 bp, Homo sapiens
ccaggcaccatgttcttaggac

SEQ ID NO: 7403660 - DNA, 22 bp, Homo sapiens
ccaggcaccatgttcttaggac

SEQ ID NO: 7403661 - DNA, 22 bp, Homo sapiens
ccaggcacggtggctcatgcct

SEQ ID NO: 7403662 - DNA, 22 bp, Homo sapiens
ccaggcacggtggctcatgcct

SEQ ID NO: 7403663 - DNA, 18 bp, Homo sapiens
ccaggcacctttaaatat

SEQ ID NO: 7403664 - DNA, 18 bp, Homo sapiens
ccaggcacctttaaatat

SEQ ID NO: 7403665 - DNA, 22 bp, Homo sapiens
ccaggcacaggtgggcctcaga

SEQ ID NO: 7403666 - DNA, 22 bp, Homo sapiens
ccaggcacaggtgggcctcaga

SEQ ID NO: 7403667 - DNA, 22 bp, Homo sapiens
ccaggcacaggtgggcctcaga

SEQ ID NO: 7403668 - DNA, 22 bp, Homo sapiens
ccaggcacaggtgggcctcaga

SEQ ID NO: 7403669 - DNA, 20 bp, Homo sapiens
aggctcagatacccagggaa

SEQ ID NO: 7403670 - DNA, 22 bp, Homo sapiens
ccaggcacaggtgggcctcaga

SEQ ID NO: 7403671 - DNA, 22 bp, Homo sapiens
ccaggcacaggtgggcctcaga

SEQ ID NO: 7403672 - DNA, 22 bp, Homo sapiens
ccaggcaccaaagtatgcttta

SEQ ID NO: 7403673 - DNA, 22 bp, Homo sapiens
ccaggcacaggtgggcctcaga

SEQ ID NO: 7403674 - DNA, 20 bp, Homo sapiens
aggctcagatacccagggaa

SEQ ID NO: 7403675 - DNA, 20 bp, Homo sapiens
aggctcagatacccagggaa

SEQ ID NO: 7403676 - DNA, 20 bp, Homo sapiens
aggctcagatacccagggaa

SEQ ID NO: 7403677 - DNA, 20 bp, Homo sapiens
aggctcagatacccagggaa

SEQ ID NO: 7403678 - DNA, 22 bp, Homo sapiens
aggctcagaggtgagcatctgc

SEQ ID NO: 7403679 - DNA, 22 bp, Homo sapiens
aggctcagaggtgagcatctgc

SEQ ID NO: 7403680 - DNA, 22 bp, Homo sapiens
aggctcagaggtgagcatctgc

SEQ ID NO: 7403681 - DNA, 22 bp, Homo sapiens
aggctcagaggtgagcatctgc

SEQ ID NO: 7403682 - DNA, 22 bp, Homo sapiens
aggctcagaggtgagcatctgc

SEQ ID NO: 7403683 - DNA, 22 bp, Homo sapiens
aggctcagaggtgagcatctgc

SEQ ID NO: 7403684 - DNA, 16 bp, Homo sapiens
aggctcagaggctgga

SEQ ID NO: 7403685 - DNA, 22 bp, Homo sapiens
aggctcagaggtgagcatctgc

SEQ ID NO: 7403686 - DNA, 22 bp, Homo sapiens
aggctcagaggtgagcatctgc

SEQ ID NO: 7403687 - DNA, 22 bp, Homo sapiens
aggctcagaggtgagcatctgc

SEQ ID NO: 7403688 - DNA, 22 bp, Homo sapiens
aggctcagaggtgagcatctgc

SEQ ID NO: 7403689 - DNA, 16 bp, Homo sapiens
aggctcagaggctgga

SEQ ID NO: 7403690 - DNA, 16 bp, Homo sapiens
aggctcagaggctgga

SEQ ID NO: 7403691 - DNA, 16 bp, Homo sapiens
aggctcagaggctgga

SEQ ID NO: 7403692 - DNA, 16 bp, Homo sapiens
aggctcagaggctgga

SEQ ID NO: 7403693 - DNA, 20 bp, Homo sapiens
aggctcagagcagtagtaca

SEQ ID NO: 7403694 - DNA, 16 bp, Homo sapiens
aggctcagaggctgga

SEQ ID NO: 7403695 - DNA, 16 bp, Homo sapiens
aggctcagaggctgga

SEQ ID NO: 7403696 - DNA, 16 bp, Homo sapiens
aggctcagaggctgga

SEQ ID NO: 7403697 - DNA, 20 bp, Homo sapiens
aggctcagagcagtagtaca

SEQ ID NO: 7403698 - DNA, 20 bp, Homo sapiens
aggctcagagcagtagtaca

SEQ ID NO: 7403699 - DNA, 20 bp, Homo sapiens
aggctcagagcagtagtaca

SEQ ID NO: 7403700 - DNA, 20 bp, Homo sapiens
aggctcagagcagtagtaca

SEQ ID NO: 7403701 - DNA, 20 bp, Homo sapiens
aggctcagagcagtagtaca

SEQ ID NO: 7403702 - DNA, 20 bp, Homo sapiens
aggctcagagcagtagtaca

SEQ ID NO: 7403703 - DNA, 22 bp, Homo sapiens
aggcctgggcaagaaggggcgt

SEQ ID NO: 7403704 - DNA, 22 bp, Homo sapiens
aggcctgggcaagaaggggcgt

SEQ ID NO: 7403705 - DNA, 19 bp, Homo sapiens
aggcctggggttttgcact

SEQ ID NO: 7403706 - DNA, 22 bp, Homo sapiens
aggcctgggcaagaaggggcgt

SEQ ID NO: 7403707 - DNA, 22 bp, Homo sapiens
aggcctgggcaagaaggggcgt

SEQ ID NO: 7403708 - DNA, 22 bp, Homo sapiens
aggcctgggcaagaaggggcgt

SEQ ID NO: 7403709 - DNA, 22 bp, Homo sapiens
aggcctgggtctcgtgcctacc

SEQ ID NO: 7403710 - DNA, 22 bp, Homo sapiens
aggcctgggtctcgtgcctacc

SEQ ID NO: 7403711 - DNA, 22 bp, Homo sapiens
aggcctgggtctcgtgcctacc

SEQ ID NO: 7403712 - DNA, 22 bp, Homo sapiens
aggcctgggtctcgtgcctacc

SEQ ID NO: 7403713 - DNA, 19 bp, Homo sapiens
aggcctggggttttgcact

SEQ ID NO: 7403714 - DNA, 22 bp, Homo sapiens
aggcctgggtctcgtgcctacc

SEQ ID NO: 7403715 - DNA, 22 bp, Homo sapiens
aggcctgggtctcgtgcctacc

SEQ ID NO: 7403716 - DNA, 22 bp, Homo sapiens
aggcctgggtctcgtgcctacc

SEQ ID NO: 7403717 - DNA, 22 bp, Homo sapiens
aggcctgggtgttcaccagaag

SEQ ID NO: 7403718 - DNA, 22 bp, Homo sapiens
aggcctgggtgttcaccagaag

SEQ ID NO: 7403719 - DNA, 22 bp, Homo sapiens
aggcctgggtgttcaccagaag

SEQ ID NO: 7403720 - DNA, 22 bp, Homo sapiens
aggcctgggtgttcaccagaag

SEQ ID NO: 7403721 - DNA, 22 bp, Homo sapiens
aggcctgggtgttcaccagaag

SEQ ID NO: 7403722 - DNA, 22 bp, Homo sapiens
aggcctgggtctcgtgcctacc

SEQ ID NO: 7403723 - DNA, 22 bp, Homo sapiens
aggcctgggtctcgtgcctacc

SEQ ID NO: 7403724 - DNA, 22 bp, Homo sapiens
aggcctggtgaatgaagtatct

SEQ ID NO: 7403725 - DNA, 22 bp, Homo sapiens
aggcctgggtgttcaccagaag

SEQ ID NO: 7403726 - DNA, 22 bp, Homo sapiens
aggcctggtgaatgaagtatct

SEQ ID NO: 7403727 - DNA, 22 bp, Homo sapiens
aggcctggtgaatgaagtatct

SEQ ID NO: 7403728 - DNA, 22 bp, Homo sapiens
aggcctggtgtgccggatgcag

SEQ ID NO: 7403729 - DNA, 22 bp, Homo sapiens
aggcctggtgaatgaagtatct

SEQ ID NO: 7403730 - DNA, 22 bp, Homo sapiens
aggcctggtgaatgaagtatct

SEQ ID NO: 7403731 - DNA, 22 bp, Homo sapiens
aggcctggtgaatgaagtatct

SEQ ID NO: 7403732 - DNA, 22 bp, Homo sapiens
aggcctggtgtgccggatgcag

SEQ ID NO: 7403733 - DNA, 22 bp, Homo sapiens
aggcctggtgtgccggatgcag

SEQ ID NO: 7403734 - DNA, 22 bp, Homo sapiens
aggctagaggcttctggcttca

SEQ ID NO: 7403735 - DNA, 22 bp, Homo sapiens
aggctagaggcttctggcttca

SEQ ID NO: 7403736 - DNA, 22 bp, Homo sapiens
aggctcagagagctgtgtccat

SEQ ID NO: 7403737 - DNA, 22 bp, Homo sapiens
aggctcagagagctgtgtccat

SEQ ID NO: 7403738 - DNA, 22 bp, Homo sapiens
aggctcagagagctgtgtccat

SEQ ID NO: 7403739 - DNA, 21 bp, Homo sapiens
aggctcagagagaaactcttg

SEQ ID NO: 7403740 - DNA, 22 bp, Homo sapiens
aggctcagagagctgtgtccat

SEQ ID NO: 7403741 - DNA, 21 bp, Homo sapiens
aggctcagagagaaactcttg

SEQ ID NO: 7403742 - DNA, 21 bp, Homo sapiens
aggctcagagagaaactcttg

SEQ ID NO: 7403743 - DNA, 22 bp, Homo sapiens
aggctagatagagggtcatctt

SEQ ID NO: 7403744 - DNA, 21 bp, Homo sapiens
aggctcagagagaaactcttg

SEQ ID NO: 7403745 - DNA, 22 bp, Homo sapiens
aggctagatagagggtcatctt

SEQ ID NO: 7403746 - DNA, 22 bp, Homo sapiens
aggctcagacaggaaaagtaac

SEQ ID NO: 7403747 - DNA, 21 bp, Homo sapiens
aggctcagagatcaaacagta

SEQ ID NO: 7403748 - DNA, 21 bp, Homo sapiens
aggctcagagatcaaacagta

SEQ ID NO: 7403749 - DNA, 21 bp, Homo sapiens
aggctcagagatcaaacagta

SEQ ID NO: 7403750 - DNA, 21 bp, Homo sapiens
aggctcagagatcaaacagta

SEQ ID NO: 7403751 - DNA, 22 bp, Homo sapiens
aggctcagagagctgtgtccat

SEQ ID NO: 7403752 - DNA, 21 bp, Homo sapiens
aggctcagagatcaaacagta

SEQ ID NO: 7403753 - DNA, 22 bp, Homo sapiens
aggctcagagagctgtgtccat

SEQ ID NO: 7403754 - DNA, 22 bp, Homo sapiens
aggctcagagagctgtgtccat

SEQ ID NO: 7403755 - DNA, 22 bp, Homo sapiens
aggctcagagatgagtaagcac

SEQ ID NO: 7403756 - DNA, 22 bp, Homo sapiens
aggctcagagatgagtaagcac

SEQ ID NO: 7403757 - DNA, 22 bp, Homo sapiens
aggctcagagatgagtaagcac

SEQ ID NO: 7403758 - DNA, 22 bp, Homo sapiens
aggctcagagatgagtaagcac

SEQ ID NO: 7403759 - DNA, 21 bp, Homo sapiens
aggctcagagatcaaacagta

SEQ ID NO: 7403760 - DNA, 21 bp, Homo sapiens
aggctcagagatcaaacagta

SEQ ID NO: 7403761 - DNA, 22 bp, Homo sapiens
aggctcagagatgagtaagcac

SEQ ID NO: 7403762 - DNA, 22 bp, Homo sapiens
aggctcagagatgagtaagcac

SEQ ID NO: 7403763 - DNA, 22 bp, Homo sapiens
aggctcagagatgagtaagcac

SEQ ID NO: 7403764 - DNA, 22 bp, Homo sapiens
aggctcagagatgagtaagcac

SEQ ID NO: 7403765 - DNA, 22 bp, Homo sapiens
aggctcagagatgagtaagcac

SEQ ID NO: 7403766 - DNA, 22 bp, Homo sapiens
aggctcagagatgagtaagcac

SEQ ID NO: 7403767 - DNA, 22 bp, Homo sapiens
ccagccagctggttggacgcct

SEQ ID NO: 7403768 - DNA, 22 bp, Homo sapiens
ccagccagctggttggacgcct

SEQ ID NO: 7403769 - DNA, 22 bp, Homo sapiens
ccagccagctggttggacgcct

SEQ ID NO: 7403770 - DNA, 22 bp, Homo sapiens
ccagccagctggttggacgcct

SEQ ID NO: 7403771 - DNA, 22 bp, Homo sapiens
ccagccagctggttggacgcct

SEQ ID NO: 7403772 - DNA, 22 bp, Homo sapiens
ccagccagccttgatctgagta

SEQ ID NO: 7403773 - DNA, 22 bp, Homo sapiens
ccagccagcaagctcccagttc

SEQ ID NO: 7403774 - DNA, 22 bp, Homo sapiens
ccagccagcaagctcccagttc

SEQ ID NO: 7403775 - DNA, 22 bp, Homo sapiens
ccagccagctgcccttggggcc

SEQ ID NO: 7403776 - DNA, 22 bp, Homo sapiens
ccagccagctgcccttggggcc

SEQ ID NO: 7403777 - DNA, 22 bp, Homo sapiens
ccagccagccttgatctgagta

SEQ ID NO: 7403778 - DNA, 22 bp, Homo sapiens
ccagccagccttgatctgagta

SEQ ID NO: 7403779 - DNA, 22 bp, Homo sapiens
ccagccaggcattgcaaactga

SEQ ID NO: 7403780 - DNA, 22 bp, Homo sapiens
ccagccaggcattgcaaactga

SEQ ID NO: 7403781 - DNA, 22 bp, Homo sapiens
ccagccagctggttggacgcct

SEQ ID NO: 7403782 - DNA, 22 bp, Homo sapiens
ccagccaggctggctgtggagg

SEQ ID NO: 7403783 - DNA, 22 bp, Homo sapiens
ccagccaggctggctgtggagg

SEQ ID NO: 7403784 - DNA, 22 bp, Homo sapiens
ccagccagtatattccaaagcc

SEQ ID NO: 7403785 - DNA, 22 bp, Homo sapiens
ccagccagtatattccaaagcc

SEQ ID NO: 7403786 - DNA, 22 bp, Homo sapiens
ccagccagtatattccaaagcc

SEQ ID NO: 7403787 - DNA, 22 bp, Homo sapiens
ccagccagtatattccaaagcc

SEQ ID NO: 7403788 - DNA, 22 bp, Homo sapiens
ccagccagtatattccaaagcc

SEQ ID NO: 7403789 - DNA, 22 bp, Homo sapiens
ccagccagtatattccaaagcc

SEQ ID NO: 7403790 - DNA, 22 bp, Homo sapiens
ccagccagggaaactttttctt

SEQ ID NO: 7403791 - DNA, 22 bp, Homo sapiens
ccagccaggctggctgtggagg

SEQ ID NO: 7403792 - DNA, 22 bp, Homo sapiens
ccagccaggctggctgtggagg

SEQ ID NO: 7403793 - DNA, 22 bp, Homo sapiens
ccagagtcattttgagtcataa

SEQ ID NO: 7403794 - DNA, 22 bp, Homo sapiens
ccagagtcattttgagtcataa

SEQ ID NO: 7403795 - DNA, 22 bp, Homo sapiens
ccagagtcccttgcagctcagt

SEQ ID NO: 7403796 - DNA, 22 bp, Homo sapiens
ccagagtcccttgcagctcagt

SEQ ID NO: 7403797 - DNA, 22 bp, Homo sapiens
ccagagtccctgttctcggcct

SEQ ID NO: 7403798 - DNA, 22 bp, Homo sapiens
ccagagtcccttgcagctcagt

SEQ ID NO: 7403799 - DNA, 22 bp, Homo sapiens
ccagagtctatgagtcctcatt

SEQ ID NO: 7403800 - DNA, 22 bp, Homo sapiens
ccagagtctatgagtcctcatt

SEQ ID NO: 7403801 - DNA, 22 bp, Homo sapiens
ccagagtcccttgcagctcagt

SEQ ID NO: 7403802 - DNA, 22 bp, Homo sapiens
ccagagtcccttgcagctcagt

SEQ ID NO: 7403803 - DNA, 22 bp, Homo sapiens
ccagagtcccttgcagctcagt

SEQ ID NO: 7403804 - DNA, 22 bp, Homo sapiens
ccagcagggaaaaacccaccaa

SEQ ID NO: 7403805 - DNA, 22 bp, Homo sapiens
ccagcagggaaaaacccaccaa

SEQ ID NO: 7403806 - DNA, 22 bp, Homo sapiens
ccagcaggcagtcatatccttt

SEQ ID NO: 7403807 - DNA, 22 bp, Homo sapiens
ccagagtctatgagtcctcatt

SEQ ID NO: 7403808 - DNA, 22 bp, Homo sapiens
ccagagtctgtgtgtgtcatcc

SEQ ID NO: 7403809 - DNA, 22 bp, Homo sapiens
ccagagtctatgagtcctcatt

SEQ ID NO: 7403810 - DNA, 22 bp, Homo sapiens
ccagagtctgtgtgtgtcatcc

SEQ ID NO: 7403811 - DNA, 22 bp, Homo sapiens
ccagagtctgtgtgtgtcatcc

SEQ ID NO: 7403812 - DNA, 22 bp, Homo sapiens
ccagagtctttatattcctgaa

SEQ ID NO: 7403813 - DNA, 22 bp, Homo sapiens
ccagcagggaaaaacccaccaa

SEQ ID NO: 7403814 - DNA, 22 bp, Homo sapiens
ccagccactgggccactgccag

SEQ ID NO: 7403815 - DNA, 22 bp, Homo sapiens
ccagccactgggccactgccag

SEQ ID NO: 7403816 - DNA, 22 bp, Homo sapiens
ccagccactgggccactgccag

SEQ ID NO: 7403817 - DNA, 22 bp, Homo sapiens
ccagccagatgataagctctat

SEQ ID NO: 7403818 - DNA, 22 bp, Homo sapiens
ccagccagatgataagctctat

SEQ ID NO: 7403819 - DNA, 22 bp, Homo sapiens
ccagccagaagtccgggcttct

SEQ ID NO: 7403820 - DNA, 22 bp, Homo sapiens
ccagccagaagtccgggcttct

SEQ ID NO: 7403821 - DNA, 22 bp, Homo sapiens
ccagccagaagtccgggcttct

SEQ ID NO: 7403822 - DNA, 22 bp, Homo sapiens
ccagccagatgataagctctat

SEQ ID NO: 7403823 - DNA, 22 bp, Homo sapiens
ccagccagcaagctcccagttc

SEQ ID NO: 7403824 - DNA, 22 bp, Homo sapiens
ccagccagcaagctcccagttc

SEQ ID NO: 7403825 - DNA, 22 bp, Homo sapiens
ccagccagcaagctcccagttc

SEQ ID NO: 7403826 - DNA, 22 bp, Homo sapiens
ccagccagcaagctcccagttc

SEQ ID NO: 7403827 - DNA, 22 bp, Homo sapiens
ccagccagcaagctcccagttc

SEQ ID NO: 7403828 - DNA, 22 bp, Homo sapiens
aggccctgacctgggagatcta

SEQ ID NO: 7403829 - DNA, 18 bp, Homo sapiens
ccagccctgcagcacctg

SEQ ID NO: 7403830 - DNA, 22 bp, Homo sapiens
aggccctgacctgggagatcta

SEQ ID NO: 7403831 - DNA, 22 bp, Homo sapiens
aggccctgacctgggagatcta

SEQ ID NO: 7403832 - DNA, 22 bp, Homo sapiens
aggccctgagaaaatccctgca

SEQ ID NO: 7403833 - DNA, 22 bp, Homo sapiens
aggccctgcccagagctcctcg

SEQ ID NO: 7403834 - DNA, 22 bp, Homo sapiens
aggccctgcccagagctcctcg

SEQ ID NO: 7403835 - DNA, 22 bp, Homo sapiens
ccagccctgattagagaatgtc

SEQ ID NO: 7403836 - DNA, 18 bp, Homo sapiens
ccagccctgcagcacctg

SEQ ID NO: 7403837 - DNA, 18 bp, Homo sapiens
ccagccctgcagcacctg

SEQ ID NO: 7403838 - DNA, 18 bp, Homo sapiens
ccagccctgcagcacctg

SEQ ID NO: 7403839 - DNA, 18 bp, Homo sapiens
ccagccctgcagcacctg

SEQ ID NO: 7403840 - DNA, 22 bp, Homo sapiens
aggccctgacctgggagatcta

SEQ ID NO: 7403841 - DNA, 22 bp, Homo sapiens
ccagccctgccagagagagctg

SEQ ID NO: 7403842 - DNA, 18 bp, Homo sapiens
ccagccctgcagcacctg

SEQ ID NO: 7403843 - DNA, 18 bp, Homo sapiens
ccagccctgcagcacctg

SEQ ID NO: 7403844 - DNA, 22 bp, Homo sapiens
aggccctgcccagtgccacaag

SEQ ID NO: 7403845 - DNA, 22 bp, Homo sapiens
aggccctgcccagtgccacaag

SEQ ID NO: 7403846 - DNA, 22 bp, Homo sapiens
aggccctgcccagtgccacaag

SEQ ID NO: 7403847 - DNA, 22 bp, Homo sapiens
aggccctgcccagtgccacaag

SEQ ID NO: 7403848 - DNA, 22 bp, Homo sapiens
aggccctgcccagagctcctcg

SEQ ID NO: 7403849 - DNA, 22 bp, Homo sapiens
aggccctgcccagtgccacaag

SEQ ID NO: 7403850 - DNA, 22 bp, Homo sapiens
aggccctgcccagtgccacaag

SEQ ID NO: 7403851 - DNA, 22 bp, Homo sapiens
aggccctgcccagtgccacaag

SEQ ID NO: 7403852 - DNA, 22 bp, Homo sapiens
aggccctgcccagtgccacaag

SEQ ID NO: 7403853 - DNA, 22 bp, Homo sapiens
aggccctgcccagagctcctcg

SEQ ID NO: 7403854 - DNA, 22 bp, Homo sapiens
aggccctgcggaaatgatcatt

SEQ ID NO: 7403855 - DNA, 22 bp, Homo sapiens
aggccctgcggaaatgatcatt

SEQ ID NO: 7403856 - DNA, 22 bp, Homo sapiens
aggccctgctgaggcctccctc

SEQ ID NO: 7403857 - DNA, 22 bp, Homo sapiens
aggccctgctgaggcctccctc

SEQ ID NO: 7403858 - DNA, 22 bp, Homo sapiens
aggccctgctgaggcctccctc

SEQ ID NO: 7403859 - DNA, 22 bp, Homo sapiens
aggccctgctgaggcctccctc

SEQ ID NO: 7403860 - DNA, 23 bp, Homo sapiens
aggccctgcctgtccctcttttt

SEQ ID NO: 7403861 - DNA, 23 bp, Homo sapiens
aggccctgcctgtccctcttttt

SEQ ID NO: 7403862 - DNA, 22 bp, Homo sapiens
ccagccctcggtagtcccatag

SEQ ID NO: 7403863 - DNA, 22 bp, Homo sapiens
ccagccctgaaccctgctgcat

SEQ ID NO: 7403864 - DNA, 22 bp, Homo sapiens
ccagccctgaaccctgctgcat

SEQ ID NO: 7403865 - DNA, 22 bp, Homo sapiens
ccagccctgaaccctgctgcat

SEQ ID NO: 7403866 - DNA, 22 bp, Homo sapiens
ccagccctgaaccctgctgcat

SEQ ID NO: 7403867 - DNA, 22 bp, Homo sapiens
ccagccctcggtagtcccatag

SEQ ID NO: 7403868 - DNA, 22 bp, Homo sapiens
ccagccctcggtagtcccatag

SEQ ID NO: 7403869 - DNA, 22 bp, Homo sapiens
ccagccctcggtagtcccatag

SEQ ID NO: 7403870 - DNA, 22 bp, Homo sapiens
ccagccctcggtagtcccatag

SEQ ID NO: 7403871 - DNA, 22 bp, Homo sapiens
ccagccctcggtagtcccatag

SEQ ID NO: 7403872 - DNA, 22 bp, Homo sapiens
ccagccctcggtagtcccatag

SEQ ID NO: 7403873 - DNA, 22 bp, Homo sapiens
ccagccctgaaccctgctgcat

SEQ ID NO: 7403874 - DNA, 22 bp, Homo sapiens
ccagccctcggtagtcccatag

SEQ ID NO: 7403875 - DNA, 22 bp, Homo sapiens
ccagccctgattagagaatgtc

SEQ ID NO: 7403876 - DNA, 22 bp, Homo sapiens
ccagccctgattagagaatgtc

SEQ ID NO: 7403877 - DNA, 22 bp, Homo sapiens
ccagccctgaaccctgctgcat

SEQ ID NO: 7403878 - DNA, 22 bp, Homo sapiens
ccagccctgattagagaatgtc

SEQ ID NO: 7403879 - DNA, 22 bp, Homo sapiens
ccagccctcggtagtcccatag

SEQ ID NO: 7403880 - DNA, 17 bp, Homo sapiens
ccagccctcgcgctttt

SEQ ID NO: 7403881 - DNA, 17 bp, Homo sapiens
ccagccctcgcgctttt

SEQ ID NO: 7403882 - DNA, 22 bp, Homo sapiens
ccagccctcctccatcagagga

SEQ ID NO: 7403883 - DNA, 22 bp, Homo sapiens
ccagccctcctccatcagagga

SEQ ID NO: 7403884 - DNA, 22 bp, Homo sapiens
ccagccctcctccatcagagga

SEQ ID NO: 7403885 - DNA, 22 bp, Homo sapiens
ccagccctcctccatcagagga

SEQ ID NO: 7403886 - DNA, 23 bp, Homo sapiens
ccagccctccaccagctctaggc

SEQ ID NO: 7403887 - DNA, 22 bp, Homo sapiens
ccagccagtatattccaaagcc

SEQ ID NO: 7403888 - DNA, 23 bp, Homo sapiens
ccagccctccaccagctctaggc

SEQ ID NO: 7403889 - DNA, 23 bp, Homo sapiens
ccagccctccaccagctctaggc

SEQ ID NO: 7403890 - DNA, 23 bp, Homo sapiens
ccagccctccaccagctctaggc

SEQ ID NO: 7403891 - DNA, 23 bp, Homo sapiens
ccagccctccaccagctctaggc

SEQ ID NO: 7403892 - DNA, 23 bp, Homo sapiens
ccagccctccaccagctctaggc

SEQ ID NO: 7403893 - DNA, 23 bp, Homo sapiens
ccagccctccaccagctctaggc

SEQ ID NO: 7403894 - DNA, 23 bp, Homo sapiens
ccagccctccaccagctctaggc

SEQ ID NO: 7403895 - DNA, 22 bp, Homo sapiens
ccagaggtggtgggtgctacag

SEQ ID NO: 7403896 - DNA, 22 bp, Homo sapiens
ccagaggtggtgggtgctacag

SEQ ID NO: 7403897 - DNA, 22 bp, Homo sapiens
ccagaggtggtggtgtctagaa

SEQ ID NO: 7403898 - DNA, 22 bp, Homo sapiens
ccagaggtggtggtgtctagaa

SEQ ID NO: 7403899 - DNA, 22 bp, Homo sapiens
ccagaggtggtggtgtctagaa

SEQ ID NO: 7403900 - DNA, 22 bp, Homo sapiens
ccagaggtggtgggtgctacag

SEQ ID NO: 7403901 - DNA, 22 bp, Homo sapiens
ccagaggtggtcatagaaagca

SEQ ID NO: 7403902 - DNA, 22 bp, Homo sapiens
ccagaggtggtgggtgctacag

SEQ ID NO: 7403903 - DNA, 22 bp, Homo sapiens
ccagaggtggtcatagaaagca

SEQ ID NO: 7403904 - DNA, 22 bp, Homo sapiens
ccagaggtgggagtgatctggt

SEQ ID NO: 7403905 - DNA, 22 bp, Homo sapiens
ccagaggtgggagtgatctggt

SEQ ID NO: 7403906 - DNA, 22 bp, Homo sapiens
ccagaggttccaggctagggag

SEQ ID NO: 7403907 - DNA, 22 bp, Homo sapiens
ccagaggttactttgccttgga

SEQ ID NO: 7403908 - DNA, 22 bp, Homo sapiens
ccagaggttactttgccttgga

SEQ ID NO: 7403909 - DNA, 22 bp, Homo sapiens
ccagaggttactttgccttgga

SEQ ID NO: 7403910 - DNA, 22 bp, Homo sapiens
ccagaggttacaccctcagccc

SEQ ID NO: 7403911 - DNA, 22 bp, Homo sapiens
ccagaggtggtggtgtctagaa

SEQ ID NO: 7403912 - DNA, 22 bp, Homo sapiens
ccagaggttacaccctcagccc

SEQ ID NO: 7403913 - DNA, 22 bp, Homo sapiens
ccagaggtggtggtgtctagaa

SEQ ID NO: 7403914 - DNA, 19 bp, Homo sapiens
ccagagtcatgtctccccc

SEQ ID NO: 7403915 - DNA, 22 bp, Homo sapiens
ccagagtcattttgagtcataa

SEQ ID NO: 7403916 - DNA, 19 bp, Homo sapiens
ccagagtcatgtctccccc

SEQ ID NO: 7403917 - DNA, 22 bp, Homo sapiens
ccagagtcaggagctcatgtga

SEQ ID NO: 7403918 - DNA, 22 bp, Homo sapiens
ccagagtcaggagctcatgtga

SEQ ID NO: 7403919 - DNA, 22 bp, Homo sapiens
ccagagtcaggagctcatgtga

SEQ ID NO: 7403920 - DNA, 22 bp, Homo sapiens
ccagagtagctgccctgcacct

SEQ ID NO: 7403921 - DNA, 22 bp, Homo sapiens
ccagagtcaggagctcatgtga

SEQ ID NO: 7403922 - DNA, 19 bp, Homo sapiens
ccagaggtttgctgggcct

SEQ ID NO: 7403923 - DNA, 19 bp, Homo sapiens
ccagaggtttgctgggcct

SEQ ID NO: 7403924 - DNA, 19 bp, Homo sapiens
ccagaggtttgctgggcct

SEQ ID NO: 7403925 - DNA, 19 bp, Homo sapiens
ccagaggtttgctgggcct

SEQ ID NO: 7403926 - DNA, 19 bp, Homo sapiens
ccagaggtttgctgggcct

SEQ ID NO: 7403927 - DNA, 21 bp, Homo sapiens
ccagaggttctgggcctccct

SEQ ID NO: 7403928 - DNA, 22 bp, Homo sapiens
ccagaggttccaggctagggag

SEQ ID NO: 7403929 - DNA, 21 bp, Homo sapiens
ccagaggttctgggcctccct

SEQ ID NO: 7403930 - DNA, 21 bp, Homo sapiens
ccagaggttctgggcctccct

SEQ ID NO: 7403931 - DNA, 21 bp, Homo sapiens
ccagaggttctgggcctccct

SEQ ID NO: 7403932 - DNA, 22 bp, Homo sapiens
ccagaggttccaggctagggag

SEQ ID NO: 7403933 - DNA, 22 bp, Homo sapiens
ccagaggttccaggctagggag

SEQ ID NO: 7403934 - DNA, 22 bp, Homo sapiens
ccagaggttccaggctagggag

SEQ ID NO: 7403935 - DNA, 21 bp, Homo sapiens
ccagaggcctctcttggccac

SEQ ID NO: 7403936 - DNA, 21 bp, Homo sapiens
ccagaggcctctcttggccac

SEQ ID NO: 7403937 - DNA, 22 bp, Homo sapiens
ccagaggcggaggtttgcagtg

SEQ ID NO: 7403938 - DNA, 22 bp, Homo sapiens
ccagaggcggaggtttgcagtg

SEQ ID NO: 7403939 - DNA, 16 bp, Homo sapiens
ccagaggcctggcctc

SEQ ID NO: 7403940 - DNA, 18 bp, Homo sapiens
ccagaggcccgggcaggc

SEQ ID NO: 7403941 - DNA, 18 bp, Homo sapiens
ccagaggcccgggcaggc

SEQ ID NO: 7403942 - DNA, 18 bp, Homo sapiens
ccagaggcccgggcaggc

SEQ ID NO: 7403943 - DNA, 18 bp, Homo sapiens
ccagaggcccgggcaggc

SEQ ID NO: 7403944 - DNA, 21 bp, Homo sapiens
ccagaggcctctcttggccac

SEQ ID NO: 7403945 - DNA, 21 bp, Homo sapiens
ccagaggcctctcttggccac

SEQ ID NO: 7403946 - DNA, 21 bp, Homo sapiens
ccagaggcctctcttggccac

SEQ ID NO: 7403947 - DNA, 21 bp, Homo sapiens
ccagaggcctctcttggccac

SEQ ID NO: 7403948 - DNA, 21 bp, Homo sapiens
ccagaggcctctcttggccac

SEQ ID NO: 7403949 - DNA, 21 bp, Homo sapiens
ccagaggcctctcttggccac

SEQ ID NO: 7403950 - DNA, 22 bp, Homo sapiens
ccagaggctggcaagggctcct

SEQ ID NO: 7403951 - DNA, 22 bp, Homo sapiens
ccagaggctggcaagggctcct

SEQ ID NO: 7403952 - DNA, 22 bp, Homo sapiens
ccagaggctggcaagggctcct

SEQ ID NO: 7403953 - DNA, 22 bp, Homo sapiens
ccagaggtgggagtgatctggt

SEQ ID NO: 7403954 - DNA, 22 bp, Homo sapiens
ccagaggtgggagtgatctggt

SEQ ID NO: 7403955 - DNA, 22 bp, Homo sapiens
ccagaggtgggagtgatctggt

SEQ ID NO: 7403956 - DNA, 22 bp, Homo sapiens
ccagaggtggaagattgttttg

SEQ ID NO: 7403957 - DNA, 22 bp, Homo sapiens
ccagaggtggaagattgttttg

SEQ ID NO: 7403958 - DNA, 22 bp, Homo sapiens
ccagaggctggcaagggctcct

SEQ ID NO: 7403959 - DNA, 22 bp, Homo sapiens
ccagaggtgctgggagaggtct

SEQ ID NO: 7403960 - DNA, 20 bp, Homo sapiens
ccagaggctgacagactttg

SEQ ID NO: 7403961 - DNA, 20 bp, Homo sapiens
ccagaggctgacagactttg

SEQ ID NO: 7403962 - DNA, 20 bp, Homo sapiens
ccagaggctgacagactttg

SEQ ID NO: 7403963 - DNA, 22 bp, Homo sapiens
ccagaggcggaggtttgcagtg

SEQ ID NO: 7403964 - DNA, 20 bp, Homo sapiens
ccagaggctgacagactttg

SEQ ID NO: 7403965 - DNA, 20 bp, Homo sapiens
ccagaggctgacagactttg

SEQ ID NO: 7403966 - DNA, 22 bp, Homo sapiens
ccagaggctggcaagggctcct

SEQ ID NO: 7403967 - DNA, 22 bp, Homo sapiens
ccagaggctggcaagggctcct

SEQ ID NO: 7403968 - DNA, 22 bp, Homo sapiens
ccagaggctggcaagggctcct

SEQ ID NO: 7403969 - DNA, 20 bp, Homo sapiens
ccagaggctgacagactttg

SEQ ID NO: 7403970 - DNA, 20 bp, Homo sapiens
ccagaggctgacagactttg

SEQ ID NO: 7403971 - DNA, 22 bp, Homo sapiens
ccagaggatgctggtcagcctc

SEQ ID NO: 7403972 - DNA, 22 bp, Homo sapiens
ccagaggatgctggtcagcctc

SEQ ID NO: 7403973 - DNA, 22 bp, Homo sapiens
ccagaggatgctggtcagcctc

SEQ ID NO: 7403974 - DNA, 22 bp, Homo sapiens
ccagaggatgctggtcagcctc

SEQ ID NO: 7403975 - DNA, 22 bp, Homo sapiens
ccagaggatgctggtcagcctc

SEQ ID NO: 7403976 - DNA, 22 bp, Homo sapiens
ccagaggatgctggtcagcctc

SEQ ID NO: 7403977 - DNA, 22 bp, Homo sapiens
ccagaggatgctggtcagcctc

SEQ ID NO: 7403978 - DNA, 19 bp, Homo sapiens
aggcaggtgcagaggtccc

SEQ ID NO: 7403979 - DNA, 19 bp, Homo sapiens
aggcaggtgcagaggtccc

SEQ ID NO: 7403980 - DNA, 20 bp, Homo sapiens
ccagagctgatggctgcccg

SEQ ID NO: 7403981 - DNA, 19 bp, Homo sapiens
aggcaggtgcagaggtccc

SEQ ID NO: 7403982 - DNA, 19 bp, Homo sapiens
aggcaggtgcagaggtccc

SEQ ID NO: 7403983 - DNA, 19 bp, Homo sapiens
aggcaggtgcagaggtccc

SEQ ID NO: 7403984 - DNA, 22 bp, Homo sapiens
ccagaggcatgttcaaagcaat

SEQ ID NO: 7403985 - DNA, 22 bp, Homo sapiens
ccagaggcatgttcaaagcaat

SEQ ID NO: 7403986 - DNA, 19 bp, Homo sapiens
ccagaggcagcttctgtaa

SEQ ID NO: 7403987 - DNA, 19 bp, Homo sapiens
ccagaggcagcttctgtaa

SEQ ID NO: 7403988 - DNA, 22 bp, Homo sapiens
ccagaggcatgttcaaagcaat

SEQ ID NO: 7403989 - DNA, 22 bp, Homo sapiens
ccagaggcatgttcaaagcaat

SEQ ID NO: 7403990 - DNA, 18 bp, Homo sapiens
ccagaggcccgggcaggc

SEQ ID NO: 7403991 - DNA, 18 bp, Homo sapiens
ccagaggcccgggcaggc

SEQ ID NO: 7403992 - DNA, 22 bp, Homo sapiens
ccagaggcatgttcaaagcaat

SEQ ID NO: 7403993 - DNA, 22 bp, Homo sapiens
ccagaggcagacttacactcca

SEQ ID NO: 7403994 - DNA, 22 bp, Homo sapiens
ccagaggcagacttacactcca

SEQ ID NO: 7403995 - DNA, 19 bp, Homo sapiens
ccagaggcagcttctgtaa

SEQ ID NO: 7403996 - DNA, 19 bp, Homo sapiens
ccagaggcagcttctgtaa

SEQ ID NO: 7403997 - DNA, 22 bp, Homo sapiens
ccagaggcagacttacactcca

SEQ ID NO: 7403998 - DNA, 22 bp, Homo sapiens
ccagaggcagacttacactcca

SEQ ID NO: 7403999 - DNA, 22 bp, Homo sapiens
ccagaggatgctggtcagcctc

SEQ ID NO: 7404000 - DNA, 22 bp, Homo sapiens
ccagaggatgctggtcagcctc

SEQ ID NO: 7404001 - DNA, 22 bp, Homo sapiens
aggcaggtcccctggaaggcac

SEQ ID NO: 7404002 - DNA, 22 bp, Homo sapiens
aggcaggtcccctggaaggcac

SEQ ID NO: 7404003 - DNA, 22 bp, Homo sapiens
aggcaggtcccctggaaggcac

SEQ ID NO: 7404004 - DNA, 22 bp, Homo sapiens
aggcaggtgagtcaaaacagac

SEQ ID NO: 7404005 - DNA, 22 bp, Homo sapiens
aggcaggtctgtatctagtctc

SEQ ID NO: 7404006 - DNA, 22 bp, Homo sapiens
aggcaggtcccctggaaggcac

SEQ ID NO: 7404007 - DNA, 22 bp, Homo sapiens
aggcaggtcccctggaaggcac

SEQ ID NO: 7404008 - DNA, 22 bp, Homo sapiens
aggcaggtcccctggaaggcac

SEQ ID NO: 7404009 - DNA, 22 bp, Homo sapiens
aggcaggtcacatgcttggcga

SEQ ID NO: 7404010 - DNA, 22 bp, Homo sapiens
aggcaggtcccctggaaggcac

SEQ ID NO: 7404011 - DNA, 22 bp, Homo sapiens
aggcaggtcacatgcttggcga

SEQ ID NO: 7404012 - DNA, 22 bp, Homo sapiens
aggcaggtcccctggaaggcac

SEQ ID NO: 7404013 - DNA, 22 bp, Homo sapiens
aggcaggtcccctggaaggcac

SEQ ID NO: 7404014 - DNA, 21 bp, Homo sapiens
ccactcatgactccactcacc

SEQ ID NO: 7404015 - DNA, 20 bp, Homo sapiens
ccactccaggtgattctgat

SEQ ID NO: 7404016 - DNA, 22 bp, Homo sapiens
ccactccccacgtgctgtcaga

SEQ ID NO: 7404017 - DNA, 22 bp, Homo sapiens
ccactccccacgtgctgtcaga

SEQ ID NO: 7404018 - DNA, 20 bp, Homo sapiens
ccactccaggtgattctgat

SEQ ID NO: 7404019 - DNA, 22 bp, Homo sapiens
ccactcccttccggtccagggc

SEQ ID NO: 7404020 - DNA, 22 bp, Homo sapiens
ccactcccttccggtccagggc

SEQ ID NO: 7404021 - DNA, 22 bp, Homo sapiens
ccactcccttccggtccagggc

SEQ ID NO: 7404022 - DNA, 22 bp, Homo sapiens
ccactcccttccggtccagggc

SEQ ID NO: 7404023 - DNA, 22 bp, Homo sapiens
aggcaggtagaaggatctttat

SEQ ID NO: 7404024 - DNA, 22 bp, Homo sapiens
aggcaggtcacatgcttggcga

SEQ ID NO: 7404025 - DNA, 22 bp, Homo sapiens
aggcaggtagaaggatctttat

SEQ ID NO: 7404026 - DNA, 22 bp, Homo sapiens
ccactcccttccggtccagggc

SEQ ID NO: 7404027 - DNA, 23 bp, Homo sapiens
aggatgtaggatgtatggcagag

SEQ ID NO: 7404028 - DNA, 23 bp, Homo sapiens
aggatgtaggatgtatggcagag

SEQ ID NO: 7404029 - DNA, 22 bp, Homo sapiens
aggatgtcagcattggctagag

SEQ ID NO: 7404030 - DNA, 20 bp, Homo sapiens
aggatgtccccgagggcctg

SEQ ID NO: 7404031 - DNA, 23 bp, Homo sapiens
aggatgtcgaatgttagagtgag

SEQ ID NO: 7404032 - DNA, 22 bp, Homo sapiens
aggatgtctctccagcctggag

SEQ ID NO: 7404033 - DNA, 23 bp, Homo sapiens
aggatgtcgaatgttagagtgag

SEQ ID NO: 7404034 - DNA, 22 bp, Homo sapiens
aggatgtctgctgctgtgggct

SEQ ID NO: 7404035 - DNA, 22 bp, Homo sapiens
aggatgtctctccagcctggag

SEQ ID NO: 7404036 - DNA, 22 bp, Homo sapiens
aggatgtgagtggacacagtcc

SEQ ID NO: 7404037 - DNA, 22 bp, Homo sapiens
aggatgtgagccagcctggcct

SEQ ID NO: 7404038 - DNA, 22 bp, Homo sapiens
aggatgtgccaccagctttgca

SEQ ID NO: 7404039 - DNA, 23 bp, Homo sapiens
aggatgtgcatatgacctaatca

SEQ ID NO: 7404040 - DNA, 22 bp, Homo sapiens
aggatgtgccaccagctttgca

SEQ ID NO: 7404041 - DNA, 22 bp, Homo sapiens
aggatgtgagtggacacagtcc

SEQ ID NO: 7404042 - DNA, 22 bp, Homo sapiens
catgagataatttttctccagt

SEQ ID NO: 7404043 - DNA, 22 bp, Homo sapiens
catgagataatttttctccagt

SEQ ID NO: 7404044 - DNA, 22 bp, Homo sapiens
catgagataatttttctccagt

SEQ ID NO: 7404045 - DNA, 22 bp, Homo sapiens
catgagagacattctgtgtgaa

SEQ ID NO: 7404046 - DNA, 22 bp, Homo sapiens
catgagagatccttcatgagag

SEQ ID NO: 7404047 - DNA, 22 bp, Homo sapiens
catgagatttgggaggggccag

SEQ ID NO: 7404048 - DNA, 22 bp, Homo sapiens
catgagatctgcagggatgggc

SEQ ID NO: 7404049 - DNA, 22 bp, Homo sapiens
catgagataatttttctccagt

SEQ ID NO: 7404050 - DNA, 22 bp, Homo sapiens
catgagataatttttctccagt

SEQ ID NO: 7404051 - DNA, 22 bp, Homo sapiens
aggatgtgggttttcacattgt

SEQ ID NO: 7404052 - DNA, 22 bp, Homo sapiens
catgagaatgaagaagacttaa

SEQ ID NO: 7404053 - DNA, 22 bp, Homo sapiens
aggatgtggctgagacttctgg

SEQ ID NO: 7404054 - DNA, 22 bp, Homo sapiens
aggatgtgccaccagctttgca

SEQ ID NO: 7404055 - DNA, 17 bp, Homo sapiens
aggatgtggagaaaatt

SEQ ID NO: 7404056 - DNA, 22 bp, Homo sapiens
catgagagacattctgtgtgaa

SEQ ID NO: 7404057 - DNA, 19 bp, Homo sapiens
catgaggcagctgcacccc

SEQ ID NO: 7404058 - DNA, 19 bp, Homo sapiens
catgaggcagctgcacccc

SEQ ID NO: 7404059 - DNA, 22 bp, Homo sapiens
catgagggttggggtggagctt

SEQ ID NO: 7404060 - DNA, 22 bp, Homo sapiens
catgagggttggggtggagctt

SEQ ID NO: 7404061 - DNA, 22 bp, Homo sapiens
catgagggttggggtggagctt

SEQ ID NO: 7404062 - DNA, 19 bp, Homo sapiens
catgaggcagctgcacccc

SEQ ID NO: 7404063 - DNA, 22 bp, Homo sapiens
catgaggatgggcagctgggga

SEQ ID NO: 7404064 - DNA, 22 bp, Homo sapiens
catgaggatgggcagctgggga

SEQ ID NO: 7404065 - DNA, 22 bp, Homo sapiens
catgaggatgggcagctgggga

SEQ ID NO: 7404066 - DNA, 22 bp, Homo sapiens
catgaggtcagggggagccggt

SEQ ID NO: 7404067 - DNA, 22 bp, Homo sapiens
catgaggtgataaagctgggat

SEQ ID NO: 7404068 - DNA, 22 bp, Homo sapiens
catgaggtcagggggagccggt

SEQ ID NO: 7404069 - DNA, 22 bp, Homo sapiens
catgaggtcagggggagccggt

SEQ ID NO: 7404070 - DNA, 22 bp, Homo sapiens
catgaggtgataaagctgggat

SEQ ID NO: 7404071 - DNA, 22 bp, Homo sapiens
aggattttagataagacagcaa

SEQ ID NO: 7404072 - DNA, 18 bp, Homo sapiens
catgagctgcccctagac

SEQ ID NO: 7404073 - DNA, 22 bp, Homo sapiens
catgagctgctgggagcctgtc

SEQ ID NO: 7404074 - DNA, 22 bp, Homo sapiens
catgagcattttggtctagttt

SEQ ID NO: 7404075 - DNA, 18 bp, Homo sapiens
catgagctgcccctagac

SEQ ID NO: 7404076 - DNA, 22 bp, Homo sapiens
catgaggatccaggtgacaggc

SEQ ID NO: 7404077 - DNA, 22 bp, Homo sapiens
catgaggatccaggtgacaggc

SEQ ID NO: 7404078 - DNA, 22 bp, Homo sapiens
catgaggatgggcagctgggga

SEQ ID NO: 7404079 - DNA, 22 bp, Homo sapiens
catgaggatccaggtgacaggc

SEQ ID NO: 7404080 - DNA, 22 bp, Homo sapiens
catgaggatccaggtgacaggc

SEQ ID NO: 7404081 - DNA, 22 bp, Homo sapiens
catgagatttgggaggggccag

SEQ ID NO: 7404082 - DNA, 22 bp, Homo sapiens
catgagatttgggaggggccag

SEQ ID NO: 7404083 - DNA, 22 bp, Homo sapiens
catgagatttgggaggggccag

SEQ ID NO: 7404084 - DNA, 22 bp, Homo sapiens
catgagcataaatcagtcacga

SEQ ID NO: 7404085 - DNA, 22 bp, Homo sapiens
catgagcattttggtctagttt

SEQ ID NO: 7404086 - DNA, 22 bp, Homo sapiens
catgagcataaatcagtcacga

SEQ ID NO: 7404087 - DNA, 22 bp, Homo sapiens
catgagatttgggaggggccag

SEQ ID NO: 7404088 - DNA, 22 bp, Homo sapiens
catgagatttgggaggggccag

SEQ ID NO: 7404089 - DNA, 22 bp, Homo sapiens
catcttcaggttcatggtcata

SEQ ID NO: 7404090 - DNA, 22 bp, Homo sapiens
catcttcaggttcatggtcata

SEQ ID NO: 7404091 - DNA, 22 bp, Homo sapiens
catcttcaggtgttttccatca

SEQ ID NO: 7404092 - DNA, 22 bp, Homo sapiens
catcttcaggtgttttccatca

SEQ ID NO: 7404093 - DNA, 22 bp, Homo sapiens
catcttcagtgattacctaaaa

SEQ ID NO: 7404094 - DNA, 22 bp, Homo sapiens
catcttcattttgtccagtact

SEQ ID NO: 7404095 - DNA, 22 bp, Homo sapiens
catcttcattttgtccagtact

SEQ ID NO: 7404096 - DNA, 22 bp, Homo sapiens
catcttcataaaggaactgcat

SEQ ID NO: 7404097 - DNA, 22 bp, Homo sapiens
catcttcagtgattacctaaaa

SEQ ID NO: 7404098 - DNA, 22 bp, Homo sapiens
catcttctgggacttctcagtt

SEQ ID NO: 7404099 - DNA, 20 bp, Homo sapiens
catcttgaaggtcttccaca

SEQ ID NO: 7404100 - DNA, 22 bp, Homo sapiens
catcttgactgggataagggat

SEQ ID NO: 7404101 - DNA, 20 bp, Homo sapiens
catcttgaaggtcttccaca

SEQ ID NO: 7404102 - DNA, 22 bp, Homo sapiens
catcttgaaggtttctttagct

SEQ ID NO: 7404103 - DNA, 22 bp, Homo sapiens
catcttgaaggtttctttagct

SEQ ID NO: 7404104 - DNA, 22 bp, Homo sapiens
catcttgaaggtttctttagct

SEQ ID NO: 7404105 - DNA, 22 bp, Homo sapiens
catcttctgggacttctcagtt

SEQ ID NO: 7404106 - DNA, 22 bp, Homo sapiens
catcttctgggacttctcagtt

SEQ ID NO: 7404107 - DNA, 22 bp, Homo sapiens
catcttctgggacttctcagtt

SEQ ID NO: 7404108 - DNA, 22 bp, Homo sapiens
catcttgcctgctattctgttg

SEQ ID NO: 7404109 - DNA, 22 bp, Homo sapiens
catcttgctgacttgcattatt

SEQ ID NO: 7404110 - DNA, 22 bp, Homo sapiens
catcttgctgacttgcattatt

SEQ ID NO: 7404111 - DNA, 22 bp, Homo sapiens
catcttgctgggttttatcata

SEQ ID NO: 7404112 - DNA, 22 bp, Homo sapiens
catcttgctgttatgtttatgt

SEQ ID NO: 7404113 - DNA, 22 bp, Homo sapiens
catcttgagacatgaaaggtgt

SEQ ID NO: 7404114 - DNA, 22 bp, Homo sapiens
catcttgatgctttgacaggtt

SEQ ID NO: 7404115 - DNA, 22 bp, Homo sapiens
catcttgatgctttgacaggtt

SEQ ID NO: 7404116 - DNA, 22 bp, Homo sapiens
catcttgatgctttgacaggtt

SEQ ID NO: 7404117 - DNA, 22 bp, Homo sapiens
catcttgatgctttgacaggtt

SEQ ID NO: 7404118 - DNA, 22 bp, Homo sapiens
catcttgccctacacatttatc

SEQ ID NO: 7404119 - DNA, 22 bp, Homo sapiens
catcttgtctttttgggcctga

SEQ ID NO: 7404120 - DNA, 22 bp, Homo sapiens
catcttgtgaatttctgattct

SEQ ID NO: 7404121 - DNA, 22 bp, Homo sapiens
catcttggttcaatttcttcat

SEQ ID NO: 7404122 - DNA, 22 bp, Homo sapiens
catcttgtgaatttctgattct

SEQ ID NO: 7404123 - DNA, 17 bp, Homo sapiens
catctttaaaatcctga

SEQ ID NO: 7404124 - DNA, 17 bp, Homo sapiens
catctttaaaatcctga

SEQ ID NO: 7404125 - DNA, 17 bp, Homo sapiens
catctttaaaatcctga

SEQ ID NO: 7404126 - DNA, 22 bp, Homo sapiens
catcttgcttcatctgctgtgt

SEQ ID NO: 7404127 - DNA, 22 bp, Homo sapiens
catcttgcttcatctgctgtgt

SEQ ID NO: 7404128 - DNA, 22 bp, Homo sapiens
catcttgcttgtctttagtaag

SEQ ID NO: 7404129 - DNA, 22 bp, Homo sapiens
catcttgcttgtctttagtaag

SEQ ID NO: 7404130 - DNA, 19 bp, Homo sapiens
catcttggagtactccttt

SEQ ID NO: 7404131 - DNA, 22 bp, Homo sapiens
catcttggatgacataactgtg

SEQ ID NO: 7404132 - DNA, 22 bp, Homo sapiens
aggatgagagatacatggagca

SEQ ID NO: 7404133 - DNA, 22 bp, Homo sapiens
aggatgagagatacatggagca

SEQ ID NO: 7404134 - DNA, 22 bp, Homo sapiens
aggatgagagatacatggagca

SEQ ID NO: 7404135 - DNA, 22 bp, Homo sapiens
aggatgagagatacatggagca

SEQ ID NO: 7404136 - DNA, 22 bp, Homo sapiens
aggatgagagatacatggagca

SEQ ID NO: 7404137 - DNA, 22 bp, Homo sapiens
aggatgagagatacatggagca

SEQ ID NO: 7404138 - DNA, 22 bp, Homo sapiens
aggatgagagatacatggagca

SEQ ID NO: 7404139 - DNA, 22 bp, Homo sapiens
aggatggcttgcaggaggctgt

SEQ ID NO: 7404140 - DNA, 22 bp, Homo sapiens
aggatgagagatacatggagca

SEQ ID NO: 7404141 - DNA, 22 bp, Homo sapiens
aggatggcttgcaggaggctgt

SEQ ID NO: 7404142 - DNA, 22 bp, Homo sapiens
aggatggggtctgcagcctggt

SEQ ID NO: 7404143 - DNA, 22 bp, Homo sapiens
aggatggggtctgcagcctggt

SEQ ID NO: 7404144 - DNA, 22 bp, Homo sapiens
aggatggggtctgcagcctggt

SEQ ID NO: 7404145 - DNA, 22 bp, Homo sapiens
aggatgggcctgggatatgctt

SEQ ID NO: 7404146 - DNA, 22 bp, Homo sapiens
aggatgggcctgggatatgctt

SEQ ID NO: 7404147 - DNA, 22 bp, Homo sapiens
aggatgggcctgggatatgctt

SEQ ID NO: 7404148 - DNA, 22 bp, Homo sapiens
aggatgggcctgggatatgctt

SEQ ID NO: 7404149 - DNA, 22 bp, Homo sapiens
aggatggcttgcaggaggctgt

SEQ ID NO: 7404150 - DNA, 23 bp, Homo sapiens
aggatgtaggatgtatggcagag

SEQ ID NO: 7404151 - DNA, 23 bp, Homo sapiens
aggatgtaggatgtatggcagag

SEQ ID NO: 7404152 - DNA, 23 bp, Homo sapiens
aggatgtaggatgtatggcagag

SEQ ID NO: 7404153 - DNA, 23 bp, Homo sapiens
aggatgggtggcaatagaaagac

SEQ ID NO: 7404154 - DNA, 23 bp, Homo sapiens
aggatgggtggcaatagaaagac

SEQ ID NO: 7404155 - DNA, 22 bp, Homo sapiens
aggatgggtcagctagagtcca

SEQ ID NO: 7404156 - DNA, 22 bp, Homo sapiens
aggatgggtcagctagagtcca

SEQ ID NO: 7404157 - DNA, 23 bp, Homo sapiens
aggatgggtggcaatagaaagac

SEQ ID NO: 7404158 - DNA, 23 bp, Homo sapiens
aggatgggtggcaatagaaagac

SEQ ID NO: 7404159 - DNA, 22 bp, Homo sapiens
aggatggggtctgcagcctggt

SEQ ID NO: 7404160 - DNA, 22 bp, Homo sapiens
aggatggggtctgcagcctggt

SEQ ID NO: 7404161 - DNA, 22 bp, Homo sapiens
aggatggggtctgcagcctggt

SEQ ID NO: 7404162 - DNA, 22 bp, Homo sapiens
aggatggggtctgcagcctggt

SEQ ID NO: 7404163 - DNA, 22 bp, Homo sapiens
aggatgggtcagctagagtcca

SEQ ID NO: 7404164 - DNA, 22 bp, Homo sapiens
aggatgggtcagctagagtcca

SEQ ID NO: 7404165 - DNA, 22 bp, Homo sapiens
catcttcaggggctacatctgt

SEQ ID NO: 7404166 - DNA, 22 bp, Homo sapiens
catcttcaggggctacatctgt

SEQ ID NO: 7404167 - DNA, 22 bp, Homo sapiens
catcttcaccagagacaagcaa

SEQ ID NO: 7404168 - DNA, 22 bp, Homo sapiens
catcttcaccagagacaagcaa

SEQ ID NO: 7404169 - DNA, 22 bp, Homo sapiens
catcttattttcttctagtgct

SEQ ID NO: 7404170 - DNA, 22 bp, Homo sapiens
catcttataggcagagttcagt

SEQ ID NO: 7404171 - DNA, 22 bp, Homo sapiens
catcttcaccagagacaagcaa

SEQ ID NO: 7404172 - DNA, 22 bp, Homo sapiens
catcttcacatatttccaatga

SEQ ID NO: 7404173 - DNA, 22 bp, Homo sapiens
catcttcacatatttccaatga

SEQ ID NO: 7404174 - DNA, 22 bp, Homo sapiens
catctcttcattagcattattg

SEQ ID NO: 7404175 - DNA, 21 bp, Homo sapiens
catcttaggttgtacatatat

SEQ ID NO: 7404176 - DNA, 21 bp, Homo sapiens
catcttaggttgtacatatat

SEQ ID NO: 7404177 - DNA, 22 bp, Homo sapiens
catcttaatttctaacaggcac

SEQ ID NO: 7404178 - DNA, 22 bp, Homo sapiens
catcttacccctgctaatgacc

SEQ ID NO: 7404179 - DNA, 22 bp, Homo sapiens
catctctgagacctcagctggg

SEQ ID NO: 7404180 - DNA, 22 bp, Homo sapiens
catctctgagacctcagctggg

SEQ ID NO: 7404181 - DNA, 19 bp, Homo sapiens
catctctgcaaggagctgc

SEQ ID NO: 7404182 - DNA, 19 bp, Homo sapiens
catctctgcaaggagctgc

SEQ ID NO: 7404183 - DNA, 22 bp, Homo sapiens
catctctccacggcagctctcg

SEQ ID NO: 7404184 - DNA, 22 bp, Homo sapiens
catctctccacggcagctctcg

SEQ ID NO: 7404185 - DNA, 22 bp, Homo sapiens
catctctgagacctcagctggg

SEQ ID NO: 7404186 - DNA, 22 bp, Homo sapiens
catctctggttcagtctctgtg

SEQ ID NO: 7404187 - DNA, 19 bp, Homo sapiens
catctctgcaaggagctgc

SEQ ID NO: 7404188 - DNA, 19 bp, Homo sapiens
catctctgcaaggagctgc

SEQ ID NO: 7404189 - DNA, 19 bp, Homo sapiens
catctctgcaaggagctgc

SEQ ID NO: 7404190 - DNA, 22 bp, Homo sapiens
catctctgtgtccccagagctt

SEQ ID NO: 7404191 - DNA, 22 bp, Homo sapiens
catctctgtgtccccagagctt

SEQ ID NO: 7404192 - DNA, 22 bp, Homo sapiens
catctctgtgtccccagagctt

SEQ ID NO: 7404193 - DNA, 22 bp, Homo sapiens
catctctgtgtccccagagctt

SEQ ID NO: 7404194 - DNA, 22 bp, Homo sapiens
catctctgtgtccccagagctt

SEQ ID NO: 7404195 - DNA, 22 bp, Homo sapiens
catctctgtgtccccacaccca

SEQ ID NO: 7404196 - DNA, 22 bp, Homo sapiens
catctcctggcagctgttagga

SEQ ID NO: 7404197 - DNA, 20 bp, Homo sapiens
catctcctgcctccatgttc

SEQ ID NO: 7404198 - DNA, 20 bp, Homo sapiens
catctcctgcctccatgttc

SEQ ID NO: 7404199 - DNA, 20 bp, Homo sapiens
catctcctgcctccatgttc

SEQ ID NO: 7404200 - DNA, 22 bp, Homo sapiens
catctctccacggcagctctcg

SEQ ID NO: 7404201 - DNA, 22 bp, Homo sapiens
catctccaggtttagggagcac

SEQ ID NO: 7404202 - DNA, 22 bp, Homo sapiens
catctccaggtttagggagcac

SEQ ID NO: 7404203 - DNA, 22 bp, Homo sapiens
catctccaggtttagggagcac

SEQ ID NO: 7404204 - DNA, 22 bp, Homo sapiens
catctcccacttccttgggggt

SEQ ID NO: 7404205 - DNA, 19 bp, Homo sapiens
catctcccacagccacaca

SEQ ID NO: 7404206 - DNA, 22 bp, Homo sapiens
catctccaggagttctactcat

SEQ ID NO: 7404207 - DNA, 22 bp, Homo sapiens
catctccaggagttctactcat

SEQ ID NO: 7404208 - DNA, 22 bp, Homo sapiens
catctcatgggcatgccaagct

SEQ ID NO: 7404209 - DNA, 22 bp, Homo sapiens
catctcatttattccaactcag

SEQ ID NO: 7404210 - DNA, 22 bp, Homo sapiens
catccaaagcaaatatcttaaa

SEQ ID NO: 7404211 - DNA, 22 bp, Homo sapiens
catccaaagcaaatatcttaaa

SEQ ID NO: 7404212 - DNA, 22 bp, Homo sapiens
catccaaactctcattatctgt

SEQ ID NO: 7404213 - DNA, 22 bp, Homo sapiens
catacatatgcatgtgtgtata

SEQ ID NO: 7404214 - DNA, 22 bp, Homo sapiens
catacatatgtggatgtcatat

SEQ ID NO: 7404215 - DNA, 22 bp, Homo sapiens
catacatatgtggatgtcatat

SEQ ID NO: 7404216 - DNA, 22 bp, Homo sapiens
catacatatgtggatgtcatat

SEQ ID NO: 7404217 - DNA, 22 bp, Homo sapiens
catccaagaaaattttctctct

SEQ ID NO: 7404218 - DNA, 22 bp, Homo sapiens
catccaataccagtttgcaggc

SEQ ID NO: 7404219 - DNA, 22 bp, Homo sapiens
catccaagaaaattttctctct

SEQ ID NO: 7404220 - DNA, 22 bp, Homo sapiens
catctcatagtgcagtgctgta

SEQ ID NO: 7404221 - DNA, 22 bp, Homo sapiens
catctcatagtgcagtgctgta

SEQ ID NO: 7404222 - DNA, 22 bp, Homo sapiens
catctcatcagtgagagtcagc

SEQ ID NO: 7404223 - DNA, 22 bp, Homo sapiens
catctcatcagtgagagtcagc

SEQ ID NO: 7404224 - DNA, 22 bp, Homo sapiens
catctcatcagtgagagtcagc

SEQ ID NO: 7404225 - DNA, 22 bp, Homo sapiens
catctcatcctgccctaaaaca

SEQ ID NO: 7404226 - DNA, 22 bp, Homo sapiens
catacagttttccctagatgtg

SEQ ID NO: 7404227 - DNA, 22 bp, Homo sapiens
catacataccactgctgtcttt

SEQ ID NO: 7404228 - DNA, 22 bp, Homo sapiens
catacataccactgctgtcttt

SEQ ID NO: 7404229 - DNA, 22 bp, Homo sapiens
catacatatgcatgtgtgtata

SEQ ID NO: 7404230 - DNA, 22 bp, Homo sapiens
catacatactgagtggactgat

SEQ ID NO: 7404231 - DNA, 22 bp, Homo sapiens
catacataccactgctgtcttt

SEQ ID NO: 7404232 - DNA, 22 bp, Homo sapiens
catacatactgagtggactgat

SEQ ID NO: 7404233 - DNA, 22 bp, Homo sapiens
catacatactgagtggactgat

SEQ ID NO: 7404234 - DNA, 22 bp, Homo sapiens
catacagtgtggcatgtagtct

SEQ ID NO: 7404235 - DNA, 22 bp, Homo sapiens
catacagtgtggcatgtagtct

SEQ ID NO: 7404236 - DNA, 22 bp, Homo sapiens
catacagttttccctagatgtg

SEQ ID NO: 7404237 - DNA, 22 bp, Homo sapiens
catacagtgtggcatgtagtct

SEQ ID NO: 7404238 - DNA, 22 bp, Homo sapiens
catacagatggccaggcctcac

SEQ ID NO: 7404239 - DNA, 22 bp, Homo sapiens
catacagatggccaggcctcac

SEQ ID NO: 7404240 - DNA, 22 bp, Homo sapiens
catacagagaaggataataaag

SEQ ID NO: 7404241 - DNA, 22 bp, Homo sapiens
catacagagaaggataataaag

SEQ ID NO: 7404242 - DNA, 22 bp, Homo sapiens
catacagagaaggataataaag

SEQ ID NO: 7404243 - DNA, 22 bp, Homo sapiens
catacaaatgtgtccaggctct

SEQ ID NO: 7404244 - DNA, 22 bp, Homo sapiens
catacaaatgtgtccaggctct

SEQ ID NO: 7404245 - DNA, 22 bp, Homo sapiens
catacaagcgtgcatgtgcttg

SEQ ID NO: 7404246 - DNA, 22 bp, Homo sapiens
catacaagcgtgcatgtgcttg

SEQ ID NO: 7404247 - DNA, 22 bp, Homo sapiens
catacaatcaagttctttatta

SEQ ID NO: 7404248 - DNA, 22 bp, Homo sapiens
catacaatcaagttctttatta

SEQ ID NO: 7404249 - DNA, 22 bp, Homo sapiens
catacaagcgttcaatagatgt

SEQ ID NO: 7404250 - DNA, 22 bp, Homo sapiens
catacaagcgttcaatagatgt

SEQ ID NO: 7404251 - DNA, 22 bp, Homo sapiens
catacaagcgttcaatagatgt

SEQ ID NO: 7404252 - DNA, 22 bp, Homo sapiens
catacaagcgttcaatagatgt

SEQ ID NO: 7404253 - DNA, 22 bp, Homo sapiens
catacaagcgttcaatagatgt

SEQ ID NO: 7404254 - DNA, 22 bp, Homo sapiens
catacaagcgttcaatagatgt

SEQ ID NO: 7404255 - DNA, 22 bp, Homo sapiens
catacaatcaagttctttatta

SEQ ID NO: 7404256 - DNA, 22 bp, Homo sapiens
catacaatcaagttctttatta

SEQ ID NO: 7404257 - DNA, 22 bp, Homo sapiens
catacagaaaatatattttgat

SEQ ID NO: 7404258 - DNA, 20 bp, Homo sapiens
catacactattctgtatagt

SEQ ID NO: 7404259 - DNA, 20 bp, Homo sapiens
catacactattctgtatagt

SEQ ID NO: 7404260 - DNA, 22 bp, Homo sapiens
aggaggcctgtgtttgtctgta

SEQ ID NO: 7404261 - DNA, 22 bp, Homo sapiens
aggaggcctgttttctcctgga

SEQ ID NO: 7404262 - DNA, 22 bp, Homo sapiens
aggaggcctgttttctcctgga

SEQ ID NO: 7404263 - DNA, 22 bp, Homo sapiens
aggaggcctgttttctcctgga

SEQ ID NO: 7404264 - DNA, 22 bp, Homo sapiens
aggaggcctgtgtttgtctgta

SEQ ID NO: 7404265 - DNA, 22 bp, Homo sapiens
aggaggctctcaggtcctcccc

SEQ ID NO: 7404266 - DNA, 22 bp, Homo sapiens
aggaggctctcaggtcctcccc

SEQ ID NO: 7404267 - DNA, 22 bp, Homo sapiens
aggaggccttggggcttagagc

SEQ ID NO: 7404268 - DNA, 22 bp, Homo sapiens
aggaggctctcaggtcctcccc

SEQ ID NO: 7404269 - DNA, 22 bp, Homo sapiens
aggaggctctcaggtcctcccc

SEQ ID NO: 7404270 - DNA, 22 bp, Homo sapiens
aggaggcctgcagctgccattc

SEQ ID NO: 7404271 - DNA, 22 bp, Homo sapiens
aggaggcctgcagctgccattc

SEQ ID NO: 7404272 - DNA, 22 bp, Homo sapiens
aggaggcctgcagctgccattc

SEQ ID NO: 7404273 - DNA, 22 bp, Homo sapiens
aggaggcctgcagctgccattc

SEQ ID NO: 7404274 - DNA, 22 bp, Homo sapiens
aggaggcctggctggggagatc

SEQ ID NO: 7404275 - DNA, 22 bp, Homo sapiens
aggaggcctggctggggagatc

SEQ ID NO: 7404276 - DNA, 22 bp, Homo sapiens
aggaggcctggctggggagatc

SEQ ID NO: 7404277 - DNA, 20 bp, Homo sapiens
aggaggcctgcagatagttc

SEQ ID NO: 7404278 - DNA, 20 bp, Homo sapiens
aggaggcctgcagatagttc

SEQ ID NO: 7404279 - DNA, 20 bp, Homo sapiens
aggaggcctgcagatagttc

SEQ ID NO: 7404280 - DNA, 22 bp, Homo sapiens
aggaggcctgcagctgccattc

SEQ ID NO: 7404281 - DNA, 22 bp, Homo sapiens
aggaggctgaactagggtctgg

SEQ ID NO: 7404282 - DNA, 22 bp, Homo sapiens
aggaggctgaactagggtctgg

SEQ ID NO: 7404283 - DNA, 22 bp, Homo sapiens
aggaggctgaactagggtctgg

SEQ ID NO: 7404284 - DNA, 22 bp, Homo sapiens
aggaggctgaactagggtctgg

SEQ ID NO: 7404285 - DNA, 22 bp, Homo sapiens
aggaggctctcaggtcctcccc

SEQ ID NO: 7404286 - DNA, 22 bp, Homo sapiens
aggaggctctcaggtcctcccc

SEQ ID NO: 7404287 - DNA, 22 bp, Homo sapiens
aggaggctgaactagggtctgg

SEQ ID NO: 7404288 - DNA, 22 bp, Homo sapiens
aggaggctgaactagggtctgg

SEQ ID NO: 7404289 - DNA, 22 bp, Homo sapiens
aggaggctgaactagggtctgg

SEQ ID NO: 7404290 - DNA, 22 bp, Homo sapiens
catacaaatgtgtccaggctct

SEQ ID NO: 7404291 - DNA, 22 bp, Homo sapiens
aggaggctgcaaccctgaggcc

SEQ ID NO: 7404292 - DNA, 22 bp, Homo sapiens
aggaggctgaactagggtctgg

SEQ ID NO: 7404293 - DNA, 22 bp, Homo sapiens
aggaggctgaactagggtctgg

SEQ ID NO: 7404294 - DNA, 22 bp, Homo sapiens
aggaggctgaactagggtctgg

SEQ ID NO: 7404295 - DNA, 22 bp, Homo sapiens
catacaaatgtgtccaggctct

SEQ ID NO: 7404296 - DNA, 22 bp, Homo sapiens
catacaaatgtgtccaggctct

SEQ ID NO: 7404297 - DNA, 22 bp, Homo sapiens
catacaaatgtgtccaggctct

SEQ ID NO: 7404298 - DNA, 22 bp, Homo sapiens
catacaaatgtgtccaggctct

SEQ ID NO: 7404299 - DNA, 22 bp, Homo sapiens
catacaaatgtgtccaggctct

SEQ ID NO: 7404300 - DNA, 22 bp, Homo sapiens
catacaaatgtgtccaggctct

SEQ ID NO: 7404301 - DNA, 22 bp, Homo sapiens
catacaaatgtgtccaggctct

SEQ ID NO: 7404302 - DNA, 22 bp, Homo sapiens
aggagctggtagtctcattggg

SEQ ID NO: 7404303 - DNA, 22 bp, Homo sapiens
aggagctggtagtctcattggg

SEQ ID NO: 7404304 - DNA, 22 bp, Homo sapiens
aggagctgtcagagtgccagag

SEQ ID NO: 7404305 - DNA, 22 bp, Homo sapiens
aggagctggtagtctcattggg

SEQ ID NO: 7404306 - DNA, 22 bp, Homo sapiens
aggagctggtagtctcattggg

SEQ ID NO: 7404307 - DNA, 22 bp, Homo sapiens
aggagctgggttcctttggtgg

SEQ ID NO: 7404308 - DNA, 22 bp, Homo sapiens
aggagctgggttcctttggtgg

SEQ ID NO: 7404309 - DNA, 22 bp, Homo sapiens
aggagctggtagtctcattggg

SEQ ID NO: 7404310 - DNA, 22 bp, Homo sapiens
aggagctggtagtctcattggg

SEQ ID NO: 7404311 - DNA, 22 bp, Homo sapiens
aggagctgggttcctttggtgg

SEQ ID NO: 7404312 - DNA, 22 bp, Homo sapiens
aggagctgggttcctttggtgg

SEQ ID NO: 7404313 - DNA, 22 bp, Homo sapiens
aggagctgggttcctttggtgg

SEQ ID NO: 7404314 - DNA, 16 bp, Homo sapiens
aggagctgggtaggag

SEQ ID NO: 7404315 - DNA, 16 bp, Homo sapiens
aggagctgggtaggag

SEQ ID NO: 7404316 - DNA, 17 bp, Homo sapiens
aggagctgggggtggtg

SEQ ID NO: 7404317 - DNA, 16 bp, Homo sapiens
aggagctgggtaggag

SEQ ID NO: 7404318 - DNA, 16 bp, Homo sapiens
aggagctgggtaggag

SEQ ID NO: 7404319 - DNA, 22 bp, Homo sapiens
aggagctgtcagagtgccagag

SEQ ID NO: 7404320 - DNA, 22 bp, Homo sapiens
aggagctgtcagagtgccagag

SEQ ID NO: 7404321 - DNA, 22 bp, Homo sapiens
aggagctgtcagagtgccagag

SEQ ID NO: 7404322 - DNA, 22 bp, Homo sapiens
aggagctgtcagagtgccagag

SEQ ID NO: 7404323 - DNA, 22 bp, Homo sapiens
aggagctgtcagagtgccagag

SEQ ID NO: 7404324 - DNA, 22 bp, Homo sapiens
aggagctgtcagagtgccagag

SEQ ID NO: 7404325 - DNA, 22 bp, Homo sapiens
aggagctgtcatttgattcaca

SEQ ID NO: 7404326 - DNA, 22 bp, Homo sapiens
aggagctgtcagagtgccagag

SEQ ID NO: 7404327 - DNA, 22 bp, Homo sapiens
aggagctgtcagagtgccagag

SEQ ID NO: 7404328 - DNA, 22 bp, Homo sapiens
aggagctgtcagagtgccagag

SEQ ID NO: 7404329 - DNA, 22 bp, Homo sapiens
aggagctgtgaatgggaggggt

SEQ ID NO: 7404330 - DNA, 22 bp, Homo sapiens
aggagctgtgaatgggaggggt

SEQ ID NO: 7404331 - DNA, 22 bp, Homo sapiens
aggagctgtgaatgggaggggt

SEQ ID NO: 7404332 - DNA, 22 bp, Homo sapiens
aggagctgtcatttgattcaca

SEQ ID NO: 7404333 - DNA, 22 bp, Homo sapiens
aggagctgtgaatgggaggggt

SEQ ID NO: 7404334 - DNA, 22 bp, Homo sapiens
aggagctgtgaatgggaggggt

SEQ ID NO: 7404335 - DNA, 22 bp, Homo sapiens
aggaggcagatgcttggctgta

SEQ ID NO: 7404336 - DNA, 22 bp, Homo sapiens
aggaggcagatgcttggctgta

SEQ ID NO: 7404337 - DNA, 22 bp, Homo sapiens
aggagctgtgaatgggaggggt

SEQ ID NO: 7404338 - DNA, 22 bp, Homo sapiens
aggagctgtgaatgggaggggt

SEQ ID NO: 7404339 - DNA, 22 bp, Homo sapiens
aggagctgtgaatgggaggggt

SEQ ID NO: 7404340 - DNA, 22 bp, Homo sapiens
aggagctgtgaatgggaggggt

SEQ ID NO: 7404341 - DNA, 22 bp, Homo sapiens
aggaggcagatgcttggctgta

SEQ ID NO: 7404342 - DNA, 22 bp, Homo sapiens
aggaggcagatgcttggctgta

SEQ ID NO: 7404343 - DNA, 22 bp, Homo sapiens
aggaggcaggaagtctatggga

SEQ ID NO: 7404344 - DNA, 22 bp, Homo sapiens
aggaggcaggaagtctatggga

SEQ ID NO: 7404345 - DNA, 22 bp, Homo sapiens
aggaggcaggaagtctatggga

SEQ ID NO: 7404346 - DNA, 22 bp, Homo sapiens
aggaggccgctgatgggctccc

SEQ ID NO: 7404347 - DNA, 22 bp, Homo sapiens
aggaggccgctgatgggctccc

SEQ ID NO: 7404348 - DNA, 22 bp, Homo sapiens
aggaggcctctatccagagaga

SEQ ID NO: 7404349 - DNA, 22 bp, Homo sapiens
aggaggcctctatccagagaga

SEQ ID NO: 7404350 - DNA, 22 bp, Homo sapiens
aggaggcctacgcacatgtcta

SEQ ID NO: 7404351 - DNA, 22 bp, Homo sapiens
aggaggccgggattctggagat

SEQ ID NO: 7404352 - DNA, 22 bp, Homo sapiens
aggaggcctacgcacatgtcta

SEQ ID NO: 7404353 - DNA, 22 bp, Homo sapiens
aggaggcctacgcacatgtcta

SEQ ID NO: 7404354 - DNA, 22 bp, Homo sapiens
aggaggccgggattctggagat

SEQ ID NO: 7404355 - DNA, 22 bp, Homo sapiens
aggaggcaggaagtctatggga

SEQ ID NO: 7404356 - DNA, 22 bp, Homo sapiens
aggaggccgggattctggagat

SEQ ID NO: 7404357 - DNA, 23 bp, Homo sapiens
aggaggcctgaaactgaggctga

SEQ ID NO: 7404358 - DNA, 23 bp, Homo sapiens
aggaggcctgaaactgaggctga

SEQ ID NO: 7404359 - DNA, 22 bp, Homo sapiens
aggaggcctctatccagagaga

SEQ ID NO: 7404360 - DNA, 22 bp, Homo sapiens
aggaggcctctatccagagaga

SEQ ID NO: 7404361 - DNA, 23 bp, Homo sapiens
aggaggcctgaaactgaggctga

SEQ ID NO: 7404362 - DNA, 23 bp, Homo sapiens
aggaggcctgaaactgaggctga

SEQ ID NO: 7404363 - DNA, 22 bp, Homo sapiens
cataagaaataatgatgatgac

SEQ ID NO: 7404364 - DNA, 22 bp, Homo sapiens
cataagaaataatgatgatgac

SEQ ID NO: 7404365 - DNA, 22 bp, Homo sapiens
cataagaaataatgatgatgac

SEQ ID NO: 7404366 - DNA, 22 bp, Homo sapiens
cataacttggtgttggaaactg

SEQ ID NO: 7404367 - DNA, 22 bp, Homo sapiens
cataactttaaagacagtgtgg

SEQ ID NO: 7404368 - DNA, 22 bp, Homo sapiens
cataactttaaagacagtgtgg

SEQ ID NO: 7404369 - DNA, 22 bp, Homo sapiens
cataagaaatttaacagaactt

SEQ ID NO: 7404370 - DNA, 22 bp, Homo sapiens
cataagaaatttaacagaactt

SEQ ID NO: 7404371 - DNA, 22 bp, Homo sapiens
cataagaaataatgatgatgac

SEQ ID NO: 7404372 - DNA, 22 bp, Homo sapiens
cataagaaataatgatgatgac

SEQ ID NO: 7404373 - DNA, 22 bp, Homo sapiens
cataacttgctttggagcccgg

SEQ ID NO: 7404374 - DNA, 22 bp, Homo sapiens
cataactggggacacttctcta

SEQ ID NO: 7404375 - DNA, 22 bp, Homo sapiens
cataacattgagcagcattcct

SEQ ID NO: 7404376 - DNA, 22 bp, Homo sapiens
cataacattattttctgaagat

SEQ ID NO: 7404377 - DNA, 22 bp, Homo sapiens
cataacattgagcagcattcct

SEQ ID NO: 7404378 - DNA, 22 bp, Homo sapiens
cataactgggagatccaagggt

SEQ ID NO: 7404379 - DNA, 22 bp, Homo sapiens
cataactagagtgaaatgttga

SEQ ID NO: 7404380 - DNA, 22 bp, Homo sapiens
cataactagagtgaaatgttga

SEQ ID NO: 7404381 - DNA, 22 bp, Homo sapiens
cataagaatatttagtggcagc

SEQ ID NO: 7404382 - DNA, 22 bp, Homo sapiens
cataagaatatttagtggcagc

SEQ ID NO: 7404383 - DNA, 22 bp, Homo sapiens
cataagaatatttagtggcagc

SEQ ID NO: 7404384 - DNA, 22 bp, Homo sapiens
cataagaaggtaacatccttaa

SEQ ID NO: 7404385 - DNA, 22 bp, Homo sapiens
cataagaatattccatcctttg

SEQ ID NO: 7404386 - DNA, 22 bp, Homo sapiens
cataagaatatttagtggcagc

SEQ ID NO: 7404387 - DNA, 22 bp, Homo sapiens
cataagaatcttccagggcatg

SEQ ID NO: 7404388 - DNA, 17 bp, Homo sapiens
aggagctgggggtggtg

SEQ ID NO: 7404389 - DNA, 17 bp, Homo sapiens
aggagctgggggtggtg

SEQ ID NO: 7404390 - DNA, 17 bp, Homo sapiens
aggagctgggggtggtg

SEQ ID NO: 7404391 - DNA, 22 bp, Homo sapiens
cataatatactacattgatgaa

SEQ ID NO: 7404392 - DNA, 22 bp, Homo sapiens
cataatatactacattgatgaa

SEQ ID NO: 7404393 - DNA, 22 bp, Homo sapiens
cataatatactacattgatgaa

SEQ ID NO: 7404394 - DNA, 22 bp, Homo sapiens
cataatatactacattgatgaa

SEQ ID NO: 7404395 - DNA, 22 bp, Homo sapiens
cataatatactacattgatgaa

SEQ ID NO: 7404396 - DNA, 19 bp, Homo sapiens
cataatacagtggatctga

SEQ ID NO: 7404397 - DNA, 22 bp, Homo sapiens
aggagccatgagcaggaggcaa

SEQ ID NO: 7404398 - DNA, 22 bp, Homo sapiens
aggagccatccccatgagaggt

SEQ ID NO: 7404399 - DNA, 22 bp, Homo sapiens
cagttttatgtcgaatgtatac

SEQ ID NO: 7404400 - DNA, 22 bp, Homo sapiens
cagttttatgtcgaatgtatac

SEQ ID NO: 7404401 - DNA, 22 bp, Homo sapiens
aggagccatgagcaggaggcaa

SEQ ID NO: 7404402 - DNA, 22 bp, Homo sapiens
cagttttatgtcgaatgtatac

SEQ ID NO: 7404403 - DNA, 22 bp, Homo sapiens
cagttttatgtcgaatgtatac

SEQ ID NO: 7404404 - DNA, 22 bp, Homo sapiens
cagttttattggttgaaatctg

SEQ ID NO: 7404405 - DNA, 22 bp, Homo sapiens
cagttttattggttgaaatctg

SEQ ID NO: 7404406 - DNA, 22 bp, Homo sapiens
cagttttattggttgaaatctg

SEQ ID NO: 7404407 - DNA, 22 bp, Homo sapiens
aggagccatccccatgagaggt

SEQ ID NO: 7404408 - DNA, 22 bp, Homo sapiens
aggagccatccccatgagaggt

SEQ ID NO: 7404409 - DNA, 22 bp, Homo sapiens
aggagccatccccatgagaggt

SEQ ID NO: 7404410 - DNA, 22 bp, Homo sapiens
aggagccatccccatgagaggt

SEQ ID NO: 7404411 - DNA, 22 bp, Homo sapiens
aggagccatccccatgagaggt

SEQ ID NO: 7404412 - DNA, 22 bp, Homo sapiens
aggagccatccccatgagaggt

SEQ ID NO: 7404413 - DNA, 22 bp, Homo sapiens
aggagccatccccatgagaggt

SEQ ID NO: 7404414 - DNA, 22 bp, Homo sapiens
aggagccagttccaccccagga

SEQ ID NO: 7404415 - DNA, 22 bp, Homo sapiens
aggagccagtggagttcctgcc

SEQ ID NO: 7404416 - DNA, 22 bp, Homo sapiens
cataacatgtacatataaatgc

SEQ ID NO: 7404417 - DNA, 22 bp, Homo sapiens
cataacatgtacatataaatgc

SEQ ID NO: 7404418 - DNA, 22 bp, Homo sapiens
cataacattaagcctctatttc

SEQ ID NO: 7404419 - DNA, 22 bp, Homo sapiens
cataacattaagcctctatttc

SEQ ID NO: 7404420 - DNA, 22 bp, Homo sapiens
cataacattaagcctctatttc

SEQ ID NO: 7404421 - DNA, 22 bp, Homo sapiens
cataacattaagcctctatttc

SEQ ID NO: 7404422 - DNA, 22 bp, Homo sapiens
cataacattattttctgaagat

SEQ ID NO: 7404423 - DNA, 22 bp, Homo sapiens
cataacattattttctgaagat

SEQ ID NO: 7404424 - DNA, 22 bp, Homo sapiens
cataacatgtacatataaatgc

SEQ ID NO: 7404425 - DNA, 22 bp, Homo sapiens
cataacatgtacatataaatgc

SEQ ID NO: 7404426 - DNA, 22 bp, Homo sapiens
cataacatgtacatataaatgc

SEQ ID NO: 7404427 - DNA, 22 bp, Homo sapiens
cataacatgtacatataaatgc

SEQ ID NO: 7404428 - DNA, 22 bp, Homo sapiens
cagttttattggttgaaatctg

SEQ ID NO: 7404429 - DNA, 22 bp, Homo sapiens
cagttttattggttgaaatctg

SEQ ID NO: 7404430 - DNA, 20 bp, Homo sapiens
cagtccaggctagaaaacaa

SEQ ID NO: 7404431 - DNA, 20 bp, Homo sapiens
cagtccaggctagaaaacaa

SEQ ID NO: 7404432 - DNA, 20 bp, Homo sapiens
cagtccaggctagaaaacaa

SEQ ID NO: 7404433 - DNA, 20 bp, Homo sapiens
cagtccaggctgcagcatct

SEQ ID NO: 7404434 - DNA, 22 bp, Homo sapiens
cagtccagtccaatcctcaatg

SEQ ID NO: 7404435 - DNA, 22 bp, Homo sapiens
cagtccagtccaatcctcaatg

SEQ ID NO: 7404436 - DNA, 22 bp, Homo sapiens
cagtccagtccaatcctcaatg

SEQ ID NO: 7404437 - DNA, 22 bp, Homo sapiens
cagtccagtccaatcctcaatg

SEQ ID NO: 7404438 - DNA, 22 bp, Homo sapiens
cagtccaggttctttctctaaa

SEQ ID NO: 7404439 - DNA, 20 bp, Homo sapiens
cagtccaggctgcagcatct

SEQ ID NO: 7404440 - DNA, 22 bp, Homo sapiens
cagtccaggttctttctctaaa

SEQ ID NO: 7404441 - DNA, 22 bp, Homo sapiens
cagtccaggttctttctctaaa

SEQ ID NO: 7404442 - DNA, 22 bp, Homo sapiens
cagtgtgctgcagagaacattt

SEQ ID NO: 7404443 - DNA, 22 bp, Homo sapiens
cagtgtgctgcagagaacattt

SEQ ID NO: 7404444 - DNA, 22 bp, Homo sapiens
cagtgtgctatctggaagtctc

SEQ ID NO: 7404445 - DNA, 22 bp, Homo sapiens
cagtgtgctgcagagaacattt

SEQ ID NO: 7404446 - DNA, 22 bp, Homo sapiens
cagtgtggagggagagagcctg

SEQ ID NO: 7404447 - DNA, 22 bp, Homo sapiens
cagtgtggagggagagagcctg

SEQ ID NO: 7404448 - DNA, 22 bp, Homo sapiens
cagtgtggagggagagagcctg

SEQ ID NO: 7404449 - DNA, 21 bp, Homo sapiens
cagtggttgctgaattagtgg

SEQ ID NO: 7404450 - DNA, 22 bp, Homo sapiens
cagtgtgctatctggaagtctc

SEQ ID NO: 7404451 - DNA, 22 bp, Homo sapiens
cagtgtgctatctggaagtctc

SEQ ID NO: 7404452 - DNA, 22 bp, Homo sapiens
cagtggttctcaatcaggaatg

SEQ ID NO: 7404453 - DNA, 22 bp, Homo sapiens
cagtggttgaacccaaatactt

SEQ ID NO: 7404454 - DNA, 21 bp, Homo sapiens
cagtggttgctgaattagtgg

SEQ ID NO: 7404455 - DNA, 22 bp, Homo sapiens
cagtggttctcaatcaggaatg

SEQ ID NO: 7404456 - DNA, 22 bp, Homo sapiens
cagtccagtgatttttccagtt

SEQ ID NO: 7404457 - DNA, 22 bp, Homo sapiens
cagtccagtgatttttccagtt

SEQ ID NO: 7404458 - DNA, 22 bp, Homo sapiens
cagtggttcctgttcttctggg

SEQ ID NO: 7404459 - DNA, 22 bp, Homo sapiens
cagtgtggagggagagagcctg

SEQ ID NO: 7404460 - DNA, 22 bp, Homo sapiens
cagtgtggagggagagagcctg

SEQ ID NO: 7404461 - DNA, 22 bp, Homo sapiens
cagtgtggctgagacagaggct

SEQ ID NO: 7404462 - DNA, 22 bp, Homo sapiens
cagtgtggctgagacagaggct

SEQ ID NO: 7404463 - DNA, 22 bp, Homo sapiens
cagtgtgggtttgggaggagta

SEQ ID NO: 7404464 - DNA, 22 bp, Homo sapiens
cagtgtgggtttgggaggagta

SEQ ID NO: 7404465 - DNA, 22 bp, Homo sapiens
cagtgtgggtgaaatacaaagt

SEQ ID NO: 7404466 - DNA, 22 bp, Homo sapiens
cagtgtgggtttgggaggagta

SEQ ID NO: 7404467 - DNA, 22 bp, Homo sapiens
cagtgtgggtgaaatacaaagt

SEQ ID NO: 7404468 - DNA, 22 bp, Homo sapiens
cagtgtggcttagggaataggc

SEQ ID NO: 7404469 - DNA, 22 bp, Homo sapiens
cagtgtgggtgaaatacaaagt

SEQ ID NO: 7404470 - DNA, 22 bp, Homo sapiens
cagtgtgggtgaaatacaaagt

SEQ ID NO: 7404471 - DNA, 22 bp, Homo sapiens
cagtgtggcttagggaataggc

SEQ ID NO: 7404472 - DNA, 22 bp, Homo sapiens
cagtgtgggtttgggaggagta

SEQ ID NO: 7404473 - DNA, 22 bp, Homo sapiens
cagtgtgggtttgggaggagta

SEQ ID NO: 7404474 - DNA, 22 bp, Homo sapiens
cagtgtgggtttgggaggagta

SEQ ID NO: 7404475 - DNA, 22 bp, Homo sapiens
cagtccaggcctggaggagcca

SEQ ID NO: 7404476 - DNA, 22 bp, Homo sapiens
cagtccaggcctggaggagcca

SEQ ID NO: 7404477 - DNA, 22 bp, Homo sapiens
cagtccaggcctggaggagcca

SEQ ID NO: 7404478 - DNA, 22 bp, Homo sapiens
cagtccaggcctggaggagcca

SEQ ID NO: 7404479 - DNA, 22 bp, Homo sapiens
cagtccaggcctggaggagcca

SEQ ID NO: 7404480 - DNA, 22 bp, Homo sapiens
cagtccaggcctggaggagcca

SEQ ID NO: 7404481 - DNA, 22 bp, Homo sapiens
cagtccaggcctggaggagcca

SEQ ID NO: 7404482 - DNA, 22 bp, Homo sapiens
cagtccaggcctggaggagcca

SEQ ID NO: 7404483 - DNA, 22 bp, Homo sapiens
cagtccaggcctggaggagcca

SEQ ID NO: 7404484 - DNA, 22 bp, Homo sapiens
cagtccagctcatcagtggcac

SEQ ID NO: 7404485 - DNA, 22 bp, Homo sapiens
cagtccagctcatcagtggcac

SEQ ID NO: 7404486 - DNA, 22 bp, Homo sapiens
cagtccagctcatcagtggcac

SEQ ID NO: 7404487 - DNA, 22 bp, Homo sapiens
cagtccagctcatcagtggcac

SEQ ID NO: 7404488 - DNA, 22 bp, Homo sapiens
cagtccagctcatcagtggcac

SEQ ID NO: 7404489 - DNA, 22 bp, Homo sapiens
cagtccagctcatcagtggcac

SEQ ID NO: 7404490 - DNA, 22 bp, Homo sapiens
cagtccaggcctggaggagcca

SEQ ID NO: 7404491 - DNA, 22 bp, Homo sapiens
cagtccagctcatcagtggcac

SEQ ID NO: 7404492 - DNA, 22 bp, Homo sapiens
cagtccagctcatcagtggcac

SEQ ID NO: 7404493 - DNA, 22 bp, Homo sapiens
cagtccagccccctgctaaaag

SEQ ID NO: 7404494 - DNA, 22 bp, Homo sapiens
cagtccagccccctgctaaaag

SEQ ID NO: 7404495 - DNA, 22 bp, Homo sapiens
cagtccagccagtagggtgtgg

SEQ ID NO: 7404496 - DNA, 22 bp, Homo sapiens
cagtccagccccctgctaaaag

SEQ ID NO: 7404497 - DNA, 22 bp, Homo sapiens
cagtccagccagtagggtgtgg

SEQ ID NO: 7404498 - DNA, 22 bp, Homo sapiens
cagtccagcaaagaactttcac

SEQ ID NO: 7404499 - DNA, 22 bp, Homo sapiens
cagtccagccagtagggtgtgg

SEQ ID NO: 7404500 - DNA, 22 bp, Homo sapiens
cagtccagagtatatccgcttt

SEQ ID NO: 7404501 - DNA, 22 bp, Homo sapiens
cagtccagagtatatccgcttt

SEQ ID NO: 7404502 - DNA, 22 bp, Homo sapiens
cagtccagagcccaccagagga

SEQ ID NO: 7404503 - DNA, 22 bp, Homo sapiens
cagtccagagtaccccaagaag

SEQ ID NO: 7404504 - DNA, 22 bp, Homo sapiens
cagtccagagtatatccgcttt

SEQ ID NO: 7404505 - DNA, 22 bp, Homo sapiens
cagtccagagcccaccagagga

SEQ ID NO: 7404506 - DNA, 22 bp, Homo sapiens
cagtatttgttccctatcaatg

SEQ ID NO: 7404507 - DNA, 21 bp, Homo sapiens
cagtattttaagcagtgagtt

SEQ ID NO: 7404508 - DNA, 22 bp, Homo sapiens
cagtatttgttccctatcaatg

SEQ ID NO: 7404509 - DNA, 22 bp, Homo sapiens
cagtccagagtaccccaagaag

SEQ ID NO: 7404510 - DNA, 22 bp, Homo sapiens
cagtccagagcccaccagagga

SEQ ID NO: 7404511 - DNA, 22 bp, Homo sapiens
cagtccagagcccaccagagga

SEQ ID NO: 7404512 - DNA, 22 bp, Homo sapiens
cagtccagagcccaccagagga

SEQ ID NO: 7404513 - DNA, 22 bp, Homo sapiens
cagtccagagcccaccagagga

SEQ ID NO: 7404514 - DNA, 22 bp, Homo sapiens
aggagccagcgttcctcaggat

SEQ ID NO: 7404515 - DNA, 22 bp, Homo sapiens
aggagccagcgttcctcaggat

SEQ ID NO: 7404516 - DNA, 21 bp, Homo sapiens
aggagccagcctgtcagtcta

SEQ ID NO: 7404517 - DNA, 22 bp, Homo sapiens
aggagccagcgttcctcaggat

SEQ ID NO: 7404518 - DNA, 22 bp, Homo sapiens
aggagccagcgttcctcaggat

SEQ ID NO: 7404519 - DNA, 22 bp, Homo sapiens
aggagccagaatccagactcgg

SEQ ID NO: 7404520 - DNA, 22 bp, Homo sapiens
aggagccacttaggtgagataa

SEQ ID NO: 7404521 - DNA, 22 bp, Homo sapiens
aggagccagaatccagactcgg

SEQ ID NO: 7404522 - DNA, 22 bp, Homo sapiens
aggagccagaatccagactcgg

SEQ ID NO: 7404523 - DNA, 22 bp, Homo sapiens
aggagccacttaggtgagataa

SEQ ID NO: 7404524 - DNA, 22 bp, Homo sapiens
aggagccagattctctcacttt

SEQ ID NO: 7404525 - DNA, 22 bp, Homo sapiens
aggagccagattctctcacttt

SEQ ID NO: 7404526 - DNA, 23 bp, Homo sapiens
aggagccagccctgttctcagta

SEQ ID NO: 7404527 - DNA, 22 bp, Homo sapiens
aggagccaggaaacctgctctg

SEQ ID NO: 7404528 - DNA, 22 bp, Homo sapiens
aggagccaggccccatggggct

SEQ ID NO: 7404529 - DNA, 22 bp, Homo sapiens
aggagccaggccccatggggct

SEQ ID NO: 7404530 - DNA, 22 bp, Homo sapiens
aggagccaggccccatggggct

SEQ ID NO: 7404531 - DNA, 22 bp, Homo sapiens
aggagccaggccccatggggct

SEQ ID NO: 7404532 - DNA, 22 bp, Homo sapiens
aggagccaggccccatggggct

SEQ ID NO: 7404533 - DNA, 22 bp, Homo sapiens
aggagccaggccccatggggct

SEQ ID NO: 7404534 - DNA, 22 bp, Homo sapiens
aggagccaggccccatggggct

SEQ ID NO: 7404535 - DNA, 23 bp, Homo sapiens
aggagccaggtgcagcccttgtg

SEQ ID NO: 7404536 - DNA, 22 bp, Homo sapiens
aggagccagggaagctgctttc

SEQ ID NO: 7404537 - DNA, 22 bp, Homo sapiens
cagtgtgtggatcctcccagga

SEQ ID NO: 7404538 - DNA, 22 bp, Homo sapiens
cagtgtgtggattgcccttgca

SEQ ID NO: 7404539 - DNA, 22 bp, Homo sapiens
cagtgtgtttcatgtaggtcct

SEQ ID NO: 7404540 - DNA, 22 bp, Homo sapiens
cagtgttccctgaacatatgtt

SEQ ID NO: 7404541 - DNA, 22 bp, Homo sapiens
cagtgttccaggcggcagtgaa

SEQ ID NO: 7404542 - DNA, 22 bp, Homo sapiens
cagtgttactgggcctgggtgt

SEQ ID NO: 7404543 - DNA, 22 bp, Homo sapiens
cagtgttccctgaacatatgtt

SEQ ID NO: 7404544 - DNA, 22 bp, Homo sapiens
cagtgttgctaagttctgaact

SEQ ID NO: 7404545 - DNA, 22 bp, Homo sapiens
cagtgtttagcacagtgcttgg

SEQ ID NO: 7404546 - DNA, 22 bp, Homo sapiens
cagtgtttagcacagtgcttgg

SEQ ID NO: 7404547 - DNA, 22 bp, Homo sapiens
cagtgtttagatcaagaaggcc

SEQ ID NO: 7404548 - DNA, 22 bp, Homo sapiens
cagtgtttaatcattgtgaatt

SEQ ID NO: 7404549 - DNA, 22 bp, Homo sapiens
aggagccacttaggtgagataa

SEQ ID NO: 7404550 - DNA, 22 bp, Homo sapiens
aggagccacctaggagctgttt

SEQ ID NO: 7404551 - DNA, 22 bp, Homo sapiens
aggagccacctaggagctgttt

SEQ ID NO: 7404552 - DNA, 21 bp, Homo sapiens
cagtgtggtgaccagggtctc

SEQ ID NO: 7404553 - DNA, 21 bp, Homo sapiens
cagtgtggtgaccagggtctc

SEQ ID NO: 7404554 - DNA, 21 bp, Homo sapiens
cagtgtggtgaccagggtctc

SEQ ID NO: 7404555 - DNA, 21 bp, Homo sapiens
cagtgtggtgaccagggtctc

SEQ ID NO: 7404556 - DNA, 21 bp, Homo sapiens
cagtgtggtgaccagggtctc

SEQ ID NO: 7404557 - DNA, 22 bp, Homo sapiens
cagtgtggtgagattccaggtg

SEQ ID NO: 7404558 - DNA, 22 bp, Homo sapiens
cagtgtggtgagattccaggtg

SEQ ID NO: 7404559 - DNA, 21 bp, Homo sapiens
cagtgtggtgaccagggtctc

SEQ ID NO: 7404560 - DNA, 22 bp, Homo sapiens
cagtgtgtgactctgggggtac

SEQ ID NO: 7404561 - DNA, 22 bp, Homo sapiens
cagtgtgtctcttgtcctggct

SEQ ID NO: 7404562 - DNA, 22 bp, Homo sapiens
cagtgtgtgactctgggggtac

SEQ ID NO: 7404563 - DNA, 22 bp, Homo sapiens
cagtgtgtggatcctcccagga

SEQ ID NO: 7404564 - DNA, 22 bp, Homo sapiens
cagtgtgtggatcctcccagga

SEQ ID NO: 7404565 - DNA, 22 bp, Homo sapiens
cagtgtggtgtgcacagcttag

SEQ ID NO: 7404566 - DNA, 22 bp, Homo sapiens
cagtgtgtcctcagaatatata

SEQ ID NO: 7404567 - DNA, 22 bp, Homo sapiens
cagtgtgtagaaggccgattta

SEQ ID NO: 7404568 - DNA, 22 bp, Homo sapiens
catttacttaaatctttacaag

SEQ ID NO: 7404569 - DNA, 22 bp, Homo sapiens
catttacttaaatctttacaag

SEQ ID NO: 7404570 - DNA, 22 bp, Homo sapiens
catttactgttgaatccctagc

SEQ ID NO: 7404571 - DNA, 22 bp, Homo sapiens
catttactgttgaatccctagc

SEQ ID NO: 7404572 - DNA, 22 bp, Homo sapiens
catttactgtaaaagattctct

SEQ ID NO: 7404573 - DNA, 22 bp, Homo sapiens
catttactgtaaaagattctct

SEQ ID NO: 7404574 - DNA, 22 bp, Homo sapiens
catttactgttgaatccctagc

SEQ ID NO: 7404575 - DNA, 22 bp, Homo sapiens
catttactgtaaaagattctct

SEQ ID NO: 7404576 - DNA, 22 bp, Homo sapiens
catttactgtaaaagattctct

SEQ ID NO: 7404577 - DNA, 22 bp, Homo sapiens
catttacctttaattaaaacac

SEQ ID NO: 7404578 - DNA, 22 bp, Homo sapiens
catttacatttaaggttaatat

SEQ ID NO: 7404579 - DNA, 22 bp, Homo sapiens
aggcacttgtgactgtctgcat

SEQ ID NO: 7404580 - DNA, 22 bp, Homo sapiens
aggcacttgtaattgcagtcat

SEQ ID NO: 7404581 - DNA, 22 bp, Homo sapiens
aggcacttgtaattgcagtcat

SEQ ID NO: 7404582 - DNA, 22 bp, Homo sapiens
aggcacttggaggtctctgccc

SEQ ID NO: 7404583 - DNA, 22 bp, Homo sapiens
aggcacttggagttctttgccc

SEQ ID NO: 7404584 - DNA, 22 bp, Homo sapiens
aggcacttctcaaattcatgcc

SEQ ID NO: 7404585 - DNA, 22 bp, Homo sapiens
aggcacttcatgggttcaagga

SEQ ID NO: 7404586 - DNA, 22 bp, Homo sapiens
aggcacttcatgggttcaagga

SEQ ID NO: 7404587 - DNA, 22 bp, Homo sapiens
aggcacttctcaaattcatgcc

SEQ ID NO: 7404588 - DNA, 22 bp, Homo sapiens
aggcacttaataaggattcaat

SEQ ID NO: 7404589 - DNA, 22 bp, Homo sapiens
aggcacttaataaggattcaat

SEQ ID NO: 7404590 - DNA, 22 bp, Homo sapiens
aggcacttcatgggttcaagga

SEQ ID NO: 7404591 - DNA, 22 bp, Homo sapiens
aggcacttaataaggattcaat

SEQ ID NO: 7404592 - DNA, 22 bp, Homo sapiens
aggcacttgcattgatgaggtc

SEQ ID NO: 7404593 - DNA, 22 bp, Homo sapiens
aggcacttgcattgatgaggtc

SEQ ID NO: 7404594 - DNA, 22 bp, Homo sapiens
aggcacttgcattgatgaggtc

SEQ ID NO: 7404595 - DNA, 22 bp, Homo sapiens
aggcacttgaattgatgatgtt

SEQ ID NO: 7404596 - DNA, 22 bp, Homo sapiens
aggcacttgaattgatgatgtt

SEQ ID NO: 7404597 - DNA, 22 bp, Homo sapiens
aggcacttgaattgatgatgtt

SEQ ID NO: 7404598 - DNA, 22 bp, Homo sapiens
aggcacttgattaatgtgaatt

SEQ ID NO: 7404599 - DNA, 22 bp, Homo sapiens
aggcacttgattaatgtgaatt

SEQ ID NO: 7404600 - DNA, 22 bp, Homo sapiens
aggcacttgattaatgtgaatt

SEQ ID NO: 7404601 - DNA, 22 bp, Homo sapiens
cattggcacaagtagcttcatc

SEQ ID NO: 7404602 - DNA, 22 bp, Homo sapiens
cattggaatgatcgttttgctg

SEQ ID NO: 7404603 - DNA, 22 bp, Homo sapiens
cattggaagacatatcatgcta

SEQ ID NO: 7404604 - DNA, 22 bp, Homo sapiens
cattggaagacatatcatgcta

SEQ ID NO: 7404605 - DNA, 22 bp, Homo sapiens
cattggaaaatgcatgcttttt

SEQ ID NO: 7404606 - DNA, 22 bp, Homo sapiens
cattggccttttatcctagagg

SEQ ID NO: 7404607 - DNA, 20 bp, Homo sapiens
cattggcattcacagaagct

SEQ ID NO: 7404608 - DNA, 20 bp, Homo sapiens
cattggcattcacagaagct

SEQ ID NO: 7404609 - DNA, 22 bp, Homo sapiens
cattggcacaagtagcttcatc

SEQ ID NO: 7404610 - DNA, 22 bp, Homo sapiens
cattggcacctcacaggataga

SEQ ID NO: 7404611 - DNA, 22 bp, Homo sapiens
cattggcacctcacaggataga

SEQ ID NO: 7404612 - DNA, 22 bp, Homo sapiens
cattgtaagaggctttgcagca

SEQ ID NO: 7404613 - DNA, 22 bp, Homo sapiens
cattgtaagctgttgaatcctc

SEQ ID NO: 7404614 - DNA, 22 bp, Homo sapiens
cattgtaagaggctttgcagca

SEQ ID NO: 7404615 - DNA, 22 bp, Homo sapiens
cattggtttgatattgccatgg

SEQ ID NO: 7404616 - DNA, 22 bp, Homo sapiens
cattggtttgatattgccatgg

SEQ ID NO: 7404617 - DNA, 20 bp, Homo sapiens
cattggcattcacagaagct

SEQ ID NO: 7404618 - DNA, 22 bp, Homo sapiens
cattggtcttctaacagagaga

SEQ ID NO: 7404619 - DNA, 22 bp, Homo sapiens
cattggttgtcatggcaggagg

SEQ ID NO: 7404620 - DNA, 22 bp, Homo sapiens
cattggttgtcatggcaggagg

SEQ ID NO: 7404621 - DNA, 22 bp, Homo sapiens
aggcactgttcccagttatcct

SEQ ID NO: 7404622 - DNA, 20 bp, Homo sapiens
aggcactgttgtctgtatcc

SEQ ID NO: 7404623 - DNA, 22 bp, Homo sapiens
aggcactgttcccagttatcct

SEQ ID NO: 7404624 - DNA, 22 bp, Homo sapiens
aggcactgtgggtgtggccgga

SEQ ID NO: 7404625 - DNA, 22 bp, Homo sapiens
aggcactgtgggtgtggccgga

SEQ ID NO: 7404626 - DNA, 22 bp, Homo sapiens
aggcactgtgggtgtggccgga

SEQ ID NO: 7404627 - DNA, 18 bp, Homo sapiens
cattgtacaatgctttat

SEQ ID NO: 7404628 - DNA, 18 bp, Homo sapiens
cattgtacaatgctttat

SEQ ID NO: 7404629 - DNA, 22 bp, Homo sapiens
cattgtaagctgttgaatcctc

SEQ ID NO: 7404630 - DNA, 22 bp, Homo sapiens
aggcactgtgggtgtggccgga

SEQ ID NO: 7404631 - DNA, 22 bp, Homo sapiens
cattgtaagctgttgaatcctc

SEQ ID NO: 7404632 - DNA, 18 bp, Homo sapiens
cattgtacaatgctttat

SEQ ID NO: 7404633 - DNA, 21 bp, Homo sapiens
aggcactgtttgtggtttggg

SEQ ID NO: 7404634 - DNA, 21 bp, Homo sapiens
aggcactgtttgtggtttggg

SEQ ID NO: 7404635 - DNA, 21 bp, Homo sapiens
aggcacttaaccaatgttagc

SEQ ID NO: 7404636 - DNA, 20 bp, Homo sapiens
aggcactgttgtctgtatcc

SEQ ID NO: 7404637 - DNA, 20 bp, Homo sapiens
aggcactgttgtctgtatcc

SEQ ID NO: 7404638 - DNA, 20 bp, Homo sapiens
aggcactgttgtctgtatcc

SEQ ID NO: 7404639 - DNA, 21 bp, Homo sapiens
aggcactgtttgtggtttggg

SEQ ID NO: 7404640 - DNA, 22 bp, Homo sapiens
catttcaatgccttcaacatag

SEQ ID NO: 7404641 - DNA, 22 bp, Homo sapiens
catttcaatgccttcaacatag

SEQ ID NO: 7404642 - DNA, 22 bp, Homo sapiens
catttcaatgccttcaacatag

SEQ ID NO: 7404643 - DNA, 22 bp, Homo sapiens
catttcaatgccttcaacatag

SEQ ID NO: 7404644 - DNA, 22 bp, Homo sapiens
catttcaattatttgctcttct

SEQ ID NO: 7404645 - DNA, 22 bp, Homo sapiens
catttcaattatttgctcttct

SEQ ID NO: 7404646 - DNA, 22 bp, Homo sapiens
catttcaatgccttcaacatag

SEQ ID NO: 7404647 - DNA, 22 bp, Homo sapiens
catttcaattatttgctcttct

SEQ ID NO: 7404648 - DNA, 22 bp, Homo sapiens
catttcaattatttgctcttct

SEQ ID NO: 7404649 - DNA, 22 bp, Homo sapiens
catttcaatacagtttgtaaat

SEQ ID NO: 7404650 - DNA, 22 bp, Homo sapiens
catttcaatactatctgagaat

SEQ ID NO: 7404651 - DNA, 22 bp, Homo sapiens
catttcaatactatctgagaat

SEQ ID NO: 7404652 - DNA, 22 bp, Homo sapiens
catttcaatgccttcaacatag

SEQ ID NO: 7404653 - DNA, 22 bp, Homo sapiens
catttcaatgccttcaacatag

SEQ ID NO: 7404654 - DNA, 22 bp, Homo sapiens
catttcaatgccttcaacatag

SEQ ID NO: 7404655 - DNA, 22 bp, Homo sapiens
catttcaatgccttcaacatag

SEQ ID NO: 7404656 - DNA, 22 bp, Homo sapiens
catttctcctgggtgataaatt

SEQ ID NO: 7404657 - DNA, 22 bp, Homo sapiens
catttctcctgggtgataaatt

SEQ ID NO: 7404658 - DNA, 22 bp, Homo sapiens
catttctcctgggtgataaatt

SEQ ID NO: 7404659 - DNA, 22 bp, Homo sapiens
catttctccgccgagatcactg

SEQ ID NO: 7404660 - DNA, 22 bp, Homo sapiens
catttctgattacagaatacta

SEQ ID NO: 7404661 - DNA, 22 bp, Homo sapiens
catttctgcagaattgctcttc

SEQ ID NO: 7404662 - DNA, 22 bp, Homo sapiens
catttctgcagaattgctcttc

SEQ ID NO: 7404663 - DNA, 22 bp, Homo sapiens
catttctgattacagaatacta

SEQ ID NO: 7404664 - DNA, 22 bp, Homo sapiens
catttctgattacagaatacta

SEQ ID NO: 7404665 - DNA, 22 bp, Homo sapiens
catttctcataatattagcact

SEQ ID NO: 7404666 - DNA, 22 bp, Homo sapiens
catttctccgccgagatcactg

SEQ ID NO: 7404667 - DNA, 22 bp, Homo sapiens
catttctccgccgagatcactg

SEQ ID NO: 7404668 - DNA, 22 bp, Homo sapiens
catttctcataatattagcact

SEQ ID NO: 7404669 - DNA, 22 bp, Homo sapiens
catttcacagtaaagtgatttc

SEQ ID NO: 7404670 - DNA, 22 bp, Homo sapiens
catttattggttaggccagcag

SEQ ID NO: 7404671 - DNA, 22 bp, Homo sapiens
catttattggttaggccagcag

SEQ ID NO: 7404672 - DNA, 22 bp, Homo sapiens
catttattggttaggccagcag

SEQ ID NO: 7404673 - DNA, 22 bp, Homo sapiens
catttattggcatgtagtaggt

SEQ ID NO: 7404674 - DNA, 22 bp, Homo sapiens
catttattggcatgtagtaggt

SEQ ID NO: 7404675 - DNA, 22 bp, Homo sapiens
catttattggttaggccagcag

SEQ ID NO: 7404676 - DNA, 22 bp, Homo sapiens
catttattggttaggccagcag

SEQ ID NO: 7404677 - DNA, 22 bp, Homo sapiens
catttcaaacagttacagctgc

SEQ ID NO: 7404678 - DNA, 22 bp, Homo sapiens
catttcaaacagttacagctgc

SEQ ID NO: 7404679 - DNA, 22 bp, Homo sapiens
catttcaaaagaattgccagaa

SEQ ID NO: 7404680 - DNA, 22 bp, Homo sapiens
catttcaaaagaattgccagaa

SEQ ID NO: 7404681 - DNA, 22 bp, Homo sapiens
catttcaaaagaattgccagaa

SEQ ID NO: 7404682 - DNA, 22 bp, Homo sapiens
catttattggttaggccagcag

SEQ ID NO: 7404683 - DNA, 22 bp, Homo sapiens
catttcaagcattgacttctat

SEQ ID NO: 7404684 - DNA, 22 bp, Homo sapiens
catttcaagcattgacttctat

SEQ ID NO: 7404685 - DNA, 22 bp, Homo sapiens
catttcaagcattgacttctat

SEQ ID NO: 7404686 - DNA, 22 bp, Homo sapiens
catttcaagcattgacttctat

SEQ ID NO: 7404687 - DNA, 21 bp, Homo sapiens
catttcaaagagctggaaatc

SEQ ID NO: 7404688 - DNA, 21 bp, Homo sapiens
catttcaaagagctggaaatc

SEQ ID NO: 7404689 - DNA, 21 bp, Homo sapiens
catttcaaagagctggaaatc

SEQ ID NO: 7404690 - DNA, 23 bp, Homo sapiens
catttcaacgaattttccttctg

SEQ ID NO: 7404691 - DNA, 23 bp, Homo sapiens
catttcaacgaattttccttctg

SEQ ID NO: 7404692 - DNA, 22 bp, Homo sapiens
catttcaagtaacagattgctt

SEQ ID NO: 7404693 - DNA, 22 bp, Homo sapiens
catttcaagtaacagattgctt

SEQ ID NO: 7404694 - DNA, 22 bp, Homo sapiens
catttcaagcattgacttctat

SEQ ID NO: 7404695 - DNA, 22 bp, Homo sapiens
catttcaaggaccaccctggga

SEQ ID NO: 7404696 - DNA, 22 bp, Homo sapiens
catttcaagtaacagattgctt

SEQ ID NO: 7404697 - DNA, 22 bp, Homo sapiens
catttcaagtaacagattgctt

SEQ ID NO: 7404698 - DNA, 22 bp, Homo sapiens
catttcaatacagtttgtaaat

SEQ ID NO: 7404699 - DNA, 22 bp, Homo sapiens
catttcaatacagtttgtaaat

SEQ ID NO: 7404700 - DNA, 22 bp, Homo sapiens
catttcaatacagtttgtaaat

SEQ ID NO: 7404701 - DNA, 22 bp, Homo sapiens
catttcaatacagtttgtaaat

SEQ ID NO: 7404702 - DNA, 22 bp, Homo sapiens
catttcaatacagtttgtaaat

SEQ ID NO: 7404703 - DNA, 22 bp, Homo sapiens
aggcaagcccaggcacttggag

SEQ ID NO: 7404704 - DNA, 22 bp, Homo sapiens
aggcaagcatttaaccactcat

SEQ ID NO: 7404705 - DNA, 22 bp, Homo sapiens
aggcaagcccaggcacttggag

SEQ ID NO: 7404706 - DNA, 22 bp, Homo sapiens
aggcaagcattgggaacagggc

SEQ ID NO: 7404707 - DNA, 22 bp, Homo sapiens
aggcaagcattgggaacagggc

SEQ ID NO: 7404708 - DNA, 22 bp, Homo sapiens
aggcaagcgcagaagcggagga

SEQ ID NO: 7404709 - DNA, 22 bp, Homo sapiens
aggcaagccgtgcctgtctcaa

SEQ ID NO: 7404710 - DNA, 22 bp, Homo sapiens
aggcaagccgtgcctgtctcaa

SEQ ID NO: 7404711 - DNA, 22 bp, Homo sapiens
aggcaagcccccagtgaggctc

SEQ ID NO: 7404712 - DNA, 22 bp, Homo sapiens
aggcaagcccccagtgaggctc

SEQ ID NO: 7404713 - DNA, 22 bp, Homo sapiens
aggcaagcaccgggggcctttt

SEQ ID NO: 7404714 - DNA, 22 bp, Homo sapiens
aggcaagcagtcagtctatgag

SEQ ID NO: 7404715 - DNA, 22 bp, Homo sapiens
aggcaagcagtcagtctatgag

SEQ ID NO: 7404716 - DNA, 22 bp, Homo sapiens
aggcaagcattgggaacagggc

SEQ ID NO: 7404717 - DNA, 22 bp, Homo sapiens
aggcaagcattgggaacagggc

SEQ ID NO: 7404718 - DNA, 22 bp, Homo sapiens
aggcaagcattgggaacagggc

SEQ ID NO: 7404719 - DNA, 22 bp, Homo sapiens
aggcaagattaggaccagaaga

SEQ ID NO: 7404720 - DNA, 22 bp, Homo sapiens
aggcaagattaggaccagaaga

SEQ ID NO: 7404721 - DNA, 22 bp, Homo sapiens
aggcaagattaggaccagaaga

SEQ ID NO: 7404722 - DNA, 22 bp, Homo sapiens
aggcaagattaggaccagaaga

SEQ ID NO: 7404723 - DNA, 22 bp, Homo sapiens
aggcaagcaccgggggcctttt

SEQ ID NO: 7404724 - DNA, 23 bp, Homo sapiens
aggcaagggtgtaaaggaaatga

SEQ ID NO: 7404725 - DNA, 23 bp, Homo sapiens
aggcaagggtgtaaaggaaatga

SEQ ID NO: 7404726 - DNA, 20 bp, Homo sapiens
aggcaaggtagatgtctgct

SEQ ID NO: 7404727 - DNA, 23 bp, Homo sapiens
aggcaagggtgtaaaggaaatga

SEQ ID NO: 7404728 - DNA, 20 bp, Homo sapiens
aggcaaggtagatgtctgct

SEQ ID NO: 7404729 - DNA, 20 bp, Homo sapiens
aggcaaggtagatgtctgct

SEQ ID NO: 7404730 - DNA, 20 bp, Homo sapiens
aggcaaggtagatgtctgct

SEQ ID NO: 7404731 - DNA, 20 bp, Homo sapiens
aggcaaggtagatgtctgct

SEQ ID NO: 7404732 - DNA, 22 bp, Homo sapiens
aggcaaggtgctacagacagtg

SEQ ID NO: 7404733 - DNA, 22 bp, Homo sapiens
aggcaaggtgctacagacagtg

SEQ ID NO: 7404734 - DNA, 22 bp, Homo sapiens
aggcaagcttgaaattggctct

SEQ ID NO: 7404735 - DNA, 22 bp, Homo sapiens
aggcaagcttgaaattggctct

SEQ ID NO: 7404736 - DNA, 22 bp, Homo sapiens
aggcaagcttgaaattggctct

SEQ ID NO: 7404737 - DNA, 22 bp, Homo sapiens
aggcaaggaagaattctcccct

SEQ ID NO: 7404738 - DNA, 22 bp, Homo sapiens
aggcaaggaagaattctcccct

SEQ ID NO: 7404739 - DNA, 22 bp, Homo sapiens
aggcaagggggcgccaccttcc

SEQ ID NO: 7404740 - DNA, 22 bp, Homo sapiens
aggcaagggggcgccaccttcc

SEQ ID NO: 7404741 - DNA, 23 bp, Homo sapiens
aggcaagggtgtaaaggaaatga

SEQ ID NO: 7404742 - DNA, 22 bp, Homo sapiens
aggcaagggggcgccaccttcc

SEQ ID NO: 7404743 - DNA, 23 bp, Homo sapiens
aggcaagggtgtaaaggaaatga

SEQ ID NO: 7404744 - DNA, 23 bp, Homo sapiens
aggcaagggtgtaaaggaaatga

SEQ ID NO: 7404745 - DNA, 23 bp, Homo sapiens
aggcaagggtgtaaaggaaatga

SEQ ID NO: 7404746 - DNA, 23 bp, Homo sapiens
aggcaagggtgtaaaggaaatga

SEQ ID NO: 7404747 - DNA, 22 bp, Homo sapiens
aggcaactctgaccttatgaag

SEQ ID NO: 7404748 - DNA, 22 bp, Homo sapiens
aggcaactgacagcatatcctg

SEQ ID NO: 7404749 - DNA, 22 bp, Homo sapiens
aggcaactgacagtttctgctt

SEQ ID NO: 7404750 - DNA, 20 bp, Homo sapiens
aggcaactcaagtttttgcc

SEQ ID NO: 7404751 - DNA, 22 bp, Homo sapiens
aggcaactcatcatgaaagact

SEQ ID NO: 7404752 - DNA, 22 bp, Homo sapiens
aggcaacttgaccaggctttct

SEQ ID NO: 7404753 - DNA, 22 bp, Homo sapiens
aggcaacttttggggatgatgg

SEQ ID NO: 7404754 - DNA, 22 bp, Homo sapiens
aggcaagaaactttctgggaga

SEQ ID NO: 7404755 - DNA, 22 bp, Homo sapiens
aggcaagaaactttctgggaga

SEQ ID NO: 7404756 - DNA, 22 bp, Homo sapiens
aggcaagaaactttctgggaga

SEQ ID NO: 7404757 - DNA, 22 bp, Homo sapiens
aggcaactctgaccttatgaag

SEQ ID NO: 7404758 - DNA, 22 bp, Homo sapiens
aggcaactgagaggcccgtgtt

SEQ ID NO: 7404759 - DNA, 22 bp, Homo sapiens
aggcaactgagaggcccgtgtt

SEQ ID NO: 7404760 - DNA, 22 bp, Homo sapiens
aggcaactgtttgataatgttg

SEQ ID NO: 7404761 - DNA, 22 bp, Homo sapiens
aggcaactggttaagtaaattg

SEQ ID NO: 7404762 - DNA, 22 bp, Homo sapiens
aggcaagaccagaaagggctga

SEQ ID NO: 7404763 - DNA, 22 bp, Homo sapiens
aggcaagattaggaccagaaga

SEQ ID NO: 7404764 - DNA, 22 bp, Homo sapiens
aggcaagagtgactacgtgaaa

SEQ ID NO: 7404765 - DNA, 22 bp, Homo sapiens
aggcaagagtgactacgtgaaa

SEQ ID NO: 7404766 - DNA, 22 bp, Homo sapiens
aggcaagaacagacatgggagt

SEQ ID NO: 7404767 - DNA, 22 bp, Homo sapiens
aggcaagaacagacatgggagt

SEQ ID NO: 7404768 - DNA, 22 bp, Homo sapiens
aggcaagaccagaaagggctga

SEQ ID NO: 7404769 - DNA, 22 bp, Homo sapiens
aggcaagaacagacatgggagt

SEQ ID NO: 7404770 - DNA, 22 bp, Homo sapiens
aggcaagaacagacatgggagt

SEQ ID NO: 7404771 - DNA, 22 bp, Homo sapiens
aggcaagaacagacatgggagt

SEQ ID NO: 7404772 - DNA, 22 bp, Homo sapiens
aggcaagaacagacatgggagt

SEQ ID NO: 7404773 - DNA, 22 bp, Homo sapiens
aggcaagaacagacatgggagt

SEQ ID NO: 7404774 - DNA, 22 bp, Homo sapiens
aggcaagaacagacatgggagt

SEQ ID NO: 7404775 - DNA, 22 bp, Homo sapiens
aggcaagaaactttctgggaga

SEQ ID NO: 7404776 - DNA, 22 bp, Homo sapiens
aggcaagaaactttctgggaga

SEQ ID NO: 7404777 - DNA, 22 bp, Homo sapiens
cattgctttgtgcatatttaaa

SEQ ID NO: 7404778 - DNA, 22 bp, Homo sapiens
cattgcttgatagctgaaaatt

SEQ ID NO: 7404779 - DNA, 22 bp, Homo sapiens
cattgctttgtgcatatttaaa

SEQ ID NO: 7404780 - DNA, 22 bp, Homo sapiens
cattgcttgatagctgaaaatt

SEQ ID NO: 7404781 - DNA, 22 bp, Homo sapiens
cattgcttgatagctgaaaatt

SEQ ID NO: 7404782 - DNA, 22 bp, Homo sapiens
cattgcttgatagctgaaaatt

SEQ ID NO: 7404783 - DNA, 22 bp, Homo sapiens
cattgcttatttcagctaaagt

SEQ ID NO: 7404784 - DNA, 22 bp, Homo sapiens
cattgcttcctatgtcccttct

SEQ ID NO: 7404785 - DNA, 22 bp, Homo sapiens
cattgctgttaattgtctctag

SEQ ID NO: 7404786 - DNA, 22 bp, Homo sapiens
cattgcttatttcagctaaagt

SEQ ID NO: 7404787 - DNA, 22 bp, Homo sapiens
cattgctgttatgcataattcc

SEQ ID NO: 7404788 - DNA, 22 bp, Homo sapiens
cattgcttatctagttcacata

SEQ ID NO: 7404789 - DNA, 22 bp, Homo sapiens
cattgctgccactggatatttc

SEQ ID NO: 7404790 - DNA, 22 bp, Homo sapiens
cattgctgcttccaggcacagg

SEQ ID NO: 7404791 - DNA, 22 bp, Homo sapiens
cattgctgcttccaggcacagg

SEQ ID NO: 7404792 - DNA, 22 bp, Homo sapiens
cattgctgcttccaggcacagg

SEQ ID NO: 7404793 - DNA, 22 bp, Homo sapiens
cattgctgtagtccagatgagg

SEQ ID NO: 7404794 - DNA, 22 bp, Homo sapiens
cattgctgtgggcatttgctgc

SEQ ID NO: 7404795 - DNA, 22 bp, Homo sapiens
cattgctgtgggcatttgctgc

SEQ ID NO: 7404796 - DNA, 22 bp, Homo sapiens
cattgctgtagtccagatgagg

SEQ ID NO: 7404797 - DNA, 22 bp, Homo sapiens
cattgctgttaattgtctctag

SEQ ID NO: 7404798 - DNA, 22 bp, Homo sapiens
cattgcccagtaggatcaccag

SEQ ID NO: 7404799 - DNA, 22 bp, Homo sapiens
cattgctcaggcccagcaggaa

SEQ ID NO: 7404800 - DNA, 22 bp, Homo sapiens
cattgctcttgctcccaatgtt

SEQ ID NO: 7404801 - DNA, 22 bp, Homo sapiens
cattgctgaatgagatcaaatc

SEQ ID NO: 7404802 - DNA, 22 bp, Homo sapiens
cattgctgacagatgaagagaa

SEQ ID NO: 7404803 - DNA, 22 bp, Homo sapiens
cattgctgccactggatatttc

SEQ ID NO: 7404804 - DNA, 22 bp, Homo sapiens
cattgcctcggagcctgttatg

SEQ ID NO: 7404805 - DNA, 22 bp, Homo sapiens
cattgcattggattgtacttgt

SEQ ID NO: 7404806 - DNA, 20 bp, Homo sapiens
cattgcatatttcattgagg

SEQ ID NO: 7404807 - DNA, 22 bp, Homo sapiens
cattgcagtaatctggtgaaat

SEQ ID NO: 7404808 - DNA, 22 bp, Homo sapiens
cattgcactctagcctgggtga

SEQ ID NO: 7404809 - DNA, 22 bp, Homo sapiens
cattcggaggtagttgaggtta

SEQ ID NO: 7404810 - DNA, 19 bp, Homo sapiens
cattcctttgtctgccaaa

SEQ ID NO: 7404811 - DNA, 22 bp, Homo sapiens
cattctaaagtgttttatacct

SEQ ID NO: 7404812 - DNA, 19 bp, Homo sapiens
cattcctttgtctgccaaa

SEQ ID NO: 7404813 - DNA, 19 bp, Homo sapiens
cattcctttgtctgccaaa

SEQ ID NO: 7404814 - DNA, 22 bp, Homo sapiens
aggcaatacacagcatttcaca

SEQ ID NO: 7404815 - DNA, 22 bp, Homo sapiens
aggcaatagaatatgcctgagg

SEQ ID NO: 7404816 - DNA, 22 bp, Homo sapiens
aggcaatagaatatgcctgagg

SEQ ID NO: 7404817 - DNA, 23 bp, Homo sapiens
aggcaatacaaggcatctctgga

SEQ ID NO: 7404818 - DNA, 22 bp, Homo sapiens
aggcaataggttcctcatcttt

SEQ ID NO: 7404819 - DNA, 22 bp, Homo sapiens
aggcaatcccctgaggatactt

SEQ ID NO: 7404820 - DNA, 22 bp, Homo sapiens
aggcaatcccctgaggatactt

SEQ ID NO: 7404821 - DNA, 22 bp, Homo sapiens
aggcaatcccctgaggatactt

SEQ ID NO: 7404822 - DNA, 22 bp, Homo sapiens
aggcaatcctcttacagatggg

SEQ ID NO: 7404823 - DNA, 17 bp, Homo sapiens
aggcaatgactgtggtt

SEQ ID NO: 7404824 - DNA, 22 bp, Homo sapiens
aggcaatcctcttacagatggg

SEQ ID NO: 7404825 - DNA, 22 bp, Homo sapiens
cattccttaacgtggggagtct

SEQ ID NO: 7404826 - DNA, 22 bp, Homo sapiens
cattccttaacgtggggagtct

SEQ ID NO: 7404827 - DNA, 22 bp, Homo sapiens
cattccttaacgtggggagtct

SEQ ID NO: 7404828 - DNA, 17 bp, Homo sapiens
aggcaatgactgtggtt

SEQ ID NO: 7404829 - DNA, 22 bp, Homo sapiens
aggcaatgcagatagatgaatg

SEQ ID NO: 7404830 - DNA, 22 bp, Homo sapiens
aggcaatgcagatagatgaatg

SEQ ID NO: 7404831 - DNA, 22 bp, Homo sapiens
aggcaagttattggctcagagc

SEQ ID NO: 7404832 - DNA, 22 bp, Homo sapiens
aggcaagttattggctcagagc

SEQ ID NO: 7404833 - DNA, 22 bp, Homo sapiens
aggcaagttattggctcagagc

SEQ ID NO: 7404834 - DNA, 22 bp, Homo sapiens
aggcaagtgcattagaagagca

SEQ ID NO: 7404835 - DNA, 22 bp, Homo sapiens
aggcaaggtgctcttgctctat

SEQ ID NO: 7404836 - DNA, 22 bp, Homo sapiens
aggcaaggtgctcttgctctat

SEQ ID NO: 7404837 - DNA, 22 bp, Homo sapiens
aggcaaggtgctacagacagtg

SEQ ID NO: 7404838 - DNA, 22 bp, Homo sapiens
aggcaaggtgctcttgctctat

SEQ ID NO: 7404839 - DNA, 22 bp, Homo sapiens
aggcaaggtgctcttgctctat

SEQ ID NO: 7404840 - DNA, 22 bp, Homo sapiens
aggcaaggtgctacagacagtg

SEQ ID NO: 7404841 - DNA, 22 bp, Homo sapiens
aggcaaggtgctacagacagtg

SEQ ID NO: 7404842 - DNA, 22 bp, Homo sapiens
aggcaaggtgctacagacagtg

SEQ ID NO: 7404843 - DNA, 22 bp, Homo sapiens
aggcaaggtgctacagacagtg

SEQ ID NO: 7404844 - DNA, 22 bp, Homo sapiens
aggcaaggtgctacagacagtg

SEQ ID NO: 7404845 - DNA, 22 bp, Homo sapiens
aggcaaggtgctacagacagtg

SEQ ID NO: 7404846 - DNA, 22 bp, Homo sapiens
aggcaaggtgctacagacagtg

SEQ ID NO: 7404847 - DNA, 22 bp, Homo sapiens
aggcaaggtgctacagacagtg

SEQ ID NO: 7404848 - DNA, 22 bp, Homo sapiens
aggcaaggtgctacagacagtg

SEQ ID NO: 7404849 - DNA, 22 bp, Homo sapiens
aggcaaggtgctacagacagtg

SEQ ID NO: 7404850 - DNA, 22 bp, Homo sapiens
aggcaaggtgctacagacagtg

SEQ ID NO: 7404851 - DNA, 22 bp, Homo sapiens
aggcaaggtgctacagacagtg

SEQ ID NO: 7404852 - DNA, 23 bp, Homo sapiens
ccacagttcatcgttcactcacc

SEQ ID NO: 7404853 - DNA, 22 bp, Homo sapiens
ccacagttattcatttgtgaca

SEQ ID NO: 7404854 - DNA, 23 bp, Homo sapiens
ccacagttcatcgttcactcacc

SEQ ID NO: 7404855 - DNA, 22 bp, Homo sapiens
ccacagttattcatttgtgaca

SEQ ID NO: 7404856 - DNA, 22 bp, Homo sapiens
ccacagttattcatttgtgaca

SEQ ID NO: 7404857 - DNA, 22 bp, Homo sapiens
ccacagtgttttgtcacattag

SEQ ID NO: 7404858 - DNA, 22 bp, Homo sapiens
ccacagtgttttgtcacattag

SEQ ID NO: 7404859 - DNA, 22 bp, Homo sapiens
ccacagtgttttgtcacattag

SEQ ID NO: 7404860 - DNA, 22 bp, Homo sapiens
ccacagtgttttgtcacattag

SEQ ID NO: 7404861 - DNA, 22 bp, Homo sapiens
ccacagtgttttgtcacattag

SEQ ID NO: 7404862 - DNA, 22 bp, Homo sapiens
ccacagtttcttcatctataaa

SEQ ID NO: 7404863 - DNA, 21 bp, Homo sapiens
ccacagttctggcaagggctg

SEQ ID NO: 7404864 - DNA, 22 bp, Homo sapiens
ccacagtttaggaagtcactct

SEQ ID NO: 7404865 - DNA, 22 bp, Homo sapiens
ccacagtttcttcatctataaa

SEQ ID NO: 7404866 - DNA, 22 bp, Homo sapiens
ccacatacaaatggggtgctgt

SEQ ID NO: 7404867 - DNA, 22 bp, Homo sapiens
ccacagtttgccaacacctact

SEQ ID NO: 7404868 - DNA, 22 bp, Homo sapiens
ccacagtttgccagccaggaat

SEQ ID NO: 7404869 - DNA, 22 bp, Homo sapiens
ccacagtttgccagccaggaat

SEQ ID NO: 7404870 - DNA, 22 bp, Homo sapiens
ccacagtggttgtggcatgtgg

SEQ ID NO: 7404871 - DNA, 22 bp, Homo sapiens
ccacagtggttgtggcatgtgg

SEQ ID NO: 7404872 - DNA, 22 bp, Homo sapiens
ccacagtggttgtggcatgtgg

SEQ ID NO: 7404873 - DNA, 22 bp, Homo sapiens
ccacagtggttgtggcatgtgg

SEQ ID NO: 7404874 - DNA, 22 bp, Homo sapiens
ccacagtggttgtggcatgtgg

SEQ ID NO: 7404875 - DNA, 22 bp, Homo sapiens
ccacagtgtggcataaactgta

SEQ ID NO: 7404876 - DNA, 22 bp, Homo sapiens
ccacagtgtggcataaactgta

SEQ ID NO: 7404877 - DNA, 22 bp, Homo sapiens
ccacagtgtggcataaactgta

SEQ ID NO: 7404878 - DNA, 22 bp, Homo sapiens
ccacagtgttctttttaaaatt

SEQ ID NO: 7404879 - DNA, 22 bp, Homo sapiens
ccacagtgttctttttaaaatt

SEQ ID NO: 7404880 - DNA, 22 bp, Homo sapiens
ccacagtgggcacagcaggact

SEQ ID NO: 7404881 - DNA, 22 bp, Homo sapiens
ccacagtgggcacagcaggact

SEQ ID NO: 7404882 - DNA, 22 bp, Homo sapiens
ccacagtggttctcaaccaggg

SEQ ID NO: 7404883 - DNA, 22 bp, Homo sapiens
ccacagtggttctcaaccaggg

SEQ ID NO: 7404884 - DNA, 22 bp, Homo sapiens
ccacagtggttctcaaccaggg

SEQ ID NO: 7404885 - DNA, 20 bp, Homo sapiens
ccacagtggagactggagac

SEQ ID NO: 7404886 - DNA, 22 bp, Homo sapiens
ccacagtgggcacagcaggact

SEQ ID NO: 7404887 - DNA, 22 bp, Homo sapiens
ccacagtgggcacagcaggact

SEQ ID NO: 7404888 - DNA, 20 bp, Homo sapiens
ccacagtggagactggagac

SEQ ID NO: 7404889 - DNA, 22 bp, Homo sapiens
ccaccatgggaagagagactaa

SEQ ID NO: 7404890 - DNA, 21 bp, Homo sapiens
ccaccaggtcttctgctcggg

SEQ ID NO: 7404891 - DNA, 21 bp, Homo sapiens
ccaccaggtcttctgctcggg

SEQ ID NO: 7404892 - DNA, 21 bp, Homo sapiens
ccaccaggtcttctgctcggg

SEQ ID NO: 7404893 - DNA, 21 bp, Homo sapiens
ccaccaggtcttctgctcggg

SEQ ID NO: 7404894 - DNA, 21 bp, Homo sapiens
ccaccaggtcttctgctcggg

SEQ ID NO: 7404895 - DNA, 21 bp, Homo sapiens
ccaccaggtcttctgctcggg

SEQ ID NO: 7404896 - DNA, 22 bp, Homo sapiens
ccacccacaaccagctggctgt

SEQ ID NO: 7404897 - DNA, 22 bp, Homo sapiens
ccaccattcaaggtcttcacag

SEQ ID NO: 7404898 - DNA, 22 bp, Homo sapiens
ccaccattatatctcccatgcc

SEQ ID NO: 7404899 - DNA, 22 bp, Homo sapiens
ccaccattatatctcccatgcc

SEQ ID NO: 7404900 - DNA, 20 bp, Homo sapiens
ccacccacgcgggctctgcc

SEQ ID NO: 7404901 - DNA, 20 bp, Homo sapiens
ccacccacgcgggctctgcc

SEQ ID NO: 7404902 - DNA, 22 bp, Homo sapiens
ccacccacaaccagctggctgt

SEQ ID NO: 7404903 - DNA, 22 bp, Homo sapiens
ccacccacaaccagctggctgt

SEQ ID NO: 7404904 - DNA, 22 bp, Homo sapiens
ccacccacaaccagctggctgt

SEQ ID NO: 7404905 - DNA, 20 bp, Homo sapiens
ccacccacgcgggctctgcc

SEQ ID NO: 7404906 - DNA, 22 bp, Homo sapiens
ccacatctccctattgctcttt

SEQ ID NO: 7404907 - DNA, 22 bp, Homo sapiens
ccacatctatctttagtatgaa

SEQ ID NO: 7404908 - DNA, 22 bp, Homo sapiens
ccacatctaagccttcatgata

SEQ ID NO: 7404909 - DNA, 22 bp, Homo sapiens
ccacatcatggatacagttatg

SEQ ID NO: 7404910 - DNA, 22 bp, Homo sapiens
ccacatctaagccttcatgata

SEQ ID NO: 7404911 - DNA, 22 bp, Homo sapiens
ccacatcatggatacagttatg

SEQ ID NO: 7404912 - DNA, 22 bp, Homo sapiens
ccacatcagaaatgtttactca

SEQ ID NO: 7404913 - DNA, 22 bp, Homo sapiens
ccacatcagaaatgtttactca

SEQ ID NO: 7404914 - DNA, 22 bp, Homo sapiens
ccaccaggcactcacagggaag

SEQ ID NO: 7404915 - DNA, 22 bp, Homo sapiens
ccaccaggcactcacagggaag

SEQ ID NO: 7404916 - DNA, 22 bp, Homo sapiens
ccaccaggcactcacagggaag

SEQ ID NO: 7404917 - DNA, 22 bp, Homo sapiens
ccaccaggcactcacagggaag

SEQ ID NO: 7404918 - DNA, 22 bp, Homo sapiens
ccaccaggctctgtccgagcgg

SEQ ID NO: 7404919 - DNA, 21 bp, Homo sapiens
ccaccaggtcttctgctcggg

SEQ ID NO: 7404920 - DNA, 22 bp, Homo sapiens
ccaccaggctctgtccgagcgg

SEQ ID NO: 7404921 - DNA, 22 bp, Homo sapiens
ccactactttgtttttggtgct

SEQ ID NO: 7404922 - DNA, 22 bp, Homo sapiens
ccactaccacggcatgcctccc

SEQ ID NO: 7404923 - DNA, 22 bp, Homo sapiens
ccactaccacggcatgcctccc

SEQ ID NO: 7404924 - DNA, 22 bp, Homo sapiens
ccacgtgtaggtggacaggatc

SEQ ID NO: 7404925 - DNA, 22 bp, Homo sapiens
ccacgtccagctaattttcgta

SEQ ID NO: 7404926 - DNA, 22 bp, Homo sapiens
ccacgggcagatgtggttggtt

SEQ ID NO: 7404927 - DNA, 19 bp, Homo sapiens
ccacgaggttagcagccac

SEQ ID NO: 7404928 - DNA, 22 bp, Homo sapiens
ccacggccacccgctcatgggc

SEQ ID NO: 7404929 - DNA, 22 bp, Homo sapiens
ccacgctccctgatccctgctt

SEQ ID NO: 7404930 - DNA, 22 bp, Homo sapiens
ccacggccacccgctcatgggc

SEQ ID NO: 7404931 - DNA, 22 bp, Homo sapiens
ccacgagggaaccaggtggggt

SEQ ID NO: 7404932 - DNA, 22 bp, Homo sapiens
ccacgagggaaccaggtggggt

SEQ ID NO: 7404933 - DNA, 19 bp, Homo sapiens
ccacgaggttagcagccac

SEQ ID NO: 7404934 - DNA, 22 bp, Homo sapiens
ccacgcatccctccacagagag

SEQ ID NO: 7404935 - DNA, 19 bp, Homo sapiens
ccacgaggttagcagccac

SEQ ID NO: 7404936 - DNA, 22 bp, Homo sapiens
ccacgctcatcctctctgagag

SEQ ID NO: 7404937 - DNA, 22 bp, Homo sapiens
ccacgctcatcctctctgagag

SEQ ID NO: 7404938 - DNA, 22 bp, Homo sapiens
ccacgaggctatcctgctaggg

SEQ ID NO: 7404939 - DNA, 22 bp, Homo sapiens
ccacgaggctatcctgctaggg

SEQ ID NO: 7404940 - DNA, 22 bp, Homo sapiens
ccacgagggaaccaggtggggt

SEQ ID NO: 7404941 - DNA, 22 bp, Homo sapiens
ccacgaggctatcctgctaggg

SEQ ID NO: 7404942 - DNA, 22 bp, Homo sapiens
ccacgagggaaccaggtggggt

SEQ ID NO: 7404943 - DNA, 22 bp, Homo sapiens
ccactcagcacagtggatgcag

SEQ ID NO: 7404944 - DNA, 22 bp, Homo sapiens
ccactcagaccaacgacccttc

SEQ ID NO: 7404945 - DNA, 22 bp, Homo sapiens
ccactattactgtgtggcagtc

SEQ ID NO: 7404946 - DNA, 22 bp, Homo sapiens
ccactagtttaataccttcctt

SEQ ID NO: 7404947 - DNA, 23 bp, Homo sapiens
ccactagcacctgttcaacttct

SEQ ID NO: 7404948 - DNA, 22 bp, Homo sapiens
ccactattactgtgtggcagtc

SEQ ID NO: 7404949 - DNA, 22 bp, Homo sapiens
ccactattactgtgtggcagtc

SEQ ID NO: 7404950 - DNA, 22 bp, Homo sapiens
ccacccagccagatgcaggaag

SEQ ID NO: 7404951 - DNA, 22 bp, Homo sapiens
ccacccagccagatgcaggaag

SEQ ID NO: 7404952 - DNA, 22 bp, Homo sapiens
ccacccagccagatgcaggaag

SEQ ID NO: 7404953 - DNA, 22 bp, Homo sapiens
ccacccagccagatgcaggaag

SEQ ID NO: 7404954 - DNA, 22 bp, Homo sapiens
ccacccagccagatgcaggaag

SEQ ID NO: 7404955 - DNA, 22 bp, Homo sapiens
ccacccagcagaggaggcaaga

SEQ ID NO: 7404956 - DNA, 22 bp, Homo sapiens
ccacccagcagaggaggcaaga

SEQ ID NO: 7404957 - DNA, 22 bp, Homo sapiens
ccacccagcagaggaggcaaga

SEQ ID NO: 7404958 - DNA, 22 bp, Homo sapiens
ccacccagcagaggaggcaaga

SEQ ID NO: 7404959 - DNA, 22 bp, Homo sapiens
ccacccagcagaggaggcaaga

SEQ ID NO: 7404960 - DNA, 22 bp, Homo sapiens
ccacccagcagaggaggcaaga

SEQ ID NO: 7404961 - DNA, 22 bp, Homo sapiens
ccacccagaccagggatctggg

SEQ ID NO: 7404962 - DNA, 22 bp, Homo sapiens
ccacccagcagaggaggcaaga

SEQ ID NO: 7404963 - DNA, 22 bp, Homo sapiens
ccacccagaccagggatctggg

SEQ ID NO: 7404964 - DNA, 22 bp, Homo sapiens
ccacccagaccagggatctggg

SEQ ID NO: 7404965 - DNA, 22 bp, Homo sapiens
ccacccagaccagggatctggg

SEQ ID NO: 7404966 - DNA, 22 bp, Homo sapiens
ccacccagaccagggatctggg

SEQ ID NO: 7404967 - DNA, 22 bp, Homo sapiens
ccacccagaccagggatctggg

SEQ ID NO: 7404968 - DNA, 22 bp, Homo sapiens
ccacccagaccagggatctggg

SEQ ID NO: 7404969 - DNA, 22 bp, Homo sapiens
ccaccttgggactgctcacccc

SEQ ID NO: 7404970 - DNA, 22 bp, Homo sapiens
ccaccttgggactgctcacccc

SEQ ID NO: 7404971 - DNA, 20 bp, Homo sapiens
ccacctggccaaggctgtgc

SEQ ID NO: 7404972 - DNA, 22 bp, Homo sapiens
ccacctggggctgtggcccctt

SEQ ID NO: 7404973 - DNA, 22 bp, Homo sapiens
ccacctggggctgtggcccctt

SEQ ID NO: 7404974 - DNA, 22 bp, Homo sapiens
ccacctggggctgtggcccctt

SEQ ID NO: 7404975 - DNA, 22 bp, Homo sapiens
ccacctggggctgtggcccctt

SEQ ID NO: 7404976 - DNA, 22 bp, Homo sapiens
ccacctggggctgtggcccctt

SEQ ID NO: 7404977 - DNA, 22 bp, Homo sapiens
ccacctggggcctctgagtctc

SEQ ID NO: 7404978 - DNA, 22 bp, Homo sapiens
ccacctggggcctctgagtctc

SEQ ID NO: 7404979 - DNA, 22 bp, Homo sapiens
ccacctggggcctctgagtctc

SEQ ID NO: 7404980 - DNA, 20 bp, Homo sapiens
ccacctggccaaggctgtgc

SEQ ID NO: 7404981 - DNA, 20 bp, Homo sapiens
ccacctggccaaggctgtgc

SEQ ID NO: 7404982 - DNA, 18 bp, Homo sapiens
ccacccagggggagagga

SEQ ID NO: 7404983 - DNA, 18 bp, Homo sapiens
ccacccagggggagagga

SEQ ID NO: 7404984 - DNA, 18 bp, Homo sapiens
ccacccagggggagagga

SEQ ID NO: 7404985 - DNA, 22 bp, Homo sapiens
ccacccagccagatgcaggaag

SEQ ID NO: 7404986 - DNA, 22 bp, Homo sapiens
ccacccagccagatgcaggaag

SEQ ID NO: 7404987 - DNA, 22 bp, Homo sapiens
ccacccagccagatgcaggaag

SEQ ID NO: 7404988 - DNA, 23 bp, Homo sapiens
catttctgggagatttataaaat

SEQ ID NO: 7404989 - DNA, 23 bp, Homo sapiens
catttctgggagatttataaaat

SEQ ID NO: 7404990 - DNA, 23 bp, Homo sapiens
catttctgggagatttataaaat

SEQ ID NO: 7404991 - DNA, 23 bp, Homo sapiens
catttctgggagatttataaaat

SEQ ID NO: 7404992 - DNA, 23 bp, Homo sapiens
catttctgggagatttataaaat

SEQ ID NO: 7404993 - DNA, 23 bp, Homo sapiens
catttctgggagatttataaaat

SEQ ID NO: 7404994 - DNA, 22 bp, Homo sapiens
catttctgtacatgttttggtg

SEQ ID NO: 7404995 - DNA, 22 bp, Homo sapiens
catttctgtacatgttttggtg

SEQ ID NO: 7404996 - DNA, 22 bp, Homo sapiens
catttctgcagaattgctcttc

SEQ ID NO: 7404997 - DNA, 22 bp, Homo sapiens
catttctgcagaattgctcttc

SEQ ID NO: 7404998 - DNA, 22 bp, Homo sapiens
catttctgggagacatgctaga

SEQ ID NO: 7404999 - DNA, 22 bp, Homo sapiens
catttctgggagacatgctaga

SEQ ID NO: 7405000 - DNA, 22 bp, Homo sapiens
catttctgcagaattgctcttc

SEQ ID NO: 7405001 - DNA, 22 bp, Homo sapiens
catttctgggagacatgctaga

SEQ ID NO: 7405002 - DNA, 22 bp, Homo sapiens
catttctgggagacatgctaga

SEQ ID NO: 7405003 - DNA, 22 bp, Homo sapiens
catttctgggagacatgctaga

SEQ ID NO: 7405004 - DNA, 22 bp, Homo sapiens
catttctgtcacgttcttttat

SEQ ID NO: 7405005 - DNA, 22 bp, Homo sapiens
catttctgtcacgttcttttat

SEQ ID NO: 7405006 - DNA, 22 bp, Homo sapiens
catttctgtcacgttcttttat

SEQ ID NO: 7405007 - DNA, 22 bp, Homo sapiens
catttctgtcacgttcttttat

SEQ ID NO: 7405008 - DNA, 22 bp, Homo sapiens
catttctgtacatgttttggtg

SEQ ID NO: 7405009 - DNA, 22 bp, Homo sapiens
catttctgttctcttcctgtac

SEQ ID NO: 7405010 - DNA, 22 bp, Homo sapiens
catttctgtgacacttccatct

SEQ ID NO: 7405011 - DNA, 22 bp, Homo sapiens
catttctgtgacacttccatct

SEQ ID NO: 7405012 - DNA, 22 bp, Homo sapiens
catttctgtgacacttccatct

SEQ ID NO: 7405013 - DNA, 22 bp, Homo sapiens
catttctgtgacacttccatct

SEQ ID NO: 7405014 - DNA, 22 bp, Homo sapiens
catttctgtgacacttccatct

SEQ ID NO: 7405015 - DNA, 22 bp, Homo sapiens
catttctgtcacgttcttttat

SEQ ID NO: 7405016 - DNA, 22 bp, Homo sapiens
ccaatgatggtgcccacgatga

SEQ ID NO: 7405017 - DNA, 22 bp, Homo sapiens
ccaatgaatatatttcatatga

SEQ ID NO: 7405018 - DNA, 22 bp, Homo sapiens
ccaatgagacagaaagagcctc

SEQ ID NO: 7405019 - DNA, 22 bp, Homo sapiens
ccacagaatgatgacacttcag

SEQ ID NO: 7405020 - DNA, 22 bp, Homo sapiens
ccaatgaacaagtcggtcagga

SEQ ID NO: 7405021 - DNA, 22 bp, Homo sapiens
ccaatgaatatatttcatatga

SEQ ID NO: 7405022 - DNA, 22 bp, Homo sapiens
catttgaaacctggaatctacc

SEQ ID NO: 7405023 - DNA, 22 bp, Homo sapiens
ccaatgaaaggtcaattctata

SEQ ID NO: 7405024 - DNA, 22 bp, Homo sapiens
catttctgttctcttcctgtac

SEQ ID NO: 7405025 - DNA, 22 bp, Homo sapiens
catttctgttctcttcctgtac

SEQ ID NO: 7405026 - DNA, 22 bp, Homo sapiens
catttgaaaatactcttttcca

SEQ ID NO: 7405027 - DNA, 22 bp, Homo sapiens
catttgaaaatactcttttcca

SEQ ID NO: 7405028 - DNA, 22 bp, Homo sapiens
catttgaaaatactcttttcca

SEQ ID NO: 7405029 - DNA, 22 bp, Homo sapiens
catttgaaacctggaatctacc

SEQ ID NO: 7405030 - DNA, 22 bp, Homo sapiens
catttgaaacctggaatctacc

SEQ ID NO: 7405031 - DNA, 22 bp, Homo sapiens
catttgaaacctggaatctacc

SEQ ID NO: 7405032 - DNA, 22 bp, Homo sapiens
catttgaaacctggaatctacc

SEQ ID NO: 7405033 - DNA, 22 bp, Homo sapiens
ccacagaccttggcttccacct

SEQ ID NO: 7405034 - DNA, 22 bp, Homo sapiens
ccacagaattctgtctccagga

SEQ ID NO: 7405035 - DNA, 22 bp, Homo sapiens
ccacagagacagagcccagggt

SEQ ID NO: 7405036 - DNA, 22 bp, Homo sapiens
ccacagaattctgtctccagga

SEQ ID NO: 7405037 - DNA, 22 bp, Homo sapiens
ccacagaatgatgacacttcag

SEQ ID NO: 7405038 - DNA, 22 bp, Homo sapiens
ccacagaatgatgacacttcag

SEQ ID NO: 7405039 - DNA, 22 bp, Homo sapiens
ccacagaattctgtctccagga

SEQ ID NO: 7405040 - DNA, 22 bp, Homo sapiens
ccacagaattctgtctccagga

SEQ ID NO: 7405041 - DNA, 22 bp, Homo sapiens
ccacagaattctgtctccagga

SEQ ID NO: 7405042 - DNA, 22 bp, Homo sapiens
ccacagagacagggtccttgct

SEQ ID NO: 7405043 - DNA, 22 bp, Homo sapiens
ccacagagacagggtccttgct

SEQ ID NO: 7405044 - DNA, 22 bp, Homo sapiens
ccacagagacagagcccagggt

SEQ ID NO: 7405045 - DNA, 22 bp, Homo sapiens
ccacagagacagagcccagggt

SEQ ID NO: 7405046 - DNA, 22 bp, Homo sapiens
ccacagagacagagcccagggt

SEQ ID NO: 7405047 - DNA, 22 bp, Homo sapiens
ccacagagacagggtccttgct

SEQ ID NO: 7405048 - DNA, 22 bp, Homo sapiens
ccacagagacagggtccttgct

SEQ ID NO: 7405049 - DNA, 19 bp, Homo sapiens
ccacagagactagaagaca

SEQ ID NO: 7405050 - DNA, 22 bp, Homo sapiens
ccacagagactctgcaggactg

SEQ ID NO: 7405051 - DNA, 22 bp, Homo sapiens
ccacagagactctgcaggactg

SEQ ID NO: 7405052 - DNA, 19 bp, Homo sapiens
ccacagagactagaagaca

SEQ ID NO: 7405053 - DNA, 19 bp, Homo sapiens
ccacagagactagaagaca

SEQ ID NO: 7405054 - DNA, 19 bp, Homo sapiens
ccacagagactagaagaca

SEQ ID NO: 7405055 - DNA, 19 bp, Homo sapiens
ccacagagactagaagaca

SEQ ID NO: 7405056 - DNA, 19 bp, Homo sapiens
ccacagagactagaagaca

SEQ ID NO: 7405057 - DNA, 19 bp, Homo sapiens
ccacagagactagaagaca

SEQ ID NO: 7405058 - DNA, 22 bp, Homo sapiens
ccacagagacagggtccttgct

SEQ ID NO: 7405059 - DNA, 22 bp, Homo sapiens
ccacagagactctgcaggactg

SEQ ID NO: 7405060 - DNA, 22 bp, Homo sapiens
ccacagagactctgcaggactg

SEQ ID NO: 7405061 - DNA, 22 bp, Homo sapiens
ccacagagactctgcaggactg

SEQ ID NO: 7405062 - DNA, 22 bp, Homo sapiens
ccacagagactctgcaggactg

SEQ ID NO: 7405063 - DNA, 22 bp, Homo sapiens
ccacagagactctgcaggactg

SEQ ID NO: 7405064 - DNA, 22 bp, Homo sapiens
ccacagagactctgcaggactg

SEQ ID NO: 7405065 - DNA, 22 bp, Homo sapiens
ccacagagactctgcaggactg

SEQ ID NO: 7405066 - DNA, 22 bp, Homo sapiens
ccacagagagtgtcagcctttg

SEQ ID NO: 7405067 - DNA, 19 bp, Homo sapiens
ccacagagcatgctgaggc

SEQ ID NO: 7405068 - DNA, 19 bp, Homo sapiens
ccacagagcatgctgaggc

SEQ ID NO: 7405069 - DNA, 19 bp, Homo sapiens
ccacagagcatgctgaggc

SEQ ID NO: 7405070 - DNA, 19 bp, Homo sapiens
ccacagagcatgctgaggc

SEQ ID NO: 7405071 - DNA, 19 bp, Homo sapiens
ccacagagcatgctgaggc

SEQ ID NO: 7405072 - DNA, 22 bp, Homo sapiens
ccacagagactctgcaggactg

SEQ ID NO: 7405073 - DNA, 22 bp, Homo sapiens
ccacagagactctgcaggactg

SEQ ID NO: 7405074 - DNA, 22 bp, Homo sapiens
ccacagagagtgtcagcctttg

SEQ ID NO: 7405075 - DNA, 22 bp, Homo sapiens
ccacagagagtgtcagcctttg

SEQ ID NO: 7405076 - DNA, 17 bp, Homo sapiens
aggcaggagattggaga

SEQ ID NO: 7405077 - DNA, 22 bp, Homo sapiens
aggcaggagcaagccctacaag

SEQ ID NO: 7405078 - DNA, 17 bp, Homo sapiens
aggcaggagattggaga

SEQ ID NO: 7405079 - DNA, 22 bp, Homo sapiens
aggcaggagcaagccctacaag

SEQ ID NO: 7405080 - DNA, 22 bp, Homo sapiens
aggcaggagcaagccctacaag

SEQ ID NO: 7405081 - DNA, 22 bp, Homo sapiens
aggcaggagcaagccctacaag

SEQ ID NO: 7405082 - DNA, 22 bp, Homo sapiens
aggcaggagcaagccctacaag

SEQ ID NO: 7405083 - DNA, 22 bp, Homo sapiens
aggcaggagcaagccctacaag

SEQ ID NO: 7405084 - DNA, 22 bp, Homo sapiens
aggcaggagcaagccctacaag

SEQ ID NO: 7405085 - DNA, 22 bp, Homo sapiens
aggcaggaggatcatggatgca

SEQ ID NO: 7405086 - DNA, 17 bp, Homo sapiens
aggcaggagattggaga

SEQ ID NO: 7405087 - DNA, 17 bp, Homo sapiens
aggcaggagattggaga

SEQ ID NO: 7405088 - DNA, 17 bp, Homo sapiens
aggcaggagattggaga

SEQ ID NO: 7405089 - DNA, 17 bp, Homo sapiens
aggcaggagattggaga

SEQ ID NO: 7405090 - DNA, 17 bp, Homo sapiens
aggcaggagattggaga

SEQ ID NO: 7405091 - DNA, 17 bp, Homo sapiens
aggcaggagattggaga

SEQ ID NO: 7405092 - DNA, 17 bp, Homo sapiens
aggcaggagattggaga

SEQ ID NO: 7405093 - DNA, 22 bp, Homo sapiens
aggcaggaaccctgtgtgcgcc

SEQ ID NO: 7405094 - DNA, 22 bp, Homo sapiens
aggcaggaaccctgtgtgcgcc

SEQ ID NO: 7405095 - DNA, 22 bp, Homo sapiens
aggcaggaaccctgtgtgcgcc

SEQ ID NO: 7405096 - DNA, 22 bp, Homo sapiens
aggcaggaaccctgtgtgcgcc

SEQ ID NO: 7405097 - DNA, 22 bp, Homo sapiens
aggcaggaaccctgtgtgcgcc

SEQ ID NO: 7405098 - DNA, 22 bp, Homo sapiens
aggcaggaaaatcgcttgaacc

SEQ ID NO: 7405099 - DNA, 22 bp, Homo sapiens
aggcaggaaccctgtgtgcgcc

SEQ ID NO: 7405100 - DNA, 22 bp, Homo sapiens
aggcaggaaccctgtgtgcgcc

SEQ ID NO: 7405101 - DNA, 22 bp, Homo sapiens
aggcaggaaccctgtgtgcgcc

SEQ ID NO: 7405102 - DNA, 22 bp, Homo sapiens
aggcaggaaaatcgcttgaacc

SEQ ID NO: 7405103 - DNA, 22 bp, Homo sapiens
aggcaggaaaatcgcttgaacc

SEQ ID NO: 7405104 - DNA, 22 bp, Homo sapiens
aggcaggaaaatcgcttgaacc

SEQ ID NO: 7405105 - DNA, 22 bp, Homo sapiens
aggcaggaaaatcgcttgaacc

SEQ ID NO: 7405106 - DNA, 22 bp, Homo sapiens
aggcaggaaaatcgcttgaacc

SEQ ID NO: 7405107 - DNA, 23 bp, Homo sapiens
ccacagagctgccaattcctgtg

SEQ ID NO: 7405108 - DNA, 19 bp, Homo sapiens
ccacagagcatgctgaggc

SEQ ID NO: 7405109 - DNA, 22 bp, Homo sapiens
ccacagagcattagatttcaga

SEQ ID NO: 7405110 - DNA, 19 bp, Homo sapiens
ccacagagcatgctgaggc

SEQ ID NO: 7405111 - DNA, 22 bp, Homo sapiens
ccacagagcattagatttcaga

SEQ ID NO: 7405112 - DNA, 23 bp, Homo sapiens
ccacagagctgccaattcctgtg

SEQ ID NO: 7405113 - DNA, 23 bp, Homo sapiens
ccacagagctgccaattcctgtg

SEQ ID NO: 7405114 - DNA, 22 bp, Homo sapiens
aggcaggaggatcatggatgca

SEQ ID NO: 7405115 - DNA, 22 bp, Homo sapiens
aggcaggagtgaccctgacagg

SEQ ID NO: 7405116 - DNA, 22 bp, Homo sapiens
aggcaggagtgaccctgacagg

SEQ ID NO: 7405117 - DNA, 22 bp, Homo sapiens
aggcaggagtgaccctgacagg

SEQ ID NO: 7405118 - DNA, 22 bp, Homo sapiens
aggcaggagtgaccctgacagg

SEQ ID NO: 7405119 - DNA, 22 bp, Homo sapiens
aggcaggagtgaccctgacagg

SEQ ID NO: 7405120 - DNA, 22 bp, Homo sapiens
aggcaggagtgaccctgacagg

SEQ ID NO: 7405121 - DNA, 22 bp, Homo sapiens
aggcaggagtgaccctgacagg

SEQ ID NO: 7405122 - DNA, 22 bp, Homo sapiens
aggcaggagtgaccctgacagg

SEQ ID NO: 7405123 - DNA, 22 bp, Homo sapiens
aggcaggagtgaccctgacagg

SEQ ID NO: 7405124 - DNA, 22 bp, Homo sapiens
aggcaggagtgaccctgacagg

SEQ ID NO: 7405125 - DNA, 22 bp, Homo sapiens
aggcaggagtgaccctgacagg

SEQ ID NO: 7405126 - DNA, 22 bp, Homo sapiens
aggcaggagtgaccctgacagg

SEQ ID NO: 7405127 - DNA, 22 bp, Homo sapiens
aggcaggagtgaccctgacagg

SEQ ID NO: 7405128 - DNA, 22 bp, Homo sapiens
aggcaggaggatcatggatgca

SEQ ID NO: 7405129 - DNA, 22 bp, Homo sapiens
aggcaggaggatcatggatgca

SEQ ID NO: 7405130 - DNA, 22 bp, Homo sapiens
aggcaggaggatcatggatgca

SEQ ID NO: 7405131 - DNA, 22 bp, Homo sapiens
aggcaggaggatcatggatgca

SEQ ID NO: 7405132 - DNA, 22 bp, Homo sapiens
aggcaggaggatcatggatgca

SEQ ID NO: 7405133 - DNA, 22 bp, Homo sapiens
aggcaggaggatcatggatgca

SEQ ID NO: 7405134 - DNA, 22 bp, Homo sapiens
aggcaggagcaagccctacaag

SEQ ID NO: 7405135 - DNA, 22 bp, Homo sapiens
aggcaggaggatcatggatgca

SEQ ID NO: 7405136 - DNA, 22 bp, Homo sapiens
aggcaggaggatcatggatgca

SEQ ID NO: 7405137 - DNA, 22 bp, Homo sapiens
aggcaggaggatcatggatgca

SEQ ID NO: 7405138 - DNA, 22 bp, Homo sapiens
aggcaggaggatcatggatgca

SEQ ID NO: 7405139 - DNA, 18 bp, Homo sapiens
aggcaggatcctggcctc

SEQ ID NO: 7405140 - DNA, 18 bp, Homo sapiens
aggcaggatcctggcctc

SEQ ID NO: 7405141 - DNA, 18 bp, Homo sapiens
aggcaggatcctggcctc

SEQ ID NO: 7405142 - DNA, 18 bp, Homo sapiens
aggcaggatcctggcctc

SEQ ID NO: 7405143 - DNA, 18 bp, Homo sapiens
aggcaggatcctggcctc

SEQ ID NO: 7405144 - DNA, 18 bp, Homo sapiens
aggcaggatcctggcctc

SEQ ID NO: 7405145 - DNA, 22 bp, Homo sapiens
aggcaggagtgaccctgacagg

SEQ ID NO: 7405146 - DNA, 23 bp, Homo sapiens
ccacaggcacagaggcttgcatc

SEQ ID NO: 7405147 - DNA, 18 bp, Homo sapiens
aggcaggatcctggcctc

SEQ ID NO: 7405148 - DNA, 18 bp, Homo sapiens
aggcaggatcctggcctc

SEQ ID NO: 7405149 - DNA, 18 bp, Homo sapiens
aggcaggatcctggcctc

SEQ ID NO: 7405150 - DNA, 18 bp, Homo sapiens
aggcaggatcctggcctc

SEQ ID NO: 7405151 - DNA, 22 bp, Homo sapiens
ccacaggcggagtggcgggcag

SEQ ID NO: 7405152 - DNA, 22 bp, Homo sapiens
ccacaggcggagtggcgggcag

SEQ ID NO: 7405153 - DNA, 22 bp, Homo sapiens
ccacagtgcctggaattctgca

SEQ ID NO: 7405154 - DNA, 22 bp, Homo sapiens
ccacagtgcctggaattctgca

SEQ ID NO: 7405155 - DNA, 20 bp, Homo sapiens
ccacagtggagactggagac

SEQ ID NO: 7405156 - DNA, 20 bp, Homo sapiens
ccacagtggagactggagac

SEQ ID NO: 7405157 - DNA, 20 bp, Homo sapiens
ccacagtggagactggagac

SEQ ID NO: 7405158 - DNA, 23 bp, Homo sapiens
ccacaggcacagaggcttgcatc

SEQ ID NO: 7405159 - DNA, 23 bp, Homo sapiens
ccacaggcacagaggcttgcatc

SEQ ID NO: 7405160 - DNA, 23 bp, Homo sapiens
ccacaggcacagaggcttgcatc

SEQ ID NO: 7405161 - DNA, 23 bp, Homo sapiens
ccacaggcacagaggcttgcatc

SEQ ID NO: 7405162 - DNA, 23 bp, Homo sapiens
ccacaggcacagaggcttgcatc

SEQ ID NO: 7405163 - DNA, 22 bp, Homo sapiens
cagtaaatggtacgtatatttt

SEQ ID NO: 7405164 - DNA, 22 bp, Homo sapiens
cagtaaatgatgatagtgcctt

SEQ ID NO: 7405165 - DNA, 22 bp, Homo sapiens
cagtaaatgcagatatagatac

SEQ ID NO: 7405166 - DNA, 22 bp, Homo sapiens
cagtaaatgcagatatagatac

SEQ ID NO: 7405167 - DNA, 22 bp, Homo sapiens
cagtaaatcctagagccctcat

SEQ ID NO: 7405168 - DNA, 22 bp, Homo sapiens
cagtaaatctctatctgccatt

SEQ ID NO: 7405169 - DNA, 22 bp, Homo sapiens
cagtaaatgagaagctagtaat

SEQ ID NO: 7405170 - DNA, 22 bp, Homo sapiens
cagtaaatttgagggatctaat

SEQ ID NO: 7405171 - DNA, 22 bp, Homo sapiens
cagtaaattatctcatctctgt

SEQ ID NO: 7405172 - DNA, 22 bp, Homo sapiens
cagtaaattatctcatctctgt

SEQ ID NO: 7405173 - DNA, 22 bp, Homo sapiens
cagtaacacaaccactccgtga

SEQ ID NO: 7405174 - DNA, 22 bp, Homo sapiens
cagtaacacaaccactccgtga

SEQ ID NO: 7405175 - DNA, 22 bp, Homo sapiens
cagtaacacaaccactccgtga

SEQ ID NO: 7405176 - DNA, 22 bp, Homo sapiens
cagtaaatgtgatttttcttgt

SEQ ID NO: 7405177 - DNA, 22 bp, Homo sapiens
cagtaaatgtgatttttcttgt

SEQ ID NO: 7405178 - DNA, 22 bp, Homo sapiens
cagtaaatggtacgtatatttt

SEQ ID NO: 7405179 - DNA, 22 bp, Homo sapiens
cagtaaattatctcatctctgt

SEQ ID NO: 7405180 - DNA, 22 bp, Homo sapiens
cagtaaatgtgatttttcttgt

SEQ ID NO: 7405181 - DNA, 22 bp, Homo sapiens
cagtaaatgtgatttttcttgt

SEQ ID NO: 7405182 - DNA, 22 bp, Homo sapiens
cagtaacatttcaaggtagagg

SEQ ID NO: 7405183 - DNA, 22 bp, Homo sapiens
cagtaacatttcaaggtagagg

SEQ ID NO: 7405184 - DNA, 22 bp, Homo sapiens
cagtaacatttcaaggtagagg

SEQ ID NO: 7405185 - DNA, 22 bp, Homo sapiens
cagtaactaggacaaggaggaa

SEQ ID NO: 7405186 - DNA, 22 bp, Homo sapiens
cagtaacatgtctgttaagaaa

SEQ ID NO: 7405187 - DNA, 22 bp, Homo sapiens
cagtaacatgaagagacatgga

SEQ ID NO: 7405188 - DNA, 22 bp, Homo sapiens
cagtaacatgtctgttaagaaa

SEQ ID NO: 7405189 - DNA, 22 bp, Homo sapiens
cagtaacatgtctgttaagaaa

SEQ ID NO: 7405190 - DNA, 22 bp, Homo sapiens
cagtaacatgtctgttaagaaa

SEQ ID NO: 7405191 - DNA, 22 bp, Homo sapiens
cagtaacatgaagagacatgga

SEQ ID NO: 7405192 - DNA, 22 bp, Homo sapiens
cagtaacagtgatcacctgtgg

SEQ ID NO: 7405193 - DNA, 22 bp, Homo sapiens
cagtaacatgaagagacatgga

SEQ ID NO: 7405194 - DNA, 22 bp, Homo sapiens
cagtaacagtgatcacctgtgg

SEQ ID NO: 7405195 - DNA, 22 bp, Homo sapiens
cagtaacatgaagagacatgga

SEQ ID NO: 7405196 - DNA, 22 bp, Homo sapiens
cagtaacatgaagagacatgga

SEQ ID NO: 7405197 - DNA, 22 bp, Homo sapiens
cagtaacagtgatcacctgtgg

SEQ ID NO: 7405198 - DNA, 22 bp, Homo sapiens
cagtaacaggctctgtggtata

SEQ ID NO: 7405199 - DNA, 22 bp, Homo sapiens
cagtaacagtgatcacctgtgg

SEQ ID NO: 7405200 - DNA, 22 bp, Homo sapiens
cagtaacagtgatcacctgtgg

SEQ ID NO: 7405201 - DNA, 22 bp, Homo sapiens
cagtaacaggctctgtggtata

SEQ ID NO: 7405202 - DNA, 22 bp, Homo sapiens
cagtaacaggctctgtggtata

SEQ ID NO: 7405203 - DNA, 22 bp, Homo sapiens
cagtaacaggctctgtggtata

SEQ ID NO: 7405204 - DNA, 22 bp, Homo sapiens
cagtaacaggctctgtggtata

SEQ ID NO: 7405205 - DNA, 22 bp, Homo sapiens
cagtaacaggctctgtggtata

SEQ ID NO: 7405206 - DNA, 22 bp, Homo sapiens
aggacagagggaccagagccca

SEQ ID NO: 7405207 - DNA, 21 bp, Homo sapiens
aggacagatgtaggaataaag

SEQ ID NO: 7405208 - DNA, 21 bp, Homo sapiens
aggacagatgtaggaataaag

SEQ ID NO: 7405209 - DNA, 22 bp, Homo sapiens
aggacagatttttggccaccag

SEQ ID NO: 7405210 - DNA, 21 bp, Homo sapiens
aggacagatgtaggaataaag

SEQ ID NO: 7405211 - DNA, 21 bp, Homo sapiens
aggacagatgtaggaataaag

SEQ ID NO: 7405212 - DNA, 22 bp, Homo sapiens
aggacagagggaccagagccca

SEQ ID NO: 7405213 - DNA, 22 bp, Homo sapiens
aggacagagggaccagagccca

SEQ ID NO: 7405214 - DNA, 22 bp, Homo sapiens
aggacagagggaccagagccca

SEQ ID NO: 7405215 - DNA, 22 bp, Homo sapiens
aggacagagggaccagagccca

SEQ ID NO: 7405216 - DNA, 22 bp, Homo sapiens
aggacagagggaccagagccca

SEQ ID NO: 7405217 - DNA, 22 bp, Homo sapiens
aggacagagggaccagagccca

SEQ ID NO: 7405218 - DNA, 22 bp, Homo sapiens
aggacagagggaccagagccca

SEQ ID NO: 7405219 - DNA, 22 bp, Homo sapiens
aggacagagggaccagagccca

SEQ ID NO: 7405220 - DNA, 22 bp, Homo sapiens
aggacagagggaccagagccca

SEQ ID NO: 7405221 - DNA, 22 bp, Homo sapiens
aggacagagggaccagagccca

SEQ ID NO: 7405222 - DNA, 22 bp, Homo sapiens
aggacagagggaccagagccca

SEQ ID NO: 7405223 - DNA, 22 bp, Homo sapiens
aggacagagggaccagagccca

SEQ ID NO: 7405224 - DNA, 22 bp, Homo sapiens
aggacagagggaccagagccca

SEQ ID NO: 7405225 - DNA, 22 bp, Homo sapiens
aggacagagggaccagagccca

SEQ ID NO: 7405226 - DNA, 22 bp, Homo sapiens
aggacagatttttggccaccag

SEQ ID NO: 7405227 - DNA, 23 bp, Homo sapiens
aggacagcaaaccccgcctcccc

SEQ ID NO: 7405228 - DNA, 23 bp, Homo sapiens
aggacagcaaaccccgcctcccc

SEQ ID NO: 7405229 - DNA, 22 bp, Homo sapiens
aggacagatttttggccaccag

SEQ ID NO: 7405230 - DNA, 21 bp, Homo sapiens
aggacagatgtaggaataaag

SEQ ID NO: 7405231 - DNA, 22 bp, Homo sapiens
aggacagatttttggccaccag

SEQ ID NO: 7405232 - DNA, 22 bp, Homo sapiens
aggacagatttttggccaccag

SEQ ID NO: 7405233 - DNA, 22 bp, Homo sapiens
cagtaaacagttactaagaaga

SEQ ID NO: 7405234 - DNA, 22 bp, Homo sapiens
cagtaaacactagcattcttgg

SEQ ID NO: 7405235 - DNA, 22 bp, Homo sapiens
aggacagcaaccgttattcaca

SEQ ID NO: 7405236 - DNA, 22 bp, Homo sapiens
cagtaaaagatggaaatagaat

SEQ ID NO: 7405237 - DNA, 22 bp, Homo sapiens
cagtaaacactagcattcttgg

SEQ ID NO: 7405238 - DNA, 22 bp, Homo sapiens
cagtaaaggttttatggggctt

SEQ ID NO: 7405239 - DNA, 22 bp, Homo sapiens
cagtaaaggttttatggggctt

SEQ ID NO: 7405240 - DNA, 22 bp, Homo sapiens
cagtaaagcatgtatgtcttca

SEQ ID NO: 7405241 - DNA, 22 bp, Homo sapiens
cagtaaagcatgtatgtcttca

SEQ ID NO: 7405242 - DNA, 22 bp, Homo sapiens
cagtaaagcatgtatgtcttca

SEQ ID NO: 7405243 - DNA, 22 bp, Homo sapiens
cagtaaagcatgtatgtcttca

SEQ ID NO: 7405244 - DNA, 22 bp, Homo sapiens
cagtaaagagccttcattaaat

SEQ ID NO: 7405245 - DNA, 22 bp, Homo sapiens
cagtaaacagttactaagaaga

SEQ ID NO: 7405246 - DNA, 22 bp, Homo sapiens
cagtaaacagttactaagaaga

SEQ ID NO: 7405247 - DNA, 22 bp, Homo sapiens
cagtaaacagttactaagaaga

SEQ ID NO: 7405248 - DNA, 22 bp, Homo sapiens
cagtaaagagccttcattaaat

SEQ ID NO: 7405249 - DNA, 22 bp, Homo sapiens
cagtaaggatgcacataactag

SEQ ID NO: 7405250 - DNA, 22 bp, Homo sapiens
cagtaaggatgcacataactag

SEQ ID NO: 7405251 - DNA, 22 bp, Homo sapiens
cagtaactgatgtgatcaaacg

SEQ ID NO: 7405252 - DNA, 22 bp, Homo sapiens
cagtaactgatgtgatcaaacg

SEQ ID NO: 7405253 - DNA, 22 bp, Homo sapiens
cagtaagtgtctccacttttct

SEQ ID NO: 7405254 - DNA, 22 bp, Homo sapiens
cagtaataaagctaagtatttc

SEQ ID NO: 7405255 - DNA, 22 bp, Homo sapiens
cagtaataaagctaagtatttc

SEQ ID NO: 7405256 - DNA, 22 bp, Homo sapiens
cagtaataaagctaagtatttc

SEQ ID NO: 7405257 - DNA, 22 bp, Homo sapiens
cagtaataaagctaagtatttc

SEQ ID NO: 7405258 - DNA, 22 bp, Homo sapiens
cagtaagtattcgagtctccat

SEQ ID NO: 7405259 - DNA, 22 bp, Homo sapiens
cagtaagtattcgagtctccat

SEQ ID NO: 7405260 - DNA, 22 bp, Homo sapiens
cagtaagtcaacaaacatgggg

SEQ ID NO: 7405261 - DNA, 22 bp, Homo sapiens
cagtatctgtcagtaatcaggt

SEQ ID NO: 7405262 - DNA, 22 bp, Homo sapiens
cagtaatagcagagtcttccat

SEQ ID NO: 7405263 - DNA, 20 bp, Homo sapiens
cagtatctgaagccacacaa

SEQ ID NO: 7405264 - DNA, 22 bp, Homo sapiens
cagtaatagagtgccagggatg

SEQ ID NO: 7405265 - DNA, 22 bp, Homo sapiens
cagtaatagagtgccagggatg

SEQ ID NO: 7405266 - DNA, 22 bp, Homo sapiens
cagtaatagatttgagagtggt

SEQ ID NO: 7405267 - DNA, 22 bp, Homo sapiens
cagtaatagatttgagagtggt

SEQ ID NO: 7405268 - DNA, 22 bp, Homo sapiens
cagtaatagcagagtcttccat

SEQ ID NO: 7405269 - DNA, 22 bp, Homo sapiens
cagtaatagcagagtcttccat

SEQ ID NO: 7405270 - DNA, 22 bp, Homo sapiens
cagtaataacacagaaagtttg

SEQ ID NO: 7405271 - DNA, 22 bp, Homo sapiens
cagtaataacacagaaagtttg

SEQ ID NO: 7405272 - DNA, 22 bp, Homo sapiens
cagtaataagctggagggtgtg

SEQ ID NO: 7405273 - DNA, 22 bp, Homo sapiens
cagtaataagctggagggtgtg

SEQ ID NO: 7405274 - DNA, 22 bp, Homo sapiens
cagtaatacccctggctcaggt

SEQ ID NO: 7405275 - DNA, 22 bp, Homo sapiens
cagtaatacccctggctcaggt

SEQ ID NO: 7405276 - DNA, 22 bp, Homo sapiens
cagtaatacccctggctcaggt

SEQ ID NO: 7405277 - DNA, 22 bp, Homo sapiens
cagtaatagaggctttgagtct

SEQ ID NO: 7405278 - DNA, 22 bp, Homo sapiens
cagtaatagaggctttgagtct

SEQ ID NO: 7405279 - DNA, 22 bp, Homo sapiens
cagtatgagagttgaatcaagg

SEQ ID NO: 7405280 - DNA, 22 bp, Homo sapiens
cagtatcttatgaaccctgatc

SEQ ID NO: 7405281 - DNA, 22 bp, Homo sapiens
cagtatcttatgaaccctgatc

SEQ ID NO: 7405282 - DNA, 22 bp, Homo sapiens
cagtatcttgcttatagacaca

SEQ ID NO: 7405283 - DNA, 22 bp, Homo sapiens
cagtatgactacaaacagcttt

SEQ ID NO: 7405284 - DNA, 22 bp, Homo sapiens
cagtatgtactcttatcatgta

SEQ ID NO: 7405285 - DNA, 22 bp, Homo sapiens
cagtatgtactcttatcatgta

SEQ ID NO: 7405286 - DNA, 22 bp, Homo sapiens
cagtatgtactcttatcatgta

SEQ ID NO: 7405287 - DNA, 22 bp, Homo sapiens
cagtatgtactcttatcatgta

SEQ ID NO: 7405288 - DNA, 22 bp, Homo sapiens
cagtatgtctactggacaaagt

SEQ ID NO: 7405289 - DNA, 22 bp, Homo sapiens
cagtatgtctactggacaaagt

SEQ ID NO: 7405290 - DNA, 22 bp, Homo sapiens
cagtatgtctactggacaaagt

SEQ ID NO: 7405291 - DNA, 22 bp, Homo sapiens
cagtatgtgatgcaacggaata

SEQ ID NO: 7405292 - DNA, 22 bp, Homo sapiens
cagtatgtgatgcaacggaata

SEQ ID NO: 7405293 - DNA, 22 bp, Homo sapiens
cagtatgttcttccaggacaga

SEQ ID NO: 7405294 - DNA, 22 bp, Homo sapiens
cagtatttgttacagcattagc

SEQ ID NO: 7405295 - DNA, 22 bp, Homo sapiens
cagtatttgttacagcattagc

SEQ ID NO: 7405296 - DNA, 22 bp, Homo sapiens
cagtatttgttacagcattagc

SEQ ID NO: 7405297 - DNA, 22 bp, Homo sapiens
cagtatttgttacagcattagc

SEQ ID NO: 7405298 - DNA, 22 bp, Homo sapiens
cagtatttggtaattggctacc

SEQ ID NO: 7405299 - DNA, 22 bp, Homo sapiens
cagtatttggtaattggctacc

SEQ ID NO: 7405300 - DNA, 22 bp, Homo sapiens
cagtatttgttacagcattagc

SEQ ID NO: 7405301 - DNA, 22 bp, Homo sapiens
cagtatttgttacagcattagc

SEQ ID NO: 7405302 - DNA, 22 bp, Homo sapiens
cagtatttgttacagcattagc

SEQ ID NO: 7405303 - DNA, 22 bp, Homo sapiens
cagtatttgttacagcattagc

SEQ ID NO: 7405304 - DNA, 22 bp, Homo sapiens
cagtatttggaatatagctaag

SEQ ID NO: 7405305 - DNA, 22 bp, Homo sapiens
cagtatttggaatatagctaag

SEQ ID NO: 7405306 - DNA, 22 bp, Homo sapiens
cagtatttggaatatagctaag

SEQ ID NO: 7405307 - DNA, 22 bp, Homo sapiens
cagtatttggaatatagctaag

SEQ ID NO: 7405308 - DNA, 22 bp, Homo sapiens
cagtatttggaatatagctaag

SEQ ID NO: 7405309 - DNA, 22 bp, Homo sapiens
cagtatttcctcttcttaactt

SEQ ID NO: 7405310 - DNA, 22 bp, Homo sapiens
cagtatttcctcttcttaactt

SEQ ID NO: 7405311 - DNA, 22 bp, Homo sapiens
cagtatttcctcttcttaactt

SEQ ID NO: 7405312 - DNA, 22 bp, Homo sapiens
cagtatttcctcttcttaactt

SEQ ID NO: 7405313 - DNA, 22 bp, Homo sapiens
cagtatgtttgggagacatgac

SEQ ID NO: 7405314 - DNA, 22 bp, Homo sapiens
cagtatgtttattagaactgca

SEQ ID NO: 7405315 - DNA, 22 bp, Homo sapiens
cagtatgtttattagaactgca

SEQ ID NO: 7405316 - DNA, 22 bp, Homo sapiens
cagtatgtttgggagacatgac

SEQ ID NO: 7405317 - DNA, 20 bp, Homo sapiens
cagtattgatccattgtctg

SEQ ID NO: 7405318 - DNA, 22 bp, Homo sapiens
cagtatgtttgggagacatgac

SEQ ID NO: 7405319 - DNA, 22 bp, Homo sapiens
cagtatgtttgggagacatgac

SEQ ID NO: 7405320 - DNA, 22 bp, Homo sapiens
cagtatttaggattaggagaga

SEQ ID NO: 7405321 - DNA, 22 bp, Homo sapiens
cagtatttaggattaggagaga

SEQ ID NO: 7405322 - DNA, 22 bp, Homo sapiens
cagtatttaggattaggagaga

SEQ ID NO: 7405323 - DNA, 22 bp, Homo sapiens
cagtatttaggattaggagaga

SEQ ID NO: 7405324 - DNA, 22 bp, Homo sapiens
cagtatttatggcttgagtatt

SEQ ID NO: 7405325 - DNA, 22 bp, Homo sapiens
cagtatttatggcttgagtatt

SEQ ID NO: 7405326 - DNA, 22 bp, Homo sapiens
cagtatttatggcttgagtatt

SEQ ID NO: 7405327 - DNA, 22 bp, Homo sapiens
cagtatttaggattaggagaga

SEQ ID NO: 7405328 - DNA, 22 bp, Homo sapiens
cagtatttatggcttgagtatt

SEQ ID NO: 7405329 - DNA, 22 bp, Homo sapiens
cagtatttatggcttgagtatt

SEQ ID NO: 7405330 - DNA, 22 bp, Homo sapiens
cagtatttatggcttgagtatt

SEQ ID NO: 7405331 - DNA, 22 bp, Homo sapiens
cagtatttatggcttgagtatt

SEQ ID NO: 7405332 - DNA, 22 bp, Homo sapiens
cagtatttcattcagaattgtt

SEQ ID NO: 7405333 - DNA, 22 bp, Homo sapiens
cagtatttcattcagaattgtt

SEQ ID NO: 7405334 - DNA, 22 bp, Homo sapiens
cagtatttcattcagaattgtt

SEQ ID NO: 7405335 - DNA, 22 bp, Homo sapiens
cagtatttcattcagaattgtt

SEQ ID NO: 7405336 - DNA, 22 bp, Homo sapiens
cagtatttatggcttgagtatt

SEQ ID NO: 7405337 - DNA, 22 bp, Homo sapiens
cagtatttcattcagaattgtt

SEQ ID NO: 7405338 - DNA, 22 bp, Homo sapiens
cagtatttcattcagaattgtt

SEQ ID NO: 7405339 - DNA, 22 bp, Homo sapiens
cagtatttcattcagaattgtt

SEQ ID NO: 7405340 - DNA, 22 bp, Homo sapiens
aggacagacctaggactggagc

SEQ ID NO: 7405341 - DNA, 22 bp, Homo sapiens
aggacagacctaggactggagc

SEQ ID NO: 7405342 - DNA, 22 bp, Homo sapiens
aggacagacctaggactggagc

SEQ ID NO: 7405343 - DNA, 22 bp, Homo sapiens
aggacagacctaggactggagc

SEQ ID NO: 7405344 - DNA, 22 bp, Homo sapiens
aggacagacctaggactggagc

SEQ ID NO: 7405345 - DNA, 22 bp, Homo sapiens
aggacagaatctatattcagtt

SEQ ID NO: 7405346 - DNA, 22 bp, Homo sapiens
aggacagacctaggactggagc

SEQ ID NO: 7405347 - DNA, 22 bp, Homo sapiens
aggacagaatctatattcagtt

SEQ ID NO: 7405348 - DNA, 22 bp, Homo sapiens
aggacacatgcacaccctgcgt

SEQ ID NO: 7405349 - DNA, 22 bp, Homo sapiens
aggacacatgcacaccctgcgt

SEQ ID NO: 7405350 - DNA, 22 bp, Homo sapiens
aggacacttgagagtccagtca

SEQ ID NO: 7405351 - DNA, 22 bp, Homo sapiens
aggacacttaggttattcaact

SEQ ID NO: 7405352 - DNA, 22 bp, Homo sapiens
aggacactgctgaggatcagat

SEQ ID NO: 7405353 - DNA, 22 bp, Homo sapiens
aggacagagcctgtgcagaccg

SEQ ID NO: 7405354 - DNA, 22 bp, Homo sapiens
aggacagagccctagtttcata

SEQ ID NO: 7405355 - DNA, 22 bp, Homo sapiens
aggacagagcctgtgcagaccg

SEQ ID NO: 7405356 - DNA, 22 bp, Homo sapiens
aggacagagcctgtgcagaccg

SEQ ID NO: 7405357 - DNA, 22 bp, Homo sapiens
aggacagagcctgtgcagaccg

SEQ ID NO: 7405358 - DNA, 22 bp, Homo sapiens
aggacagagcctgtgcagaccg

SEQ ID NO: 7405359 - DNA, 22 bp, Homo sapiens
aggacagagcctgtgcagaccg

SEQ ID NO: 7405360 - DNA, 22 bp, Homo sapiens
aggacagagcctgtgcagaccg

SEQ ID NO: 7405361 - DNA, 22 bp, Homo sapiens
aggacagagcctgtgcagaccg

SEQ ID NO: 7405362 - DNA, 22 bp, Homo sapiens
aggacagagccctagtttcata

SEQ ID NO: 7405363 - DNA, 22 bp, Homo sapiens
aggacagacctaggactggagc

SEQ ID NO: 7405364 - DNA, 22 bp, Homo sapiens
aggacagagccctagtttcata

SEQ ID NO: 7405365 - DNA, 22 bp, Homo sapiens
aggacagagccctagtttcata

SEQ ID NO: 7405366 - DNA, 22 bp, Homo sapiens
aggacagagccctagtttcata

SEQ ID NO: 7405367 - DNA, 22 bp, Homo sapiens
aggacagagccctagtttcata

SEQ ID NO: 7405368 - DNA, 22 bp, Homo sapiens
aggacagacctaggactggagc

SEQ ID NO: 7405369 - DNA, 22 bp, Homo sapiens
aggacagacctaggactggagc

SEQ ID NO: 7405370 - DNA, 22 bp, Homo sapiens
aggacagacctaggactggagc

SEQ ID NO: 7405371 - DNA, 22 bp, Homo sapiens
aggaatattactttgcttttat

SEQ ID NO: 7405372 - DNA, 22 bp, Homo sapiens
aggaatattactttgcttttat

SEQ ID NO: 7405373 - DNA, 22 bp, Homo sapiens
aggaatatggatttgctcagct

SEQ ID NO: 7405374 - DNA, 22 bp, Homo sapiens
aggaatatggatttgctcagct

SEQ ID NO: 7405375 - DNA, 18 bp, Homo sapiens
aggaatattcaaggtgct

SEQ ID NO: 7405376 - DNA, 18 bp, Homo sapiens
aggaatattcaaggtgct

SEQ ID NO: 7405377 - DNA, 18 bp, Homo sapiens
aggaatattcaaggtgct

SEQ ID NO: 7405378 - DNA, 18 bp, Homo sapiens
aggaatattcaaggtgct

SEQ ID NO: 7405379 - DNA, 18 bp, Homo sapiens
aggaatattcaaggtgct

SEQ ID NO: 7405380 - DNA, 22 bp, Homo sapiens
aggaatattctcaagtggtcgt

SEQ ID NO: 7405381 - DNA, 22 bp, Homo sapiens
aggaatcaggagatgagcacgg

SEQ ID NO: 7405382 - DNA, 22 bp, Homo sapiens
aggaatcagaattcttagaatt

SEQ ID NO: 7405383 - DNA, 22 bp, Homo sapiens
aggaatattctcaagtggtcgt

SEQ ID NO: 7405384 - DNA, 22 bp, Homo sapiens
aggaatattctcaagtggtcgt

SEQ ID NO: 7405385 - DNA, 22 bp, Homo sapiens
aggaatcaggagatgagcacgg

SEQ ID NO: 7405386 - DNA, 21 bp, Homo sapiens
aggaatccagttcgcaggttt

SEQ ID NO: 7405387 - DNA, 22 bp, Homo sapiens
aggaatcccgcaccagctgctg

SEQ ID NO: 7405388 - DNA, 22 bp, Homo sapiens
aggacaagctaaaggacttcct

SEQ ID NO: 7405389 - DNA, 22 bp, Homo sapiens
aggacaagacaaggaccagaga

SEQ ID NO: 7405390 - DNA, 22 bp, Homo sapiens
aggacaagacaaggaccagaga

SEQ ID NO: 7405391 - DNA, 22 bp, Homo sapiens
aggaatctgggcccaactgtgc

SEQ ID NO: 7405392 - DNA, 22 bp, Homo sapiens
aggaatgaactcgagtgatctg

SEQ ID NO: 7405393 - DNA, 22 bp, Homo sapiens
aggaatgaactcgagtgatctg

SEQ ID NO: 7405394 - DNA, 22 bp, Homo sapiens
aggaagtgggaagggtctgcca

SEQ ID NO: 7405395 - DNA, 22 bp, Homo sapiens
aggaagtgggaagggtctgcca

SEQ ID NO: 7405396 - DNA, 23 bp, Homo sapiens
aggaagttaaggcagacagacag

SEQ ID NO: 7405397 - DNA, 23 bp, Homo sapiens
aggaagttaaggcagacagacag

SEQ ID NO: 7405398 - DNA, 23 bp, Homo sapiens
aggaagttatgaagggagaatag

SEQ ID NO: 7405399 - DNA, 23 bp, Homo sapiens
aggaagttatgaagggagaatag

SEQ ID NO: 7405400 - DNA, 23 bp, Homo sapiens
aggaagttatgaagggagaatag

SEQ ID NO: 7405401 - DNA, 22 bp, Homo sapiens
aggaataacctcattgcttttt

SEQ ID NO: 7405402 - DNA, 22 bp, Homo sapiens
aggaagttggcattttgtttca

SEQ ID NO: 7405403 - DNA, 22 bp, Homo sapiens
aggaatagaccacttcactgag

SEQ ID NO: 7405404 - DNA, 22 bp, Homo sapiens
aggaatagaccacttcactgag

SEQ ID NO: 7405405 - DNA, 22 bp, Homo sapiens
aggaatagctgttaaagtcaat

SEQ ID NO: 7405406 - DNA, 22 bp, Homo sapiens
aggaatatgagctgctgcagtg

SEQ ID NO: 7405407 - DNA, 22 bp, Homo sapiens
aggaatatgagctgctgcagtg

SEQ ID NO: 7405408 - DNA, 22 bp, Homo sapiens
aggaatatagttggaatgtagg

SEQ ID NO: 7405409 - DNA, 22 bp, Homo sapiens
aggaatatgagctgctgcagtg

SEQ ID NO: 7405410 - DNA, 22 bp, Homo sapiens
aggaatatagttggaatgtagg

SEQ ID NO: 7405411 - DNA, 22 bp, Homo sapiens
aggaatagctgttaaagtcaat

SEQ ID NO: 7405412 - DNA, 22 bp, Homo sapiens
aggaatatagttggaatgtagg

SEQ ID NO: 7405413 - DNA, 22 bp, Homo sapiens
aggaagtgctaagagaacatca

SEQ ID NO: 7405414 - DNA, 22 bp, Homo sapiens
aggaagtgcagggggaagtact

SEQ ID NO: 7405415 - DNA, 22 bp, Homo sapiens
aggaagtgctaagagaacatca

SEQ ID NO: 7405416 - DNA, 22 bp, Homo sapiens
aggaagtggataaaatagcttt

SEQ ID NO: 7405417 - DNA, 21 bp, Homo sapiens
aggaagtggccagattgggaa

SEQ ID NO: 7405418 - DNA, 21 bp, Homo sapiens
aggaagtggccagattgggaa

SEQ ID NO: 7405419 - DNA, 21 bp, Homo sapiens
aggaagtggccagattgggaa

SEQ ID NO: 7405420 - DNA, 21 bp, Homo sapiens
aggaagtggccagattgggaa

SEQ ID NO: 7405421 - DNA, 22 bp, Homo sapiens
aggaagtggataaaatagcttt

SEQ ID NO: 7405422 - DNA, 22 bp, Homo sapiens
aggaagtggataaaatagcttt

SEQ ID NO: 7405423 - DNA, 20 bp, Homo sapiens
aggaagtgatgttttatctg

SEQ ID NO: 7405424 - DNA, 22 bp, Homo sapiens
aggaagtgcagggggaagtact

SEQ ID NO: 7405425 - DNA, 22 bp, Homo sapiens
caggtgtctaattctcaccccc

SEQ ID NO: 7405426 - DNA, 22 bp, Homo sapiens
caggtgtacacattgtgtttat

SEQ ID NO: 7405427 - DNA, 20 bp, Homo sapiens
caggtgtacagtgagctgag

SEQ ID NO: 7405428 - DNA, 22 bp, Homo sapiens
caggtgtcaaaatactaagtgg

SEQ ID NO: 7405429 - DNA, 22 bp, Homo sapiens
caggtgtcaaaatactaagtgg

SEQ ID NO: 7405430 - DNA, 22 bp, Homo sapiens
caggtggttgagagctgtaggc

SEQ ID NO: 7405431 - DNA, 22 bp, Homo sapiens
caggtggttgagagctgtaggc

SEQ ID NO: 7405432 - DNA, 22 bp, Homo sapiens
caggtggttgagagctgtaggc

SEQ ID NO: 7405433 - DNA, 22 bp, Homo sapiens
caggtggttatgaggaaggtga

SEQ ID NO: 7405434 - DNA, 22 bp, Homo sapiens
caggtggttgtttggattctaa

SEQ ID NO: 7405435 - DNA, 22 bp, Homo sapiens
caggtgtacacattgtgtttat

SEQ ID NO: 7405436 - DNA, 22 bp, Homo sapiens
cagggcttcgtgtctcagtgct

SEQ ID NO: 7405437 - DNA, 22 bp, Homo sapiens
cagggcttcgtgtctcagtgct

SEQ ID NO: 7405438 - DNA, 22 bp, Homo sapiens
cagggcttgaatcaaggaagtc

SEQ ID NO: 7405439 - DNA, 22 bp, Homo sapiens
cagggcttctataccaattcat

SEQ ID NO: 7405440 - DNA, 22 bp, Homo sapiens
cagggcttcttggcatttgctg

SEQ ID NO: 7405441 - DNA, 22 bp, Homo sapiens
cagggcttcttggcatttgctg

SEQ ID NO: 7405442 - DNA, 22 bp, Homo sapiens
cagggcttcgtgtctcagtgct

SEQ ID NO: 7405443 - DNA, 22 bp, Homo sapiens
cagggcttcgctcctggtgcac

SEQ ID NO: 7405444 - DNA, 22 bp, Homo sapiens
cagggcttcgctcctggtgcac

SEQ ID NO: 7405445 - DNA, 22 bp, Homo sapiens
cagggctgttagctgctgctct

SEQ ID NO: 7405446 - DNA, 22 bp, Homo sapiens
cagggctgttagctgctgctct

SEQ ID NO: 7405447 - DNA, 22 bp, Homo sapiens
cagggcttactggaggctgctt

SEQ ID NO: 7405448 - DNA, 22 bp, Homo sapiens
cagggcttactggaggctgctt

SEQ ID NO: 7405449 - DNA, 22 bp, Homo sapiens
cagggcttactggaggctgctt

SEQ ID NO: 7405450 - DNA, 22 bp, Homo sapiens
cagggcttcactaggaaccctc

SEQ ID NO: 7405451 - DNA, 22 bp, Homo sapiens
cagggcttcgatggatggatgg

SEQ ID NO: 7405452 - DNA, 22 bp, Homo sapiens
cagggcttcgatggatggatgg

SEQ ID NO: 7405453 - DNA, 22 bp, Homo sapiens
cagggcttcgctcctggtgcac

SEQ ID NO: 7405454 - DNA, 22 bp, Homo sapiens
cagggcttcgctcctggtgcac

SEQ ID NO: 7405455 - DNA, 22 bp, Homo sapiens
caggtgggccatgaaaaatgac

SEQ ID NO: 7405456 - DNA, 22 bp, Homo sapiens
caggtgggattttgctgcttga

SEQ ID NO: 7405457 - DNA, 22 bp, Homo sapiens
cagggcttgaatcaaggaagtc

SEQ ID NO: 7405458 - DNA, 22 bp, Homo sapiens
caggtgggattttgctgcttga

SEQ ID NO: 7405459 - DNA, 22 bp, Homo sapiens
caggtgggattttgctgcttga

SEQ ID NO: 7405460 - DNA, 22 bp, Homo sapiens
caggtggttatgaggaaggtga

SEQ ID NO: 7405461 - DNA, 22 bp, Homo sapiens
caggtggttatgaggaaggtga

SEQ ID NO: 7405462 - DNA, 22 bp, Homo sapiens
caggtgggattttgctgcttga

SEQ ID NO: 7405463 - DNA, 22 bp, Homo sapiens
caggtggttatgaggaaggtga

SEQ ID NO: 7405464 - DNA, 22 bp, Homo sapiens
caggtggttatgaggaaggtga

SEQ ID NO: 7405465 - DNA, 22 bp, Homo sapiens
caggtggtgcctccaggctggt

SEQ ID NO: 7405466 - DNA, 22 bp, Homo sapiens
caggtggtgcctccaggctggt

SEQ ID NO: 7405467 - DNA, 22 bp, Homo sapiens
caggtggtgcctcctcccttcc

SEQ ID NO: 7405468 - DNA, 22 bp, Homo sapiens
cagggcagtaacgggaacatct

SEQ ID NO: 7405469 - DNA, 22 bp, Homo sapiens
cagggcagtaacgggaacatct

SEQ ID NO: 7405470 - DNA, 22 bp, Homo sapiens
cagggcagtaacgggaacatct

SEQ ID NO: 7405471 - DNA, 22 bp, Homo sapiens
cagggcagtaacgggaacatct

SEQ ID NO: 7405472 - DNA, 22 bp, Homo sapiens
cagggcagtaacgggaacatct

SEQ ID NO: 7405473 - DNA, 22 bp, Homo sapiens
cagggcagtaacgggaacatct

SEQ ID NO: 7405474 - DNA, 22 bp, Homo sapiens
cagggcagtaacgggaacatct

SEQ ID NO: 7405475 - DNA, 22 bp, Homo sapiens
cagggcagtaacgggaacatct

SEQ ID NO: 7405476 - DNA, 22 bp, Homo sapiens
cagggcagggccacaccccctg

SEQ ID NO: 7405477 - DNA, 22 bp, Homo sapiens
cagggcagggccacaccccctg

SEQ ID NO: 7405478 - DNA, 22 bp, Homo sapiens
cagggcagggccacaccccctg

SEQ ID NO: 7405479 - DNA, 22 bp, Homo sapiens
cagggcagggccacaccccctg

SEQ ID NO: 7405480 - DNA, 22 bp, Homo sapiens
cagggcagggccacaccccctg

SEQ ID NO: 7405481 - DNA, 22 bp, Homo sapiens
cagggcagggccacaccccctg

SEQ ID NO: 7405482 - DNA, 22 bp, Homo sapiens
cagggcagggccacaccccctg

SEQ ID NO: 7405483 - DNA, 22 bp, Homo sapiens
cagggcagtaacgggaacatct

SEQ ID NO: 7405484 - DNA, 22 bp, Homo sapiens
cagggcagggccacaccccctg

SEQ ID NO: 7405485 - DNA, 22 bp, Homo sapiens
cagggcagggccacaccccctg

SEQ ID NO: 7405486 - DNA, 22 bp, Homo sapiens
cagggcagggatgttgcggcag

SEQ ID NO: 7405487 - DNA, 22 bp, Homo sapiens
cagggcagggatgttgcggcag

SEQ ID NO: 7405488 - DNA, 22 bp, Homo sapiens
cagggcagggatgttgcggcag

SEQ ID NO: 7405489 - DNA, 22 bp, Homo sapiens
cagggcagggatgttgcggcag

SEQ ID NO: 7405490 - DNA, 22 bp, Homo sapiens
cagggcagggatgttgcggcag

SEQ ID NO: 7405491 - DNA, 22 bp, Homo sapiens
cagggcagggatgttgcggcag

SEQ ID NO: 7405492 - DNA, 22 bp, Homo sapiens
cagggcagggatgttgcggcag

SEQ ID NO: 7405493 - DNA, 22 bp, Homo sapiens
cagggcagggagcttagaatga

SEQ ID NO: 7405494 - DNA, 22 bp, Homo sapiens
cagggcagggatgttgcggcag

SEQ ID NO: 7405495 - DNA, 22 bp, Homo sapiens
cagggcagggagcttagaatga

SEQ ID NO: 7405496 - DNA, 22 bp, Homo sapiens
cagggcagggagcttagaatga

SEQ ID NO: 7405497 - DNA, 22 bp, Homo sapiens
cagggcagggagcttagaatga

SEQ ID NO: 7405498 - DNA, 22 bp, Homo sapiens
cagggcaggatgctgtgattat

SEQ ID NO: 7405499 - DNA, 22 bp, Homo sapiens
cagggcagggagcttagaatga

SEQ ID NO: 7405500 - DNA, 22 bp, Homo sapiens
cagggcagggagcttagaatga

SEQ ID NO: 7405501 - DNA, 22 bp, Homo sapiens
cagggcagggagcttagaatga

SEQ ID NO: 7405502 - DNA, 22 bp, Homo sapiens
cagggcagggagcttagaatga

SEQ ID NO: 7405503 - DNA, 22 bp, Homo sapiens
cagggcaggatgctgtgattat

SEQ ID NO: 7405504 - DNA, 22 bp, Homo sapiens
cagggcaggatgctgtgattat

SEQ ID NO: 7405505 - DNA, 22 bp, Homo sapiens
cagggcaggatgctgtgattat

SEQ ID NO: 7405506 - DNA, 22 bp, Homo sapiens
cagggcaggatgctgtgattat

SEQ ID NO: 7405507 - DNA, 22 bp, Homo sapiens
cagggcaggatgctgtgattat

SEQ ID NO: 7405508 - DNA, 22 bp, Homo sapiens
cagggcaggatgctgtgattat

SEQ ID NO: 7405509 - DNA, 22 bp, Homo sapiens
cagggcaaagagagcacatgct

SEQ ID NO: 7405510 - DNA, 22 bp, Homo sapiens
cagggcaggatgctgtgattat

SEQ ID NO: 7405511 - DNA, 22 bp, Homo sapiens
cagggcaggatgctgtgattat

SEQ ID NO: 7405512 - DNA, 22 bp, Homo sapiens
cagggcaggatgctgtgattat

SEQ ID NO: 7405513 - DNA, 22 bp, Homo sapiens
cagggatgtgatgagctgagcc

SEQ ID NO: 7405514 - DNA, 22 bp, Homo sapiens
cagggatgtgatgagctgagcc

SEQ ID NO: 7405515 - DNA, 22 bp, Homo sapiens
cagggatgtgatgagctgagcc

SEQ ID NO: 7405516 - DNA, 22 bp, Homo sapiens
caggctgacaactgagcatttt

SEQ ID NO: 7405517 - DNA, 22 bp, Homo sapiens
caggctgaagtgcagtggtgtg

SEQ ID NO: 7405518 - DNA, 22 bp, Homo sapiens
caggctgacaactgagcatttt

SEQ ID NO: 7405519 - DNA, 22 bp, Homo sapiens
caggctcttttggtggcaagga

SEQ ID NO: 7405520 - DNA, 22 bp, Homo sapiens
caggctcttttggtggcaagga

SEQ ID NO: 7405521 - DNA, 22 bp, Homo sapiens
caggctcttttggtggcaagga

SEQ ID NO: 7405522 - DNA, 22 bp, Homo sapiens
caggctcttttggtggcaagga

SEQ ID NO: 7405523 - DNA, 22 bp, Homo sapiens
caggctcttttggtggcaagga

SEQ ID NO: 7405524 - DNA, 22 bp, Homo sapiens
caggctcttttggtggcaagga

SEQ ID NO: 7405525 - DNA, 22 bp, Homo sapiens
caggctcttccatcctgctgag

SEQ ID NO: 7405526 - DNA, 22 bp, Homo sapiens
caggctcttccatcctgctgag

SEQ ID NO: 7405527 - DNA, 22 bp, Homo sapiens
caggctcttccatcctgctgag

SEQ ID NO: 7405528 - DNA, 22 bp, Homo sapiens
caggctcttccatcctgctgag

SEQ ID NO: 7405529 - DNA, 22 bp, Homo sapiens
caggctcttccatcctgctgag

SEQ ID NO: 7405530 - DNA, 22 bp, Homo sapiens
caggctgaagtgcagtggtgtg

SEQ ID NO: 7405531 - DNA, 22 bp, Homo sapiens
caggctgaagtgcagtggtgtg

SEQ ID NO: 7405532 - DNA, 22 bp, Homo sapiens
caggctgaagtgcagtggtgtg

SEQ ID NO: 7405533 - DNA, 23 bp, Homo sapiens
agctttgaggactttaaaagata

SEQ ID NO: 7405534 - DNA, 22 bp, Homo sapiens
agctttgaatgagtgcattgca

SEQ ID NO: 7405535 - DNA, 22 bp, Homo sapiens
agctttgaatgagtgcattgca

SEQ ID NO: 7405536 - DNA, 22 bp, Homo sapiens
agctttgcattcaaactgatgt

SEQ ID NO: 7405537 - DNA, 22 bp, Homo sapiens
agctttggatgatctttgatac

SEQ ID NO: 7405538 - DNA, 19 bp, Homo sapiens
agctttggacttgcatttc

SEQ ID NO: 7405539 - DNA, 19 bp, Homo sapiens
agctttggacttgcatttc

SEQ ID NO: 7405540 - DNA, 22 bp, Homo sapiens
agctttcttctagttgtacagt

SEQ ID NO: 7405541 - DNA, 22 bp, Homo sapiens
agctttcttctagttgtacagt

SEQ ID NO: 7405542 - DNA, 22 bp, Homo sapiens
agctttcttctagttgtacagt

SEQ ID NO: 7405543 - DNA, 22 bp, Homo sapiens
agctttcttctagttgtacagt

SEQ ID NO: 7405544 - DNA, 22 bp, Homo sapiens
agctttcttctagttgtacagt

SEQ ID NO: 7405545 - DNA, 22 bp, Homo sapiens
agctttctgtcacctgtgcttg

SEQ ID NO: 7405546 - DNA, 22 bp, Homo sapiens
agctttctgtcacctgtgcttg

SEQ ID NO: 7405547 - DNA, 22 bp, Homo sapiens
cagggcagtaccgccctctggc

SEQ ID NO: 7405548 - DNA, 22 bp, Homo sapiens
cagggcagtaacgggaacatct

SEQ ID NO: 7405549 - DNA, 22 bp, Homo sapiens
cagggcagtaacgggaacatct

SEQ ID NO: 7405550 - DNA, 22 bp, Homo sapiens
cagggcagtaacgggaacatct

SEQ ID NO: 7405551 - DNA, 22 bp, Homo sapiens
cagggcagtaacgggaacatct

SEQ ID NO: 7405552 - DNA, 22 bp, Homo sapiens
agctttgaaaatccaaattaca

SEQ ID NO: 7405553 - DNA, 22 bp, Homo sapiens
agctttgaaattatgtttcaga

SEQ ID NO: 7405554 - DNA, 22 bp, Homo sapiens
agctttcttgattttgcctgta

SEQ ID NO: 7405555 - DNA, 22 bp, Homo sapiens
agctttgaagtatttggtctcc

SEQ ID NO: 7405556 - DNA, 22 bp, Homo sapiens
agctttgaagtatttggtctcc

SEQ ID NO: 7405557 - DNA, 22 bp, Homo sapiens
agctttgaatctggtgtttgca

SEQ ID NO: 7405558 - DNA, 20 bp, Homo sapiens
cagggctctgggcctggcct

SEQ ID NO: 7405559 - DNA, 22 bp, Homo sapiens
cagggctctgccttgagggatg

SEQ ID NO: 7405560 - DNA, 22 bp, Homo sapiens
cagggctctgccttgagggatg

SEQ ID NO: 7405561 - DNA, 22 bp, Homo sapiens
agctttgggcaaaggcttgtga

SEQ ID NO: 7405562 - DNA, 22 bp, Homo sapiens
agctttgggcaaaggcttgtga

SEQ ID NO: 7405563 - DNA, 22 bp, Homo sapiens
agctttgggcagaagaggattc

SEQ ID NO: 7405564 - DNA, 22 bp, Homo sapiens
agctttgggcagaagaggattc

SEQ ID NO: 7405565 - DNA, 22 bp, Homo sapiens
cagggctctgccttgagggatg

SEQ ID NO: 7405566 - DNA, 22 bp, Homo sapiens
agctttggatttcttatagccc

SEQ ID NO: 7405567 - DNA, 22 bp, Homo sapiens
agctttggatttcttatagccc

SEQ ID NO: 7405568 - DNA, 22 bp, Homo sapiens
agctttggatgatctttgatac

SEQ ID NO: 7405569 - DNA, 22 bp, Homo sapiens
agctttggatttcttatagccc

SEQ ID NO: 7405570 - DNA, 22 bp, Homo sapiens
agctttggccctggaggttact

SEQ ID NO: 7405571 - DNA, 22 bp, Homo sapiens
agctttggccctggaggttact

SEQ ID NO: 7405572 - DNA, 22 bp, Homo sapiens
agctttggccctggaggttact

SEQ ID NO: 7405573 - DNA, 22 bp, Homo sapiens
agctttggctgtgttgctctgt

SEQ ID NO: 7405574 - DNA, 22 bp, Homo sapiens
agctttgggattcaggcaggaa

SEQ ID NO: 7405575 - DNA, 22 bp, Homo sapiens
agctttgggattcaggcaggaa

SEQ ID NO: 7405576 - DNA, 22 bp, Homo sapiens
agctttgggattcaggcaggaa

SEQ ID NO: 7405577 - DNA, 22 bp, Homo sapiens
agctttggctgtgttgctctgt

SEQ ID NO: 7405578 - DNA, 22 bp, Homo sapiens
agctttggcttctgttgaacct

SEQ ID NO: 7405579 - DNA, 22 bp, Homo sapiens
agctttggcttctgttgaacct

SEQ ID NO: 7405580 - DNA, 22 bp, Homo sapiens
cagggctggctcatgaaaagtt

SEQ ID NO: 7405581 - DNA, 20 bp, Homo sapiens
cagggctctgggcctggcct

SEQ ID NO: 7405582 - DNA, 20 bp, Homo sapiens
cagggctctgggcctggcct

SEQ ID NO: 7405583 - DNA, 20 bp, Homo sapiens
cagggctctgggcctggcct

SEQ ID NO: 7405584 - DNA, 20 bp, Homo sapiens
cagggctctgggcctggcct

SEQ ID NO: 7405585 - DNA, 22 bp, Homo sapiens
cagggctggatttcatttctag

SEQ ID NO: 7405586 - DNA, 22 bp, Homo sapiens
cagggctggctcatgaaaagtt

SEQ ID NO: 7405587 - DNA, 22 bp, Homo sapiens
cagggctggctcatgaaaagtt

SEQ ID NO: 7405588 - DNA, 22 bp, Homo sapiens
cagggctggctcatgaaaagtt

SEQ ID NO: 7405589 - DNA, 22 bp, Homo sapiens
cagggctggctgtggcaatctc

SEQ ID NO: 7405590 - DNA, 22 bp, Homo sapiens
cagggctggctgtggcaatctc

SEQ ID NO: 7405591 - DNA, 22 bp, Homo sapiens
cagggctggctgtggcaatctc

SEQ ID NO: 7405592 - DNA, 22 bp, Homo sapiens
cagggctggctgtggcaatctc

SEQ ID NO: 7405593 - DNA, 22 bp, Homo sapiens
cagggctggctgtggcaatctc

SEQ ID NO: 7405594 - DNA, 22 bp, Homo sapiens
cagggctggctgtggcaatctc

SEQ ID NO: 7405595 - DNA, 22 bp, Homo sapiens
aggaagagctggaccagaggac

SEQ ID NO: 7405596 - DNA, 22 bp, Homo sapiens
aggaagagctggaccagaggac

SEQ ID NO: 7405597 - DNA, 22 bp, Homo sapiens
aggaagagctggaccagaggac

SEQ ID NO: 7405598 - DNA, 22 bp, Homo sapiens
aggaagagctggaccagaggac

SEQ ID NO: 7405599 - DNA, 22 bp, Homo sapiens
aggaagagctggaccagaggac

SEQ ID NO: 7405600 - DNA, 22 bp, Homo sapiens
aggaagagctggaccagaggac

SEQ ID NO: 7405601 - DNA, 22 bp, Homo sapiens
aggaagagctggaccagaggac

SEQ ID NO: 7405602 - DNA, 22 bp, Homo sapiens
aggaagagctggaccagaggac

SEQ ID NO: 7405603 - DNA, 22 bp, Homo sapiens
aggaagagctggaccagaggac

SEQ ID NO: 7405604 - DNA, 22 bp, Homo sapiens
aggaagagctggaccagaggac

SEQ ID NO: 7405605 - DNA, 22 bp, Homo sapiens
aggaagagcccgggtgacataa

SEQ ID NO: 7405606 - DNA, 22 bp, Homo sapiens
aggaagagctggaccagaggac

SEQ ID NO: 7405607 - DNA, 22 bp, Homo sapiens
aggaagagctggaccagaggac

SEQ ID NO: 7405608 - DNA, 22 bp, Homo sapiens
aggaagagctggaccagaggac

SEQ ID NO: 7405609 - DNA, 22 bp, Homo sapiens
aggaagagctggaccagaggac

SEQ ID NO: 7405610 - DNA, 22 bp, Homo sapiens
aggaagagctggaccagaggac

SEQ ID NO: 7405611 - DNA, 22 bp, Homo sapiens
aggaagagctggaccagaggac

SEQ ID NO: 7405612 - DNA, 22 bp, Homo sapiens
aggaagagctggaccagaggac

SEQ ID NO: 7405613 - DNA, 22 bp, Homo sapiens
aggaagagctggaccagaggac

SEQ ID NO: 7405614 - DNA, 22 bp, Homo sapiens
aggaagagctggaccagaggac

SEQ ID NO: 7405615 - DNA, 22 bp, Homo sapiens
aggaagagctggaccagaggac

SEQ ID NO: 7405616 - DNA, 22 bp, Homo sapiens
aggaagagcccgggtgacataa

SEQ ID NO: 7405617 - DNA, 22 bp, Homo sapiens
aggaagagcccgggtgacataa

SEQ ID NO: 7405618 - DNA, 22 bp, Homo sapiens
aggaagagcccgggtgacataa

SEQ ID NO: 7405619 - DNA, 22 bp, Homo sapiens
aggaagagcccgggtgacataa

SEQ ID NO: 7405620 - DNA, 22 bp, Homo sapiens
aggaagagcattcacatggtag

SEQ ID NO: 7405621 - DNA, 22 bp, Homo sapiens
aggaagagcattcacatggtag

SEQ ID NO: 7405622 - DNA, 22 bp, Homo sapiens
aggaagagcccgggtgacataa

SEQ ID NO: 7405623 - DNA, 22 bp, Homo sapiens
aggaagaaacctactagagttt

SEQ ID NO: 7405624 - DNA, 22 bp, Homo sapiens
aggaagagcccgggtgacataa

SEQ ID NO: 7405625 - DNA, 22 bp, Homo sapiens
aggaagagcccgggtgacataa

SEQ ID NO: 7405626 - DNA, 22 bp, Homo sapiens
aggaagagcccgggtgacataa

SEQ ID NO: 7405627 - DNA, 22 bp, Homo sapiens
aggaagagcccgggtgacataa

SEQ ID NO: 7405628 - DNA, 22 bp, Homo sapiens
aggaagagcccgggtgacataa

SEQ ID NO: 7405629 - DNA, 22 bp, Homo sapiens
aggaagagcccgggtgacataa

SEQ ID NO: 7405630 - DNA, 22 bp, Homo sapiens
aggaagagggtggcagataatc

SEQ ID NO: 7405631 - DNA, 18 bp, Homo sapiens
cagggctgtggggtcact

SEQ ID NO: 7405632 - DNA, 18 bp, Homo sapiens
cagggctgtggggtcact

SEQ ID NO: 7405633 - DNA, 18 bp, Homo sapiens
cagggctgtggggtcact

SEQ ID NO: 7405634 - DNA, 18 bp, Homo sapiens
cagggctgtggggtcact

SEQ ID NO: 7405635 - DNA, 18 bp, Homo sapiens
cagggctgtggggtcact

SEQ ID NO: 7405636 - DNA, 22 bp, Homo sapiens
aggaagagggtggcagataatc

SEQ ID NO: 7405637 - DNA, 22 bp, Homo sapiens
aggaagagggtggcagataatc

SEQ ID NO: 7405638 - DNA, 22 bp, Homo sapiens
aggaagagggtggcagataatc

SEQ ID NO: 7405639 - DNA, 23 bp, Homo sapiens
aggaagaggcaatttctcttaga

SEQ ID NO: 7405640 - DNA, 23 bp, Homo sapiens
aggaagaggcaatttctcttaga

SEQ ID NO: 7405641 - DNA, 23 bp, Homo sapiens
aggaagaggcaatttctcttaga

SEQ ID NO: 7405642 - DNA, 22 bp, Homo sapiens
aggaagagctggaccagaggac

SEQ ID NO: 7405643 - DNA, 22 bp, Homo sapiens
aggaagagctggaccagaggac

SEQ ID NO: 7405644 - DNA, 22 bp, Homo sapiens
aggaagagctggaccagaggac

SEQ ID NO: 7405645 - DNA, 23 bp, Homo sapiens
aggaagaggcaatttctcttaga

SEQ ID NO: 7405646 - DNA, 23 bp, Homo sapiens
aggaagaggcaatttctcttaga

SEQ ID NO: 7405647 - DNA, 23 bp, Homo sapiens
aggaagaggcaatttctcttaga

SEQ ID NO: 7405648 - DNA, 23 bp, Homo sapiens
aggaagaggcaatttctcttaga

SEQ ID NO: 7405649 - DNA, 22 bp, Homo sapiens
aggaagagctggaccagaggac

SEQ ID NO: 7405650 - DNA, 22 bp, Homo sapiens
aggaagagctggaccagaggac

SEQ ID NO: 7405651 - DNA, 18 bp, Homo sapiens
cagggctgtggggtcact

SEQ ID NO: 7405652 - DNA, 18 bp, Homo sapiens
cagggctgtggggtcact

SEQ ID NO: 7405653 - DNA, 18 bp, Homo sapiens
cagggctgtggggtcact

SEQ ID NO: 7405654 - DNA, 18 bp, Homo sapiens
cagggctgtggggtcact

SEQ ID NO: 7405655 - DNA, 18 bp, Homo sapiens
cagggctgtggggtcact

SEQ ID NO: 7405656 - DNA, 18 bp, Homo sapiens
cagggctgtggggtcact

SEQ ID NO: 7405657 - DNA, 22 bp, Homo sapiens
cagggctgttagctgctgctct

SEQ ID NO: 7405658 - DNA, 22 bp, Homo sapiens
cagggctgttagctgctgctct

SEQ ID NO: 7405659 - DNA, 22 bp, Homo sapiens
cagggctgttagctgctgctct

SEQ ID NO: 7405660 - DNA, 22 bp, Homo sapiens
cagggctgttagctgctgctct

SEQ ID NO: 7405661 - DNA, 22 bp, Homo sapiens
cagggctgttagctgctgctct

SEQ ID NO: 7405662 - DNA, 22 bp, Homo sapiens
cagggctgttagctgctgctct

SEQ ID NO: 7405663 - DNA, 22 bp, Homo sapiens
cagggctgttagctgctgctct

SEQ ID NO: 7405664 - DNA, 22 bp, Homo sapiens
cagggctgttagctgctgctct

SEQ ID NO: 7405665 - DNA, 22 bp, Homo sapiens
cagggctgttagctgctgctct

SEQ ID NO: 7405666 - DNA, 22 bp, Homo sapiens
aggaaaggattggcttctctgt

SEQ ID NO: 7405667 - DNA, 21 bp, Homo sapiens
aggaaaggccagcacgtaggg

SEQ ID NO: 7405668 - DNA, 22 bp, Homo sapiens
aggaaaggattggcttctctgt

SEQ ID NO: 7405669 - DNA, 21 bp, Homo sapiens
aggaaaggccagcacgtaggg

SEQ ID NO: 7405670 - DNA, 22 bp, Homo sapiens
aggaaaggattggcttctctgt

SEQ ID NO: 7405671 - DNA, 21 bp, Homo sapiens
aggaaaggccagcacgtaggg

SEQ ID NO: 7405672 - DNA, 21 bp, Homo sapiens
aggaaaggccagcacgtaggg

SEQ ID NO: 7405673 - DNA, 21 bp, Homo sapiens
aggaaaggccagcacgtaggg

SEQ ID NO: 7405674 - DNA, 21 bp, Homo sapiens
aggaaaggccagcacgtaggg

SEQ ID NO: 7405675 - DNA, 22 bp, Homo sapiens
aggaaaggcctcagcagaaacc

SEQ ID NO: 7405676 - DNA, 22 bp, Homo sapiens
aggaaaggcctcagcagaaacc

SEQ ID NO: 7405677 - DNA, 22 bp, Homo sapiens
aggaaaggcctcagcagaaacc

SEQ ID NO: 7405678 - DNA, 22 bp, Homo sapiens
aggaaaggcctcagcagaaacc

SEQ ID NO: 7405679 - DNA, 22 bp, Homo sapiens
aggaaaggcctcagcagaaacc

SEQ ID NO: 7405680 - DNA, 21 bp, Homo sapiens
aggaaaggccagcacgtaggg

SEQ ID NO: 7405681 - DNA, 22 bp, Homo sapiens
aggaaaggcctcagcagaaacc

SEQ ID NO: 7405682 - DNA, 21 bp, Homo sapiens
aggaaaggccagcacgtaggg

SEQ ID NO: 7405683 - DNA, 22 bp, Homo sapiens
aggaaaggcctcagcagaaacc

SEQ ID NO: 7405684 - DNA, 22 bp, Homo sapiens
aggaagaaaactaattagatgg

SEQ ID NO: 7405685 - DNA, 22 bp, Homo sapiens
aggaaaggcctttgcatttggt

SEQ ID NO: 7405686 - DNA, 22 bp, Homo sapiens
aggaagaaaactaattagatgg

SEQ ID NO: 7405687 - DNA, 22 bp, Homo sapiens
aggaagaaaactaattagatgg

SEQ ID NO: 7405688 - DNA, 22 bp, Homo sapiens
aggaagaaacctactagagttt

SEQ ID NO: 7405689 - DNA, 22 bp, Homo sapiens
aggaagaaacctactagagttt

SEQ ID NO: 7405690 - DNA, 22 bp, Homo sapiens
aggaagaaacctactagagttt

SEQ ID NO: 7405691 - DNA, 22 bp, Homo sapiens
aggaagaaacctactagagttt

SEQ ID NO: 7405692 - DNA, 22 bp, Homo sapiens
aggaagaaaactaattagatgg

SEQ ID NO: 7405693 - DNA, 22 bp, Homo sapiens
aggaagagcattcacatggtag

SEQ ID NO: 7405694 - DNA, 22 bp, Homo sapiens
aggaagaaacctactagagttt

SEQ ID NO: 7405695 - DNA, 22 bp, Homo sapiens
aggaaaggcctcagcagaaacc

SEQ ID NO: 7405696 - DNA, 22 bp, Homo sapiens
aggaaaggcctcagcagaaacc

SEQ ID NO: 7405697 - DNA, 22 bp, Homo sapiens
aggaaaggcctttgcatttggt

SEQ ID NO: 7405698 - DNA, 22 bp, Homo sapiens
aggaaaggcctttgcatttggt

SEQ ID NO: 7405699 - DNA, 22 bp, Homo sapiens
aggaaaggcctcagcagaaacc

SEQ ID NO: 7405700 - DNA, 22 bp, Homo sapiens
aggaaaggcctttgcatttggt

SEQ ID NO: 7405701 - DNA, 22 bp, Homo sapiens
aggaaaggcctttgcatttggt

SEQ ID NO: 7405702 - DNA, 22 bp, Homo sapiens
aggaaaggattggcttctctgt

SEQ ID NO: 7405703 - DNA, 22 bp, Homo sapiens
aggaaaggattggcttctctgt

SEQ ID NO: 7405704 - DNA, 22 bp, Homo sapiens
aggaaaggattggcttctctgt

SEQ ID NO: 7405705 - DNA, 22 bp, Homo sapiens
aggaaaggattggcttctctgt

SEQ ID NO: 7405706 - DNA, 19 bp, Homo sapiens
aggaaaggatcaaaatagc

SEQ ID NO: 7405707 - DNA, 22 bp, Homo sapiens
aggaaaggattggcttctctgt

SEQ ID NO: 7405708 - DNA, 19 bp, Homo sapiens
aggaaaggatcaaaatagc

SEQ ID NO: 7405709 - DNA, 21 bp, Homo sapiens
aggaaaggaagtccccagggt

SEQ ID NO: 7405710 - DNA, 21 bp, Homo sapiens
aggaaaggaagtccccagggt

SEQ ID NO: 7405711 - DNA, 19 bp, Homo sapiens
aggaaaggatcaaaatagc

SEQ ID NO: 7405712 - DNA, 22 bp, Homo sapiens
cagggctgggttaaaagcaggg

SEQ ID NO: 7405713 - DNA, 22 bp, Homo sapiens
cagggctgggttaaaagcaggg

SEQ ID NO: 7405714 - DNA, 22 bp, Homo sapiens
cagggctgggttaaaagcaggg

SEQ ID NO: 7405715 - DNA, 22 bp, Homo sapiens
cagggctgggttaaaagcaggg

SEQ ID NO: 7405716 - DNA, 22 bp, Homo sapiens
cagggctgggttaaaagcaggg

SEQ ID NO: 7405717 - DNA, 22 bp, Homo sapiens
cagggctggcttccaagttgtt

SEQ ID NO: 7405718 - DNA, 23 bp, Homo sapiens
cagggctgggcttggtgttaggc

SEQ ID NO: 7405719 - DNA, 23 bp, Homo sapiens
cagggctgggcttggtgttaggc

SEQ ID NO: 7405720 - DNA, 23 bp, Homo sapiens
cagggctgggcttggtgttaggc

SEQ ID NO: 7405721 - DNA, 22 bp, Homo sapiens
cagggctgggttaaaagcaggg

SEQ ID NO: 7405722 - DNA, 23 bp, Homo sapiens
cagggctgggcttggtgttaggc

SEQ ID NO: 7405723 - DNA, 23 bp, Homo sapiens
cagggctgggcttggtgttaggc

SEQ ID NO: 7405724 - DNA, 22 bp, Homo sapiens
cagggctggcttccaagttgtt

SEQ ID NO: 7405725 - DNA, 22 bp, Homo sapiens
cagggctggctgtggcaatctc

SEQ ID NO: 7405726 - DNA, 22 bp, Homo sapiens
cagggctggcttccaagttgtt

SEQ ID NO: 7405727 - DNA, 22 bp, Homo sapiens
cagggctggcttccaagttgtt

SEQ ID NO: 7405728 - DNA, 22 bp, Homo sapiens
cagggctggcttccaagttgtt

SEQ ID NO: 7405729 - DNA, 22 bp, Homo sapiens
cagggctggcttccaagttgtt

SEQ ID NO: 7405730 - DNA, 22 bp, Homo sapiens
caggcaggtcagtgaagaagga

SEQ ID NO: 7405731 - DNA, 22 bp, Homo sapiens
caggcaggtcagtgaagaagga

SEQ ID NO: 7405732 - DNA, 22 bp, Homo sapiens
caggcaggtgcagattcctctt

SEQ ID NO: 7405733 - DNA, 22 bp, Homo sapiens
caggcaggtgcagattcctctt

SEQ ID NO: 7405734 - DNA, 22 bp, Homo sapiens
caggcaggtgcagattcctctt

SEQ ID NO: 7405735 - DNA, 22 bp, Homo sapiens
caggcaggtgcagattcctctt

SEQ ID NO: 7405736 - DNA, 22 bp, Homo sapiens
caggcaggtgcagattcctctt

SEQ ID NO: 7405737 - DNA, 22 bp, Homo sapiens
caggcaggtgcagattcctctt

SEQ ID NO: 7405738 - DNA, 22 bp, Homo sapiens
caggcaggtgcagattcctctt

SEQ ID NO: 7405739 - DNA, 22 bp, Homo sapiens
caggcagtggctcacagcaacc

SEQ ID NO: 7405740 - DNA, 22 bp, Homo sapiens
caggcagtggctcacagcaacc

SEQ ID NO: 7405741 - DNA, 22 bp, Homo sapiens
caggcaggtgcagattcctctt

SEQ ID NO: 7405742 - DNA, 22 bp, Homo sapiens
caggcagtggccatgttgggag

SEQ ID NO: 7405743 - DNA, 22 bp, Homo sapiens
caggcagtggctcacagcaacc

SEQ ID NO: 7405744 - DNA, 22 bp, Homo sapiens
caggcagtggctcacagcaacc

SEQ ID NO: 7405745 - DNA, 22 bp, Homo sapiens
caggcaggtgcagattcctctt

SEQ ID NO: 7405746 - DNA, 22 bp, Homo sapiens
caggcagtgtcccaggaagcca

SEQ ID NO: 7405747 - DNA, 22 bp, Homo sapiens
caggcagtgtcccaggaagcca

SEQ ID NO: 7405748 - DNA, 22 bp, Homo sapiens
caggcagtgtcccaggaagcca

SEQ ID NO: 7405749 - DNA, 22 bp, Homo sapiens
caggcagtgtcccaggaagcca

SEQ ID NO: 7405750 - DNA, 22 bp, Homo sapiens
caggcagtgtcccaggaagcca

SEQ ID NO: 7405751 - DNA, 22 bp, Homo sapiens
caggcagtgtcccaggaagcca

SEQ ID NO: 7405752 - DNA, 22 bp, Homo sapiens
caggcagtgtgacgctagggtt

SEQ ID NO: 7405753 - DNA, 22 bp, Homo sapiens
caggcagtgtgacgctagggtt

SEQ ID NO: 7405754 - DNA, 20 bp, Homo sapiens
caggcagtttgtggttaggg

SEQ ID NO: 7405755 - DNA, 22 bp, Homo sapiens
caggcagtgtcccaggaagcca

SEQ ID NO: 7405756 - DNA, 22 bp, Homo sapiens
caggcagtgtgacgctagggtt

SEQ ID NO: 7405757 - DNA, 22 bp, Homo sapiens
agctggtggaagggagcccaaa

SEQ ID NO: 7405758 - DNA, 20 bp, Homo sapiens
caggcagtttgtggttaggg

SEQ ID NO: 7405759 - DNA, 22 bp, Homo sapiens
agctggtggaagggagcccaaa

SEQ ID NO: 7405760 - DNA, 22 bp, Homo sapiens
agctggtggaagggagcccaaa

SEQ ID NO: 7405761 - DNA, 22 bp, Homo sapiens
agctggtggagaagcagacctc

SEQ ID NO: 7405762 - DNA, 22 bp, Homo sapiens
agctggttcatggactgcctgg

SEQ ID NO: 7405763 - DNA, 22 bp, Homo sapiens
agctgtcctgtgggagggagtg

SEQ ID NO: 7405764 - DNA, 22 bp, Homo sapiens
agctgtctacagcaataaagga

SEQ ID NO: 7405765 - DNA, 22 bp, Homo sapiens
agctgtcctgtgggagggagtg

SEQ ID NO: 7405766 - DNA, 22 bp, Homo sapiens
agctgtcctggctcaggctgtg

SEQ ID NO: 7405767 - DNA, 22 bp, Homo sapiens
agctgtcaggcagaactgagct

SEQ ID NO: 7405768 - DNA, 22 bp, Homo sapiens
agctgtcagtgctgtgcctgta

SEQ ID NO: 7405769 - DNA, 22 bp, Homo sapiens
agctgtcctggctcaggctgtg

SEQ ID NO: 7405770 - DNA, 22 bp, Homo sapiens
agctgtcaggcagaactgagct

SEQ ID NO: 7405771 - DNA, 22 bp, Homo sapiens
agctgtctctggtattatgtga

SEQ ID NO: 7405772 - DNA, 19 bp, Homo sapiens
agctgtctgctgcttttgt

SEQ ID NO: 7405773 - DNA, 22 bp, Homo sapiens
agctgtctctctggtgtccata

SEQ ID NO: 7405774 - DNA, 22 bp, Homo sapiens
agctgtctacctgcagagtcct

SEQ ID NO: 7405775 - DNA, 22 bp, Homo sapiens
agctgtctacctgcagagtcct

SEQ ID NO: 7405776 - DNA, 22 bp, Homo sapiens
agctgtctacctgcagagtcct

SEQ ID NO: 7405777 - DNA, 22 bp, Homo sapiens
agctgtatgcccaagatgctat

SEQ ID NO: 7405778 - DNA, 22 bp, Homo sapiens
agctgtaatataagcaatgaaa

SEQ ID NO: 7405779 - DNA, 22 bp, Homo sapiens
agctggtttggggtagaggaca

SEQ ID NO: 7405780 - DNA, 22 bp, Homo sapiens
agctggtttggggtagaggaca

SEQ ID NO: 7405781 - DNA, 22 bp, Homo sapiens
agctgtatttgtgaatatttaa

SEQ ID NO: 7405782 - DNA, 22 bp, Homo sapiens
agctgtatgcccaagatgctat

SEQ ID NO: 7405783 - DNA, 22 bp, Homo sapiens
agctgtcaccaggagccggacc

SEQ ID NO: 7405784 - DNA, 22 bp, Homo sapiens
agctgtcaggcagaactgagct

SEQ ID NO: 7405785 - DNA, 22 bp, Homo sapiens
agctgtcaggcagaactgagct

SEQ ID NO: 7405786 - DNA, 22 bp, Homo sapiens
agctgtcaggcagaactgagct

SEQ ID NO: 7405787 - DNA, 22 bp, Homo sapiens
agctggtttaggatggtctcca

SEQ ID NO: 7405788 - DNA, 22 bp, Homo sapiens
agctggtttaggatggtctcca

SEQ ID NO: 7405789 - DNA, 22 bp, Homo sapiens
agctggtttaggaaaaggtagg

SEQ ID NO: 7405790 - DNA, 22 bp, Homo sapiens
agctggtttatttctcacaaca

SEQ ID NO: 7405791 - DNA, 22 bp, Homo sapiens
agctggtttatttctcacaaca

SEQ ID NO: 7405792 - DNA, 22 bp, Homo sapiens
agctggtttgcaagtataatca

SEQ ID NO: 7405793 - DNA, 22 bp, Homo sapiens
agctggttcccactgggcctgt

SEQ ID NO: 7405794 - DNA, 22 bp, Homo sapiens
agctggttcccactgggcctgt

SEQ ID NO: 7405795 - DNA, 22 bp, Homo sapiens
agctggttcattcattcatggt

SEQ ID NO: 7405796 - DNA, 22 bp, Homo sapiens
agctggttcattcattcatggt

SEQ ID NO: 7405797 - DNA, 22 bp, Homo sapiens
agctggttgacttcaggcaagt

SEQ ID NO: 7405798 - DNA, 22 bp, Homo sapiens
agctggttgcttaacctctctg

SEQ ID NO: 7405799 - DNA, 22 bp, Homo sapiens
caggcagctcaaccttgggagc

SEQ ID NO: 7405800 - DNA, 22 bp, Homo sapiens
caggcagctcaaccttgggagc

SEQ ID NO: 7405801 - DNA, 22 bp, Homo sapiens
caggcagctcgatgccttgttg

SEQ ID NO: 7405802 - DNA, 22 bp, Homo sapiens
caggcagctcgatgccttgttg

SEQ ID NO: 7405803 - DNA, 22 bp, Homo sapiens
caggcagctcgatgccttgttg

SEQ ID NO: 7405804 - DNA, 22 bp, Homo sapiens
caggcagctcaaccttgggagc

SEQ ID NO: 7405805 - DNA, 22 bp, Homo sapiens
caggcagctcaaccttgggagc

SEQ ID NO: 7405806 - DNA, 22 bp, Homo sapiens
caggcagctagatttataacaa

SEQ ID NO: 7405807 - DNA, 22 bp, Homo sapiens
caggcagggagctggaaaggat

SEQ ID NO: 7405808 - DNA, 22 bp, Homo sapiens
caggcagggagctggaaaggat

SEQ ID NO: 7405809 - DNA, 22 bp, Homo sapiens
caggcaggtcagtgaagaagga

SEQ ID NO: 7405810 - DNA, 22 bp, Homo sapiens
caggcaggtcagtgaagaagga

SEQ ID NO: 7405811 - DNA, 22 bp, Homo sapiens
caggcaggtcagtgaagaagga

SEQ ID NO: 7405812 - DNA, 22 bp, Homo sapiens
caggcaggtcagtgaagaagga

SEQ ID NO: 7405813 - DNA, 22 bp, Homo sapiens
caggcaggtcagtgaagaagga

SEQ ID NO: 7405814 - DNA, 22 bp, Homo sapiens
caggcaggtcagtgaagaagga

SEQ ID NO: 7405815 - DNA, 22 bp, Homo sapiens
caggcaggtcagtgaagaagga

SEQ ID NO: 7405816 - DNA, 22 bp, Homo sapiens
caggcaggtcagtgaagaagga

SEQ ID NO: 7405817 - DNA, 22 bp, Homo sapiens
caggcaggtcagtgaagaagga

SEQ ID NO: 7405818 - DNA, 22 bp, Homo sapiens
caggcaggtcagtgaagaagga

SEQ ID NO: 7405819 - DNA, 22 bp, Homo sapiens
caggcagggagctggaaaggat

SEQ ID NO: 7405820 - DNA, 22 bp, Homo sapiens
caggcagggagctggaaaggat

SEQ ID NO: 7405821 - DNA, 22 bp, Homo sapiens
caggcagggagctggaaaggat

SEQ ID NO: 7405822 - DNA, 22 bp, Homo sapiens
caggcagggagctggaaaggat

SEQ ID NO: 7405823 - DNA, 22 bp, Homo sapiens
caggcaggtcagtgaagaagga

SEQ ID NO: 7405824 - DNA, 22 bp, Homo sapiens
caggcagggagctggaaaggat

SEQ ID NO: 7405825 - DNA, 22 bp, Homo sapiens
caggcaggtcagtgaagaagga

SEQ ID NO: 7405826 - DNA, 22 bp, Homo sapiens
caggcagccttctcgtctcaca

SEQ ID NO: 7405827 - DNA, 22 bp, Homo sapiens
caggcagcgctcgtggcctggc

SEQ ID NO: 7405828 - DNA, 22 bp, Homo sapiens
caggcagcgctcgtggcctggc

SEQ ID NO: 7405829 - DNA, 22 bp, Homo sapiens
caggcagcgctcgtggcctggc

SEQ ID NO: 7405830 - DNA, 22 bp, Homo sapiens
caggcagcgctcgtggcctggc

SEQ ID NO: 7405831 - DNA, 22 bp, Homo sapiens
caggcagcctgcggtctgcaca

SEQ ID NO: 7405832 - DNA, 22 bp, Homo sapiens
caggcagccttctcgtctcaca

SEQ ID NO: 7405833 - DNA, 22 bp, Homo sapiens
caggcagccttctcgtctcaca

SEQ ID NO: 7405834 - DNA, 22 bp, Homo sapiens
caggcagcctgcggtctgcaca

SEQ ID NO: 7405835 - DNA, 22 bp, Homo sapiens
caggcagcctgcggtctgcaca

SEQ ID NO: 7405836 - DNA, 22 bp, Homo sapiens
caggcagcctgcggtctgcaca

SEQ ID NO: 7405837 - DNA, 22 bp, Homo sapiens
caggcagcctgcggtctgcaca

SEQ ID NO: 7405838 - DNA, 22 bp, Homo sapiens
caggcagcctgcggtctgcaca

SEQ ID NO: 7405839 - DNA, 22 bp, Homo sapiens
caggcagcctgcggtctgcaca

SEQ ID NO: 7405840 - DNA, 22 bp, Homo sapiens
caggcagagtgaggtggtctaa

SEQ ID NO: 7405841 - DNA, 22 bp, Homo sapiens
caggcagcctgcggtctgcaca

SEQ ID NO: 7405842 - DNA, 22 bp, Homo sapiens
caggcagcgtcctgcttcctgt

SEQ ID NO: 7405843 - DNA, 22 bp, Homo sapiens
caggcagcgtcctgcttcctgt

SEQ ID NO: 7405844 - DNA, 22 bp, Homo sapiens
caggcagctagatttataacaa

SEQ ID NO: 7405845 - DNA, 22 bp, Homo sapiens
caggcagctagatttataacaa

SEQ ID NO: 7405846 - DNA, 22 bp, Homo sapiens
caggcagcgtcctgcttcctgt

SEQ ID NO: 7405847 - DNA, 22 bp, Homo sapiens
caggcagcgtcctgcttcctgt

SEQ ID NO: 7405848 - DNA, 22 bp, Homo sapiens
caggcagcgtcctgcttcctgt

SEQ ID NO: 7405849 - DNA, 22 bp, Homo sapiens
caggcagcgtcctgcttcctgt

SEQ ID NO: 7405850 - DNA, 22 bp, Homo sapiens
caggcagcgtcctgcttcctgt

SEQ ID NO: 7405851 - DNA, 22 bp, Homo sapiens
caggcagcgctcgtggcctggc

SEQ ID NO: 7405852 - DNA, 22 bp, Homo sapiens
caggcagcgctcgtggcctggc

SEQ ID NO: 7405853 - DNA, 22 bp, Homo sapiens
caggcagcgtcctgcttcctgt

SEQ ID NO: 7405854 - DNA, 22 bp, Homo sapiens
caggcagcgctcgtggcctggc

SEQ ID NO: 7405855 - DNA, 22 bp, Homo sapiens
caggcagcgctcgtggcctggc

SEQ ID NO: 7405856 - DNA, 22 bp, Homo sapiens
caggcagcgctcgtggcctggc

SEQ ID NO: 7405857 - DNA, 22 bp, Homo sapiens
agcttcctacaaccatctcaga

SEQ ID NO: 7405858 - DNA, 23 bp, Homo sapiens
agcttcctagtgacctggagtct

SEQ ID NO: 7405859 - DNA, 22 bp, Homo sapiens
agcttcctacaaccatctcaga

SEQ ID NO: 7405860 - DNA, 22 bp, Homo sapiens
agcttcctgactggtgctctta

SEQ ID NO: 7405861 - DNA, 22 bp, Homo sapiens
agcttcctgactggtgctctta

SEQ ID NO: 7405862 - DNA, 22 bp, Homo sapiens
agcttcctcacctcagaggtct

SEQ ID NO: 7405863 - DNA, 22 bp, Homo sapiens
agcttccctagcagttctaaac

SEQ ID NO: 7405864 - DNA, 18 bp, Homo sapiens
agcttccctctgagaggg

SEQ ID NO: 7405865 - DNA, 22 bp, Homo sapiens
agcttcctacaaccatctcaga

SEQ ID NO: 7405866 - DNA, 18 bp, Homo sapiens
agcttccctctgagaggg

SEQ ID NO: 7405867 - DNA, 18 bp, Homo sapiens
agcttccctctgagaggg

SEQ ID NO: 7405868 - DNA, 22 bp, Homo sapiens
agcttcccaaggttggaaggtt

SEQ ID NO: 7405869 - DNA, 22 bp, Homo sapiens
agcttcccaaggttggaaggtt

SEQ ID NO: 7405870 - DNA, 22 bp, Homo sapiens
agcttcccacactctagtttcc

SEQ ID NO: 7405871 - DNA, 22 bp, Homo sapiens
agcttcccggcaggcacgtcct

SEQ ID NO: 7405872 - DNA, 22 bp, Homo sapiens
agcttcccggcaggcacgtcct

SEQ ID NO: 7405873 - DNA, 22 bp, Homo sapiens
agcttcccaggagaatcaggga

SEQ ID NO: 7405874 - DNA, 22 bp, Homo sapiens
agcttcctgttgagagagggag

SEQ ID NO: 7405875 - DNA, 22 bp, Homo sapiens
agcttcctgtcttctgcacaaa

SEQ ID NO: 7405876 - DNA, 22 bp, Homo sapiens
agcttccttggcgctgaggcct

SEQ ID NO: 7405877 - DNA, 21 bp, Homo sapiens
agcttcctgcagtgggaggtc

SEQ ID NO: 7405878 - DNA, 22 bp, Homo sapiens
agcttcctgtcttctgcacaaa

SEQ ID NO: 7405879 - DNA, 22 bp, Homo sapiens
agcttcctgtcttctgcacaaa

SEQ ID NO: 7405880 - DNA, 22 bp, Homo sapiens
agcttcctgtcttctgcacaaa

SEQ ID NO: 7405881 - DNA, 22 bp, Homo sapiens
caggctctgctgctacagctgt

SEQ ID NO: 7405882 - DNA, 22 bp, Homo sapiens
caggctctgctgctacagctgt

SEQ ID NO: 7405883 - DNA, 22 bp, Homo sapiens
caggctctgctgctacagctgt

SEQ ID NO: 7405884 - DNA, 22 bp, Homo sapiens
caggctctgctgctacagctgt

SEQ ID NO: 7405885 - DNA, 21 bp, Homo sapiens
caggctctgctagaggagcct

SEQ ID NO: 7405886 - DNA, 22 bp, Homo sapiens
caggctctgctgctacagctgt

SEQ ID NO: 7405887 - DNA, 21 bp, Homo sapiens
caggctctgctgggtgctggg

SEQ ID NO: 7405888 - DNA, 22 bp, Homo sapiens
caggctctgctgctacagctgt

SEQ ID NO: 7405889 - DNA, 22 bp, Homo sapiens
caggctcttccatcctgctgag

SEQ ID NO: 7405890 - DNA, 21 bp, Homo sapiens
caggctctgctgggtgctggg

SEQ ID NO: 7405891 - DNA, 22 bp, Homo sapiens
caggctcttccatcctgctgag

SEQ ID NO: 7405892 - DNA, 22 bp, Homo sapiens
caggctcttccatcctgctgag

SEQ ID NO: 7405893 - DNA, 22 bp, Homo sapiens
caggctcttccatcctgctgag

SEQ ID NO: 7405894 - DNA, 22 bp, Homo sapiens
caggctcttccatcctgctgag

SEQ ID NO: 7405895 - DNA, 22 bp, Homo sapiens
caggctcttccatcctgctgag

SEQ ID NO: 7405896 - DNA, 21 bp, Homo sapiens
caggctctgctgggtgctggg

SEQ ID NO: 7405897 - DNA, 21 bp, Homo sapiens
caggctctgctgggtgctggg

SEQ ID NO: 7405898 - DNA, 21 bp, Homo sapiens
caggctctgctgggtgctggg

SEQ ID NO: 7405899 - DNA, 21 bp, Homo sapiens
caggctctgctgggtgctggg

SEQ ID NO: 7405900 - DNA, 21 bp, Homo sapiens
caggctctgctgggtgctggg

SEQ ID NO: 7405901 - DNA, 22 bp, Homo sapiens
agcttcctgatgcaagagggct

SEQ ID NO: 7405902 - DNA, 22 bp, Homo sapiens
agcttctagcccatccagcagg

SEQ ID NO: 7405903 - DNA, 22 bp, Homo sapiens
agcttctcagaagagtcctgta

SEQ ID NO: 7405904 - DNA, 22 bp, Homo sapiens
agcttctcagaagagtcctgta

SEQ ID NO: 7405905 - DNA, 22 bp, Homo sapiens
agcttctagcccatccagcagg

SEQ ID NO: 7405906 - DNA, 22 bp, Homo sapiens
agcttctcagaagagtcctgta

SEQ ID NO: 7405907 - DNA, 21 bp, Homo sapiens
caggctctgctagaggagcct

SEQ ID NO: 7405908 - DNA, 21 bp, Homo sapiens
caggctctgctagaggagcct

SEQ ID NO: 7405909 - DNA, 21 bp, Homo sapiens
caggctctgctagaggagcct

SEQ ID NO: 7405910 - DNA, 21 bp, Homo sapiens
caggctctgctagaggagcct

SEQ ID NO: 7405911 - DNA, 21 bp, Homo sapiens
caggctctgctagaggagcct

SEQ ID NO: 7405912 - DNA, 21 bp, Homo sapiens
caggctctgctagaggagcct

SEQ ID NO: 7405913 - DNA, 21 bp, Homo sapiens
caggctctgctagaggagcct

SEQ ID NO: 7405914 - DNA, 21 bp, Homo sapiens
caggctctgctagaggagcct

SEQ ID NO: 7405915 - DNA, 22 bp, Homo sapiens
agcttctcagcttcagaactgt

SEQ ID NO: 7405916 - DNA, 22 bp, Homo sapiens
agcttctcaggagtctgaggca

SEQ ID NO: 7405917 - DNA, 22 bp, Homo sapiens
caggcccagtgatcagggctct

SEQ ID NO: 7405918 - DNA, 22 bp, Homo sapiens
caggcccataatgcaaatattt

SEQ ID NO: 7405919 - DNA, 22 bp, Homo sapiens
caggcccataatgcaaatattt

SEQ ID NO: 7405920 - DNA, 22 bp, Homo sapiens
caggcccataatgcaaatattt

SEQ ID NO: 7405921 - DNA, 22 bp, Homo sapiens
caggcccatctgctcccaggct

SEQ ID NO: 7405922 - DNA, 22 bp, Homo sapiens
caggcccataatgcaaatattt

SEQ ID NO: 7405923 - DNA, 22 bp, Homo sapiens
caggcccagtgatcagggctct

SEQ ID NO: 7405924 - DNA, 22 bp, Homo sapiens
caggcccagtgatcagggctct

SEQ ID NO: 7405925 - DNA, 22 bp, Homo sapiens
caggcccagtgatcagggctct

SEQ ID NO: 7405926 - DNA, 22 bp, Homo sapiens
caggcccagtgatcagggctct

SEQ ID NO: 7405927 - DNA, 22 bp, Homo sapiens
caggcccagtgatcagggctct

SEQ ID NO: 7405928 - DNA, 22 bp, Homo sapiens
caggcccagtgatcagggctct

SEQ ID NO: 7405929 - DNA, 22 bp, Homo sapiens
caggcccagtgatcagggctct

SEQ ID NO: 7405930 - DNA, 22 bp, Homo sapiens
caggcccagtgatcagggctct

SEQ ID NO: 7405931 - DNA, 22 bp, Homo sapiens
caggcccagggttattgggaaa

SEQ ID NO: 7405932 - DNA, 22 bp, Homo sapiens
caggcccagggttattgggaaa

SEQ ID NO: 7405933 - DNA, 22 bp, Homo sapiens
caggcccaggggtctggcccac

SEQ ID NO: 7405934 - DNA, 22 bp, Homo sapiens
caggcccagggttattgggaaa

SEQ ID NO: 7405935 - DNA, 22 bp, Homo sapiens
caggcccaggtgtcgatgttcc

SEQ ID NO: 7405936 - DNA, 22 bp, Homo sapiens
caggcccaggtgtcgatgttcc

SEQ ID NO: 7405937 - DNA, 22 bp, Homo sapiens
caggcccaggtgtcgatgttcc

SEQ ID NO: 7405938 - DNA, 22 bp, Homo sapiens
caggcccaggtgtcgatgttcc

SEQ ID NO: 7405939 - DNA, 22 bp, Homo sapiens
agctgtctgtctcctgaggaga

SEQ ID NO: 7405940 - DNA, 22 bp, Homo sapiens
agctgtctggaagttcctcatg

SEQ ID NO: 7405941 - DNA, 22 bp, Homo sapiens
agctgtctggaagttcctcatg

SEQ ID NO: 7405942 - DNA, 22 bp, Homo sapiens
agctgtctgtctcctgaggaga

SEQ ID NO: 7405943 - DNA, 22 bp, Homo sapiens
agctgtctgtgaacacagcatt

SEQ ID NO: 7405944 - DNA, 22 bp, Homo sapiens
agctgtctgtctcctgaggaga

SEQ ID NO: 7405945 - DNA, 22 bp, Homo sapiens
agctgtctttctgcctcctgat

SEQ ID NO: 7405946 - DNA, 22 bp, Homo sapiens
agctgtctttggagagggagag

SEQ ID NO: 7405947 - DNA, 22 bp, Homo sapiens
agctgtctttctgcctcctgat

SEQ ID NO: 7405948 - DNA, 22 bp, Homo sapiens
agctgtctttctgcctcctgat

SEQ ID NO: 7405949 - DNA, 22 bp, Homo sapiens
agctgtctttcattacctcatt

SEQ ID NO: 7405950 - DNA, 22 bp, Homo sapiens
agctgtctttcattacctcatt

SEQ ID NO: 7405951 - DNA, 22 bp, Homo sapiens
agcttactgtaattaaaagact

SEQ ID NO: 7405952 - DNA, 21 bp, Homo sapiens
agcttacattaccattgttgc

SEQ ID NO: 7405953 - DNA, 19 bp, Homo sapiens
agcttacctggcaggaatg

SEQ ID NO: 7405954 - DNA, 22 bp, Homo sapiens
agcttactgggcagtaaagatt

SEQ ID NO: 7405955 - DNA, 22 bp, Homo sapiens
agcttactgccccatggaagga

SEQ ID NO: 7405956 - DNA, 22 bp, Homo sapiens
agcttccattaactgctacact

SEQ ID NO: 7405957 - DNA, 22 bp, Homo sapiens
agcttccattaactgctacact

SEQ ID NO: 7405958 - DNA, 22 bp, Homo sapiens
agcttccattaactgctacact

SEQ ID NO: 7405959 - DNA, 22 bp, Homo sapiens
caggcccatttgtagccacttt

SEQ ID NO: 7405960 - DNA, 22 bp, Homo sapiens
caggcccatttgtagccacttt

SEQ ID NO: 7405961 - DNA, 22 bp, Homo sapiens
caggcccatttgtagccacttt

SEQ ID NO: 7405962 - DNA, 22 bp, Homo sapiens
caggcccatttgtagccacttt

SEQ ID NO: 7405963 - DNA, 22 bp, Homo sapiens
caggcccatttgtagccacttt

SEQ ID NO: 7405964 - DNA, 22 bp, Homo sapiens
caggcccattctaggcttgcta

SEQ ID NO: 7405965 - DNA, 22 bp, Homo sapiens
caggcccattctaggcttgcta

SEQ ID NO: 7405966 - DNA, 22 bp, Homo sapiens
caggcccattctaggcttgcta

SEQ ID NO: 7405967 - DNA, 21 bp, Homo sapiens
agcttacattaccattgttgc

SEQ ID NO: 7405968 - DNA, 21 bp, Homo sapiens
agcttacattaccattgttgc

SEQ ID NO: 7405969 - DNA, 22 bp, Homo sapiens
caggcccatttgtagccacttt

SEQ ID NO: 7405970 - DNA, 22 bp, Homo sapiens
caggcccatttgtagccacttt

SEQ ID NO: 7405971 - DNA, 22 bp, Homo sapiens
caggcccatttgtagccacttt

SEQ ID NO: 7405972 - DNA, 22 bp, Homo sapiens
caggcccatttgtagccacttt

SEQ ID NO: 7405973 - DNA, 22 bp, Homo sapiens
caggcccatgagggcagccaca

SEQ ID NO: 7405974 - DNA, 22 bp, Homo sapiens
caggcccatgagggcagccaca

SEQ ID NO: 7405975 - DNA, 22 bp, Homo sapiens
caggcccatgagggcagccaca

SEQ ID NO: 7405976 - DNA, 22 bp, Homo sapiens
caggcccatgagggcagccaca

SEQ ID NO: 7405977 - DNA, 22 bp, Homo sapiens
caggcccatgagggcagccaca

SEQ ID NO: 7405978 - DNA, 22 bp, Homo sapiens
caggcccatctgctcccaggct

SEQ ID NO: 7405979 - DNA, 22 bp, Homo sapiens
caggcccatctgctcccaggct

SEQ ID NO: 7405980 - DNA, 22 bp, Homo sapiens
caggcccataatgcaaatattt

SEQ ID NO: 7405981 - DNA, 22 bp, Homo sapiens
caggcccatctgctcccaggct

SEQ ID NO: 7405982 - DNA, 22 bp, Homo sapiens
caggcccatctgctcccaggct

SEQ ID NO: 7405983 - DNA, 22 bp, Homo sapiens
caggcccatctgctcccaggct

SEQ ID NO: 7405984 - DNA, 22 bp, Homo sapiens
caggcccatctgctcccaggct

SEQ ID NO: 7405985 - DNA, 22 bp, Homo sapiens
caggcccatctgctcccaggct

SEQ ID NO: 7405986 - DNA, 22 bp, Homo sapiens
caggcccattctaggcttgcta

SEQ ID NO: 7405987 - DNA, 22 bp, Homo sapiens
caggcccattctaggcttgcta

SEQ ID NO: 7405988 - DNA, 22 bp, Homo sapiens
caggcccattctaggcttgcta

SEQ ID NO: 7405989 - DNA, 22 bp, Homo sapiens
caggcccatgagggcagccaca

SEQ ID NO: 7405990 - DNA, 22 bp, Homo sapiens
caggcccattctaggcttgcta

SEQ ID NO: 7405991 - DNA, 22 bp, Homo sapiens
caggcccattctaggcttgcta

SEQ ID NO: 7405992 - DNA, 22 bp, Homo sapiens
caggcccattctaggcttgcta

SEQ ID NO: 7405993 - DNA, 22 bp, Homo sapiens
caggcccatgagggcagccaca

SEQ ID NO: 7405994 - DNA, 22 bp, Homo sapiens
caggcccatgagggcagccaca

SEQ ID NO: 7405995 - DNA, 22 bp, Homo sapiens
caggcccatgagggcagccaca

SEQ ID NO: 7405996 - DNA, 22 bp, Homo sapiens
caggagcagttagaagcccact

SEQ ID NO: 7405997 - DNA, 22 bp, Homo sapiens
caggagcagttagaagcccact

SEQ ID NO: 7405998 - DNA, 22 bp, Homo sapiens
caggagcagttagaagcccact

SEQ ID NO: 7405999 - DNA, 22 bp, Homo sapiens
caggagcaggcccaaggacaca

SEQ ID NO: 7406000 - DNA, 22 bp, Homo sapiens
caggagcaggcccaaggacaca

SEQ ID NO: 7406001 - DNA, 22 bp, Homo sapiens
caggagcatgctgatgccagaa

SEQ ID NO: 7406002 - DNA, 22 bp, Homo sapiens
caggagcatgctgatgccagaa

SEQ ID NO: 7406003 - DNA, 22 bp, Homo sapiens
caggagcatgctgatgccagaa

SEQ ID NO: 7406004 - DNA, 22 bp, Homo sapiens
caggagcatgctgatgccagaa

SEQ ID NO: 7406005 - DNA, 22 bp, Homo sapiens
caggagcatgctgatgccagaa

SEQ ID NO: 7406006 - DNA, 22 bp, Homo sapiens
caggagccagaggcggatggag

SEQ ID NO: 7406007 - DNA, 22 bp, Homo sapiens
caggagccagaggcggatggag

SEQ ID NO: 7406008 - DNA, 22 bp, Homo sapiens
caggagccacattccaccttga

SEQ ID NO: 7406009 - DNA, 22 bp, Homo sapiens
caggagccagaggcggatggag

SEQ ID NO: 7406010 - DNA, 22 bp, Homo sapiens
caggagccagaggcggatggag

SEQ ID NO: 7406011 - DNA, 22 bp, Homo sapiens
caggagccacattccaccttga

SEQ ID NO: 7406012 - DNA, 22 bp, Homo sapiens
caggagccacattccaccttga

SEQ ID NO: 7406013 - DNA, 18 bp, Homo sapiens
caggagcaggagttgaac

SEQ ID NO: 7406014 - DNA, 22 bp, Homo sapiens
caggagcaggcccaaggacaca

SEQ ID NO: 7406015 - DNA, 22 bp, Homo sapiens
caggagcaggcccaaggacaca

SEQ ID NO: 7406016 - DNA, 18 bp, Homo sapiens
caggagcaggagttgaac

SEQ ID NO: 7406017 - DNA, 22 bp, Homo sapiens
caggagcagagggtggtcagca

SEQ ID NO: 7406018 - DNA, 18 bp, Homo sapiens
caggagcaggagttgaac

SEQ ID NO: 7406019 - DNA, 22 bp, Homo sapiens
caggagcagagggtggtcagca

SEQ ID NO: 7406020 - DNA, 22 bp, Homo sapiens
caggagcagagggtggtcagca

SEQ ID NO: 7406021 - DNA, 22 bp, Homo sapiens
caggagcagagggtggtcagca

SEQ ID NO: 7406022 - DNA, 22 bp, Homo sapiens
caggagcagagggtggtcagca

SEQ ID NO: 7406023 - DNA, 22 bp, Homo sapiens
caggagcagagggtggtcagca

SEQ ID NO: 7406024 - DNA, 22 bp, Homo sapiens
caggagcagagggtggtcagca

SEQ ID NO: 7406025 - DNA, 22 bp, Homo sapiens
caggagcagagggtggtcagca

SEQ ID NO: 7406026 - DNA, 22 bp, Homo sapiens
caggagcagagggtggtcagca

SEQ ID NO: 7406027 - DNA, 22 bp, Homo sapiens
caggatggagggagggctgtta

SEQ ID NO: 7406028 - DNA, 22 bp, Homo sapiens
caggatggagagttgttggttg

SEQ ID NO: 7406029 - DNA, 22 bp, Homo sapiens
caggatggagagttgttggttg

SEQ ID NO: 7406030 - DNA, 22 bp, Homo sapiens
caggatggagggagggctgtta

SEQ ID NO: 7406031 - DNA, 22 bp, Homo sapiens
caggatggagggagggctgtta

SEQ ID NO: 7406032 - DNA, 22 bp, Homo sapiens
caggatggagggagggctgtta

SEQ ID NO: 7406033 - DNA, 22 bp, Homo sapiens
caggatggccccggggctgtgc

SEQ ID NO: 7406034 - DNA, 22 bp, Homo sapiens
caggatggcagagaaaagggtg

SEQ ID NO: 7406035 - DNA, 22 bp, Homo sapiens
caggatggagggagggctgtta

SEQ ID NO: 7406036 - DNA, 22 bp, Homo sapiens
caggatggcagagaaaagggtg

SEQ ID NO: 7406037 - DNA, 22 bp, Homo sapiens
caggatggccccggggctgtgc

SEQ ID NO: 7406038 - DNA, 22 bp, Homo sapiens
caggatggccccggggctgtgc

SEQ ID NO: 7406039 - DNA, 22 bp, Homo sapiens
caggatggccccggggctgtgc

SEQ ID NO: 7406040 - DNA, 22 bp, Homo sapiens
caggagccagctgtcccaacca

SEQ ID NO: 7406041 - DNA, 22 bp, Homo sapiens
caggagccagaggcggatggag

SEQ ID NO: 7406042 - DNA, 22 bp, Homo sapiens
caggagccagctgtcccaacca

SEQ ID NO: 7406043 - DNA, 22 bp, Homo sapiens
caggagccagaggcggatggag

SEQ ID NO: 7406044 - DNA, 22 bp, Homo sapiens
caggagcccagagtcctcagct

SEQ ID NO: 7406045 - DNA, 22 bp, Homo sapiens
caggagcccagagtcctcagct

SEQ ID NO: 7406046 - DNA, 22 bp, Homo sapiens
caggagcccagagtcctcagct

SEQ ID NO: 7406047 - DNA, 22 bp, Homo sapiens
caggagcccagagtcctcagct

SEQ ID NO: 7406048 - DNA, 22 bp, Homo sapiens
caggagtgaaatgaggcccagg

SEQ ID NO: 7406049 - DNA, 22 bp, Homo sapiens
caggagcccagagtcctcagct

SEQ ID NO: 7406050 - DNA, 22 bp, Homo sapiens
caggagtctgttcctcatttgt

SEQ ID NO: 7406051 - DNA, 22 bp, Homo sapiens
caggagtgaaatgaggcccagg

SEQ ID NO: 7406052 - DNA, 22 bp, Homo sapiens
caggcacacccactggtgcaga

SEQ ID NO: 7406053 - DNA, 20 bp, Homo sapiens
caggcacactcattcctgct

SEQ ID NO: 7406054 - DNA, 20 bp, Homo sapiens
caggcacactcattcctgct

SEQ ID NO: 7406055 - DNA, 22 bp, Homo sapiens
caggcacacccactggtgcaga

SEQ ID NO: 7406056 - DNA, 22 bp, Homo sapiens
caggcacacccactggtgcaga

SEQ ID NO: 7406057 - DNA, 22 bp, Homo sapiens
caggcacacccactggtgcaga

SEQ ID NO: 7406058 - DNA, 22 bp, Homo sapiens
caggcacacccactggtgcaga

SEQ ID NO: 7406059 - DNA, 22 bp, Homo sapiens
caggcacacatccgtgagagat

SEQ ID NO: 7406060 - DNA, 22 bp, Homo sapiens
caggcacacccactggtgcaga

SEQ ID NO: 7406061 - DNA, 22 bp, Homo sapiens
caggcagagttagagcaactgg

SEQ ID NO: 7406062 - DNA, 22 bp, Homo sapiens
caggcagagtgaggtggtctaa

SEQ ID NO: 7406063 - DNA, 22 bp, Homo sapiens
caggcagagtgaggtggtctaa

SEQ ID NO: 7406064 - DNA, 20 bp, Homo sapiens
caggcacactcattcctgct

SEQ ID NO: 7406065 - DNA, 20 bp, Homo sapiens
caggcacactcattcctgct

SEQ ID NO: 7406066 - DNA, 20 bp, Homo sapiens
caggcacactcattcctgct

SEQ ID NO: 7406067 - DNA, 22 bp, Homo sapiens
caggcagagtgaggtggtctaa

SEQ ID NO: 7406068 - DNA, 20 bp, Homo sapiens
caggcacactcattcctgct

SEQ ID NO: 7406069 - DNA, 20 bp, Homo sapiens
caggcacactcattcctgct

SEQ ID NO: 7406070 - DNA, 22 bp, Homo sapiens
caggcacacagggaatttggct

SEQ ID NO: 7406071 - DNA, 22 bp, Homo sapiens
caggcacacagggaatttggct

SEQ ID NO: 7406072 - DNA, 22 bp, Homo sapiens
caggcacacaggctccctgggc

SEQ ID NO: 7406073 - DNA, 22 bp, Homo sapiens
caggcacacaggctccctgggc

SEQ ID NO: 7406074 - DNA, 22 bp, Homo sapiens
caggcacacaggctccctgggc

SEQ ID NO: 7406075 - DNA, 22 bp, Homo sapiens
caggcacacaggctccctgggc

SEQ ID NO: 7406076 - DNA, 22 bp, Homo sapiens
caggcacacaggctccctgggc

SEQ ID NO: 7406077 - DNA, 22 bp, Homo sapiens
caggcacacagcacatggcctg

SEQ ID NO: 7406078 - DNA, 22 bp, Homo sapiens
caggcacacatccgtgagagat

SEQ ID NO: 7406079 - DNA, 22 bp, Homo sapiens
caggcacacatccgtgagagat

SEQ ID NO: 7406080 - DNA, 22 bp, Homo sapiens
caggcacacatccgtgagagat

SEQ ID NO: 7406081 - DNA, 22 bp, Homo sapiens
caggcacacatccgtgagagat

SEQ ID NO: 7406082 - DNA, 22 bp, Homo sapiens
caggcacacatccgtgagagat

SEQ ID NO: 7406083 - DNA, 22 bp, Homo sapiens
caggcacacatccgtgagagat

SEQ ID NO: 7406084 - DNA, 22 bp, Homo sapiens
caggcacacatccgtgagagat

SEQ ID NO: 7406085 - DNA, 22 bp, Homo sapiens
caggcacacatccgtgagagat

SEQ ID NO: 7406086 - DNA, 22 bp, Homo sapiens
caggatgggtgtcggccagcac

SEQ ID NO: 7406087 - DNA, 22 bp, Homo sapiens
caggatgggtgtcggccagcac

SEQ ID NO: 7406088 - DNA, 22 bp, Homo sapiens
caggatgggtgtcggccagcac

SEQ ID NO: 7406089 - DNA, 22 bp, Homo sapiens
caggatgggtgtcggccagcac

SEQ ID NO: 7406090 - DNA, 22 bp, Homo sapiens
caggatgggatgtagtgggccc

SEQ ID NO: 7406091 - DNA, 22 bp, Homo sapiens
caggatgggatgtagtgggccc

SEQ ID NO: 7406092 - DNA, 22 bp, Homo sapiens
caggatgggatgtagtgggccc

SEQ ID NO: 7406093 - DNA, 22 bp, Homo sapiens
caggatgggatgtagtgggccc

SEQ ID NO: 7406094 - DNA, 22 bp, Homo sapiens
caggatgggatgtagtgggccc

SEQ ID NO: 7406095 - DNA, 22 bp, Homo sapiens
caggatgggatgtagtgggccc

SEQ ID NO: 7406096 - DNA, 22 bp, Homo sapiens
caggatgggatgtagtgggccc

SEQ ID NO: 7406097 - DNA, 22 bp, Homo sapiens
caggatggccccggggctgtgc

SEQ ID NO: 7406098 - DNA, 22 bp, Homo sapiens
caggatgggatgtagtgggccc

SEQ ID NO: 7406099 - DNA, 22 bp, Homo sapiens
caggatgggatgtagtgggccc

SEQ ID NO: 7406100 - DNA, 22 bp, Homo sapiens
caggatgggatgtagtgggccc

SEQ ID NO: 7406101 - DNA, 22 bp, Homo sapiens
caggatggtctcgatctcctga

SEQ ID NO: 7406102 - DNA, 22 bp, Homo sapiens
caggatggtcagatgcattgtc

SEQ ID NO: 7406103 - DNA, 22 bp, Homo sapiens
caggatgggtgtcggccagcac

SEQ ID NO: 7406104 - DNA, 22 bp, Homo sapiens
caggatgggtgtcggccagcac

SEQ ID NO: 7406105 - DNA, 22 bp, Homo sapiens
caggcacacagcacatggcctg

SEQ ID NO: 7406106 - DNA, 22 bp, Homo sapiens
caggcacacagcacatggcctg

SEQ ID NO: 7406107 - DNA, 22 bp, Homo sapiens
caggcacacagcacatggcctg

SEQ ID NO: 7406108 - DNA, 22 bp, Homo sapiens
caggcacacagcacatggcctg

SEQ ID NO: 7406109 - DNA, 22 bp, Homo sapiens
caggcacacagcacatggcctg

SEQ ID NO: 7406110 - DNA, 22 bp, Homo sapiens
caggcacacagcacatggcctg

SEQ ID NO: 7406111 - DNA, 22 bp, Homo sapiens
caggcacacagcacatggcctg

SEQ ID NO: 7406112 - DNA, 22 bp, Homo sapiens
caggcacaatgagcgccatctt

SEQ ID NO: 7406113 - DNA, 22 bp, Homo sapiens
caggatggtctcgatctcctga

SEQ ID NO: 7406114 - DNA, 22 bp, Homo sapiens
caggcacaattatttccctttc

SEQ ID NO: 7406115 - DNA, 22 bp, Homo sapiens
caggcacaattatttccctttc

SEQ ID NO: 7406116 - DNA, 22 bp, Homo sapiens
caggcacaattatttccctttc

SEQ ID NO: 7406117 - DNA, 22 bp, Homo sapiens
caggcacaattatttccctttc

SEQ ID NO: 7406118 - DNA, 22 bp, Homo sapiens
caggacctaactcacctgtctc

SEQ ID NO: 7406119 - DNA, 22 bp, Homo sapiens
caggacctgaagacaggcaggt

SEQ ID NO: 7406120 - DNA, 22 bp, Homo sapiens
caggacctgaagacaggcaggt

SEQ ID NO: 7406121 - DNA, 22 bp, Homo sapiens
caggaccccatattcactgaac

SEQ ID NO: 7406122 - DNA, 22 bp, Homo sapiens
caggacagctcaacacctcctc

SEQ ID NO: 7406123 - DNA, 20 bp, Homo sapiens
caggacagcgcaatcggagg

SEQ ID NO: 7406124 - DNA, 20 bp, Homo sapiens
caggacagcgcaatcggagg

SEQ ID NO: 7406125 - DNA, 22 bp, Homo sapiens
caggactcacttctcacatccc

SEQ ID NO: 7406126 - DNA, 22 bp, Homo sapiens
caggactcacttctcacatccc

SEQ ID NO: 7406127 - DNA, 22 bp, Homo sapiens
caggactcacttctcacatccc

SEQ ID NO: 7406128 - DNA, 22 bp, Homo sapiens
caggactgaagggcacagggaa

SEQ ID NO: 7406129 - DNA, 22 bp, Homo sapiens
caggactgaagggcacagggaa

SEQ ID NO: 7406130 - DNA, 22 bp, Homo sapiens
caggactcttgtcatcatcagt

SEQ ID NO: 7406131 - DNA, 22 bp, Homo sapiens
caggactcttgtcatcatcagt

SEQ ID NO: 7406132 - DNA, 22 bp, Homo sapiens
caggactcttgtcatcatcagt

SEQ ID NO: 7406133 - DNA, 22 bp, Homo sapiens
caggacgggcaaacaggatggt

SEQ ID NO: 7406134 - DNA, 22 bp, Homo sapiens
caggacgggcaaacaggatggt

SEQ ID NO: 7406135 - DNA, 22 bp, Homo sapiens
caggactagatgttgggcagtt

SEQ ID NO: 7406136 - DNA, 22 bp, Homo sapiens
caggacctggaatgcttgtgaa

SEQ ID NO: 7406137 - DNA, 22 bp, Homo sapiens
caggacctggaatgcttgtgaa

SEQ ID NO: 7406138 - DNA, 22 bp, Homo sapiens
caggacagagcccagactgtgt

SEQ ID NO: 7406139 - DNA, 22 bp, Homo sapiens
cagctgttgtcacctcacatcc

SEQ ID NO: 7406140 - DNA, 22 bp, Homo sapiens
caggacagagcccagactgtgt

SEQ ID NO: 7406141 - DNA, 20 bp, Homo sapiens
caggacagcgcaatcggagg

SEQ ID NO: 7406142 - DNA, 20 bp, Homo sapiens
caggacagcgcaatcggagg

SEQ ID NO: 7406143 - DNA, 22 bp, Homo sapiens
cagctgttgcagcactgagaga

SEQ ID NO: 7406144 - DNA, 22 bp, Homo sapiens
cagctgttgatctcttaagcct

SEQ ID NO: 7406145 - DNA, 22 bp, Homo sapiens
cagctgttgcagcactgagaga

SEQ ID NO: 7406146 - DNA, 22 bp, Homo sapiens
cagctgttgactggtacatgaa

SEQ ID NO: 7406147 - DNA, 22 bp, Homo sapiens
cagctgttcttgggacagacag

SEQ ID NO: 7406148 - DNA, 22 bp, Homo sapiens
cagctgttgactggtacatgaa

SEQ ID NO: 7406149 - DNA, 22 bp, Homo sapiens
cagctgttcttgggacagacag

SEQ ID NO: 7406150 - DNA, 22 bp, Homo sapiens
cagctgttcggggctggcatgt

SEQ ID NO: 7406151 - DNA, 22 bp, Homo sapiens
cagctgttcttgggacagacag

SEQ ID NO: 7406152 - DNA, 22 bp, Homo sapiens
caggactgatgttcctccagcc

SEQ ID NO: 7406153 - DNA, 22 bp, Homo sapiens
caggactgatgttcctccagcc

SEQ ID NO: 7406154 - DNA, 22 bp, Homo sapiens
caggactgatgttcctccagcc

SEQ ID NO: 7406155 - DNA, 22 bp, Homo sapiens
caggactgaagggcacagggaa

SEQ ID NO: 7406156 - DNA, 22 bp, Homo sapiens
caggactgaagggcacagggaa

SEQ ID NO: 7406157 - DNA, 22 bp, Homo sapiens
caggactgaagggcacagggaa

SEQ ID NO: 7406158 - DNA, 22 bp, Homo sapiens
caggactggctcgcagtgggtg

SEQ ID NO: 7406159 - DNA, 22 bp, Homo sapiens
caggactggaagtctcaagaga

SEQ ID NO: 7406160 - DNA, 22 bp, Homo sapiens
caggactggaagtctcaagaga

SEQ ID NO: 7406161 - DNA, 22 bp, Homo sapiens
caggactggaagtctcaagaga

SEQ ID NO: 7406162 - DNA, 22 bp, Homo sapiens
caggactggaagtctcaagaga

SEQ ID NO: 7406163 - DNA, 22 bp, Homo sapiens
caggactggctcgcagtgggtg

SEQ ID NO: 7406164 - DNA, 22 bp, Homo sapiens
caggactggctcgcagtgggtg

SEQ ID NO: 7406165 - DNA, 22 bp, Homo sapiens
caggactggctcgcagtgggtg

SEQ ID NO: 7406166 - DNA, 22 bp, Homo sapiens
caggactggctcgcagtgggtg

SEQ ID NO: 7406167 - DNA, 22 bp, Homo sapiens
caggactggctcgcagtgggtg

SEQ ID NO: 7406168 - DNA, 22 bp, Homo sapiens
caggactggctcgcagtgggtg

SEQ ID NO: 7406169 - DNA, 22 bp, Homo sapiens
caggagaaggtttggagtgcag

SEQ ID NO: 7406170 - DNA, 22 bp, Homo sapiens
caggagcaaggagcagtgggat

SEQ ID NO: 7406171 - DNA, 22 bp, Homo sapiens
caggagcaaggagcagtgggat

SEQ ID NO: 7406172 - DNA, 22 bp, Homo sapiens
caggagaaggtttggagtgcag

SEQ ID NO: 7406173 - DNA, 22 bp, Homo sapiens
caggagaaatgtggctgctacc

SEQ ID NO: 7406174 - DNA, 22 bp, Homo sapiens
caggagaaggtttggagtgcag

SEQ ID NO: 7406175 - DNA, 22 bp, Homo sapiens
caggagaaacataattttctgg

SEQ ID NO: 7406176 - DNA, 22 bp, Homo sapiens
caggagaaacataattttctgg

SEQ ID NO: 7406177 - DNA, 22 bp, Homo sapiens
caggactgtatccttggagaaa

SEQ ID NO: 7406178 - DNA, 22 bp, Homo sapiens
caggactgtatccttggagaaa

SEQ ID NO: 7406179 - DNA, 22 bp, Homo sapiens
caggactggctcgcagtgggtg

SEQ ID NO: 7406180 - DNA, 22 bp, Homo sapiens
caggactgtatccttggagaaa

SEQ ID NO: 7406181 - DNA, 22 bp, Homo sapiens
caggacttattatagcattata

SEQ ID NO: 7406182 - DNA, 22 bp, Homo sapiens
caggacttattatagcattata

SEQ ID NO: 7406183 - DNA, 21 bp, Homo sapiens
caggactttcctccaaagtta

SEQ ID NO: 7406184 - DNA, 22 bp, Homo sapiens
cagctgtccttcctggtgggcg

SEQ ID NO: 7406185 - DNA, 22 bp, Homo sapiens
cagctgtccttcctggtgggcg

SEQ ID NO: 7406186 - DNA, 22 bp, Homo sapiens
cagctgtctaagttgagcagga

SEQ ID NO: 7406187 - DNA, 22 bp, Homo sapiens
cagctgtctaagttgagcagga

SEQ ID NO: 7406188 - DNA, 22 bp, Homo sapiens
cagctgtccttcctggtgggcg

SEQ ID NO: 7406189 - DNA, 22 bp, Homo sapiens
cagctgtcagccggtgcaggct

SEQ ID NO: 7406190 - DNA, 22 bp, Homo sapiens
cagctgtcagccggtgcaggct

SEQ ID NO: 7406191 - DNA, 22 bp, Homo sapiens
cagctgtcagccggtgcaggct

SEQ ID NO: 7406192 - DNA, 22 bp, Homo sapiens
cagctgtcagccggtgcaggct

SEQ ID NO: 7406193 - DNA, 22 bp, Homo sapiens
cagctgtccaaacacattaact

SEQ ID NO: 7406194 - DNA, 22 bp, Homo sapiens
cagctgtccaaacacattaact

SEQ ID NO: 7406195 - DNA, 22 bp, Homo sapiens
cagctgtgtctaattatggctg

SEQ ID NO: 7406196 - DNA, 22 bp, Homo sapiens
cagctgtgtctaattatggctg

SEQ ID NO: 7406197 - DNA, 22 bp, Homo sapiens
cagctgtgtctaattatggctg

SEQ ID NO: 7406198 - DNA, 22 bp, Homo sapiens
cagctgtgtatgagagcatgct

SEQ ID NO: 7406199 - DNA, 22 bp, Homo sapiens
cagctgtgtatgagagcatgct

SEQ ID NO: 7406200 - DNA, 22 bp, Homo sapiens
cagctgtgtatgagagcatgct

SEQ ID NO: 7406201 - DNA, 22 bp, Homo sapiens
cagctgtgtatgagagcatgct

SEQ ID NO: 7406202 - DNA, 22 bp, Homo sapiens
cagctgttactctgagtaaatg

SEQ ID NO: 7406203 - DNA, 22 bp, Homo sapiens
cagctgttactgaagtaaaatg

SEQ ID NO: 7406204 - DNA, 22 bp, Homo sapiens
cagctgttatgaggtgtacatg

SEQ ID NO: 7406205 - DNA, 22 bp, Homo sapiens
cagctgttatgaggtgtacatg

SEQ ID NO: 7406206 - DNA, 22 bp, Homo sapiens
cagctgttatgaggtgtacatg

SEQ ID NO: 7406207 - DNA, 22 bp, Homo sapiens
cagctgttcacatttccaaaac

SEQ ID NO: 7406208 - DNA, 22 bp, Homo sapiens
cagctgttcacatttccaaaac

SEQ ID NO: 7406209 - DNA, 22 bp, Homo sapiens
cagctgttcagcaactcgcaga

SEQ ID NO: 7406210 - DNA, 22 bp, Homo sapiens
cagctgttcattgttgccaccc

SEQ ID NO: 7406211 - DNA, 22 bp, Homo sapiens
cagctgttcctggaaggagacc

SEQ ID NO: 7406212 - DNA, 22 bp, Homo sapiens
cagctggttatcagagaggcct

SEQ ID NO: 7406213 - DNA, 22 bp, Homo sapiens
cagctggttatcagagaggcct

SEQ ID NO: 7406214 - DNA, 22 bp, Homo sapiens
cagctggttatcagagaggcct

SEQ ID NO: 7406215 - DNA, 22 bp, Homo sapiens
cagctggttatcagagaggcct

SEQ ID NO: 7406216 - DNA, 22 bp, Homo sapiens
cagctggttatcagagaggcct

SEQ ID NO: 7406217 - DNA, 22 bp, Homo sapiens
cagctggtgtccagggaagtgg

SEQ ID NO: 7406218 - DNA, 22 bp, Homo sapiens
cagctggtgtcaggcactgcag

SEQ ID NO: 7406219 - DNA, 22 bp, Homo sapiens
cagctggttggaagggagctga

SEQ ID NO: 7406220 - DNA, 22 bp, Homo sapiens
cagctggttgaagaggagctgg

SEQ ID NO: 7406221 - DNA, 22 bp, Homo sapiens
cagctggttgaagaggagctgg

SEQ ID NO: 7406222 - DNA, 22 bp, Homo sapiens
cagctggttggaagggagctga

SEQ ID NO: 7406223 - DNA, 23 bp, Homo sapiens
cagctggttgtgggagtggctgc

SEQ ID NO: 7406224 - DNA, 22 bp, Homo sapiens
cagctgtcacttctaagttttg

SEQ ID NO: 7406225 - DNA, 22 bp, Homo sapiens
cagctggtgagcttagtagggt

SEQ ID NO: 7406226 - DNA, 22 bp, Homo sapiens
cagctggtcaactgaatgaaca

SEQ ID NO: 7406227 - DNA, 22 bp, Homo sapiens
cagctggtaggtagcagatttg

SEQ ID NO: 7406228 - DNA, 22 bp, Homo sapiens
cagctgggtttagtggggtgtg

SEQ ID NO: 7406229 - DNA, 22 bp, Homo sapiens
cagctgggtggctcttctgctc

SEQ ID NO: 7406230 - DNA, 22 bp, Homo sapiens
cagctgggtttagtggggtgtg

SEQ ID NO: 7406231 - DNA, 22 bp, Homo sapiens
cagctgggtttagtggggtgtg

SEQ ID NO: 7406232 - DNA, 22 bp, Homo sapiens
cagctgggtttagtggggtgtg

SEQ ID NO: 7406233 - DNA, 22 bp, Homo sapiens
cagctgggtttagtggggtgtg

SEQ ID NO: 7406234 - DNA, 22 bp, Homo sapiens
cagctgggtttagtggggtgtg

SEQ ID NO: 7406235 - DNA, 22 bp, Homo sapiens
aggacaggattgagctgaactg

SEQ ID NO: 7406236 - DNA, 22 bp, Homo sapiens
aggacacagtggtggggaaaag

SEQ ID NO: 7406237 - DNA, 22 bp, Homo sapiens
aggacacagtggtggggaaaag

SEQ ID NO: 7406238 - DNA, 22 bp, Homo sapiens
aggacacagtggtggggaaaag

SEQ ID NO: 7406239 - DNA, 22 bp, Homo sapiens
aggacacaggtaagccagtgga

SEQ ID NO: 7406240 - DNA, 22 bp, Homo sapiens
acagggctatattcctcagagc

SEQ ID NO: 7406241 - DNA, 22 bp, Homo sapiens
acagggctatattcctcagagt

SEQ ID NO: 7406242 - DNA, 22 bp, Homo sapiens
acagggctatattcctcagagt

SEQ ID NO: 7406243 - DNA, 22 bp, Homo sapiens
aggacacaggtaagccagtgga

SEQ ID NO: 7406244 - DNA, 22 bp, Homo sapiens
aggacacaggtaagccagtgga

SEQ ID NO: 7406245 - DNA, 22 bp, Homo sapiens
aggacacaggtaagccagtgga

SEQ ID NO: 7406246 - DNA, 22 bp, Homo sapiens
aggacaggattgagctgaactg

SEQ ID NO: 7406247 - DNA, 22 bp, Homo sapiens
aggacagggattcaaactccca

SEQ ID NO: 7406248 - DNA, 22 bp, Homo sapiens
aggacagggattcaaactccca

SEQ ID NO: 7406249 - DNA, 22 bp, Homo sapiens
aggacaggtgtagtgggctctg

SEQ ID NO: 7406250 - DNA, 22 bp, Homo sapiens
aggacaggtgtagtgggctctg

SEQ ID NO: 7406251 - DNA, 22 bp, Homo sapiens
aggacaggtgtagtgggctctg

SEQ ID NO: 7406252 - DNA, 22 bp, Homo sapiens
aggacagggattcaaactccca

SEQ ID NO: 7406253 - DNA, 22 bp, Homo sapiens
aggacagggattcaaactccca

SEQ ID NO: 7406254 - DNA, 22 bp, Homo sapiens
aggacagggattcaaactccca

SEQ ID NO: 7406255 - DNA, 22 bp, Homo sapiens
acagggccttatatccagaagg

SEQ ID NO: 7406256 - DNA, 22 bp, Homo sapiens
acagggccttatatccagaagg

SEQ ID NO: 7406257 - DNA, 22 bp, Homo sapiens
acagggccttatatccagaagg

SEQ ID NO: 7406258 - DNA, 22 bp, Homo sapiens
acagggccttatatccagaagg

SEQ ID NO: 7406259 - DNA, 22 bp, Homo sapiens
acagggccttatatccagaagg

SEQ ID NO: 7406260 - DNA, 22 bp, Homo sapiens
acagggcctttgatggattata

SEQ ID NO: 7406261 - DNA, 22 bp, Homo sapiens
acagggcctttgatggattata

SEQ ID NO: 7406262 - DNA, 22 bp, Homo sapiens
acagggcctttgatggattata

SEQ ID NO: 7406263 - DNA, 23 bp, Homo sapiens
acagggctagctgacagtggtat

SEQ ID NO: 7406264 - DNA, 23 bp, Homo sapiens
acagggctagctgacagtggtat

SEQ ID NO: 7406265 - DNA, 23 bp, Homo sapiens
acagggctagctgacagtggtat

SEQ ID NO: 7406266 - DNA, 23 bp, Homo sapiens
acagggctagctgacagtggtat

SEQ ID NO: 7406267 - DNA, 23 bp, Homo sapiens
acagggctagctgacagtggtat

SEQ ID NO: 7406268 - DNA, 22 bp, Homo sapiens
acagggctatattcctcagagc

SEQ ID NO: 7406269 - DNA, 22 bp, Homo sapiens
acagggctatattcctcagagc

SEQ ID NO: 7406270 - DNA, 22 bp, Homo sapiens
acagggctatattcctcagagc

SEQ ID NO: 7406271 - DNA, 22 bp, Homo sapiens
acagggctatattcctcagagc

SEQ ID NO: 7406272 - DNA, 22 bp, Homo sapiens
acagggctatattcctcagagc

SEQ ID NO: 7406273 - DNA, 22 bp, Homo sapiens
acagggcccttagatcctttta

SEQ ID NO: 7406274 - DNA, 22 bp, Homo sapiens
acagggcccttgccagcacaag

SEQ ID NO: 7406275 - DNA, 22 bp, Homo sapiens
acagggcccttagatcctttta

SEQ ID NO: 7406276 - DNA, 22 bp, Homo sapiens
acagggcctcagccagggcaga

SEQ ID NO: 7406277 - DNA, 22 bp, Homo sapiens
acagggcctcagccagggcaga

SEQ ID NO: 7406278 - DNA, 22 bp, Homo sapiens
acagggcccttgccagcacaag

SEQ ID NO: 7406279 - DNA, 22 bp, Homo sapiens
acagggcccttagatcctttta

SEQ ID NO: 7406280 - DNA, 22 bp, Homo sapiens
acagggcccttgccagcacaag

SEQ ID NO: 7406281 - DNA, 22 bp, Homo sapiens
acagggcctcagccagggcaga

SEQ ID NO: 7406282 - DNA, 22 bp, Homo sapiens
acagggcctcagccagggcaga

SEQ ID NO: 7406283 - DNA, 22 bp, Homo sapiens
acagggcctcagccagggcaga

SEQ ID NO: 7406284 - DNA, 22 bp, Homo sapiens
acagggcctcagccagggcaga

SEQ ID NO: 7406285 - DNA, 22 bp, Homo sapiens
acagggcctggctccaaaagat

SEQ ID NO: 7406286 - DNA, 22 bp, Homo sapiens
acagggcctcagctgattctgg

SEQ ID NO: 7406287 - DNA, 22 bp, Homo sapiens
acagggcctggctccaaaagat

SEQ ID NO: 7406288 - DNA, 22 bp, Homo sapiens
acagggcctcagctgattctgg

SEQ ID NO: 7406289 - DNA, 22 bp, Homo sapiens
acagggccctgtgggccccact

SEQ ID NO: 7406290 - DNA, 22 bp, Homo sapiens
acagggccctgtgggccccact

SEQ ID NO: 7406291 - DNA, 22 bp, Homo sapiens
acagggccctgtgggccccact

SEQ ID NO: 7406292 - DNA, 22 bp, Homo sapiens
acagggccctgtgggccccact

SEQ ID NO: 7406293 - DNA, 22 bp, Homo sapiens
acagggccattggaggattata

SEQ ID NO: 7406294 - DNA, 22 bp, Homo sapiens
acagggccattggaggattata

SEQ ID NO: 7406295 - DNA, 22 bp, Homo sapiens
acagggccattatctgttctag

SEQ ID NO: 7406296 - DNA, 22 bp, Homo sapiens
acagggccattatctgttctag

SEQ ID NO: 7406297 - DNA, 22 bp, Homo sapiens
acagggccattggaggattata

SEQ ID NO: 7406298 - DNA, 22 bp, Homo sapiens
acagggccattatctgttctag

SEQ ID NO: 7406299 - DNA, 22 bp, Homo sapiens
acagggccaggtgagaggtgct

SEQ ID NO: 7406300 - DNA, 22 bp, Homo sapiens
acagggccagcctgggacctgg

SEQ ID NO: 7406301 - DNA, 22 bp, Homo sapiens
acagggccagcctgggacctgg

SEQ ID NO: 7406302 - DNA, 22 bp, Homo sapiens
acagggccagcctgggacctgg

SEQ ID NO: 7406303 - DNA, 22 bp, Homo sapiens
acagggccaggtgagaggtgct

SEQ ID NO: 7406304 - DNA, 22 bp, Homo sapiens
acagggccaggtgagaggtgct

SEQ ID NO: 7406305 - DNA, 22 bp, Homo sapiens
acagggccaggtgagaggtgct

SEQ ID NO: 7406306 - DNA, 22 bp, Homo sapiens
acagggccaggtgagaggtgct

SEQ ID NO: 7406307 - DNA, 22 bp, Homo sapiens
acagggccaggtgagaggtgct

SEQ ID NO: 7406308 - DNA, 22 bp, Homo sapiens
aggactgggtgcagagggcatc

SEQ ID NO: 7406309 - DNA, 22 bp, Homo sapiens
aggactgggtgcagagggcatc

SEQ ID NO: 7406310 - DNA, 22 bp, Homo sapiens
aggactggcggtcggtggggat

SEQ ID NO: 7406311 - DNA, 22 bp, Homo sapiens
aggactgggtgcagagggcatc

SEQ ID NO: 7406312 - DNA, 22 bp, Homo sapiens
aggactgggtgcagagggcatc

SEQ ID NO: 7406313 - DNA, 22 bp, Homo sapiens
aggactgggtgcagagggcatc

SEQ ID NO: 7406314 - DNA, 22 bp, Homo sapiens
aggactgggtgcagagggcatc

SEQ ID NO: 7406315 - DNA, 22 bp, Homo sapiens
aggactggtgccagacaaggta

SEQ ID NO: 7406316 - DNA, 22 bp, Homo sapiens
aggactggtgccagacaaggta

SEQ ID NO: 7406317 - DNA, 22 bp, Homo sapiens
aggactggtgccagacaaggta

SEQ ID NO: 7406318 - DNA, 22 bp, Homo sapiens
aggactgggtgcagagggcatc

SEQ ID NO: 7406319 - DNA, 22 bp, Homo sapiens
aggactggtgtgtgatcagcat

SEQ ID NO: 7406320 - DNA, 22 bp, Homo sapiens
aggactggtgccagacaaggta

SEQ ID NO: 7406321 - DNA, 22 bp, Homo sapiens
aggactggtgtgtgatcagcat

SEQ ID NO: 7406322 - DNA, 22 bp, Homo sapiens
aggactggtgtgtgatcagcat

SEQ ID NO: 7406323 - DNA, 22 bp, Homo sapiens
aggactgttttttcttctaggg

SEQ ID NO: 7406324 - DNA, 22 bp, Homo sapiens
aggactggcagtgtgaggggtc

SEQ ID NO: 7406325 - DNA, 22 bp, Homo sapiens
aggactggcagtgtgaggggtc

SEQ ID NO: 7406326 - DNA, 22 bp, Homo sapiens
aggactggcagtgtgaggggtc

SEQ ID NO: 7406327 - DNA, 22 bp, Homo sapiens
aggactggcagtgtgaggggtc

SEQ ID NO: 7406328 - DNA, 22 bp, Homo sapiens
aggactggcagtgtgaggggtc

SEQ ID NO: 7406329 - DNA, 22 bp, Homo sapiens
aggactgatgatggtgctgaca

SEQ ID NO: 7406330 - DNA, 22 bp, Homo sapiens
aggactgattgggatgccatgt

SEQ ID NO: 7406331 - DNA, 22 bp, Homo sapiens
aggactggccctgaggggaggc

SEQ ID NO: 7406332 - DNA, 22 bp, Homo sapiens
aggactggccctgaggggaggc

SEQ ID NO: 7406333 - DNA, 22 bp, Homo sapiens
aggactggccctgaggggaggc

SEQ ID NO: 7406334 - DNA, 22 bp, Homo sapiens
aggactggccctgaggggaggc

SEQ ID NO: 7406335 - DNA, 22 bp, Homo sapiens
aggactggcggtcggtggggat

SEQ ID NO: 7406336 - DNA, 22 bp, Homo sapiens
aggactggccctgaggggaggc

SEQ ID NO: 7406337 - DNA, 22 bp, Homo sapiens
aggactggccctgaggggaggc

SEQ ID NO: 7406338 - DNA, 22 bp, Homo sapiens
aggacagttagttaggaagttt

SEQ ID NO: 7406339 - DNA, 22 bp, Homo sapiens
aggacagttagttaggaagttt

SEQ ID NO: 7406340 - DNA, 22 bp, Homo sapiens
aggacagttagttaggaagttt

SEQ ID NO: 7406341 - DNA, 22 bp, Homo sapiens
aggacagtgtggaagagggtgc

SEQ ID NO: 7406342 - DNA, 22 bp, Homo sapiens
aggacagttaaaaatagatggc

SEQ ID NO: 7406343 - DNA, 22 bp, Homo sapiens
aggacagttaaaaatagatggc

SEQ ID NO: 7406344 - DNA, 22 bp, Homo sapiens
aggacagtgtggaagagggtgc

SEQ ID NO: 7406345 - DNA, 22 bp, Homo sapiens
aggacagttagttaggaagttt

SEQ ID NO: 7406346 - DNA, 22 bp, Homo sapiens
aggacagttaaaaatagatggc

SEQ ID NO: 7406347 - DNA, 22 bp, Homo sapiens
aggacagtggacactagtccct

SEQ ID NO: 7406348 - DNA, 22 bp, Homo sapiens
aggacagtggacactagtccct

SEQ ID NO: 7406349 - DNA, 22 bp, Homo sapiens
aggacagtggcaaggcaggaca

SEQ ID NO: 7406350 - DNA, 22 bp, Homo sapiens
aggacagtggcaaggcaggaca

SEQ ID NO: 7406351 - DNA, 22 bp, Homo sapiens
aggacagtggtgttctggagtg

SEQ ID NO: 7406352 - DNA, 22 bp, Homo sapiens
aggacagtggcagggtgacaga

SEQ ID NO: 7406353 - DNA, 22 bp, Homo sapiens
aggacagtggtgttctggagtg

SEQ ID NO: 7406354 - DNA, 22 bp, Homo sapiens
aggacagtggcaaggcaggaca

SEQ ID NO: 7406355 - DNA, 22 bp, Homo sapiens
aggacaggtgtagtgggctctg

SEQ ID NO: 7406356 - DNA, 22 bp, Homo sapiens
aggacaggtgtagtgggctctg

SEQ ID NO: 7406357 - DNA, 22 bp, Homo sapiens
aggacaggtgtagtgggctctg

SEQ ID NO: 7406358 - DNA, 22 bp, Homo sapiens
aggacaggtgtagtgggctctg

SEQ ID NO: 7406359 - DNA, 22 bp, Homo sapiens
aggacaggtgtagtgggctctg

SEQ ID NO: 7406360 - DNA, 22 bp, Homo sapiens
aggacaggtgtagtgggctctg

SEQ ID NO: 7406361 - DNA, 22 bp, Homo sapiens
aggacaggtgtagtgggctctg

SEQ ID NO: 7406362 - DNA, 22 bp, Homo sapiens
aggacaggtgtagtgggctctg

SEQ ID NO: 7406363 - DNA, 22 bp, Homo sapiens
aggacaggtgtagtgggctctg

SEQ ID NO: 7406364 - DNA, 22 bp, Homo sapiens
aggacaggtgtagtgggctctg

SEQ ID NO: 7406365 - DNA, 22 bp, Homo sapiens
aggacaggtgtagtgggctctg

SEQ ID NO: 7406366 - DNA, 22 bp, Homo sapiens
aggacaggtgtagtgggctctg

SEQ ID NO: 7406367 - DNA, 22 bp, Homo sapiens
aggacaggtgtagtgggctctg

SEQ ID NO: 7406368 - DNA, 22 bp, Homo sapiens
aggacaggtgtagtgggctctg

SEQ ID NO: 7406369 - DNA, 22 bp, Homo sapiens
aggacagtataggctttaggag

SEQ ID NO: 7406370 - DNA, 22 bp, Homo sapiens
aggacagtataggctttaggag

SEQ ID NO: 7406371 - DNA, 22 bp, Homo sapiens
aggacaggtgtagtgggctctg

SEQ ID NO: 7406372 - DNA, 22 bp, Homo sapiens
aggacaggtgtagtgggctctg

SEQ ID NO: 7406373 - DNA, 22 bp, Homo sapiens
aggacaggtgtagtgggctctg

SEQ ID NO: 7406374 - DNA, 22 bp, Homo sapiens
aggacagtccggggtcctccac

SEQ ID NO: 7406375 - DNA, 22 bp, Homo sapiens
aggacagtccggggtcctccac

SEQ ID NO: 7406376 - DNA, 22 bp, Homo sapiens
aggacagtccggggtcctccac

SEQ ID NO: 7406377 - DNA, 23 bp, Homo sapiens
aggacagtggaatttagggattg

SEQ ID NO: 7406378 - DNA, 23 bp, Homo sapiens
aggacagtggaatttagggattg

SEQ ID NO: 7406379 - DNA, 22 bp, Homo sapiens
aggacagtggacactagtccct

SEQ ID NO: 7406380 - DNA, 19 bp, Homo sapiens
acagggcagcaataggata

SEQ ID NO: 7406381 - DNA, 19 bp, Homo sapiens
acagggcagcaataggata

SEQ ID NO: 7406382 - DNA, 21 bp, Homo sapiens
acaggctctggggatgctggg

SEQ ID NO: 7406383 - DNA, 22 bp, Homo sapiens
acagggcacctgaggtaggaag

SEQ ID NO: 7406384 - DNA, 22 bp, Homo sapiens
acagggcacctgaggtaggaag

SEQ ID NO: 7406385 - DNA, 21 bp, Homo sapiens
acaggctctggggatgctggg

SEQ ID NO: 7406386 - DNA, 21 bp, Homo sapiens
acaggctctggggatgctggg

SEQ ID NO: 7406387 - DNA, 22 bp, Homo sapiens
acagggcaggtggctactggtc

SEQ ID NO: 7406388 - DNA, 22 bp, Homo sapiens
acagggcaggtggctactggtc

SEQ ID NO: 7406389 - DNA, 22 bp, Homo sapiens
acagggcaggtggctactggtc

SEQ ID NO: 7406390 - DNA, 22 bp, Homo sapiens
acagggcagtgtcttgaaaaat

SEQ ID NO: 7406391 - DNA, 22 bp, Homo sapiens
acagggcagtgtcttgaaaaat

SEQ ID NO: 7406392 - DNA, 22 bp, Homo sapiens
acagggcaggtggctactggtc

SEQ ID NO: 7406393 - DNA, 22 bp, Homo sapiens
acaggctcgtgcgcgcacgtgt

SEQ ID NO: 7406394 - DNA, 22 bp, Homo sapiens
acaggctctcagccagttggca

SEQ ID NO: 7406395 - DNA, 22 bp, Homo sapiens
acaggctcgtgcgcgcacgtgt

SEQ ID NO: 7406396 - DNA, 22 bp, Homo sapiens
acaggctcagttcactggattt

SEQ ID NO: 7406397 - DNA, 22 bp, Homo sapiens
acaggctcagttcactggattt

SEQ ID NO: 7406398 - DNA, 22 bp, Homo sapiens
acaggctcagttcactggattt

SEQ ID NO: 7406399 - DNA, 21 bp, Homo sapiens
acaggctcacgatccatttct

SEQ ID NO: 7406400 - DNA, 22 bp, Homo sapiens
acaggctctctattgagtgcag

SEQ ID NO: 7406401 - DNA, 22 bp, Homo sapiens
acaggctctctattgagtgcag

SEQ ID NO: 7406402 - DNA, 21 bp, Homo sapiens
acaggctctggggatgctggg

SEQ ID NO: 7406403 - DNA, 22 bp, Homo sapiens
acaggctctctattgagtgcag

SEQ ID NO: 7406404 - DNA, 22 bp, Homo sapiens
acaggctctctattgagtgcag

SEQ ID NO: 7406405 - DNA, 22 bp, Homo sapiens
acaggctcgtgcgcgcacgtgt

SEQ ID NO: 7406406 - DNA, 22 bp, Homo sapiens
acaggctctctattgagtgcag

SEQ ID NO: 7406407 - DNA, 22 bp, Homo sapiens
acaggctctctattgagtgcag

SEQ ID NO: 7406408 - DNA, 22 bp, Homo sapiens
acaggctctcagccagttggca

SEQ ID NO: 7406409 - DNA, 22 bp, Homo sapiens
acaggctctcagccagttggca

SEQ ID NO: 7406410 - DNA, 22 bp, Homo sapiens
acaggctctcagccagttggca

SEQ ID NO: 7406411 - DNA, 22 bp, Homo sapiens
acaggctctcagccagttggca

SEQ ID NO: 7406412 - DNA, 22 bp, Homo sapiens
acagggcatgtgcaagagacat

SEQ ID NO: 7406413 - DNA, 22 bp, Homo sapiens
acagggcatgtgcaagagacat

SEQ ID NO: 7406414 - DNA, 22 bp, Homo sapiens
acagggcatgtgcaagagacat

SEQ ID NO: 7406415 - DNA, 21 bp, Homo sapiens
acagggcatgcagctggctgt

SEQ ID NO: 7406416 - DNA, 22 bp, Homo sapiens
acagggcatgtgcaagagacat

SEQ ID NO: 7406417 - DNA, 22 bp, Homo sapiens
acagggcatgtgcaagagacat

SEQ ID NO: 7406418 - DNA, 21 bp, Homo sapiens
acagggcatgcagctggctgt

SEQ ID NO: 7406419 - DNA, 21 bp, Homo sapiens
acagggcatgcagctggctgt

SEQ ID NO: 7406420 - DNA, 21 bp, Homo sapiens
acagggcatgcagctggctgt

SEQ ID NO: 7406421 - DNA, 22 bp, Homo sapiens
acagggcagtgtcttgaaaaat

SEQ ID NO: 7406422 - DNA, 21 bp, Homo sapiens
acagggcatgcagctggctgt

SEQ ID NO: 7406423 - DNA, 21 bp, Homo sapiens
acagggcatgcagctggctgt

SEQ ID NO: 7406424 - DNA, 21 bp, Homo sapiens
acagggcatgcagctggctgt

SEQ ID NO: 7406425 - DNA, 21 bp, Homo sapiens
acagggcatgcagctggctgt

SEQ ID NO: 7406426 - DNA, 22 bp, Homo sapiens
acagggccaagtaaaccctacc

SEQ ID NO: 7406427 - DNA, 22 bp, Homo sapiens
acagggcatttcctctatgtgt

SEQ ID NO: 7406428 - DNA, 22 bp, Homo sapiens
acagggccaatgttagcattga

SEQ ID NO: 7406429 - DNA, 22 bp, Homo sapiens
acagggccaatgttagcattga

SEQ ID NO: 7406430 - DNA, 22 bp, Homo sapiens
acagggccacatgtaaacagat

SEQ ID NO: 7406431 - DNA, 22 bp, Homo sapiens
acagggccagcctgggacctgg

SEQ ID NO: 7406432 - DNA, 22 bp, Homo sapiens
acagggccacatgtaaacagat

SEQ ID NO: 7406433 - DNA, 22 bp, Homo sapiens
acagggccacatgtaaacagat

SEQ ID NO: 7406434 - DNA, 23 bp, Homo sapiens
acagggcattgctggcctcgagg

SEQ ID NO: 7406435 - DNA, 23 bp, Homo sapiens
acagggcattgctggcctcgagg

SEQ ID NO: 7406436 - DNA, 23 bp, Homo sapiens
acagggcattgctggcctcgagg

SEQ ID NO: 7406437 - DNA, 22 bp, Homo sapiens
acagggcatgtgcaagagacat

SEQ ID NO: 7406438 - DNA, 22 bp, Homo sapiens
acagggcatgtgcaagagacat

SEQ ID NO: 7406439 - DNA, 22 bp, Homo sapiens
acagggcatttcctctatgtgt

SEQ ID NO: 7406440 - DNA, 23 bp, Homo sapiens
acagggcattgctggcctcgagg

SEQ ID NO: 7406441 - DNA, 19 bp, Homo sapiens
aggaaaggtggccttagca

SEQ ID NO: 7406442 - DNA, 19 bp, Homo sapiens
aggaaaggtggccttagca

SEQ ID NO: 7406443 - DNA, 19 bp, Homo sapiens
aggaaaggtggccttagca

SEQ ID NO: 7406444 - DNA, 19 bp, Homo sapiens
aggaaaggtggccttagca

SEQ ID NO: 7406445 - DNA, 19 bp, Homo sapiens
aggaaaggtggccttagca

SEQ ID NO: 7406446 - DNA, 19 bp, Homo sapiens
aggaaaggtggccttagca

SEQ ID NO: 7406447 - DNA, 19 bp, Homo sapiens
aggaaaggtggccttagca

SEQ ID NO: 7406448 - DNA, 19 bp, Homo sapiens
aggaaaggtggccttagca

SEQ ID NO: 7406449 - DNA, 22 bp, Homo sapiens
aggaaaggttcagtgattgaaa

SEQ ID NO: 7406450 - DNA, 22 bp, Homo sapiens
aggaaaggttcagtgattgaaa

SEQ ID NO: 7406451 - DNA, 19 bp, Homo sapiens
aggaaaggtggccttagca

SEQ ID NO: 7406452 - DNA, 17 bp, Homo sapiens
aggaaagtctgctgtcc

SEQ ID NO: 7406453 - DNA, 17 bp, Homo sapiens
aggaaagtctgctgtcc

SEQ ID NO: 7406454 - DNA, 22 bp, Homo sapiens
aggaaaggttcagtgattgaaa

SEQ ID NO: 7406455 - DNA, 22 bp, Homo sapiens
aggaaaggttcagtgattgaaa

SEQ ID NO: 7406456 - DNA, 22 bp, Homo sapiens
aggaaaggtagcgtgccagcag

SEQ ID NO: 7406457 - DNA, 22 bp, Homo sapiens
aggaaaggtgagagcggccgcg

SEQ ID NO: 7406458 - DNA, 22 bp, Homo sapiens
aggaaaggtgagagcggccgcg

SEQ ID NO: 7406459 - DNA, 22 bp, Homo sapiens
aggaaaggtagcgtgccagcag

SEQ ID NO: 7406460 - DNA, 22 bp, Homo sapiens
aggaaaggtagcgtgccagcag

SEQ ID NO: 7406461 - DNA, 22 bp, Homo sapiens
aggaaaggtagcgtgccagcag

SEQ ID NO: 7406462 - DNA, 22 bp, Homo sapiens
aggaaaggtagcgtgccagcag

SEQ ID NO: 7406463 - DNA, 22 bp, Homo sapiens
aggaaaggtagcgtgccagcag

SEQ ID NO: 7406464 - DNA, 22 bp, Homo sapiens
aggaaaggtagcgtgccagcag

SEQ ID NO: 7406465 - DNA, 22 bp, Homo sapiens
aggaaaggtagcgtgccagcag

SEQ ID NO: 7406466 - DNA, 22 bp, Homo sapiens
aggaaaggtagcgtgccagcag

SEQ ID NO: 7406467 - DNA, 22 bp, Homo sapiens
aggaaaggggtaggtgtggacg

SEQ ID NO: 7406468 - DNA, 22 bp, Homo sapiens
aggaaaggggtaggtgtggacg

SEQ ID NO: 7406469 - DNA, 22 bp, Homo sapiens
aggaaaggggtaggtgtggacg

SEQ ID NO: 7406470 - DNA, 22 bp, Homo sapiens
aggaaaggggtaggtgtggacg

SEQ ID NO: 7406471 - DNA, 22 bp, Homo sapiens
aggaaaggggtaggtgtggacg

SEQ ID NO: 7406472 - DNA, 22 bp, Homo sapiens
acaggcctgtgtgcacacgagg

SEQ ID NO: 7406473 - DNA, 22 bp, Homo sapiens
acaggccttaggagagatgggg

SEQ ID NO: 7406474 - DNA, 22 bp, Homo sapiens
acaggccttaggagagatgggg

SEQ ID NO: 7406475 - DNA, 22 bp, Homo sapiens
acaggccttaggagagatgggg

SEQ ID NO: 7406476 - DNA, 22 bp, Homo sapiens
acaggcctgtgtgcacacgagg

SEQ ID NO: 7406477 - DNA, 22 bp, Homo sapiens
acaggccttaggagagatgggg

SEQ ID NO: 7406478 - DNA, 22 bp, Homo sapiens
acaggccttggcaggcatgtga

SEQ ID NO: 7406479 - DNA, 22 bp, Homo sapiens
acaggccttggcaggcatgtga

SEQ ID NO: 7406480 - DNA, 22 bp, Homo sapiens
acaggccttggcaggcatgtga

SEQ ID NO: 7406481 - DNA, 21 bp, Homo sapiens
acaggccttaggggccattca

SEQ ID NO: 7406482 - DNA, 22 bp, Homo sapiens
acaggccttaggagagatgggg

SEQ ID NO: 7406483 - DNA, 21 bp, Homo sapiens
acaggccttaggggccattca

SEQ ID NO: 7406484 - DNA, 22 bp, Homo sapiens
acaggctcacagtcatttcatt

SEQ ID NO: 7406485 - DNA, 18 bp, Homo sapiens
acaggctattgcaggaga

SEQ ID NO: 7406486 - DNA, 18 bp, Homo sapiens
acaggctattgcaggaga

SEQ ID NO: 7406487 - DNA, 18 bp, Homo sapiens
acaggctattgcaggaga

SEQ ID NO: 7406488 - DNA, 22 bp, Homo sapiens
acaggcgctggcagagagaaaa

SEQ ID NO: 7406489 - DNA, 20 bp, Homo sapiens
acaggcgctggggagatggc

SEQ ID NO: 7406490 - DNA, 21 bp, Homo sapiens
acaggctacatgcaggagctg

SEQ ID NO: 7406491 - DNA, 21 bp, Homo sapiens
acaggctacatgcaggagctg

SEQ ID NO: 7406492 - DNA, 22 bp, Homo sapiens
acaggccttggtcctgacctaa

SEQ ID NO: 7406493 - DNA, 22 bp, Homo sapiens
acaggccttggtcctgacctaa

SEQ ID NO: 7406494 - DNA, 22 bp, Homo sapiens
acaggccttggcaggcatgtga

SEQ ID NO: 7406495 - DNA, 22 bp, Homo sapiens
acaggccttggcaggcatgtga

SEQ ID NO: 7406496 - DNA, 22 bp, Homo sapiens
acaggccttggtcctgacctaa

SEQ ID NO: 7406497 - DNA, 22 bp, Homo sapiens
aggaaataggaccagacaaagc

SEQ ID NO: 7406498 - DNA, 22 bp, Homo sapiens
aggaaataggaccagacaaagc

SEQ ID NO: 7406499 - DNA, 22 bp, Homo sapiens
aggaaataggaccagacaaagc

SEQ ID NO: 7406500 - DNA, 22 bp, Homo sapiens
aggaaataggaccagacaaagc

SEQ ID NO: 7406501 - DNA, 22 bp, Homo sapiens
aggaaataggaccagacaaagc

SEQ ID NO: 7406502 - DNA, 22 bp, Homo sapiens
aggaaataagggcacttcagat

SEQ ID NO: 7406503 - DNA, 22 bp, Homo sapiens
acaggcctgtgtgcacacgagg

SEQ ID NO: 7406504 - DNA, 22 bp, Homo sapiens
acaggcctgtgtgcacacgagg

SEQ ID NO: 7406505 - DNA, 22 bp, Homo sapiens
aggaaataggaccagacaaagc

SEQ ID NO: 7406506 - DNA, 22 bp, Homo sapiens
aggaaataggaccagacaaagc

SEQ ID NO: 7406507 - DNA, 22 bp, Homo sapiens
acaggcctggtgctgctgacag

SEQ ID NO: 7406508 - DNA, 22 bp, Homo sapiens
acaggcctggtgctgctgacag

SEQ ID NO: 7406509 - DNA, 22 bp, Homo sapiens
acaggcctggtgctgctgacag

SEQ ID NO: 7406510 - DNA, 22 bp, Homo sapiens
aggaaagtggtgggaaatcagg

SEQ ID NO: 7406511 - DNA, 22 bp, Homo sapiens
aggaaagtggtgggaaatcagg

SEQ ID NO: 7406512 - DNA, 22 bp, Homo sapiens
aggaaagtggtgggaaatcagg

SEQ ID NO: 7406513 - DNA, 22 bp, Homo sapiens
aggaaataagggacaagacaaa

SEQ ID NO: 7406514 - DNA, 22 bp, Homo sapiens
aggaaataagggacaagacaaa

SEQ ID NO: 7406515 - DNA, 22 bp, Homo sapiens
aggaaataagggcacttcagat

SEQ ID NO: 7406516 - DNA, 22 bp, Homo sapiens
aggaaataagggacaagacaaa

SEQ ID NO: 7406517 - DNA, 22 bp, Homo sapiens
aggaaataagggcacttcagat

SEQ ID NO: 7406518 - DNA, 22 bp, Homo sapiens
aggaaataagggcacttcagat

SEQ ID NO: 7406519 - DNA, 22 bp, Homo sapiens
aggaaataagggcacttcagat

SEQ ID NO: 7406520 - DNA, 22 bp, Homo sapiens
aggaaataagggcacttcagat

SEQ ID NO: 7406521 - DNA, 22 bp, Homo sapiens
aggaaataagggacaagacaaa

SEQ ID NO: 7406522 - DNA, 22 bp, Homo sapiens
agcttcttccaggcagtgactc

SEQ ID NO: 7406523 - DNA, 22 bp, Homo sapiens
agcttcttcccagcctcacccg

SEQ ID NO: 7406524 - DNA, 22 bp, Homo sapiens
agcttcttctattttggggcca

SEQ ID NO: 7406525 - DNA, 22 bp, Homo sapiens
agcttcttctgatttgtcagtc

SEQ ID NO: 7406526 - DNA, 22 bp, Homo sapiens
agcttcttctgatttgtcagtc

SEQ ID NO: 7406527 - DNA, 22 bp, Homo sapiens
agcttcttccaggcagtgactc

SEQ ID NO: 7406528 - DNA, 22 bp, Homo sapiens
agcttccatactaagacaaaag

SEQ ID NO: 7406529 - DNA, 22 bp, Homo sapiens
agcttcttcaaagcaggaggcc

SEQ ID NO: 7406530 - DNA, 22 bp, Homo sapiens
agcttcttcaaagcaggaggcc

SEQ ID NO: 7406531 - DNA, 22 bp, Homo sapiens
acaggagaaatctggtcaaaag

SEQ ID NO: 7406532 - DNA, 22 bp, Homo sapiens
agcttccaatttctccaagaga

SEQ ID NO: 7406533 - DNA, 22 bp, Homo sapiens
acaggagaaatctggtcaaaag

SEQ ID NO: 7406534 - DNA, 22 bp, Homo sapiens
acaggagaaatctggtcaaaag

SEQ ID NO: 7406535 - DNA, 22 bp, Homo sapiens
acaggagaaatctggtcaaaag

SEQ ID NO: 7406536 - DNA, 22 bp, Homo sapiens
agcttccatactaagacaaaag

SEQ ID NO: 7406537 - DNA, 21 bp, Homo sapiens
agcttccagagcacattccat

SEQ ID NO: 7406538 - DNA, 22 bp, Homo sapiens
agcttccacatctgtcttcagt

SEQ ID NO: 7406539 - DNA, 22 bp, Homo sapiens
agcttccacatctgtcttcagt

SEQ ID NO: 7406540 - DNA, 22 bp, Homo sapiens
agcttcttggctcagcacttgg

SEQ ID NO: 7406541 - DNA, 22 bp, Homo sapiens
agcttcttggctcagcacttgg

SEQ ID NO: 7406542 - DNA, 22 bp, Homo sapiens
agcttcttgggctttacacaaa

SEQ ID NO: 7406543 - DNA, 22 bp, Homo sapiens
agcttcttgggctttacacaaa

SEQ ID NO: 7406544 - DNA, 22 bp, Homo sapiens
agcttcttgacggatgttctgg

SEQ ID NO: 7406545 - DNA, 22 bp, Homo sapiens
agcttcttgacggatgttctgg

SEQ ID NO: 7406546 - DNA, 22 bp, Homo sapiens
agcttcttgacggatgttctgg

SEQ ID NO: 7406547 - DNA, 22 bp, Homo sapiens
agcttcttgaccaagcctgtaa

SEQ ID NO: 7406548 - DNA, 22 bp, Homo sapiens
agcttcttgaccaagcctgtaa

SEQ ID NO: 7406549 - DNA, 22 bp, Homo sapiens
agcttcttgacggatgttctgg

SEQ ID NO: 7406550 - DNA, 20 bp, Homo sapiens
agcttcttctgtctaatttt

SEQ ID NO: 7406551 - DNA, 22 bp, Homo sapiens
agcttcttcttggtctttccca

SEQ ID NO: 7406552 - DNA, 22 bp, Homo sapiens
agcttcttctgatttgtcagtc

SEQ ID NO: 7406553 - DNA, 20 bp, Homo sapiens
agcttcttctgtctaatttt

SEQ ID NO: 7406554 - DNA, 22 bp, Homo sapiens
agcttcttcttggtctttccca

SEQ ID NO: 7406555 - DNA, 22 bp, Homo sapiens
agcttcttgaccaagcctgtaa

SEQ ID NO: 7406556 - DNA, 22 bp, Homo sapiens
acaggactgtggaaggatctct

SEQ ID NO: 7406557 - DNA, 22 bp, Homo sapiens
acaggactagatgataaaatgt

SEQ ID NO: 7406558 - DNA, 22 bp, Homo sapiens
acaggactgtgatccagtaacc

SEQ ID NO: 7406559 - DNA, 22 bp, Homo sapiens
acaggacttaagtcatttataa

SEQ ID NO: 7406560 - DNA, 22 bp, Homo sapiens
acaggacatgtaccaggtggtc

SEQ ID NO: 7406561 - DNA, 22 bp, Homo sapiens
acaggacatgtaccaggtggtc

SEQ ID NO: 7406562 - DNA, 22 bp, Homo sapiens
acaggactctctgaaaatgtac

SEQ ID NO: 7406563 - DNA, 22 bp, Homo sapiens
acaggactctctgaaaatgtac

SEQ ID NO: 7406564 - DNA, 22 bp, Homo sapiens
acaggacatggcttctgtgacg

SEQ ID NO: 7406565 - DNA, 22 bp, Homo sapiens
acaggacatggcttctgtgacg

SEQ ID NO: 7406566 - DNA, 22 bp, Homo sapiens
acaggacatggcttctgtgacg

SEQ ID NO: 7406567 - DNA, 22 bp, Homo sapiens
acaggacatgtaccaggtggtc

SEQ ID NO: 7406568 - DNA, 22 bp, Homo sapiens
acaggacatgtaccaggtggtc

SEQ ID NO: 7406569 - DNA, 22 bp, Homo sapiens
acaggacatgtaccaggtggtc

SEQ ID NO: 7406570 - DNA, 22 bp, Homo sapiens
acaggacatgtaccaggtggtc

SEQ ID NO: 7406571 - DNA, 22 bp, Homo sapiens
acaggacatgtaccaggtggtc

SEQ ID NO: 7406572 - DNA, 22 bp, Homo sapiens
acaggacagggaattcgaaatt

SEQ ID NO: 7406573 - DNA, 22 bp, Homo sapiens
acaggacagggaattcgaaatt

SEQ ID NO: 7406574 - DNA, 22 bp, Homo sapiens
acaggacaggtaggattcgcag

SEQ ID NO: 7406575 - DNA, 22 bp, Homo sapiens
acaggacaggtaggattcgcag

SEQ ID NO: 7406576 - DNA, 22 bp, Homo sapiens
acaggacaggctgggctagact

SEQ ID NO: 7406577 - DNA, 22 bp, Homo sapiens
acaggacaggctgggctagact

SEQ ID NO: 7406578 - DNA, 22 bp, Homo sapiens
acaggacagggaattcgaaatt

SEQ ID NO: 7406579 - DNA, 22 bp, Homo sapiens
acaggacagggaattcgaaatt

SEQ ID NO: 7406580 - DNA, 22 bp, Homo sapiens
acaggacaggctgggctagact

SEQ ID NO: 7406581 - DNA, 22 bp, Homo sapiens
acaggacaggctgggctagact

SEQ ID NO: 7406582 - DNA, 22 bp, Homo sapiens
acaggacagtctagtaacagta

SEQ ID NO: 7406583 - DNA, 22 bp, Homo sapiens
acaggacagtctagtaacagta

SEQ ID NO: 7406584 - DNA, 22 bp, Homo sapiens
acaggacagtctagtaacagta

SEQ ID NO: 7406585 - DNA, 22 bp, Homo sapiens
acaggacagtctagtaacagta

SEQ ID NO: 7406586 - DNA, 22 bp, Homo sapiens
acaggacagtctagtaacagta

SEQ ID NO: 7406587 - DNA, 22 bp, Homo sapiens
acaggacagtctagtaacagta

SEQ ID NO: 7406588 - DNA, 22 bp, Homo sapiens
acaggacagtctagtaacagta

SEQ ID NO: 7406589 - DNA, 22 bp, Homo sapiens
acaggacagtctagtaacagta

SEQ ID NO: 7406590 - DNA, 22 bp, Homo sapiens
acaggacatggcttctgtgacg

SEQ ID NO: 7406591 - DNA, 22 bp, Homo sapiens
acaggacatggcttctgtgacg

SEQ ID NO: 7406592 - DNA, 22 bp, Homo sapiens
acaggacatggcttctgtgacg

SEQ ID NO: 7406593 - DNA, 22 bp, Homo sapiens
acaggacatggcttctgtgacg

SEQ ID NO: 7406594 - DNA, 22 bp, Homo sapiens
agcttcttgtagaactcaaaag

SEQ ID NO: 7406595 - DNA, 22 bp, Homo sapiens
agcttcttgtagaactcaaaag

SEQ ID NO: 7406596 - DNA, 22 bp, Homo sapiens
agcttcttgtagaactcaaaag

SEQ ID NO: 7406597 - DNA, 22 bp, Homo sapiens
agcttcttgtatgaagttagag

SEQ ID NO: 7406598 - DNA, 22 bp, Homo sapiens
agcttcttgtatgaagttagag

SEQ ID NO: 7406599 - DNA, 22 bp, Homo sapiens
agcttctttaattcagcatgat

SEQ ID NO: 7406600 - DNA, 19 bp, Homo sapiens
agcttctttggaaacattt

SEQ ID NO: 7406601 - DNA, 22 bp, Homo sapiens
agcttcttttacagctcatgct

SEQ ID NO: 7406602 - DNA, 22 bp, Homo sapiens
agcttcttttacagctcatgct

SEQ ID NO: 7406603 - DNA, 22 bp, Homo sapiens
acaggatcgccctgttgcccag

SEQ ID NO: 7406604 - DNA, 22 bp, Homo sapiens
agcttctttgtgggctccagaa

SEQ ID NO: 7406605 - DNA, 22 bp, Homo sapiens
acaggatgagaatatcatattt

SEQ ID NO: 7406606 - DNA, 22 bp, Homo sapiens
agcttcttttacagctcatgct

SEQ ID NO: 7406607 - DNA, 22 bp, Homo sapiens
acaggatgataaaggatggcca

SEQ ID NO: 7406608 - DNA, 22 bp, Homo sapiens
acaggatgataaaggatggcca

SEQ ID NO: 7406609 - DNA, 22 bp, Homo sapiens
acaggatgagaatatcatattt

SEQ ID NO: 7406610 - DNA, 22 bp, Homo sapiens
acaggatgataaaggatggcca

SEQ ID NO: 7406611 - DNA, 22 bp, Homo sapiens
acaggatgagaatatcatattt

SEQ ID NO: 7406612 - DNA, 20 bp, Homo sapiens
acaggatgcctgccatttca

SEQ ID NO: 7406613 - DNA, 21 bp, Homo sapiens
acaggatgatttttccttatg

SEQ ID NO: 7406614 - DNA, 22 bp, Homo sapiens
acaggatgataaaggatggcca

SEQ ID NO: 7406615 - DNA, 22 bp, Homo sapiens
acaggatgataaaggatggcca

SEQ ID NO: 7406616 - DNA, 22 bp, Homo sapiens
acaggatggccagctgatattg

SEQ ID NO: 7406617 - DNA, 22 bp, Homo sapiens
acaggatggagataatagaaaa

SEQ ID NO: 7406618 - DNA, 20 bp, Homo sapiens
acaggatgcctgccatttca

SEQ ID NO: 7406619 - DNA, 22 bp, Homo sapiens
acaggatggagataatagaaaa

SEQ ID NO: 7406620 - DNA, 22 bp, Homo sapiens
acaggatggagataatagaaaa

SEQ ID NO: 7406621 - DNA, 22 bp, Homo sapiens
acaggatggagataatagaaaa

SEQ ID NO: 7406622 - DNA, 22 bp, Homo sapiens
acaggatggagataatagaaaa

SEQ ID NO: 7406623 - DNA, 22 bp, Homo sapiens
acaggatgggcgcacagagcta

SEQ ID NO: 7406624 - DNA, 22 bp, Homo sapiens
acaggatggccagctgatattg

SEQ ID NO: 7406625 - DNA, 22 bp, Homo sapiens
acaggatgggcgcacagagcta

SEQ ID NO: 7406626 - DNA, 22 bp, Homo sapiens
acaggatgggcgcacagagcta

SEQ ID NO: 7406627 - DNA, 22 bp, Homo sapiens
acaggatggccagctgatattg

SEQ ID NO: 7406628 - DNA, 22 bp, Homo sapiens
acaggatggccagctgatattg

SEQ ID NO: 7406629 - DNA, 22 bp, Homo sapiens
acaggattagcaagtaatcagg

SEQ ID NO: 7406630 - DNA, 22 bp, Homo sapiens
acaggattactggattatgaca

SEQ ID NO: 7406631 - DNA, 22 bp, Homo sapiens
acaggatgggcgcacagagcta

SEQ ID NO: 7406632 - DNA, 22 bp, Homo sapiens
acaggatgggcgcacagagcta

SEQ ID NO: 7406633 - DNA, 22 bp, Homo sapiens
acaggatgggcgcacagagcta

SEQ ID NO: 7406634 - DNA, 22 bp, Homo sapiens
acaggcaagaggaaagcaagta

SEQ ID NO: 7406635 - DNA, 22 bp, Homo sapiens
acaggcaaggccagtgagaaat

SEQ ID NO: 7406636 - DNA, 22 bp, Homo sapiens
acaggcaaggccagtgagaaat

SEQ ID NO: 7406637 - DNA, 22 bp, Homo sapiens
acaggcaagaggaaagcaagta

SEQ ID NO: 7406638 - DNA, 22 bp, Homo sapiens
acaggcaacttcaaatctcact

SEQ ID NO: 7406639 - DNA, 22 bp, Homo sapiens
acaggcaagaggaaagcaagta

SEQ ID NO: 7406640 - DNA, 22 bp, Homo sapiens
acaggcaagtacacaggctcat

SEQ ID NO: 7406641 - DNA, 22 bp, Homo sapiens
acaggcaagtacacaggctcat

SEQ ID NO: 7406642 - DNA, 22 bp, Homo sapiens
acaggcaaggccagtgagaaat

SEQ ID NO: 7406643 - DNA, 22 bp, Homo sapiens
acaggcaagaggaaagcaagta

SEQ ID NO: 7406644 - DNA, 22 bp, Homo sapiens
acaggcaaggccagtgagaaat

SEQ ID NO: 7406645 - DNA, 22 bp, Homo sapiens
acaggcaaacacagaaagtagg

SEQ ID NO: 7406646 - DNA, 22 bp, Homo sapiens
acaggcaaacacagaaagtagg

SEQ ID NO: 7406647 - DNA, 22 bp, Homo sapiens
acaggcaaacacagaaagtagg

SEQ ID NO: 7406648 - DNA, 22 bp, Homo sapiens
acaggcaacttcaaatctcact

SEQ ID NO: 7406649 - DNA, 21 bp, Homo sapiens
acaggcaaattttagacaatg

SEQ ID NO: 7406650 - DNA, 21 bp, Homo sapiens
acaggcaaattttagacaatg

SEQ ID NO: 7406651 - DNA, 21 bp, Homo sapiens
acaggcaaattttagacaatg

SEQ ID NO: 7406652 - DNA, 22 bp, Homo sapiens
acaggcaaagggtcagtagcag

SEQ ID NO: 7406653 - DNA, 22 bp, Homo sapiens
acaggcaagtcacacaacttgt

SEQ ID NO: 7406654 - DNA, 22 bp, Homo sapiens
acaggcaagtcacacaacttgt

SEQ ID NO: 7406655 - DNA, 22 bp, Homo sapiens
acaggcacaactgagtagactc

SEQ ID NO: 7406656 - DNA, 22 bp, Homo sapiens
acaggcacaactgagtagactc

SEQ ID NO: 7406657 - DNA, 22 bp, Homo sapiens
acaggcacaactgagtagactc

SEQ ID NO: 7406658 - DNA, 21 bp, Homo sapiens
acaggcaatttcatatggttc

SEQ ID NO: 7406659 - DNA, 22 bp, Homo sapiens
acaggcaattagcaagctgtta

SEQ ID NO: 7406660 - DNA, 22 bp, Homo sapiens
acaggcaattagcaagctgtta

SEQ ID NO: 7406661 - DNA, 22 bp, Homo sapiens
aggaaagaagtacattctcatg

SEQ ID NO: 7406662 - DNA, 22 bp, Homo sapiens
aggaaagaagtacattctcatg

SEQ ID NO: 7406663 - DNA, 22 bp, Homo sapiens
aggaaagaagtacattctcatg

SEQ ID NO: 7406664 - DNA, 18 bp, Homo sapiens
aggaaagaaaggcaggtg

SEQ ID NO: 7406665 - DNA, 18 bp, Homo sapiens
aggaaagaaaggcaggtg

SEQ ID NO: 7406666 - DNA, 22 bp, Homo sapiens
aggaaagaagtacattctcatg

SEQ ID NO: 7406667 - DNA, 22 bp, Homo sapiens
aggaaagaagtacattctcatg

SEQ ID NO: 7406668 - DNA, 22 bp, Homo sapiens
aggaaaggggtaggtgtggacg

SEQ ID NO: 7406669 - DNA, 22 bp, Homo sapiens
aggaaagaagtacattctcatg

SEQ ID NO: 7406670 - DNA, 22 bp, Homo sapiens
aggaaagaagtacattctcatg

SEQ ID NO: 7406671 - DNA, 22 bp, Homo sapiens
aggaaagaagtacattctcatg

SEQ ID NO: 7406672 - DNA, 22 bp, Homo sapiens
acaggcacaccttcctgcaggc

SEQ ID NO: 7406673 - DNA, 18 bp, Homo sapiens
aggaaagaaaggcaggtg

SEQ ID NO: 7406674 - DNA, 18 bp, Homo sapiens
aggaaagaaaggcaggtg

SEQ ID NO: 7406675 - DNA, 22 bp, Homo sapiens
acagcagtttagaggacagcca

SEQ ID NO: 7406676 - DNA, 22 bp, Homo sapiens
acagcagtttagaggacagcca

SEQ ID NO: 7406677 - DNA, 22 bp, Homo sapiens
acagcataatcacttctttctt

SEQ ID NO: 7406678 - DNA, 22 bp, Homo sapiens
acagcatcatatagtggaagaa

SEQ ID NO: 7406679 - DNA, 22 bp, Homo sapiens
acagcatcatatagtggaagaa

SEQ ID NO: 7406680 - DNA, 22 bp, Homo sapiens
acagcatccctgaagataacca

SEQ ID NO: 7406681 - DNA, 22 bp, Homo sapiens
acagcatccctgaagataacca

SEQ ID NO: 7406682 - DNA, 22 bp, Homo sapiens
acagcatcatatagtggaagaa

SEQ ID NO: 7406683 - DNA, 22 bp, Homo sapiens
acagcatctagtacagtctagt

SEQ ID NO: 7406684 - DNA, 22 bp, Homo sapiens
acagcatccttctaaagtagct

SEQ ID NO: 7406685 - DNA, 22 bp, Homo sapiens
acagcatggataacaaggcact

SEQ ID NO: 7406686 - DNA, 22 bp, Homo sapiens
acagcatctagtacagtctagt

SEQ ID NO: 7406687 - DNA, 22 bp, Homo sapiens
acagcatctagtacagtctagt

SEQ ID NO: 7406688 - DNA, 22 bp, Homo sapiens
acagcatgagagatgaacattc

SEQ ID NO: 7406689 - DNA, 22 bp, Homo sapiens
acagcatctagtacagtctagt

SEQ ID NO: 7406690 - DNA, 22 bp, Homo sapiens
acagcatctagtacagtctagt

SEQ ID NO: 7406691 - DNA, 22 bp, Homo sapiens
acagcatggataacaaggcact

SEQ ID NO: 7406692 - DNA, 22 bp, Homo sapiens
acagcatgtctagttaaatact

SEQ ID NO: 7406693 - DNA, 22 bp, Homo sapiens
acagcatgtctagttaaatact

SEQ ID NO: 7406694 - DNA, 22 bp, Homo sapiens
acagcagttaacgatcagactc

SEQ ID NO: 7406695 - DNA, 22 bp, Homo sapiens
acagcagttaacgatcagactc

SEQ ID NO: 7406696 - DNA, 22 bp, Homo sapiens
acagcagttaacgatcagactc

SEQ ID NO: 7406697 - DNA, 22 bp, Homo sapiens
acagcagttactgaaataaagt

SEQ ID NO: 7406698 - DNA, 22 bp, Homo sapiens
acagcagttactgaaataaagt

SEQ ID NO: 7406699 - DNA, 22 bp, Homo sapiens
acagcagttcaggccgcagagg

SEQ ID NO: 7406700 - DNA, 22 bp, Homo sapiens
acagcagtttagaggacagcca

SEQ ID NO: 7406701 - DNA, 22 bp, Homo sapiens
acagcagttactgaaataaagt

SEQ ID NO: 7406702 - DNA, 22 bp, Homo sapiens
acagcagttactgaaataaagt

SEQ ID NO: 7406703 - DNA, 22 bp, Homo sapiens
acagcagttaacgatcagactc

SEQ ID NO: 7406704 - DNA, 22 bp, Homo sapiens
acagcagtgtctggtactgagt

SEQ ID NO: 7406705 - DNA, 22 bp, Homo sapiens
acagcagtgtctggtactgagt

SEQ ID NO: 7406706 - DNA, 22 bp, Homo sapiens
acagcagtggtgcactgagcca

SEQ ID NO: 7406707 - DNA, 22 bp, Homo sapiens
acagcagtggtgcactgagcca

SEQ ID NO: 7406708 - DNA, 22 bp, Homo sapiens
acagcagtggtgcactgagcca

SEQ ID NO: 7406709 - DNA, 22 bp, Homo sapiens
acagcagtgggttgccagtggg

SEQ ID NO: 7406710 - DNA, 22 bp, Homo sapiens
acagcagtgggttgccagtggg

SEQ ID NO: 7406711 - DNA, 22 bp, Homo sapiens
acagcagtgggttgccagtggg

SEQ ID NO: 7406712 - DNA, 22 bp, Homo sapiens
acagccaacgtctttcttactt

SEQ ID NO: 7406713 - DNA, 22 bp, Homo sapiens
acagccaaggaattaggaaggg

SEQ ID NO: 7406714 - DNA, 22 bp, Homo sapiens
acagccactcaaagggccgaag

SEQ ID NO: 7406715 - DNA, 22 bp, Homo sapiens
acagccactcaaagggccgaag

SEQ ID NO: 7406716 - DNA, 22 bp, Homo sapiens
acagccaaggaattaggaaggg

SEQ ID NO: 7406717 - DNA, 22 bp, Homo sapiens
acagccagaagtcagggtggga

SEQ ID NO: 7406718 - DNA, 22 bp, Homo sapiens
acagccagaagtcagggtggga

SEQ ID NO: 7406719 - DNA, 22 bp, Homo sapiens
acagccagaagtcagggtggga

SEQ ID NO: 7406720 - DNA, 22 bp, Homo sapiens
acagccagaagtcagggtggga

SEQ ID NO: 7406721 - DNA, 22 bp, Homo sapiens
acagccactcaaagggccgaag

SEQ ID NO: 7406722 - DNA, 22 bp, Homo sapiens
acagccactcaaagggccgaag

SEQ ID NO: 7406723 - DNA, 22 bp, Homo sapiens
acagccactcaaagggccgaag

SEQ ID NO: 7406724 - DNA, 22 bp, Homo sapiens
acagccactcaaagggccgaag

SEQ ID NO: 7406725 - DNA, 22 bp, Homo sapiens
acagccagaggagccaggctgg

SEQ ID NO: 7406726 - DNA, 22 bp, Homo sapiens
acagccagaggagccaggctgg

SEQ ID NO: 7406727 - DNA, 22 bp, Homo sapiens
acagccagaggagccaggctgg

SEQ ID NO: 7406728 - DNA, 22 bp, Homo sapiens
acagccagaggagccaggctgg

SEQ ID NO: 7406729 - DNA, 22 bp, Homo sapiens
acagccagaggagccaggctgg

SEQ ID NO: 7406730 - DNA, 20 bp, Homo sapiens
acagccagaggaggcagaca

SEQ ID NO: 7406731 - DNA, 22 bp, Homo sapiens
acagccagaggagccaggctgg

SEQ ID NO: 7406732 - DNA, 22 bp, Homo sapiens
acagccagaggagccaggctgg

SEQ ID NO: 7406733 - DNA, 22 bp, Homo sapiens
acagccagaggagccaggctgg

SEQ ID NO: 7406734 - DNA, 22 bp, Homo sapiens
acagcatttaaagaaaatgaac

SEQ ID NO: 7406735 - DNA, 22 bp, Homo sapiens
acagcattgctccatctcaaga

SEQ ID NO: 7406736 - DNA, 22 bp, Homo sapiens
acagcattgctccatctcaaga

SEQ ID NO: 7406737 - DNA, 22 bp, Homo sapiens
acagcattgctccatctcaaga

SEQ ID NO: 7406738 - DNA, 22 bp, Homo sapiens
acagcattgctccatctcaaga

SEQ ID NO: 7406739 - DNA, 22 bp, Homo sapiens
acagcatttaaagaaaatgaac

SEQ ID NO: 7406740 - DNA, 22 bp, Homo sapiens
acagcatttaaagaaaatgaac

SEQ ID NO: 7406741 - DNA, 22 bp, Homo sapiens
acagcatttaaagaaaatgaac

SEQ ID NO: 7406742 - DNA, 22 bp, Homo sapiens
acagcatttaaagaaaatgaac

SEQ ID NO: 7406743 - DNA, 22 bp, Homo sapiens
acagcattccctttggctgctt

SEQ ID NO: 7406744 - DNA, 22 bp, Homo sapiens
acagcattccctttggctgctt

SEQ ID NO: 7406745 - DNA, 22 bp, Homo sapiens
acagcattcaataaataataac

SEQ ID NO: 7406746 - DNA, 22 bp, Homo sapiens
acagcattcaataaataataac

SEQ ID NO: 7406747 - DNA, 21 bp, Homo sapiens
acagcatgtttgtgtgtttgc

SEQ ID NO: 7406748 - DNA, 21 bp, Homo sapiens
acagcatgtttgtgtgtttgc

SEQ ID NO: 7406749 - DNA, 22 bp, Homo sapiens
acaggaagaaagtgcagtagat

SEQ ID NO: 7406750 - DNA, 22 bp, Homo sapiens
acaggaagaaagtgcagtagat

SEQ ID NO: 7406751 - DNA, 22 bp, Homo sapiens
acaggaagaaagtgcagtagat

SEQ ID NO: 7406752 - DNA, 22 bp, Homo sapiens
acaggaagaaagtgcagtagat

SEQ ID NO: 7406753 - DNA, 22 bp, Homo sapiens
acaggaagaaagtgcagtagat

SEQ ID NO: 7406754 - DNA, 22 bp, Homo sapiens
acaggaactgttatctcagatg

SEQ ID NO: 7406755 - DNA, 22 bp, Homo sapiens
acaggaactgttatctcagatg

SEQ ID NO: 7406756 - DNA, 22 bp, Homo sapiens
acagcttcttgtttcccaggag

SEQ ID NO: 7406757 - DNA, 22 bp, Homo sapiens
acaggaacgaatgtacattgtt

SEQ ID NO: 7406758 - DNA, 22 bp, Homo sapiens
acaggaacgaatgtacattgtt

SEQ ID NO: 7406759 - DNA, 22 bp, Homo sapiens
acagccagaggagccaggctgg

SEQ ID NO: 7406760 - DNA, 20 bp, Homo sapiens
acagccagaggaggcagaca

SEQ ID NO: 7406761 - DNA, 22 bp, Homo sapiens
acagcttcgaggatctcatccc

SEQ ID NO: 7406762 - DNA, 22 bp, Homo sapiens
acagcttctatttctctgtact

SEQ ID NO: 7406763 - DNA, 22 bp, Homo sapiens
acagcttctatttctctgtact

SEQ ID NO: 7406764 - DNA, 22 bp, Homo sapiens
acagcttctcctcgatgtcatg

SEQ ID NO: 7406765 - DNA, 22 bp, Homo sapiens
acagcttctcctcgatgtcatg

SEQ ID NO: 7406766 - DNA, 22 bp, Homo sapiens
acagcttctctgaaattcatgt

SEQ ID NO: 7406767 - DNA, 22 bp, Homo sapiens
acagcttctctgaaattcatgt

SEQ ID NO: 7406768 - DNA, 22 bp, Homo sapiens
acaggaagtgggaagaaacagg

SEQ ID NO: 7406769 - DNA, 22 bp, Homo sapiens
acaggaagtgggaagaaacagg

SEQ ID NO: 7406770 - DNA, 22 bp, Homo sapiens
acaggaagtgggaagaaacagg

SEQ ID NO: 7406771 - DNA, 22 bp, Homo sapiens
acaggaagtgggaagaaacagg

SEQ ID NO: 7406772 - DNA, 22 bp, Homo sapiens
acaggaagtgggaagaaacagg

SEQ ID NO: 7406773 - DNA, 22 bp, Homo sapiens
acaggaagtgggaagaaacagg

SEQ ID NO: 7406774 - DNA, 22 bp, Homo sapiens
acaggaagtgctggcacttaca

SEQ ID NO: 7406775 - DNA, 22 bp, Homo sapiens
acaggaagtgctggcacttaca

SEQ ID NO: 7406776 - DNA, 22 bp, Homo sapiens
acaggaagtgctggcacttaca

SEQ ID NO: 7406777 - DNA, 22 bp, Homo sapiens
acaggaagaaagtgcagtagat

SEQ ID NO: 7406778 - DNA, 22 bp, Homo sapiens
acaggaagaaagtgcagtagat

SEQ ID NO: 7406779 - DNA, 22 bp, Homo sapiens
acaggaagaaagtgcagtagat

SEQ ID NO: 7406780 - DNA, 22 bp, Homo sapiens
acaggaagaaagtgcagtagat

SEQ ID NO: 7406781 - DNA, 22 bp, Homo sapiens
acaggaagaaagtgcagtagat

SEQ ID NO: 7406782 - DNA, 22 bp, Homo sapiens
acaggaagctggagacccttga

SEQ ID NO: 7406783 - DNA, 22 bp, Homo sapiens
acaggaagctggagacccttga

SEQ ID NO: 7406784 - DNA, 22 bp, Homo sapiens
acaggaagctggagacccttga

SEQ ID NO: 7406785 - DNA, 22 bp, Homo sapiens
acaggaagctggagacccttga

SEQ ID NO: 7406786 - DNA, 22 bp, Homo sapiens
acaggaagtgctggcacttaca

SEQ ID NO: 7406787 - DNA, 22 bp, Homo sapiens
acaggaagtgctggcacttaca

SEQ ID NO: 7406788 - DNA, 22 bp, Homo sapiens
acaggaagtgctggcacttaca

SEQ ID NO: 7406789 - DNA, 22 bp, Homo sapiens
acaggaagtgctggcacttaca

SEQ ID NO: 7406790 - DNA, 22 bp, Homo sapiens
acaggacaactcagcagccagc

SEQ ID NO: 7406791 - DNA, 22 bp, Homo sapiens
acaggacaactcagcagccagc

SEQ ID NO: 7406792 - DNA, 22 bp, Homo sapiens
acaggacaactcagcagccagc

SEQ ID NO: 7406793 - DNA, 22 bp, Homo sapiens
acaggacaaaaatctggatggc

SEQ ID NO: 7406794 - DNA, 22 bp, Homo sapiens
acaggacaaaaatctggatggc

SEQ ID NO: 7406795 - DNA, 22 bp, Homo sapiens
acaggacaaaaatctggatggc

SEQ ID NO: 7406796 - DNA, 22 bp, Homo sapiens
acaggacaactcagcagccagc

SEQ ID NO: 7406797 - DNA, 22 bp, Homo sapiens
acaggacaactcagcagccagc

SEQ ID NO: 7406798 - DNA, 22 bp, Homo sapiens
acaggacaactcagcagccagc

SEQ ID NO: 7406799 - DNA, 22 bp, Homo sapiens
acaggacaactcagcagccagc

SEQ ID NO: 7406800 - DNA, 22 bp, Homo sapiens
acaggacaaggggaagaagata

SEQ ID NO: 7406801 - DNA, 22 bp, Homo sapiens
acaggacaatttataatgggca

SEQ ID NO: 7406802 - DNA, 22 bp, Homo sapiens
acaggacaaggggaagaagata

SEQ ID NO: 7406803 - DNA, 22 bp, Homo sapiens
acaggacaaggggaagaagata

SEQ ID NO: 7406804 - DNA, 22 bp, Homo sapiens
acaggacaaggggaagaagata

SEQ ID NO: 7406805 - DNA, 22 bp, Homo sapiens
acaggacaatttataatgggca

SEQ ID NO: 7406806 - DNA, 22 bp, Homo sapiens
acaggacaggctgggctagact

SEQ ID NO: 7406807 - DNA, 22 bp, Homo sapiens
acaggacaggctgggctagact

SEQ ID NO: 7406808 - DNA, 22 bp, Homo sapiens
acaggaagtttggaaagcctca

SEQ ID NO: 7406809 - DNA, 22 bp, Homo sapiens
acaggaataaaaggaataagga

SEQ ID NO: 7406810 - DNA, 22 bp, Homo sapiens
acaggaatttcctaatattcga

SEQ ID NO: 7406811 - DNA, 22 bp, Homo sapiens
acaggaatttcctaatattcga

SEQ ID NO: 7406812 - DNA, 22 bp, Homo sapiens
acaggaagtttggaaagcctca

SEQ ID NO: 7406813 - DNA, 22 bp, Homo sapiens
acaggaagtttggaaagcctca

SEQ ID NO: 7406814 - DNA, 23 bp, Homo sapiens
acaggaatttgtgcaccatgaag

SEQ ID NO: 7406815 - DNA, 22 bp, Homo sapiens
acaggaatttcctaatattcga

SEQ ID NO: 7406816 - DNA, 23 bp, Homo sapiens
acaggaatttgtgcaccatgaag

SEQ ID NO: 7406817 - DNA, 22 bp, Homo sapiens
acaggacaaaaatctggatggc

SEQ ID NO: 7406818 - DNA, 22 bp, Homo sapiens
acaggacaaaaatctggatggc

SEQ ID NO: 7406819 - DNA, 22 bp, Homo sapiens
acaggaagtttggaaagcctca

SEQ ID NO: 7406820 - DNA, 22 bp, Homo sapiens
acaggaagtttggaaagcctca

SEQ ID NO: 7406821 - DNA, 22 bp, Homo sapiens
acaggaagtttggaaagcctca

SEQ ID NO: 7406822 - DNA, 22 bp, Homo sapiens
acaggaagtgggaagaaacagg

SEQ ID NO: 7406823 - DNA, 22 bp, Homo sapiens
acaggaagtttggaaagcctca

SEQ ID NO: 7406824 - DNA, 22 bp, Homo sapiens
acaggaagtttggaaagcctca

SEQ ID NO: 7406825 - DNA, 22 bp, Homo sapiens
acaggaagtttggaaagcctca

SEQ ID NO: 7406826 - DNA, 22 bp, Homo sapiens
acaggaagtttggaaagcctca

SEQ ID NO: 7406827 - DNA, 22 bp, Homo sapiens
acaggaagtttggaaagcctca

SEQ ID NO: 7406828 - DNA, 22 bp, Homo sapiens
acaggaagtttggaaagcctca

SEQ ID NO: 7406829 - DNA, 22 bp, Homo sapiens
acaggaagtttggaaagcctca

SEQ ID NO: 7406830 - DNA, 22 bp, Homo sapiens
acaggaagtgggaagaaacagg

SEQ ID NO: 7406831 - DNA, 22 bp, Homo sapiens
acaggaagtgggaagaaacagg

SEQ ID NO: 7406832 - DNA, 22 bp, Homo sapiens
acaggaagtgggaagaaacagg

SEQ ID NO: 7406833 - DNA, 22 bp, Homo sapiens
acaggaagtgggaagaaacagg

SEQ ID NO: 7406834 - DNA, 22 bp, Homo sapiens
acaggaagtgggaagaaacagg

SEQ ID NO: 7406835 - DNA, 22 bp, Homo sapiens
acaggaagtgggaagaaacagg

SEQ ID NO: 7406836 - DNA, 22 bp, Homo sapiens
acaggaagtgggaagaaacagg

SEQ ID NO: 7406837 - DNA, 22 bp, Homo sapiens
aggacttagaacattatgtact

SEQ ID NO: 7406838 - DNA, 22 bp, Homo sapiens
aggacttagaacattatgtact

SEQ ID NO: 7406839 - DNA, 22 bp, Homo sapiens
aggacttagaacattatgtact

SEQ ID NO: 7406840 - DNA, 22 bp, Homo sapiens
aggactgttttttcttctaggg

SEQ ID NO: 7406841 - DNA, 22 bp, Homo sapiens
aggacttcaaatggaaacaaaa

SEQ ID NO: 7406842 - DNA, 22 bp, Homo sapiens
acagtctggaagcagggggcaa

SEQ ID NO: 7406843 - DNA, 22 bp, Homo sapiens
acagtgaaaagaatattagaat

SEQ ID NO: 7406844 - DNA, 22 bp, Homo sapiens
acagtctgtcccccaggtgcta

SEQ ID NO: 7406845 - DNA, 22 bp, Homo sapiens
acagtgaaaagaatattagaat

SEQ ID NO: 7406846 - DNA, 22 bp, Homo sapiens
acagtgaaaagaatattagaat

SEQ ID NO: 7406847 - DNA, 22 bp, Homo sapiens
acagtgaaaagaatattagaat

SEQ ID NO: 7406848 - DNA, 22 bp, Homo sapiens
acagtctgtcccccaggtgcta

SEQ ID NO: 7406849 - DNA, 22 bp, Homo sapiens
acagtctggcaggtgttgaaag

SEQ ID NO: 7406850 - DNA, 22 bp, Homo sapiens
acagtctgtcccccaggtgcta

SEQ ID NO: 7406851 - DNA, 22 bp, Homo sapiens
acagtctggaggctgcttcatt

SEQ ID NO: 7406852 - DNA, 22 bp, Homo sapiens
acagtctggaggctgcttcatt

SEQ ID NO: 7406853 - DNA, 22 bp, Homo sapiens
acagtctggaggctgcttcatt

SEQ ID NO: 7406854 - DNA, 22 bp, Homo sapiens
acagtgaatgagaatggagaaa

SEQ ID NO: 7406855 - DNA, 22 bp, Homo sapiens
acagtgaatgagaatggagaaa

SEQ ID NO: 7406856 - DNA, 22 bp, Homo sapiens
acagtgaatccaaattcctacc

SEQ ID NO: 7406857 - DNA, 22 bp, Homo sapiens
acagtgaataagacatgtgctt

SEQ ID NO: 7406858 - DNA, 22 bp, Homo sapiens
acagtgaataagacatgtgctt

SEQ ID NO: 7406859 - DNA, 23 bp, Homo sapiens
acagtgaaacacgcagtaagagt

SEQ ID NO: 7406860 - DNA, 23 bp, Homo sapiens
acagtgaaacacgcagtaagagt

SEQ ID NO: 7406861 - DNA, 22 bp, Homo sapiens
acagtgaataagacatgtgctt

SEQ ID NO: 7406862 - DNA, 23 bp, Homo sapiens
acagtgaaacacgcagtaagagt

SEQ ID NO: 7406863 - DNA, 23 bp, Homo sapiens
acagtgaaacacgcagtaagagt

SEQ ID NO: 7406864 - DNA, 23 bp, Homo sapiens
acagtgaaacacgcagtaagagt

SEQ ID NO: 7406865 - DNA, 22 bp, Homo sapiens
acagtgaaaagtagctaacaca

SEQ ID NO: 7406866 - DNA, 22 bp, Homo sapiens
acagtgaaaagtagctaacaca

SEQ ID NO: 7406867 - DNA, 22 bp, Homo sapiens
acagtgaaaagtagctaacaca

SEQ ID NO: 7406868 - DNA, 22 bp, Homo sapiens
acagtgaaaagtagctaacaca

SEQ ID NO: 7406869 - DNA, 22 bp, Homo sapiens
acagtgaaaataatatcttcaa

SEQ ID NO: 7406870 - DNA, 22 bp, Homo sapiens
acagtgaaaataatatcttcaa

SEQ ID NO: 7406871 - DNA, 22 bp, Homo sapiens
acagtgaaaattctattgattt

SEQ ID NO: 7406872 - DNA, 22 bp, Homo sapiens
aggaggcaggaagtctatggga

SEQ ID NO: 7406873 - DNA, 22 bp, Homo sapiens
aggaggcaggaagtctatggga

SEQ ID NO: 7406874 - DNA, 22 bp, Homo sapiens
aggaggcagtctgtcccttagc

SEQ ID NO: 7406875 - DNA, 22 bp, Homo sapiens
aggaggcagtctgtcccttagc

SEQ ID NO: 7406876 - DNA, 22 bp, Homo sapiens
aggaggcagtctgtcccttagc

SEQ ID NO: 7406877 - DNA, 22 bp, Homo sapiens
acagtgaggaagcagctgtgct

SEQ ID NO: 7406878 - DNA, 22 bp, Homo sapiens
acagtgaggaagcagctgtgct

SEQ ID NO: 7406879 - DNA, 22 bp, Homo sapiens
acagtgaggaagcagctgtgct

SEQ ID NO: 7406880 - DNA, 22 bp, Homo sapiens
acagtgaggaagcagctgtgct

SEQ ID NO: 7406881 - DNA, 22 bp, Homo sapiens
acagtgagatccaagggcaggc

SEQ ID NO: 7406882 - DNA, 22 bp, Homo sapiens
acagtgagatccaagggcaggc

SEQ ID NO: 7406883 - DNA, 22 bp, Homo sapiens
acagtgagatccaagggcaggc

SEQ ID NO: 7406884 - DNA, 22 bp, Homo sapiens
acagtgagcccactccaggaga

SEQ ID NO: 7406885 - DNA, 22 bp, Homo sapiens
acagtgagcggtagtgattgct

SEQ ID NO: 7406886 - DNA, 22 bp, Homo sapiens
acagtgagcggtagtgattgct

SEQ ID NO: 7406887 - DNA, 22 bp, Homo sapiens
acagtgagcccactccaggaga

SEQ ID NO: 7406888 - DNA, 22 bp, Homo sapiens
acagtgagcccactccaggaga

SEQ ID NO: 7406889 - DNA, 22 bp, Homo sapiens
acagtgacgtttatttgagacg

SEQ ID NO: 7406890 - DNA, 21 bp, Homo sapiens
acagtgagaaataaatggaaa

SEQ ID NO: 7406891 - DNA, 22 bp, Homo sapiens
acagtgacgtttatttgagacg

SEQ ID NO: 7406892 - DNA, 21 bp, Homo sapiens
acagtgagaaataaatggaaa

SEQ ID NO: 7406893 - DNA, 22 bp, Homo sapiens
acagtgagatccaagggcaggc

SEQ ID NO: 7406894 - DNA, 17 bp, Homo sapiens
acagtgagaagtcatct

SEQ ID NO: 7406895 - DNA, 22 bp, Homo sapiens
acagtgagatccaagggcaggc

SEQ ID NO: 7406896 - DNA, 17 bp, Homo sapiens
acagtgagaagtcatct

SEQ ID NO: 7406897 - DNA, 17 bp, Homo sapiens
acagtgagaagtcatct

SEQ ID NO: 7406898 - DNA, 17 bp, Homo sapiens
acagtgagaagtcatct

SEQ ID NO: 7406899 - DNA, 22 bp, Homo sapiens
acagtgacaacccaggataaat

SEQ ID NO: 7406900 - DNA, 22 bp, Homo sapiens
acagtgacactcaggtgggatg

SEQ ID NO: 7406901 - DNA, 22 bp, Homo sapiens
acagtgacactcaggtgggatg

SEQ ID NO: 7406902 - DNA, 22 bp, Homo sapiens
acagtgaatgcccaagaaaagt

SEQ ID NO: 7406903 - DNA, 22 bp, Homo sapiens
acagtgaatgcccaagaaaagt

SEQ ID NO: 7406904 - DNA, 22 bp, Homo sapiens
acagtgaatgcccaagaaaagt

SEQ ID NO: 7406905 - DNA, 22 bp, Homo sapiens
acagtgaatgcccaagaaaagt

SEQ ID NO: 7406906 - DNA, 22 bp, Homo sapiens
acagtgaatgcccaagaaaagt

SEQ ID NO: 7406907 - DNA, 22 bp, Homo sapiens
acagtgaatgcccaagaaaagt

SEQ ID NO: 7406908 - DNA, 22 bp, Homo sapiens
acagtgaatgcccaagaaaagt

SEQ ID NO: 7406909 - DNA, 22 bp, Homo sapiens
acagtgaatgagaatggagaaa

SEQ ID NO: 7406910 - DNA, 22 bp, Homo sapiens
acagtgaatgagaatggagaaa

SEQ ID NO: 7406911 - DNA, 22 bp, Homo sapiens
acagtgaatgagaatggagaaa

SEQ ID NO: 7406912 - DNA, 22 bp, Homo sapiens
acagtgaataagacatgtgctt

SEQ ID NO: 7406913 - DNA, 22 bp, Homo sapiens
aggaggccaggccctcaagcct

SEQ ID NO: 7406914 - DNA, 22 bp, Homo sapiens
aggaggccaggccctcaagcct

SEQ ID NO: 7406915 - DNA, 21 bp, Homo sapiens
aggaggccagtactgctgaac

SEQ ID NO: 7406916 - DNA, 22 bp, Homo sapiens
aggaggccaggccctcaagcct

SEQ ID NO: 7406917 - DNA, 21 bp, Homo sapiens
aggaggccagtactgctgaac

SEQ ID NO: 7406918 - DNA, 21 bp, Homo sapiens
aggaggccagtactgctgaac

SEQ ID NO: 7406919 - DNA, 22 bp, Homo sapiens
aggaggccaggccctcaagcct

SEQ ID NO: 7406920 - DNA, 20 bp, Homo sapiens
aggaggcatagtctggaaag

SEQ ID NO: 7406921 - DNA, 20 bp, Homo sapiens
aggaggccaaagtaatgggg

SEQ ID NO: 7406922 - DNA, 20 bp, Homo sapiens
aggaggccaaagtaatgggg

SEQ ID NO: 7406923 - DNA, 20 bp, Homo sapiens
aggaggcatgaggggattta

SEQ ID NO: 7406924 - DNA, 22 bp, Homo sapiens
aggaggccaggccctcaagcct

SEQ ID NO: 7406925 - DNA, 22 bp, Homo sapiens
aggaggccaggccctcaagcct

SEQ ID NO: 7406926 - DNA, 22 bp, Homo sapiens
aggaggcagtctgtcccttagc

SEQ ID NO: 7406927 - DNA, 20 bp, Homo sapiens
aggaggcatagtctggaaag

SEQ ID NO: 7406928 - DNA, 20 bp, Homo sapiens
aggaggcatagtctggaaag

SEQ ID NO: 7406929 - DNA, 20 bp, Homo sapiens
aggaggcatagtctggaaag

SEQ ID NO: 7406930 - DNA, 20 bp, Homo sapiens
aggaggcatagtctggaaag

SEQ ID NO: 7406931 - DNA, 20 bp, Homo sapiens
aggaggcatgaggggattta

SEQ ID NO: 7406932 - DNA, 20 bp, Homo sapiens
aggaggcatgaggggattta

SEQ ID NO: 7406933 - DNA, 20 bp, Homo sapiens
aggaggcatgaggggattta

SEQ ID NO: 7406934 - DNA, 20 bp, Homo sapiens
aggaggcatagtctggaaag

SEQ ID NO: 7406935 - DNA, 20 bp, Homo sapiens
aggaggcatgaggggattta

SEQ ID NO: 7406936 - DNA, 22 bp, Homo sapiens
aggaggccctagagctctagag

SEQ ID NO: 7406937 - DNA, 22 bp, Homo sapiens
aggaggccctagagctctagag

SEQ ID NO: 7406938 - DNA, 22 bp, Homo sapiens
aggaggccctagagctctagag

SEQ ID NO: 7406939 - DNA, 22 bp, Homo sapiens
aggaggcccctcctgggttgct

SEQ ID NO: 7406940 - DNA, 22 bp, Homo sapiens
aggaggccctagagctctagag

SEQ ID NO: 7406941 - DNA, 22 bp, Homo sapiens
aggaggccctagagctctagag

SEQ ID NO: 7406942 - DNA, 22 bp, Homo sapiens
aggaggcccctcctgggttgct

SEQ ID NO: 7406943 - DNA, 19 bp, Homo sapiens
aggaggccatgccactaga

SEQ ID NO: 7406944 - DNA, 19 bp, Homo sapiens
aggaggccatgccactaga

SEQ ID NO: 7406945 - DNA, 22 bp, Homo sapiens
aggaggccatcagttccttcct

SEQ ID NO: 7406946 - DNA, 22 bp, Homo sapiens
aggaggccatcagttccttcct

SEQ ID NO: 7406947 - DNA, 21 bp, Homo sapiens
aggaggccagtactgctgaac

SEQ ID NO: 7406948 - DNA, 19 bp, Homo sapiens
aggaggccatgccactaga

SEQ ID NO: 7406949 - DNA, 19 bp, Homo sapiens
aggaggccatgccactaga

SEQ ID NO: 7406950 - DNA, 22 bp, Homo sapiens
aggaggccatgtactaggttcc

SEQ ID NO: 7406951 - DNA, 22 bp, Homo sapiens
aggaggccatgtactaggttcc

SEQ ID NO: 7406952 - DNA, 22 bp, Homo sapiens
aggaggccattctctcagtagc

SEQ ID NO: 7406953 - DNA, 22 bp, Homo sapiens
aggaggcccctcctgggttgct

SEQ ID NO: 7406954 - DNA, 17 bp, Homo sapiens
aggaggccctggcgttt

SEQ ID NO: 7406955 - DNA, 17 bp, Homo sapiens
aggaggccctggcgttt

SEQ ID NO: 7406956 - DNA, 22 bp, Homo sapiens
aggaggccctagagctctagag

SEQ ID NO: 7406957 - DNA, 22 bp, Homo sapiens
aggaggccctggttaatgttta

SEQ ID NO: 7406958 - DNA, 17 bp, Homo sapiens
aggaggccctggcgttt

SEQ ID NO: 7406959 - DNA, 17 bp, Homo sapiens
aggaggccctggcgttt

SEQ ID NO: 7406960 - DNA, 22 bp, Homo sapiens
aggaggccgatttcagaggtcg

SEQ ID NO: 7406961 - DNA, 22 bp, Homo sapiens
aggaggccgatttcagaggtcg

SEQ ID NO: 7406962 - DNA, 22 bp, Homo sapiens
acagtgcagggcgggaagaagg

SEQ ID NO: 7406963 - DNA, 22 bp, Homo sapiens
acagtgcagggcgggaagaagg

SEQ ID NO: 7406964 - DNA, 22 bp, Homo sapiens
aggaggccgatttcagaggtcg

SEQ ID NO: 7406965 - DNA, 22 bp, Homo sapiens
acagtgcagggtgggaagaagg

SEQ ID NO: 7406966 - DNA, 22 bp, Homo sapiens
acagtgcagggtgggaagaagg

SEQ ID NO: 7406967 - DNA, 22 bp, Homo sapiens
acagtgcagggtgggaagaagg

SEQ ID NO: 7406968 - DNA, 22 bp, Homo sapiens
acagtgcagggcgggaagaagg

SEQ ID NO: 7406969 - DNA, 22 bp, Homo sapiens
acagtgcttagcacagagtaga

SEQ ID NO: 7406970 - DNA, 22 bp, Homo sapiens
acagtgcttagcacagagtaga

SEQ ID NO: 7406971 - DNA, 22 bp, Homo sapiens
acagtgcttagcacagagtaga

SEQ ID NO: 7406972 - DNA, 22 bp, Homo sapiens
acagtgcttctgatatgatgcc

SEQ ID NO: 7406973 - DNA, 22 bp, Homo sapiens
acagtgcttctgatatgatgcc

SEQ ID NO: 7406974 - DNA, 19 bp, Homo sapiens
acagtgcttctgagtgagg

SEQ ID NO: 7406975 - DNA, 19 bp, Homo sapiens
acagtgcttctgagtgagg

SEQ ID NO: 7406976 - DNA, 19 bp, Homo sapiens
acagtgcttctgagtgagg

SEQ ID NO: 7406977 - DNA, 22 bp, Homo sapiens
acagtgcttggcacacagtaat

SEQ ID NO: 7406978 - DNA, 22 bp, Homo sapiens
acagtgcttggcacacagtaat

SEQ ID NO: 7406979 - DNA, 22 bp, Homo sapiens
acagtgcttctgatatgatgcc

SEQ ID NO: 7406980 - DNA, 22 bp, Homo sapiens
acagtgcttttgttcctctcct

SEQ ID NO: 7406981 - DNA, 22 bp, Homo sapiens
acagtggaaagaacatggattt

SEQ ID NO: 7406982 - DNA, 22 bp, Homo sapiens
acagtggaaagaacatggattt

SEQ ID NO: 7406983 - DNA, 22 bp, Homo sapiens
acagtggaaagaaacgaattag

SEQ ID NO: 7406984 - DNA, 22 bp, Homo sapiens
acagtggaaagaacatggattt

SEQ ID NO: 7406985 - DNA, 22 bp, Homo sapiens
acagtggaaagaaacgaattag

SEQ ID NO: 7406986 - DNA, 22 bp, Homo sapiens
acagtggaaagaacatggattt

SEQ ID NO: 7406987 - DNA, 22 bp, Homo sapiens
acagtggaaagaaacgaattag

SEQ ID NO: 7406988 - DNA, 22 bp, Homo sapiens
acagtggcttttgtgtctgcag

SEQ ID NO: 7406989 - DNA, 22 bp, Homo sapiens
acagtgggacagtgacggggga

SEQ ID NO: 7406990 - DNA, 22 bp, Homo sapiens
acagtgggacagtgacggggga

SEQ ID NO: 7406991 - DNA, 22 bp, Homo sapiens
acagtggctcatgcctgtcatc

SEQ ID NO: 7406992 - DNA, 22 bp, Homo sapiens
acagtggcttttgtgtctgcag

SEQ ID NO: 7406993 - DNA, 22 bp, Homo sapiens
acagtggcatctacttaatctg

SEQ ID NO: 7406994 - DNA, 22 bp, Homo sapiens
acagtggcagtcgtgttctcta

SEQ ID NO: 7406995 - DNA, 22 bp, Homo sapiens
acagtggctcatgcctgtcatc

SEQ ID NO: 7406996 - DNA, 22 bp, Homo sapiens
acagtggctcatgcctgtcatc

SEQ ID NO: 7406997 - DNA, 22 bp, Homo sapiens
acagtggcctcaaagaaagaga

SEQ ID NO: 7406998 - DNA, 22 bp, Homo sapiens
aggcacagcacacctggccccc

SEQ ID NO: 7406999 - DNA, 22 bp, Homo sapiens
aggcacagcacacctggccccc

SEQ ID NO: 7407000 - DNA, 22 bp, Homo sapiens
aggcacagcacacctggccccc

SEQ ID NO: 7407001 - DNA, 22 bp, Homo sapiens
aggcacagcacacctggccccc

SEQ ID NO: 7407002 - DNA, 22 bp, Homo sapiens
aggcacagcacacctggccccc

SEQ ID NO: 7407003 - DNA, 21 bp, Homo sapiens
aggcaccacatctccctcccc

SEQ ID NO: 7407004 - DNA, 22 bp, Homo sapiens
aggcaccaggatcagttagaga

SEQ ID NO: 7407005 - DNA, 22 bp, Homo sapiens
aggcacataatcatcctagcta

SEQ ID NO: 7407006 - DNA, 22 bp, Homo sapiens
aggcaccaggatcagttagaga

SEQ ID NO: 7407007 - DNA, 22 bp, Homo sapiens
aggcacagcacacctggccccc

SEQ ID NO: 7407008 - DNA, 22 bp, Homo sapiens
aggcacagcacacctggccccc

SEQ ID NO: 7407009 - DNA, 22 bp, Homo sapiens
aggcacctcagctgagcctggg

SEQ ID NO: 7407010 - DNA, 22 bp, Homo sapiens
aggcacctcagctgagcctggg

SEQ ID NO: 7407011 - DNA, 22 bp, Homo sapiens
aggcacctcagctgagcctggg

SEQ ID NO: 7407012 - DNA, 22 bp, Homo sapiens
aggcacctcagctgagcctggg

SEQ ID NO: 7407013 - DNA, 22 bp, Homo sapiens
aggcacctcagctgagcctggg

SEQ ID NO: 7407014 - DNA, 22 bp, Homo sapiens
aggcacctcttaggctgctact

SEQ ID NO: 7407015 - DNA, 22 bp, Homo sapiens
aggcacctcatagccagccccc

SEQ ID NO: 7407016 - DNA, 22 bp, Homo sapiens
aggcacctcatagccagccccc

SEQ ID NO: 7407017 - DNA, 22 bp, Homo sapiens
aggcacctcatagccagccccc

SEQ ID NO: 7407018 - DNA, 17 bp, Homo sapiens
aggcacctcttcctgct

SEQ ID NO: 7407019 - DNA, 22 bp, Homo sapiens
aggcacctcttaggctgctact

SEQ ID NO: 7407020 - DNA, 22 bp, Homo sapiens
aggcacctcttaggctgctact

SEQ ID NO: 7407021 - DNA, 22 bp, Homo sapiens
aggcacctcttaggctgctact

SEQ ID NO: 7407022 - DNA, 17 bp, Homo sapiens
aggcacctcttcctgct

SEQ ID NO: 7407023 - DNA, 17 bp, Homo sapiens
aggcacctcttcctgct

SEQ ID NO: 7407024 - DNA, 17 bp, Homo sapiens
aggcacctcttcctgct

SEQ ID NO: 7407025 - DNA, 22 bp, Homo sapiens
aggcaccagtaagagtagaact

SEQ ID NO: 7407026 - DNA, 22 bp, Homo sapiens
aggcacctcagctgagcctggg

SEQ ID NO: 7407027 - DNA, 19 bp, Homo sapiens
aggcaccgagggccactct

SEQ ID NO: 7407028 - DNA, 22 bp, Homo sapiens
aggcaccgctcctcagtccaga

SEQ ID NO: 7407029 - DNA, 22 bp, Homo sapiens
aggcaccagtaagagtagaact

SEQ ID NO: 7407030 - DNA, 22 bp, Homo sapiens
aggcaccagtaagagtagaact

SEQ ID NO: 7407031 - DNA, 22 bp, Homo sapiens
aggcaccaggttgtggtttgtc

SEQ ID NO: 7407032 - DNA, 22 bp, Homo sapiens
aggcaccaggatcagttagaga

SEQ ID NO: 7407033 - DNA, 22 bp, Homo sapiens
acagtggagctcagatgaaaat

SEQ ID NO: 7407034 - DNA, 22 bp, Homo sapiens
acagtggagctcagatgaaaat

SEQ ID NO: 7407035 - DNA, 22 bp, Homo sapiens
acagtggagctcagatgaaaat

SEQ ID NO: 7407036 - DNA, 22 bp, Homo sapiens
acagtggaggccatatggtcct

SEQ ID NO: 7407037 - DNA, 22 bp, Homo sapiens
acagtggatatattaaatgaga

SEQ ID NO: 7407038 - DNA, 22 bp, Homo sapiens
acagtggagctcagatgaaaat

SEQ ID NO: 7407039 - DNA, 22 bp, Homo sapiens
acagtggagttggggtagccct

SEQ ID NO: 7407040 - DNA, 22 bp, Homo sapiens
acagtggaggccatatggtcct

SEQ ID NO: 7407041 - DNA, 22 bp, Homo sapiens
acagtggatgtgatgtccaggt

SEQ ID NO: 7407042 - DNA, 22 bp, Homo sapiens
acagtggatgtgatgtccaggt

SEQ ID NO: 7407043 - DNA, 22 bp, Homo sapiens
acagtggatgacatccttttgc

SEQ ID NO: 7407044 - DNA, 22 bp, Homo sapiens
acagtggatatattaaatgaga

SEQ ID NO: 7407045 - DNA, 22 bp, Homo sapiens
acagtggagttggggtagccct

SEQ ID NO: 7407046 - DNA, 22 bp, Homo sapiens
acagtggatatattaaatgaga

SEQ ID NO: 7407047 - DNA, 22 bp, Homo sapiens
acagtggcagtattagggcaga

SEQ ID NO: 7407048 - DNA, 22 bp, Homo sapiens
acagtggcagtattagggcaga

SEQ ID NO: 7407049 - DNA, 22 bp, Homo sapiens
acagtggatgtgatgtccaggt

SEQ ID NO: 7407050 - DNA, 22 bp, Homo sapiens
acagtggatgtgatgtccaggt

SEQ ID NO: 7407051 - DNA, 22 bp, Homo sapiens
acagtggatgacatccttttgc

SEQ ID NO: 7407052 - DNA, 22 bp, Homo sapiens
acagtggatgacatccttttgc

SEQ ID NO: 7407053 - DNA, 22 bp, Homo sapiens
acagtggatgtgatgtccaggt

SEQ ID NO: 7407054 - DNA, 22 bp, Homo sapiens
acagtggaaatgtgggagggga

SEQ ID NO: 7407055 - DNA, 22 bp, Homo sapiens
acagtggaaatgtgggagggga

SEQ ID NO: 7407056 - DNA, 20 bp, Homo sapiens
acagtggaaattgatgtctg

SEQ ID NO: 7407057 - DNA, 22 bp, Homo sapiens
acagtggaaatgtgggagggga

SEQ ID NO: 7407058 - DNA, 22 bp, Homo sapiens
acagtggaaatgtgggagggga

SEQ ID NO: 7407059 - DNA, 20 bp, Homo sapiens
acagtggaaattgatgtctg

SEQ ID NO: 7407060 - DNA, 22 bp, Homo sapiens
acagtggaaatgtgggagggga

SEQ ID NO: 7407061 - DNA, 22 bp, Homo sapiens
acagtggaagcatgatgctatc

SEQ ID NO: 7407062 - DNA, 22 bp, Homo sapiens
acagtggaagaagcactgaact

SEQ ID NO: 7407063 - DNA, 20 bp, Homo sapiens
acagtggaaattgatgtctg

SEQ ID NO: 7407064 - DNA, 22 bp, Homo sapiens
acagtggagaaggcatgaggct

SEQ ID NO: 7407065 - DNA, 22 bp, Homo sapiens
acagtggagaaggcatgaggct

SEQ ID NO: 7407066 - DNA, 22 bp, Homo sapiens
acagtggagaagcaaatgcagt

SEQ ID NO: 7407067 - DNA, 22 bp, Homo sapiens
acagtggagaagcaaatgcagt

SEQ ID NO: 7407068 - DNA, 22 bp, Homo sapiens
acagtggagaagcaaatgcagt

SEQ ID NO: 7407069 - DNA, 22 bp, Homo sapiens
acagtggaatttgtagatgtgt

SEQ ID NO: 7407070 - DNA, 22 bp, Homo sapiens
acagtggagaagcaaatgcagt

SEQ ID NO: 7407071 - DNA, 22 bp, Homo sapiens
acagtggaatttgtagatgtgt

SEQ ID NO: 7407072 - DNA, 22 bp, Homo sapiens
acagtggaatggtgggcctgca

SEQ ID NO: 7407073 - DNA, 22 bp, Homo sapiens
acagtggaatggtgggcctgca

SEQ ID NO: 7407074 - DNA, 22 bp, Homo sapiens
acagtggaatggtgggcctgca

SEQ ID NO: 7407075 - DNA, 22 bp, Homo sapiens
acagtggaagcatgatgctatc

SEQ ID NO: 7407076 - DNA, 22 bp, Homo sapiens
acagtggaagcatgatgctatc

SEQ ID NO: 7407077 - DNA, 22 bp, Homo sapiens
acagtggaatggtgggcctgca

SEQ ID NO: 7407078 - DNA, 22 bp, Homo sapiens
acagtgttcaaaccactaggct

SEQ ID NO: 7407079 - DNA, 22 bp, Homo sapiens
acagtgttcactaaggttagct

SEQ ID NO: 7407080 - DNA, 20 bp, Homo sapiens
acagtgttaggtttttcctt

SEQ ID NO: 7407081 - DNA, 20 bp, Homo sapiens
acagtgttagttatcatctc

SEQ ID NO: 7407082 - DNA, 20 bp, Homo sapiens
acagtgttagttatcatctc

SEQ ID NO: 7407083 - DNA, 22 bp, Homo sapiens
acagtgttatttctgagtaatg

SEQ ID NO: 7407084 - DNA, 22 bp, Homo sapiens
acagtgttatttctgagtaatg

SEQ ID NO: 7407085 - DNA, 22 bp, Homo sapiens
acagtgttcacttaacaatgga

SEQ ID NO: 7407086 - DNA, 22 bp, Homo sapiens
acagtgttcacttaacaatgga

SEQ ID NO: 7407087 - DNA, 22 bp, Homo sapiens
acagtgttcctttgttgtgact

SEQ ID NO: 7407088 - DNA, 22 bp, Homo sapiens
aggcactggtccattttctgca

SEQ ID NO: 7407089 - DNA, 22 bp, Homo sapiens
aggcactggtccattttctgca

SEQ ID NO: 7407090 - DNA, 22 bp, Homo sapiens
aggcactggtccattttctgca

SEQ ID NO: 7407091 - DNA, 22 bp, Homo sapiens
aggcactggtccattttctgca

SEQ ID NO: 7407092 - DNA, 22 bp, Homo sapiens
acagtgttctgaaagttgaggg

SEQ ID NO: 7407093 - DNA, 22 bp, Homo sapiens
acagtgttctgaaagttgaggg

SEQ ID NO: 7407094 - DNA, 22 bp, Homo sapiens
aggcactttttgcattttagaa

SEQ ID NO: 7407095 - DNA, 22 bp, Homo sapiens
aggcactttttgcattttagaa

SEQ ID NO: 7407096 - DNA, 22 bp, Homo sapiens
aggcagaaaatagtcatccaaa

SEQ ID NO: 7407097 - DNA, 22 bp, Homo sapiens
aggcagaaaatagtcatccaaa

SEQ ID NO: 7407098 - DNA, 22 bp, Homo sapiens
aggcagaaaatagtcatccaaa

SEQ ID NO: 7407099 - DNA, 21 bp, Homo sapiens
aggcagaaagagcccaggctg

SEQ ID NO: 7407100 - DNA, 21 bp, Homo sapiens
aggcagaaagagcccaggctg

SEQ ID NO: 7407101 - DNA, 22 bp, Homo sapiens
aggcagaaaatagtcatccaaa

SEQ ID NO: 7407102 - DNA, 22 bp, Homo sapiens
aggcagaaaatagtcatccaaa

SEQ ID NO: 7407103 - DNA, 22 bp, Homo sapiens
aggcagaaaatagtcatccaaa

SEQ ID NO: 7407104 - DNA, 23 bp, Homo sapiens
aggcactcgacagaaatattgga

SEQ ID NO: 7407105 - DNA, 22 bp, Homo sapiens
aggcactagagttcaaagatga

SEQ ID NO: 7407106 - DNA, 22 bp, Homo sapiens
aggcactagagttcaaagatga

SEQ ID NO: 7407107 - DNA, 22 bp, Homo sapiens
aggcactaatccctactatgag

SEQ ID NO: 7407108 - DNA, 22 bp, Homo sapiens
aggcactaatggtagtggactg

SEQ ID NO: 7407109 - DNA, 22 bp, Homo sapiens
aggcaccttgcggtccagtgaa

SEQ ID NO: 7407110 - DNA, 22 bp, Homo sapiens
aggcaccttgcggtccagtgaa

SEQ ID NO: 7407111 - DNA, 22 bp, Homo sapiens
aggcaccttgcggtccagtgaa

SEQ ID NO: 7407112 - DNA, 22 bp, Homo sapiens
aggcaccttgcggtccagtgaa

SEQ ID NO: 7407113 - DNA, 22 bp, Homo sapiens
aggcaccttgcggtccagtgaa

SEQ ID NO: 7407114 - DNA, 22 bp, Homo sapiens
aggcacgtggcgccaggagtga

SEQ ID NO: 7407115 - DNA, 22 bp, Homo sapiens
aggcacgagcaatggccgagga

SEQ ID NO: 7407116 - DNA, 22 bp, Homo sapiens
aggcactgaaaggtggccagag

SEQ ID NO: 7407117 - DNA, 22 bp, Homo sapiens
aggcactaatggtagtggactg

SEQ ID NO: 7407118 - DNA, 22 bp, Homo sapiens
aggcactaatccctactatgag

SEQ ID NO: 7407119 - DNA, 22 bp, Homo sapiens
aggcactgaaaggtggccagag

SEQ ID NO: 7407120 - DNA, 20 bp, Homo sapiens
acagtgttaggtttttcctt

SEQ ID NO: 7407121 - DNA, 22 bp, Homo sapiens
acagtgttacttgatagtgtat

SEQ ID NO: 7407122 - DNA, 22 bp, Homo sapiens
aggcacctggccagttgtcttg

SEQ ID NO: 7407123 - DNA, 22 bp, Homo sapiens
aggcacctggccagttgtcttg

SEQ ID NO: 7407124 - DNA, 22 bp, Homo sapiens
aggcacctggccagttgtcttg

SEQ ID NO: 7407125 - DNA, 20 bp, Homo sapiens
aggcacctgtcacaggtgag

SEQ ID NO: 7407126 - DNA, 20 bp, Homo sapiens
aggcacctgtcacaggtgag

SEQ ID NO: 7407127 - DNA, 20 bp, Homo sapiens
aggcacctgtcacaggtgag

SEQ ID NO: 7407128 - DNA, 22 bp, Homo sapiens
aggcacctgaggtggccagcct

SEQ ID NO: 7407129 - DNA, 22 bp, Homo sapiens
aggcacctgaggtggccagcct

SEQ ID NO: 7407130 - DNA, 22 bp, Homo sapiens
aggcacctgaggtggccagcct

SEQ ID NO: 7407131 - DNA, 22 bp, Homo sapiens
aggcacctgaggtggccagcct

SEQ ID NO: 7407132 - DNA, 22 bp, Homo sapiens
aggcacctggatcttggaattc

SEQ ID NO: 7407133 - DNA, 22 bp, Homo sapiens
aggcacctggatcttggaattc

SEQ ID NO: 7407134 - DNA, 22 bp, Homo sapiens
aggcaccttgcggtccagtgaa

SEQ ID NO: 7407135 - DNA, 22 bp, Homo sapiens
aggcaccttgagagcaggagct

SEQ ID NO: 7407136 - DNA, 19 bp, Homo sapiens
aggcaccttgatggcttcc

SEQ ID NO: 7407137 - DNA, 19 bp, Homo sapiens
aggcaccttgatggcttcc

SEQ ID NO: 7407138 - DNA, 22 bp, Homo sapiens
aggcaccttgagagcaggagct

SEQ ID NO: 7407139 - DNA, 22 bp, Homo sapiens
aggcaccttgagagcaggagct

SEQ ID NO: 7407140 - DNA, 22 bp, Homo sapiens
aggcaccttgagagcaggagct

SEQ ID NO: 7407141 - DNA, 22 bp, Homo sapiens
aggcaccttgagagcaggagct

SEQ ID NO: 7407142 - DNA, 22 bp, Homo sapiens
aggcaccttgagagcaggagct

SEQ ID NO: 7407143 - DNA, 20 bp, Homo sapiens
aggcagtgtagagatgagta

SEQ ID NO: 7407144 - DNA, 20 bp, Homo sapiens
aggcagtgtagagatgagta

SEQ ID NO: 7407145 - DNA, 22 bp, Homo sapiens
aggcagtggtgtttgctggtgg

SEQ ID NO: 7407146 - DNA, 22 bp, Homo sapiens
aggcagtggtgtttgctggtgg

SEQ ID NO: 7407147 - DNA, 22 bp, Homo sapiens
aggcagtggtgtttgctggtgg

SEQ ID NO: 7407148 - DNA, 22 bp, Homo sapiens
aggcagtggtgtttgctggtgg

SEQ ID NO: 7407149 - DNA, 22 bp, Homo sapiens
aggcagtggtgtttgctggtgg

SEQ ID NO: 7407150 - DNA, 22 bp, Homo sapiens
aggcagtggtgtttgctggtgg

SEQ ID NO: 7407151 - DNA, 23 bp, Homo sapiens
aggcagtggtggtaacatgtcaa

SEQ ID NO: 7407152 - DNA, 22 bp, Homo sapiens
acatctttatactagtccttga

SEQ ID NO: 7407153 - DNA, 22 bp, Homo sapiens
acatctttatactagtccttga

SEQ ID NO: 7407154 - DNA, 22 bp, Homo sapiens
acatctttgctcttatagagct

SEQ ID NO: 7407155 - DNA, 22 bp, Homo sapiens
acatctttgctcttatagagct

SEQ ID NO: 7407156 - DNA, 22 bp, Homo sapiens
acatctttatactagtccttga

SEQ ID NO: 7407157 - DNA, 22 bp, Homo sapiens
acatctttatactagtccttga

SEQ ID NO: 7407158 - DNA, 22 bp, Homo sapiens
acatcttcccacacttgcaaaa

SEQ ID NO: 7407159 - DNA, 22 bp, Homo sapiens
acatcttcactggtttctggaa

SEQ ID NO: 7407160 - DNA, 22 bp, Homo sapiens
acatctgtcctctgcagagctc

SEQ ID NO: 7407161 - DNA, 22 bp, Homo sapiens
acatctgtcctctgcagagctc

SEQ ID NO: 7407162 - DNA, 22 bp, Homo sapiens
acatctgttcaaatatgcattt

SEQ ID NO: 7407163 - DNA, 22 bp, Homo sapiens
acatctgttcaaatatgcattt

SEQ ID NO: 7407164 - DNA, 22 bp, Homo sapiens
acatctgttcaaatatgcattt

SEQ ID NO: 7407165 - DNA, 22 bp, Homo sapiens
acatctgtaatctagtcaaccc

SEQ ID NO: 7407166 - DNA, 22 bp, Homo sapiens
acatctgtaatctagtcaaccc

SEQ ID NO: 7407167 - DNA, 22 bp, Homo sapiens
acatctgggcctaaggctatat

SEQ ID NO: 7407168 - DNA, 22 bp, Homo sapiens
acatctgggcctaaggctatat

SEQ ID NO: 7407169 - DNA, 22 bp, Homo sapiens
acatctggagactacagtttgg

SEQ ID NO: 7407170 - DNA, 22 bp, Homo sapiens
acatctggagactacagtttgg

SEQ ID NO: 7407171 - DNA, 22 bp, Homo sapiens
acatctggagactacagtttgg

SEQ ID NO: 7407172 - DNA, 22 bp, Homo sapiens
acatctgtttaacgaaggcatt

SEQ ID NO: 7407173 - DNA, 22 bp, Homo sapiens
acatctgttgattgatgttaca

SEQ ID NO: 7407174 - DNA, 22 bp, Homo sapiens
acatctgtttaacgaaggcatt

SEQ ID NO: 7407175 - DNA, 22 bp, Homo sapiens
acatctgttcttctcttgtccc

SEQ ID NO: 7407176 - DNA, 22 bp, Homo sapiens
acatctgttcttctcttgtccc

SEQ ID NO: 7407177 - DNA, 22 bp, Homo sapiens
acatctgttcttctcttgtccc

SEQ ID NO: 7407178 - DNA, 22 bp, Homo sapiens
acatctgtttgagaaaaagaag

SEQ ID NO: 7407179 - DNA, 22 bp, Homo sapiens
acatcttcaaagtgctttgcaa

SEQ ID NO: 7407180 - DNA, 22 bp, Homo sapiens
acatctgtttgagaaaaagaag

SEQ ID NO: 7407181 - DNA, 22 bp, Homo sapiens
acatctgtttaacgaaggcatt

SEQ ID NO: 7407182 - DNA, 22 bp, Homo sapiens
aggcagtgtgtagctggaagag

SEQ ID NO: 7407183 - DNA, 22 bp, Homo sapiens
aggcagtgtgtagctggaagag

SEQ ID NO: 7407184 - DNA, 22 bp, Homo sapiens
aggcagtgtgtagctggaagag

SEQ ID NO: 7407185 - DNA, 22 bp, Homo sapiens
aggcagtgtgtagctggaagag

SEQ ID NO: 7407186 - DNA, 22 bp, Homo sapiens
aggcagtgtgtagctggaagag

SEQ ID NO: 7407187 - DNA, 22 bp, Homo sapiens
aggcagtgtgtagctggaagag

SEQ ID NO: 7407188 - DNA, 22 bp, Homo sapiens
aggcagtgtgtagctggaagag

SEQ ID NO: 7407189 - DNA, 22 bp, Homo sapiens
aggcagtgtgtagctggaagag

SEQ ID NO: 7407190 - DNA, 22 bp, Homo sapiens
aggcagtgtgtagctggaagag

SEQ ID NO: 7407191 - DNA, 22 bp, Homo sapiens
aggcagtgtgtagctggaagag

SEQ ID NO: 7407192 - DNA, 22 bp, Homo sapiens
aggcagtgtgtagctggaagag

SEQ ID NO: 7407193 - DNA, 22 bp, Homo sapiens
aggcagtgtgtagctggaagag

SEQ ID NO: 7407194 - DNA, 22 bp, Homo sapiens
aggcagtgtgtagctggaagag

SEQ ID NO: 7407195 - DNA, 22 bp, Homo sapiens
aggcagtgtgggccaagcttcc

SEQ ID NO: 7407196 - DNA, 22 bp, Homo sapiens
aggcagtgtgggccaagcttcc

SEQ ID NO: 7407197 - DNA, 22 bp, Homo sapiens
aggcagtgtgtagctggaagag

SEQ ID NO: 7407198 - DNA, 22 bp, Homo sapiens
aggcagtgtggagggctgttgc

SEQ ID NO: 7407199 - DNA, 23 bp, Homo sapiens
aggcagtgtctcttatcctgtcc

SEQ ID NO: 7407200 - DNA, 22 bp, Homo sapiens
aggcagtgtggagggctgttgc

SEQ ID NO: 7407201 - DNA, 22 bp, Homo sapiens
aggcagtgtgggccaagcttcc

SEQ ID NO: 7407202 - DNA, 22 bp, Homo sapiens
aggcagtgtgggccaagcttcc

SEQ ID NO: 7407203 - DNA, 22 bp, Homo sapiens
aggcagtgtattgctagcggct

SEQ ID NO: 7407204 - DNA, 22 bp, Homo sapiens
aggcagtgtattgctagcggct

SEQ ID NO: 7407205 - DNA, 20 bp, Homo sapiens
aggcagtgtagagatgagta

SEQ ID NO: 7407206 - DNA, 20 bp, Homo sapiens
aggcagtgtagagatgagta

SEQ ID NO: 7407207 - DNA, 20 bp, Homo sapiens
aggcagtgtagagatgagta

SEQ ID NO: 7407208 - DNA, 20 bp, Homo sapiens
aggcagtgtagagatgagta

SEQ ID NO: 7407209 - DNA, 20 bp, Homo sapiens
aggcagtgtagagatgagta

SEQ ID NO: 7407210 - DNA, 20 bp, Homo sapiens
aggcagtgtagagatgagta

SEQ ID NO: 7407211 - DNA, 20 bp, Homo sapiens
aggcagtgtagagatgagta

SEQ ID NO: 7407212 - DNA, 20 bp, Homo sapiens
aggcagtgtagagatgagta

SEQ ID NO: 7407213 - DNA, 22 bp, Homo sapiens
aggcagtgtattgctagcggct

SEQ ID NO: 7407214 - DNA, 22 bp, Homo sapiens
aggcagtgtattgctagcggct

SEQ ID NO: 7407215 - DNA, 22 bp, Homo sapiens
aggcagtgtattgctagcggct

SEQ ID NO: 7407216 - DNA, 22 bp, Homo sapiens
aggcagtgtattgctagcggct

SEQ ID NO: 7407217 - DNA, 22 bp, Homo sapiens
acatatatgtgcacatgtgcag

SEQ ID NO: 7407218 - DNA, 22 bp, Homo sapiens
acatatatgtgcacatgtgcag

SEQ ID NO: 7407219 - DNA, 22 bp, Homo sapiens
acatatattactagtaaagaca

SEQ ID NO: 7407220 - DNA, 22 bp, Homo sapiens
acatatattactagtaaagaca

SEQ ID NO: 7407221 - DNA, 22 bp, Homo sapiens
acatatatgtgcacatgtgcag

SEQ ID NO: 7407222 - DNA, 22 bp, Homo sapiens
acatatattactagtaaagaca

SEQ ID NO: 7407223 - DNA, 22 bp, Homo sapiens
acatatattactagtaaagaca

SEQ ID NO: 7407224 - DNA, 22 bp, Homo sapiens
acatatattactagtaaagaca

SEQ ID NO: 7407225 - DNA, 22 bp, Homo sapiens
acatatattactagtaaagaca

SEQ ID NO: 7407226 - DNA, 22 bp, Homo sapiens
acatatattactagtaaagaca

SEQ ID NO: 7407227 - DNA, 22 bp, Homo sapiens
acatatatgtgcacatgtgcag

SEQ ID NO: 7407228 - DNA, 22 bp, Homo sapiens
acatatatgtgcacatgtgcag

SEQ ID NO: 7407229 - DNA, 22 bp, Homo sapiens
acatatatgtgcacatgtgcag

SEQ ID NO: 7407230 - DNA, 22 bp, Homo sapiens
acatatatgtaaagtactttgt

SEQ ID NO: 7407231 - DNA, 22 bp, Homo sapiens
acatatatgtaaagtactttgt

SEQ ID NO: 7407232 - DNA, 22 bp, Homo sapiens
acatatatgtaaagtactttgt

SEQ ID NO: 7407233 - DNA, 22 bp, Homo sapiens
acatatatgtaaagtactttgt

SEQ ID NO: 7407234 - DNA, 22 bp, Homo sapiens
acatatatgtaaagtactttgt

SEQ ID NO: 7407235 - DNA, 22 bp, Homo sapiens
acatatatgtaaagtactttgt

SEQ ID NO: 7407236 - DNA, 22 bp, Homo sapiens
acatatatgtaaagtactttgt

SEQ ID NO: 7407237 - DNA, 22 bp, Homo sapiens
acatatatgtaaagtactttgt

SEQ ID NO: 7407238 - DNA, 22 bp, Homo sapiens
acatatatgtaaagtactttgt

SEQ ID NO: 7407239 - DNA, 22 bp, Homo sapiens
acatatatgtaaagtactttgt

SEQ ID NO: 7407240 - DNA, 22 bp, Homo sapiens
acatatatgtaaagtactttgt

SEQ ID NO: 7407241 - DNA, 22 bp, Homo sapiens
acatatatgctgggactgtgac

SEQ ID NO: 7407242 - DNA, 22 bp, Homo sapiens
acatatatgcgtgggctcatgg

SEQ ID NO: 7407243 - DNA, 22 bp, Homo sapiens
acatatatgctgggactgtgac

SEQ ID NO: 7407244 - DNA, 22 bp, Homo sapiens
acatatatgctgggactgtgac

SEQ ID NO: 7407245 - DNA, 22 bp, Homo sapiens
acatatatgctgggactgtgac

SEQ ID NO: 7407246 - DNA, 22 bp, Homo sapiens
acatataagggatcagtgacag

SEQ ID NO: 7407247 - DNA, 22 bp, Homo sapiens
acatatatgcgtgggctcatgg

SEQ ID NO: 7407248 - DNA, 22 bp, Homo sapiens
acatatatgcgtgggctcatgg

SEQ ID NO: 7407249 - DNA, 22 bp, Homo sapiens
acatataagggatcagtgacag

SEQ ID NO: 7407250 - DNA, 22 bp, Homo sapiens
acatataagggatcagtgacag

SEQ ID NO: 7407251 - DNA, 22 bp, Homo sapiens
acatataagggatcagtgacag

SEQ ID NO: 7407252 - DNA, 22 bp, Homo sapiens
acatataagggatcagtgacag

SEQ ID NO: 7407253 - DNA, 22 bp, Homo sapiens
acatatattactagtaaagaca

SEQ ID NO: 7407254 - DNA, 22 bp, Homo sapiens
acatatattactagtaaagaca

SEQ ID NO: 7407255 - DNA, 23 bp, Homo sapiens
acatccatgaatcatctgctttc

SEQ ID NO: 7407256 - DNA, 23 bp, Homo sapiens
acatccatgaatcatctgctttc

SEQ ID NO: 7407257 - DNA, 22 bp, Homo sapiens
acatccatgcatgtctgtgcac

SEQ ID NO: 7407258 - DNA, 22 bp, Homo sapiens
acatccatgttgtaatgttcct

SEQ ID NO: 7407259 - DNA, 22 bp, Homo sapiens
acatccatgttgtaatgttcct

SEQ ID NO: 7407260 - DNA, 22 bp, Homo sapiens
acatccatgttgtaatgttcct

SEQ ID NO: 7407261 - DNA, 22 bp, Homo sapiens
acatctctgggtcctccatgca

SEQ ID NO: 7407262 - DNA, 22 bp, Homo sapiens
acatctctgggtcctccatgca

SEQ ID NO: 7407263 - DNA, 22 bp, Homo sapiens
acatctcttcttaaggctccag

SEQ ID NO: 7407264 - DNA, 22 bp, Homo sapiens
acatctcttataaactctctga

SEQ ID NO: 7407265 - DNA, 22 bp, Homo sapiens
acatctctccaaaggaaggtgc

SEQ ID NO: 7407266 - DNA, 22 bp, Homo sapiens
acatctctccaaaggaaggtgc

SEQ ID NO: 7407267 - DNA, 22 bp, Homo sapiens
acatctcatgaatgataaatca

SEQ ID NO: 7407268 - DNA, 22 bp, Homo sapiens
acatccatttgctttatttgct

SEQ ID NO: 7407269 - DNA, 22 bp, Homo sapiens
acatccatttgctttatttgct

SEQ ID NO: 7407270 - DNA, 22 bp, Homo sapiens
acatctggaaagttacttgaga

SEQ ID NO: 7407271 - DNA, 22 bp, Homo sapiens
acatctggaaagttacttgaga

SEQ ID NO: 7407272 - DNA, 22 bp, Homo sapiens
acatctgattacatgagaatat

SEQ ID NO: 7407273 - DNA, 22 bp, Homo sapiens
acatctgattacatgagaatat

SEQ ID NO: 7407274 - DNA, 22 bp, Homo sapiens
acatctgattacatgagaatat

SEQ ID NO: 7407275 - DNA, 20 bp, Homo sapiens
acatctgagaaacacttaaa

SEQ ID NO: 7407276 - DNA, 22 bp, Homo sapiens
acatctgagcaacagaacacta

SEQ ID NO: 7407277 - DNA, 22 bp, Homo sapiens
acatctgagcaacagaacacta

SEQ ID NO: 7407278 - DNA, 22 bp, Homo sapiens
acatctgagcaacagaacacta

SEQ ID NO: 7407279 - DNA, 22 bp, Homo sapiens
acatctgaggagaccagcctct

SEQ ID NO: 7407280 - DNA, 22 bp, Homo sapiens
acatctgaccattacaagacat

SEQ ID NO: 7407281 - DNA, 22 bp, Homo sapiens
acatctgaccattacaagacat

SEQ ID NO: 7407282 - DNA, 22 bp, Homo sapiens
acatctgaccattacaagacat

SEQ ID NO: 7407283 - DNA, 22 bp, Homo sapiens
acatctgacatgatcttcagta

SEQ ID NO: 7407284 - DNA, 22 bp, Homo sapiens
acatctgaaagggattgcagaa

SEQ ID NO: 7407285 - DNA, 22 bp, Homo sapiens
acatctgacatgatcttcagta

SEQ ID NO: 7407286 - DNA, 22 bp, Homo sapiens
acatctcttcttaaggctccag

SEQ ID NO: 7407287 - DNA, 22 bp, Homo sapiens
acatctgaaagggattgcagaa

SEQ ID NO: 7407288 - DNA, 22 bp, Homo sapiens
aggcagacttaccttctgggga

SEQ ID NO: 7407289 - DNA, 22 bp, Homo sapiens
aggcagagaaaaaccagatatg

SEQ ID NO: 7407290 - DNA, 22 bp, Homo sapiens
aggcagacttcctgcttggatc

SEQ ID NO: 7407291 - DNA, 22 bp, Homo sapiens
aggcagagaaaaaccagatatg

SEQ ID NO: 7407292 - DNA, 22 bp, Homo sapiens
aggcagactcaatggctagata

SEQ ID NO: 7407293 - DNA, 22 bp, Homo sapiens
aggcagactcaatggctagata

SEQ ID NO: 7407294 - DNA, 22 bp, Homo sapiens
aggcagactcaatggctagata

SEQ ID NO: 7407295 - DNA, 22 bp, Homo sapiens
aggcagactggcagggcctgga

SEQ ID NO: 7407296 - DNA, 22 bp, Homo sapiens
aggcagactggcagggcctgga

SEQ ID NO: 7407297 - DNA, 22 bp, Homo sapiens
aggcagactgtgcgggaagagt

SEQ ID NO: 7407298 - DNA, 22 bp, Homo sapiens
aggcagactgtgcgggaagagt

SEQ ID NO: 7407299 - DNA, 22 bp, Homo sapiens
aggcagacaagtccagaactgg

SEQ ID NO: 7407300 - DNA, 22 bp, Homo sapiens
aggcagacaagtccagaactgg

SEQ ID NO: 7407301 - DNA, 22 bp, Homo sapiens
aggcagacaaggtccctggtct

SEQ ID NO: 7407302 - DNA, 22 bp, Homo sapiens
aggcagacaaggtccctggtct

SEQ ID NO: 7407303 - DNA, 18 bp, Homo sapiens
aggcagacactagaggtc

SEQ ID NO: 7407304 - DNA, 18 bp, Homo sapiens
aggcagacactagaggtc

SEQ ID NO: 7407305 - DNA, 18 bp, Homo sapiens
aggcagacactagaggtc

SEQ ID NO: 7407306 - DNA, 22 bp, Homo sapiens
aggcagaccacctgtagccatc

SEQ ID NO: 7407307 - DNA, 22 bp, Homo sapiens
aggcagaccacctgtagccatc

SEQ ID NO: 7407308 - DNA, 22 bp, Homo sapiens
aggcagacaaggacacagtggg

SEQ ID NO: 7407309 - DNA, 22 bp, Homo sapiens
aggcagacaaggacacagtggg

SEQ ID NO: 7407310 - DNA, 22 bp, Homo sapiens
aggcagacaaggacacagtggg

SEQ ID NO: 7407311 - DNA, 20 bp, Homo sapiens
aggcagacaaggagtctgtt

SEQ ID NO: 7407312 - DNA, 20 bp, Homo sapiens
aggcagacaaggagtctgtt

SEQ ID NO: 7407313 - DNA, 20 bp, Homo sapiens
aggcagacaaggagtctgtt

SEQ ID NO: 7407314 - DNA, 20 bp, Homo sapiens
aggcagacaaggagtctgtt

SEQ ID NO: 7407315 - DNA, 22 bp, Homo sapiens
aggcagaatgttggaaaggaag

SEQ ID NO: 7407316 - DNA, 22 bp, Homo sapiens
aggcagaatgttggaaaggaag

SEQ ID NO: 7407317 - DNA, 22 bp, Homo sapiens
aggcagaatgttggaaaggaag

SEQ ID NO: 7407318 - DNA, 22 bp, Homo sapiens
aggcagaatgttggaaaggaag

SEQ ID NO: 7407319 - DNA, 22 bp, Homo sapiens
aggcagaatgttggaaaggaag

SEQ ID NO: 7407320 - DNA, 22 bp, Homo sapiens
aggcagaatgttggaaaggaag

SEQ ID NO: 7407321 - DNA, 22 bp, Homo sapiens
aggcagaagccagccagggtcc

SEQ ID NO: 7407322 - DNA, 22 bp, Homo sapiens
aggcagaagccagccagggtcc

SEQ ID NO: 7407323 - DNA, 22 bp, Homo sapiens
aggcagaagccagccagggtcc

SEQ ID NO: 7407324 - DNA, 22 bp, Homo sapiens
aggcagaagccagccagggtcc

SEQ ID NO: 7407325 - DNA, 22 bp, Homo sapiens
aggcagaagccagccagggtcc

SEQ ID NO: 7407326 - DNA, 22 bp, Homo sapiens
aggcagaagccagccagggtcc

SEQ ID NO: 7407327 - DNA, 22 bp, Homo sapiens
aggcagaaccagctgggacttt

SEQ ID NO: 7407328 - DNA, 22 bp, Homo sapiens
aggcagaaccagctgggacttt

SEQ ID NO: 7407329 - DNA, 22 bp, Homo sapiens
aggcagaaccagctgggacttt

SEQ ID NO: 7407330 - DNA, 22 bp, Homo sapiens
aggcagaaccagctgggacttt

SEQ ID NO: 7407331 - DNA, 21 bp, Homo sapiens
aggcagaaagagcccaggctg

SEQ ID NO: 7407332 - DNA, 21 bp, Homo sapiens
aggcagaaagagcccaggctg

SEQ ID NO: 7407333 - DNA, 21 bp, Homo sapiens
aggcagaaagagcccaggctg

SEQ ID NO: 7407334 - DNA, 22 bp, Homo sapiens
aggcagatcacaggagggcctg

SEQ ID NO: 7407335 - DNA, 22 bp, Homo sapiens
aggcagatattggggtgatgtg

SEQ ID NO: 7407336 - DNA, 22 bp, Homo sapiens
aggcagatcacttgaggccagg

SEQ ID NO: 7407337 - DNA, 22 bp, Homo sapiens
aggcagatcagtacagggttaa

SEQ ID NO: 7407338 - DNA, 22 bp, Homo sapiens
aggcagatatttcagttcacat

SEQ ID NO: 7407339 - DNA, 22 bp, Homo sapiens
aggcagatatttcagttcacat

SEQ ID NO: 7407340 - DNA, 22 bp, Homo sapiens
aggcagatattggggtgatgtg

SEQ ID NO: 7407341 - DNA, 22 bp, Homo sapiens
aggcagagaaaaaccagatatg

SEQ ID NO: 7407342 - DNA, 22 bp, Homo sapiens
aggcagatattggggtgatgtg

SEQ ID NO: 7407343 - DNA, 22 bp, Homo sapiens
aggcagatatttcagttcacat

SEQ ID NO: 7407344 - DNA, 22 bp, Homo sapiens
aggcagagaaaaaccagatatg

SEQ ID NO: 7407345 - DNA, 22 bp, Homo sapiens
aggcagagaaaaaccagatatg

SEQ ID NO: 7407346 - DNA, 22 bp, Homo sapiens
aggcagagaaaaaccagatatg

SEQ ID NO: 7407347 - DNA, 22 bp, Homo sapiens
aggcagagaaaaaccagatatg

SEQ ID NO: 7407348 - DNA, 22 bp, Homo sapiens
aggcagagaaaaaccagatatg

SEQ ID NO: 7407349 - DNA, 22 bp, Homo sapiens
aggcagagaaaaaccagatatg

SEQ ID NO: 7407350 - DNA, 22 bp, Homo sapiens
aggcagagaaaaaccagatatg

SEQ ID NO: 7407351 - DNA, 22 bp, Homo sapiens
aggcagagaaaaaccagatatg

SEQ ID NO: 7407352 - DNA, 22 bp, Homo sapiens
aggcagatgtgattaatttcct

SEQ ID NO: 7407353 - DNA, 22 bp, Homo sapiens
aggcagatggtaactgtgatat

SEQ ID NO: 7407354 - DNA, 22 bp, Homo sapiens
aggcagatggtaactgtgatat

SEQ ID NO: 7407355 - DNA, 22 bp, Homo sapiens
aggcagatgtgattaatttcct

SEQ ID NO: 7407356 - DNA, 22 bp, Homo sapiens
aggcagatgtgtcttctaaaat

SEQ ID NO: 7407357 - DNA, 22 bp, Homo sapiens
aggcagatgtgtcttctaaaat

SEQ ID NO: 7407358 - DNA, 22 bp, Homo sapiens
aggcagattacttgaggccagg

SEQ ID NO: 7407359 - DNA, 22 bp, Homo sapiens
aggcagattaggattaggaaat

SEQ ID NO: 7407360 - DNA, 22 bp, Homo sapiens
aggcagattaggattaggaaat

SEQ ID NO: 7407361 - DNA, 22 bp, Homo sapiens
aggcagatgaacctgggttgag

SEQ ID NO: 7407362 - DNA, 22 bp, Homo sapiens
aggcagatgaacctgggttgag

SEQ ID NO: 7407363 - DNA, 22 bp, Homo sapiens
aggcagatcagtacagggttaa

SEQ ID NO: 7407364 - DNA, 22 bp, Homo sapiens
aggcagatcagtacagggttaa

SEQ ID NO: 7407365 - DNA, 22 bp, Homo sapiens
aggcagatggatgggcatttgt

SEQ ID NO: 7407366 - DNA, 22 bp, Homo sapiens
aggcagatggatgggcatttgt

SEQ ID NO: 7407367 - DNA, 22 bp, Homo sapiens
aggcagatgaacctgggttgag

SEQ ID NO: 7407368 - DNA, 22 bp, Homo sapiens
aggcagatgggagctggaagtt

SEQ ID NO: 7407369 - DNA, 22 bp, Homo sapiens
aggcagatgggagctggaagtt

SEQ ID NO: 7407370 - DNA, 22 bp, Homo sapiens
aggcagatgggcgtctataaat

SEQ ID NO: 7407371 - DNA, 22 bp, Homo sapiens
aggcagcaagattatttaatcc

SEQ ID NO: 7407372 - DNA, 22 bp, Homo sapiens
aggcagcaagattatttaatcc

SEQ ID NO: 7407373 - DNA, 22 bp, Homo sapiens
aggcagcaaatgtctggaacag

SEQ ID NO: 7407374 - DNA, 22 bp, Homo sapiens
aggcagcaaagaaatgatgctg

SEQ ID NO: 7407375 - DNA, 22 bp, Homo sapiens
aggcagcaaatgtctggaacag

SEQ ID NO: 7407376 - DNA, 22 bp, Homo sapiens
aggcagcaaatgtctggaacag

SEQ ID NO: 7407377 - DNA, 22 bp, Homo sapiens
aggcagcaaagaaatgatgctg

SEQ ID NO: 7407378 - DNA, 22 bp, Homo sapiens
aggcagcaaagaaatgatgctg

SEQ ID NO: 7407379 - DNA, 22 bp, Homo sapiens
aggcagcaaagaaatgatgctg

SEQ ID NO: 7407380 - DNA, 22 bp, Homo sapiens
aggcagcaaagaaatgatgctg

SEQ ID NO: 7407381 - DNA, 22 bp, Homo sapiens
aggcagcaaagaaatgatgctg

SEQ ID NO: 7407382 - DNA, 22 bp, Homo sapiens
aggcagcaaagaaatgatgctg

SEQ ID NO: 7407383 - DNA, 22 bp, Homo sapiens
aggcagattttctttactcagt

SEQ ID NO: 7407384 - DNA, 22 bp, Homo sapiens
aggcagatttaggagaaaagaa

SEQ ID NO: 7407385 - DNA, 22 bp, Homo sapiens
aggcagattttctttactcagt

SEQ ID NO: 7407386 - DNA, 22 bp, Homo sapiens
aggcagattttctttactcagt

SEQ ID NO: 7407387 - DNA, 18 bp, Homo sapiens
aggcaggtgctggaagtc

SEQ ID NO: 7407388 - DNA, 18 bp, Homo sapiens
aggcaggtgctggaagtc

SEQ ID NO: 7407389 - DNA, 18 bp, Homo sapiens
aggcaggtgctggaagtc

SEQ ID NO: 7407390 - DNA, 18 bp, Homo sapiens
aggcaggtgctggaagtc

SEQ ID NO: 7407391 - DNA, 18 bp, Homo sapiens
aggcaggtgctggaagtc

SEQ ID NO: 7407392 - DNA, 18 bp, Homo sapiens
aggcaggtgctggaagtc

SEQ ID NO: 7407393 - DNA, 22 bp, Homo sapiens
aggcaggggagctggaagggta

SEQ ID NO: 7407394 - DNA, 22 bp, Homo sapiens
aggcaggggagctggaagggta

SEQ ID NO: 7407395 - DNA, 22 bp, Homo sapiens
aggcaggggagctggaagggta

SEQ ID NO: 7407396 - DNA, 22 bp, Homo sapiens
aggcaggggagctggaagggta

SEQ ID NO: 7407397 - DNA, 22 bp, Homo sapiens
aggcaggggagctggaagggta

SEQ ID NO: 7407398 - DNA, 22 bp, Homo sapiens
aggcaggggagctggaagggta

SEQ ID NO: 7407399 - DNA, 22 bp, Homo sapiens
aggcaggggagctggaagggta

SEQ ID NO: 7407400 - DNA, 22 bp, Homo sapiens
aggcaggggagctggaagggta

SEQ ID NO: 7407401 - DNA, 22 bp, Homo sapiens
aggcaggggagctggaagggta

SEQ ID NO: 7407402 - DNA, 22 bp, Homo sapiens
aggcaggggagctggaagggta

SEQ ID NO: 7407403 - DNA, 22 bp, Homo sapiens
aggcagcaatgaatgaaatgga

SEQ ID NO: 7407404 - DNA, 22 bp, Homo sapiens
aggcaggggagctggaagggta

SEQ ID NO: 7407405 - DNA, 22 bp, Homo sapiens
aggcaggggagctggaagggta

SEQ ID NO: 7407406 - DNA, 22 bp, Homo sapiens
aggcagcaatgaatgaaatgga

SEQ ID NO: 7407407 - DNA, 22 bp, Homo sapiens
aggcagcaatgaatgaaatgga

SEQ ID NO: 7407408 - DNA, 22 bp, Homo sapiens
aggcagcaagattatttaatcc

SEQ ID NO: 7407409 - DNA, 22 bp, Homo sapiens
aggcaggtgttgggagacacca

SEQ ID NO: 7407410 - DNA, 22 bp, Homo sapiens
aggcaggtgttgggagacacca

SEQ ID NO: 7407411 - DNA, 22 bp, Homo sapiens
aggcaggtgttgggagacacca

SEQ ID NO: 7407412 - DNA, 22 bp, Homo sapiens
aggcaggtgttgggagacacca

SEQ ID NO: 7407413 - DNA, 22 bp, Homo sapiens
aggcaggtgttgggagacacca

SEQ ID NO: 7407414 - DNA, 22 bp, Homo sapiens
aggcaggtgttacctctggttt

SEQ ID NO: 7407415 - DNA, 22 bp, Homo sapiens
aggcaggtgttgggagacacca

SEQ ID NO: 7407416 - DNA, 22 bp, Homo sapiens
acatagttagcttagagatact

SEQ ID NO: 7407417 - DNA, 22 bp, Homo sapiens
aggcaggttggtgagaagactg

SEQ ID NO: 7407418 - DNA, 22 bp, Homo sapiens
aggcaggtgcttatgacttgct

SEQ ID NO: 7407419 - DNA, 22 bp, Homo sapiens
aggcaggtgcttatgacttgct

SEQ ID NO: 7407420 - DNA, 18 bp, Homo sapiens
aggcaggtgctggaagtc

SEQ ID NO: 7407421 - DNA, 22 bp, Homo sapiens
aggcaggtgggagtgattcctt

SEQ ID NO: 7407422 - DNA, 22 bp, Homo sapiens
aggcaggtgggagtgattcctt

SEQ ID NO: 7407423 - DNA, 22 bp, Homo sapiens
aggcaggtgggagtgattcctt

SEQ ID NO: 7407424 - DNA, 22 bp, Homo sapiens
aggcaggtgggtcacttgagtc

SEQ ID NO: 7407425 - DNA, 22 bp, Homo sapiens
aggcaggtgttaaccctctgag

SEQ ID NO: 7407426 - DNA, 22 bp, Homo sapiens
aggcaggtgggtcacttgagtc

SEQ ID NO: 7407427 - DNA, 22 bp, Homo sapiens
aggcaggtgggtcacttgagtc

SEQ ID NO: 7407428 - DNA, 22 bp, Homo sapiens
aggctcaagcactgatattttt

SEQ ID NO: 7407429 - DNA, 20 bp, Homo sapiens
aggctcactcaccttgtgga

SEQ ID NO: 7407430 - DNA, 20 bp, Homo sapiens
aggctcactcaccttgtgga

SEQ ID NO: 7407431 - DNA, 22 bp, Homo sapiens
aggctcagacaggaaaagtaac

SEQ ID NO: 7407432 - DNA, 22 bp, Homo sapiens
aggctcaagcactgatattttt

SEQ ID NO: 7407433 - DNA, 22 bp, Homo sapiens
acatgtgggttttattttgcat

SEQ ID NO: 7407434 - DNA, 22 bp, Homo sapiens
acatgtgggttttattttgcat

SEQ ID NO: 7407435 - DNA, 22 bp, Homo sapiens
acatgtgagtaaatttaatgtt

SEQ ID NO: 7407436 - DNA, 22 bp, Homo sapiens
acatgtgcagacagcaagcagg

SEQ ID NO: 7407437 - DNA, 23 bp, Homo sapiens
acatgtggagagaacagatatct

SEQ ID NO: 7407438 - DNA, 23 bp, Homo sapiens
acatgtggagagaacagatatct

SEQ ID NO: 7407439 - DNA, 22 bp, Homo sapiens
acatgtgctcttgctgtacagc

SEQ ID NO: 7407440 - DNA, 22 bp, Homo sapiens
acatgtgctcttgctgtacagc

SEQ ID NO: 7407441 - DNA, 22 bp, Homo sapiens
acatgtgcagacagcaagcagg

SEQ ID NO: 7407442 - DNA, 22 bp, Homo sapiens
acatgtgctcttgctgtacagc

SEQ ID NO: 7407443 - DNA, 17 bp, Homo sapiens
acatgtgggtgtttttc

SEQ ID NO: 7407444 - DNA, 23 bp, Homo sapiens
acatgtggagagaacagatatct

SEQ ID NO: 7407445 - DNA, 22 bp, Homo sapiens
acatgtggaggaggcgagggta

SEQ ID NO: 7407446 - DNA, 22 bp, Homo sapiens
acatgtcttttaaagtctaata

SEQ ID NO: 7407447 - DNA, 22 bp, Homo sapiens
acatgtgaggtgtgagtgatac

SEQ ID NO: 7407448 - DNA, 22 bp, Homo sapiens
acatgtgaggtgtgagtgatac

SEQ ID NO: 7407449 - DNA, 22 bp, Homo sapiens
acatgtgaaatctcatagttag

SEQ ID NO: 7407450 - DNA, 22 bp, Homo sapiens
acatgtctgtaattattttagg

SEQ ID NO: 7407451 - DNA, 22 bp, Homo sapiens
acatgtcttgtggctttgatct

SEQ ID NO: 7407452 - DNA, 22 bp, Homo sapiens
acatgtcttttaaagtctaata

SEQ ID NO: 7407453 - DNA, 22 bp, Homo sapiens
acatgtcttttaaagtctaata

SEQ ID NO: 7407454 - DNA, 22 bp, Homo sapiens
acatgtcttgtggctttgatct

SEQ ID NO: 7407455 - DNA, 21 bp, Homo sapiens
acatgtctctaatctcagtga

SEQ ID NO: 7407456 - DNA, 21 bp, Homo sapiens
acatgtctctaatctcagtga

SEQ ID NO: 7407457 - DNA, 21 bp, Homo sapiens
acatgtctctaatctcagtga

SEQ ID NO: 7407458 - DNA, 21 bp, Homo sapiens
acatgtctctaatctcagtga

SEQ ID NO: 7407459 - DNA, 21 bp, Homo sapiens
acatgtctggtcatttttagc

SEQ ID NO: 7407460 - DNA, 21 bp, Homo sapiens
acatgtctggtcatttttagc

SEQ ID NO: 7407461 - DNA, 21 bp, Homo sapiens
acatgtctctaatctcagtga

SEQ ID NO: 7407462 - DNA, 22 bp, Homo sapiens
acatgtctcttctgaaagacaa

SEQ ID NO: 7407463 - DNA, 22 bp, Homo sapiens
aggctcaggaggagctgccgga

SEQ ID NO: 7407464 - DNA, 22 bp, Homo sapiens
aggctcaggaggagctgccgga

SEQ ID NO: 7407465 - DNA, 22 bp, Homo sapiens
aggctcaggaggagctgccgga

SEQ ID NO: 7407466 - DNA, 22 bp, Homo sapiens
aggctcagctggtggtgatcgc

SEQ ID NO: 7407467 - DNA, 22 bp, Homo sapiens
aggctcagctggtggtgatcgc

SEQ ID NO: 7407468 - DNA, 22 bp, Homo sapiens
aggctcagctggtggtgatcgc

SEQ ID NO: 7407469 - DNA, 22 bp, Homo sapiens
aggctcagctggtggtgatcgc

SEQ ID NO: 7407470 - DNA, 22 bp, Homo sapiens
aggctcagctggtggtgatcgc

SEQ ID NO: 7407471 - DNA, 22 bp, Homo sapiens
aggctcagctggtggtgatcgc

SEQ ID NO: 7407472 - DNA, 20 bp, Homo sapiens
aggctcagctgagctcttgg

SEQ ID NO: 7407473 - DNA, 22 bp, Homo sapiens
aggctcagctggtggtgatcgc

SEQ ID NO: 7407474 - DNA, 22 bp, Homo sapiens
aggctcagacaggaaaagtaac

SEQ ID NO: 7407475 - DNA, 20 bp, Homo sapiens
aggctcagctgagctcttgg

SEQ ID NO: 7407476 - DNA, 22 bp, Homo sapiens
aggctcagacaggaaaagtaac

SEQ ID NO: 7407477 - DNA, 20 bp, Homo sapiens
aggctcagctgagctcttgg

SEQ ID NO: 7407478 - DNA, 20 bp, Homo sapiens
aggctcagctgagctcttgg

SEQ ID NO: 7407479 - DNA, 20 bp, Homo sapiens
aggctcagctgagctcttgg

SEQ ID NO: 7407480 - DNA, 20 bp, Homo sapiens
aggctcagctgagctcttgg

SEQ ID NO: 7407481 - DNA, 22 bp, Homo sapiens
aggctcaggcaggaatggcgga

SEQ ID NO: 7407482 - DNA, 22 bp, Homo sapiens
aggctcaggcaggaatggcgga

SEQ ID NO: 7407483 - DNA, 22 bp, Homo sapiens
aggctcaggcaggaatggcgga

SEQ ID NO: 7407484 - DNA, 22 bp, Homo sapiens
aggctcaggaggagctgccgga

SEQ ID NO: 7407485 - DNA, 22 bp, Homo sapiens
aggctcaggaggagctgccgga

SEQ ID NO: 7407486 - DNA, 22 bp, Homo sapiens
aggctcaggaggagctgccgga

SEQ ID NO: 7407487 - DNA, 22 bp, Homo sapiens
aggctcaggaggagctgccgga

SEQ ID NO: 7407488 - DNA, 22 bp, Homo sapiens
aggctcagggactccctccctc

SEQ ID NO: 7407489 - DNA, 22 bp, Homo sapiens
aggctcagggacggggcccctt

SEQ ID NO: 7407490 - DNA, 22 bp, Homo sapiens
aggctcagggacggggcccctt

SEQ ID NO: 7407491 - DNA, 22 bp, Homo sapiens
aggctcagggactccctccctc

SEQ ID NO: 7407492 - DNA, 22 bp, Homo sapiens
aggctcagggactccctccctc

SEQ ID NO: 7407493 - DNA, 22 bp, Homo sapiens
aggctcaggcaggaatggcgga

SEQ ID NO: 7407494 - DNA, 22 bp, Homo sapiens
aggctcagggacggggcccctt

SEQ ID NO: 7407495 - DNA, 22 bp, Homo sapiens
aggctcagggacggggcccctt

SEQ ID NO: 7407496 - DNA, 22 bp, Homo sapiens
aggctcagggacggggcccctt

SEQ ID NO: 7407497 - DNA, 22 bp, Homo sapiens
aggctcaggcaggaatggcgga

SEQ ID NO: 7407498 - DNA, 22 bp, Homo sapiens
acatgtctacacattctgcaat

SEQ ID NO: 7407499 - DNA, 22 bp, Homo sapiens
acatgtctccacccatcttaaa

SEQ ID NO: 7407500 - DNA, 21 bp, Homo sapiens
acatgtcccctatgcttaagg

SEQ ID NO: 7407501 - DNA, 22 bp, Homo sapiens
acatgtctacacattctgcaat

SEQ ID NO: 7407502 - DNA, 22 bp, Homo sapiens
acatgtcaatttagtactctta

SEQ ID NO: 7407503 - DNA, 22 bp, Homo sapiens
acatgtattgacattatattct

SEQ ID NO: 7407504 - DNA, 22 bp, Homo sapiens
acatgtcaatttagtactctta

SEQ ID NO: 7407505 - DNA, 22 bp, Homo sapiens
acatgtattgacattatattct

SEQ ID NO: 7407506 - DNA, 22 bp, Homo sapiens
acatgtatgctttatgaagtag

SEQ ID NO: 7407507 - DNA, 22 bp, Homo sapiens
acatgtatgctttatgaagtag

SEQ ID NO: 7407508 - DNA, 22 bp, Homo sapiens
acatgtatgctttatgaagtag

SEQ ID NO: 7407509 - DNA, 22 bp, Homo sapiens
acatgtatgctttatgaagtag

SEQ ID NO: 7407510 - DNA, 22 bp, Homo sapiens
acatgtatgctttatgaagtag

SEQ ID NO: 7407511 - DNA, 22 bp, Homo sapiens
acatgtatacaatgtgtaatga

SEQ ID NO: 7407512 - DNA, 22 bp, Homo sapiens
acatgtatacaatgtgtaatga

SEQ ID NO: 7407513 - DNA, 22 bp, Homo sapiens
acatgtatacaatgtgtaatga

SEQ ID NO: 7407514 - DNA, 22 bp, Homo sapiens
acatgtaggagagtcacaatgc

SEQ ID NO: 7407515 - DNA, 22 bp, Homo sapiens
acatgtaggagagtcacaatgc

SEQ ID NO: 7407516 - DNA, 20 bp, Homo sapiens
acatgtactaatgaatacag

SEQ ID NO: 7407517 - DNA, 20 bp, Homo sapiens
acatgtactaatgaatacag

SEQ ID NO: 7407518 - DNA, 22 bp, Homo sapiens
acatgtacatacacatatgtaa

SEQ ID NO: 7407519 - DNA, 20 bp, Homo sapiens
acatgtactaatgaatacag

SEQ ID NO: 7407520 - DNA, 22 bp, Homo sapiens
acatgtacatacacatatgtaa

SEQ ID NO: 7407521 - DNA, 22 bp, Homo sapiens
acatgtacatacacatatgtaa

SEQ ID NO: 7407522 - DNA, 22 bp, Homo sapiens
acatgtacatacacatatgtaa

SEQ ID NO: 7407523 - DNA, 20 bp, Homo sapiens
acatgtacagacaggtttct

SEQ ID NO: 7407524 - DNA, 22 bp, Homo sapiens
acatggctcagtctcatgacag

SEQ ID NO: 7407525 - DNA, 22 bp, Homo sapiens
acatggctcagtctcatgacag

SEQ ID NO: 7407526 - DNA, 22 bp, Homo sapiens
acatggctaaagcaagtctaga

SEQ ID NO: 7407527 - DNA, 22 bp, Homo sapiens
acatggctaaattagctttact

SEQ ID NO: 7407528 - DNA, 22 bp, Homo sapiens
acatggctaaattagctttact

SEQ ID NO: 7407529 - DNA, 22 bp, Homo sapiens
acatggctcagtctcatgacag

SEQ ID NO: 7407530 - DNA, 22 bp, Homo sapiens
acatgtaaaaggaacatgcatg

SEQ ID NO: 7407531 - DNA, 22 bp, Homo sapiens
acatgtaaaaggaacatgcatg

SEQ ID NO: 7407532 - DNA, 22 bp, Homo sapiens
acatgtaaaagataaattaaca

SEQ ID NO: 7407533 - DNA, 22 bp, Homo sapiens
acatgtaaaagataaattaaca

SEQ ID NO: 7407534 - DNA, 22 bp, Homo sapiens
aggcagtgttcttctaagggca

SEQ ID NO: 7407535 - DNA, 22 bp, Homo sapiens
aggcagtgttcttctaagggca

SEQ ID NO: 7407536 - DNA, 22 bp, Homo sapiens
acatggctaaagcaagtctaga

SEQ ID NO: 7407537 - DNA, 22 bp, Homo sapiens
acatggctaaagcaagtctaga

SEQ ID NO: 7407538 - DNA, 22 bp, Homo sapiens
acatggcgggagtttcagatac

SEQ ID NO: 7407539 - DNA, 22 bp, Homo sapiens
aggcagtgtgtagctggaagag

SEQ ID NO: 7407540 - DNA, 22 bp, Homo sapiens
aggcagtgtgtagctggaagag

SEQ ID NO: 7407541 - DNA, 22 bp, Homo sapiens
aggcagtgttcttctaagggca

SEQ ID NO: 7407542 - DNA, 22 bp, Homo sapiens
acatgtaaaaggaacatgcatg

SEQ ID NO: 7407543 - DNA, 22 bp, Homo sapiens
acatgtaaaaggaacatgcatg

SEQ ID NO: 7407544 - DNA, 22 bp, Homo sapiens
acatgtaaacatttacagtatt

SEQ ID NO: 7407545 - DNA, 22 bp, Homo sapiens
acatgtaaacatttacagtatt

SEQ ID NO: 7407546 - DNA, 22 bp, Homo sapiens
acatgtaaacatttacagtatt

SEQ ID NO: 7407547 - DNA, 22 bp, Homo sapiens
acatgtaaacatttacagtatt

SEQ ID NO: 7407548 - DNA, 22 bp, Homo sapiens
acatgtaaacatttacagtatt

SEQ ID NO: 7407549 - DNA, 22 bp, Homo sapiens
acatgtaaacatttacagtatt

SEQ ID NO: 7407550 - DNA, 22 bp, Homo sapiens
acatgtaacatatatgtagcat

SEQ ID NO: 7407551 - DNA, 22 bp, Homo sapiens
acatgtaacatatatgtagcat

SEQ ID NO: 7407552 - DNA, 22 bp, Homo sapiens
acatgtaagactagcttaaagt

SEQ ID NO: 7407553 - DNA, 21 bp, Homo sapiens
acatgtaagagagtttcaaga

SEQ ID NO: 7407554 - DNA, 21 bp, Homo sapiens
acatgtaagagagtttcaaga

SEQ ID NO: 7407555 - DNA, 22 bp, Homo sapiens
acatgtaacatatatgtagcat

SEQ ID NO: 7407556 - DNA, 22 bp, Homo sapiens
acatgtaagactagcttaaagt

SEQ ID NO: 7407557 - DNA, 22 bp, Homo sapiens
acatgtaagactagcttaaagt

SEQ ID NO: 7407558 - DNA, 22 bp, Homo sapiens
acatgtaagactagcttaaagt

SEQ ID NO: 7407559 - DNA, 22 bp, Homo sapiens
aggctctgaaggagaacctgtt

SEQ ID NO: 7407560 - DNA, 22 bp, Homo sapiens
aggctctgaaggagaacctgtt

SEQ ID NO: 7407561 - DNA, 22 bp, Homo sapiens
aggctctgaaggagaacctgtt

SEQ ID NO: 7407562 - DNA, 22 bp, Homo sapiens
aggctctctctgccagccgtgc

SEQ ID NO: 7407563 - DNA, 22 bp, Homo sapiens
aggctctctctgcccctgggac

SEQ ID NO: 7407564 - DNA, 22 bp, Homo sapiens
aggctctgaagcaaccctttga

SEQ ID NO: 7407565 - DNA, 22 bp, Homo sapiens
aggctctgacccatgggaccca

SEQ ID NO: 7407566 - DNA, 22 bp, Homo sapiens
aggctctgacccatgggaccca

SEQ ID NO: 7407567 - DNA, 22 bp, Homo sapiens
aggctctgacccatgggaccca

SEQ ID NO: 7407568 - DNA, 22 bp, Homo sapiens
aggctctctctgcccctgggac

SEQ ID NO: 7407569 - DNA, 22 bp, Homo sapiens
aggctctctagaaactgtgcct

SEQ ID NO: 7407570 - DNA, 22 bp, Homo sapiens
aggctctctagaaactgtgcct

SEQ ID NO: 7407571 - DNA, 22 bp, Homo sapiens
aggctctcaccctctgaccaga

SEQ ID NO: 7407572 - DNA, 22 bp, Homo sapiens
aggctctcctccccaggaccat

SEQ ID NO: 7407573 - DNA, 22 bp, Homo sapiens
aggctctcctccccaggaccat

SEQ ID NO: 7407574 - DNA, 22 bp, Homo sapiens
aggctctccagagagctgcttt

SEQ ID NO: 7407575 - DNA, 22 bp, Homo sapiens
aggctctccagagagctgcttt

SEQ ID NO: 7407576 - DNA, 22 bp, Homo sapiens
aggctctcctccccaggaccat

SEQ ID NO: 7407577 - DNA, 22 bp, Homo sapiens
aggctctcctccccaggaccat

SEQ ID NO: 7407578 - DNA, 22 bp, Homo sapiens
aggctctccagagagctgcttt

SEQ ID NO: 7407579 - DNA, 22 bp, Homo sapiens
aggctctcagatcagccacatt

SEQ ID NO: 7407580 - DNA, 22 bp, Homo sapiens
aggctctcagatcagccacatt

SEQ ID NO: 7407581 - DNA, 21 bp, Homo sapiens
aggctctcatccagggaccca

SEQ ID NO: 7407582 - DNA, 21 bp, Homo sapiens
aggctctcatccagggaccca

SEQ ID NO: 7407583 - DNA, 21 bp, Homo sapiens
aggctctcatccagggaccca

SEQ ID NO: 7407584 - DNA, 22 bp, Homo sapiens
aggctctcaccctctgaccaga

SEQ ID NO: 7407585 - DNA, 22 bp, Homo sapiens
aggctctcaccctctgaccaga

SEQ ID NO: 7407586 - DNA, 22 bp, Homo sapiens
aggctctcaccctctgaccaga

SEQ ID NO: 7407587 - DNA, 22 bp, Homo sapiens
aggctctcagatcagccacatt

SEQ ID NO: 7407588 - DNA, 22 bp, Homo sapiens
aggctctcactatcctcctagc

SEQ ID NO: 7407589 - DNA, 22 bp, Homo sapiens
aggctctcaccctctgaccaga

SEQ ID NO: 7407590 - DNA, 22 bp, Homo sapiens
aggctctcaatatgatccagtc

SEQ ID NO: 7407591 - DNA, 22 bp, Homo sapiens
aggctctcaatatgatccagtc

SEQ ID NO: 7407592 - DNA, 22 bp, Homo sapiens
aggctctcaatatgatccagtc

SEQ ID NO: 7407593 - DNA, 22 bp, Homo sapiens
aggctctcaatatgatccagtc

SEQ ID NO: 7407594 - DNA, 22 bp, Homo sapiens
aggctctggacagtgaggagtt

SEQ ID NO: 7407595 - DNA, 22 bp, Homo sapiens
aggctctggacagtgaggagtt

SEQ ID NO: 7407596 - DNA, 22 bp, Homo sapiens
aggctctggacagtgaggagtt

SEQ ID NO: 7407597 - DNA, 22 bp, Homo sapiens
aggctctggacagtgaggagtt

SEQ ID NO: 7407598 - DNA, 22 bp, Homo sapiens
aggctctggacagtgaggagtt

SEQ ID NO: 7407599 - DNA, 22 bp, Homo sapiens
aggctctggacagtgaggagtt

SEQ ID NO: 7407600 - DNA, 19 bp, Homo sapiens
aggctctgagctcctggag

SEQ ID NO: 7407601 - DNA, 19 bp, Homo sapiens
aggctctgagctcctggag

SEQ ID NO: 7407602 - DNA, 22 bp, Homo sapiens
aggctctgacccatgggaccca

SEQ ID NO: 7407603 - DNA, 22 bp, Homo sapiens
aggctctgacccatgggaccca

SEQ ID NO: 7407604 - DNA, 22 bp, Homo sapiens
aggctctgacccatgggaccca

SEQ ID NO: 7407605 - DNA, 22 bp, Homo sapiens
aggctctgaaggagaacctgtt

SEQ ID NO: 7407606 - DNA, 22 bp, Homo sapiens
aggctctgacgtcacacgtggc

SEQ ID NO: 7407607 - DNA, 22 bp, Homo sapiens
aggctctgacgtcacacgtggc

SEQ ID NO: 7407608 - DNA, 22 bp, Homo sapiens
aggctctgacgtcacacgtggc

SEQ ID NO: 7407609 - DNA, 22 bp, Homo sapiens
aggctctggagttagccaggca

SEQ ID NO: 7407610 - DNA, 22 bp, Homo sapiens
aggctctggagtgtggtgctgg

SEQ ID NO: 7407611 - DNA, 22 bp, Homo sapiens
aggctctggagtgtggtgctgg

SEQ ID NO: 7407612 - DNA, 22 bp, Homo sapiens
aggctctggagttagccaggca

SEQ ID NO: 7407613 - DNA, 22 bp, Homo sapiens
aggctctggagttagccaggca

SEQ ID NO: 7407614 - DNA, 22 bp, Homo sapiens
aggctctggagttagccaggca

SEQ ID NO: 7407615 - DNA, 22 bp, Homo sapiens
aggctctggagttagccaggca

SEQ ID NO: 7407616 - DNA, 22 bp, Homo sapiens
aggctctggagttagccaggca

SEQ ID NO: 7407617 - DNA, 22 bp, Homo sapiens
aggctctggagttagccaggca

SEQ ID NO: 7407618 - DNA, 22 bp, Homo sapiens
aggctctggacagtgaggagtt

SEQ ID NO: 7407619 - DNA, 22 bp, Homo sapiens
aggctctggagaagaatccgct

SEQ ID NO: 7407620 - DNA, 22 bp, Homo sapiens
aggctctggagtgtggtgctgg

SEQ ID NO: 7407621 - DNA, 22 bp, Homo sapiens
aggctctggagtgtggtgctgg

SEQ ID NO: 7407622 - DNA, 22 bp, Homo sapiens
aggctctggagtgtggtgctgg

SEQ ID NO: 7407623 - DNA, 22 bp, Homo sapiens
aggctctggagtgtggtgctgg

SEQ ID NO: 7407624 - DNA, 19 bp, Homo sapiens
acatgttttgcagaacagc

SEQ ID NO: 7407625 - DNA, 22 bp, Homo sapiens
aggctcaggtctcaggtctggc

SEQ ID NO: 7407626 - DNA, 19 bp, Homo sapiens
acatgttttgcagaacagc

SEQ ID NO: 7407627 - DNA, 22 bp, Homo sapiens
acatgttttgtgccttgactag

SEQ ID NO: 7407628 - DNA, 22 bp, Homo sapiens
acatgttttgtgccttgactag

SEQ ID NO: 7407629 - DNA, 22 bp, Homo sapiens
acatgttttgtgccttgactag

SEQ ID NO: 7407630 - DNA, 22 bp, Homo sapiens
acattaaaaaatgttgcatgaa

SEQ ID NO: 7407631 - DNA, 22 bp, Homo sapiens
acattaaaaaatgttgcatgaa

SEQ ID NO: 7407632 - DNA, 22 bp, Homo sapiens
acattaaaaaatgttgcatgaa

SEQ ID NO: 7407633 - DNA, 22 bp, Homo sapiens
acattaaaaaatgttgcatgaa

SEQ ID NO: 7407634 - DNA, 22 bp, Homo sapiens
acattaaaaaatgttgcatgaa

SEQ ID NO: 7407635 - DNA, 22 bp, Homo sapiens
acatgttttgtgccttgactag

SEQ ID NO: 7407636 - DNA, 22 bp, Homo sapiens
acattaaaatggagaattttga

SEQ ID NO: 7407637 - DNA, 22 bp, Homo sapiens
acattaaaatggagaattttga

SEQ ID NO: 7407638 - DNA, 22 bp, Homo sapiens
acattaaaatggagaattttga

SEQ ID NO: 7407639 - DNA, 22 bp, Homo sapiens
acattaaaatggagaattttga

SEQ ID NO: 7407640 - DNA, 22 bp, Homo sapiens
acattaaaatggagaattttga

SEQ ID NO: 7407641 - DNA, 22 bp, Homo sapiens
acattaaacttgcttggctgta

SEQ ID NO: 7407642 - DNA, 22 bp, Homo sapiens
acattaaaatggagaattttga

SEQ ID NO: 7407643 - DNA, 22 bp, Homo sapiens
acattaaaattgggtggggtaa

SEQ ID NO: 7407644 - DNA, 22 bp, Homo sapiens
acattaaaattgggtggggtaa

SEQ ID NO: 7407645 - DNA, 22 bp, Homo sapiens
acattaaaattgggtggggtaa

SEQ ID NO: 7407646 - DNA, 22 bp, Homo sapiens
acattaaaattgggtggggtaa

SEQ ID NO: 7407647 - DNA, 20 bp, Homo sapiens
aggctcagggtgtttaggaa

SEQ ID NO: 7407648 - DNA, 22 bp, Homo sapiens
aggctcagggactccctccctc

SEQ ID NO: 7407649 - DNA, 22 bp, Homo sapiens
aggctcagggactccctccctc

SEQ ID NO: 7407650 - DNA, 22 bp, Homo sapiens
aggctcaggtctcaggtctggc

SEQ ID NO: 7407651 - DNA, 22 bp, Homo sapiens
aggctcaggtctcaggtctggc

SEQ ID NO: 7407652 - DNA, 22 bp, Homo sapiens
aggctcaggtctcaggtctggc

SEQ ID NO: 7407653 - DNA, 22 bp, Homo sapiens
aggctcaggtctcaggtctggc

SEQ ID NO: 7407654 - DNA, 22 bp, Homo sapiens
aggctcaggtctcaggtctggc

SEQ ID NO: 7407655 - DNA, 20 bp, Homo sapiens
aggctcagggtgtttaggaa

SEQ ID NO: 7407656 - DNA, 20 bp, Homo sapiens
aggctcagggtgtttaggaa

SEQ ID NO: 7407657 - DNA, 20 bp, Homo sapiens
aggctcagggtgtttaggaa

SEQ ID NO: 7407658 - DNA, 20 bp, Homo sapiens
aggctcagggtgtttaggaa

SEQ ID NO: 7407659 - DNA, 19 bp, Homo sapiens
acatgttttgcagaacagc

SEQ ID NO: 7407660 - DNA, 22 bp, Homo sapiens
aggctcaggtctcaggtctggc

SEQ ID NO: 7407661 - DNA, 22 bp, Homo sapiens
aggctcaggtctcaggtctggc

SEQ ID NO: 7407662 - DNA, 22 bp, Homo sapiens
aggctcaggtctcaggtctggc

SEQ ID NO: 7407663 - DNA, 22 bp, Homo sapiens
aggctcaggtctcaggtctggc

SEQ ID NO: 7407664 - DNA, 22 bp, Homo sapiens
aggctcaggtctcaggtctggc

SEQ ID NO: 7407665 - DNA, 22 bp, Homo sapiens
aggctcaggtctcaggtctggc

SEQ ID NO: 7407666 - DNA, 22 bp, Homo sapiens
acattaaatttcatagtgatta

SEQ ID NO: 7407667 - DNA, 22 bp, Homo sapiens
acattaaatttcatagtgatta

SEQ ID NO: 7407668 - DNA, 22 bp, Homo sapiens
acattaaatttcatagtgatta

SEQ ID NO: 7407669 - DNA, 22 bp, Homo sapiens
acattaaatttcatagtgatta

SEQ ID NO: 7407670 - DNA, 22 bp, Homo sapiens
acattaaatttcatagtgatta

SEQ ID NO: 7407671 - DNA, 22 bp, Homo sapiens
acattaaatttcatagtgatta

SEQ ID NO: 7407672 - DNA, 22 bp, Homo sapiens
acattaaatttcatagtgatta

SEQ ID NO: 7407673 - DNA, 22 bp, Homo sapiens
acattaaagagtaaggttagtt

SEQ ID NO: 7407674 - DNA, 22 bp, Homo sapiens
acattaaagagtaaggttagtt

SEQ ID NO: 7407675 - DNA, 22 bp, Homo sapiens
acattaaagagtaaggttagtt

SEQ ID NO: 7407676 - DNA, 22 bp, Homo sapiens
acattaaatttcatagtgatta

SEQ ID NO: 7407677 - DNA, 22 bp, Homo sapiens
acattaaagagtaaggttagtt

SEQ ID NO: 7407678 - DNA, 22 bp, Homo sapiens
acattaaagagtaaggttagtt

SEQ ID NO: 7407679 - DNA, 22 bp, Homo sapiens
acattaaagagtaaggttagtt

SEQ ID NO: 7407680 - DNA, 22 bp, Homo sapiens
acattaaacttgcttggctgta

SEQ ID NO: 7407681 - DNA, 22 bp, Homo sapiens
acattaaacttgcttggctgta

SEQ ID NO: 7407682 - DNA, 22 bp, Homo sapiens
acattaaacttgcttggctgta

SEQ ID NO: 7407683 - DNA, 22 bp, Homo sapiens
acattaaacttgcttggctgta

SEQ ID NO: 7407684 - DNA, 22 bp, Homo sapiens
aggctccagtctcctctggcag

SEQ ID NO: 7407685 - DNA, 22 bp, Homo sapiens
aggctccagtctcctctggcag

SEQ ID NO: 7407686 - DNA, 22 bp, Homo sapiens
aggctccagtctcctctggcag

SEQ ID NO: 7407687 - DNA, 22 bp, Homo sapiens
aggctccagtctcctctggcag

SEQ ID NO: 7407688 - DNA, 22 bp, Homo sapiens
acattaacaccgtgagtttggt

SEQ ID NO: 7407689 - DNA, 22 bp, Homo sapiens
acattaacaccataagtgtgtt

SEQ ID NO: 7407690 - DNA, 22 bp, Homo sapiens
aggctcgcatgccctgcaccac

SEQ ID NO: 7407691 - DNA, 22 bp, Homo sapiens
aggctcgcatgccctgcaccac

SEQ ID NO: 7407692 - DNA, 22 bp, Homo sapiens
aggctctataccgctgggagtt

SEQ ID NO: 7407693 - DNA, 22 bp, Homo sapiens
aggctctataccgctgggagtt

SEQ ID NO: 7407694 - DNA, 22 bp, Homo sapiens
aggctccagtctcctctggcag

SEQ ID NO: 7407695 - DNA, 22 bp, Homo sapiens
aggctcctttaccattctggag

SEQ ID NO: 7407696 - DNA, 22 bp, Homo sapiens
accacaggacccatgagtcagt

SEQ ID NO: 7407697 - DNA, 22 bp, Homo sapiens
accacaggacccatgagtcagt

SEQ ID NO: 7407698 - DNA, 22 bp, Homo sapiens
accacaggacccatgagtcagt

SEQ ID NO: 7407699 - DNA, 22 bp, Homo sapiens
aggctgtgattccaccactctc

SEQ ID NO: 7407700 - DNA, 22 bp, Homo sapiens
aggctgtgattccaccactctc

SEQ ID NO: 7407701 - DNA, 22 bp, Homo sapiens
accacaggacccatgagtcagt

SEQ ID NO: 7407702 - DNA, 22 bp, Homo sapiens
accacaggacccatgagtcagt

SEQ ID NO: 7407703 - DNA, 22 bp, Homo sapiens
accacaggacccatgagtcagt

SEQ ID NO: 7407704 - DNA, 22 bp, Homo sapiens
accacaggaattgctctgtggt

SEQ ID NO: 7407705 - DNA, 22 bp, Homo sapiens
aggctgtgatgagcctcatgga

SEQ ID NO: 7407706 - DNA, 22 bp, Homo sapiens
aggctgtgatgagcctcatgga

SEQ ID NO: 7407707 - DNA, 22 bp, Homo sapiens
aggctgtgatgagcctcatgga

SEQ ID NO: 7407708 - DNA, 22 bp, Homo sapiens
aggctgtgatgagcctcatgga

SEQ ID NO: 7407709 - DNA, 22 bp, Homo sapiens
aggctgtgatgagcctcatgga

SEQ ID NO: 7407710 - DNA, 22 bp, Homo sapiens
aggctgtgattccaccactctc

SEQ ID NO: 7407711 - DNA, 22 bp, Homo sapiens
aggctgtgatggatgtaaagga

SEQ ID NO: 7407712 - DNA, 22 bp, Homo sapiens
aggctgtgatggatgtaaagga

SEQ ID NO: 7407713 - DNA, 22 bp, Homo sapiens
aggctgtgatggatgtaaagga

SEQ ID NO: 7407714 - DNA, 22 bp, Homo sapiens
aggctgtgatgagcctcatgga

SEQ ID NO: 7407715 - DNA, 22 bp, Homo sapiens
aggctgtgatgagcctcatgga

SEQ ID NO: 7407716 - DNA, 22 bp, Homo sapiens
aggctgtgatgagcctcatgga

SEQ ID NO: 7407717 - DNA, 22 bp, Homo sapiens
accactgcccatggtgaaaact

SEQ ID NO: 7407718 - DNA, 22 bp, Homo sapiens
accactgcccatggtgaaaact

SEQ ID NO: 7407719 - DNA, 22 bp, Homo sapiens
accactgcccatggtgaaaact

SEQ ID NO: 7407720 - DNA, 21 bp, Homo sapiens
accactgcctccaaggttcag

SEQ ID NO: 7407721 - DNA, 22 bp, Homo sapiens
accactgcccatggtgaaaact

SEQ ID NO: 7407722 - DNA, 22 bp, Homo sapiens
accactgcccatggtgaaaact

SEQ ID NO: 7407723 - DNA, 22 bp, Homo sapiens
accactgggcgggcagcctgct

SEQ ID NO: 7407724 - DNA, 22 bp, Homo sapiens
accactgggcgggcagcctgct

SEQ ID NO: 7407725 - DNA, 22 bp, Homo sapiens
accactggcctggtggggacca

SEQ ID NO: 7407726 - DNA, 22 bp, Homo sapiens
accactggctcaggagctggga

SEQ ID NO: 7407727 - DNA, 22 bp, Homo sapiens
accactggctcaggagctggga

SEQ ID NO: 7407728 - DNA, 22 bp, Homo sapiens
accactggctcaggagctggga

SEQ ID NO: 7407729 - DNA, 22 bp, Homo sapiens
accactggcctggtggggacca

SEQ ID NO: 7407730 - DNA, 19 bp, Homo sapiens
accactggccacacactcc

SEQ ID NO: 7407731 - DNA, 19 bp, Homo sapiens
accactggccacacactcc

SEQ ID NO: 7407732 - DNA, 22 bp, Homo sapiens
accactggatatcagagatgta

SEQ ID NO: 7407733 - DNA, 22 bp, Homo sapiens
accactgcccatggtgaaaact

SEQ ID NO: 7407734 - DNA, 22 bp, Homo sapiens
accactggatatcagagatgta

SEQ ID NO: 7407735 - DNA, 22 bp, Homo sapiens
accactggatatcagagatgta

SEQ ID NO: 7407736 - DNA, 22 bp, Homo sapiens
accactggatatcagagatgta

SEQ ID NO: 7407737 - DNA, 22 bp, Homo sapiens
accagaaaggaataatagaatt

SEQ ID NO: 7407738 - DNA, 22 bp, Homo sapiens
accagaaaggaataatagaatt

SEQ ID NO: 7407739 - DNA, 22 bp, Homo sapiens
accagaaaggaataatagaatt

SEQ ID NO: 7407740 - DNA, 22 bp, Homo sapiens
accagaaaggaataatagaatt

SEQ ID NO: 7407741 - DNA, 22 bp, Homo sapiens
accagaagacagaaatattatt

SEQ ID NO: 7407742 - DNA, 22 bp, Homo sapiens
accagaagacagaaatattatt

SEQ ID NO: 7407743 - DNA, 22 bp, Homo sapiens
accagaaaggaataatagaatt

SEQ ID NO: 7407744 - DNA, 22 bp, Homo sapiens
accagaaaggatgcctccttcc

SEQ ID NO: 7407745 - DNA, 22 bp, Homo sapiens
accagaaaggaataatagaatt

SEQ ID NO: 7407746 - DNA, 22 bp, Homo sapiens
accagaaaggaataatagaatt

SEQ ID NO: 7407747 - DNA, 22 bp, Homo sapiens
accagaaaggaataatagaatt

SEQ ID NO: 7407748 - DNA, 22 bp, Homo sapiens
accagaagttctccaaaaagat

SEQ ID NO: 7407749 - DNA, 22 bp, Homo sapiens
accagacactgtgaagacaggc

SEQ ID NO: 7407750 - DNA, 22 bp, Homo sapiens
accagacactgtgaagacaggc

SEQ ID NO: 7407751 - DNA, 22 bp, Homo sapiens
accagacactgtgaagacaggc

SEQ ID NO: 7407752 - DNA, 22 bp, Homo sapiens
accagaaaggatgcctccttcc

SEQ ID NO: 7407753 - DNA, 22 bp, Homo sapiens
accagaagctggagcacaagga

SEQ ID NO: 7407754 - DNA, 22 bp, Homo sapiens
accagaagctggagcacaagga

SEQ ID NO: 7407755 - DNA, 22 bp, Homo sapiens
accagaagctggagcacaagga

SEQ ID NO: 7407756 - DNA, 22 bp, Homo sapiens
accagaaggaccagaggcaagg

SEQ ID NO: 7407757 - DNA, 22 bp, Homo sapiens
accagaagttctccaaaaagat

SEQ ID NO: 7407758 - DNA, 22 bp, Homo sapiens
accagaaggaccagaggcaagg

SEQ ID NO: 7407759 - DNA, 22 bp, Homo sapiens
accactggggcaagtcttcaaa

SEQ ID NO: 7407760 - DNA, 22 bp, Homo sapiens
accactgggcgggcagcctgct

SEQ ID NO: 7407761 - DNA, 22 bp, Homo sapiens
accactggttttgcagaggcgc

SEQ ID NO: 7407762 - DNA, 22 bp, Homo sapiens
accactggttttgcagaggcgc

SEQ ID NO: 7407763 - DNA, 22 bp, Homo sapiens
accactggttttgcagaggcgc

SEQ ID NO: 7407764 - DNA, 22 bp, Homo sapiens
accactgtacagcagatatagt

SEQ ID NO: 7407765 - DNA, 22 bp, Homo sapiens
accactgtactatttgagtggc

SEQ ID NO: 7407766 - DNA, 22 bp, Homo sapiens
accactttacagaaatggaaag

SEQ ID NO: 7407767 - DNA, 22 bp, Homo sapiens
accactttacagaaatggaaag

SEQ ID NO: 7407768 - DNA, 22 bp, Homo sapiens
accactttggtatttcaatttt

SEQ ID NO: 7407769 - DNA, 22 bp, Homo sapiens
accactttggtatttcaatttt

SEQ ID NO: 7407770 - DNA, 22 bp, Homo sapiens
accactttggtatttcaatttt

SEQ ID NO: 7407771 - DNA, 17 bp, Homo sapiens
accactttgccaagttg

SEQ ID NO: 7407772 - DNA, 17 bp, Homo sapiens
accactttgccaagttg

SEQ ID NO: 7407773 - DNA, 22 bp, Homo sapiens
accactgtctacacattgactc

SEQ ID NO: 7407774 - DNA, 22 bp, Homo sapiens
accactgtctacacattgactc

SEQ ID NO: 7407775 - DNA, 22 bp, Homo sapiens
accactgtatctccagcacatt

SEQ ID NO: 7407776 - DNA, 22 bp, Homo sapiens
accactgtctacacattgactc

SEQ ID NO: 7407777 - DNA, 22 bp, Homo sapiens
aggctgtgagttttgtctcaga

SEQ ID NO: 7407778 - DNA, 22 bp, Homo sapiens
aggctgtgagtagttcttgttg

SEQ ID NO: 7407779 - DNA, 22 bp, Homo sapiens
aggctgtgaggggcccgcatgc

SEQ ID NO: 7407780 - DNA, 19 bp, Homo sapiens
aggctgtgaggggaaggaa

SEQ ID NO: 7407781 - DNA, 22 bp, Homo sapiens
aggctgtgatctcatgatttgt

SEQ ID NO: 7407782 - DNA, 22 bp, Homo sapiens
aggctgtgagttttgtctcaga

SEQ ID NO: 7407783 - DNA, 22 bp, Homo sapiens
aggctgtgagttttgtctcaga

SEQ ID NO: 7407784 - DNA, 22 bp, Homo sapiens
aggctgtgagttttgtctcaga

SEQ ID NO: 7407785 - DNA, 19 bp, Homo sapiens
aggctgtgagggaggactc

SEQ ID NO: 7407786 - DNA, 19 bp, Homo sapiens
aggctgtgagggaggactc

SEQ ID NO: 7407787 - DNA, 19 bp, Homo sapiens
aggctgtgaggggaaggaa

SEQ ID NO: 7407788 - DNA, 19 bp, Homo sapiens
aggctgtgaggggaaggaa

SEQ ID NO: 7407789 - DNA, 19 bp, Homo sapiens
aggctgtgagggaggactc

SEQ ID NO: 7407790 - DNA, 19 bp, Homo sapiens
aggctgtgaggggaaggaa

SEQ ID NO: 7407791 - DNA, 19 bp, Homo sapiens
aggctgtgaggggaaggaa

SEQ ID NO: 7407792 - DNA, 22 bp, Homo sapiens
aggctgtgagaggtggctccca

SEQ ID NO: 7407793 - DNA, 22 bp, Homo sapiens
aggctgtgagaggtggctccca

SEQ ID NO: 7407794 - DNA, 22 bp, Homo sapiens
aggctgtgagaggtggctccca

SEQ ID NO: 7407795 - DNA, 22 bp, Homo sapiens
aggctgtgagaggtggctccca

SEQ ID NO: 7407796 - DNA, 22 bp, Homo sapiens
aggctgtgagaagtccttcagt

SEQ ID NO: 7407797 - DNA, 22 bp, Homo sapiens
aggctgtgagaggtggctccca

SEQ ID NO: 7407798 - DNA, 22 bp, Homo sapiens
aggctgtgagaggtggctccca

SEQ ID NO: 7407799 - DNA, 22 bp, Homo sapiens
aggctgtgagaagtccttcagt

SEQ ID NO: 7407800 - DNA, 22 bp, Homo sapiens
aggctgtgagaagtccttcagt

SEQ ID NO: 7407801 - DNA, 22 bp, Homo sapiens
aggctgtgagaagtccttcagt

SEQ ID NO: 7407802 - DNA, 19 bp, Homo sapiens
aggctgtgagggaggactc

SEQ ID NO: 7407803 - DNA, 19 bp, Homo sapiens
aggctgtgagggaggactc

SEQ ID NO: 7407804 - DNA, 19 bp, Homo sapiens
aggctgtgagggaggactc

SEQ ID NO: 7407805 - DNA, 19 bp, Homo sapiens
aggctgtgagggaggactc

SEQ ID NO: 7407806 - DNA, 22 bp, Homo sapiens
aggctgtgagcaagaacaccta

SEQ ID NO: 7407807 - DNA, 22 bp, Homo sapiens
aggctgtgagcaagaacaccta

SEQ ID NO: 7407808 - DNA, 22 bp, Homo sapiens
aggctgtgagcaagaacaccta

SEQ ID NO: 7407809 - DNA, 19 bp, Homo sapiens
aggctgtgagggaggactc

SEQ ID NO: 7407810 - DNA, 22 bp, Homo sapiens
aggctggctttggtagcatggt

SEQ ID NO: 7407811 - DNA, 22 bp, Homo sapiens
aggctggctttggtagcatggt

SEQ ID NO: 7407812 - DNA, 22 bp, Homo sapiens
aggctggctttggtagcatggt

SEQ ID NO: 7407813 - DNA, 22 bp, Homo sapiens
aggctggctttggtagcatggt

SEQ ID NO: 7407814 - DNA, 22 bp, Homo sapiens
aggctggctttggtagcatggt

SEQ ID NO: 7407815 - DNA, 22 bp, Homo sapiens
aggctggcttggctctcctgtg

SEQ ID NO: 7407816 - DNA, 22 bp, Homo sapiens
aggctggctttggtagcatggt

SEQ ID NO: 7407817 - DNA, 22 bp, Homo sapiens
aggctggctttggtagcatggt

SEQ ID NO: 7407818 - DNA, 22 bp, Homo sapiens
aggctgggaaacctgaagttgt

SEQ ID NO: 7407819 - DNA, 22 bp, Homo sapiens
aggctgggaaacctgaagttgt

SEQ ID NO: 7407820 - DNA, 22 bp, Homo sapiens
aggctgggaaacctgaagttgt

SEQ ID NO: 7407821 - DNA, 22 bp, Homo sapiens
aggctgggaaacctgaagttgt

SEQ ID NO: 7407822 - DNA, 22 bp, Homo sapiens
aggctgggaaacctgaagttgt

SEQ ID NO: 7407823 - DNA, 22 bp, Homo sapiens
aggctgggaaacctgaagttgt

SEQ ID NO: 7407824 - DNA, 22 bp, Homo sapiens
aggctgggaaatgtattccagc

SEQ ID NO: 7407825 - DNA, 22 bp, Homo sapiens
aggctgggaaatgtattccagc

SEQ ID NO: 7407826 - DNA, 22 bp, Homo sapiens
aggctgggaaatgtagtcttcc

SEQ ID NO: 7407827 - DNA, 22 bp, Homo sapiens
aggctgggaaatgtattccagc

SEQ ID NO: 7407828 - DNA, 22 bp, Homo sapiens
aggctgggaaatgtattccagc

SEQ ID NO: 7407829 - DNA, 22 bp, Homo sapiens
aggctgggaaatgtattccagc

SEQ ID NO: 7407830 - DNA, 22 bp, Homo sapiens
aggctgggaaatgtattccagc

SEQ ID NO: 7407831 - DNA, 22 bp, Homo sapiens
aggctgggaaatgtattccagc

SEQ ID NO: 7407832 - DNA, 22 bp, Homo sapiens
aggctgggaaatgtagtcttcc

SEQ ID NO: 7407833 - DNA, 22 bp, Homo sapiens
aggctgggaaatgtagtcttcc

SEQ ID NO: 7407834 - DNA, 22 bp, Homo sapiens
aggctgggaaatgtagtcttcc

SEQ ID NO: 7407835 - DNA, 22 bp, Homo sapiens
aggctgggaaatgtagtcttcc

SEQ ID NO: 7407836 - DNA, 22 bp, Homo sapiens
aggctgggaaacctgaagttgt

SEQ ID NO: 7407837 - DNA, 22 bp, Homo sapiens
aggctgggaaacctgaagttgt

SEQ ID NO: 7407838 - DNA, 22 bp, Homo sapiens
aggctgggaaatgtagtcttcc

SEQ ID NO: 7407839 - DNA, 22 bp, Homo sapiens
aggctgggaaatgtagtcttcc

SEQ ID NO: 7407840 - DNA, 22 bp, Homo sapiens
acatttctcaggtaagtcattt

SEQ ID NO: 7407841 - DNA, 22 bp, Homo sapiens
acatttctcaggtaagtcattt

SEQ ID NO: 7407842 - DNA, 22 bp, Homo sapiens
acatttctcaggtaagtcattt

SEQ ID NO: 7407843 - DNA, 22 bp, Homo sapiens
acatttctcaggtaagtcattt

SEQ ID NO: 7407844 - DNA, 22 bp, Homo sapiens
acatttctcaggtaagtcattt

SEQ ID NO: 7407845 - DNA, 22 bp, Homo sapiens
acatttctcaggtaagtcattt

SEQ ID NO: 7407846 - DNA, 22 bp, Homo sapiens
acatttctcatctagtagagta

SEQ ID NO: 7407847 - DNA, 22 bp, Homo sapiens
acatttctcatctagtagagta

SEQ ID NO: 7407848 - DNA, 22 bp, Homo sapiens
acatttctcataggagagccac

SEQ ID NO: 7407849 - DNA, 22 bp, Homo sapiens
acatttctcataggagagccac

SEQ ID NO: 7407850 - DNA, 22 bp, Homo sapiens
acatttctcaggtaagtcattt

SEQ ID NO: 7407851 - DNA, 22 bp, Homo sapiens
acatttctcataggagagccac

SEQ ID NO: 7407852 - DNA, 22 bp, Homo sapiens
acatttctcatctagtagagta

SEQ ID NO: 7407853 - DNA, 22 bp, Homo sapiens
acatttctcatctagtagagta

SEQ ID NO: 7407854 - DNA, 22 bp, Homo sapiens
acatttctcatctagtagagta

SEQ ID NO: 7407855 - DNA, 22 bp, Homo sapiens
acatttctcattctcccctaac

SEQ ID NO: 7407856 - DNA, 18 bp, Homo sapiens
acatttctccttctgacc

SEQ ID NO: 7407857 - DNA, 22 bp, Homo sapiens
acatttctcctacttgttattt

SEQ ID NO: 7407858 - DNA, 18 bp, Homo sapiens
acatttctccttctgacc

SEQ ID NO: 7407859 - DNA, 22 bp, Homo sapiens
acatttctcctacttgttattt

SEQ ID NO: 7407860 - DNA, 22 bp, Homo sapiens
acatttctcctacttgttattt

SEQ ID NO: 7407861 - DNA, 22 bp, Homo sapiens
acatttctcctacttgttattt

SEQ ID NO: 7407862 - DNA, 18 bp, Homo sapiens
acatttctccttctgacc

SEQ ID NO: 7407863 - DNA, 18 bp, Homo sapiens
acatttctccttctgacc

SEQ ID NO: 7407864 - DNA, 18 bp, Homo sapiens
acatttctccttctgacc

SEQ ID NO: 7407865 - DNA, 18 bp, Homo sapiens
acatttctccttctgacc

SEQ ID NO: 7407866 - DNA, 18 bp, Homo sapiens
acatttctccttctgacc

SEQ ID NO: 7407867 - DNA, 22 bp, Homo sapiens
acatttctcattctcccctaac

SEQ ID NO: 7407868 - DNA, 22 bp, Homo sapiens
acatttctccctgcatgcctgc

SEQ ID NO: 7407869 - DNA, 22 bp, Homo sapiens
acatttctcattctcccctaac

SEQ ID NO: 7407870 - DNA, 22 bp, Homo sapiens
acatttctccctgcatgcctgc

SEQ ID NO: 7407871 - DNA, 22 bp, Homo sapiens
acatttctccctgcatgcctgc

SEQ ID NO: 7407872 - DNA, 22 bp, Homo sapiens
acatttctccctgcatgcctgc

SEQ ID NO: 7407873 - DNA, 22 bp, Homo sapiens
acatttctccctgcatgcctgc

SEQ ID NO: 7407874 - DNA, 22 bp, Homo sapiens
acatttctccctgcatgcctgc

SEQ ID NO: 7407875 - DNA, 22 bp, Homo sapiens
acatttctccctgcatgcctgc

SEQ ID NO: 7407876 - DNA, 22 bp, Homo sapiens
acatttctccctgcatgcctgc

SEQ ID NO: 7407877 - DNA, 22 bp, Homo sapiens
acatttctccctgcatgcctgc

SEQ ID NO: 7407878 - DNA, 22 bp, Homo sapiens
aggctggcttcccaagcgtcct

SEQ ID NO: 7407879 - DNA, 22 bp, Homo sapiens
aggctggcttcccaagcgtcct

SEQ ID NO: 7407880 - DNA, 23 bp, Homo sapiens
aggctggcttcaggagcctctcc

SEQ ID NO: 7407881 - DNA, 23 bp, Homo sapiens
aggctggcttcaggagcctctcc

SEQ ID NO: 7407882 - DNA, 23 bp, Homo sapiens
aggctggcttcaggagcctctcc

SEQ ID NO: 7407883 - DNA, 23 bp, Homo sapiens
aggctggcttcaggagcctctcc

SEQ ID NO: 7407884 - DNA, 23 bp, Homo sapiens
aggctggcttcaggagcctctcc

SEQ ID NO: 7407885 - DNA, 22 bp, Homo sapiens
aggctggcttggctctcctgtg

SEQ ID NO: 7407886 - DNA, 22 bp, Homo sapiens
aggctggcttggctctcctgtg

SEQ ID NO: 7407887 - DNA, 22 bp, Homo sapiens
aggctggcttggctctcctgtg

SEQ ID NO: 7407888 - DNA, 22 bp, Homo sapiens
aggctggcttggctctcctgtg

SEQ ID NO: 7407889 - DNA, 22 bp, Homo sapiens
aggctggcttggctctcctgtg

SEQ ID NO: 7407890 - DNA, 22 bp, Homo sapiens
aggctggcttcccaagcgtcct

SEQ ID NO: 7407891 - DNA, 22 bp, Homo sapiens
aggctggcttcccaagcgtcct

SEQ ID NO: 7407892 - DNA, 22 bp, Homo sapiens
aggctggcttcccaagcgtcct

SEQ ID NO: 7407893 - DNA, 22 bp, Homo sapiens
aggctggctggggatgcgtctt

SEQ ID NO: 7407894 - DNA, 23 bp, Homo sapiens
aggctggcttcaggagcctctcc

SEQ ID NO: 7407895 - DNA, 23 bp, Homo sapiens
aggctggcttcaggagcctctcc

SEQ ID NO: 7407896 - DNA, 22 bp, Homo sapiens
aggctggccagtgctgcagtgg

SEQ ID NO: 7407897 - DNA, 22 bp, Homo sapiens
aggctggccagtgctgcagtgg

SEQ ID NO: 7407898 - DNA, 22 bp, Homo sapiens
aggctggccagtgctgcagtgg

SEQ ID NO: 7407899 - DNA, 22 bp, Homo sapiens
aggctggccagtgctgcagtgg

SEQ ID NO: 7407900 - DNA, 18 bp, Homo sapiens
acatttctctctgcgtga

SEQ ID NO: 7407901 - DNA, 18 bp, Homo sapiens
acatttctctctgcgtga

SEQ ID NO: 7407902 - DNA, 18 bp, Homo sapiens
acatttctctctgcgtga

SEQ ID NO: 7407903 - DNA, 18 bp, Homo sapiens
acatttctccttctgacc

SEQ ID NO: 7407904 - DNA, 22 bp, Homo sapiens
acatttctccttgcaggagtca

SEQ ID NO: 7407905 - DNA, 22 bp, Homo sapiens
acatttctccttgcaggagtca

SEQ ID NO: 7407906 - DNA, 22 bp, Homo sapiens
acatttctccttgcaggagtca

SEQ ID NO: 7407907 - DNA, 22 bp, Homo sapiens
acatttctccttgcaggagtca

SEQ ID NO: 7407908 - DNA, 22 bp, Homo sapiens
acatttctccttgcaggagtca

SEQ ID NO: 7407909 - DNA, 21 bp, Homo sapiens
aggctgctctttcttgtggta

SEQ ID NO: 7407910 - DNA, 22 bp, Homo sapiens
aggctgctctgcgaagtcagct

SEQ ID NO: 7407911 - DNA, 21 bp, Homo sapiens
aggctgctctttcttgtggta

SEQ ID NO: 7407912 - DNA, 21 bp, Homo sapiens
aggctgctctttcttgtggta

SEQ ID NO: 7407913 - DNA, 23 bp, Homo sapiens
aggctgcagaagaatagggtcat

SEQ ID NO: 7407914 - DNA, 23 bp, Homo sapiens
aggctgcagaagaatagggtcat

SEQ ID NO: 7407915 - DNA, 23 bp, Homo sapiens
aggctgcagaagaatagggtcat

SEQ ID NO: 7407916 - DNA, 21 bp, Homo sapiens
aggctgctctttcttgtggta

SEQ ID NO: 7407917 - DNA, 23 bp, Homo sapiens
aggctgctgagatgggtgtgtca

SEQ ID NO: 7407918 - DNA, 23 bp, Homo sapiens
aggctgctgagatgggtgtgtca

SEQ ID NO: 7407919 - DNA, 23 bp, Homo sapiens
aggctgctgagatgggtgtgtca

SEQ ID NO: 7407920 - DNA, 23 bp, Homo sapiens
aggctgctgagatgggtgtgtca

SEQ ID NO: 7407921 - DNA, 22 bp, Homo sapiens
aggctgctgaggccaccacgct

SEQ ID NO: 7407922 - DNA, 22 bp, Homo sapiens
aggctgctgaggccaccacgct

SEQ ID NO: 7407923 - DNA, 22 bp, Homo sapiens
aggctgctgaggccaccacgct

SEQ ID NO: 7407924 - DNA, 22 bp, Homo sapiens
aggctgctgaggccaccacgct

SEQ ID NO: 7407925 - DNA, 22 bp, Homo sapiens
aggctgctgccttggagagtgt

SEQ ID NO: 7407926 - DNA, 22 bp, Homo sapiens
aggctgctgccttggagagtgt

SEQ ID NO: 7407927 - DNA, 22 bp, Homo sapiens
aggctctggcaacagctggtgt

SEQ ID NO: 7407928 - DNA, 22 bp, Homo sapiens
aggctctggcaacagctggtgt

SEQ ID NO: 7407929 - DNA, 22 bp, Homo sapiens
aggctctggcaacagctggtgt

SEQ ID NO: 7407930 - DNA, 22 bp, Homo sapiens
aggctctggcaacagctggtgt

SEQ ID NO: 7407931 - DNA, 22 bp, Homo sapiens
aggctctggcaacagctggtgt

SEQ ID NO: 7407932 - DNA, 22 bp, Homo sapiens
aggctctggcaacagctggtgt

SEQ ID NO: 7407933 - DNA, 22 bp, Homo sapiens
aggctctggcaacagctggtgt

SEQ ID NO: 7407934 - DNA, 22 bp, Homo sapiens
aggctctggctactacagagct

SEQ ID NO: 7407935 - DNA, 22 bp, Homo sapiens
aggctctggctactacagagct

SEQ ID NO: 7407936 - DNA, 22 bp, Homo sapiens
aggctctggctactacagagct

SEQ ID NO: 7407937 - DNA, 22 bp, Homo sapiens
aggctctggctactacagagct

SEQ ID NO: 7407938 - DNA, 22 bp, Homo sapiens
aggctctggctactacagagct

SEQ ID NO: 7407939 - DNA, 22 bp, Homo sapiens
aggctctggctactacagagct

SEQ ID NO: 7407940 - DNA, 22 bp, Homo sapiens
aggctctggcaacagctggtgt

SEQ ID NO: 7407941 - DNA, 22 bp, Homo sapiens
aggctctggcaacagctggtgt

SEQ ID NO: 7407942 - DNA, 22 bp, Homo sapiens
aggctctggcaacagctggtgt

SEQ ID NO: 7407943 - DNA, 22 bp, Homo sapiens
aggctgctggaggatttatgcc

SEQ ID NO: 7407944 - DNA, 22 bp, Homo sapiens
aggctgctggaggatttatgcc

SEQ ID NO: 7407945 - DNA, 22 bp, Homo sapiens
aggctgctggaggatttatgcc

SEQ ID NO: 7407946 - DNA, 22 bp, Homo sapiens
aggctgctggcaggcgtggacg

SEQ ID NO: 7407947 - DNA, 22 bp, Homo sapiens
aggctgctgctctacagttgct

SEQ ID NO: 7407948 - DNA, 22 bp, Homo sapiens
aggctgctggcaggcgtggacg

SEQ ID NO: 7407949 - DNA, 22 bp, Homo sapiens
aggctgctggcaggcgtggacg

SEQ ID NO: 7407950 - DNA, 22 bp, Homo sapiens
aggctgctgctctacagttgct

SEQ ID NO: 7407951 - DNA, 22 bp, Homo sapiens
aggctgctgctctacagttgct

SEQ ID NO: 7407952 - DNA, 22 bp, Homo sapiens
aggctgctgccttggagagtgt

SEQ ID NO: 7407953 - DNA, 22 bp, Homo sapiens
aggctgctgccttggagagtgt

SEQ ID NO: 7407954 - DNA, 22 bp, Homo sapiens
aggctgctggcaggcgtggacg

SEQ ID NO: 7407955 - DNA, 22 bp, Homo sapiens
aggctgctggcaggcgtggacg

SEQ ID NO: 7407956 - DNA, 22 bp, Homo sapiens
aggctgctggcaggcgtggacg

SEQ ID NO: 7407957 - DNA, 21 bp, Homo sapiens
aggctgctggctcagggtcct

SEQ ID NO: 7407958 - DNA, 21 bp, Homo sapiens
aggctgctggctcagggtcct

SEQ ID NO: 7407959 - DNA, 21 bp, Homo sapiens
aggctgctggctcagggtcct

SEQ ID NO: 7407960 - DNA, 21 bp, Homo sapiens
aggctgctggctcagggtcct

SEQ ID NO: 7407961 - DNA, 22 bp, Homo sapiens
aggctgctggctaagaataaga

SEQ ID NO: 7407962 - DNA, 22 bp, Homo sapiens
aggctgctggctaagaataaga

SEQ ID NO: 7407963 - DNA, 22 bp, Homo sapiens
aggctgctggcaggcgtggacg

SEQ ID NO: 7407964 - DNA, 22 bp, Homo sapiens
aggctgcttcagctgcagggag

SEQ ID NO: 7407965 - DNA, 22 bp, Homo sapiens
aggctgcttcaatggataagat

SEQ ID NO: 7407966 - DNA, 22 bp, Homo sapiens
aggctgcttcagctgcagggag

SEQ ID NO: 7407967 - DNA, 22 bp, Homo sapiens
aggctgcttcagctgcagggag

SEQ ID NO: 7407968 - DNA, 22 bp, Homo sapiens
aggctgcttcagctgcagggag

SEQ ID NO: 7407969 - DNA, 22 bp, Homo sapiens
acatttctcagggagttttgct

SEQ ID NO: 7407970 - DNA, 22 bp, Homo sapiens
acatttctcagggagttttgct

SEQ ID NO: 7407971 - DNA, 22 bp, Homo sapiens
aggctgcttcaatggataagat

SEQ ID NO: 7407972 - DNA, 23 bp, Homo sapiens
aggctgcttactggtatcagagc

SEQ ID NO: 7407973 - DNA, 17 bp, Homo sapiens
aggctgctgggccaggg

SEQ ID NO: 7407974 - DNA, 17 bp, Homo sapiens
aggctgctgggccaggg

SEQ ID NO: 7407975 - DNA, 17 bp, Homo sapiens
aggctgctgggccaggg

SEQ ID NO: 7407976 - DNA, 17 bp, Homo sapiens
aggctgctgggccaggg

SEQ ID NO: 7407977 - DNA, 17 bp, Homo sapiens
aggctgctgggccaggg

SEQ ID NO: 7407978 - DNA, 21 bp, Homo sapiens
aggctgctggctcagggtcct

SEQ ID NO: 7407979 - DNA, 22 bp, Homo sapiens
aggggagcttgaggcatggcct

SEQ ID NO: 7407980 - DNA, 22 bp, Homo sapiens
aggggagcttgaggcatggcct

SEQ ID NO: 7407981 - DNA, 22 bp, Homo sapiens
aggggagcttgaggcatggcct

SEQ ID NO: 7407982 - DNA, 22 bp, Homo sapiens
aggggagcttgcctggtcaccc

SEQ ID NO: 7407983 - DNA, 22 bp, Homo sapiens
aggggagcttgcctggtcaccc

SEQ ID NO: 7407984 - DNA, 22 bp, Homo sapiens
aggggaggagcttttcttgcct

SEQ ID NO: 7407985 - DNA, 22 bp, Homo sapiens
aggggaggagcttttcttgcct

SEQ ID NO: 7407986 - DNA, 22 bp, Homo sapiens
aggggaggagcttttcttgcct

SEQ ID NO: 7407987 - DNA, 22 bp, Homo sapiens
aggggagcttgcctggtcaccc

SEQ ID NO: 7407988 - DNA, 22 bp, Homo sapiens
aggggagcttgcctggtcaccc

SEQ ID NO: 7407989 - DNA, 22 bp, Homo sapiens
aggggagcttgcctggtcaccc

SEQ ID NO: 7407990 - DNA, 22 bp, Homo sapiens
aggggagcttgcctggtcaccc

SEQ ID NO: 7407991 - DNA, 22 bp, Homo sapiens
aggggagctaacaccagagccc

SEQ ID NO: 7407992 - DNA, 22 bp, Homo sapiens
aggggagctaacaccagagccc

SEQ ID NO: 7407993 - DNA, 22 bp, Homo sapiens
aggggagctaacaccagagccc

SEQ ID NO: 7407994 - DNA, 22 bp, Homo sapiens
aggggagcgacattccgtgccg

SEQ ID NO: 7407995 - DNA, 22 bp, Homo sapiens
aggggagcgacattccgtgccg

SEQ ID NO: 7407996 - DNA, 22 bp, Homo sapiens
aggggagctaacaccagagccc

SEQ ID NO: 7407997 - DNA, 22 bp, Homo sapiens
aggggagcttgaggcatggcct

SEQ ID NO: 7407998 - DNA, 22 bp, Homo sapiens
aggggagctaacaccagagccc

SEQ ID NO: 7407999 - DNA, 22 bp, Homo sapiens
aggggagctaacaccagagccc

SEQ ID NO: 7408000 - DNA, 22 bp, Homo sapiens
aggggcaggtgctgcacttaga

SEQ ID NO: 7408001 - DNA, 22 bp, Homo sapiens
aggggcaggtgctgcacttaga

SEQ ID NO: 7408002 - DNA, 22 bp, Homo sapiens
aggggcaggtgctgcacttaga

SEQ ID NO: 7408003 - DNA, 22 bp, Homo sapiens
aggggcaggtgctgcacttaga

SEQ ID NO: 7408004 - DNA, 22 bp, Homo sapiens
aggggaggagcttttcttgcct

SEQ ID NO: 7408005 - DNA, 22 bp, Homo sapiens
aggggcaggtgctgcacttaga

SEQ ID NO: 7408006 - DNA, 22 bp, Homo sapiens
aggggcaggtgctgcacttaga

SEQ ID NO: 7408007 - DNA, 22 bp, Homo sapiens
aggggcaggtgctgcacttaga

SEQ ID NO: 7408008 - DNA, 22 bp, Homo sapiens
aggggcaggtgctgcacttaga

SEQ ID NO: 7408009 - DNA, 22 bp, Homo sapiens
aggggaggagcttttcttgcct

SEQ ID NO: 7408010 - DNA, 22 bp, Homo sapiens
aggggaggagcttttcttgcct

SEQ ID NO: 7408011 - DNA, 22 bp, Homo sapiens
aggggcagttccaagttttgtg

SEQ ID NO: 7408012 - DNA, 22 bp, Homo sapiens
aggggcaggtgctgcacttaga

SEQ ID NO: 7408013 - DNA, 22 bp, Homo sapiens
aggggcagttccaagttttgtg

SEQ ID NO: 7408014 - DNA, 22 bp, Homo sapiens
aggggcagttccaagttttgtg

SEQ ID NO: 7408015 - DNA, 22 bp, Homo sapiens
aggggcagttccaagttttgtg

SEQ ID NO: 7408016 - DNA, 22 bp, Homo sapiens
aggggcagttccaagttttgtg

SEQ ID NO: 7408017 - DNA, 22 bp, Homo sapiens
aggggcagttccaagttttgtg

SEQ ID NO: 7408018 - DNA, 22 bp, Homo sapiens
aggggagcccctggtcctggtg

SEQ ID NO: 7408019 - DNA, 22 bp, Homo sapiens
aggggagcccctggtcctggtg

SEQ ID NO: 7408020 - DNA, 22 bp, Homo sapiens
aggggagcccctggtcctggtg

SEQ ID NO: 7408021 - DNA, 22 bp, Homo sapiens
aggggagccgaggggcatctgt

SEQ ID NO: 7408022 - DNA, 22 bp, Homo sapiens
aggggagccgaggggcatctgt

SEQ ID NO: 7408023 - DNA, 22 bp, Homo sapiens
aggggagcccctggtcctggtg

SEQ ID NO: 7408024 - DNA, 22 bp, Homo sapiens
aggggagccagggctgcgagtt

SEQ ID NO: 7408025 - DNA, 22 bp, Homo sapiens
aggggagccagggctgcgagtt

SEQ ID NO: 7408026 - DNA, 22 bp, Homo sapiens
aggggagccagggctgcgagtt

SEQ ID NO: 7408027 - DNA, 22 bp, Homo sapiens
aggggagccagggctgcgagtt

SEQ ID NO: 7408028 - DNA, 22 bp, Homo sapiens
aggggagccgaggggcatctgt

SEQ ID NO: 7408029 - DNA, 22 bp, Homo sapiens
aggggagccgaggggcatctgt

SEQ ID NO: 7408030 - DNA, 22 bp, Homo sapiens
aggggagccgaggggcatctgt

SEQ ID NO: 7408031 - DNA, 22 bp, Homo sapiens
aggggagccgaggggcatctgt

SEQ ID NO: 7408032 - DNA, 22 bp, Homo sapiens
aggggagccgaggggcatctgt

SEQ ID NO: 7408033 - DNA, 22 bp, Homo sapiens
aggggagccgaggggcatctgt

SEQ ID NO: 7408034 - DNA, 22 bp, Homo sapiens
aggggagccgaggggcatctgt

SEQ ID NO: 7408035 - DNA, 22 bp, Homo sapiens
aggggagcgacattccgtgccg

SEQ ID NO: 7408036 - DNA, 22 bp, Homo sapiens
agggctttctttgtaaaagaag

SEQ ID NO: 7408037 - DNA, 22 bp, Homo sapiens
agggctttctttgtaaaagaag

SEQ ID NO: 7408038 - DNA, 22 bp, Homo sapiens
agggctttgagaatagtggaac

SEQ ID NO: 7408039 - DNA, 22 bp, Homo sapiens
agggctttgagaatagtggaac

SEQ ID NO: 7408040 - DNA, 22 bp, Homo sapiens
agggctttgatggcattctcat

SEQ ID NO: 7408041 - DNA, 22 bp, Homo sapiens
agggctttgatggcattctcat

SEQ ID NO: 7408042 - DNA, 22 bp, Homo sapiens
aggggagcaaggccgtggtgta

SEQ ID NO: 7408043 - DNA, 22 bp, Homo sapiens
aggggagcaacatagtcactct

SEQ ID NO: 7408044 - DNA, 22 bp, Homo sapiens
aggggagcaaggccgtggtgta

SEQ ID NO: 7408045 - DNA, 22 bp, Homo sapiens
aggggagcaaggccgtggtgta

SEQ ID NO: 7408046 - DNA, 22 bp, Homo sapiens
aggggagcaacatagtcactct

SEQ ID NO: 7408047 - DNA, 22 bp, Homo sapiens
aggggagcaaggccgtggtgta

SEQ ID NO: 7408048 - DNA, 22 bp, Homo sapiens
aggggagcaaggccgtggtgta

SEQ ID NO: 7408049 - DNA, 22 bp, Homo sapiens
aggggagcatctgtgatggtta

SEQ ID NO: 7408050 - DNA, 22 bp, Homo sapiens
aggggagcatctgtgatggtta

SEQ ID NO: 7408051 - DNA, 22 bp, Homo sapiens
aggggagcaaggccgtggtgta

SEQ ID NO: 7408052 - DNA, 22 bp, Homo sapiens
aggggagcatctgtgatggtta

SEQ ID NO: 7408053 - DNA, 22 bp, Homo sapiens
agggctgaagttatggctgagc

SEQ ID NO: 7408054 - DNA, 22 bp, Homo sapiens
agggctgaagttatggctgagc

SEQ ID NO: 7408055 - DNA, 22 bp, Homo sapiens
agggctgaagggaggtgctcat

SEQ ID NO: 7408056 - DNA, 22 bp, Homo sapiens
agggctgaagggaggtgctcat

SEQ ID NO: 7408057 - DNA, 22 bp, Homo sapiens
agggctgaaacataatccttct

SEQ ID NO: 7408058 - DNA, 22 bp, Homo sapiens
agggctgaagggaggtgctcat

SEQ ID NO: 7408059 - DNA, 22 bp, Homo sapiens
agggctgaagggaggtgctcat

SEQ ID NO: 7408060 - DNA, 22 bp, Homo sapiens
agggctcagtaaacggtggatt

SEQ ID NO: 7408061 - DNA, 22 bp, Homo sapiens
agggctcagttgcctggagccc

SEQ ID NO: 7408062 - DNA, 22 bp, Homo sapiens
agggctcagttgcctggagccc

SEQ ID NO: 7408063 - DNA, 22 bp, Homo sapiens
agggctcagttgcctggagccc

SEQ ID NO: 7408064 - DNA, 22 bp, Homo sapiens
agggctcaggggccccaagctg

SEQ ID NO: 7408065 - DNA, 22 bp, Homo sapiens
agggctcagggtcaccatctgt

SEQ ID NO: 7408066 - DNA, 22 bp, Homo sapiens
agggctcagggtcaccatctgt

SEQ ID NO: 7408067 - DNA, 22 bp, Homo sapiens
agggctcagtaaacggtggatt

SEQ ID NO: 7408068 - DNA, 23 bp, Homo sapiens
agggctgaatgcagagaagcaga

SEQ ID NO: 7408069 - DNA, 23 bp, Homo sapiens
agggctgaatgcagagaagcaga

SEQ ID NO: 7408070 - DNA, 23 bp, Homo sapiens
agggctgaatgcagagaagcaga

SEQ ID NO: 7408071 - DNA, 23 bp, Homo sapiens
agggctgaatgcagagaagcaga

SEQ ID NO: 7408072 - DNA, 22 bp, Homo sapiens
agggctgaagttatggctgagc

SEQ ID NO: 7408073 - DNA, 22 bp, Homo sapiens
agggctgacaaatggcagtgac

SEQ ID NO: 7408074 - DNA, 22 bp, Homo sapiens
agggctgacaaatggcagtgac

SEQ ID NO: 7408075 - DNA, 22 bp, Homo sapiens
agggctgacaaatggcagtgac

SEQ ID NO: 7408076 - DNA, 22 bp, Homo sapiens
agggctgacaaatggcagtgac

SEQ ID NO: 7408077 - DNA, 22 bp, Homo sapiens
agggctgacaaatggcagtgac

SEQ ID NO: 7408078 - DNA, 22 bp, Homo sapiens
agggctgacaaatggcagtgac

SEQ ID NO: 7408079 - DNA, 22 bp, Homo sapiens
agggctgacagtgaggagtcaa

SEQ ID NO: 7408080 - DNA, 22 bp, Homo sapiens
agggctgacagtaaaagtatga

SEQ ID NO: 7408081 - DNA, 22 bp, Homo sapiens
agggctgacacaccttatcctc

SEQ ID NO: 7408082 - DNA, 22 bp, Homo sapiens
agggctgacacaccttatcctc

SEQ ID NO: 7408083 - DNA, 22 bp, Homo sapiens
agggctgacaaatggcagtgac

SEQ ID NO: 7408084 - DNA, 22 bp, Homo sapiens
agggctgacaaatggcagtgac

SEQ ID NO: 7408085 - DNA, 22 bp, Homo sapiens
agggctcactacaaccctggga

SEQ ID NO: 7408086 - DNA, 22 bp, Homo sapiens
agggctcaccactgtgcactcc

SEQ ID NO: 7408087 - DNA, 22 bp, Homo sapiens
agggctcactgggaggctataa

SEQ ID NO: 7408088 - DNA, 22 bp, Homo sapiens
agggctcactgggaggctataa

SEQ ID NO: 7408089 - DNA, 22 bp, Homo sapiens
agggctcactgggaggctataa

SEQ ID NO: 7408090 - DNA, 22 bp, Homo sapiens
agggctcactgggaggctataa

SEQ ID NO: 7408091 - DNA, 22 bp, Homo sapiens
agggctcagaaagcaggttttc

SEQ ID NO: 7408092 - DNA, 22 bp, Homo sapiens
agggctcagaaatgtctacggg

SEQ ID NO: 7408093 - DNA, 22 bp, Homo sapiens
agggctcagaaatgtctacggg

SEQ ID NO: 7408094 - DNA, 22 bp, Homo sapiens
agggctcagaaagcaggttttc

SEQ ID NO: 7408095 - DNA, 22 bp, Homo sapiens
agggctcagagcaaaagggcac

SEQ ID NO: 7408096 - DNA, 22 bp, Homo sapiens
agggctcagaacaatgagtgta

SEQ ID NO: 7408097 - DNA, 22 bp, Homo sapiens
agggctcagaacaatgagtgta

SEQ ID NO: 7408098 - DNA, 22 bp, Homo sapiens
agggctcagagcaaaagggcac

SEQ ID NO: 7408099 - DNA, 22 bp, Homo sapiens
agggctcagaacaatgagtgta

SEQ ID NO: 7408100 - DNA, 22 bp, Homo sapiens
agggctcagaacaatgagtgta

SEQ ID NO: 7408101 - DNA, 22 bp, Homo sapiens
agggctcagaaatgtctacggg

SEQ ID NO: 7408102 - DNA, 22 bp, Homo sapiens
agggctcaggggccccaagctg

SEQ ID NO: 7408103 - DNA, 22 bp, Homo sapiens
agggctcaggggccccaagctg

SEQ ID NO: 7408104 - DNA, 22 bp, Homo sapiens
agggctcagggcacgtcatcca

SEQ ID NO: 7408105 - DNA, 22 bp, Homo sapiens
agggctcagggcacgtcatcca

SEQ ID NO: 7408106 - DNA, 22 bp, Homo sapiens
agggctcagggcacgtcatcca

SEQ ID NO: 7408107 - DNA, 22 bp, Homo sapiens
agggctcagcctcctcctcagc

SEQ ID NO: 7408108 - DNA, 22 bp, Homo sapiens
agggctcagcctcctcctcagc

SEQ ID NO: 7408109 - DNA, 22 bp, Homo sapiens
agggctcagcctcctcctcagc

SEQ ID NO: 7408110 - DNA, 22 bp, Homo sapiens
agggctcagcctcctcctcagc

SEQ ID NO: 7408111 - DNA, 22 bp, Homo sapiens
agggctcagccagcctgtgtgc

SEQ ID NO: 7408112 - DNA, 22 bp, Homo sapiens
agggctcagccagcctgtgtgc

SEQ ID NO: 7408113 - DNA, 22 bp, Homo sapiens
agggctcagccagcctgtgtgc

SEQ ID NO: 7408114 - DNA, 22 bp, Homo sapiens
agggctcagcatctcattctgt

SEQ ID NO: 7408115 - DNA, 22 bp, Homo sapiens
agggctcagagtagttcggttt

SEQ ID NO: 7408116 - DNA, 22 bp, Homo sapiens
agggctcagcatctcattctgt

SEQ ID NO: 7408117 - DNA, 22 bp, Homo sapiens
acctcacaagtctctgtcagct

SEQ ID NO: 7408118 - DNA, 22 bp, Homo sapiens
acctcacaagtctctgtcagct

SEQ ID NO: 7408119 - DNA, 22 bp, Homo sapiens
acctcaagtgatccactcacct

SEQ ID NO: 7408120 - DNA, 22 bp, Homo sapiens
acctcaagtgatccactcacct

SEQ ID NO: 7408121 - DNA, 22 bp, Homo sapiens
acctcacaagtctctgtcagct

SEQ ID NO: 7408122 - DNA, 22 bp, Homo sapiens
acctcacaagtctctgtcagct

SEQ ID NO: 7408123 - DNA, 22 bp, Homo sapiens
acctcagaggaggctcctggct

SEQ ID NO: 7408124 - DNA, 22 bp, Homo sapiens
acctcagagatacaaaccatgg

SEQ ID NO: 7408125 - DNA, 21 bp, Homo sapiens
acctcaagcaacaaccaaggt

SEQ ID NO: 7408126 - DNA, 21 bp, Homo sapiens
acctcaagcaacaaccaaggt

SEQ ID NO: 7408127 - DNA, 22 bp, Homo sapiens
accctttgtccaatagaaatga

SEQ ID NO: 7408128 - DNA, 21 bp, Homo sapiens
accctttgtttatgaatcagc

SEQ ID NO: 7408129 - DNA, 22 bp, Homo sapiens
accctttgtccaatagaaatga

SEQ ID NO: 7408130 - DNA, 22 bp, Homo sapiens
accctttgtcaagcacagaaga

SEQ ID NO: 7408131 - DNA, 22 bp, Homo sapiens
acctcagttcaattcagttaga

SEQ ID NO: 7408132 - DNA, 22 bp, Homo sapiens
acctccagctttttagagacat

SEQ ID NO: 7408133 - DNA, 22 bp, Homo sapiens
acctccaggaagctcttggtac

SEQ ID NO: 7408134 - DNA, 22 bp, Homo sapiens
acctccagctttttagagacat

SEQ ID NO: 7408135 - DNA, 22 bp, Homo sapiens
acctcaggatgtggacacagaa

SEQ ID NO: 7408136 - DNA, 22 bp, Homo sapiens
acctcaggatgtggacacagaa

SEQ ID NO: 7408137 - DNA, 22 bp, Homo sapiens
acctcaggatgtggacacagaa

SEQ ID NO: 7408138 - DNA, 22 bp, Homo sapiens
acctcaggatgtggacacagaa

SEQ ID NO: 7408139 - DNA, 22 bp, Homo sapiens
acctcagctatttcaaaacaga

SEQ ID NO: 7408140 - DNA, 22 bp, Homo sapiens
acctcagattgtggctccgctg

SEQ ID NO: 7408141 - DNA, 22 bp, Homo sapiens
acctcagctatttcaaaacaga

SEQ ID NO: 7408142 - DNA, 22 bp, Homo sapiens
acctcagagggatgttacaggc

SEQ ID NO: 7408143 - DNA, 22 bp, Homo sapiens
acctcagattgtggctccgctg

SEQ ID NO: 7408144 - DNA, 22 bp, Homo sapiens
aggggccacctgtggcaccctg

SEQ ID NO: 7408145 - DNA, 22 bp, Homo sapiens
aggggccaccaccaaggaaggt

SEQ ID NO: 7408146 - DNA, 22 bp, Homo sapiens
aggggccaccaccaaggaaggt

SEQ ID NO: 7408147 - DNA, 22 bp, Homo sapiens
aggggcatcagttgcacatttt

SEQ ID NO: 7408148 - DNA, 22 bp, Homo sapiens
aggggcatcagttgcacatttt

SEQ ID NO: 7408149 - DNA, 22 bp, Homo sapiens
aggggccacctgtggcaccctg

SEQ ID NO: 7408150 - DNA, 22 bp, Homo sapiens
aggggccacctgtggcaccctg

SEQ ID NO: 7408151 - DNA, 22 bp, Homo sapiens
aggggccacctgtggcaccctg

SEQ ID NO: 7408152 - DNA, 21 bp, Homo sapiens
aggggcccttgccaggacgcc

SEQ ID NO: 7408153 - DNA, 21 bp, Homo sapiens
aggggcccttgccaggacgcc

SEQ ID NO: 7408154 - DNA, 22 bp, Homo sapiens
aggggcctcagcctcctggtca

SEQ ID NO: 7408155 - DNA, 22 bp, Homo sapiens
aggggcctcagcctcctggtca

SEQ ID NO: 7408156 - DNA, 21 bp, Homo sapiens
aggggcccttgccaggacgcc

SEQ ID NO: 7408157 - DNA, 21 bp, Homo sapiens
aggggcccttgccaggacgcc

SEQ ID NO: 7408158 - DNA, 21 bp, Homo sapiens
aggggcccttgccaggacgcc

SEQ ID NO: 7408159 - DNA, 22 bp, Homo sapiens
aggggccatgtaagtgtatcac

SEQ ID NO: 7408160 - DNA, 22 bp, Homo sapiens
aggggccatgtaagtgtatcac

SEQ ID NO: 7408161 - DNA, 22 bp, Homo sapiens
aggggccatgtaagtgtatcac

SEQ ID NO: 7408162 - DNA, 22 bp, Homo sapiens
aggggccatgtaagtgtatcac

SEQ ID NO: 7408163 - DNA, 22 bp, Homo sapiens
aggggccattgttctgcccgct

SEQ ID NO: 7408164 - DNA, 22 bp, Homo sapiens
aggggccattgttctgcccgct

SEQ ID NO: 7408165 - DNA, 20 bp, Homo sapiens
aggggcctggaacaggcctt

SEQ ID NO: 7408166 - DNA, 22 bp, Homo sapiens
aggggcctggacatggacgcgc

SEQ ID NO: 7408167 - DNA, 20 bp, Homo sapiens
aggggcctggaacaggcctt

SEQ ID NO: 7408168 - DNA, 20 bp, Homo sapiens
aggggcctggaacaggcctt

SEQ ID NO: 7408169 - DNA, 20 bp, Homo sapiens
aggggcctggaacaggcctt

SEQ ID NO: 7408170 - DNA, 20 bp, Homo sapiens
aggggcctggaacaggcctt

SEQ ID NO: 7408171 - DNA, 22 bp, Homo sapiens
aggggcctcgcaggaccgctcc

SEQ ID NO: 7408172 - DNA, 22 bp, Homo sapiens
aggggcctcctcattggagtgt

SEQ ID NO: 7408173 - DNA, 22 bp, Homo sapiens
aggggcctcctcattggagtgt

SEQ ID NO: 7408174 - DNA, 22 bp, Homo sapiens
aggggcctcagcctcctggtca

SEQ ID NO: 7408175 - DNA, 22 bp, Homo sapiens
aggggcctcctcattggagtgt

SEQ ID NO: 7408176 - DNA, 22 bp, Homo sapiens
aggggcctcgcaggaccgctcc

SEQ ID NO: 7408177 - DNA, 22 bp, Homo sapiens
agggtcagtgatgagggagccc

SEQ ID NO: 7408178 - DNA, 22 bp, Homo sapiens
agggtcagtgatgagggagccc

SEQ ID NO: 7408179 - DNA, 22 bp, Homo sapiens
agggtcagtgatgagggagccc

SEQ ID NO: 7408180 - DNA, 22 bp, Homo sapiens
agggtcagtagtgatgcgtgaa

SEQ ID NO: 7408181 - DNA, 22 bp, Homo sapiens
agggtcagtagtgatgcgtgaa

SEQ ID NO: 7408182 - DNA, 22 bp, Homo sapiens
agggtcagtgatgagggagccc

SEQ ID NO: 7408183 - DNA, 22 bp, Homo sapiens
agggtcagtgatgagggagccc

SEQ ID NO: 7408184 - DNA, 22 bp, Homo sapiens
agggtcagtgatgagggagccc

SEQ ID NO: 7408185 - DNA, 22 bp, Homo sapiens
agggtcagtgatgagggagccc

SEQ ID NO: 7408186 - DNA, 22 bp, Homo sapiens
agggtcagtagtgatgcgtgaa

SEQ ID NO: 7408187 - DNA, 22 bp, Homo sapiens
agggtcagtagtgatgcgtgaa

SEQ ID NO: 7408188 - DNA, 22 bp, Homo sapiens
agggtcagtagtgatgcgtgaa

SEQ ID NO: 7408189 - DNA, 22 bp, Homo sapiens
aggggttggatttggcctagag

SEQ ID NO: 7408190 - DNA, 22 bp, Homo sapiens
agggtaaagtacatccttctca

SEQ ID NO: 7408191 - DNA, 22 bp, Homo sapiens
agggtaaagtacatccttctca

SEQ ID NO: 7408192 - DNA, 22 bp, Homo sapiens
agggtaatagcaaacaaaaggt

SEQ ID NO: 7408193 - DNA, 19 bp, Homo sapiens
agggtacacgagagaagag

SEQ ID NO: 7408194 - DNA, 22 bp, Homo sapiens
agggtaagcttggggctggcag

SEQ ID NO: 7408195 - DNA, 22 bp, Homo sapiens
agggtaagtttcatgtggctaa

SEQ ID NO: 7408196 - DNA, 22 bp, Homo sapiens
agggtaagtttcatgtggctaa

SEQ ID NO: 7408197 - DNA, 22 bp, Homo sapiens
agggtcagtagtgatgcgtgaa

SEQ ID NO: 7408198 - DNA, 20 bp, Homo sapiens
agggtcagtagcacagagct

SEQ ID NO: 7408199 - DNA, 20 bp, Homo sapiens
agggtcagtagcacagagct

SEQ ID NO: 7408200 - DNA, 22 bp, Homo sapiens
agggtagctacccaactccaga

SEQ ID NO: 7408201 - DNA, 19 bp, Homo sapiens
agggtacacgagagaagag

SEQ ID NO: 7408202 - DNA, 22 bp, Homo sapiens
agggtagctacccaactccaga

SEQ ID NO: 7408203 - DNA, 23 bp, Homo sapiens
aggggtggtcagtacccgcagtg

SEQ ID NO: 7408204 - DNA, 23 bp, Homo sapiens
aggggtggtcagtacccgcagtg

SEQ ID NO: 7408205 - DNA, 23 bp, Homo sapiens
aggggtggtcagtacccgcagtg

SEQ ID NO: 7408206 - DNA, 23 bp, Homo sapiens
aggggtggtcagtacccgcagtg

SEQ ID NO: 7408207 - DNA, 23 bp, Homo sapiens
aggggtggtcagtacccgcagtg

SEQ ID NO: 7408208 - DNA, 23 bp, Homo sapiens
aggggtggtcagtacccgcagtg

SEQ ID NO: 7408209 - DNA, 23 bp, Homo sapiens
aggggtggtcagtacccgcagtg

SEQ ID NO: 7408210 - DNA, 23 bp, Homo sapiens
aggggtggtcagtacccgcagtg

SEQ ID NO: 7408211 - DNA, 23 bp, Homo sapiens
aggggtggtcagtacccgcagtg

SEQ ID NO: 7408212 - DNA, 22 bp, Homo sapiens
aggggttggacataagacagaa

SEQ ID NO: 7408213 - DNA, 22 bp, Homo sapiens
aggggttggatttggcctagag

SEQ ID NO: 7408214 - DNA, 22 bp, Homo sapiens
aggggttggatttggcctagag

SEQ ID NO: 7408215 - DNA, 22 bp, Homo sapiens
aggggttggatttggcctagag

SEQ ID NO: 7408216 - DNA, 22 bp, Homo sapiens
aggggtgtgcatcctggaggat

SEQ ID NO: 7408217 - DNA, 22 bp, Homo sapiens
aggggtggcctgccttactccc

SEQ ID NO: 7408218 - DNA, 22 bp, Homo sapiens
aggggtggcctgccttactccc

SEQ ID NO: 7408219 - DNA, 22 bp, Homo sapiens
aggggtggcctgccttactccc

SEQ ID NO: 7408220 - DNA, 22 bp, Homo sapiens
aggggtggcctgccttactccc

SEQ ID NO: 7408221 - DNA, 22 bp, Homo sapiens
aggggtggcctgccttactccc

SEQ ID NO: 7408222 - DNA, 22 bp, Homo sapiens
aggggtggcctgccttactccc

SEQ ID NO: 7408223 - DNA, 22 bp, Homo sapiens
aggggtggagagtgttgccagt

SEQ ID NO: 7408224 - DNA, 22 bp, Homo sapiens
aggggtggagagtgttgccagt

SEQ ID NO: 7408225 - DNA, 22 bp, Homo sapiens
aggggtggagagtgttgccagt

SEQ ID NO: 7408226 - DNA, 22 bp, Homo sapiens
aggggtgatttgggacaggaca

SEQ ID NO: 7408227 - DNA, 22 bp, Homo sapiens
aggggtgatttgggacaggaca

SEQ ID NO: 7408228 - DNA, 22 bp, Homo sapiens
aggggtgatttgggacaggaca

SEQ ID NO: 7408229 - DNA, 22 bp, Homo sapiens
aggggtgatttgggacaggaca

SEQ ID NO: 7408230 - DNA, 22 bp, Homo sapiens
aggggtggagagtgttgccagt

SEQ ID NO: 7408231 - DNA, 22 bp, Homo sapiens
aggggtggagagtgttgccagt

SEQ ID NO: 7408232 - DNA, 22 bp, Homo sapiens
aggggtggagagtgttgccagt

SEQ ID NO: 7408233 - DNA, 22 bp, Homo sapiens
aggggtggagagtgttgccagt

SEQ ID NO: 7408234 - DNA, 22 bp, Homo sapiens
acctcccagaaagttttgcagg

SEQ ID NO: 7408235 - DNA, 22 bp, Homo sapiens
acctcccagaaagttttgcagg

SEQ ID NO: 7408236 - DNA, 22 bp, Homo sapiens
acctcccagctctgagcttggg

SEQ ID NO: 7408237 - DNA, 22 bp, Homo sapiens
acctcccagaaagttttgcagg

SEQ ID NO: 7408238 - DNA, 22 bp, Homo sapiens
acctcccagaaagttttgcagg

SEQ ID NO: 7408239 - DNA, 22 bp, Homo sapiens
acctccatggctcagtttcaga

SEQ ID NO: 7408240 - DNA, 16 bp, Homo sapiens
acctccagtcaagggt

SEQ ID NO: 7408241 - DNA, 20 bp, Homo sapiens
aggggtgatcgggtgacact

SEQ ID NO: 7408242 - DNA, 20 bp, Homo sapiens
aggggtgatcgggtgacact

SEQ ID NO: 7408243 - DNA, 20 bp, Homo sapiens
aggggtgatcgggtgacact

SEQ ID NO: 7408244 - DNA, 22 bp, Homo sapiens
acctcccagctctgagcttggg

SEQ ID NO: 7408245 - DNA, 22 bp, Homo sapiens
aggggtgatttgggacaggaca

SEQ ID NO: 7408246 - DNA, 20 bp, Homo sapiens
aggggtgatcgggtgacact

SEQ ID NO: 7408247 - DNA, 22 bp, Homo sapiens
aggggtgatttgggacaggaca

SEQ ID NO: 7408248 - DNA, 22 bp, Homo sapiens
agggaggtctggctgccctgag

SEQ ID NO: 7408249 - DNA, 22 bp, Homo sapiens
agggaggtccatccctgcagag

SEQ ID NO: 7408250 - DNA, 22 bp, Homo sapiens
agggaggtccatccctgcagag

SEQ ID NO: 7408251 - DNA, 22 bp, Homo sapiens
agggaggtccatccctgcagag

SEQ ID NO: 7408252 - DNA, 22 bp, Homo sapiens
agggaggtaggagcttctagct

SEQ ID NO: 7408253 - DNA, 22 bp, Homo sapiens
agggaggtccatccctgcagag

SEQ ID NO: 7408254 - DNA, 22 bp, Homo sapiens
agggaggtccatccctgcagag

SEQ ID NO: 7408255 - DNA, 19 bp, Homo sapiens
agggaggtagcattggaaa

SEQ ID NO: 7408256 - DNA, 22 bp, Homo sapiens
agggaggtaggagcttctagct

SEQ ID NO: 7408257 - DNA, 22 bp, Homo sapiens
agggaggtaggagcttctagct

SEQ ID NO: 7408258 - DNA, 22 bp, Homo sapiens
agggaggcattagctactgcga

SEQ ID NO: 7408259 - DNA, 22 bp, Homo sapiens
agggaggcattagctactgcga

SEQ ID NO: 7408260 - DNA, 22 bp, Homo sapiens
agggaggcattagctactgcga

SEQ ID NO: 7408261 - DNA, 22 bp, Homo sapiens
agggaggcattagctactgcga

SEQ ID NO: 7408262 - DNA, 22 bp, Homo sapiens
agggaggcattagctactgcga

SEQ ID NO: 7408263 - DNA, 22 bp, Homo sapiens
agggaggcattagctactgcga

SEQ ID NO: 7408264 - DNA, 22 bp, Homo sapiens
agggaggcattagctactgcga

SEQ ID NO: 7408265 - DNA, 19 bp, Homo sapiens
agggaggtagcattggaaa

SEQ ID NO: 7408266 - DNA, 19 bp, Homo sapiens
agggaggtagcattggaaa

SEQ ID NO: 7408267 - DNA, 19 bp, Homo sapiens
agggaggtagcattggaaa

SEQ ID NO: 7408268 - DNA, 19 bp, Homo sapiens
agggaggtagcattggaaa

SEQ ID NO: 7408269 - DNA, 19 bp, Homo sapiens
agggaggtagcattggaaa

SEQ ID NO: 7408270 - DNA, 22 bp, Homo sapiens
agggaggtctttgaggggctta

SEQ ID NO: 7408271 - DNA, 22 bp, Homo sapiens
agggaggtctttgaggggctta

SEQ ID NO: 7408272 - DNA, 22 bp, Homo sapiens
agggaggtctttgaggggctta

SEQ ID NO: 7408273 - DNA, 22 bp, Homo sapiens
agggaggtctttgaggggctta

SEQ ID NO: 7408274 - DNA, 20 bp, Homo sapiens
agggaggtgctgggcctgag

SEQ ID NO: 7408275 - DNA, 20 bp, Homo sapiens
agggaggtgctgggcctgag

SEQ ID NO: 7408276 - DNA, 20 bp, Homo sapiens
agggaggtgctgggcctgag

SEQ ID NO: 7408277 - DNA, 22 bp, Homo sapiens
agggaggtctggctgccctgag

SEQ ID NO: 7408278 - DNA, 22 bp, Homo sapiens
agggaggtctttgaggggctta

SEQ ID NO: 7408279 - DNA, 22 bp, Homo sapiens
agggaggtctggctgccctgag

SEQ ID NO: 7408280 - DNA, 22 bp, Homo sapiens
agggaggtctggctgccctgag

SEQ ID NO: 7408281 - DNA, 22 bp, Homo sapiens
agggaggtctggctgccctgag

SEQ ID NO: 7408282 - DNA, 22 bp, Homo sapiens
agggaggtctggctgccctgag

SEQ ID NO: 7408283 - DNA, 22 bp, Homo sapiens
agggaggtggttccccagtgga

SEQ ID NO: 7408284 - DNA, 22 bp, Homo sapiens
agggaggtggttccccagtgga

SEQ ID NO: 7408285 - DNA, 22 bp, Homo sapiens
agggaggtggttccccagtgga

SEQ ID NO: 7408286 - DNA, 20 bp, Homo sapiens
agggaggtgctgggcctgag

SEQ ID NO: 7408287 - DNA, 20 bp, Homo sapiens
agggaggtgctgggcctgag

SEQ ID NO: 7408288 - DNA, 20 bp, Homo sapiens
agggaggtgctgggcctgag

SEQ ID NO: 7408289 - DNA, 18 bp, Homo sapiens
agggatgtatgctggtgg

SEQ ID NO: 7408290 - DNA, 22 bp, Homo sapiens
agggagtcaacacagtaatgtt

SEQ ID NO: 7408291 - DNA, 22 bp, Homo sapiens
agggatgtgacattacagaagc

SEQ ID NO: 7408292 - DNA, 22 bp, Homo sapiens
agggagtcaacacagtaatgtt

SEQ ID NO: 7408293 - DNA, 22 bp, Homo sapiens
agggaggtggttccccagtgga

SEQ ID NO: 7408294 - DNA, 22 bp, Homo sapiens
agggaggtggttccccagtgga

SEQ ID NO: 7408295 - DNA, 22 bp, Homo sapiens
agggaggtggttccccagtgga

SEQ ID NO: 7408296 - DNA, 22 bp, Homo sapiens
agggaggtggttccccagtgga

SEQ ID NO: 7408297 - DNA, 22 bp, Homo sapiens
agggatgttgtcaaggatgtgg

SEQ ID NO: 7408298 - DNA, 20 bp, Homo sapiens
agggcaaaatccaaaagtct

SEQ ID NO: 7408299 - DNA, 22 bp, Homo sapiens
agggcaagggttgaagataaga

SEQ ID NO: 7408300 - DNA, 22 bp, Homo sapiens
agggcaatccagccagctgatc

SEQ ID NO: 7408301 - DNA, 22 bp, Homo sapiens
agggcaatccagccagctgatc

SEQ ID NO: 7408302 - DNA, 22 bp, Homo sapiens
agggcaagttgagtgtgcgtgg

SEQ ID NO: 7408303 - DNA, 22 bp, Homo sapiens
agggatgttcattttgtggctg

SEQ ID NO: 7408304 - DNA, 22 bp, Homo sapiens
agggatgttcattttgtggctg

SEQ ID NO: 7408305 - DNA, 22 bp, Homo sapiens
agggatgttagttgtgagctca

SEQ ID NO: 7408306 - DNA, 22 bp, Homo sapiens
agggatgttagttgtgagctca

SEQ ID NO: 7408307 - DNA, 22 bp, Homo sapiens
agggatgtgcagcatccagaca

SEQ ID NO: 7408308 - DNA, 22 bp, Homo sapiens
agggatgtggtgggagagaaag

SEQ ID NO: 7408309 - DNA, 22 bp, Homo sapiens
agggatgttagttgtgagctca

SEQ ID NO: 7408310 - DNA, 22 bp, Homo sapiens
agggatgtggtgggagagaaag

SEQ ID NO: 7408311 - DNA, 22 bp, Homo sapiens
agggatgtggtgggagagaaag

SEQ ID NO: 7408312 - DNA, 22 bp, Homo sapiens
agggatgtgggaactgcaggtt

SEQ ID NO: 7408313 - DNA, 22 bp, Homo sapiens
agggatgtgggaactgcaggtt

SEQ ID NO: 7408314 - DNA, 22 bp, Homo sapiens
agggatgtgggaactgcaggtt

SEQ ID NO: 7408315 - DNA, 22 bp, Homo sapiens
agggatgtgcagcatccagaca

SEQ ID NO: 7408316 - DNA, 22 bp, Homo sapiens
agggatgtgacattacagaagc

SEQ ID NO: 7408317 - DNA, 22 bp, Homo sapiens
agggatgtgcagcatccagaca

SEQ ID NO: 7408318 - DNA, 22 bp, Homo sapiens
agggcacatctgctgggaatgg

SEQ ID NO: 7408319 - DNA, 22 bp, Homo sapiens
agggcacatctgctgggaatgg

SEQ ID NO: 7408320 - DNA, 19 bp, Homo sapiens
agggcacagggacagaagg

SEQ ID NO: 7408321 - DNA, 19 bp, Homo sapiens
agggcacagggacagaagg

SEQ ID NO: 7408322 - DNA, 22 bp, Homo sapiens
agggcacatctgctgggaatgg

SEQ ID NO: 7408323 - DNA, 19 bp, Homo sapiens
agggcacagggacagaagg

SEQ ID NO: 7408324 - DNA, 22 bp, Homo sapiens
agggcacctgttttagcttggt

SEQ ID NO: 7408325 - DNA, 22 bp, Homo sapiens
agggcacctgttttagcttggt

SEQ ID NO: 7408326 - DNA, 22 bp, Homo sapiens
agggcaccctctctgcagtacc

SEQ ID NO: 7408327 - DNA, 21 bp, Homo sapiens
agggcacccccgctgcctacc

SEQ ID NO: 7408328 - DNA, 22 bp, Homo sapiens
agggcacatctgctgggaatgg

SEQ ID NO: 7408329 - DNA, 21 bp, Homo sapiens
agggcacccccgctgcctacc

SEQ ID NO: 7408330 - DNA, 21 bp, Homo sapiens
agggcacccccgctgcctacc

SEQ ID NO: 7408331 - DNA, 22 bp, Homo sapiens
agggcacaagactctgagcccc

SEQ ID NO: 7408332 - DNA, 22 bp, Homo sapiens
agggcacaagactctgagcccc

SEQ ID NO: 7408333 - DNA, 19 bp, Homo sapiens
agggcacagggacagaagg

SEQ ID NO: 7408334 - DNA, 22 bp, Homo sapiens
agggcacaggctccgggtccag

SEQ ID NO: 7408335 - DNA, 22 bp, Homo sapiens
agggcacaggctccgggtccag

SEQ ID NO: 7408336 - DNA, 22 bp, Homo sapiens
agggcacagcctaaagcctatg

SEQ ID NO: 7408337 - DNA, 22 bp, Homo sapiens
agggcacagcctaaagcctatg

SEQ ID NO: 7408338 - DNA, 22 bp, Homo sapiens
agggagctgactggctgccatt

SEQ ID NO: 7408339 - DNA, 22 bp, Homo sapiens
agggagctgactggctgccatt

SEQ ID NO: 7408340 - DNA, 22 bp, Homo sapiens
agggagctgactggctgccatt

SEQ ID NO: 7408341 - DNA, 22 bp, Homo sapiens
agggagctgactggctgccatt

SEQ ID NO: 7408342 - DNA, 22 bp, Homo sapiens
agggagctgactggctgccatt

SEQ ID NO: 7408343 - DNA, 22 bp, Homo sapiens
agggagctgactggctgccatt

SEQ ID NO: 7408344 - DNA, 22 bp, Homo sapiens
agggagctgactggctgccatt

SEQ ID NO: 7408345 - DNA, 22 bp, Homo sapiens
accagagctcttcagcacagga

SEQ ID NO: 7408346 - DNA, 22 bp, Homo sapiens
accagagctcttcagcacagga

SEQ ID NO: 7408347 - DNA, 20 bp, Homo sapiens
accagagctctcagtatgtg

SEQ ID NO: 7408348 - DNA, 20 bp, Homo sapiens
accagagctctcagtatgtg

SEQ ID NO: 7408349 - DNA, 22 bp, Homo sapiens
accagagcgctcaagccttccc

SEQ ID NO: 7408350 - DNA, 20 bp, Homo sapiens
accagagctctcagtatgtg

SEQ ID NO: 7408351 - DNA, 20 bp, Homo sapiens
accagagctctcagtatgtg

SEQ ID NO: 7408352 - DNA, 22 bp, Homo sapiens
accagagcgctcaagccttccc

SEQ ID NO: 7408353 - DNA, 22 bp, Homo sapiens
accagagcccatctgctcctag

SEQ ID NO: 7408354 - DNA, 22 bp, Homo sapiens
accagagcagactactggaggt

SEQ ID NO: 7408355 - DNA, 22 bp, Homo sapiens
agggaggatagtagtcagttta

SEQ ID NO: 7408356 - DNA, 22 bp, Homo sapiens
agggaggatagtagtcagttta

SEQ ID NO: 7408357 - DNA, 22 bp, Homo sapiens
agggaggatagtagtcagttta

SEQ ID NO: 7408358 - DNA, 22 bp, Homo sapiens
agggaggatagtagtcagttta

SEQ ID NO: 7408359 - DNA, 22 bp, Homo sapiens
agggaggatagtagtcagttta

SEQ ID NO: 7408360 - DNA, 22 bp, Homo sapiens
agggaggagtcctcaaagtcat

SEQ ID NO: 7408361 - DNA, 22 bp, Homo sapiens
agggaggatctgctccttgtct

SEQ ID NO: 7408362 - DNA, 22 bp, Homo sapiens
agggaggatctgctccttgtct

SEQ ID NO: 7408363 - DNA, 22 bp, Homo sapiens
agggaggatctgctccttgtct

SEQ ID NO: 7408364 - DNA, 22 bp, Homo sapiens
agggaggcaggaaagttgtctg

SEQ ID NO: 7408365 - DNA, 22 bp, Homo sapiens
agggaggcaggaaagttgtctg

SEQ ID NO: 7408366 - DNA, 22 bp, Homo sapiens
agggaggatctgctccttgtct

SEQ ID NO: 7408367 - DNA, 22 bp, Homo sapiens
agggaggatctgctccttgtct

SEQ ID NO: 7408368 - DNA, 22 bp, Homo sapiens
agggaggatctgctccttgtct

SEQ ID NO: 7408369 - DNA, 22 bp, Homo sapiens
agggaggcaggaaagttgtctg

SEQ ID NO: 7408370 - DNA, 22 bp, Homo sapiens
agggaggcaggaaagttgtctg

SEQ ID NO: 7408371 - DNA, 22 bp, Homo sapiens
agggaggcaggaaagttgtctg

SEQ ID NO: 7408372 - DNA, 22 bp, Homo sapiens
accagagaatgtgcatctctaa

SEQ ID NO: 7408373 - DNA, 22 bp, Homo sapiens
accagagaaaacacagcaggct

SEQ ID NO: 7408374 - DNA, 22 bp, Homo sapiens
accagagaatttagccaagaaa

SEQ ID NO: 7408375 - DNA, 22 bp, Homo sapiens
accagagaatttagccaagaaa

SEQ ID NO: 7408376 - DNA, 22 bp, Homo sapiens
accagagaaaacacagcaggct

SEQ ID NO: 7408377 - DNA, 22 bp, Homo sapiens
accagagaaaacacagcaggct

SEQ ID NO: 7408378 - DNA, 22 bp, Homo sapiens
accagagaaaacacagcaggct

SEQ ID NO: 7408379 - DNA, 22 bp, Homo sapiens
accagagaaaacacagcaggct

SEQ ID NO: 7408380 - DNA, 22 bp, Homo sapiens
accagagaaaacacagcaggct

SEQ ID NO: 7408381 - DNA, 20 bp, Homo sapiens
accagagactggggacaagt

SEQ ID NO: 7408382 - DNA, 20 bp, Homo sapiens
accagagactggggacaagt

SEQ ID NO: 7408383 - DNA, 20 bp, Homo sapiens
accagagactggggacaagt

SEQ ID NO: 7408384 - DNA, 20 bp, Homo sapiens
accagagactggggacaagt

SEQ ID NO: 7408385 - DNA, 22 bp, Homo sapiens
accagagactctttctagtcct

SEQ ID NO: 7408386 - DNA, 22 bp, Homo sapiens
accagagactctttctagtcct

SEQ ID NO: 7408387 - DNA, 22 bp, Homo sapiens
accagagactgcatttctctga

SEQ ID NO: 7408388 - DNA, 22 bp, Homo sapiens
accagagactgcatttctctga

SEQ ID NO: 7408389 - DNA, 22 bp, Homo sapiens
accagagactgcatttctctga

SEQ ID NO: 7408390 - DNA, 20 bp, Homo sapiens
accagagacctgaatcagtt

SEQ ID NO: 7408391 - DNA, 20 bp, Homo sapiens
accagagacctgaatcagtt

SEQ ID NO: 7408392 - DNA, 22 bp, Homo sapiens
accagagaatttagccaagaaa

SEQ ID NO: 7408393 - DNA, 20 bp, Homo sapiens
accagagacctgaatcagtt

SEQ ID NO: 7408394 - DNA, 20 bp, Homo sapiens
accagagatagcaatagtgc

SEQ ID NO: 7408395 - DNA, 22 bp, Homo sapiens
accagagatggggcttctctgt

SEQ ID NO: 7408396 - DNA, 22 bp, Homo sapiens
accagagatggggcttctctgt

SEQ ID NO: 7408397 - DNA, 20 bp, Homo sapiens
accagagatagcaatagtgc

SEQ ID NO: 7408398 - DNA, 22 bp, Homo sapiens
accagagaggctgcagtgtgtg

SEQ ID NO: 7408399 - DNA, 20 bp, Homo sapiens
accagagatagcaatagtgc

SEQ ID NO: 7408400 - DNA, 22 bp, Homo sapiens
accagagatgtctaataggggc

SEQ ID NO: 7408401 - DNA, 22 bp, Homo sapiens
accagagcagactactggaggt

SEQ ID NO: 7408402 - DNA, 22 bp, Homo sapiens
accagagcagactactggaggt

SEQ ID NO: 7408403 - DNA, 22 bp, Homo sapiens
accagagatggggcttctctgt

SEQ ID NO: 7408404 - DNA, 22 bp, Homo sapiens
accagagatgtctaataggggc

SEQ ID NO: 7408405 - DNA, 22 bp, Homo sapiens
accagagatgtctaataggggc

SEQ ID NO: 7408406 - DNA, 22 bp, Homo sapiens
accagagagagacagggttgtg

SEQ ID NO: 7408407 - DNA, 22 bp, Homo sapiens
accagagagagacagggttgtg

SEQ ID NO: 7408408 - DNA, 22 bp, Homo sapiens
accagagagagacagggttgtg

SEQ ID NO: 7408409 - DNA, 22 bp, Homo sapiens
accagagagagacagggttgtg

SEQ ID NO: 7408410 - DNA, 22 bp, Homo sapiens
accagagagcctaggctgggca

SEQ ID NO: 7408411 - DNA, 22 bp, Homo sapiens
accagagagcctaggctgggca

SEQ ID NO: 7408412 - DNA, 22 bp, Homo sapiens
accagagagcctaggctgggca

SEQ ID NO: 7408413 - DNA, 22 bp, Homo sapiens
accagagagcctaggctgggca

SEQ ID NO: 7408414 - DNA, 22 bp, Homo sapiens
accagagagcctaggctgggca

SEQ ID NO: 7408415 - DNA, 22 bp, Homo sapiens
accagagagcctaggctgggca

SEQ ID NO: 7408416 - DNA, 22 bp, Homo sapiens
accagagaggctgcagtgtgtg

SEQ ID NO: 7408417 - DNA, 22 bp, Homo sapiens
accagagaggctgcagtgtgtg

SEQ ID NO: 7408418 - DNA, 22 bp, Homo sapiens
accagagaggctgcagtgtgtg

SEQ ID NO: 7408419 - DNA, 22 bp, Homo sapiens
accagagaggctgcagtgtgtg

SEQ ID NO: 7408420 - DNA, 22 bp, Homo sapiens
accagagagcctaggctgggca

SEQ ID NO: 7408421 - DNA, 22 bp, Homo sapiens
accagagagcctaggctgggca

SEQ ID NO: 7408422 - DNA, 22 bp, Homo sapiens
agggccagcccataatgccaaa

SEQ ID NO: 7408423 - DNA, 22 bp, Homo sapiens
agggccagcccataatgccaaa

SEQ ID NO: 7408424 - DNA, 22 bp, Homo sapiens
agggccagcccataatgccaaa

SEQ ID NO: 7408425 - DNA, 22 bp, Homo sapiens
agggccagcccataatgccaaa

SEQ ID NO: 7408426 - DNA, 22 bp, Homo sapiens
agggccagcccataatgccaaa

SEQ ID NO: 7408427 - DNA, 22 bp, Homo sapiens
agggccagccaggccctacaaa

SEQ ID NO: 7408428 - DNA, 22 bp, Homo sapiens
agggccagcccataatgccaaa

SEQ ID NO: 7408429 - DNA, 22 bp, Homo sapiens
agggccagccaggccctacaaa

SEQ ID NO: 7408430 - DNA, 22 bp, Homo sapiens
agggccagccaggccctacaaa

SEQ ID NO: 7408431 - DNA, 22 bp, Homo sapiens
agggccagccaggccctacaaa

SEQ ID NO: 7408432 - DNA, 22 bp, Homo sapiens
agggccagccaggccctacaaa

SEQ ID NO: 7408433 - DNA, 22 bp, Homo sapiens
agggccagcagcttggccaacc

SEQ ID NO: 7408434 - DNA, 22 bp, Homo sapiens
agggccagcagcttggccaacc

SEQ ID NO: 7408435 - DNA, 22 bp, Homo sapiens
agggccagcagcttggccaacc

SEQ ID NO: 7408436 - DNA, 22 bp, Homo sapiens
agggccagcagcttggccaacc

SEQ ID NO: 7408437 - DNA, 22 bp, Homo sapiens
agggccagcagcttggccaacc

SEQ ID NO: 7408438 - DNA, 22 bp, Homo sapiens
agggccagcactcctggcagga

SEQ ID NO: 7408439 - DNA, 22 bp, Homo sapiens
agggccagcactcctggcagga

SEQ ID NO: 7408440 - DNA, 22 bp, Homo sapiens
agggccagcactcctggcagga

SEQ ID NO: 7408441 - DNA, 22 bp, Homo sapiens
agggccagcactcctggcagga

SEQ ID NO: 7408442 - DNA, 22 bp, Homo sapiens
agggccagcactcctggcagga

SEQ ID NO: 7408443 - DNA, 22 bp, Homo sapiens
agggccagcactcctggcagga

SEQ ID NO: 7408444 - DNA, 22 bp, Homo sapiens
agggccagcactcctggcagga

SEQ ID NO: 7408445 - DNA, 22 bp, Homo sapiens
agggccagatgaagccacaagc

SEQ ID NO: 7408446 - DNA, 22 bp, Homo sapiens
agggccagcactcctggcagga

SEQ ID NO: 7408447 - DNA, 22 bp, Homo sapiens
agggccagatgaagccacaagc

SEQ ID NO: 7408448 - DNA, 22 bp, Homo sapiens
agggccagcactcctggcagga

SEQ ID NO: 7408449 - DNA, 22 bp, Homo sapiens
agggccagcactcctggcagga

SEQ ID NO: 7408450 - DNA, 22 bp, Homo sapiens
agggccagcactcctggcagga

SEQ ID NO: 7408451 - DNA, 22 bp, Homo sapiens
agggccagcactcctggcagga

SEQ ID NO: 7408452 - DNA, 22 bp, Homo sapiens
agggccagcactcctggcagga

SEQ ID NO: 7408453 - DNA, 22 bp, Homo sapiens
agggccagcactcctggcagga

SEQ ID NO: 7408454 - DNA, 22 bp, Homo sapiens
agggccagcactcctggcagga

SEQ ID NO: 7408455 - DNA, 22 bp, Homo sapiens
agggcatgctggaggagagaca

SEQ ID NO: 7408456 - DNA, 22 bp, Homo sapiens
agggccagatgaagccacaagc

SEQ ID NO: 7408457 - DNA, 22 bp, Homo sapiens
agggccagatgaagccacaagc

SEQ ID NO: 7408458 - DNA, 21 bp, Homo sapiens
agggccagatcaccaaggagc

SEQ ID NO: 7408459 - DNA, 22 bp, Homo sapiens
agggccagatgaagccacaagc

SEQ ID NO: 7408460 - DNA, 22 bp, Homo sapiens
agggccagatgaagccacaagc

SEQ ID NO: 7408461 - DNA, 18 bp, Homo sapiens
agggcacggtgccagcct

SEQ ID NO: 7408462 - DNA, 22 bp, Homo sapiens
agggcactccttggcagctctg

SEQ ID NO: 7408463 - DNA, 22 bp, Homo sapiens
agggcactccttggcagctctg

SEQ ID NO: 7408464 - DNA, 18 bp, Homo sapiens
agggcacggtgccagcct

SEQ ID NO: 7408465 - DNA, 22 bp, Homo sapiens
agggcactccttggcagctctg

SEQ ID NO: 7408466 - DNA, 22 bp, Homo sapiens
agggcactccttggcagctctg

SEQ ID NO: 7408467 - DNA, 22 bp, Homo sapiens
agggcactccttggcagctctg

SEQ ID NO: 7408468 - DNA, 22 bp, Homo sapiens
agggcactccttggcagctctg

SEQ ID NO: 7408469 - DNA, 23 bp, Homo sapiens
agggcactgaagctggaattggg

SEQ ID NO: 7408470 - DNA, 23 bp, Homo sapiens
agggcactgaagctggaattggg

SEQ ID NO: 7408471 - DNA, 23 bp, Homo sapiens
agggcactgaagctggaattggg

SEQ ID NO: 7408472 - DNA, 22 bp, Homo sapiens
agggcactgaacagctgtagca

SEQ ID NO: 7408473 - DNA, 22 bp, Homo sapiens
agggcactgaacagctgtagca

SEQ ID NO: 7408474 - DNA, 22 bp, Homo sapiens
agggcactgaacagctgtagca

SEQ ID NO: 7408475 - DNA, 22 bp, Homo sapiens
agggcactgaacagctgtagca

SEQ ID NO: 7408476 - DNA, 22 bp, Homo sapiens
agggcactgcaagggttgaagg

SEQ ID NO: 7408477 - DNA, 22 bp, Homo sapiens
agggcatgctggaggagagaca

SEQ ID NO: 7408478 - DNA, 22 bp, Homo sapiens
agggcatgctggaggagagaca

SEQ ID NO: 7408479 - DNA, 22 bp, Homo sapiens
agggcatgctggaggagagaca

SEQ ID NO: 7408480 - DNA, 22 bp, Homo sapiens
agggcatgctggaggagagaca

SEQ ID NO: 7408481 - DNA, 23 bp, Homo sapiens
agggcactgttgggtgttgagga

SEQ ID NO: 7408482 - DNA, 23 bp, Homo sapiens
agggcactgttgggtgttgagga

SEQ ID NO: 7408483 - DNA, 23 bp, Homo sapiens
agggcactgttgggtgttgagga

SEQ ID NO: 7408484 - DNA, 23 bp, Homo sapiens
agggcactgttgggtgttgagga

SEQ ID NO: 7408485 - DNA, 22 bp, Homo sapiens
agggccagttcagaggacatgg

SEQ ID NO: 7408486 - DNA, 22 bp, Homo sapiens
agggccagttcagaggacatgg

SEQ ID NO: 7408487 - DNA, 22 bp, Homo sapiens
agggccagttcagaggacatgg

SEQ ID NO: 7408488 - DNA, 22 bp, Homo sapiens
agggccagttcagaggacatgg

SEQ ID NO: 7408489 - DNA, 22 bp, Homo sapiens
agggccagttcagaggacatgg

SEQ ID NO: 7408490 - DNA, 22 bp, Homo sapiens
agggccagttcagaggacatgg

SEQ ID NO: 7408491 - DNA, 22 bp, Homo sapiens
agggccagttcagaggacatgg

SEQ ID NO: 7408492 - DNA, 22 bp, Homo sapiens
agggccagttcagaggacatgg

SEQ ID NO: 7408493 - DNA, 22 bp, Homo sapiens
agggccagtgggttgaaaggca

SEQ ID NO: 7408494 - DNA, 22 bp, Homo sapiens
agggccagtgggttgaaaggca

SEQ ID NO: 7408495 - DNA, 22 bp, Homo sapiens
agggccagtattaaggtaatta

SEQ ID NO: 7408496 - DNA, 22 bp, Homo sapiens
agggccagtcgtgtattactgt

SEQ ID NO: 7408497 - DNA, 22 bp, Homo sapiens
agggccagtcgtgtattactgt

SEQ ID NO: 7408498 - DNA, 22 bp, Homo sapiens
agggccagtgggttgaaaggca

SEQ ID NO: 7408499 - DNA, 22 bp, Homo sapiens
agggccagtgggttgaaaggca

SEQ ID NO: 7408500 - DNA, 22 bp, Homo sapiens
agggccagtgggttgaaaggca

SEQ ID NO: 7408501 - DNA, 22 bp, Homo sapiens
agggccagtcgtgtattactgt

SEQ ID NO: 7408502 - DNA, 22 bp, Homo sapiens
agggccagtgggttgaaaggca

SEQ ID NO: 7408503 - DNA, 22 bp, Homo sapiens
agggccagtgggttgaaaggca

SEQ ID NO: 7408504 - DNA, 22 bp, Homo sapiens
agggccagtgggttgaaaggca

SEQ ID NO: 7408505 - DNA, 22 bp, Homo sapiens
agggccagtgggttgaaaggca

SEQ ID NO: 7408506 - DNA, 22 bp, Homo sapiens
agggccagtaaatgtttcctca

SEQ ID NO: 7408507 - DNA, 22 bp, Homo sapiens
agggccagccccaccctctctg

SEQ ID NO: 7408508 - DNA, 22 bp, Homo sapiens
agggccagtaaatgtttcctca

SEQ ID NO: 7408509 - DNA, 22 bp, Homo sapiens
agggccagtaaatgtttcctca

SEQ ID NO: 7408510 - DNA, 22 bp, Homo sapiens
agggccagtaccaggtgggtgg

SEQ ID NO: 7408511 - DNA, 22 bp, Homo sapiens
agggccagtaccaggtgggtgg

SEQ ID NO: 7408512 - DNA, 22 bp, Homo sapiens
agggccagtaccaggtgggtgg

SEQ ID NO: 7408513 - DNA, 22 bp, Homo sapiens
agggccagtaccaggtgggtgg

SEQ ID NO: 7408514 - DNA, 22 bp, Homo sapiens
agggccagtaccaggtgggtgg

SEQ ID NO: 7408515 - DNA, 22 bp, Homo sapiens
agggccagtattaaggtaatta

SEQ ID NO: 7408516 - DNA, 22 bp, Homo sapiens
agggccagtattaaggtaatta

SEQ ID NO: 7408517 - DNA, 22 bp, Homo sapiens
agggccagtattaaggtaatta

SEQ ID NO: 7408518 - DNA, 22 bp, Homo sapiens
agggccagtattaaggtaatta

SEQ ID NO: 7408519 - DNA, 22 bp, Homo sapiens
agggccagtattaaggtaatta

SEQ ID NO: 7408520 - DNA, 22 bp, Homo sapiens
agggccagtaccaggtgggtgg

SEQ ID NO: 7408521 - DNA, 22 bp, Homo sapiens
agggccagtaccaggtgggtgg

SEQ ID NO: 7408522 - DNA, 22 bp, Homo sapiens
agggccagtaccaggtgggtgg

SEQ ID NO: 7408523 - DNA, 22 bp, Homo sapiens
agggccagtaccaggtgggtgg

SEQ ID NO: 7408524 - DNA, 22 bp, Homo sapiens
agggccagtaccaggtgggtgg

SEQ ID NO: 7408525 - DNA, 22 bp, Homo sapiens
agggctcaatggtgggcatgta

SEQ ID NO: 7408526 - DNA, 22 bp, Homo sapiens
agggctcaatggtgggcatgta

SEQ ID NO: 7408527 - DNA, 22 bp, Homo sapiens
agggctcaatggtgggcatgta

SEQ ID NO: 7408528 - DNA, 22 bp, Homo sapiens
agggctcaatggtgggcatgta

SEQ ID NO: 7408529 - DNA, 22 bp, Homo sapiens
agggctcaccactgtgcactcc

SEQ ID NO: 7408530 - DNA, 22 bp, Homo sapiens
agggctcaccactgtgcactcc

SEQ ID NO: 7408531 - DNA, 22 bp, Homo sapiens
agggctcaccactgtgcactcc

SEQ ID NO: 7408532 - DNA, 22 bp, Homo sapiens
agggctcaatggtgggcatgta

SEQ ID NO: 7408533 - DNA, 22 bp, Homo sapiens
agggctcaatggtgggcatgta

SEQ ID NO: 7408534 - DNA, 22 bp, Homo sapiens
agggctcaagggcatgctacgt

SEQ ID NO: 7408535 - DNA, 22 bp, Homo sapiens
agggctcaagaaagtgtacctc

SEQ ID NO: 7408536 - DNA, 22 bp, Homo sapiens
agggctcaagggcatgctacgt

SEQ ID NO: 7408537 - DNA, 22 bp, Homo sapiens
agggctcaagggcatgctacgt

SEQ ID NO: 7408538 - DNA, 22 bp, Homo sapiens
agggcctgtcagcggtgtcctg

SEQ ID NO: 7408539 - DNA, 21 bp, Homo sapiens
agggctcaaatgtgcttgctg

SEQ ID NO: 7408540 - DNA, 22 bp, Homo sapiens
agggccagttcagaggacatgg

SEQ ID NO: 7408541 - DNA, 22 bp, Homo sapiens
agggccagttcagaggacatgg

SEQ ID NO: 7408542 - DNA, 22 bp, Homo sapiens
agggccagttctacctctgaat

SEQ ID NO: 7408543 - DNA, 22 bp, Homo sapiens
agggccagttctacctctgaat

SEQ ID NO: 7408544 - DNA, 22 bp, Homo sapiens
agggccagttctacctctgaat

SEQ ID NO: 7408545 - DNA, 22 bp, Homo sapiens
agggccagttctacctctgaat

SEQ ID NO: 7408546 - DNA, 22 bp, Homo sapiens
agggccagttctacctctgaat

SEQ ID NO: 7408547 - DNA, 22 bp, Homo sapiens
agggccagttctacctctgaat

SEQ ID NO: 7408548 - DNA, 22 bp, Homo sapiens
agggccagttctacctctgaat

SEQ ID NO: 7408549 - DNA, 22 bp, Homo sapiens
agggccagttctacctctgaat

SEQ ID NO: 7408550 - DNA, 22 bp, Homo sapiens
agggccagttctacctctgaat

SEQ ID NO: 7408551 - DNA, 22 bp, Homo sapiens
agggccagttctacctctgaat

SEQ ID NO: 7408552 - DNA, 22 bp, Homo sapiens
agggcctgtcagcggtgtcctg

SEQ ID NO: 7408553 - DNA, 22 bp, Homo sapiens
agggcctgtcagcggtgtcctg

SEQ ID NO: 7408554 - DNA, 22 bp, Homo sapiens
agggcctgtcagcggtgtcctg

SEQ ID NO: 7408555 - DNA, 22 bp, Homo sapiens
agggcctgtcagcggtgtcctg

SEQ ID NO: 7408556 - DNA, 22 bp, Homo sapiens
agggcctggttctgtgtaggga

SEQ ID NO: 7408557 - DNA, 22 bp, Homo sapiens
agggtcccgaaggagacagcaa

SEQ ID NO: 7408558 - DNA, 22 bp, Homo sapiens
agggtccatcaaggactgcaca

SEQ ID NO: 7408559 - DNA, 22 bp, Homo sapiens
agggtccatgtttccagttaat

SEQ ID NO: 7408560 - DNA, 22 bp, Homo sapiens
agggtccatgtttccagttaat

SEQ ID NO: 7408561 - DNA, 22 bp, Homo sapiens
agggtccatcaaggactgcaca

SEQ ID NO: 7408562 - DNA, 23 bp, Homo sapiens
agggtccagggatcaccaggtgt

SEQ ID NO: 7408563 - DNA, 19 bp, Homo sapiens
agggtccagggagcggctc

SEQ ID NO: 7408564 - DNA, 19 bp, Homo sapiens
agggtccagggagcggctc

SEQ ID NO: 7408565 - DNA, 19 bp, Homo sapiens
agggtccagggagcggctc

SEQ ID NO: 7408566 - DNA, 19 bp, Homo sapiens
agggtccagggagcggctc

SEQ ID NO: 7408567 - DNA, 23 bp, Homo sapiens
agggtccagggatcaccaggtgt

SEQ ID NO: 7408568 - DNA, 22 bp, Homo sapiens
agggtccagtaacagatgccag

SEQ ID NO: 7408569 - DNA, 22 bp, Homo sapiens
agggtccagtaacagatgccag

SEQ ID NO: 7408570 - DNA, 22 bp, Homo sapiens
agggtccagtaacagatgccag

SEQ ID NO: 7408571 - DNA, 22 bp, Homo sapiens
agggtccatcaaggactgcaca

SEQ ID NO: 7408572 - DNA, 19 bp, Homo sapiens
agggtccaggccctgtgga

SEQ ID NO: 7408573 - DNA, 19 bp, Homo sapiens
agggtccaggccctgtgga

SEQ ID NO: 7408574 - DNA, 19 bp, Homo sapiens
agggtccaggccctgtgga

SEQ ID NO: 7408575 - DNA, 22 bp, Homo sapiens
agggtccaactgaggctgaact

SEQ ID NO: 7408576 - DNA, 22 bp, Homo sapiens
agggtccacttggacattgatc

SEQ ID NO: 7408577 - DNA, 22 bp, Homo sapiens
agggtcagttctgtgaggtgtt

SEQ ID NO: 7408578 - DNA, 22 bp, Homo sapiens
agggtcagttctgtgaggtgtt

SEQ ID NO: 7408579 - DNA, 22 bp, Homo sapiens
agggtcagttctgtgaggtgtt

SEQ ID NO: 7408580 - DNA, 22 bp, Homo sapiens
agggtcagttctgtgaggtgtt

SEQ ID NO: 7408581 - DNA, 22 bp, Homo sapiens
agggtcagttctgtgaggtgtt

SEQ ID NO: 7408582 - DNA, 18 bp, Homo sapiens
agggtcagtgtcactggc

SEQ ID NO: 7408583 - DNA, 18 bp, Homo sapiens
agggtcagtgtcactggc

SEQ ID NO: 7408584 - DNA, 22 bp, Homo sapiens
agggtcagtgatgagggagccc

SEQ ID NO: 7408585 - DNA, 22 bp, Homo sapiens
agggtcagtgatgagggagccc

SEQ ID NO: 7408586 - DNA, 18 bp, Homo sapiens
agggtcagtgtcactggc

SEQ ID NO: 7408587 - DNA, 18 bp, Homo sapiens
agggtcagtgtcactggc

SEQ ID NO: 7408588 - DNA, 22 bp, Homo sapiens
agggtcagttctgtgaggtgtt

SEQ ID NO: 7408589 - DNA, 18 bp, Homo sapiens
agggtcagtgtcactggc

SEQ ID NO: 7408590 - DNA, 22 bp, Homo sapiens
agggtgcaaaagcaaggacagt

SEQ ID NO: 7408591 - DNA, 15 bp, Homo sapiens
agggtgagtaactgt

SEQ ID NO: 7408592 - DNA, 22 bp, Homo sapiens
agggtgcagaaggagcctagga

SEQ ID NO: 7408593 - DNA, 22 bp, Homo sapiens
agggtgcagaacaaattaagac

SEQ ID NO: 7408594 - DNA, 22 bp, Homo sapiens
agggtgcaaaagcaaggacagt

SEQ ID NO: 7408595 - DNA, 22 bp, Homo sapiens
agggtgcaaaagcaaggacagt

SEQ ID NO: 7408596 - DNA, 22 bp, Homo sapiens
agggtgagggtctggccttgag

SEQ ID NO: 7408597 - DNA, 22 bp, Homo sapiens
agggtcctaagcctcagataag

SEQ ID NO: 7408598 - DNA, 22 bp, Homo sapiens
agggtcctaagcctcagataag

SEQ ID NO: 7408599 - DNA, 21 bp, Homo sapiens
agggtcctacagggctcagga

SEQ ID NO: 7408600 - DNA, 23 bp, Homo sapiens
agggtgagcaagctatggagacc

SEQ ID NO: 7408601 - DNA, 21 bp, Homo sapiens
agggtcctacagggctcagga

SEQ ID NO: 7408602 - DNA, 22 bp, Homo sapiens
agggtgagggtctggccttgag

SEQ ID NO: 7408603 - DNA, 22 bp, Homo sapiens
agggtgagggtctggccttgag

SEQ ID NO: 7408604 - DNA, 23 bp, Homo sapiens
agggtgagcaagctatggagacc

SEQ ID NO: 7408605 - DNA, 22 bp, Homo sapiens
agggtgagggtctggccttgag

SEQ ID NO: 7408606 - DNA, 22 bp, Homo sapiens
agggtgcaggtgtggagtctag

SEQ ID NO: 7408607 - DNA, 22 bp, Homo sapiens
agggtgcaggtgtggagtctag

SEQ ID NO: 7408608 - DNA, 22 bp, Homo sapiens
agggtgcaggtgtggagtctag

SEQ ID NO: 7408609 - DNA, 22 bp, Homo sapiens
agggtgcagtcacaggaaatgt

SEQ ID NO: 7408610 - DNA, 22 bp, Homo sapiens
agggtgcagtcacaggaaatgt

SEQ ID NO: 7408611 - DNA, 22 bp, Homo sapiens
agggtgcagtcacaggaaatgt

SEQ ID NO: 7408612 - DNA, 22 bp, Homo sapiens
agggtgcagtcacaggaaatgt

SEQ ID NO: 7408613 - DNA, 22 bp, Homo sapiens
agggtgcaggggaagctgccct

SEQ ID NO: 7408614 - DNA, 22 bp, Homo sapiens
agggtgcaggggaagctgccct

SEQ ID NO: 7408615 - DNA, 22 bp, Homo sapiens
agggtgcaggggaagctgccct

SEQ ID NO: 7408616 - DNA, 22 bp, Homo sapiens
agggtgcaggggaagctgccct

SEQ ID NO: 7408617 - DNA, 22 bp, Homo sapiens
agggtgcaggggaagctgccct

SEQ ID NO: 7408618 - DNA, 22 bp, Homo sapiens
agggtgcaggggaagctgccct

SEQ ID NO: 7408619 - DNA, 22 bp, Homo sapiens
agggtgcaggggaagctgccct

SEQ ID NO: 7408620 - DNA, 22 bp, Homo sapiens
agggtgcaggtgtggagtctag

SEQ ID NO: 7408621 - DNA, 22 bp, Homo sapiens
agggtgcaggtgtggagtctag

SEQ ID NO: 7408622 - DNA, 22 bp, Homo sapiens
agggtgcaggtgtggagtctag

SEQ ID NO: 7408623 - DNA, 22 bp, Homo sapiens
agggtgcagaaggagcctagga

SEQ ID NO: 7408624 - DNA, 22 bp, Homo sapiens
agggtgcagaaggagcctagga

SEQ ID NO: 7408625 - DNA, 22 bp, Homo sapiens
agggtgcagaaggagcctagga

SEQ ID NO: 7408626 - DNA, 22 bp, Homo sapiens
agggtgcagaaggagcctagga

SEQ ID NO: 7408627 - DNA, 22 bp, Homo sapiens
agggtgcagggacaggtgtgca

SEQ ID NO: 7408628 - DNA, 22 bp, Homo sapiens
agggtgcagaaggagcctagga

SEQ ID NO: 7408629 - DNA, 22 bp, Homo sapiens
agggtgcagggacaggtgtgca

SEQ ID NO: 7408630 - DNA, 22 bp, Homo sapiens
agggtgcagggacaggtgtgca

SEQ ID NO: 7408631 - DNA, 22 bp, Homo sapiens
agggtgcagggacaggtgtgca

SEQ ID NO: 7408632 - DNA, 22 bp, Homo sapiens
agggtgcagggacaggtgtgca

SEQ ID NO: 7408633 - DNA, 22 bp, Homo sapiens
agggtgcagggacaggtgtgca

SEQ ID NO: 7408634 - DNA, 21 bp, Homo sapiens
aggtgccaaggagaagcaggc

SEQ ID NO: 7408635 - DNA, 22 bp, Homo sapiens
aggtgccaagaagaataggttc

SEQ ID NO: 7408636 - DNA, 22 bp, Homo sapiens
aggtgccaagatgtcacagaca

SEQ ID NO: 7408637 - DNA, 23 bp, Homo sapiens
aggtgccaactgagagctgagag

SEQ ID NO: 7408638 - DNA, 23 bp, Homo sapiens
aggtgccaactgagagctgagag

SEQ ID NO: 7408639 - DNA, 22 bp, Homo sapiens
aggtgccaaagcctgcgggtgt

SEQ ID NO: 7408640 - DNA, 22 bp, Homo sapiens
aggtgccaacagtatttctgcc

SEQ ID NO: 7408641 - DNA, 23 bp, Homo sapiens
aggtgccaactgagagctgagag

SEQ ID NO: 7408642 - DNA, 22 bp, Homo sapiens
aggtgcatctcgtagctcttct

SEQ ID NO: 7408643 - DNA, 22 bp, Homo sapiens
aggtgcagtgtttaaaagtagc

SEQ ID NO: 7408644 - DNA, 22 bp, Homo sapiens
aggtgcagtggctcatgcctgt

SEQ ID NO: 7408645 - DNA, 22 bp, Homo sapiens
aggtgcagtggctcatgcctgt

SEQ ID NO: 7408646 - DNA, 22 bp, Homo sapiens
aggtgcagtgaaggaaaaggaa

SEQ ID NO: 7408647 - DNA, 22 bp, Homo sapiens
aggtgcagtgaaggaaaaggaa

SEQ ID NO: 7408648 - DNA, 22 bp, Homo sapiens
aggtgcagtgaaggaaaaggaa

SEQ ID NO: 7408649 - DNA, 22 bp, Homo sapiens
aggtgcagtgaaggaaaaggaa

SEQ ID NO: 7408650 - DNA, 22 bp, Homo sapiens
aggtgcagtggctcatgcctgt

SEQ ID NO: 7408651 - DNA, 22 bp, Homo sapiens
aggtgcagtgaaggaaaaggaa

SEQ ID NO: 7408652 - DNA, 22 bp, Homo sapiens
aggtgcagtggctcatgcctgt

SEQ ID NO: 7408653 - DNA, 22 bp, Homo sapiens
aggtgccaattttcagtgaaca

SEQ ID NO: 7408654 - DNA, 22 bp, Homo sapiens
aggtgccagatgcacagctgaa

SEQ ID NO: 7408655 - DNA, 22 bp, Homo sapiens
aggtgccactctcatgggctac

SEQ ID NO: 7408656 - DNA, 22 bp, Homo sapiens
aggtgccacctctggtgctgtc

SEQ ID NO: 7408657 - DNA, 22 bp, Homo sapiens
aggtgccactctcatgggctac

SEQ ID NO: 7408658 - DNA, 22 bp, Homo sapiens
aggtgccacctctggtgctgtc

SEQ ID NO: 7408659 - DNA, 22 bp, Homo sapiens
aggtgccacctctggtgctgtc

SEQ ID NO: 7408660 - DNA, 22 bp, Homo sapiens
aggtgccacctctggtgctgtc

SEQ ID NO: 7408661 - DNA, 22 bp, Homo sapiens
aggtgccagatgcacagctgaa

SEQ ID NO: 7408662 - DNA, 22 bp, Homo sapiens
aggtgccagatgcacagctgaa

SEQ ID NO: 7408663 - DNA, 22 bp, Homo sapiens
aggtgccagcagggttgatgac

SEQ ID NO: 7408664 - DNA, 22 bp, Homo sapiens
aggtgccagctctcaggcagga

SEQ ID NO: 7408665 - DNA, 22 bp, Homo sapiens
aggtggaaatggctttcctagg

SEQ ID NO: 7408666 - DNA, 22 bp, Homo sapiens
aggtgccagcagggttgatgac

SEQ ID NO: 7408667 - DNA, 22 bp, Homo sapiens
aggtgccagatgcacagctgaa

SEQ ID NO: 7408668 - DNA, 22 bp, Homo sapiens
aggtggaaatggctttcctagg

SEQ ID NO: 7408669 - DNA, 22 bp, Homo sapiens
aggtggaaatggctttcctagg

SEQ ID NO: 7408670 - DNA, 22 bp, Homo sapiens
agggtgcagtcacaggaaatgt

SEQ ID NO: 7408671 - DNA, 22 bp, Homo sapiens
agggtgcatgtttgcaagagtg

SEQ ID NO: 7408672 - DNA, 22 bp, Homo sapiens
agggtgcatgtttgcaagagtg

SEQ ID NO: 7408673 - DNA, 23 bp, Homo sapiens
agggtgcatttcacttacagacc

SEQ ID NO: 7408674 - DNA, 22 bp, Homo sapiens
agggtgccaggattcgctgcag

SEQ ID NO: 7408675 - DNA, 22 bp, Homo sapiens
agggtgccctggagccagttcc

SEQ ID NO: 7408676 - DNA, 22 bp, Homo sapiens
agggtgcctgctgcaggttcag

SEQ ID NO: 7408677 - DNA, 22 bp, Homo sapiens
agggtgcatgtttgcaagagtg

SEQ ID NO: 7408678 - DNA, 22 bp, Homo sapiens
agggtgccctggagccagttcc

SEQ ID NO: 7408679 - DNA, 22 bp, Homo sapiens
aggtgaggataggtggccaagg

SEQ ID NO: 7408680 - DNA, 22 bp, Homo sapiens
aggtgaggataggtggccaagg

SEQ ID NO: 7408681 - DNA, 22 bp, Homo sapiens
aggtgaggataggtggccaagg

SEQ ID NO: 7408682 - DNA, 22 bp, Homo sapiens
agggtgcctgctgcaggttcag

SEQ ID NO: 7408683 - DNA, 22 bp, Homo sapiens
aggtgaggataggtggccaagg

SEQ ID NO: 7408684 - DNA, 22 bp, Homo sapiens
aggtgaggataggtggccaagg

SEQ ID NO: 7408685 - DNA, 19 bp, Homo sapiens
aggtgaggggcaccatgtc

SEQ ID NO: 7408686 - DNA, 22 bp, Homo sapiens
aggtgaggataggtggccaagg

SEQ ID NO: 7408687 - DNA, 19 bp, Homo sapiens
aggtgaggggcaccatgtc

SEQ ID NO: 7408688 - DNA, 19 bp, Homo sapiens
aggtgaggggcaccatgtc

SEQ ID NO: 7408689 - DNA, 19 bp, Homo sapiens
aggtgaggggcaccatgtc

SEQ ID NO: 7408690 - DNA, 22 bp, Homo sapiens
aggtgcaggagctgtgcaggga

SEQ ID NO: 7408691 - DNA, 19 bp, Homo sapiens
aggtgaggggcaccatgtc

SEQ ID NO: 7408692 - DNA, 19 bp, Homo sapiens
aggtgcaggtcacagggga

SEQ ID NO: 7408693 - DNA, 19 bp, Homo sapiens
aggtgcaggtcacagggga

SEQ ID NO: 7408694 - DNA, 19 bp, Homo sapiens
aggtgcaggtcacagggga

SEQ ID NO: 7408695 - DNA, 19 bp, Homo sapiens
aggtgcaggtcacagggga

SEQ ID NO: 7408696 - DNA, 19 bp, Homo sapiens
aggtgcaggtcacagggga

SEQ ID NO: 7408697 - DNA, 19 bp, Homo sapiens
aggtgcaggtcacagggga

SEQ ID NO: 7408698 - DNA, 19 bp, Homo sapiens
aggtgcaggtcacagggga

SEQ ID NO: 7408699 - DNA, 19 bp, Homo sapiens
aggtgcaggtcacagggga

SEQ ID NO: 7408700 - DNA, 22 bp, Homo sapiens
aggtgcaggagctgtgcaggga

SEQ ID NO: 7408701 - DNA, 21 bp, Homo sapiens
aggtgcaggcctcaagcccca

SEQ ID NO: 7408702 - DNA, 21 bp, Homo sapiens
aggtgcaggcctcaagcccca

SEQ ID NO: 7408703 - DNA, 21 bp, Homo sapiens
aggtgcaggcctcaagcccca

SEQ ID NO: 7408704 - DNA, 21 bp, Homo sapiens
aggtgcaggcctcaagcccca

SEQ ID NO: 7408705 - DNA, 21 bp, Homo sapiens
aggtgcaggcctcaagcccca

SEQ ID NO: 7408706 - DNA, 22 bp, Homo sapiens
aggtgcaggagctgtgcaggga

SEQ ID NO: 7408707 - DNA, 22 bp, Homo sapiens
aggtgcaggagctgtgcaggga

SEQ ID NO: 7408708 - DNA, 22 bp, Homo sapiens
aggtgcaggagctgtgcaggga

SEQ ID NO: 7408709 - DNA, 22 bp, Homo sapiens
aggtgcaggagctgtgcaggga

SEQ ID NO: 7408710 - DNA, 22 bp, Homo sapiens
aggtgcaggagctgtgcaggga

SEQ ID NO: 7408711 - DNA, 22 bp, Homo sapiens
aggtggagaagagatgggcagt

SEQ ID NO: 7408712 - DNA, 22 bp, Homo sapiens
aggtggaaatggctttcctagg

SEQ ID NO: 7408713 - DNA, 22 bp, Homo sapiens
aggtggaaatggctttcctagg

SEQ ID NO: 7408714 - DNA, 22 bp, Homo sapiens
aggtggaacgttcaggtgctag

SEQ ID NO: 7408715 - DNA, 22 bp, Homo sapiens
aggtggagaagagatgggcagt

SEQ ID NO: 7408716 - DNA, 22 bp, Homo sapiens
aggtggagaagagatgggcagt

SEQ ID NO: 7408717 - DNA, 22 bp, Homo sapiens
aggtggagaagagatgggcagt

SEQ ID NO: 7408718 - DNA, 22 bp, Homo sapiens
aggtggagaagagatgggcagt

SEQ ID NO: 7408719 - DNA, 22 bp, Homo sapiens
aggtggagaagagatgggcagt

SEQ ID NO: 7408720 - DNA, 22 bp, Homo sapiens
aggtggagaagagatgggcagt

SEQ ID NO: 7408721 - DNA, 22 bp, Homo sapiens
aggtggagaagagatgggcagt

SEQ ID NO: 7408722 - DNA, 22 bp, Homo sapiens
aggtggagaagagatgggcagt

SEQ ID NO: 7408723 - DNA, 22 bp, Homo sapiens
aggtggagaagagatgggcagt

SEQ ID NO: 7408724 - DNA, 22 bp, Homo sapiens
aggtggagaagagatgggcagt

SEQ ID NO: 7408725 - DNA, 22 bp, Homo sapiens
aggtggagaagagatgggcagt

SEQ ID NO: 7408726 - DNA, 22 bp, Homo sapiens
aggtggagacccagagaaggcg

SEQ ID NO: 7408727 - DNA, 22 bp, Homo sapiens
aggtggagacccagagaaggcg

SEQ ID NO: 7408728 - DNA, 22 bp, Homo sapiens
aggtggagacccagagaaggcg

SEQ ID NO: 7408729 - DNA, 22 bp, Homo sapiens
aggtggagacccagagaaggcg

SEQ ID NO: 7408730 - DNA, 22 bp, Homo sapiens
aggtggagacccagagaaggcg

SEQ ID NO: 7408731 - DNA, 22 bp, Homo sapiens
aggtggagacccagagaaggcg

SEQ ID NO: 7408732 - DNA, 22 bp, Homo sapiens
aggtggagacccagagaaggcg

SEQ ID NO: 7408733 - DNA, 22 bp, Homo sapiens
aggtggagacccagagaaggcg

SEQ ID NO: 7408734 - DNA, 22 bp, Homo sapiens
aggtggagacccagagaaggcg

SEQ ID NO: 7408735 - DNA, 22 bp, Homo sapiens
aggtggagacccagagaaggcg

SEQ ID NO: 7408736 - DNA, 16 bp, Homo sapiens
aggtggagaagttcac

SEQ ID NO: 7408737 - DNA, 22 bp, Homo sapiens
aggtggagaagagatgggcagt

SEQ ID NO: 7408738 - DNA, 22 bp, Homo sapiens
aggtggagacccagagaaggcg

SEQ ID NO: 7408739 - DNA, 22 bp, Homo sapiens
aggtggagacccagagaaggcg

SEQ ID NO: 7408740 - DNA, 22 bp, Homo sapiens
aggtggagacccagagaaggcg

SEQ ID NO: 7408741 - DNA, 22 bp, Homo sapiens
aggtggagacccagagaaggcg

SEQ ID NO: 7408742 - DNA, 22 bp, Homo sapiens
aggtggagacccagagaaggcg

SEQ ID NO: 7408743 - DNA, 22 bp, Homo sapiens
aggtggagacccagagaaggcg

SEQ ID NO: 7408744 - DNA, 22 bp, Homo sapiens
aggtggagacccagagaaggcg

SEQ ID NO: 7408745 - DNA, 22 bp, Homo sapiens
aggtggggaaaccagcgatccc

SEQ ID NO: 7408746 - DNA, 22 bp, Homo sapiens
aggtggggaggagtgtctcttt

SEQ ID NO: 7408747 - DNA, 19 bp, Homo sapiens
aggtgggtaagcagttctc

SEQ ID NO: 7408748 - DNA, 22 bp, Homo sapiens
aggtggggttcagtctcagccg

SEQ ID NO: 7408749 - DNA, 22 bp, Homo sapiens
aggtggggaggagtgtctcttt

SEQ ID NO: 7408750 - DNA, 22 bp, Homo sapiens
aggtgggtgccgtctgtcctct

SEQ ID NO: 7408751 - DNA, 22 bp, Homo sapiens
aggtgggtgccgtctgtcctct

SEQ ID NO: 7408752 - DNA, 22 bp, Homo sapiens
aggtgggtgcctatgtatgtat

SEQ ID NO: 7408753 - DNA, 22 bp, Homo sapiens
aggtgggtgccgtctgtcctct

SEQ ID NO: 7408754 - DNA, 17 bp, Homo sapiens
aggtgggtggatcacct

SEQ ID NO: 7408755 - DNA, 22 bp, Homo sapiens
aggtgggtgccgtctgtcctct

SEQ ID NO: 7408756 - DNA, 22 bp, Homo sapiens
aggtgggtcctggctctgccat

SEQ ID NO: 7408757 - DNA, 22 bp, Homo sapiens
aggtgggtcctggctctgccat

SEQ ID NO: 7408758 - DNA, 22 bp, Homo sapiens
aggtgggtatcatgagagatta

SEQ ID NO: 7408759 - DNA, 22 bp, Homo sapiens
aggtgggtatcatgagagatta

SEQ ID NO: 7408760 - DNA, 19 bp, Homo sapiens
aggtgggtaagcagttctc

SEQ ID NO: 7408761 - DNA, 22 bp, Homo sapiens
aggtgggtatcatgagagatta

SEQ ID NO: 7408762 - DNA, 19 bp, Homo sapiens
aggtgggtaagcagttctc

SEQ ID NO: 7408763 - DNA, 22 bp, Homo sapiens
aggtgggtcctggctctgccat

SEQ ID NO: 7408764 - DNA, 22 bp, Homo sapiens
aggtggtcttggcccacccagg

SEQ ID NO: 7408765 - DNA, 22 bp, Homo sapiens
aggtggtcttggcccacccagg

SEQ ID NO: 7408766 - DNA, 21 bp, Homo sapiens
aggtggtctgcagcagctgaa

SEQ ID NO: 7408767 - DNA, 22 bp, Homo sapiens
aggtggtattgacaaggtggag

SEQ ID NO: 7408768 - DNA, 22 bp, Homo sapiens
aggtgggttccgcggcggcccg

SEQ ID NO: 7408769 - DNA, 22 bp, Homo sapiens
aggtgggttccgcggcggcccg

SEQ ID NO: 7408770 - DNA, 22 bp, Homo sapiens
aggtgggttcccgactctggct

SEQ ID NO: 7408771 - DNA, 22 bp, Homo sapiens
aggtgggttccgcggcggcccg

SEQ ID NO: 7408772 - DNA, 22 bp, Homo sapiens
aggtgggttcccgactctggct

SEQ ID NO: 7408773 - DNA, 22 bp, Homo sapiens
aggtgggttccgcggcggcccg

SEQ ID NO: 7408774 - DNA, 22 bp, Homo sapiens
aggtgggttcccgactctggct

SEQ ID NO: 7408775 - DNA, 17 bp, Homo sapiens
aggtgggtggatcacct

SEQ ID NO: 7408776 - DNA, 17 bp, Homo sapiens
aggtgggtggatcacct

SEQ ID NO: 7408777 - DNA, 22 bp, Homo sapiens
actcacagtgaagccagaatca

SEQ ID NO: 7408778 - DNA, 22 bp, Homo sapiens
actcacatttcatcaggccaag

SEQ ID NO: 7408779 - DNA, 22 bp, Homo sapiens
actcacagtccctgtaggagtg

SEQ ID NO: 7408780 - DNA, 22 bp, Homo sapiens
actcacagtgaagccagaatca

SEQ ID NO: 7408781 - DNA, 22 bp, Homo sapiens
actcagagcctcgagggactgc

SEQ ID NO: 7408782 - DNA, 22 bp, Homo sapiens
actcaccacacccttgcacttg

SEQ ID NO: 7408783 - DNA, 22 bp, Homo sapiens
actcaccacacccttgcacttg

SEQ ID NO: 7408784 - DNA, 22 bp, Homo sapiens
actcagagcctcgagggactgc

SEQ ID NO: 7408785 - DNA, 22 bp, Homo sapiens
actcagagcctcgagggactgc

SEQ ID NO: 7408786 - DNA, 22 bp, Homo sapiens
actcacaggactctgcatatag

SEQ ID NO: 7408787 - DNA, 22 bp, Homo sapiens
actcacagggcctcagttttcc

SEQ ID NO: 7408788 - DNA, 22 bp, Homo sapiens
aggttcttggtgtccagatttc

SEQ ID NO: 7408789 - DNA, 22 bp, Homo sapiens
aggttctgtttggctgaggatc

SEQ ID NO: 7408790 - DNA, 22 bp, Homo sapiens
aggttctgttttaaaagagctc

SEQ ID NO: 7408791 - DNA, 22 bp, Homo sapiens
aggttcttgactctaccttcca

SEQ ID NO: 7408792 - DNA, 22 bp, Homo sapiens
aggttcttggtgagcatttggt

SEQ ID NO: 7408793 - DNA, 22 bp, Homo sapiens
aggttcttggtgagcatttggt

SEQ ID NO: 7408794 - DNA, 22 bp, Homo sapiens
aggttccttatggggatggcta

SEQ ID NO: 7408795 - DNA, 22 bp, Homo sapiens
aggttccttatggggatggcta

SEQ ID NO: 7408796 - DNA, 22 bp, Homo sapiens
aggttccttatggggatggcta

SEQ ID NO: 7408797 - DNA, 22 bp, Homo sapiens
aggttctcacacgtctacaccc

SEQ ID NO: 7408798 - DNA, 20 bp, Homo sapiens
aggttcctttgtggagaatt

SEQ ID NO: 7408799 - DNA, 22 bp, Homo sapiens
aggttctcacacgtctacaccc

SEQ ID NO: 7408800 - DNA, 18 bp, Homo sapiens
aggttctgacagtccaaa

SEQ ID NO: 7408801 - DNA, 18 bp, Homo sapiens
aggttctgacagtccaaa

SEQ ID NO: 7408802 - DNA, 23 bp, Homo sapiens
aggttctcttatcatctctgccc

SEQ ID NO: 7408803 - DNA, 22 bp, Homo sapiens
aggttctggagcttagagggag

SEQ ID NO: 7408804 - DNA, 18 bp, Homo sapiens
aggttctgacagtccaaa

SEQ ID NO: 7408805 - DNA, 22 bp, Homo sapiens
aggttcccaggatctgtctggg

SEQ ID NO: 7408806 - DNA, 21 bp, Homo sapiens
aggttcctgagtcatgcctta

SEQ ID NO: 7408807 - DNA, 22 bp, Homo sapiens
aggttcccagagatagagctgt

SEQ ID NO: 7408808 - DNA, 22 bp, Homo sapiens
aggttcccaggatctgtctggg

SEQ ID NO: 7408809 - DNA, 22 bp, Homo sapiens
aggttccatcacctgcagtgga

SEQ ID NO: 7408810 - DNA, 20 bp, Homo sapiens
aggttccagccacaaccagc

SEQ ID NO: 7408811 - DNA, 22 bp, Homo sapiens
aggttccagggattaggatgtg

SEQ ID NO: 7408812 - DNA, 22 bp, Homo sapiens
aggttccagggattaggatgtg

SEQ ID NO: 7408813 - DNA, 21 bp, Homo sapiens
aggttccagcagccagagaat

SEQ ID NO: 7408814 - DNA, 20 bp, Homo sapiens
aggttccagccacaaccagc

SEQ ID NO: 7408815 - DNA, 21 bp, Homo sapiens
aggttccagcagccagagaat

SEQ ID NO: 7408816 - DNA, 20 bp, Homo sapiens
aggtgtccacgtggcagggt

SEQ ID NO: 7408817 - DNA, 20 bp, Homo sapiens
aggtgtccacgtggcagggt

SEQ ID NO: 7408818 - DNA, 22 bp, Homo sapiens
aggtgtctggacttgtgaagca

SEQ ID NO: 7408819 - DNA, 22 bp, Homo sapiens
aggtgtctggacttgtgaagca

SEQ ID NO: 7408820 - DNA, 22 bp, Homo sapiens
aggtgtccaatcctggttggat

SEQ ID NO: 7408821 - DNA, 22 bp, Homo sapiens
aggtggtgtttggttacatgag

SEQ ID NO: 7408822 - DNA, 22 bp, Homo sapiens
aggtggtgtttggttacatgag

SEQ ID NO: 7408823 - DNA, 22 bp, Homo sapiens
aggtgtcatttctctgcaggtg

SEQ ID NO: 7408824 - DNA, 22 bp, Homo sapiens
aggtggtgatgacagaagacag

SEQ ID NO: 7408825 - DNA, 22 bp, Homo sapiens
aggtggtgatgacagaagacag

SEQ ID NO: 7408826 - DNA, 22 bp, Homo sapiens
agtcctgttggttccagaggtg

SEQ ID NO: 7408827 - DNA, 22 bp, Homo sapiens
agtcctgtgggtgggctggcca

SEQ ID NO: 7408828 - DNA, 22 bp, Homo sapiens
agtcctgttggttccagaggtg

SEQ ID NO: 7408829 - DNA, 22 bp, Homo sapiens
agtcctgttggttccagaggtg

SEQ ID NO: 7408830 - DNA, 22 bp, Homo sapiens
agtcctgtcacctctactttcg

SEQ ID NO: 7408831 - DNA, 22 bp, Homo sapiens
agtcctgtgaggggtgcagctt

SEQ ID NO: 7408832 - DNA, 22 bp, Homo sapiens
agtcctgtgcaaatgcatctga

SEQ ID NO: 7408833 - DNA, 22 bp, Homo sapiens
agtcctgtgcaaatgcatctga

SEQ ID NO: 7408834 - DNA, 22 bp, Homo sapiens
agtccttagaacactgtatctg

SEQ ID NO: 7408835 - DNA, 22 bp, Homo sapiens
agtccttagaacactgtatctg

SEQ ID NO: 7408836 - DNA, 22 bp, Homo sapiens
agtccttcaagaaatctggaaa

SEQ ID NO: 7408837 - DNA, 22 bp, Homo sapiens
agtccttcccatctgacaccct

SEQ ID NO: 7408838 - DNA, 22 bp, Homo sapiens
agtccttccggcagatttcact

SEQ ID NO: 7408839 - DNA, 22 bp, Homo sapiens
agtccttccggcagatttcact

SEQ ID NO: 7408840 - DNA, 22 bp, Homo sapiens
agtcctgggtgtgcaaggcaga

SEQ ID NO: 7408841 - DNA, 22 bp, Homo sapiens
agtcctgggtgtgcaaggcaga

SEQ ID NO: 7408842 - DNA, 22 bp, Homo sapiens
agtcctgggtgtgcaaggcaga

SEQ ID NO: 7408843 - DNA, 22 bp, Homo sapiens
agtcctgggtgtgcaaggcaga

SEQ ID NO: 7408844 - DNA, 22 bp, Homo sapiens
agtcctgggtgtgcaaggcaga

SEQ ID NO: 7408845 - DNA, 22 bp, Homo sapiens
agtcctgggttctggtgttttg

SEQ ID NO: 7408846 - DNA, 22 bp, Homo sapiens
agtcctggtgacactcctcttc

SEQ ID NO: 7408847 - DNA, 22 bp, Homo sapiens
agtcctggtgacactcctcttc

SEQ ID NO: 7408848 - DNA, 22 bp, Homo sapiens
agtcctggtgacactcctcttc

SEQ ID NO: 7408849 - DNA, 22 bp, Homo sapiens
agtcctggttctgattctgaca

SEQ ID NO: 7408850 - DNA, 22 bp, Homo sapiens
agtcctggtgacactcctcttc

SEQ ID NO: 7408851 - DNA, 22 bp, Homo sapiens
agtcctgtaattgtgagttaac

SEQ ID NO: 7408852 - DNA, 22 bp, Homo sapiens
agtcctgtatctgagctgagtc

SEQ ID NO: 7408853 - DNA, 22 bp, Homo sapiens
agtcctggttctgattctgaca

SEQ ID NO: 7408854 - DNA, 22 bp, Homo sapiens
agtcctggttctgattctgaca

SEQ ID NO: 7408855 - DNA, 22 bp, Homo sapiens
agtcctgggtgtgcaaggcaga

SEQ ID NO: 7408856 - DNA, 22 bp, Homo sapiens
agtcctgggtgtgcaaggcaga

SEQ ID NO: 7408857 - DNA, 22 bp, Homo sapiens
actctggtctttctgaaagcaa

SEQ ID NO: 7408858 - DNA, 22 bp, Homo sapiens
actctgggttctttcacttgac

SEQ ID NO: 7408859 - DNA, 22 bp, Homo sapiens
actctgggttctttcacttgac

SEQ ID NO: 7408860 - DNA, 22 bp, Homo sapiens
actctgggtcctgccattcact

SEQ ID NO: 7408861 - DNA, 22 bp, Homo sapiens
actctggggtgatgtctctgag

SEQ ID NO: 7408862 - DNA, 22 bp, Homo sapiens
actctggggtgatgtctctgag

SEQ ID NO: 7408863 - DNA, 20 bp, Homo sapiens
actctggggctcattagggg

SEQ ID NO: 7408864 - DNA, 20 bp, Homo sapiens
actctggggctcattagggg

SEQ ID NO: 7408865 - DNA, 20 bp, Homo sapiens
actctggggctcattagggg

SEQ ID NO: 7408866 - DNA, 22 bp, Homo sapiens
actctgggctttgatttgttac

SEQ ID NO: 7408867 - DNA, 22 bp, Homo sapiens
actctggggcgctactccaact

SEQ ID NO: 7408868 - DNA, 22 bp, Homo sapiens
actctgggctttgatttgttac

SEQ ID NO: 7408869 - DNA, 22 bp, Homo sapiens
actctgggccccaggtggagct

SEQ ID NO: 7408870 - DNA, 22 bp, Homo sapiens
actctgggccccaggtggagct

SEQ ID NO: 7408871 - DNA, 22 bp, Homo sapiens
actctgggccccaggtggagct

SEQ ID NO: 7408872 - DNA, 22 bp, Homo sapiens
actctgggctgttaggagctgt

SEQ ID NO: 7408873 - DNA, 22 bp, Homo sapiens
actctgggctgttaggagctgt

SEQ ID NO: 7408874 - DNA, 22 bp, Homo sapiens
actctgggctgttaggagctgt

SEQ ID NO: 7408875 - DNA, 22 bp, Homo sapiens
actctgggctgttaggagctgt

SEQ ID NO: 7408876 - DNA, 22 bp, Homo sapiens
actctgggccccaggtggagct

SEQ ID NO: 7408877 - DNA, 22 bp, Homo sapiens
actctgggccccaggtggagct

SEQ ID NO: 7408878 - DNA, 22 bp, Homo sapiens
agtccaggaagcatcatggtct

SEQ ID NO: 7408879 - DNA, 22 bp, Homo sapiens
agtccaggaaaataagctaggt

SEQ ID NO: 7408880 - DNA, 22 bp, Homo sapiens
agtccaggaaaataagctaggt

SEQ ID NO: 7408881 - DNA, 22 bp, Homo sapiens
agtccaggaaaataagctaggt

SEQ ID NO: 7408882 - DNA, 22 bp, Homo sapiens
agtccaggaaaataagctaggt

SEQ ID NO: 7408883 - DNA, 21 bp, Homo sapiens
agtccaggaggaggccaggtt

SEQ ID NO: 7408884 - DNA, 22 bp, Homo sapiens
agtccaggaagcatcatggtct

SEQ ID NO: 7408885 - DNA, 22 bp, Homo sapiens
agtccaggaagcatcatggtct

SEQ ID NO: 7408886 - DNA, 22 bp, Homo sapiens
agtccagaccccggcagctggt

SEQ ID NO: 7408887 - DNA, 22 bp, Homo sapiens
agtccagaccccggcagctggt

SEQ ID NO: 7408888 - DNA, 22 bp, Homo sapiens
agtccagaccccggcagctggt

SEQ ID NO: 7408889 - DNA, 22 bp, Homo sapiens
agtccagaccccggcagctggt

SEQ ID NO: 7408890 - DNA, 22 bp, Homo sapiens
agtccagaccccggcagctggt

SEQ ID NO: 7408891 - DNA, 22 bp, Homo sapiens
agtccagaccccggcagctggt

SEQ ID NO: 7408892 - DNA, 22 bp, Homo sapiens
agtccagagaggaggctgtgtg

SEQ ID NO: 7408893 - DNA, 22 bp, Homo sapiens
agtccagagaggaggctgtgtg

SEQ ID NO: 7408894 - DNA, 22 bp, Homo sapiens
agtccagagaggaggctgtgtg

SEQ ID NO: 7408895 - DNA, 22 bp, Homo sapiens
agtccagagaggaggctgtgtg

SEQ ID NO: 7408896 - DNA, 22 bp, Homo sapiens
agtccagagaggaggctgtgtg

SEQ ID NO: 7408897 - DNA, 22 bp, Homo sapiens
agtccagatcatgcagcaaacc

SEQ ID NO: 7408898 - DNA, 22 bp, Homo sapiens
agtccagatcatgcagcaaacc

SEQ ID NO: 7408899 - DNA, 22 bp, Homo sapiens
agtccagatcatgcagcaaacc

SEQ ID NO: 7408900 - DNA, 22 bp, Homo sapiens
agtccagccttcaatcttagtg

SEQ ID NO: 7408901 - DNA, 22 bp, Homo sapiens
agtccagccttcaatcttagtg

SEQ ID NO: 7408902 - DNA, 21 bp, Homo sapiens
agtccaggaggaggccaggtt

SEQ ID NO: 7408903 - DNA, 21 bp, Homo sapiens
agtccaggaggaggccaggtt

SEQ ID NO: 7408904 - DNA, 21 bp, Homo sapiens
agtccaggaggaggccaggtt

SEQ ID NO: 7408905 - DNA, 21 bp, Homo sapiens
agtccaggaggaggccaggtt

SEQ ID NO: 7408906 - DNA, 21 bp, Homo sapiens
agtccaggagtcacccaagcc

SEQ ID NO: 7408907 - DNA, 21 bp, Homo sapiens
agtccaggagtcacccaagcc

SEQ ID NO: 7408908 - DNA, 21 bp, Homo sapiens
agtccaggaggaggccaggtt

SEQ ID NO: 7408909 - DNA, 22 bp, Homo sapiens
agtccaggagttgggtgacatt

SEQ ID NO: 7408910 - DNA, 22 bp, Homo sapiens
agtccaggagttgggtgacatt

SEQ ID NO: 7408911 - DNA, 22 bp, Homo sapiens
agtccaggagttgggtgacatt

SEQ ID NO: 7408912 - DNA, 22 bp, Homo sapiens
agtccaggagttgggtgacatt

SEQ ID NO: 7408913 - DNA, 22 bp, Homo sapiens
agtccaggcattccagccattc

SEQ ID NO: 7408914 - DNA, 22 bp, Homo sapiens
agtccaggcattccagccattc

SEQ ID NO: 7408915 - DNA, 22 bp, Homo sapiens
agtccaggcattccagccattc

SEQ ID NO: 7408916 - DNA, 22 bp, Homo sapiens
agtccaggcattccagccattc

SEQ ID NO: 7408917 - DNA, 22 bp, Homo sapiens
agtccaggcaagttgttgtgta

SEQ ID NO: 7408918 - DNA, 22 bp, Homo sapiens
agtccaggagttgggtgacatt

SEQ ID NO: 7408919 - DNA, 22 bp, Homo sapiens
actctgctattgcagtgcaaaa

SEQ ID NO: 7408920 - DNA, 22 bp, Homo sapiens
actctgctattgcagtgcaaaa

SEQ ID NO: 7408921 - DNA, 22 bp, Homo sapiens
actctgctcaaagtcctgaggc

SEQ ID NO: 7408922 - DNA, 22 bp, Homo sapiens
actctgctccctaagccatgat

SEQ ID NO: 7408923 - DNA, 22 bp, Homo sapiens
actctgctccctaagccatgat

SEQ ID NO: 7408924 - DNA, 22 bp, Homo sapiens
actctgctcaaagtcctgaggc

SEQ ID NO: 7408925 - DNA, 22 bp, Homo sapiens
actctgctcaaagtcctgaggc

SEQ ID NO: 7408926 - DNA, 22 bp, Homo sapiens
actctgctcaaagtcctgaggc

SEQ ID NO: 7408927 - DNA, 22 bp, Homo sapiens
actctgctatcttagcaaaagg

SEQ ID NO: 7408928 - DNA, 22 bp, Homo sapiens
actctgctatcttagcaaaagg

SEQ ID NO: 7408929 - DNA, 22 bp, Homo sapiens
actctgctaaatgtgtaggctc

SEQ ID NO: 7408930 - DNA, 22 bp, Homo sapiens
actctgctaaatgtgtaggctc

SEQ ID NO: 7408931 - DNA, 21 bp, Homo sapiens
agtccaggcctgcccacttcc

SEQ ID NO: 7408932 - DNA, 22 bp, Homo sapiens
agtccaggcctcctcttttcct

SEQ ID NO: 7408933 - DNA, 21 bp, Homo sapiens
agtccaggcctgcccacttcc

SEQ ID NO: 7408934 - DNA, 22 bp, Homo sapiens
agtccaggcctccctctcctgc

SEQ ID NO: 7408935 - DNA, 22 bp, Homo sapiens
agtccaggcctccctctcctgc

SEQ ID NO: 7408936 - DNA, 22 bp, Homo sapiens
agtccaggcattccagccattc

SEQ ID NO: 7408937 - DNA, 22 bp, Homo sapiens
agtccaggcctcctcttttcct

SEQ ID NO: 7408938 - DNA, 22 bp, Homo sapiens
agtccaggcctccctctcctgc

SEQ ID NO: 7408939 - DNA, 22 bp, Homo sapiens
actctgggcccaccctcagagt

SEQ ID NO: 7408940 - DNA, 22 bp, Homo sapiens
actctgggcccaccctcagagt

SEQ ID NO: 7408941 - DNA, 22 bp, Homo sapiens
actctgggcccaccctcagagt

SEQ ID NO: 7408942 - DNA, 22 bp, Homo sapiens
actctgggattgtttctggtat

SEQ ID NO: 7408943 - DNA, 22 bp, Homo sapiens
actctgggattgtttctggtat

SEQ ID NO: 7408944 - DNA, 22 bp, Homo sapiens
actctgggatgagaaaagggtt

SEQ ID NO: 7408945 - DNA, 22 bp, Homo sapiens
actctgggatcttgaaaagagt

SEQ ID NO: 7408946 - DNA, 22 bp, Homo sapiens
actctgctctgtatttcactgt

SEQ ID NO: 7408947 - DNA, 22 bp, Homo sapiens
actctgctctgtatttcactgt

SEQ ID NO: 7408948 - DNA, 22 bp, Homo sapiens
actctgctctgtatttcactgt

SEQ ID NO: 7408949 - DNA, 22 bp, Homo sapiens
agtaagttccagtttcattatg

SEQ ID NO: 7408950 - DNA, 22 bp, Homo sapiens
agtaagttccagtttcattatg

SEQ ID NO: 7408951 - DNA, 17 bp, Homo sapiens
agtaagtgtgtcacttc

SEQ ID NO: 7408952 - DNA, 17 bp, Homo sapiens
agtaagtgtgtcacttc

SEQ ID NO: 7408953 - DNA, 22 bp, Homo sapiens
agtaagttccaggttgctcttc

SEQ ID NO: 7408954 - DNA, 22 bp, Homo sapiens
agtaataaactctttttatctc

SEQ ID NO: 7408955 - DNA, 22 bp, Homo sapiens
agtaagtgagtcactgtgctgg

SEQ ID NO: 7408956 - DNA, 22 bp, Homo sapiens
agtaagtgcagaaaagatgtgg

SEQ ID NO: 7408957 - DNA, 22 bp, Homo sapiens
agtaagtgagtcactgtgctgg

SEQ ID NO: 7408958 - DNA, 22 bp, Homo sapiens
agtaaggcatttttcatgttta

SEQ ID NO: 7408959 - DNA, 21 bp, Homo sapiens
agtaagggaggaaagaaattg

SEQ ID NO: 7408960 - DNA, 21 bp, Homo sapiens
agtaagggaggaaagaaattg

SEQ ID NO: 7408961 - DNA, 22 bp, Homo sapiens
agtaagtacctccacttgattg

SEQ ID NO: 7408962 - DNA, 22 bp, Homo sapiens
agtcacttcctgcttgacctga

SEQ ID NO: 7408963 - DNA, 22 bp, Homo sapiens
agtaataatagctgtaaagtgc

SEQ ID NO: 7408964 - DNA, 22 bp, Homo sapiens
agtaataatagctgtaaagtgc

SEQ ID NO: 7408965 - DNA, 22 bp, Homo sapiens
agtaataatagctgtaaagtgc

SEQ ID NO: 7408966 - DNA, 22 bp, Homo sapiens
agtaataaactctttttatctc

SEQ ID NO: 7408967 - DNA, 22 bp, Homo sapiens
agtaataaactctttttatctc

SEQ ID NO: 7408968 - DNA, 22 bp, Homo sapiens
agtcacttctattctattaagt

SEQ ID NO: 7408969 - DNA, 22 bp, Homo sapiens
agtcacttgattctcctgagct

SEQ ID NO: 7408970 - DNA, 22 bp, Homo sapiens
agtcacttctattctattaagt

SEQ ID NO: 7408971 - DNA, 22 bp, Homo sapiens
agtcacttctattctattaagt

SEQ ID NO: 7408972 - DNA, 22 bp, Homo sapiens
agtcacttcgtgagcactgact

SEQ ID NO: 7408973 - DNA, 22 bp, Homo sapiens
agtcacttcgtgagcactgact

SEQ ID NO: 7408974 - DNA, 22 bp, Homo sapiens
agtcaggtactccgagggcatg

SEQ ID NO: 7408975 - DNA, 19 bp, Homo sapiens
agtcaggtggctggtgcca

SEQ ID NO: 7408976 - DNA, 22 bp, Homo sapiens
agtcacttgggaagcaaagcct

SEQ ID NO: 7408977 - DNA, 22 bp, Homo sapiens
agtcaggtggttctgctccact

SEQ ID NO: 7408978 - DNA, 22 bp, Homo sapiens
agtcaggtggttctgctccact

SEQ ID NO: 7408979 - DNA, 22 bp, Homo sapiens
agtcaggtgggggctgcagtgg

SEQ ID NO: 7408980 - DNA, 19 bp, Homo sapiens
agtcaggtggctggtgcca

SEQ ID NO: 7408981 - DNA, 19 bp, Homo sapiens
agtcaggtggctggtgcca

SEQ ID NO: 7408982 - DNA, 19 bp, Homo sapiens
agtcaggtggctggtgcca

SEQ ID NO: 7408983 - DNA, 22 bp, Homo sapiens
agtcagggttgtaggctcaccc

SEQ ID NO: 7408984 - DNA, 22 bp, Homo sapiens
agtcagggttgtaggctcaccc

SEQ ID NO: 7408985 - DNA, 22 bp, Homo sapiens
agtcagggttgtaggctcaccc

SEQ ID NO: 7408986 - DNA, 22 bp, Homo sapiens
agtcaggggttggacggggcca

SEQ ID NO: 7408987 - DNA, 22 bp, Homo sapiens
agtcacttgattctcctgagct

SEQ ID NO: 7408988 - DNA, 22 bp, Homo sapiens
agtcacttggattagcaattct

SEQ ID NO: 7408989 - DNA, 22 bp, Homo sapiens
agtcacttgggaagcaaagcct

SEQ ID NO: 7408990 - DNA, 22 bp, Homo sapiens
agtcacttggattagcaattct

SEQ ID NO: 7408991 - DNA, 22 bp, Homo sapiens
agtcacttgggaagcaaagcct

SEQ ID NO: 7408992 - DNA, 22 bp, Homo sapiens
agtcaggggatctagacttgaa

SEQ ID NO: 7408993 - DNA, 22 bp, Homo sapiens
agtcaggggatctagacttgaa

SEQ ID NO: 7408994 - DNA, 22 bp, Homo sapiens
agtcaggggttggacggggcca

SEQ ID NO: 7408995 - DNA, 22 bp, Homo sapiens
agtcagtgaatggtgtatgcta

SEQ ID NO: 7408996 - DNA, 22 bp, Homo sapiens
agtcagtgaatggtgtatgcta

SEQ ID NO: 7408997 - DNA, 22 bp, Homo sapiens
agtcagtgaatggtgtatgcta

SEQ ID NO: 7408998 - DNA, 22 bp, Homo sapiens
agtcagtgacttttgctgagag

SEQ ID NO: 7408999 - DNA, 23 bp, Homo sapiens
agtcagtgcgggatggtcagggg

SEQ ID NO: 7409000 - DNA, 22 bp, Homo sapiens
agtcagtcaaaatataaattgt

SEQ ID NO: 7409001 - DNA, 22 bp, Homo sapiens
agtcagtatttattacttagct

SEQ ID NO: 7409002 - DNA, 22 bp, Homo sapiens
agtcagtcaccatttaagaaca

SEQ ID NO: 7409003 - DNA, 22 bp, Homo sapiens
agtcagtgtagaaagcccaggc

SEQ ID NO: 7409004 - DNA, 22 bp, Homo sapiens
agtcagtgtagaaagcccaggc

SEQ ID NO: 7409005 - DNA, 22 bp, Homo sapiens
agtcagtgtagaaagcccaggc

SEQ ID NO: 7409006 - DNA, 22 bp, Homo sapiens
agtcagtggtatttaggggaat

SEQ ID NO: 7409007 - DNA, 22 bp, Homo sapiens
agtcagtgggcttggcacagaa

SEQ ID NO: 7409008 - DNA, 22 bp, Homo sapiens
agtcagtgggcttggcacagaa

SEQ ID NO: 7409009 - DNA, 22 bp, Homo sapiens
agtcagtgggagaagtgtgaag

SEQ ID NO: 7409010 - DNA, 22 bp, Homo sapiens
agtcagtggctccgagcctggt

SEQ ID NO: 7409011 - DNA, 22 bp, Homo sapiens
agtcagtgggagaagtgtgaag

SEQ ID NO: 7409012 - DNA, 22 bp, Homo sapiens
agtcagtgggagaagtgtgaag

SEQ ID NO: 7409013 - DNA, 22 bp, Homo sapiens
agtcagtggctccgagcctggt

SEQ ID NO: 7409014 - DNA, 22 bp, Homo sapiens
agtcagtggatttaccatgcgt

SEQ ID NO: 7409015 - DNA, 22 bp, Homo sapiens
agtcagtggatttaccatgcgt

SEQ ID NO: 7409016 - DNA, 22 bp, Homo sapiens
agtcagtggatttaccatgcgt

SEQ ID NO: 7409017 - DNA, 22 bp, Homo sapiens
actcagagtttgcgttccatac

SEQ ID NO: 7409018 - DNA, 22 bp, Homo sapiens
actcagagttttacccagagac

SEQ ID NO: 7409019 - DNA, 22 bp, Homo sapiens
actcagagttttacccagagac

SEQ ID NO: 7409020 - DNA, 20 bp, Homo sapiens
actcagatgctcacaacagg

SEQ ID NO: 7409021 - DNA, 22 bp, Homo sapiens
actcagagtgcatctcctattt

SEQ ID NO: 7409022 - DNA, 22 bp, Homo sapiens
actcagagttcctgtgcatagt

SEQ ID NO: 7409023 - DNA, 22 bp, Homo sapiens
actcagagtctgtttggtacct

SEQ ID NO: 7409024 - DNA, 22 bp, Homo sapiens
actcagagtgcatctcctattt

SEQ ID NO: 7409025 - DNA, 22 bp, Homo sapiens
actcagctgatgaagcacaagt

SEQ ID NO: 7409026 - DNA, 22 bp, Homo sapiens
actcagctcaggagctggctgg

SEQ ID NO: 7409027 - DNA, 22 bp, Homo sapiens
actcagctcaggagctggctgg

SEQ ID NO: 7409028 - DNA, 22 bp, Homo sapiens
actcagctaaactcagtctatg

SEQ ID NO: 7409029 - DNA, 22 bp, Homo sapiens
actcagcacagcactgggaacc

SEQ ID NO: 7409030 - DNA, 20 bp, Homo sapiens
actcagatgctcacaacagg

SEQ ID NO: 7409031 - DNA, 22 bp, Homo sapiens
actcagcatatggggccgcttg

SEQ ID NO: 7409032 - DNA, 22 bp, Homo sapiens
actcagctaaactcagtctatg

SEQ ID NO: 7409033 - DNA, 22 bp, Homo sapiens
actcagctaaactcagtctatg

SEQ ID NO: 7409034 - DNA, 22 bp, Homo sapiens
actcagaggaaaccctcctagg

SEQ ID NO: 7409035 - DNA, 22 bp, Homo sapiens
actcagagcttggctccttgct

SEQ ID NO: 7409036 - DNA, 22 bp, Homo sapiens
actcagagcttggctccttgct

SEQ ID NO: 7409037 - DNA, 22 bp, Homo sapiens
actcagagcctcgagggactgc

SEQ ID NO: 7409038 - DNA, 22 bp, Homo sapiens
actcagaggaaagttgagattg

SEQ ID NO: 7409039 - DNA, 22 bp, Homo sapiens
actcagaggaaagttgagattg

SEQ ID NO: 7409040 - DNA, 22 bp, Homo sapiens
actcagaggaccaaaaggaaag

SEQ ID NO: 7409041 - DNA, 22 bp, Homo sapiens
actcagaggaaagttgagattg

SEQ ID NO: 7409042 - DNA, 22 bp, Homo sapiens
actcagagtctgagataaatct

SEQ ID NO: 7409043 - DNA, 22 bp, Homo sapiens
actcagagtctgagataaatct

SEQ ID NO: 7409044 - DNA, 22 bp, Homo sapiens
actcagagtcaatgttaatggc

SEQ ID NO: 7409045 - DNA, 22 bp, Homo sapiens
actcagaggggactggtgtggt

SEQ ID NO: 7409046 - DNA, 22 bp, Homo sapiens
actcagagtagaaaataggttc

SEQ ID NO: 7409047 - DNA, 22 bp, Homo sapiens
actcagagtagaaaataggttc

SEQ ID NO: 7409048 - DNA, 22 bp, Homo sapiens
actcagaggcagctgctcaccc

SEQ ID NO: 7409049 - DNA, 22 bp, Homo sapiens
actcagaggcagctgctcaccc

SEQ ID NO: 7409050 - DNA, 22 bp, Homo sapiens
actcagaggctggaaatcaaag

SEQ ID NO: 7409051 - DNA, 22 bp, Homo sapiens
agtaacttaggagatacatggg

SEQ ID NO: 7409052 - DNA, 22 bp, Homo sapiens
agtaacttaggagatacatggg

SEQ ID NO: 7409053 - DNA, 20 bp, Homo sapiens
agtaacttgcctaaggtcag

SEQ ID NO: 7409054 - DNA, 22 bp, Homo sapiens
agtaagcaccgggatggtcaag

SEQ ID NO: 7409055 - DNA, 22 bp, Homo sapiens
agtaagcaatagagtgagaatt

SEQ ID NO: 7409056 - DNA, 22 bp, Homo sapiens
agtaagcaccgggatggtcaag

SEQ ID NO: 7409057 - DNA, 22 bp, Homo sapiens
agtaaggcaatgccactaagat

SEQ ID NO: 7409058 - DNA, 20 bp, Homo sapiens
agtaagcaggacttctcctc

SEQ ID NO: 7409059 - DNA, 22 bp, Homo sapiens
agtaacatgctaatttgattat

SEQ ID NO: 7409060 - DNA, 23 bp, Homo sapiens
agtaacatgcaaataacagtctg

SEQ ID NO: 7409061 - DNA, 22 bp, Homo sapiens
agtaaccagtagtcattcattc

SEQ ID NO: 7409062 - DNA, 22 bp, Homo sapiens
agtaactatgcttgagaatcag

SEQ ID NO: 7409063 - DNA, 22 bp, Homo sapiens
agtaacttaagcaattgtgtat

SEQ ID NO: 7409064 - DNA, 22 bp, Homo sapiens
agtaactctcctttgacatatt

SEQ ID NO: 7409065 - DNA, 20 bp, Homo sapiens
agtaacttagcaactctagg

SEQ ID NO: 7409066 - DNA, 20 bp, Homo sapiens
agtaacttagcaactctagg

SEQ ID NO: 7409067 - DNA, 22 bp, Homo sapiens
agtaactcatgtaaacctcaca

SEQ ID NO: 7409068 - DNA, 22 bp, Homo sapiens
agtaactctcctttgacatatt

SEQ ID NO: 7409069 - DNA, 22 bp, Homo sapiens
agtaacatgagtttttctaatg

SEQ ID NO: 7409070 - DNA, 23 bp, Homo sapiens
agtaacatgcaaataacagtctg

SEQ ID NO: 7409071 - DNA, 23 bp, Homo sapiens
agtaacatgcaaataacagtctg

SEQ ID NO: 7409072 - DNA, 23 bp, Homo sapiens
agtaacatgcaaataacagtctg

SEQ ID NO: 7409073 - DNA, 22 bp, Homo sapiens
agtaacatgagtttttctaatg

SEQ ID NO: 7409074 - DNA, 22 bp, Homo sapiens
agtaacatgagtttttctaatg

SEQ ID NO: 7409075 - DNA, 22 bp, Homo sapiens
agtaacatctttgacatttgtt

SEQ ID NO: 7409076 - DNA, 22 bp, Homo sapiens
agtaacatgagtttttctaatg

SEQ ID NO: 7409077 - DNA, 22 bp, Homo sapiens
agtaacatatagcacttttgga

SEQ ID NO: 7409078 - DNA, 22 bp, Homo sapiens
agtaacatctttgacatttgtt

SEQ ID NO: 7409079 - DNA, 22 bp, Homo sapiens
agtaacatatagcacttttgga

SEQ ID NO: 7409080 - DNA, 22 bp, Homo sapiens
agtaacatctttgacatttgtt

SEQ ID NO: 7409081 - DNA, 22 bp, Homo sapiens
agtaacatctttgacatttgtt

SEQ ID NO: 7409082 - DNA, 22 bp, Homo sapiens
actcagcttcctacagctagaa

SEQ ID NO: 7409083 - DNA, 22 bp, Homo sapiens
actcagcttcctacagctagaa

SEQ ID NO: 7409084 - DNA, 22 bp, Homo sapiens
agtaacagtaacatcttcctag

SEQ ID NO: 7409085 - DNA, 19 bp, Homo sapiens
agtgagcatggcttgactg

SEQ ID NO: 7409086 - DNA, 17 bp, Homo sapiens
agtgaggagattggaag

SEQ ID NO: 7409087 - DNA, 22 bp, Homo sapiens
agtgaggaaatccattatcaag

SEQ ID NO: 7409088 - DNA, 17 bp, Homo sapiens
agtgaggagattggaag

SEQ ID NO: 7409089 - DNA, 22 bp, Homo sapiens
agtgaggcaaagtgagaggcag

SEQ ID NO: 7409090 - DNA, 22 bp, Homo sapiens
agtgaggcaaagtgagaggcag

SEQ ID NO: 7409091 - DNA, 22 bp, Homo sapiens
agtgaggcaaagtgagaggcag

SEQ ID NO: 7409092 - DNA, 22 bp, Homo sapiens
agtgaggcaaagtgagaggcag

SEQ ID NO: 7409093 - DNA, 20 bp, Homo sapiens
agtgaggcagttcagtgggc

SEQ ID NO: 7409094 - DNA, 20 bp, Homo sapiens
agtgaggcagttcagtgggc

SEQ ID NO: 7409095 - DNA, 22 bp, Homo sapiens
agtgaggctaataggcaatggt

SEQ ID NO: 7409096 - DNA, 22 bp, Homo sapiens
agtgaggctaataggcaatggt

SEQ ID NO: 7409097 - DNA, 20 bp, Homo sapiens
agtgaggcagttcagtgggc

SEQ ID NO: 7409098 - DNA, 20 bp, Homo sapiens
agtgaggcagttcagtgggc

SEQ ID NO: 7409099 - DNA, 20 bp, Homo sapiens
agtgaggcagttcagtgggc

SEQ ID NO: 7409100 - DNA, 22 bp, Homo sapiens
agtgagcatcttcaggagccaa

SEQ ID NO: 7409101 - DNA, 19 bp, Homo sapiens
agtgagcatggcttgactg

SEQ ID NO: 7409102 - DNA, 22 bp, Homo sapiens
agtgagcattcgtttggaaccc

SEQ ID NO: 7409103 - DNA, 22 bp, Homo sapiens
agtgagcatccagagaggtggg

SEQ ID NO: 7409104 - DNA, 19 bp, Homo sapiens
agtgagcatccagagaggt

SEQ ID NO: 7409105 - DNA, 19 bp, Homo sapiens
agtgagcatccagagaggt

SEQ ID NO: 7409106 - DNA, 19 bp, Homo sapiens
agtgagcatccagagaggt

SEQ ID NO: 7409107 - DNA, 23 bp, Homo sapiens
agtgagcagctgtagggcaagga

SEQ ID NO: 7409108 - DNA, 23 bp, Homo sapiens
agtgagcagctgtagggcaagga

SEQ ID NO: 7409109 - DNA, 23 bp, Homo sapiens
agtgagcagctgtagggcaagga

SEQ ID NO: 7409110 - DNA, 23 bp, Homo sapiens
agtgagcagctgtagggcaagga

SEQ ID NO: 7409111 - DNA, 22 bp, Homo sapiens
agtgagcaacagaagcgtgggt

SEQ ID NO: 7409112 - DNA, 22 bp, Homo sapiens
agtgagatgagtttttgactta

SEQ ID NO: 7409113 - DNA, 22 bp, Homo sapiens
agtgagatgagtttttgactta

SEQ ID NO: 7409114 - DNA, 20 bp, Homo sapiens
agtgagattgctgctctagc

SEQ ID NO: 7409115 - DNA, 22 bp, Homo sapiens
agtgagcaacagaagcgtgggt

SEQ ID NO: 7409116 - DNA, 22 bp, Homo sapiens
agtgagatcatgcaatatttgt

SEQ ID NO: 7409117 - DNA, 22 bp, Homo sapiens
agtgagatgaaaatatctgtga

SEQ ID NO: 7409118 - DNA, 20 bp, Homo sapiens
agtgagattgctgctctagc

SEQ ID NO: 7409119 - DNA, 22 bp, Homo sapiens
agtgaatgtccccgcgggtcag

SEQ ID NO: 7409120 - DNA, 22 bp, Homo sapiens
agtgaatgtccccgcgggtcag

SEQ ID NO: 7409121 - DNA, 18 bp, Homo sapiens
agtgaattaaggcaggaa

SEQ ID NO: 7409122 - DNA, 22 bp, Homo sapiens
agtgaatgtccccgcgggtcag

SEQ ID NO: 7409123 - DNA, 22 bp, Homo sapiens
agtgaatgagaggtgagtattg

SEQ ID NO: 7409124 - DNA, 22 bp, Homo sapiens
agtccttttgttttgagatgag

SEQ ID NO: 7409125 - DNA, 22 bp, Homo sapiens
agtccttttgttttgagatgag

SEQ ID NO: 7409126 - DNA, 22 bp, Homo sapiens
agtcctttgggaaaaatgacta

SEQ ID NO: 7409127 - DNA, 21 bp, Homo sapiens
agtccttgaaactctttcttg

SEQ ID NO: 7409128 - DNA, 22 bp, Homo sapiens
agtcctttgctgaactgtcaca

SEQ ID NO: 7409129 - DNA, 22 bp, Homo sapiens
agtcctttgctgaactgtcaca

SEQ ID NO: 7409130 - DNA, 22 bp, Homo sapiens
agtccttgaattaatttgactc

SEQ ID NO: 7409131 - DNA, 21 bp, Homo sapiens
agtccttgaaactctttcttg

SEQ ID NO: 7409132 - DNA, 22 bp, Homo sapiens
agtccttgaatgttttgaaatc

SEQ ID NO: 7409133 - DNA, 21 bp, Homo sapiens
agtccttgaaactctttcttg

SEQ ID NO: 7409134 - DNA, 22 bp, Homo sapiens
agtgagatatgtctcactgtcc

SEQ ID NO: 7409135 - DNA, 22 bp, Homo sapiens
agtgagatatgtctcactgtcc

SEQ ID NO: 7409136 - DNA, 22 bp, Homo sapiens
agtgagatattagctaatgtgt

SEQ ID NO: 7409137 - DNA, 22 bp, Homo sapiens
agtgagatgctctttcctttct

SEQ ID NO: 7409138 - DNA, 22 bp, Homo sapiens
agtgagatgtgtaatcaggggt

SEQ ID NO: 7409139 - DNA, 22 bp, Homo sapiens
agtgagatgtgtaatcaggggt

SEQ ID NO: 7409140 - DNA, 22 bp, Homo sapiens
agtgagagtattaatgtgaact

SEQ ID NO: 7409141 - DNA, 22 bp, Homo sapiens
agtgagagtattaatgtgaact

SEQ ID NO: 7409142 - DNA, 22 bp, Homo sapiens
agtgagagtattaatgtgaact

SEQ ID NO: 7409143 - DNA, 22 bp, Homo sapiens
agtgagagtattaatgtgaact

SEQ ID NO: 7409144 - DNA, 22 bp, Homo sapiens
agtgagagtattaatgtgaact

SEQ ID NO: 7409145 - DNA, 22 bp, Homo sapiens
agtgaattagcctatttgtaaa

SEQ ID NO: 7409146 - DNA, 22 bp, Homo sapiens
agtgaattagcctatttgtaaa

SEQ ID NO: 7409147 - DNA, 22 bp, Homo sapiens
agtgaattctaaatgctaaaga

SEQ ID NO: 7409148 - DNA, 19 bp, Homo sapiens
agtgagaacatgtgcacac

SEQ ID NO: 7409149 - DNA, 17 bp, Homo sapiens
agtgagaatgtcatgta

SEQ ID NO: 7409150 - DNA, 17 bp, Homo sapiens
agtgagaatgtcatgta

SEQ ID NO: 7409151 - DNA, 22 bp, Homo sapiens
agtgagagtattaatgtgaact

SEQ ID NO: 7409152 - DNA, 22 bp, Homo sapiens
agtgagacagtatactgagcag

SEQ ID NO: 7409153 - DNA, 22 bp, Homo sapiens
agtgagacagtatactgagcag

SEQ ID NO: 7409154 - DNA, 22 bp, Homo sapiens
agtgagacagtggactctgcat

SEQ ID NO: 7409155 - DNA, 17 bp, Homo sapiens
agtgagaatgtcatgta

SEQ ID NO: 7409156 - DNA, 22 bp, Homo sapiens
agtgagacagtatactgagcag

SEQ ID NO: 7409157 - DNA, 20 bp, Homo sapiens
agtgctgtggctgaataaga

SEQ ID NO: 7409158 - DNA, 20 bp, Homo sapiens
agtgctgtggctgaataaga

SEQ ID NO: 7409159 - DNA, 22 bp, Homo sapiens
agtgctgtctccttcccccggg

SEQ ID NO: 7409160 - DNA, 22 bp, Homo sapiens
agtgctgtctccttcccccggg

SEQ ID NO: 7409161 - DNA, 22 bp, Homo sapiens
agtgctgtctccttcccccggg

SEQ ID NO: 7409162 - DNA, 22 bp, Homo sapiens
agtgctgtccagtttcacaggt

SEQ ID NO: 7409163 - DNA, 22 bp, Homo sapiens
agtgctgtcccgacaactgagg

SEQ ID NO: 7409164 - DNA, 22 bp, Homo sapiens
agtgctgtcccgacaactgagg

SEQ ID NO: 7409165 - DNA, 23 bp, Homo sapiens
agtgctgaattgaaagctccagg

SEQ ID NO: 7409166 - DNA, 20 bp, Homo sapiens
agtgcaagaaagcacagctg

SEQ ID NO: 7409167 - DNA, 22 bp, Homo sapiens
agtgctgaagactggctaggga

SEQ ID NO: 7409168 - DNA, 22 bp, Homo sapiens
agtgctgtccagtttcacaggt

SEQ ID NO: 7409169 - DNA, 22 bp, Homo sapiens
agtgctgtccagtttcacaggt

SEQ ID NO: 7409170 - DNA, 23 bp, Homo sapiens
agtgctgaattgaaagctccagg

SEQ ID NO: 7409171 - DNA, 20 bp, Homo sapiens
agtgcaagaaagcacagctg

SEQ ID NO: 7409172 - DNA, 22 bp, Homo sapiens
agtgcaagctccataatcttca

SEQ ID NO: 7409173 - DNA, 22 bp, Homo sapiens
agtgcaatagcaaagaacaaca

SEQ ID NO: 7409174 - DNA, 22 bp, Homo sapiens
agtgcaagctccataatcttca

SEQ ID NO: 7409175 - DNA, 22 bp, Homo sapiens
agtgcaaatatctacgcggtga

SEQ ID NO: 7409176 - DNA, 22 bp, Homo sapiens
agtgcaaagggctgttgagaag

SEQ ID NO: 7409177 - DNA, 22 bp, Homo sapiens
agtgcaaagggctgttgagaag

SEQ ID NO: 7409178 - DNA, 22 bp, Homo sapiens
agtgcaaagggatcagattggg

SEQ ID NO: 7409179 - DNA, 20 bp, Homo sapiens
agtgcaagaaagcacagctg

SEQ ID NO: 7409180 - DNA, 22 bp, Homo sapiens
agtgcaaagcagcctgtacacc

SEQ ID NO: 7409181 - DNA, 22 bp, Homo sapiens
agtgcaaagaaatcagctttgt

SEQ ID NO: 7409182 - DNA, 22 bp, Homo sapiens
agtgcaaagaaatcagctttgt

SEQ ID NO: 7409183 - DNA, 22 bp, Homo sapiens
agtgcaaagcagcctgtacacc

SEQ ID NO: 7409184 - DNA, 22 bp, Homo sapiens
agtgcaaagggatcagattggg

SEQ ID NO: 7409185 - DNA, 22 bp, Homo sapiens
agtgattttatcaatttactca

SEQ ID NO: 7409186 - DNA, 22 bp, Homo sapiens
agtgattttatcaatttactca

SEQ ID NO: 7409187 - DNA, 22 bp, Homo sapiens
agtgattttatcaatttactca

SEQ ID NO: 7409188 - DNA, 22 bp, Homo sapiens
agtgattttaacttccagcaat

SEQ ID NO: 7409189 - DNA, 22 bp, Homo sapiens
agtgattttaacttccagcaat

SEQ ID NO: 7409190 - DNA, 20 bp, Homo sapiens
agtgatttgttagtacattg

SEQ ID NO: 7409191 - DNA, 20 bp, Homo sapiens
agtgatttgttagtacattg

SEQ ID NO: 7409192 - DNA, 20 bp, Homo sapiens
agtgatttgttagtacattg

SEQ ID NO: 7409193 - DNA, 22 bp, Homo sapiens
agtgatttggttcatacttcca

SEQ ID NO: 7409194 - DNA, 22 bp, Homo sapiens
agtgatttggtgggagcgcgta

SEQ ID NO: 7409195 - DNA, 22 bp, Homo sapiens
agtgatttgggtgtcagaaagt

SEQ ID NO: 7409196 - DNA, 22 bp, Homo sapiens
agtgatttggcggcagagttag

SEQ ID NO: 7409197 - DNA, 22 bp, Homo sapiens
agtgatttggcggcagagttag

SEQ ID NO: 7409198 - DNA, 22 bp, Homo sapiens
agtgaggctaataggcaatggt

SEQ ID NO: 7409199 - DNA, 22 bp, Homo sapiens
agtgatttgggagagccagctg

SEQ ID NO: 7409200 - DNA, 22 bp, Homo sapiens
agtgatttgggagagccagctg

SEQ ID NO: 7409201 - DNA, 22 bp, Homo sapiens
agtgatttggggatgggaaagg

SEQ ID NO: 7409202 - DNA, 22 bp, Homo sapiens
agtgatttgggtgtcagaaagt

SEQ ID NO: 7409203 - DNA, 22 bp, Homo sapiens
agtgcaaagaaatcagctttgt

SEQ ID NO: 7409204 - DNA, 22 bp, Homo sapiens
agtgcaaagaaatcagctttgt

SEQ ID NO: 7409205 - DNA, 22 bp, Homo sapiens
agtgcaaactttattgtgacct

SEQ ID NO: 7409206 - DNA, 22 bp, Homo sapiens
agtgcaaactttattgtgacct

SEQ ID NO: 7409207 - DNA, 22 bp, Homo sapiens
agtgcaaactttattgtgacct

SEQ ID NO: 7409208 - DNA, 22 bp, Homo sapiens
agtgcaaaattcagaagcaatt

SEQ ID NO: 7409209 - DNA, 22 bp, Homo sapiens
agtgcaaaattcagaagcaatt

SEQ ID NO: 7409210 - DNA, 22 bp, Homo sapiens
agtgcaaaattcagaagcaatt

SEQ ID NO: 7409211 - DNA, 22 bp, Homo sapiens
agtgcaaaattcagaagcaatt

SEQ ID NO: 7409212 - DNA, 22 bp, Homo sapiens
agtgcaaaattcagaagcaatt

SEQ ID NO: 7409213 - DNA, 22 bp, Homo sapiens
agtgatttttgaagccagccat

SEQ ID NO: 7409214 - DNA, 22 bp, Homo sapiens
agtgatttttgaagccagccat

SEQ ID NO: 7409215 - DNA, 22 bp, Homo sapiens
agtgattttgtcagcttctgca

SEQ ID NO: 7409216 - DNA, 22 bp, Homo sapiens
agtgattttgtagctatgagat

SEQ ID NO: 7409217 - DNA, 22 bp, Homo sapiens
agtgattttgtagctatgagat

SEQ ID NO: 7409218 - DNA, 22 bp, Homo sapiens
agtgattttggcctggcctttt

SEQ ID NO: 7409219 - DNA, 22 bp, Homo sapiens
agtgattttggccgtgccatta

SEQ ID NO: 7409220 - DNA, 15 bp, Homo sapiens
agtgattttggactc

SEQ ID NO: 7409221 - DNA, 20 bp, Homo sapiens
agtgattttgatatggtctt

SEQ ID NO: 7409222 - DNA, 22 bp, Homo sapiens
agtgattttcaagtggagcaca

SEQ ID NO: 7409223 - DNA, 22 bp, Homo sapiens
agtgattttgctttgaagtgac

SEQ ID NO: 7409224 - DNA, 22 bp, Homo sapiens
agtgattttgctttgaagtgac

SEQ ID NO: 7409225 - DNA, 22 bp, Homo sapiens
agtgattttctccagctggcag

SEQ ID NO: 7409226 - DNA, 22 bp, Homo sapiens
agtgattttgctttgaagtgac

SEQ ID NO: 7409227 - DNA, 22 bp, Homo sapiens
agtgggagcggcagtcggggac

SEQ ID NO: 7409228 - DNA, 22 bp, Homo sapiens
agtgggagcggcagtcggggac

SEQ ID NO: 7409229 - DNA, 22 bp, Homo sapiens
agtgggagcggcagtcggggac

SEQ ID NO: 7409230 - DNA, 22 bp, Homo sapiens
agtgggagcggcagtcggggac

SEQ ID NO: 7409231 - DNA, 22 bp, Homo sapiens
agtgggagccagcagcttgggg

SEQ ID NO: 7409232 - DNA, 22 bp, Homo sapiens
agtgggagccagcagcttgggg

SEQ ID NO: 7409233 - DNA, 22 bp, Homo sapiens
agtgggagcggcagtcggggac

SEQ ID NO: 7409234 - DNA, 22 bp, Homo sapiens
agtgggagccagcagcttgggg

SEQ ID NO: 7409235 - DNA, 22 bp, Homo sapiens
agtgggagccagcagcttgggg

SEQ ID NO: 7409236 - DNA, 22 bp, Homo sapiens
agtgggaggaagtggtgatatt

SEQ ID NO: 7409237 - DNA, 22 bp, Homo sapiens
agtgggaggaagtggtgatatt

SEQ ID NO: 7409238 - DNA, 22 bp, Homo sapiens
agtgggaggaagtggtgatatt

SEQ ID NO: 7409239 - DNA, 22 bp, Homo sapiens
agtgggaggaagtggtgatatt

SEQ ID NO: 7409240 - DNA, 22 bp, Homo sapiens
agtgggaggaagtggtgatatt

SEQ ID NO: 7409241 - DNA, 22 bp, Homo sapiens
agtgggaggaagtggtgatatt

SEQ ID NO: 7409242 - DNA, 22 bp, Homo sapiens
agtgggagcggcagtcggggac

SEQ ID NO: 7409243 - DNA, 22 bp, Homo sapiens
agtgggagcggcagtcggggac

SEQ ID NO: 7409244 - DNA, 22 bp, Homo sapiens
agtgggagcggcagtcggggac

SEQ ID NO: 7409245 - DNA, 22 bp, Homo sapiens
agtgggagcggcagtcggggac

SEQ ID NO: 7409246 - DNA, 22 bp, Homo sapiens
agtgggagccagcagcttgggg

SEQ ID NO: 7409247 - DNA, 16 bp, Homo sapiens
agtgggaggagaaaga

SEQ ID NO: 7409248 - DNA, 16 bp, Homo sapiens
agtgggaggagaaaga

SEQ ID NO: 7409249 - DNA, 22 bp, Homo sapiens
agtgggaggaagtggtgatatt

SEQ ID NO: 7409250 - DNA, 22 bp, Homo sapiens
agtgggaggaagtggtgatatt

SEQ ID NO: 7409251 - DNA, 22 bp, Homo sapiens
agtgggaggaagtggtgatatt

SEQ ID NO: 7409252 - DNA, 22 bp, Homo sapiens
agtgggaggaagtggtgatatt

SEQ ID NO: 7409253 - DNA, 22 bp, Homo sapiens
agtgggaggcggctgacgggcg

SEQ ID NO: 7409254 - DNA, 22 bp, Homo sapiens
agtgggaggcggctgacgggcg

SEQ ID NO: 7409255 - DNA, 22 bp, Homo sapiens
agtgggaggcggctgacgggcg

SEQ ID NO: 7409256 - DNA, 22 bp, Homo sapiens
agtgggaggcggctgacgggcg

SEQ ID NO: 7409257 - DNA, 22 bp, Homo sapiens
agtgggaggcggctgacgggcg

SEQ ID NO: 7409258 - DNA, 22 bp, Homo sapiens
agtgggagggccatatggtgaa

SEQ ID NO: 7409259 - DNA, 22 bp, Homo sapiens
agtggggccgcggtcctgccct

SEQ ID NO: 7409260 - DNA, 22 bp, Homo sapiens
agtgggagggccatatggtgaa

SEQ ID NO: 7409261 - DNA, 22 bp, Homo sapiens
agtggggccgcggtcctgccct

SEQ ID NO: 7409262 - DNA, 22 bp, Homo sapiens
agtgggaggcggctgacgggcg

SEQ ID NO: 7409263 - DNA, 22 bp, Homo sapiens
agtgggaggcggctgacgggcg

SEQ ID NO: 7409264 - DNA, 22 bp, Homo sapiens
agtgggaggcggctgacgggcg

SEQ ID NO: 7409265 - DNA, 20 bp, Homo sapiens
agtgggagagggcagactgc

SEQ ID NO: 7409266 - DNA, 20 bp, Homo sapiens
agtgggagagggcagactgc

SEQ ID NO: 7409267 - DNA, 20 bp, Homo sapiens
agtgggagagggcagactgc

SEQ ID NO: 7409268 - DNA, 22 bp, Homo sapiens
agtggctggaattgcaggtgcg

SEQ ID NO: 7409269 - DNA, 22 bp, Homo sapiens
agtggctggaattgcaggtgcg

SEQ ID NO: 7409270 - DNA, 23 bp, Homo sapiens
agtggctggacagactttcctgg

SEQ ID NO: 7409271 - DNA, 20 bp, Homo sapiens
agtgggagagggcagactgc

SEQ ID NO: 7409272 - DNA, 20 bp, Homo sapiens
agtgggagagggcagactgc

SEQ ID NO: 7409273 - DNA, 20 bp, Homo sapiens
agtgggagagggcagactgc

SEQ ID NO: 7409274 - DNA, 22 bp, Homo sapiens
agtgggagataacttaacagct

SEQ ID NO: 7409275 - DNA, 20 bp, Homo sapiens
agtgggagagggcagactgc

SEQ ID NO: 7409276 - DNA, 20 bp, Homo sapiens
agtgggagagggcagactgc

SEQ ID NO: 7409277 - DNA, 22 bp, Homo sapiens
agtgggagccagcagcttgggg

SEQ ID NO: 7409278 - DNA, 22 bp, Homo sapiens
agtgggagccagcagcttgggg

SEQ ID NO: 7409279 - DNA, 22 bp, Homo sapiens
agtgggagccagcagcttgggg

SEQ ID NO: 7409280 - DNA, 22 bp, Homo sapiens
agtgggagccagcagcttgggg

SEQ ID NO: 7409281 - DNA, 22 bp, Homo sapiens
agtgggagataacttaacagct

SEQ ID NO: 7409282 - DNA, 22 bp, Homo sapiens
agtggcagagccaagatatgat

SEQ ID NO: 7409283 - DNA, 22 bp, Homo sapiens
agtggcagagccaagatatgat

SEQ ID NO: 7409284 - DNA, 22 bp, Homo sapiens
agtggcagagccaagatatgat

SEQ ID NO: 7409285 - DNA, 22 bp, Homo sapiens
agtggcagagccaagatatgat

SEQ ID NO: 7409286 - DNA, 22 bp, Homo sapiens
agtggcagagccaagatatgat

SEQ ID NO: 7409287 - DNA, 22 bp, Homo sapiens
agtggcagagcaggtgctggaa

SEQ ID NO: 7409288 - DNA, 22 bp, Homo sapiens
agtggcagagcaggtgctggaa

SEQ ID NO: 7409289 - DNA, 22 bp, Homo sapiens
agtggcagagccaagtagagcc

SEQ ID NO: 7409290 - DNA, 22 bp, Homo sapiens
agtggcagagccaagatatgat

SEQ ID NO: 7409291 - DNA, 22 bp, Homo sapiens
agtggcagagccaagtagagcc

SEQ ID NO: 7409292 - DNA, 22 bp, Homo sapiens
agtggcagagccaagtagagcc

SEQ ID NO: 7409293 - DNA, 22 bp, Homo sapiens
agtggcagagccaagtagagcc

SEQ ID NO: 7409294 - DNA, 22 bp, Homo sapiens
agtggcagagccaagtagagcc

SEQ ID NO: 7409295 - DNA, 22 bp, Homo sapiens
agtggcagagccaagtagagcc

SEQ ID NO: 7409296 - DNA, 22 bp, Homo sapiens
agtggcagagccaagtagagcc

SEQ ID NO: 7409297 - DNA, 22 bp, Homo sapiens
agtggcagagccaagtagagcc

SEQ ID NO: 7409298 - DNA, 22 bp, Homo sapiens
agtggcagagccaagtagagcc

SEQ ID NO: 7409299 - DNA, 22 bp, Homo sapiens
agtggcagagccagggttggga

SEQ ID NO: 7409300 - DNA, 22 bp, Homo sapiens
agtggcagagccagggttggga

SEQ ID NO: 7409301 - DNA, 22 bp, Homo sapiens
agtggcagagccagggttggga

SEQ ID NO: 7409302 - DNA, 22 bp, Homo sapiens
agtggctggaattgcaggtgcg

SEQ ID NO: 7409303 - DNA, 22 bp, Homo sapiens
agtgctttccctgaaaccttcc

SEQ ID NO: 7409304 - DNA, 22 bp, Homo sapiens
agtgctttcttgctccatcagt

SEQ ID NO: 7409305 - DNA, 22 bp, Homo sapiens
agtgctttcttgctccatcagt

SEQ ID NO: 7409306 - DNA, 22 bp, Homo sapiens
agtgctttccttcttgtgacat

SEQ ID NO: 7409307 - DNA, 22 bp, Homo sapiens
agtgctttagcatccaactgtc

SEQ ID NO: 7409308 - DNA, 22 bp, Homo sapiens
agtgctttcagtgtgctctttt

SEQ ID NO: 7409309 - DNA, 22 bp, Homo sapiens
agtgctttatgttgttgtgcaa

SEQ ID NO: 7409310 - DNA, 22 bp, Homo sapiens
agtgctgttaggttaatatagt

SEQ ID NO: 7409311 - DNA, 22 bp, Homo sapiens
agtgctgtccagtttcacaggt

SEQ ID NO: 7409312 - DNA, 22 bp, Homo sapiens
agtgctgttaggttaatatagt

SEQ ID NO: 7409313 - DNA, 22 bp, Homo sapiens
agtgctgttaggttaatatagt

SEQ ID NO: 7409314 - DNA, 22 bp, Homo sapiens
agtgctgttggataatgctgtc

SEQ ID NO: 7409315 - DNA, 22 bp, Homo sapiens
agtgcttaaaaccctgcactag

SEQ ID NO: 7409316 - DNA, 22 bp, Homo sapiens
agtgcttaatagatgtccagca

SEQ ID NO: 7409317 - DNA, 22 bp, Homo sapiens
agtgctgttggataatgctgtc

SEQ ID NO: 7409318 - DNA, 22 bp, Homo sapiens
agtgcttaaaaccctgcactag

SEQ ID NO: 7409319 - DNA, 22 bp, Homo sapiens
agtgcttagttccatgctggaa

SEQ ID NO: 7409320 - DNA, 22 bp, Homo sapiens
agtgcttaatagatgtccagca

SEQ ID NO: 7409321 - DNA, 22 bp, Homo sapiens
agtgcttaaaaccctgcactag

SEQ ID NO: 7409322 - DNA, 22 bp, Homo sapiens
agtgcttataccaaagactctt

SEQ ID NO: 7409323 - DNA, 22 bp, Homo sapiens
agtgcttataccaaagactctt

SEQ ID NO: 7409324 - DNA, 22 bp, Homo sapiens
agtgcttaggatttgagaggcg

SEQ ID NO: 7409325 - DNA, 20 bp, Homo sapiens
agtgcttattttcatggctg

SEQ ID NO: 7409326 - DNA, 20 bp, Homo sapiens
agtgcttattttcatggctg

SEQ ID NO: 7409327 - DNA, 22 bp, Homo sapiens
agtgcttctggtgggcgtgagg

SEQ ID NO: 7409328 - DNA, 22 bp, Homo sapiens
agtgcttctggtgggcgtgagg

SEQ ID NO: 7409329 - DNA, 22 bp, Homo sapiens
agtgcttcttaaacctttctac

SEQ ID NO: 7409330 - DNA, 22 bp, Homo sapiens
agtgcttggcaaccttctgacc

SEQ ID NO: 7409331 - DNA, 22 bp, Homo sapiens
agtgcttggttcaatgaaggtt

SEQ ID NO: 7409332 - DNA, 22 bp, Homo sapiens
agtgcttggttcaatgaaggtt

SEQ ID NO: 7409333 - DNA, 22 bp, Homo sapiens
agtgcttggttcaatgaaggtt

SEQ ID NO: 7409334 - DNA, 22 bp, Homo sapiens
agtgctttacctagataatgtt

SEQ ID NO: 7409335 - DNA, 22 bp, Homo sapiens
agtgctttacctagataatgtt

SEQ ID NO: 7409336 - DNA, 22 bp, Homo sapiens
agtgcttgtgaaatactagagg

SEQ ID NO: 7409337 - DNA, 22 bp, Homo sapiens
agtgcttgtgaaatactagagg

SEQ ID NO: 7409338 - DNA, 22 bp, Homo sapiens
agtggcagacacaatgtgggca

SEQ ID NO: 7409339 - DNA, 22 bp, Homo sapiens
agtggcagacacaatgtgggca

SEQ ID NO: 7409340 - DNA, 22 bp, Homo sapiens
agtggcagacacaatgtgggca

SEQ ID NO: 7409341 - DNA, 22 bp, Homo sapiens
agtggcagacagagacagtacc

SEQ ID NO: 7409342 - DNA, 22 bp, Homo sapiens
agtggcagacagagacagtacc

SEQ ID NO: 7409343 - DNA, 22 bp, Homo sapiens
agtggcagacagagacagtacc

SEQ ID NO: 7409344 - DNA, 22 bp, Homo sapiens
agtggcagagaccccagccagc

SEQ ID NO: 7409345 - DNA, 22 bp, Homo sapiens
agtggcagagaccccagccagc

SEQ ID NO: 7409346 - DNA, 22 bp, Homo sapiens
agtggcagagaccccagccagc

SEQ ID NO: 7409347 - DNA, 22 bp, Homo sapiens
agtggcagacagagacagtacc

SEQ ID NO: 7409348 - DNA, 22 bp, Homo sapiens
agtggcagacagagacagtacc

SEQ ID NO: 7409349 - DNA, 22 bp, Homo sapiens
agtggcagagcaggtgctggaa

SEQ ID NO: 7409350 - DNA, 22 bp, Homo sapiens
agtggcagagcaggtgctggaa

SEQ ID NO: 7409351 - DNA, 22 bp, Homo sapiens
agtggcagagaccccagccagc

SEQ ID NO: 7409352 - DNA, 22 bp, Homo sapiens
agtggcagagaccccagccagc

SEQ ID NO: 7409353 - DNA, 22 bp, Homo sapiens
agtggcagagaccccagccagc

SEQ ID NO: 7409354 - DNA, 22 bp, Homo sapiens
agtggcagagcaggtgctggaa

SEQ ID NO: 7409355 - DNA, 22 bp, Homo sapiens
agtggcagagcaggtgctggaa

SEQ ID NO: 7409356 - DNA, 22 bp, Homo sapiens
agtggcagagcaggtgctggaa

SEQ ID NO: 7409357 - DNA, 22 bp, Homo sapiens
agtggcagagcaggtgctggaa

SEQ ID NO: 7409358 - DNA, 22 bp, Homo sapiens
agtggcagagcaggtgctggaa

SEQ ID NO: 7409359 - DNA, 22 bp, Homo sapiens
agtggcagaagtcactgggtag

SEQ ID NO: 7409360 - DNA, 22 bp, Homo sapiens
agtggcagacacaatgtgggca

SEQ ID NO: 7409361 - DNA, 22 bp, Homo sapiens
agtggcagacacaatgtgggca

SEQ ID NO: 7409362 - DNA, 22 bp, Homo sapiens
agtggcagacacaatgtgggca

SEQ ID NO: 7409363 - DNA, 22 bp, Homo sapiens
agtggcagacacaatgtgggca

SEQ ID NO: 7409364 - DNA, 22 bp, Homo sapiens
agtggcagacacaatgtgggca

SEQ ID NO: 7409365 - DNA, 22 bp, Homo sapiens
agtggcagaagtcactgggtag

SEQ ID NO: 7409366 - DNA, 22 bp, Homo sapiens
agtgctttggtatagaactatt

SEQ ID NO: 7409367 - DNA, 22 bp, Homo sapiens
agtgctttggtatagaactatt

SEQ ID NO: 7409368 - DNA, 22 bp, Homo sapiens
agtgctttgagcgtttgaaaag

SEQ ID NO: 7409369 - DNA, 22 bp, Homo sapiens
agtgctttgaacgaaaggctga

SEQ ID NO: 7409370 - DNA, 22 bp, Homo sapiens
agttactcaaggctgatataag

SEQ ID NO: 7409371 - DNA, 19 bp, Homo sapiens
agttatttctaaatttacc

SEQ ID NO: 7409372 - DNA, 22 bp, Homo sapiens
agttaccatatatcaaacatgg

SEQ ID NO: 7409373 - DNA, 22 bp, Homo sapiens
agttaccagcactctctccggc

SEQ ID NO: 7409374 - DNA, 20 bp, Homo sapiens
agttacgctattactctcct

SEQ ID NO: 7409375 - DNA, 22 bp, Homo sapiens
agttaccagccgtaagaagcat

SEQ ID NO: 7409376 - DNA, 22 bp, Homo sapiens
agttacatgtgaatagaaagta

SEQ ID NO: 7409377 - DNA, 22 bp, Homo sapiens
agttacattctgagctgagtag

SEQ ID NO: 7409378 - DNA, 22 bp, Homo sapiens
agttacattctgagctgagtag

SEQ ID NO: 7409379 - DNA, 22 bp, Homo sapiens
agttacattctgagctgagtag

SEQ ID NO: 7409380 - DNA, 19 bp, Homo sapiens
agttatttctaaatttacc

SEQ ID NO: 7409381 - DNA, 22 bp, Homo sapiens
agttatttggctatagatggta

SEQ ID NO: 7409382 - DNA, 19 bp, Homo sapiens
agttatttctaaatttacc

SEQ ID NO: 7409383 - DNA, 22 bp, Homo sapiens
agttattttggaaaatgagtca

SEQ ID NO: 7409384 - DNA, 22 bp, Homo sapiens
agttattttggaaaatgagtca

SEQ ID NO: 7409385 - DNA, 22 bp, Homo sapiens
agttattttggaaaatgagtca

SEQ ID NO: 7409386 - DNA, 22 bp, Homo sapiens
agttcaacaccagcctgaccaa

SEQ ID NO: 7409387 - DNA, 22 bp, Homo sapiens
agttcaaagtcaaggaaactgt

SEQ ID NO: 7409388 - DNA, 22 bp, Homo sapiens
agttcaaagtcaaggaaactgt

SEQ ID NO: 7409389 - DNA, 22 bp, Homo sapiens
agttcaaagtcaaggaaactgt

SEQ ID NO: 7409390 - DNA, 22 bp, Homo sapiens
agttcaatagaaaaatatatta

SEQ ID NO: 7409391 - DNA, 22 bp, Homo sapiens
agttcaatagaaaaatatatta

SEQ ID NO: 7409392 - DNA, 22 bp, Homo sapiens
agttcaatagaaaaatatatta

SEQ ID NO: 7409393 - DNA, 22 bp, Homo sapiens
agttcaattgttttgtaaaagt

SEQ ID NO: 7409394 - DNA, 22 bp, Homo sapiens
agttcacaagcgtaggtgctga

SEQ ID NO: 7409395 - DNA, 22 bp, Homo sapiens
agttcacaagcgtaggtgctga

SEQ ID NO: 7409396 - DNA, 22 bp, Homo sapiens
agttcaaaaaggtaaagtttat

SEQ ID NO: 7409397 - DNA, 22 bp, Homo sapiens
agttcaaaaaggtaaagtttat

SEQ ID NO: 7409398 - DNA, 22 bp, Homo sapiens
agttcaaaaaggtaaagtttat

SEQ ID NO: 7409399 - DNA, 22 bp, Homo sapiens
agttcaaaaaggtaaagtttat

SEQ ID NO: 7409400 - DNA, 22 bp, Homo sapiens
agttcaaactctataagaactt

SEQ ID NO: 7409401 - DNA, 22 bp, Homo sapiens
agttcaaactctataagaactt

SEQ ID NO: 7409402 - DNA, 23 bp, Homo sapiens
agttcaaaatcaaccaggacact

SEQ ID NO: 7409403 - DNA, 22 bp, Homo sapiens
agttcaaagctgcagtaatgga

SEQ ID NO: 7409404 - DNA, 22 bp, Homo sapiens
agttcaaagctgcagtaatgga

SEQ ID NO: 7409405 - DNA, 22 bp, Homo sapiens
agttcaaagctgcagtaatgga

SEQ ID NO: 7409406 - DNA, 22 bp, Homo sapiens
agttcaaactctataagaactt

SEQ ID NO: 7409407 - DNA, 22 bp, Homo sapiens
agttacaaccatgacacaagca

SEQ ID NO: 7409408 - DNA, 22 bp, Homo sapiens
agttacaaccatgacacaagca

SEQ ID NO: 7409409 - DNA, 22 bp, Homo sapiens
agttacaactgtttgaatgtca

SEQ ID NO: 7409410 - DNA, 22 bp, Homo sapiens
agttacaaccatgacacaagca

SEQ ID NO: 7409411 - DNA, 22 bp, Homo sapiens
agttacaagctattttacttaa

SEQ ID NO: 7409412 - DNA, 22 bp, Homo sapiens
agttacaagctattttacttaa

SEQ ID NO: 7409413 - DNA, 22 bp, Homo sapiens
agttacaactgtttgaatgtca

SEQ ID NO: 7409414 - DNA, 21 bp, Homo sapiens
agttacaagtttattcagagg

SEQ ID NO: 7409415 - DNA, 21 bp, Homo sapiens
agttacaagtttattcagagg

SEQ ID NO: 7409416 - DNA, 21 bp, Homo sapiens
agttacaagtttattcagagg

SEQ ID NO: 7409417 - DNA, 21 bp, Homo sapiens
agttacaagtttattcagagg

SEQ ID NO: 7409418 - DNA, 22 bp, Homo sapiens
agttacacaattattgcatgga

SEQ ID NO: 7409419 - DNA, 22 bp, Homo sapiens
agttacacagtgtcacttctac

SEQ ID NO: 7409420 - DNA, 22 bp, Homo sapiens
agttacacataaacattaaagg

SEQ ID NO: 7409421 - DNA, 22 bp, Homo sapiens
agttacacaacttatcacatct

SEQ ID NO: 7409422 - DNA, 21 bp, Homo sapiens
agttacaagtttattcagagg

SEQ ID NO: 7409423 - DNA, 21 bp, Homo sapiens
agttacatgtatagataaagt

SEQ ID NO: 7409424 - DNA, 21 bp, Homo sapiens
agttacatgtatagataaagt

SEQ ID NO: 7409425 - DNA, 22 bp, Homo sapiens
agttacatgtgaatagaaagta

SEQ ID NO: 7409426 - DNA, 22 bp, Homo sapiens
agttacatgtgaatagaaagta

SEQ ID NO: 7409427 - DNA, 22 bp, Homo sapiens
agttacataatctgtgaatttt

SEQ ID NO: 7409428 - DNA, 22 bp, Homo sapiens
agttacatataagaagacagac

SEQ ID NO: 7409429 - DNA, 22 bp, Homo sapiens
agttacatctgttatgtgtgtt

SEQ ID NO: 7409430 - DNA, 21 bp, Homo sapiens
agttacatgtatagataaagt

SEQ ID NO: 7409431 - DNA, 22 bp, Homo sapiens
agttacagctggcgtggggaaa

SEQ ID NO: 7409432 - DNA, 22 bp, Homo sapiens
agttacatgactgccggcggtg

SEQ ID NO: 7409433 - DNA, 22 bp, Homo sapiens
agttacaggaaagggccaggaa

SEQ ID NO: 7409434 - DNA, 22 bp, Homo sapiens
agttacaggaaagggccaggaa

SEQ ID NO: 7409435 - DNA, 22 bp, Homo sapiens
agttacagtaagccagccagca

SEQ ID NO: 7409436 - DNA, 22 bp, Homo sapiens
agttacaggaaagggccaggaa

SEQ ID NO: 7409437 - DNA, 22 bp, Homo sapiens
agttacagaatgtacagaggtt

SEQ ID NO: 7409438 - DNA, 22 bp, Homo sapiens
agttacagcactcaaagttttc

SEQ ID NO: 7409439 - DNA, 22 bp, Homo sapiens
agttacagcactcaaagttttc

SEQ ID NO: 7409440 - DNA, 22 bp, Homo sapiens
agttacataatctgtgaatttt

SEQ ID NO: 7409441 - DNA, 22 bp, Homo sapiens
agttacagtgttctattactct

SEQ ID NO: 7409442 - DNA, 22 bp, Homo sapiens
agttacagtgttctattactct

SEQ ID NO: 7409443 - DNA, 22 bp, Homo sapiens
agttacagtgttctattactct

SEQ ID NO: 7409444 - DNA, 22 bp, Homo sapiens
agttacagtgaccatttattta

SEQ ID NO: 7409445 - DNA, 22 bp, Homo sapiens
agttacagtgaccatttattta

SEQ ID NO: 7409446 - DNA, 22 bp, Homo sapiens
actggttgaagaaaagctagta

SEQ ID NO: 7409447 - DNA, 22 bp, Homo sapiens
actggtgttgatttggaagggg

SEQ ID NO: 7409448 - DNA, 22 bp, Homo sapiens
actggtgttgatttggaagggg

SEQ ID NO: 7409449 - DNA, 22 bp, Homo sapiens
actggtgtgcttttgttacata

SEQ ID NO: 7409450 - DNA, 22 bp, Homo sapiens
actggtggtttctccccagaga

SEQ ID NO: 7409451 - DNA, 22 bp, Homo sapiens
actggtggtttctccccagaga

SEQ ID NO: 7409452 - DNA, 22 bp, Homo sapiens
actggtttcccggaactacagt

SEQ ID NO: 7409453 - DNA, 22 bp, Homo sapiens
actggttgaagaaaagctagta

SEQ ID NO: 7409454 - DNA, 20 bp, Homo sapiens
actggtggactgttcattga

SEQ ID NO: 7409455 - DNA, 22 bp, Homo sapiens
actggtggccctcagtgttctc

SEQ ID NO: 7409456 - DNA, 22 bp, Homo sapiens
actggtggccctcagtgttctc

SEQ ID NO: 7409457 - DNA, 22 bp, Homo sapiens
actggtggctttcagacagaaa

SEQ ID NO: 7409458 - DNA, 22 bp, Homo sapiens
actggtcctctgccagcagctg

SEQ ID NO: 7409459 - DNA, 22 bp, Homo sapiens
actggtaacaatggaagcttct

SEQ ID NO: 7409460 - DNA, 22 bp, Homo sapiens
agttacaaacactatcagttct

SEQ ID NO: 7409461 - DNA, 22 bp, Homo sapiens
agttacaaacactatcagttct

SEQ ID NO: 7409462 - DNA, 22 bp, Homo sapiens
agttacaaacactatcagttct

SEQ ID NO: 7409463 - DNA, 22 bp, Homo sapiens
agttacaaccatgacacaagca

SEQ ID NO: 7409464 - DNA, 22 bp, Homo sapiens
agttacaaccatgacacaagca

SEQ ID NO: 7409465 - DNA, 22 bp, Homo sapiens
agttacaaccatgacacaagca

SEQ ID NO: 7409466 - DNA, 22 bp, Homo sapiens
agttacaaccatgacacaagca

SEQ ID NO: 7409467 - DNA, 22 bp, Homo sapiens
agttacaaacactatcagttct

SEQ ID NO: 7409468 - DNA, 22 bp, Homo sapiens
agttacaaacactatcagttct

SEQ ID NO: 7409469 - DNA, 22 bp, Homo sapiens
agttacaaacactatcagttct

SEQ ID NO: 7409470 - DNA, 22 bp, Homo sapiens
agttacaaacactatcagttct

SEQ ID NO: 7409471 - DNA, 17 bp, Homo sapiens
agttaaggctctttgct

SEQ ID NO: 7409472 - DNA, 17 bp, Homo sapiens
agttaaggctctttgct

SEQ ID NO: 7409473 - DNA, 22 bp, Homo sapiens
agttaagggctggtgtagactc

SEQ ID NO: 7409474 - DNA, 22 bp, Homo sapiens
agttaagggggttcatctgtaa

SEQ ID NO: 7409475 - DNA, 22 bp, Homo sapiens
agttaaggttcaattaaagtta

SEQ ID NO: 7409476 - DNA, 19 bp, Homo sapiens
agttaatgagcttttgatc

SEQ ID NO: 7409477 - DNA, 23 bp, Homo sapiens
agttaatgtgcatgaagtgctgc

SEQ ID NO: 7409478 - DNA, 22 bp, Homo sapiens
agttaatgagcattttggaatg

SEQ ID NO: 7409479 - DNA, 22 bp, Homo sapiens
agttaatgagcattttggaatg

SEQ ID NO: 7409480 - DNA, 22 bp, Homo sapiens
agttaataatggaaagacacat

SEQ ID NO: 7409481 - DNA, 22 bp, Homo sapiens
agttaatataagttttactgtt

SEQ ID NO: 7409482 - DNA, 22 bp, Homo sapiens
actggggctgatgcgttcgtgt

SEQ ID NO: 7409483 - DNA, 22 bp, Homo sapiens
actggggtgaaattggagtgtc

SEQ ID NO: 7409484 - DNA, 22 bp, Homo sapiens
actggggtgaaattggagtgtc

SEQ ID NO: 7409485 - DNA, 22 bp, Homo sapiens
actggggcctcctccatgctct

SEQ ID NO: 7409486 - DNA, 22 bp, Homo sapiens
actggggcctcctccatgctct

SEQ ID NO: 7409487 - DNA, 22 bp, Homo sapiens
actggggcctcctccatgctct

SEQ ID NO: 7409488 - DNA, 22 bp, Homo sapiens
actgggtgtattagtggtgttt

SEQ ID NO: 7409489 - DNA, 22 bp, Homo sapiens
actgggtggctgcctccttctc

SEQ ID NO: 7409490 - DNA, 22 bp, Homo sapiens
actggggtttaggcctgggcaa

SEQ ID NO: 7409491 - DNA, 22 bp, Homo sapiens
actggggtgaaattggagtgtc

SEQ ID NO: 7409492 - DNA, 22 bp, Homo sapiens
actggggtgaaattggagtgtc

SEQ ID NO: 7409493 - DNA, 22 bp, Homo sapiens
actggggcagtgggcagtggtt

SEQ ID NO: 7409494 - DNA, 22 bp, Homo sapiens
actggggcagtgggcagtggtt

SEQ ID NO: 7409495 - DNA, 22 bp, Homo sapiens
actggggcagtgggcagtggtt

SEQ ID NO: 7409496 - DNA, 22 bp, Homo sapiens
actggggcagtgggcagtggtt

SEQ ID NO: 7409497 - DNA, 22 bp, Homo sapiens
actggggcagtgggcagtggtt

SEQ ID NO: 7409498 - DNA, 22 bp, Homo sapiens
actggggagttgaagcactttc

SEQ ID NO: 7409499 - DNA, 22 bp, Homo sapiens
actggggagttgaagcactttc

SEQ ID NO: 7409500 - DNA, 22 bp, Homo sapiens
actggggagttgaagcactttc

SEQ ID NO: 7409501 - DNA, 22 bp, Homo sapiens
actgggctgcctggttcttcta

SEQ ID NO: 7409502 - DNA, 22 bp, Homo sapiens
actggggcaggaaagtatgctg

SEQ ID NO: 7409503 - DNA, 22 bp, Homo sapiens
actggggcaggaaagtatgctg

SEQ ID NO: 7409504 - DNA, 22 bp, Homo sapiens
actggggattagggactcagtg

SEQ ID NO: 7409505 - DNA, 22 bp, Homo sapiens
actggggattagggactcagtg

SEQ ID NO: 7409506 - DNA, 22 bp, Homo sapiens
agtgggggccaacgagggcagc

SEQ ID NO: 7409507 - DNA, 22 bp, Homo sapiens
agtgggggccaacgagggcagc

SEQ ID NO: 7409508 - DNA, 22 bp, Homo sapiens
agtgggggccaacgagggcagc

SEQ ID NO: 7409509 - DNA, 22 bp, Homo sapiens
agtgggggccaacgagggcagc

SEQ ID NO: 7409510 - DNA, 22 bp, Homo sapiens
agtgggggccaacgagggcagc

SEQ ID NO: 7409511 - DNA, 22 bp, Homo sapiens
agtgggggccaacgagggcagc

SEQ ID NO: 7409512 - DNA, 22 bp, Homo sapiens
agtgggggccaacgagggcagc

SEQ ID NO: 7409513 - DNA, 22 bp, Homo sapiens
agtgggggccaacgagggcagc

SEQ ID NO: 7409514 - DNA, 22 bp, Homo sapiens
agtgggggccaacgagggcagc

SEQ ID NO: 7409515 - DNA, 22 bp, Homo sapiens
agtggggtccatcccttccctc

SEQ ID NO: 7409516 - DNA, 22 bp, Homo sapiens
agtgggggctggctctgtctgt

SEQ ID NO: 7409517 - DNA, 22 bp, Homo sapiens
agtgggggctggctctgtctgt

SEQ ID NO: 7409518 - DNA, 22 bp, Homo sapiens
agtgggggctggctctgtctgt

SEQ ID NO: 7409519 - DNA, 21 bp, Homo sapiens
agtggggtctctgtggaggcc

SEQ ID NO: 7409520 - DNA, 22 bp, Homo sapiens
agtggggtcctcagtatggttc

SEQ ID NO: 7409521 - DNA, 22 bp, Homo sapiens
agtggggtctcctccagccccc

SEQ ID NO: 7409522 - DNA, 22 bp, Homo sapiens
agtggggtcctcagtatggttc

SEQ ID NO: 7409523 - DNA, 22 bp, Homo sapiens
agtggggtcctcagtatggttc

SEQ ID NO: 7409524 - DNA, 22 bp, Homo sapiens
agtggggccggtgaggccgagg

SEQ ID NO: 7409525 - DNA, 22 bp, Homo sapiens
agtggggccggtgaggccgagg

SEQ ID NO: 7409526 - DNA, 22 bp, Homo sapiens
agtggggccggtgaggccgagg

SEQ ID NO: 7409527 - DNA, 22 bp, Homo sapiens
agtggggcggacaggaccagga

SEQ ID NO: 7409528 - DNA, 22 bp, Homo sapiens
agtggggcggacaggaccagga

SEQ ID NO: 7409529 - DNA, 22 bp, Homo sapiens
agtggggcggacaggaccagga

SEQ ID NO: 7409530 - DNA, 22 bp, Homo sapiens
agtggggccggtgaggccgagg

SEQ ID NO: 7409531 - DNA, 22 bp, Homo sapiens
agtgggaggcggctgacgggcg

SEQ ID NO: 7409532 - DNA, 22 bp, Homo sapiens
agtgggggcagagcctctctcg

SEQ ID NO: 7409533 - DNA, 22 bp, Homo sapiens
agtgggggcagagcctctctcg

SEQ ID NO: 7409534 - DNA, 22 bp, Homo sapiens
agtggggcggacaggaccagga

SEQ ID NO: 7409535 - DNA, 22 bp, Homo sapiens
agtggggcggacaggaccagga

SEQ ID NO: 7409536 - DNA, 22 bp, Homo sapiens
agtggggcggacaggaccagga

SEQ ID NO: 7409537 - DNA, 22 bp, Homo sapiens
agtggggcggacaggaccagga

SEQ ID NO: 7409538 - DNA, 22 bp, Homo sapiens
agtgggggccaacgagggcagc

SEQ ID NO: 7409539 - DNA, 22 bp, Homo sapiens
agtgggggccaacgagggcagc

SEQ ID NO: 7409540 - DNA, 22 bp, Homo sapiens
agtgggggccaacgagggcagc

SEQ ID NO: 7409541 - DNA, 22 bp, Homo sapiens
agtgggggcagagcctctctcg

SEQ ID NO: 7409542 - DNA, 22 bp, Homo sapiens
agtgggggcagagcctctctcg

SEQ ID NO: 7409543 - DNA, 22 bp, Homo sapiens
agtgtctggtgagggctctctc

SEQ ID NO: 7409544 - DNA, 22 bp, Homo sapiens
agtgtctggtgagggctctctc

SEQ ID NO: 7409545 - DNA, 22 bp, Homo sapiens
agtgtctggtgagggctctctc

SEQ ID NO: 7409546 - DNA, 20 bp, Homo sapiens
agtgtctggtgcagggcctc

SEQ ID NO: 7409547 - DNA, 20 bp, Homo sapiens
agtgtctggtgcagggcctc

SEQ ID NO: 7409548 - DNA, 22 bp, Homo sapiens
agtgtctgtgaggggaattcct

SEQ ID NO: 7409549 - DNA, 22 bp, Homo sapiens
agtgtctgtgatgaggtcagga

SEQ ID NO: 7409550 - DNA, 20 bp, Homo sapiens
agtgtctggtgcagggcctc

SEQ ID NO: 7409551 - DNA, 20 bp, Homo sapiens
agtgtctggtgcagggcctc

SEQ ID NO: 7409552 - DNA, 20 bp, Homo sapiens
agtgtctggtgcagggcctc

SEQ ID NO: 7409553 - DNA, 22 bp, Homo sapiens
agtgtctgaaccaccggggcat

SEQ ID NO: 7409554 - DNA, 22 bp, Homo sapiens
agtgtctgaaccaccggggcat

SEQ ID NO: 7409555 - DNA, 22 bp, Homo sapiens
agtgtctgaaccaccggggcat

SEQ ID NO: 7409556 - DNA, 22 bp, Homo sapiens
agtgtctgaaccaccggggcat

SEQ ID NO: 7409557 - DNA, 22 bp, Homo sapiens
agtgtctggtgagggctctctc

SEQ ID NO: 7409558 - DNA, 22 bp, Homo sapiens
agtgtctggtctctgaactaaa

SEQ ID NO: 7409559 - DNA, 22 bp, Homo sapiens
agtgtctgaacctgcagtggga

SEQ ID NO: 7409560 - DNA, 22 bp, Homo sapiens
agtgtctgaacctgcagtggga

SEQ ID NO: 7409561 - DNA, 22 bp, Homo sapiens
agtgtctgaacctgcagtggga

SEQ ID NO: 7409562 - DNA, 22 bp, Homo sapiens
agtgtctgtgatgaggtcagga

SEQ ID NO: 7409563 - DNA, 22 bp, Homo sapiens
agtgtctgtgatgaggtcagga

SEQ ID NO: 7409564 - DNA, 22 bp, Homo sapiens
agtgtctgtgatgaggtcagga

SEQ ID NO: 7409565 - DNA, 22 bp, Homo sapiens
agtgtctgtgatgaggtcagga

SEQ ID NO: 7409566 - DNA, 22 bp, Homo sapiens
agtgtctgtgaggggaattcct

SEQ ID NO: 7409567 - DNA, 22 bp, Homo sapiens
agtgtctgtgatgaggtcagga

SEQ ID NO: 7409568 - DNA, 22 bp, Homo sapiens
agtgtctgtgatgaggtcagga

SEQ ID NO: 7409569 - DNA, 22 bp, Homo sapiens
agtgtctgtgttttctattgct

SEQ ID NO: 7409570 - DNA, 22 bp, Homo sapiens
agtgtctgtgctttgcagcaaa

SEQ ID NO: 7409571 - DNA, 22 bp, Homo sapiens
agtgtctgtgctttgcagcaaa

SEQ ID NO: 7409572 - DNA, 22 bp, Homo sapiens
agtgtctgtgctttgcagcaaa

SEQ ID NO: 7409573 - DNA, 22 bp, Homo sapiens
agtgtctgtgctttgcagcaaa

SEQ ID NO: 7409574 - DNA, 22 bp, Homo sapiens
agtgtctgtgctttgcagcaaa

SEQ ID NO: 7409575 - DNA, 22 bp, Homo sapiens
agtgtctgtgctttgcagcaaa

SEQ ID NO: 7409576 - DNA, 22 bp, Homo sapiens
agtgtctgttacgcttgcagaa

SEQ ID NO: 7409577 - DNA, 22 bp, Homo sapiens
agtgtctgttacgcttgcagaa

SEQ ID NO: 7409578 - DNA, 22 bp, Homo sapiens
agtgtctgttacgcttgcagaa

SEQ ID NO: 7409579 - DNA, 22 bp, Homo sapiens
agtgtctgttacgcttgcagaa

SEQ ID NO: 7409580 - DNA, 22 bp, Homo sapiens
agtgtctgtgttttctattgct

SEQ ID NO: 7409581 - DNA, 22 bp, Homo sapiens
agtgtctgtgttttctattgct

SEQ ID NO: 7409582 - DNA, 22 bp, Homo sapiens
agtgtctgtgttttctattgct

SEQ ID NO: 7409583 - DNA, 22 bp, Homo sapiens
agtgtctgttgagtttcaaaag

SEQ ID NO: 7409584 - DNA, 22 bp, Homo sapiens
agtgtctgttgagtttcaaaag

SEQ ID NO: 7409585 - DNA, 22 bp, Homo sapiens
agtgtctgttgagtttcaaaag

SEQ ID NO: 7409586 - DNA, 22 bp, Homo sapiens
agtgtctgttacgcttgcagaa

SEQ ID NO: 7409587 - DNA, 22 bp, Homo sapiens
agtgtctgttacgcttgcagaa

SEQ ID NO: 7409588 - DNA, 22 bp, Homo sapiens
agtgtctgttacgcttgcagaa

SEQ ID NO: 7409589 - DNA, 22 bp, Homo sapiens
agtgtgtagcacatggtaagca

SEQ ID NO: 7409590 - DNA, 19 bp, Homo sapiens
agtgtgtactgaaagcact

SEQ ID NO: 7409591 - DNA, 22 bp, Homo sapiens
agtgtgtcagttgaaagagatt

SEQ ID NO: 7409592 - DNA, 22 bp, Homo sapiens
agtgtgtagcacatggtaagca

SEQ ID NO: 7409593 - DNA, 22 bp, Homo sapiens
agtgtgtagcatttggcaggca

SEQ ID NO: 7409594 - DNA, 22 bp, Homo sapiens
agtgtgtacataattgtacgcc

SEQ ID NO: 7409595 - DNA, 22 bp, Homo sapiens
agtgtgtacatttggtgcagtt

SEQ ID NO: 7409596 - DNA, 19 bp, Homo sapiens
agtgtgtactgaaagcact

SEQ ID NO: 7409597 - DNA, 19 bp, Homo sapiens
agtgtgtactgaaagcact

SEQ ID NO: 7409598 - DNA, 20 bp, Homo sapiens
agtgtgtctcggaggtaagt

SEQ ID NO: 7409599 - DNA, 22 bp, Homo sapiens
agtgtgtctgatcacttgtgag

SEQ ID NO: 7409600 - DNA, 22 bp, Homo sapiens
agtgtgtcgagggagggtccag

SEQ ID NO: 7409601 - DNA, 22 bp, Homo sapiens
agtgtgtccaggaagcagatgg

SEQ ID NO: 7409602 - DNA, 22 bp, Homo sapiens
agtgtgtcgagggagggtccag

SEQ ID NO: 7409603 - DNA, 22 bp, Homo sapiens
agtgtgtccaggaagcagatgg

SEQ ID NO: 7409604 - DNA, 22 bp, Homo sapiens
agtgtgtcgagggagggtccag

SEQ ID NO: 7409605 - DNA, 22 bp, Homo sapiens
agtgtgtccagaaatctgtatt

SEQ ID NO: 7409606 - DNA, 23 bp, Homo sapiens
agtgtgtattgctgagggcagct

SEQ ID NO: 7409607 - DNA, 17 bp, Homo sapiens
agtgtgtgaaatggtgg

SEQ ID NO: 7409608 - DNA, 17 bp, Homo sapiens
agtgtgtgaaatggtgg

SEQ ID NO: 7409609 - DNA, 17 bp, Homo sapiens
agtgtgtgaaatggtgg

SEQ ID NO: 7409610 - DNA, 17 bp, Homo sapiens
agtgtgtgaaatggtgg

SEQ ID NO: 7409611 - DNA, 22 bp, Homo sapiens
agtgtgtcttatcctgggagaa

SEQ ID NO: 7409612 - DNA, 22 bp, Homo sapiens
agtgtgtcagttgaaagagatt

SEQ ID NO: 7409613 - DNA, 20 bp, Homo sapiens
agtgtgtctcggaggtaagt

SEQ ID NO: 7409614 - DNA, 22 bp, Homo sapiens
agtgtgtctgatcacttgtgag

SEQ ID NO: 7409615 - DNA, 22 bp, Homo sapiens
agtgtgtctgatcacttgtgag

SEQ ID NO: 7409616 - DNA, 17 bp, Homo sapiens
agtgtgtgaaatggtgg

SEQ ID NO: 7409617 - DNA, 22 bp, Homo sapiens
agtgtgtcttatcctgggagaa

SEQ ID NO: 7409618 - DNA, 22 bp, Homo sapiens
agtgtgtgaccttttaatttaa

SEQ ID NO: 7409619 - DNA, 23 bp, Homo sapiens
actgggctgaaattaaaggtgtc

SEQ ID NO: 7409620 - DNA, 22 bp, Homo sapiens
agtgtgtgaccttttaatttaa

SEQ ID NO: 7409621 - DNA, 22 bp, Homo sapiens
agtgtggtcgggagcgcggggc

SEQ ID NO: 7409622 - DNA, 20 bp, Homo sapiens
agtgtggttttcaggaatat

SEQ ID NO: 7409623 - DNA, 20 bp, Homo sapiens
agtgtggttttcaggaatat

SEQ ID NO: 7409624 - DNA, 22 bp, Homo sapiens
agtgtgtacataattgtacgcc

SEQ ID NO: 7409625 - DNA, 22 bp, Homo sapiens
agtgtgtaatgccaggggctgc

SEQ ID NO: 7409626 - DNA, 22 bp, Homo sapiens
agtgtgtaattcagtgcccagc

SEQ ID NO: 7409627 - DNA, 22 bp, Homo sapiens
agtgtgtaagggatcaaagagt

SEQ ID NO: 7409628 - DNA, 22 bp, Homo sapiens
agtgtgtaagggatcaaagagt

SEQ ID NO: 7409629 - DNA, 22 bp, Homo sapiens
agtgtgggtgagggaggccctc

SEQ ID NO: 7409630 - DNA, 22 bp, Homo sapiens
agtgtgggtgagggaggccctc

SEQ ID NO: 7409631 - DNA, 22 bp, Homo sapiens
agtgtggggtcaccggcccagg

SEQ ID NO: 7409632 - DNA, 22 bp, Homo sapiens
agtgtgggttttatggagccct

SEQ ID NO: 7409633 - DNA, 22 bp, Homo sapiens
agtgtgggtgagggaggccctc

SEQ ID NO: 7409634 - DNA, 22 bp, Homo sapiens
agtgtgggttttatggagccct

SEQ ID NO: 7409635 - DNA, 22 bp, Homo sapiens
agtgtcttacatgaattgattt

SEQ ID NO: 7409636 - DNA, 22 bp, Homo sapiens
agtgtctgttgttcagaactct

SEQ ID NO: 7409637 - DNA, 22 bp, Homo sapiens
agtgtctgttgttcagaactct

SEQ ID NO: 7409638 - DNA, 22 bp, Homo sapiens
agtgtcttacatgaattgattt

SEQ ID NO: 7409639 - DNA, 22 bp, Homo sapiens
agtgtctgttgttcagaactct

SEQ ID NO: 7409640 - DNA, 22 bp, Homo sapiens
agtgtctgttgcttttgcagtg

SEQ ID NO: 7409641 - DNA, 22 bp, Homo sapiens
agtgtctgttgttcagaactct

SEQ ID NO: 7409642 - DNA, 22 bp, Homo sapiens
agtgtctgttgcttttgcagtg

SEQ ID NO: 7409643 - DNA, 22 bp, Homo sapiens
agtgtctgttgcttttgcagtg

SEQ ID NO: 7409644 - DNA, 22 bp, Homo sapiens
agtgtctgttgagtttcaaaag

SEQ ID NO: 7409645 - DNA, 22 bp, Homo sapiens
agtgtcttagtccatttgggct

SEQ ID NO: 7409646 - DNA, 22 bp, Homo sapiens
agtgtcttcatgatgtggcagc

SEQ ID NO: 7409647 - DNA, 22 bp, Homo sapiens
agtgtctttagcaagtttagtc

SEQ ID NO: 7409648 - DNA, 22 bp, Homo sapiens
agtgtctttagcaagtttagtc

SEQ ID NO: 7409649 - DNA, 22 bp, Homo sapiens
agtgtctttatagactgacaat

SEQ ID NO: 7409650 - DNA, 22 bp, Homo sapiens
agtgtctttcatatcctccatc

SEQ ID NO: 7409651 - DNA, 22 bp, Homo sapiens
agaaatgtgaatttcatttcct

SEQ ID NO: 7409652 - DNA, 22 bp, Homo sapiens
agaaatgtgaatttcatttcct

SEQ ID NO: 7409653 - DNA, 22 bp, Homo sapiens
agaaatgtgagccccttatcaa

SEQ ID NO: 7409654 - DNA, 22 bp, Homo sapiens
agaaatgtgagccccttatcaa

SEQ ID NO: 7409655 - DNA, 22 bp, Homo sapiens
agaaatgtggaggaacagggct

SEQ ID NO: 7409656 - DNA, 22 bp, Homo sapiens
agaaatgtgagccccttatcaa

SEQ ID NO: 7409657 - DNA, 22 bp, Homo sapiens
agaaatgtgaatttcatttcct

SEQ ID NO: 7409658 - DNA, 22 bp, Homo sapiens
agaaatgtgaatttcatttcct

SEQ ID NO: 7409659 - DNA, 22 bp, Homo sapiens
agaaatgtgaatttcatttcct

SEQ ID NO: 7409660 - DNA, 20 bp, Homo sapiens
agaaatgtgaaaggctgagt

SEQ ID NO: 7409661 - DNA, 20 bp, Homo sapiens
agaaatgtgaaaggctgagt

SEQ ID NO: 7409662 - DNA, 20 bp, Homo sapiens
agaaatgtgaaaggctgagt

SEQ ID NO: 7409663 - DNA, 22 bp, Homo sapiens
agaaatgtccagggctaggatc

SEQ ID NO: 7409664 - DNA, 22 bp, Homo sapiens
agaaatgtccagggctaggatc

SEQ ID NO: 7409665 - DNA, 22 bp, Homo sapiens
agaaatgtccagggctaggatc

SEQ ID NO: 7409666 - DNA, 22 bp, Homo sapiens
agaaatgttgaatacacaaaat

SEQ ID NO: 7409667 - DNA, 22 bp, Homo sapiens
agaaatgttcttcatttgccat

SEQ ID NO: 7409668 - DNA, 22 bp, Homo sapiens
agaaatgttgaatacacaaaat

SEQ ID NO: 7409669 - DNA, 22 bp, Homo sapiens
agaaatgttgaatacacaaaat

SEQ ID NO: 7409670 - DNA, 22 bp, Homo sapiens
agaaatgttgaatacacaaaat

SEQ ID NO: 7409671 - DNA, 22 bp, Homo sapiens
agaaatgttacagttgttattt

SEQ ID NO: 7409672 - DNA, 22 bp, Homo sapiens
agaaatgttacagttgttattt

SEQ ID NO: 7409673 - DNA, 22 bp, Homo sapiens
agaaatgtggatcgttttaaaa

SEQ ID NO: 7409674 - DNA, 22 bp, Homo sapiens
agaaatgtggatcgttttaaaa

SEQ ID NO: 7409675 - DNA, 22 bp, Homo sapiens
agaaatgtggatcgttttaaaa

SEQ ID NO: 7409676 - DNA, 22 bp, Homo sapiens
agaaatgtggatcgttttaaaa

SEQ ID NO: 7409677 - DNA, 22 bp, Homo sapiens
agaaatgttacagttgttattt

SEQ ID NO: 7409678 - DNA, 22 bp, Homo sapiens
agaaatgttacagttgttattt

SEQ ID NO: 7409679 - DNA, 22 bp, Homo sapiens
agaaatgttacagttgttattt

SEQ ID NO: 7409680 - DNA, 22 bp, Homo sapiens
agaaatgttacagttgttattt

SEQ ID NO: 7409681 - DNA, 22 bp, Homo sapiens
agaaatgttacagttgttattt

SEQ ID NO: 7409682 - DNA, 22 bp, Homo sapiens
agaaatggtgagtgagagcccc

SEQ ID NO: 7409683 - DNA, 22 bp, Homo sapiens
agaaatggtgagtgagagcccc

SEQ ID NO: 7409684 - DNA, 22 bp, Homo sapiens
agaaatgtaattgcaactgtct

SEQ ID NO: 7409685 - DNA, 22 bp, Homo sapiens
agaaatgtaattgcaactgtct

SEQ ID NO: 7409686 - DNA, 22 bp, Homo sapiens
agaaatggtgagtgagagcccc

SEQ ID NO: 7409687 - DNA, 22 bp, Homo sapiens
agaaatgggccttgggacacaa

SEQ ID NO: 7409688 - DNA, 22 bp, Homo sapiens
agaaatggaaatccaagcaact

SEQ ID NO: 7409689 - DNA, 22 bp, Homo sapiens
agaaatgtaattgcaactgtct

SEQ ID NO: 7409690 - DNA, 22 bp, Homo sapiens
agaaatgtaattgcaactgtct

SEQ ID NO: 7409691 - DNA, 22 bp, Homo sapiens
agaaatgtaattgcaactgtct

SEQ ID NO: 7409692 - DNA, 22 bp, Homo sapiens
agaaatgtatagtgaatttttc

SEQ ID NO: 7409693 - DNA, 22 bp, Homo sapiens
agaaatgtatagtgaatttttc

SEQ ID NO: 7409694 - DNA, 22 bp, Homo sapiens
agaaatgtatagtgaatttttc

SEQ ID NO: 7409695 - DNA, 22 bp, Homo sapiens
agaaatgtatagtgaatttttc

SEQ ID NO: 7409696 - DNA, 22 bp, Homo sapiens
agaaatgtaggcatataaggaa

SEQ ID NO: 7409697 - DNA, 22 bp, Homo sapiens
agaaatgtacgatgttatgcag

SEQ ID NO: 7409698 - DNA, 22 bp, Homo sapiens
agaaatgtacgatgttatgcag

SEQ ID NO: 7409699 - DNA, 22 bp, Homo sapiens
agaaatgtacgatgttatgcag

SEQ ID NO: 7409700 - DNA, 22 bp, Homo sapiens
agaaatgtattctgtatgtttt

SEQ ID NO: 7409701 - DNA, 22 bp, Homo sapiens
agaaatgtattctgtatgtttt

SEQ ID NO: 7409702 - DNA, 22 bp, Homo sapiens
agaaatgtattctgtatgtttt

SEQ ID NO: 7409703 - DNA, 22 bp, Homo sapiens
agaaatgtattctgtatgtttt

SEQ ID NO: 7409704 - DNA, 21 bp, Homo sapiens
agaaatgtatcattcttttcc

SEQ ID NO: 7409705 - DNA, 21 bp, Homo sapiens
agaaatgtatcattcttttcc

SEQ ID NO: 7409706 - DNA, 22 bp, Homo sapiens
agaaatgtatagtgaatttttc

SEQ ID NO: 7409707 - DNA, 21 bp, Homo sapiens
agaaatgtatcattcttttcc

SEQ ID NO: 7409708 - DNA, 21 bp, Homo sapiens
agaaatgtatcattcttttcc

SEQ ID NO: 7409709 - DNA, 22 bp, Homo sapiens
agaaatgtattctgtatgtttt

SEQ ID NO: 7409710 - DNA, 22 bp, Homo sapiens
agaaatgtattctgtatgtttt

SEQ ID NO: 7409711 - DNA, 22 bp, Homo sapiens
agaaatgtcaggaaagaagtcc

SEQ ID NO: 7409712 - DNA, 22 bp, Homo sapiens
agaaatgtcaggaaagaagtcc

SEQ ID NO: 7409713 - DNA, 22 bp, Homo sapiens
agaaatgtcaggaaagaagtcc

SEQ ID NO: 7409714 - DNA, 22 bp, Homo sapiens
agaaatgtcaggaaagaagtcc

SEQ ID NO: 7409715 - DNA, 22 bp, Homo sapiens
agaaatgtcaggaaagaagtcc

SEQ ID NO: 7409716 - DNA, 22 bp, Homo sapiens
agaaatgtcaagtgttcttgtt

SEQ ID NO: 7409717 - DNA, 22 bp, Homo sapiens
agaaatgtcaagtgttcttgtt

SEQ ID NO: 7409718 - DNA, 22 bp, Homo sapiens
agaaatgtcaagtgttcttgtt

SEQ ID NO: 7409719 - DNA, 18 bp, Homo sapiens
agaagcaggtaaaattct

SEQ ID NO: 7409720 - DNA, 18 bp, Homo sapiens
agaagcaggtaaaattct

SEQ ID NO: 7409721 - DNA, 18 bp, Homo sapiens
agaagcaggtaaaattct

SEQ ID NO: 7409722 - DNA, 22 bp, Homo sapiens
agaagcagggcagggaaaagca

SEQ ID NO: 7409723 - DNA, 18 bp, Homo sapiens
agaagcaggttctcccag

SEQ ID NO: 7409724 - DNA, 18 bp, Homo sapiens
agaagcaggtaaaattct

SEQ ID NO: 7409725 - DNA, 18 bp, Homo sapiens
agaagcaggtaaaattct

SEQ ID NO: 7409726 - DNA, 22 bp, Homo sapiens
agaagcagttattttttgcaca

SEQ ID NO: 7409727 - DNA, 22 bp, Homo sapiens
agaagcagttattttttgcaca

SEQ ID NO: 7409728 - DNA, 22 bp, Homo sapiens
agaagcagttattttttgcaca

SEQ ID NO: 7409729 - DNA, 22 bp, Homo sapiens
agaagcagttattttttgcaca

SEQ ID NO: 7409730 - DNA, 22 bp, Homo sapiens
agaagcagttattttttgcaca

SEQ ID NO: 7409731 - DNA, 22 bp, Homo sapiens
agaagcattataacatgcaagg

SEQ ID NO: 7409732 - DNA, 22 bp, Homo sapiens
agaagcattataacatgcaagg

SEQ ID NO: 7409733 - DNA, 20 bp, Homo sapiens
agaagcatcattctgatgtc

SEQ ID NO: 7409734 - DNA, 20 bp, Homo sapiens
agaagcatcattctgatgtc

SEQ ID NO: 7409735 - DNA, 20 bp, Homo sapiens
agaagcatcattctgatgtc

SEQ ID NO: 7409736 - DNA, 22 bp, Homo sapiens
agaagcattataacatgcaagg

SEQ ID NO: 7409737 - DNA, 22 bp, Homo sapiens
agaagcattataacatgcaagg

SEQ ID NO: 7409738 - DNA, 22 bp, Homo sapiens
agaagcattatttaattttact

SEQ ID NO: 7409739 - DNA, 22 bp, Homo sapiens
agaagcattatttaattttact

SEQ ID NO: 7409740 - DNA, 22 bp, Homo sapiens
agaagccaaatgccagtgacct

SEQ ID NO: 7409741 - DNA, 22 bp, Homo sapiens
atcctgaaaattgaatggaagg

SEQ ID NO: 7409742 - DNA, 22 bp, Homo sapiens
atcctgaagcatgaatgtcaaa

SEQ ID NO: 7409743 - DNA, 22 bp, Homo sapiens
agaagccaacagggcaggagag

SEQ ID NO: 7409744 - DNA, 22 bp, Homo sapiens
agaagccaaatgccagtgacct

SEQ ID NO: 7409745 - DNA, 22 bp, Homo sapiens
agaagccaaaggggccagatat

SEQ ID NO: 7409746 - DNA, 22 bp, Homo sapiens
agaagccaaaggggccagatat

SEQ ID NO: 7409747 - DNA, 22 bp, Homo sapiens
agaagccaaaggggccagatat

SEQ ID NO: 7409748 - DNA, 22 bp, Homo sapiens
agaagcattggaccaggggccc

SEQ ID NO: 7409749 - DNA, 20 bp, Homo sapiens
agaagcattcaaagaaaact

SEQ ID NO: 7409750 - DNA, 20 bp, Homo sapiens
agaagcattcaaagaaaact

SEQ ID NO: 7409751 - DNA, 20 bp, Homo sapiens
agaagcattcaaagaaaact

SEQ ID NO: 7409752 - DNA, 20 bp, Homo sapiens
agaagcattcaaagaaaact

SEQ ID NO: 7409753 - DNA, 20 bp, Homo sapiens
agaagcattcaaagaaaact

SEQ ID NO: 7409754 - DNA, 22 bp, Homo sapiens
agaagcaggcctcacagatctg

SEQ ID NO: 7409755 - DNA, 22 bp, Homo sapiens
agaagcagggcagggaaaagca

SEQ ID NO: 7409756 - DNA, 22 bp, Homo sapiens
agaagcagggcagggaaaagca

SEQ ID NO: 7409757 - DNA, 22 bp, Homo sapiens
agaagcagggcagggaaaagca

SEQ ID NO: 7409758 - DNA, 22 bp, Homo sapiens
agaagcagggcagggaaaagca

SEQ ID NO: 7409759 - DNA, 22 bp, Homo sapiens
agaagcagggcagggaaaagca

SEQ ID NO: 7409760 - DNA, 22 bp, Homo sapiens
agaagcagggcagggaaaagca

SEQ ID NO: 7409761 - DNA, 22 bp, Homo sapiens
agaagcagggcagggaaaagca

SEQ ID NO: 7409762 - DNA, 22 bp, Homo sapiens
agaagcaggcagatttcagctc

SEQ ID NO: 7409763 - DNA, 22 bp, Homo sapiens
agaagcaggcagatttcagctc

SEQ ID NO: 7409764 - DNA, 22 bp, Homo sapiens
agaagcaggcctcacagatctg

SEQ ID NO: 7409765 - DNA, 22 bp, Homo sapiens
agaagcaggcagatttcagctc

SEQ ID NO: 7409766 - DNA, 22 bp, Homo sapiens
agaagcaggcctcacagatctg

SEQ ID NO: 7409767 - DNA, 22 bp, Homo sapiens
agaagcaggcctcacagatctg

SEQ ID NO: 7409768 - DNA, 22 bp, Homo sapiens
agaagcactacgataggtggtc

SEQ ID NO: 7409769 - DNA, 22 bp, Homo sapiens
agaagcactagagggtatggaa

SEQ ID NO: 7409770 - DNA, 22 bp, Homo sapiens
agaagcactagagggtatggaa

SEQ ID NO: 7409771 - DNA, 22 bp, Homo sapiens
agaaattaggaaagtaacactt

SEQ ID NO: 7409772 - DNA, 22 bp, Homo sapiens
agaaattaggaaagtaacactt

SEQ ID NO: 7409773 - DNA, 22 bp, Homo sapiens
agaagcacggttttgtctagca

SEQ ID NO: 7409774 - DNA, 22 bp, Homo sapiens
agaagcacggttttgtctagca

SEQ ID NO: 7409775 - DNA, 22 bp, Homo sapiens
agaagcacggttttgtctagca

SEQ ID NO: 7409776 - DNA, 22 bp, Homo sapiens
agaaattaggaaagtaacactt

SEQ ID NO: 7409777 - DNA, 22 bp, Homo sapiens
agaaatgtttatggctgcctat

SEQ ID NO: 7409778 - DNA, 22 bp, Homo sapiens
agaaatgtttatggctgcctat

SEQ ID NO: 7409779 - DNA, 22 bp, Homo sapiens
agaaatgttgaatacatcagga

SEQ ID NO: 7409780 - DNA, 22 bp, Homo sapiens
agaaatgttgaatacatcagga

SEQ ID NO: 7409781 - DNA, 22 bp, Homo sapiens
agaaatgttgaatacatcagga

SEQ ID NO: 7409782 - DNA, 22 bp, Homo sapiens
agaaatgttgaatacatcagga

SEQ ID NO: 7409783 - DNA, 22 bp, Homo sapiens
agaaatgttgtgggttttgtta

SEQ ID NO: 7409784 - DNA, 22 bp, Homo sapiens
agaaatgttgtgggttttgtta

SEQ ID NO: 7409785 - DNA, 22 bp, Homo sapiens
agaaatgttgaatacatcagga

SEQ ID NO: 7409786 - DNA, 22 bp, Homo sapiens
agaagctgacagatgcagcagg

SEQ ID NO: 7409787 - DNA, 22 bp, Homo sapiens
agaagctgacagatgcagcagg

SEQ ID NO: 7409788 - DNA, 22 bp, Homo sapiens
agaagctcgggtaagctccatt

SEQ ID NO: 7409789 - DNA, 22 bp, Homo sapiens
agaagctcgggtaagctccatt

SEQ ID NO: 7409790 - DNA, 22 bp, Homo sapiens
agaagctataacaacaattata

SEQ ID NO: 7409791 - DNA, 21 bp, Homo sapiens
agaagctagtcactaaatcca

SEQ ID NO: 7409792 - DNA, 22 bp, Homo sapiens
agaagctatttagctgcacttt

SEQ ID NO: 7409793 - DNA, 22 bp, Homo sapiens
agaagctaattcatgtcttatg

SEQ ID NO: 7409794 - DNA, 22 bp, Homo sapiens
agaagctaattcatgtcttatg

SEQ ID NO: 7409795 - DNA, 22 bp, Homo sapiens
agaagctaggctagacaagtga

SEQ ID NO: 7409796 - DNA, 21 bp, Homo sapiens
agaagctagtcactaaatcca

SEQ ID NO: 7409797 - DNA, 22 bp, Homo sapiens
agaagctgagaatgaattaaga

SEQ ID NO: 7409798 - DNA, 22 bp, Homo sapiens
agaagctgagaatgaattaaga

SEQ ID NO: 7409799 - DNA, 20 bp, Homo sapiens
agaagctgagactgggtttt

SEQ ID NO: 7409800 - DNA, 22 bp, Homo sapiens
agaagctgagaatgaattaaga

SEQ ID NO: 7409801 - DNA, 20 bp, Homo sapiens
agaagctgagactgggtttt

SEQ ID NO: 7409802 - DNA, 20 bp, Homo sapiens
agaagctgagactgggtttt

SEQ ID NO: 7409803 - DNA, 22 bp, Homo sapiens
agaagctgacagatgcagcagg

SEQ ID NO: 7409804 - DNA, 22 bp, Homo sapiens
agaagctgacagatgcagcagg

SEQ ID NO: 7409805 - DNA, 22 bp, Homo sapiens
agaagctgacagatgcagcagg

SEQ ID NO: 7409806 - DNA, 22 bp, Homo sapiens
agaagctgacagatgcagcagg

SEQ ID NO: 7409807 - DNA, 22 bp, Homo sapiens
agaagctgacagatgcagcagg

SEQ ID NO: 7409808 - DNA, 20 bp, Homo sapiens
atctgcttgcctgtcctcgg

SEQ ID NO: 7409809 - DNA, 20 bp, Homo sapiens
atctgcttgcctgtcctcgg

SEQ ID NO: 7409810 - DNA, 22 bp, Homo sapiens
agaagctggaggaagactaagc

SEQ ID NO: 7409811 - DNA, 22 bp, Homo sapiens
agaagctggaggaagactaagc

SEQ ID NO: 7409812 - DNA, 22 bp, Homo sapiens
agaagctggaggaagactaagc

SEQ ID NO: 7409813 - DNA, 23 bp, Homo sapiens
agaagctgggagcctggggatgg

SEQ ID NO: 7409814 - DNA, 23 bp, Homo sapiens
agaagctgggagcctggggatgg

SEQ ID NO: 7409815 - DNA, 22 bp, Homo sapiens
atctgcttttgagaatttactt

SEQ ID NO: 7409816 - DNA, 22 bp, Homo sapiens
atctgcttttgagaatttactt

SEQ ID NO: 7409817 - DNA, 22 bp, Homo sapiens
atctggaaaacacagtgtagac

SEQ ID NO: 7409818 - DNA, 22 bp, Homo sapiens
agaagctgcctacatgaccagc

SEQ ID NO: 7409819 - DNA, 22 bp, Homo sapiens
agaagctgcgtttatttaaatc

SEQ ID NO: 7409820 - DNA, 22 bp, Homo sapiens
agaagctgcgtttatttaaatc

SEQ ID NO: 7409821 - DNA, 22 bp, Homo sapiens
agaagctgcgtttatttaaatc

SEQ ID NO: 7409822 - DNA, 20 bp, Homo sapiens
agaagctgatactgatggaa

SEQ ID NO: 7409823 - DNA, 20 bp, Homo sapiens
agaagctgagactgggtttt

SEQ ID NO: 7409824 - DNA, 20 bp, Homo sapiens
agaagctgagactgggtttt

SEQ ID NO: 7409825 - DNA, 20 bp, Homo sapiens
agaagctgatactgatggaa

SEQ ID NO: 7409826 - DNA, 22 bp, Homo sapiens
agaagctgcctacatgaccagc

SEQ ID NO: 7409827 - DNA, 22 bp, Homo sapiens
agaagctgcctacatgaccagc

SEQ ID NO: 7409828 - DNA, 22 bp, Homo sapiens
agaagctgcctacatgaccagc

SEQ ID NO: 7409829 - DNA, 22 bp, Homo sapiens
agaagccatgtttagtaggatg

SEQ ID NO: 7409830 - DNA, 22 bp, Homo sapiens
agaagccatgtttagtaggatg

SEQ ID NO: 7409831 - DNA, 22 bp, Homo sapiens
agaagccatgtttagtaggatg

SEQ ID NO: 7409832 - DNA, 22 bp, Homo sapiens
agaagccatgtttagtaggatg

SEQ ID NO: 7409833 - DNA, 22 bp, Homo sapiens
agaagccattccctgtaggctc

SEQ ID NO: 7409834 - DNA, 22 bp, Homo sapiens
agaagccattccctgtaggctc

SEQ ID NO: 7409835 - DNA, 22 bp, Homo sapiens
agaagccattctcagttcctga

SEQ ID NO: 7409836 - DNA, 22 bp, Homo sapiens
agaagccattctcagttcctga

SEQ ID NO: 7409837 - DNA, 22 bp, Homo sapiens
agaagccattctcagttcctga

SEQ ID NO: 7409838 - DNA, 22 bp, Homo sapiens
agaagccattctcagttcctga

SEQ ID NO: 7409839 - DNA, 22 bp, Homo sapiens
agaagccattccctgtaggctc

SEQ ID NO: 7409840 - DNA, 22 bp, Homo sapiens
agaagccattccctgtaggctc

SEQ ID NO: 7409841 - DNA, 22 bp, Homo sapiens
agaagccattctcagttcctga

SEQ ID NO: 7409842 - DNA, 22 bp, Homo sapiens
agaagccattgaagcagacctc

SEQ ID NO: 7409843 - DNA, 22 bp, Homo sapiens
agaagccattgaagcagacctc

SEQ ID NO: 7409844 - DNA, 21 bp, Homo sapiens
agaagccatttgttaggactt

SEQ ID NO: 7409845 - DNA, 21 bp, Homo sapiens
agaagccatttgttaggactt

SEQ ID NO: 7409846 - DNA, 21 bp, Homo sapiens
agaagccatttgttaggactt

SEQ ID NO: 7409847 - DNA, 19 bp, Homo sapiens
agaagcccagatcccagcc

SEQ ID NO: 7409848 - DNA, 19 bp, Homo sapiens
agaagcccagatcccagcc

SEQ ID NO: 7409849 - DNA, 19 bp, Homo sapiens
agaagcccagatcccagcc

SEQ ID NO: 7409850 - DNA, 22 bp, Homo sapiens
agaagcccagcatggaaccagc

SEQ ID NO: 7409851 - DNA, 22 bp, Homo sapiens
agaagcctcatcctctctagtg

SEQ ID NO: 7409852 - DNA, 19 bp, Homo sapiens
agaagcccagatcccagcc

SEQ ID NO: 7409853 - DNA, 21 bp, Homo sapiens
agaagcctgggtggaggtggg

SEQ ID NO: 7409854 - DNA, 21 bp, Homo sapiens
agaagcctgggtggaggtggg

SEQ ID NO: 7409855 - DNA, 22 bp, Homo sapiens
agaagcctcatcctctctagtg

SEQ ID NO: 7409856 - DNA, 21 bp, Homo sapiens
agaagcctgatgaggtctgct

SEQ ID NO: 7409857 - DNA, 22 bp, Homo sapiens
atcctgagttctcagagtctcc

SEQ ID NO: 7409858 - DNA, 22 bp, Homo sapiens
atcctgagttctcagagtctcc

SEQ ID NO: 7409859 - DNA, 22 bp, Homo sapiens
atcctgagttctcagagtctcc

SEQ ID NO: 7409860 - DNA, 22 bp, Homo sapiens
atcctgagttcctgcctctaaa

SEQ ID NO: 7409861 - DNA, 22 bp, Homo sapiens
atcctgagttcctgcctctaaa

SEQ ID NO: 7409862 - DNA, 22 bp, Homo sapiens
atcctgagttcctgcctctaaa

SEQ ID NO: 7409863 - DNA, 22 bp, Homo sapiens
atcctgcagggggttttattca

SEQ ID NO: 7409864 - DNA, 22 bp, Homo sapiens
atcctgagttctcagagtctcc

SEQ ID NO: 7409865 - DNA, 22 bp, Homo sapiens
atcctgctgctgtggacttctc

SEQ ID NO: 7409866 - DNA, 22 bp, Homo sapiens
atcctgagttcctgcctctaaa

SEQ ID NO: 7409867 - DNA, 22 bp, Homo sapiens
atcctgagttcctgcctctaaa

SEQ ID NO: 7409868 - DNA, 22 bp, Homo sapiens
atcctgaggtactgcagggccg

SEQ ID NO: 7409869 - DNA, 22 bp, Homo sapiens
atcctgaggtactgcagggccg

SEQ ID NO: 7409870 - DNA, 22 bp, Homo sapiens
atcctgaggaaggtgcagagat

SEQ ID NO: 7409871 - DNA, 22 bp, Homo sapiens
atcctgaggaaggtgcagagat

SEQ ID NO: 7409872 - DNA, 22 bp, Homo sapiens
atcctgaggaaggtgcagagat

SEQ ID NO: 7409873 - DNA, 22 bp, Homo sapiens
atcctgagctacacctgctcct

SEQ ID NO: 7409874 - DNA, 22 bp, Homo sapiens
atcctgaggaaggtgcagagat

SEQ ID NO: 7409875 - DNA, 22 bp, Homo sapiens
atcctgagctacacctgctcct

SEQ ID NO: 7409876 - DNA, 22 bp, Homo sapiens
atcctgagctacacctgctcct

SEQ ID NO: 7409877 - DNA, 22 bp, Homo sapiens
atcctggcgccacacggctcta

SEQ ID NO: 7409878 - DNA, 22 bp, Homo sapiens
atcctggcgccacacggctcta

SEQ ID NO: 7409879 - DNA, 22 bp, Homo sapiens
atcctggcccaggtgtggaggg

SEQ ID NO: 7409880 - DNA, 22 bp, Homo sapiens
atcctggcccaggtgtggaggg

SEQ ID NO: 7409881 - DNA, 22 bp, Homo sapiens
atcctggcccaggtgtggaggg

SEQ ID NO: 7409882 - DNA, 22 bp, Homo sapiens
atcctgggaagctgacattgaa

SEQ ID NO: 7409883 - DNA, 22 bp, Homo sapiens
atcctggcgggggaactgccca

SEQ ID NO: 7409884 - DNA, 22 bp, Homo sapiens
atcctggctttaggtcagaggc

SEQ ID NO: 7409885 - DNA, 22 bp, Homo sapiens
atcctggcaagcagaggagaac

SEQ ID NO: 7409886 - DNA, 22 bp, Homo sapiens
atcctggaggctggaggcttgc

SEQ ID NO: 7409887 - DNA, 22 bp, Homo sapiens
atcctggaggctggaggcttgc

SEQ ID NO: 7409888 - DNA, 22 bp, Homo sapiens
atcctggacagtttcccctatt

SEQ ID NO: 7409889 - DNA, 22 bp, Homo sapiens
atcctggacagtttcccctatt

SEQ ID NO: 7409890 - DNA, 20 bp, Homo sapiens
atcctggaatccaaatggag

SEQ ID NO: 7409891 - DNA, 22 bp, Homo sapiens
agaagccatagtctgggaggca

SEQ ID NO: 7409892 - DNA, 22 bp, Homo sapiens
agaagccatagtctgggaggca

SEQ ID NO: 7409893 - DNA, 22 bp, Homo sapiens
agaagccatagtctgggaggca

SEQ ID NO: 7409894 - DNA, 22 bp, Homo sapiens
agaagccatagtctgggaggca

SEQ ID NO: 7409895 - DNA, 22 bp, Homo sapiens
agaagccatatttagggaggag

SEQ ID NO: 7409896 - DNA, 22 bp, Homo sapiens
agaagccatatttagggaggag

SEQ ID NO: 7409897 - DNA, 22 bp, Homo sapiens
agaagccatggggtcaccagag

SEQ ID NO: 7409898 - DNA, 21 bp, Homo sapiens
agaagccatgccagtaaaatt

SEQ ID NO: 7409899 - DNA, 21 bp, Homo sapiens
agaagccatgccagtaaaatt

SEQ ID NO: 7409900 - DNA, 21 bp, Homo sapiens
agaagccatgtggtggagaac

SEQ ID NO: 7409901 - DNA, 21 bp, Homo sapiens
agaagccatgtggtggagaac

SEQ ID NO: 7409902 - DNA, 21 bp, Homo sapiens
agaagccatgtggtggagaac

SEQ ID NO: 7409903 - DNA, 21 bp, Homo sapiens
agaagccatgtggtggagaac

SEQ ID NO: 7409904 - DNA, 22 bp, Homo sapiens
agaagccatggtatgcaactac

SEQ ID NO: 7409905 - DNA, 22 bp, Homo sapiens
agaagccatggggtcaccagag

SEQ ID NO: 7409906 - DNA, 22 bp, Homo sapiens
agaagccatggtatgcaactac

SEQ ID NO: 7409907 - DNA, 22 bp, Homo sapiens
agaagccatggtatgcaactac

SEQ ID NO: 7409908 - DNA, 22 bp, Homo sapiens
atcctgggaatgggagggtcat

SEQ ID NO: 7409909 - DNA, 22 bp, Homo sapiens
atcctgggaatgggagggtcat

SEQ ID NO: 7409910 - DNA, 22 bp, Homo sapiens
agaagccaccagctgaggaaga

SEQ ID NO: 7409911 - DNA, 22 bp, Homo sapiens
atcctgggaagctgacattgaa

SEQ ID NO: 7409912 - DNA, 22 bp, Homo sapiens
atcctgggaagtggcctcctcc

SEQ ID NO: 7409913 - DNA, 22 bp, Homo sapiens
atcctgggaagtggcctcctcc

SEQ ID NO: 7409914 - DNA, 22 bp, Homo sapiens
agaagccaccagctgaggaaga

SEQ ID NO: 7409915 - DNA, 22 bp, Homo sapiens
agaagccaccagctgaggaaga

SEQ ID NO: 7409916 - DNA, 22 bp, Homo sapiens
agaagccaccagctgaggaaga

SEQ ID NO: 7409917 - DNA, 22 bp, Homo sapiens
agaagccaccagctgaggaaga

SEQ ID NO: 7409918 - DNA, 22 bp, Homo sapiens
agaagccaccagctgaggaaga

SEQ ID NO: 7409919 - DNA, 22 bp, Homo sapiens
agaagccatagtctgggaggca

SEQ ID NO: 7409920 - DNA, 22 bp, Homo sapiens
agaagccatagtatctcagggt

SEQ ID NO: 7409921 - DNA, 22 bp, Homo sapiens
agaagccatagtatctcagggt

SEQ ID NO: 7409922 - DNA, 22 bp, Homo sapiens
agaagccatagtatctcagggt

SEQ ID NO: 7409923 - DNA, 22 bp, Homo sapiens
agaagccatagtatctcagggt

SEQ ID NO: 7409924 - DNA, 22 bp, Homo sapiens
agaagccatagtatctcagggt

SEQ ID NO: 7409925 - DNA, 22 bp, Homo sapiens
atattaatgagcaagtaagtga

SEQ ID NO: 7409926 - DNA, 22 bp, Homo sapiens
atattaatgagcaagtaagtga

SEQ ID NO: 7409927 - DNA, 22 bp, Homo sapiens
atattaatgagcaagtaagtga

SEQ ID NO: 7409928 - DNA, 22 bp, Homo sapiens
atattaagatgctattggtttt

SEQ ID NO: 7409929 - DNA, 22 bp, Homo sapiens
atattaagatgctattggtttt

SEQ ID NO: 7409930 - DNA, 22 bp, Homo sapiens
atattaaatggattttgggagc

SEQ ID NO: 7409931 - DNA, 22 bp, Homo sapiens
atattaaatggattttgggagc

SEQ ID NO: 7409932 - DNA, 22 bp, Homo sapiens
atattaaatggattttgggagc

SEQ ID NO: 7409933 - DNA, 22 bp, Homo sapiens
atattaaatggattttgggagc

SEQ ID NO: 7409934 - DNA, 22 bp, Homo sapiens
atattaaatggattttgggagc

SEQ ID NO: 7409935 - DNA, 22 bp, Homo sapiens
atattaaaactatggttttcag

SEQ ID NO: 7409936 - DNA, 22 bp, Homo sapiens
atattaaatggattttgggagc

SEQ ID NO: 7409937 - DNA, 22 bp, Homo sapiens
atattaaatggattttgggagc

SEQ ID NO: 7409938 - DNA, 22 bp, Homo sapiens
atattaaatggattttgggagc

SEQ ID NO: 7409939 - DNA, 22 bp, Homo sapiens
atattaaaactatggttttcag

SEQ ID NO: 7409940 - DNA, 22 bp, Homo sapiens
atattaaaactatggttttcag

SEQ ID NO: 7409941 - DNA, 22 bp, Homo sapiens
agaaagaggatgcagatctcat

SEQ ID NO: 7409942 - DNA, 22 bp, Homo sapiens
agaaagaggatgcagatctcat

SEQ ID NO: 7409943 - DNA, 22 bp, Homo sapiens
atattaaaactatggttttcag

SEQ ID NO: 7409944 - DNA, 22 bp, Homo sapiens
atattaatgagcaagtaagtga

SEQ ID NO: 7409945 - DNA, 22 bp, Homo sapiens
atattaatgagcaagtaagtga

SEQ ID NO: 7409946 - DNA, 22 bp, Homo sapiens
atattaatgagcaagtaagtga

SEQ ID NO: 7409947 - DNA, 22 bp, Homo sapiens
atattaaatggattttgggagc

SEQ ID NO: 7409948 - DNA, 22 bp, Homo sapiens
atattaatgagcaagtaagtga

SEQ ID NO: 7409949 - DNA, 22 bp, Homo sapiens
atattaatgggatttagtcagg

SEQ ID NO: 7409950 - DNA, 22 bp, Homo sapiens
atattaatgggatttagtcagg

SEQ ID NO: 7409951 - DNA, 22 bp, Homo sapiens
atattaatgggatttagtcagg

SEQ ID NO: 7409952 - DNA, 22 bp, Homo sapiens
atattaatgggatttagtcagg

SEQ ID NO: 7409953 - DNA, 22 bp, Homo sapiens
atattaatgagcaagtaagtga

SEQ ID NO: 7409954 - DNA, 22 bp, Homo sapiens
atattaattatttacacatgag

SEQ ID NO: 7409955 - DNA, 22 bp, Homo sapiens
atattaattatttacacatgag

SEQ ID NO: 7409956 - DNA, 22 bp, Homo sapiens
atattaattatttacacatgag

SEQ ID NO: 7409957 - DNA, 22 bp, Homo sapiens
atattaatgggatttagtcagg

SEQ ID NO: 7409958 - DNA, 22 bp, Homo sapiens
atattaatgggatttagtcagg

SEQ ID NO: 7409959 - DNA, 22 bp, Homo sapiens
atattaatgggatttagtcagg

SEQ ID NO: 7409960 - DNA, 22 bp, Homo sapiens
atattaatgggatttagtcagg

SEQ ID NO: 7409961 - DNA, 22 bp, Homo sapiens
atattaatgggatttagtcagg

SEQ ID NO: 7409962 - DNA, 22 bp, Homo sapiens
atattaatgggatttagtcagg

SEQ ID NO: 7409963 - DNA, 22 bp, Homo sapiens
atattaatgggatttagtcagg

SEQ ID NO: 7409964 - DNA, 22 bp, Homo sapiens
atattaatgggatttagtcagg

SEQ ID NO: 7409965 - DNA, 22 bp, Homo sapiens
agaaagaacgttggttatctta

SEQ ID NO: 7409966 - DNA, 22 bp, Homo sapiens
agaaagaacgttggttatctta

SEQ ID NO: 7409967 - DNA, 22 bp, Homo sapiens
agaaagaacgttggttatctta

SEQ ID NO: 7409968 - DNA, 22 bp, Homo sapiens
agaaagaacgttggttatctta

SEQ ID NO: 7409969 - DNA, 22 bp, Homo sapiens
agaaagaacgttggttatctta

SEQ ID NO: 7409970 - DNA, 22 bp, Homo sapiens
agaaagaacgttggttatctta

SEQ ID NO: 7409971 - DNA, 22 bp, Homo sapiens
agaaagaacgttggttatctta

SEQ ID NO: 7409972 - DNA, 22 bp, Homo sapiens
agaaagaacgttggttatctta

SEQ ID NO: 7409973 - DNA, 22 bp, Homo sapiens
agaaagaacgcacttgtgctgc

SEQ ID NO: 7409974 - DNA, 22 bp, Homo sapiens
agaaagaacgcacttgtgctgc

SEQ ID NO: 7409975 - DNA, 22 bp, Homo sapiens
agaaagacgtgatgaagaagta

SEQ ID NO: 7409976 - DNA, 22 bp, Homo sapiens
agaaagacaaaatgcagtggct

SEQ ID NO: 7409977 - DNA, 22 bp, Homo sapiens
agaaagacgtgatgaagaagta

SEQ ID NO: 7409978 - DNA, 22 bp, Homo sapiens
agaaagacgtgatgaagaagta

SEQ ID NO: 7409979 - DNA, 22 bp, Homo sapiens
agaaagacgtgatgaagaagta

SEQ ID NO: 7409980 - DNA, 22 bp, Homo sapiens
agaaagacgtgatgaagaagta

SEQ ID NO: 7409981 - DNA, 22 bp, Homo sapiens
agaaagacgtgatgaagaagta

SEQ ID NO: 7409982 - DNA, 22 bp, Homo sapiens
agaaagacgtgatgaagaagta

SEQ ID NO: 7409983 - DNA, 22 bp, Homo sapiens
agaaagaacgttggttatctta

SEQ ID NO: 7409984 - DNA, 22 bp, Homo sapiens
agaaagaacgttggttatctta

SEQ ID NO: 7409985 - DNA, 22 bp, Homo sapiens
agaaagacaaaatgcagtggct

SEQ ID NO: 7409986 - DNA, 22 bp, Homo sapiens
agaaagagatgaatgctttaag

SEQ ID NO: 7409987 - DNA, 22 bp, Homo sapiens
agaaagagctcgggattaacag

SEQ ID NO: 7409988 - DNA, 22 bp, Homo sapiens
agaaagagctcgggattaacag

SEQ ID NO: 7409989 - DNA, 22 bp, Homo sapiens
agaaagacgtgatgaagaagta

SEQ ID NO: 7409990 - DNA, 22 bp, Homo sapiens
agaaagacgtgatgaagaagta

SEQ ID NO: 7409991 - DNA, 22 bp, Homo sapiens
agaaagacgtgatgaagaagta

SEQ ID NO: 7409992 - DNA, 22 bp, Homo sapiens
agaaagagctcgggattaacag

SEQ ID NO: 7409993 - DNA, 22 bp, Homo sapiens
agaaagagctcgggattaacag

SEQ ID NO: 7409994 - DNA, 22 bp, Homo sapiens
agaaagagctcgggattaacag

SEQ ID NO: 7409995 - DNA, 22 bp, Homo sapiens
agaaagagctcgggattaacag

SEQ ID NO: 7409996 - DNA, 22 bp, Homo sapiens
agaaagaggatgcagatctcat

SEQ ID NO: 7409997 - DNA, 22 bp, Homo sapiens
agaaagaggatgcagatctcat

SEQ ID NO: 7409998 - DNA, 22 bp, Homo sapiens
agaaagaggatgcagatctcat

SEQ ID NO: 7409999 - DNA, 22 bp, Homo sapiens
agaaagaggatgcagatctcat

SEQ ID NO: 7410000 - DNA, 22 bp, Homo sapiens
agaaagaggatgcagatctcat

SEQ ID NO: 7410001 - DNA, 17 bp, Homo sapiens
agaaagaggatccacag

SEQ ID NO: 7410002 - DNA, 17 bp, Homo sapiens
agaaagaggatccacag

SEQ ID NO: 7410003 - DNA, 17 bp, Homo sapiens
agaaagaggatccacag

SEQ ID NO: 7410004 - DNA, 17 bp, Homo sapiens
agaaagaggatccacag

SEQ ID NO: 7410005 - DNA, 17 bp, Homo sapiens
agaaagaggatccacag

SEQ ID NO: 7410006 - DNA, 22 bp, Homo sapiens
atatagtttaggttcgaatggg

SEQ ID NO: 7410007 - DNA, 20 bp, Homo sapiens
agaaacatttcttgagaact

SEQ ID NO: 7410008 - DNA, 20 bp, Homo sapiens
agaaacatttcttgagaact

SEQ ID NO: 7410009 - DNA, 20 bp, Homo sapiens
agaaacatttcttgagaact

SEQ ID NO: 7410010 - DNA, 20 bp, Homo sapiens
agaaacatttcttgagaact

SEQ ID NO: 7410011 - DNA, 20 bp, Homo sapiens
agaaacatttcttgagaact

SEQ ID NO: 7410012 - DNA, 20 bp, Homo sapiens
agaaacatttcttgagaact

SEQ ID NO: 7410013 - DNA, 21 bp, Homo sapiens
agaaactgactcctagaggca

SEQ ID NO: 7410014 - DNA, 21 bp, Homo sapiens
agaaactgactcctagaggca

SEQ ID NO: 7410015 - DNA, 20 bp, Homo sapiens
agaaacatttcttgagaact

SEQ ID NO: 7410016 - DNA, 22 bp, Homo sapiens
atatagtcaaacatatatgtgt

SEQ ID NO: 7410017 - DNA, 22 bp, Homo sapiens
atatagtcacactttgcaggca

SEQ ID NO: 7410018 - DNA, 22 bp, Homo sapiens
atatagtgaaagtgatgtgtgg

SEQ ID NO: 7410019 - DNA, 22 bp, Homo sapiens
atatagttgggtttcattctac

SEQ ID NO: 7410020 - DNA, 22 bp, Homo sapiens
atatagttgggtttcattctac

SEQ ID NO: 7410021 - DNA, 22 bp, Homo sapiens
atatagtttaagaaagtacagt

SEQ ID NO: 7410022 - DNA, 22 bp, Homo sapiens
atatagttgggtttcattctac

SEQ ID NO: 7410023 - DNA, 22 bp, Homo sapiens
atatagtttaagaaagtacagt

SEQ ID NO: 7410024 - DNA, 22 bp, Homo sapiens
agaaactgtgttactagaatgt

SEQ ID NO: 7410025 - DNA, 22 bp, Homo sapiens
agaaactgtgttactagaatgt

SEQ ID NO: 7410026 - DNA, 22 bp, Homo sapiens
agaaactgcagctcagagaagt

SEQ ID NO: 7410027 - DNA, 22 bp, Homo sapiens
agaaactgcagctcagagaagt

SEQ ID NO: 7410028 - DNA, 22 bp, Homo sapiens
agaaactgcagctcagagaagt

SEQ ID NO: 7410029 - DNA, 17 bp, Homo sapiens
agaaactgaggctcagt

SEQ ID NO: 7410030 - DNA, 17 bp, Homo sapiens
agaaactgaggctcagt

SEQ ID NO: 7410031 - DNA, 17 bp, Homo sapiens
agaaactgaggctcagt

SEQ ID NO: 7410032 - DNA, 22 bp, Homo sapiens
agaaagaacgcacttgtgctgc

SEQ ID NO: 7410033 - DNA, 22 bp, Homo sapiens
agaaagaacgcacttgtgctgc

SEQ ID NO: 7410034 - DNA, 22 bp, Homo sapiens
agaaagaacgcacttgtgctgc

SEQ ID NO: 7410035 - DNA, 22 bp, Homo sapiens
agaaactttctagggcttcagg

SEQ ID NO: 7410036 - DNA, 22 bp, Homo sapiens
agaaactttctagggcttcagg

SEQ ID NO: 7410037 - DNA, 22 bp, Homo sapiens
agaaagaacgcacttgtgctgc

SEQ ID NO: 7410038 - DNA, 22 bp, Homo sapiens
agaaagaacgcacttgtgctgc

SEQ ID NO: 7410039 - DNA, 22 bp, Homo sapiens
agaaacttcagctattcttttg

SEQ ID NO: 7410040 - DNA, 22 bp, Homo sapiens
agaaactgtgttactagaatgt

SEQ ID NO: 7410041 - DNA, 22 bp, Homo sapiens
agaaacttcagctattcttttg

SEQ ID NO: 7410042 - DNA, 19 bp, Homo sapiens
atatagcattattcaattt

SEQ ID NO: 7410043 - DNA, 19 bp, Homo sapiens
atatagcattattcaattt

SEQ ID NO: 7410044 - DNA, 19 bp, Homo sapiens
atatagcattattcaattt

SEQ ID NO: 7410045 - DNA, 19 bp, Homo sapiens
atatagcattattcaattt

SEQ ID NO: 7410046 - DNA, 22 bp, Homo sapiens
atatagcacttgttttgcatgt

SEQ ID NO: 7410047 - DNA, 22 bp, Homo sapiens
atatagcacttgttttgcatgt

SEQ ID NO: 7410048 - DNA, 22 bp, Homo sapiens
atataggttatcatatttgccc

SEQ ID NO: 7410049 - DNA, 22 bp, Homo sapiens
atatagtaagcagtctgtaaat

SEQ ID NO: 7410050 - DNA, 22 bp, Homo sapiens
atatagtatgtcctccagaatt

SEQ ID NO: 7410051 - DNA, 22 bp, Homo sapiens
atatagtatgtcctccagaatt

SEQ ID NO: 7410052 - DNA, 22 bp, Homo sapiens
atatagtatgtcctccagaatt

SEQ ID NO: 7410053 - DNA, 22 bp, Homo sapiens
atatagtaagcagtctgtaaat

SEQ ID NO: 7410054 - DNA, 22 bp, Homo sapiens
atatagtaagcagtctgtaaat

SEQ ID NO: 7410055 - DNA, 22 bp, Homo sapiens
atatagtaagcagtctgtaaat

SEQ ID NO: 7410056 - DNA, 22 bp, Homo sapiens
atatagtaagcagtctgtaaat

SEQ ID NO: 7410057 - DNA, 22 bp, Homo sapiens
atatagaaggtgctatttacat

SEQ ID NO: 7410058 - DNA, 22 bp, Homo sapiens
atatagaaggtgctatttacat

SEQ ID NO: 7410059 - DNA, 22 bp, Homo sapiens
atatagaaggtgctatttacat

SEQ ID NO: 7410060 - DNA, 22 bp, Homo sapiens
agaaaagggcaggagggataca

SEQ ID NO: 7410061 - DNA, 22 bp, Homo sapiens
agaaaagggcaggagggataca

SEQ ID NO: 7410062 - DNA, 22 bp, Homo sapiens
agaaaagggcaggagggataca

SEQ ID NO: 7410063 - DNA, 22 bp, Homo sapiens
agaaaagggcaggagggataca

SEQ ID NO: 7410064 - DNA, 22 bp, Homo sapiens
atatagaatacacagggaaagt

SEQ ID NO: 7410065 - DNA, 22 bp, Homo sapiens
atatagaatacacagggaaagt

SEQ ID NO: 7410066 - DNA, 22 bp, Homo sapiens
atatagaaggtgctatttacat

SEQ ID NO: 7410067 - DNA, 22 bp, Homo sapiens
atatagaatacacagggaaagt

SEQ ID NO: 7410068 - DNA, 22 bp, Homo sapiens
atatagaatacacagggaaagt

SEQ ID NO: 7410069 - DNA, 22 bp, Homo sapiens
atatagaatacacagggaaagt

SEQ ID NO: 7410070 - DNA, 20 bp, Homo sapiens
atatagagtcaaaatggctt

SEQ ID NO: 7410071 - DNA, 20 bp, Homo sapiens
atatagagtcaaaatggctt

SEQ ID NO: 7410072 - DNA, 22 bp, Homo sapiens
atcaatgacagttgaattctac

SEQ ID NO: 7410073 - DNA, 22 bp, Homo sapiens
atcaatatcagatcagacagga

SEQ ID NO: 7410074 - DNA, 22 bp, Homo sapiens
atcaatatcagatcagacagga

SEQ ID NO: 7410075 - DNA, 22 bp, Homo sapiens
atcaatgacagttgaattctac

SEQ ID NO: 7410076 - DNA, 22 bp, Homo sapiens
atcaatgctctgtacccagaat

SEQ ID NO: 7410077 - DNA, 21 bp, Homo sapiens
atcaatgacctggcatgaggg

SEQ ID NO: 7410078 - DNA, 22 bp, Homo sapiens
atcaagtatccaggtagtgcta

SEQ ID NO: 7410079 - DNA, 22 bp, Homo sapiens
atcaagtctgcctgtctggagg

SEQ ID NO: 7410080 - DNA, 23 bp, Homo sapiens
atcaagtcatcagcaaaatacat

SEQ ID NO: 7410081 - DNA, 22 bp, Homo sapiens
atcaagttctgtcacatttgtc

SEQ ID NO: 7410082 - DNA, 18 bp, Homo sapiens
atcaaggaggggaaggtc

SEQ ID NO: 7410083 - DNA, 22 bp, Homo sapiens
atcaaggctattatcttgtcag

SEQ ID NO: 7410084 - DNA, 22 bp, Homo sapiens
atcaaggctattatcttgtcag

SEQ ID NO: 7410085 - DNA, 22 bp, Homo sapiens
atcaaggctttggacatagcaa

SEQ ID NO: 7410086 - DNA, 22 bp, Homo sapiens
atcaaggctttggacatagcaa

SEQ ID NO: 7410087 - DNA, 22 bp, Homo sapiens
atcaagggcgcgtggttcggcg

SEQ ID NO: 7410088 - DNA, 23 bp, Homo sapiens
atcaagtcatcagcaaaatacat

SEQ ID NO: 7410089 - DNA, 22 bp, Homo sapiens
atcaagcatatataaaactgca

SEQ ID NO: 7410090 - DNA, 22 bp, Homo sapiens
atcaagcatatataaaactgca

SEQ ID NO: 7410091 - DNA, 22 bp, Homo sapiens
atcaagcatatataaaactgca

SEQ ID NO: 7410092 - DNA, 22 bp, Homo sapiens
atcaagcacttctacatgacat

SEQ ID NO: 7410093 - DNA, 22 bp, Homo sapiens
atcaagcacttctacatgacat

SEQ ID NO: 7410094 - DNA, 22 bp, Homo sapiens
atcaagcagtgaaaaatgctag

SEQ ID NO: 7410095 - DNA, 22 bp, Homo sapiens
atcaagcagtgaaaaatgctag

SEQ ID NO: 7410096 - DNA, 22 bp, Homo sapiens
atcaagctacaccctttggaaa

SEQ ID NO: 7410097 - DNA, 22 bp, Homo sapiens
atcaagcatatataaaactgca

SEQ ID NO: 7410098 - DNA, 22 bp, Homo sapiens
atcaagctggcatatgtagttc

SEQ ID NO: 7410099 - DNA, 22 bp, Homo sapiens
atcaagctacaccctttggaaa

SEQ ID NO: 7410100 - DNA, 22 bp, Homo sapiens
atcaagagtattgacaagacca

SEQ ID NO: 7410101 - DNA, 22 bp, Homo sapiens
atcaagagttatatttcatagt

SEQ ID NO: 7410102 - DNA, 22 bp, Homo sapiens
atcaagagttatatttcatagt

SEQ ID NO: 7410103 - DNA, 20 bp, Homo sapiens
agaaatcagcatgtcctctg

SEQ ID NO: 7410104 - DNA, 22 bp, Homo sapiens
atcaagagaaggggaagatgaa

SEQ ID NO: 7410105 - DNA, 22 bp, Homo sapiens
atcaagagcacagtgctggcat

SEQ ID NO: 7410106 - DNA, 22 bp, Homo sapiens
atcaagagcacagtgctggcat

SEQ ID NO: 7410107 - DNA, 22 bp, Homo sapiens
atcaagagtattgacaagacca

SEQ ID NO: 7410108 - DNA, 22 bp, Homo sapiens
agaaatgcagtttcaagacaaa

SEQ ID NO: 7410109 - DNA, 22 bp, Homo sapiens
agaaatgcagtttcaagacaaa

SEQ ID NO: 7410110 - DNA, 22 bp, Homo sapiens
agaaatgcagtttcaagacaaa

SEQ ID NO: 7410111 - DNA, 22 bp, Homo sapiens
agaaatgcagtttcaagacaaa

SEQ ID NO: 7410112 - DNA, 22 bp, Homo sapiens
agaaatgcagtcattgtatagt

SEQ ID NO: 7410113 - DNA, 22 bp, Homo sapiens
agaaatgcagtttcaagacaaa

SEQ ID NO: 7410114 - DNA, 22 bp, Homo sapiens
agaaatgcagtttcaagacaaa

SEQ ID NO: 7410115 - DNA, 22 bp, Homo sapiens
agaaatgcagtttcaagacaaa

SEQ ID NO: 7410116 - DNA, 22 bp, Homo sapiens
agaaatgcagtctcgtcaaaag

SEQ ID NO: 7410117 - DNA, 22 bp, Homo sapiens
agaaatgcagtctcgtcaaaag

SEQ ID NO: 7410118 - DNA, 22 bp, Homo sapiens
agaaatgcagtctcgtcaaaag

SEQ ID NO: 7410119 - DNA, 22 bp, Homo sapiens
agaaatgcagtcattgtatagt

SEQ ID NO: 7410120 - DNA, 22 bp, Homo sapiens
agaaatgcagtcattgtatagt

SEQ ID NO: 7410121 - DNA, 22 bp, Homo sapiens
agaaatgcagtcattgtatagt

SEQ ID NO: 7410122 - DNA, 22 bp, Homo sapiens
agaaatgcagtcattgtatagt

SEQ ID NO: 7410123 - DNA, 22 bp, Homo sapiens
agaaatgcaaattttcatagag

SEQ ID NO: 7410124 - DNA, 22 bp, Homo sapiens
agaaatgcaaattttcatagag

SEQ ID NO: 7410125 - DNA, 22 bp, Homo sapiens
agaaatgcaaattttcatagag

SEQ ID NO: 7410126 - DNA, 22 bp, Homo sapiens
agaaatgcaaattttcatagag

SEQ ID NO: 7410127 - DNA, 22 bp, Homo sapiens
agaaatgcaaattttcatagag

SEQ ID NO: 7410128 - DNA, 22 bp, Homo sapiens
agaaatgcaaattttcatagag

SEQ ID NO: 7410129 - DNA, 22 bp, Homo sapiens
agaaatgctcaggtcaacttaa

SEQ ID NO: 7410130 - DNA, 22 bp, Homo sapiens
agaaatgctcaggtcaacttaa

SEQ ID NO: 7410131 - DNA, 22 bp, Homo sapiens
agaaatgctcttcctgaccaga

SEQ ID NO: 7410132 - DNA, 22 bp, Homo sapiens
agaaatgctcttcctgaccaga

SEQ ID NO: 7410133 - DNA, 22 bp, Homo sapiens
agaaatgctcttcctgaccaga

SEQ ID NO: 7410134 - DNA, 22 bp, Homo sapiens
agaaatggaaatccaagcaact

SEQ ID NO: 7410135 - DNA, 22 bp, Homo sapiens
agaaatggaaatccaagcaact

SEQ ID NO: 7410136 - DNA, 22 bp, Homo sapiens
agaaatgcattagcacatatag

SEQ ID NO: 7410137 - DNA, 22 bp, Homo sapiens
agaaatgcattagcacatatag

SEQ ID NO: 7410138 - DNA, 22 bp, Homo sapiens
agaaatgcattagcacatatag

SEQ ID NO: 7410139 - DNA, 22 bp, Homo sapiens
agaaatgcattagcacatatag

SEQ ID NO: 7410140 - DNA, 22 bp, Homo sapiens
agaaatgcctacgagataggga

SEQ ID NO: 7410141 - DNA, 22 bp, Homo sapiens
agaaatgcctacgagataggga

SEQ ID NO: 7410142 - DNA, 22 bp, Homo sapiens
agaaatgcctacgagataggga

SEQ ID NO: 7410143 - DNA, 22 bp, Homo sapiens
agaaatgcctacgagataggga

SEQ ID NO: 7410144 - DNA, 22 bp, Homo sapiens
atcaattcttaggaaaatagct

SEQ ID NO: 7410145 - DNA, 22 bp, Homo sapiens
atcaattcttaggaaaatagct

SEQ ID NO: 7410146 - DNA, 22 bp, Homo sapiens
atcaattttgaggatacaagaa

SEQ ID NO: 7410147 - DNA, 22 bp, Homo sapiens
atcaattttgaggatacaagaa

SEQ ID NO: 7410148 - DNA, 22 bp, Homo sapiens
atcaattttgaggatacaagaa

SEQ ID NO: 7410149 - DNA, 22 bp, Homo sapiens
atcaattttgaggatacaagaa

SEQ ID NO: 7410150 - DNA, 22 bp, Homo sapiens
atcaattttgaggatacaagaa

SEQ ID NO: 7410151 - DNA, 22 bp, Homo sapiens
atcaattcttaggaaaatagct

SEQ ID NO: 7410152 - DNA, 22 bp, Homo sapiens
atcaatgttttgatagcccaga

SEQ ID NO: 7410153 - DNA, 22 bp, Homo sapiens
atcaatgttgggccaaagcaaa

SEQ ID NO: 7410154 - DNA, 22 bp, Homo sapiens
atcaatgttgggccaaagcaaa

SEQ ID NO: 7410155 - DNA, 22 bp, Homo sapiens
atcaatgcttgccaaatggaag

SEQ ID NO: 7410156 - DNA, 22 bp, Homo sapiens
agaaatctttcctgaagtgttt

SEQ ID NO: 7410157 - DNA, 22 bp, Homo sapiens
agaaatctttcctgaagtgttt

SEQ ID NO: 7410158 - DNA, 22 bp, Homo sapiens
agaaatctttgaagtgtaatgt

SEQ ID NO: 7410159 - DNA, 22 bp, Homo sapiens
agaaatctttgaagtgtaatgt

SEQ ID NO: 7410160 - DNA, 22 bp, Homo sapiens
atcaattttgaggatacaagaa

SEQ ID NO: 7410161 - DNA, 22 bp, Homo sapiens
atcaatgttttgatagcccaga

SEQ ID NO: 7410162 - DNA, 22 bp, Homo sapiens
atcaattttgaggatacaagaa

SEQ ID NO: 7410163 - DNA, 22 bp, Homo sapiens
agaaatcttatcaagaaatgcc

SEQ ID NO: 7410164 - DNA, 22 bp, Homo sapiens
agaaatcttggagtctgtggta

SEQ ID NO: 7410165 - DNA, 22 bp, Homo sapiens
atattacacacggtatcacggg

SEQ ID NO: 7410166 - DNA, 22 bp, Homo sapiens
atattacacacggtatcacggg

SEQ ID NO: 7410167 - DNA, 22 bp, Homo sapiens
atattacacacggtatcacggg

SEQ ID NO: 7410168 - DNA, 22 bp, Homo sapiens
atattacacacggtatcacggg

SEQ ID NO: 7410169 - DNA, 22 bp, Homo sapiens
atattacacacggtatcacggg

SEQ ID NO: 7410170 - DNA, 22 bp, Homo sapiens
atattacacacggtatcacggg

SEQ ID NO: 7410171 - DNA, 22 bp, Homo sapiens
atattaattatttacacatgag

SEQ ID NO: 7410172 - DNA, 22 bp, Homo sapiens
atattaattatttacacatgag

SEQ ID NO: 7410173 - DNA, 22 bp, Homo sapiens
atattaattatttacacatgag

SEQ ID NO: 7410174 - DNA, 22 bp, Homo sapiens
atattaattatttacacatgag

SEQ ID NO: 7410175 - DNA, 22 bp, Homo sapiens
atattaattatttacacatgag

SEQ ID NO: 7410176 - DNA, 22 bp, Homo sapiens
atattaattatttacacatgag

SEQ ID NO: 7410177 - DNA, 22 bp, Homo sapiens
agaaagtttgtttttatccata

SEQ ID NO: 7410178 - DNA, 22 bp, Homo sapiens
agaaagtttgtttttatccata

SEQ ID NO: 7410179 - DNA, 22 bp, Homo sapiens
agaaatagcagagtcaggcggg

SEQ ID NO: 7410180 - DNA, 19 bp, Homo sapiens
agaaatagccttccttgtc

SEQ ID NO: 7410181 - DNA, 22 bp, Homo sapiens
agaaagttttgtgctatatatg

SEQ ID NO: 7410182 - DNA, 22 bp, Homo sapiens
agaaatatgctgattagatgaa

SEQ ID NO: 7410183 - DNA, 22 bp, Homo sapiens
agaaatatgctgattagatgaa

SEQ ID NO: 7410184 - DNA, 22 bp, Homo sapiens
agaaatatgctgattagatgaa

SEQ ID NO: 7410185 - DNA, 22 bp, Homo sapiens
agaaatatgctgattagatgaa

SEQ ID NO: 7410186 - DNA, 22 bp, Homo sapiens
agaaatatgctgattagatgaa

SEQ ID NO: 7410187 - DNA, 22 bp, Homo sapiens
agaaatatgctgattagatgaa

SEQ ID NO: 7410188 - DNA, 22 bp, Homo sapiens
agaaatagtcacattggaggaa

SEQ ID NO: 7410189 - DNA, 19 bp, Homo sapiens
agaaatagccttccttgtc

SEQ ID NO: 7410190 - DNA, 22 bp, Homo sapiens
agaaatagtcacattggaggaa

SEQ ID NO: 7410191 - DNA, 19 bp, Homo sapiens
agaaatagccttccttgtc

SEQ ID NO: 7410192 - DNA, 19 bp, Homo sapiens
agaaatagccttccttgtc

SEQ ID NO: 7410193 - DNA, 19 bp, Homo sapiens
agaaatagccttccttgtc

SEQ ID NO: 7410194 - DNA, 22 bp, Homo sapiens
agaaatatgctgattagatgaa

SEQ ID NO: 7410195 - DNA, 22 bp, Homo sapiens
agaaatatgctgattagatgaa

SEQ ID NO: 7410196 - DNA, 22 bp, Homo sapiens
agaaatatgctgattagatgaa

SEQ ID NO: 7410197 - DNA, 22 bp, Homo sapiens
agaaatatgctgattagatgaa

SEQ ID NO: 7410198 - DNA, 22 bp, Homo sapiens
agaaatatgctgattagatgaa

SEQ ID NO: 7410199 - DNA, 20 bp, Homo sapiens
agaaatcagaccacacacta

SEQ ID NO: 7410200 - DNA, 22 bp, Homo sapiens
agaaatcagaaccctgaagttc

SEQ ID NO: 7410201 - DNA, 20 bp, Homo sapiens
agaaatcagcatgtcctctg

SEQ ID NO: 7410202 - DNA, 20 bp, Homo sapiens
agaaatcagcatgtcctctg

SEQ ID NO: 7410203 - DNA, 22 bp, Homo sapiens
agaaatcagaaccctgaagttc

SEQ ID NO: 7410204 - DNA, 22 bp, Homo sapiens
agaaatcacttagaggaagtga

SEQ ID NO: 7410205 - DNA, 22 bp, Homo sapiens
agaaatcagaaccctgaagttc

SEQ ID NO: 7410206 - DNA, 22 bp, Homo sapiens
agaaatcacaggaggcagaagg

SEQ ID NO: 7410207 - DNA, 22 bp, Homo sapiens
agaaatcacaggaggcagaagg

SEQ ID NO: 7410208 - DNA, 22 bp, Homo sapiens
agaaatcacttaatgaacgtag

SEQ ID NO: 7410209 - DNA, 22 bp, Homo sapiens
agaaatcacttagaggaagtga

SEQ ID NO: 7410210 - DNA, 22 bp, Homo sapiens
agaaatcacttagaggaagtga

SEQ ID NO: 7410211 - DNA, 22 bp, Homo sapiens
agaaatcacttagaggaagtga

SEQ ID NO: 7410212 - DNA, 22 bp, Homo sapiens
agaaatcaatatctatatgttg

SEQ ID NO: 7410213 - DNA, 22 bp, Homo sapiens
agaaatcaatatctatatgttg

SEQ ID NO: 7410214 - DNA, 22 bp, Homo sapiens
agaaatcaatatctatatgttg

SEQ ID NO: 7410215 - DNA, 22 bp, Homo sapiens
agaaatcaatatctatatgttg

SEQ ID NO: 7410216 - DNA, 22 bp, Homo sapiens
agaaatcaatatctatatgttg

SEQ ID NO: 7410217 - DNA, 22 bp, Homo sapiens
agaaatcaatgaagtctgctaa

SEQ ID NO: 7410218 - DNA, 22 bp, Homo sapiens
agaaatcaatgaagtctgctaa

SEQ ID NO: 7410219 - DNA, 22 bp, Homo sapiens
agaaatcaatatctatatgttg

SEQ ID NO: 7410220 - DNA, 22 bp, Homo sapiens
agaaatcaatatctatatgttg

SEQ ID NO: 7410221 - DNA, 20 bp, Homo sapiens
agaaatattgagttcagagg

SEQ ID NO: 7410222 - DNA, 20 bp, Homo sapiens
agaaatattgagttcagagg

SEQ ID NO: 7410223 - DNA, 20 bp, Homo sapiens
agaaatattgagttcagagg

SEQ ID NO: 7410224 - DNA, 22 bp, Homo sapiens
agaaatatgctgattagatgaa

SEQ ID NO: 7410225 - DNA, 20 bp, Homo sapiens
agaaatattgagttcagagg

SEQ ID NO: 7410226 - DNA, 20 bp, Homo sapiens
agaaatattgagttcagagg

SEQ ID NO: 7410227 - DNA, 22 bp, Homo sapiens
agaaatatgctgattagatgaa

SEQ ID NO: 7410228 - DNA, 22 bp, Homo sapiens
agaaatatgctgattagatgaa

SEQ ID NO: 7410229 - DNA, 22 bp, Homo sapiens
agttgcagacgcagagatgttg

SEQ ID NO: 7410230 - DNA, 22 bp, Homo sapiens
agttgcagacgcagagatgttg

SEQ ID NO: 7410231 - DNA, 22 bp, Homo sapiens
agttgcagacgcagagatgttg

SEQ ID NO: 7410232 - DNA, 22 bp, Homo sapiens
agttgcagacgcagagatgttg

SEQ ID NO: 7410233 - DNA, 22 bp, Homo sapiens
agttgcagacgcagagatgttg

SEQ ID NO: 7410234 - DNA, 22 bp, Homo sapiens
agttgcagacgcagagatgttg

SEQ ID NO: 7410235 - DNA, 22 bp, Homo sapiens
agttgcagacgcagagatgttg

SEQ ID NO: 7410236 - DNA, 22 bp, Homo sapiens
agttgcagacgcagagatgttg

SEQ ID NO: 7410237 - DNA, 22 bp, Homo sapiens
agttgatttttctggctcagcc

SEQ ID NO: 7410238 - DNA, 22 bp, Homo sapiens
agttgagggtgggagagaaatg

SEQ ID NO: 7410239 - DNA, 22 bp, Homo sapiens
agttgactctcaagatcctgtt

SEQ ID NO: 7410240 - DNA, 22 bp, Homo sapiens
agttgcagacgcagagatgttg

SEQ ID NO: 7410241 - DNA, 22 bp, Homo sapiens
agttgcagacgcagagatgttg

SEQ ID NO: 7410242 - DNA, 19 bp, Homo sapiens
ataaataaaaagtgggaga

SEQ ID NO: 7410243 - DNA, 19 bp, Homo sapiens
ataaataaaaagtgggaga

SEQ ID NO: 7410244 - DNA, 22 bp, Homo sapiens
ataaattctctgatgtatagta

SEQ ID NO: 7410245 - DNA, 22 bp, Homo sapiens
ataaattctctgatgtatagta

SEQ ID NO: 7410246 - DNA, 22 bp, Homo sapiens
ataaattctctgatgtatagta

SEQ ID NO: 7410247 - DNA, 22 bp, Homo sapiens
ataaattcaaagcatttaggac

SEQ ID NO: 7410248 - DNA, 22 bp, Homo sapiens
ataaattatgaatggccctttt

SEQ ID NO: 7410249 - DNA, 19 bp, Homo sapiens
ataaataaaaagtgggaga

SEQ ID NO: 7410250 - DNA, 19 bp, Homo sapiens
ataaataaaaagtgggaga

SEQ ID NO: 7410251 - DNA, 22 bp, Homo sapiens
ataaattatgaatggccctttt

SEQ ID NO: 7410252 - DNA, 19 bp, Homo sapiens
ataaataaaaagtgggaga

SEQ ID NO: 7410253 - DNA, 22 bp, Homo sapiens
ataaattatgaatggccctttt

SEQ ID NO: 7410254 - DNA, 22 bp, Homo sapiens
ataaattatgaatggccctttt

SEQ ID NO: 7410255 - DNA, 22 bp, Homo sapiens
ataaattgtgcttttgacatct

SEQ ID NO: 7410256 - DNA, 21 bp, Homo sapiens
ataaattctgagaggctctgc

SEQ ID NO: 7410257 - DNA, 22 bp, Homo sapiens
ataaattgtgcttttgacatct

SEQ ID NO: 7410258 - DNA, 22 bp, Homo sapiens
ataaatttataattgtttcctg

SEQ ID NO: 7410259 - DNA, 22 bp, Homo sapiens
ataaattctctgatgtatagta

SEQ ID NO: 7410260 - DNA, 22 bp, Homo sapiens
ataaattctctgatgtatagta

SEQ ID NO: 7410261 - DNA, 22 bp, Homo sapiens
ataaattctctgatgtatagta

SEQ ID NO: 7410262 - DNA, 21 bp, Homo sapiens
ataaattctgagaggctctgc

SEQ ID NO: 7410263 - DNA, 21 bp, Homo sapiens
ataaattctgagaggctctgc

SEQ ID NO: 7410264 - DNA, 21 bp, Homo sapiens
ataaattctgagaggctctgc

SEQ ID NO: 7410265 - DNA, 22 bp, Homo sapiens
ataacaatagtggtagtgctgg

SEQ ID NO: 7410266 - DNA, 22 bp, Homo sapiens
ataacaatagtggtagtgctgg

SEQ ID NO: 7410267 - DNA, 22 bp, Homo sapiens
ataacaatagtggtagtgctgg

SEQ ID NO: 7410268 - DNA, 22 bp, Homo sapiens
ataacaatagtggtagtgctgg

SEQ ID NO: 7410269 - DNA, 22 bp, Homo sapiens
ataacaatagtggtagtgctgg

SEQ ID NO: 7410270 - DNA, 22 bp, Homo sapiens
ataacaagtatttattgagcat

SEQ ID NO: 7410271 - DNA, 22 bp, Homo sapiens
ataacaagtatttattgagcat

SEQ ID NO: 7410272 - DNA, 22 bp, Homo sapiens
ataaattttcttgctgtactta

SEQ ID NO: 7410273 - DNA, 22 bp, Homo sapiens
ataaattttcttgctgtactta

SEQ ID NO: 7410274 - DNA, 22 bp, Homo sapiens
ataaattttcttgctgtactta

SEQ ID NO: 7410275 - DNA, 22 bp, Homo sapiens
ataaattttcttgctgtactta

SEQ ID NO: 7410276 - DNA, 22 bp, Homo sapiens
ataaattttcttgctgtactta

SEQ ID NO: 7410277 - DNA, 22 bp, Homo sapiens
ataaattttcttgctgtactta

SEQ ID NO: 7410278 - DNA, 22 bp, Homo sapiens
ataaattttcttgctgtactta

SEQ ID NO: 7410279 - DNA, 22 bp, Homo sapiens
ataaattttcttgctgtactta

SEQ ID NO: 7410280 - DNA, 22 bp, Homo sapiens
ataaattttcttgctgtactta

SEQ ID NO: 7410281 - DNA, 22 bp, Homo sapiens
ataaatttataattgtttcctg

SEQ ID NO: 7410282 - DNA, 22 bp, Homo sapiens
ataaatttataattgtttcctg

SEQ ID NO: 7410283 - DNA, 22 bp, Homo sapiens
ataaatttataattgtttcctg

SEQ ID NO: 7410284 - DNA, 22 bp, Homo sapiens
ataaatttataattgtttcctg

SEQ ID NO: 7410285 - DNA, 22 bp, Homo sapiens
ataaatttataattgtttcctg

SEQ ID NO: 7410286 - DNA, 22 bp, Homo sapiens
ataaatttataattgtttcctg

SEQ ID NO: 7410287 - DNA, 22 bp, Homo sapiens
ataacagacttagagttacaag

SEQ ID NO: 7410288 - DNA, 22 bp, Homo sapiens
ataacagacttagagttacaag

SEQ ID NO: 7410289 - DNA, 22 bp, Homo sapiens
ataacagacttagagttacaag

SEQ ID NO: 7410290 - DNA, 22 bp, Homo sapiens
ataacagactgatttttaaatg

SEQ ID NO: 7410291 - DNA, 22 bp, Homo sapiens
ataacagactgatttttaaatg

SEQ ID NO: 7410292 - DNA, 22 bp, Homo sapiens
ataacagactgatttttaaatg

SEQ ID NO: 7410293 - DNA, 22 bp, Homo sapiens
ataacagacttagagttacaag

SEQ ID NO: 7410294 - DNA, 22 bp, Homo sapiens
ataacagacttagagttacaag

SEQ ID NO: 7410295 - DNA, 22 bp, Homo sapiens
ataacagacttagagttacaag

SEQ ID NO: 7410296 - DNA, 22 bp, Homo sapiens
ataacagacttagagttacaag

SEQ ID NO: 7410297 - DNA, 22 bp, Homo sapiens
ataacagagagctactgaactg

SEQ ID NO: 7410298 - DNA, 22 bp, Homo sapiens
ataacagaataagtcattaccg

SEQ ID NO: 7410299 - DNA, 22 bp, Homo sapiens
ataacagaataagtcattaccg

SEQ ID NO: 7410300 - DNA, 22 bp, Homo sapiens
ataacagactgatttttaaatg

SEQ ID NO: 7410301 - DNA, 22 bp, Homo sapiens
ataacagaataagtcattaccg

SEQ ID NO: 7410302 - DNA, 22 bp, Homo sapiens
ataacagaataagtcattaccg

SEQ ID NO: 7410303 - DNA, 22 bp, Homo sapiens
ataacagaataagtcattaccg

SEQ ID NO: 7410304 - DNA, 22 bp, Homo sapiens
ataacactaaatgtatgtaaca

SEQ ID NO: 7410305 - DNA, 22 bp, Homo sapiens
ataacactaaatgtatgtaaca

SEQ ID NO: 7410306 - DNA, 22 bp, Homo sapiens
ataacactaaatgtatgtaaca

SEQ ID NO: 7410307 - DNA, 22 bp, Homo sapiens
ataacactaaatgtatgtaaca

SEQ ID NO: 7410308 - DNA, 22 bp, Homo sapiens
agttctttgtgatggaaattta

SEQ ID NO: 7410309 - DNA, 22 bp, Homo sapiens
agttcttttctagattctggat

SEQ ID NO: 7410310 - DNA, 22 bp, Homo sapiens
agttcttttctagattctggat

SEQ ID NO: 7410311 - DNA, 22 bp, Homo sapiens
agttcttttgtgaacatatgct

SEQ ID NO: 7410312 - DNA, 22 bp, Homo sapiens
agttcttttgtgaacatatgct

SEQ ID NO: 7410313 - DNA, 22 bp, Homo sapiens
agttgaaaattaagtgaatttc

SEQ ID NO: 7410314 - DNA, 22 bp, Homo sapiens
agttctttgtgagtaatacaga

SEQ ID NO: 7410315 - DNA, 22 bp, Homo sapiens
agttctttgtgagtaatacaga

SEQ ID NO: 7410316 - DNA, 22 bp, Homo sapiens
agttctttgtgagtaatacaga

SEQ ID NO: 7410317 - DNA, 22 bp, Homo sapiens
agttctttgtcatctctggagt

SEQ ID NO: 7410318 - DNA, 22 bp, Homo sapiens
agttctttggtcctaaccctgc

SEQ ID NO: 7410319 - DNA, 22 bp, Homo sapiens
agttctttgtcatctctggagt

SEQ ID NO: 7410320 - DNA, 22 bp, Homo sapiens
agttctttgtcatctctggagt

SEQ ID NO: 7410321 - DNA, 22 bp, Homo sapiens
agttcagtgttggttaagatga

SEQ ID NO: 7410322 - DNA, 22 bp, Homo sapiens
agttctttggcagctgggctgg

SEQ ID NO: 7410323 - DNA, 23 bp, Homo sapiens
agttcataatttcttatttgtgt

SEQ ID NO: 7410324 - DNA, 22 bp, Homo sapiens
agttctttgtaaaaggtctcta

SEQ ID NO: 7410325 - DNA, 22 bp, Homo sapiens
agttgaagtcctcatcaaatat

SEQ ID NO: 7410326 - DNA, 22 bp, Homo sapiens
agttgaattatgagtgtctttg

SEQ ID NO: 7410327 - DNA, 22 bp, Homo sapiens
agttgaatatacttgctgttgc

SEQ ID NO: 7410328 - DNA, 22 bp, Homo sapiens
agttgacatccagagacattct

SEQ ID NO: 7410329 - DNA, 19 bp, Homo sapiens
agttgaattaacttgtcac

SEQ ID NO: 7410330 - DNA, 22 bp, Homo sapiens
agttgaaattagagtcctggct

SEQ ID NO: 7410331 - DNA, 22 bp, Homo sapiens
agttgaaggttggctgatccat

SEQ ID NO: 7410332 - DNA, 22 bp, Homo sapiens
agttgaagtcttcaataagctt

SEQ ID NO: 7410333 - DNA, 22 bp, Homo sapiens
agttgaagtcttcaataagctt

SEQ ID NO: 7410334 - DNA, 22 bp, Homo sapiens
agttgaaattaagagagagttt

SEQ ID NO: 7410335 - DNA, 22 bp, Homo sapiens
agttgaaattaagagagagttt

SEQ ID NO: 7410336 - DNA, 22 bp, Homo sapiens
agttgaaaattaagtgaatttc

SEQ ID NO: 7410337 - DNA, 22 bp, Homo sapiens
agttgaaagccttatttctctg

SEQ ID NO: 7410338 - DNA, 22 bp, Homo sapiens
agttcacaagtgcatttcagga

SEQ ID NO: 7410339 - DNA, 22 bp, Homo sapiens
agttcacaagtgcatttcagga

SEQ ID NO: 7410340 - DNA, 22 bp, Homo sapiens
agttcacaatagaagaggtggc

SEQ ID NO: 7410341 - DNA, 22 bp, Homo sapiens
agttcacaatagaagaggtggc

SEQ ID NO: 7410342 - DNA, 22 bp, Homo sapiens
agttcaattgttttgtaaaagt

SEQ ID NO: 7410343 - DNA, 22 bp, Homo sapiens
agttcacagaatagtgccccac

SEQ ID NO: 7410344 - DNA, 22 bp, Homo sapiens
agttcacagccatgttcatgtg

SEQ ID NO: 7410345 - DNA, 22 bp, Homo sapiens
agttcacagaatggccagaact

SEQ ID NO: 7410346 - DNA, 21 bp, Homo sapiens
agttcacaggaacaagcaggg

SEQ ID NO: 7410347 - DNA, 22 bp, Homo sapiens
agttcacatatctgttttattt

SEQ ID NO: 7410348 - DNA, 22 bp, Homo sapiens
agttcacattccgaggtactgg

SEQ ID NO: 7410349 - DNA, 22 bp, Homo sapiens
agttcacattccgaggtactgg

SEQ ID NO: 7410350 - DNA, 22 bp, Homo sapiens
agttcactatagaagacagtgt

SEQ ID NO: 7410351 - DNA, 22 bp, Homo sapiens
agttcactccagatgttctgac

SEQ ID NO: 7410352 - DNA, 22 bp, Homo sapiens
agttcactccagatgttctgac

SEQ ID NO: 7410353 - DNA, 22 bp, Homo sapiens
agttcactctttatgagaaagt

SEQ ID NO: 7410354 - DNA, 22 bp, Homo sapiens
agttcactgcttaagcctttga

SEQ ID NO: 7410355 - DNA, 22 bp, Homo sapiens
agttcactctttatgagaaagt

SEQ ID NO: 7410356 - DNA, 22 bp, Homo sapiens
agttcagaaatgtctttgcaaa

SEQ ID NO: 7410357 - DNA, 22 bp, Homo sapiens
agttcactttctgtagtggaag

SEQ ID NO: 7410358 - DNA, 22 bp, Homo sapiens
agttcactttctgtagtggaag

SEQ ID NO: 7410359 - DNA, 22 bp, Homo sapiens
agttcagagtaaatgttgaagg

SEQ ID NO: 7410360 - DNA, 23 bp, Homo sapiens
agttcagctcagttcagtgagca

SEQ ID NO: 7410361 - DNA, 22 bp, Homo sapiens
agttcagaggttaatttatttg

SEQ ID NO: 7410362 - DNA, 22 bp, Homo sapiens
agttcagcttcccaggtcactg

SEQ ID NO: 7410363 - DNA, 22 bp, Homo sapiens
agttcaggcataaggcatgaac

SEQ ID NO: 7410364 - DNA, 22 bp, Homo sapiens
agttcagtagtccttcattgta

SEQ ID NO: 7410365 - DNA, 22 bp, Homo sapiens
agttcagtagtccttcattgta

SEQ ID NO: 7410366 - DNA, 22 bp, Homo sapiens
agttcagtagtccttcattgta

SEQ ID NO: 7410367 - DNA, 22 bp, Homo sapiens
atacacatttgctagagatggg

SEQ ID NO: 7410368 - DNA, 22 bp, Homo sapiens
atacacagctacattgaacaat

SEQ ID NO: 7410369 - DNA, 22 bp, Homo sapiens
atacacatttgctagagatggg

SEQ ID NO: 7410370 - DNA, 22 bp, Homo sapiens
atacacagctacattgaacaat

SEQ ID NO: 7410371 - DNA, 20 bp, Homo sapiens
atacacattcatagaaaaat

SEQ ID NO: 7410372 - DNA, 22 bp, Homo sapiens
atacacagctacattgaacaat

SEQ ID NO: 7410373 - DNA, 22 bp, Homo sapiens
atacacagctacattgaacaat

SEQ ID NO: 7410374 - DNA, 22 bp, Homo sapiens
atacacagctacattgaacaat

SEQ ID NO: 7410375 - DNA, 22 bp, Homo sapiens
atacacagctacattgaacaat

SEQ ID NO: 7410376 - DNA, 22 bp, Homo sapiens
atacacagcgatgagaggaggc

SEQ ID NO: 7410377 - DNA, 22 bp, Homo sapiens
atacacagctacattgaacaat

SEQ ID NO: 7410378 - DNA, 22 bp, Homo sapiens
atacacagccattatgaattag

SEQ ID NO: 7410379 - DNA, 22 bp, Homo sapiens
atacacagccattatgaattag

SEQ ID NO: 7410380 - DNA, 22 bp, Homo sapiens
atacacactgctatcctttttt

SEQ ID NO: 7410381 - DNA, 22 bp, Homo sapiens
atacacactgctatcctttttt

SEQ ID NO: 7410382 - DNA, 22 bp, Homo sapiens
atacacagccattatgaattag

SEQ ID NO: 7410383 - DNA, 22 bp, Homo sapiens
atacacagccattatgaattag

SEQ ID NO: 7410384 - DNA, 22 bp, Homo sapiens
atacacagcgatgagaggaggc

SEQ ID NO: 7410385 - DNA, 22 bp, Homo sapiens
atacacagcgatgagaggaggc

SEQ ID NO: 7410386 - DNA, 22 bp, Homo sapiens
atacacagccattatgaattag

SEQ ID NO: 7410387 - DNA, 22 bp, Homo sapiens
atacacagccattatgaattag

SEQ ID NO: 7410388 - DNA, 19 bp, Homo sapiens
atacactaatataaaccac

SEQ ID NO: 7410389 - DNA, 22 bp, Homo sapiens
atacacgtgtgtgtacatgcac

SEQ ID NO: 7410390 - DNA, 22 bp, Homo sapiens
atacacatttgctagagatggg

SEQ ID NO: 7410391 - DNA, 22 bp, Homo sapiens
atacacatttgctagagatggg

SEQ ID NO: 7410392 - DNA, 22 bp, Homo sapiens
atacacgtgccatgttggtgtg

SEQ ID NO: 7410393 - DNA, 19 bp, Homo sapiens
atacactaatataaaccac

SEQ ID NO: 7410394 - DNA, 19 bp, Homo sapiens
atacactaatataaaccac

SEQ ID NO: 7410395 - DNA, 22 bp, Homo sapiens
atacactactaagcacagattg

SEQ ID NO: 7410396 - DNA, 22 bp, Homo sapiens
atacactactaagcacagattg

SEQ ID NO: 7410397 - DNA, 22 bp, Homo sapiens
atacactaatcatgtgctcagt

SEQ ID NO: 7410398 - DNA, 19 bp, Homo sapiens
atacactaatataaaccac

SEQ ID NO: 7410399 - DNA, 22 bp, Homo sapiens
atacactactaagcacagattg

SEQ ID NO: 7410400 - DNA, 22 bp, Homo sapiens
atacactgagtccttttctcat

SEQ ID NO: 7410401 - DNA, 22 bp, Homo sapiens
atacaatgataatagtacttta

SEQ ID NO: 7410402 - DNA, 22 bp, Homo sapiens
atacaatgggtgcaaagatgtg

SEQ ID NO: 7410403 - DNA, 22 bp, Homo sapiens
atacaatgggtgcaaagatgtg

SEQ ID NO: 7410404 - DNA, 22 bp, Homo sapiens
atacaatgggtgcaaagatgtg

SEQ ID NO: 7410405 - DNA, 22 bp, Homo sapiens
atacaatgggtgcaaagatgtg

SEQ ID NO: 7410406 - DNA, 22 bp, Homo sapiens
atacaatgggtgcaaagatgtg

SEQ ID NO: 7410407 - DNA, 22 bp, Homo sapiens
atacaatgattggttctcaccc

SEQ ID NO: 7410408 - DNA, 22 bp, Homo sapiens
atacaatgattggttctcaccc

SEQ ID NO: 7410409 - DNA, 22 bp, Homo sapiens
atacaatgattggttctcaccc

SEQ ID NO: 7410410 - DNA, 22 bp, Homo sapiens
atacaatgataatagtacttta

SEQ ID NO: 7410411 - DNA, 22 bp, Homo sapiens
atacaattattctgcagatatt

SEQ ID NO: 7410412 - DNA, 22 bp, Homo sapiens
atacaattattctgcagatatt

SEQ ID NO: 7410413 - DNA, 22 bp, Homo sapiens
atacacacatatgtgagttttg

SEQ ID NO: 7410414 - DNA, 22 bp, Homo sapiens
atacaattattctgcagatatt

SEQ ID NO: 7410415 - DNA, 22 bp, Homo sapiens
atacacaattgtgtttttatga

SEQ ID NO: 7410416 - DNA, 22 bp, Homo sapiens
atacacaattgtgtttttatga

SEQ ID NO: 7410417 - DNA, 22 bp, Homo sapiens
atacaatcatcattatattccc

SEQ ID NO: 7410418 - DNA, 22 bp, Homo sapiens
atacaatcatcattatattccc

SEQ ID NO: 7410419 - DNA, 20 bp, Homo sapiens
atacaatcatgaggaaaaag

SEQ ID NO: 7410420 - DNA, 22 bp, Homo sapiens
atacaatccagccattgccaca

SEQ ID NO: 7410421 - DNA, 22 bp, Homo sapiens
atacaatctagtctgtcagcaa

SEQ ID NO: 7410422 - DNA, 22 bp, Homo sapiens
atacaatctagtctgtcagcaa

SEQ ID NO: 7410423 - DNA, 22 bp, Homo sapiens
atacaatagtgtttgttttgag

SEQ ID NO: 7410424 - DNA, 22 bp, Homo sapiens
atacaatagtgtttgttttgag

SEQ ID NO: 7410425 - DNA, 22 bp, Homo sapiens
atacaatgacccgggtccaagg

SEQ ID NO: 7410426 - DNA, 22 bp, Homo sapiens
atacaatgaagtatagatgaaa

SEQ ID NO: 7410427 - DNA, 22 bp, Homo sapiens
atacaatgataatagtacttta

SEQ ID NO: 7410428 - DNA, 22 bp, Homo sapiens
atacaatgataatagtacttta

SEQ ID NO: 7410429 - DNA, 22 bp, Homo sapiens
atacaatgaagtatagatgaaa

SEQ ID NO: 7410430 - DNA, 22 bp, Homo sapiens
atacaatgaagtatagatgaaa

SEQ ID NO: 7410431 - DNA, 22 bp, Homo sapiens
atacaatgaagtatagatgaaa

SEQ ID NO: 7410432 - DNA, 22 bp, Homo sapiens
ataagctttgctggagagacct

SEQ ID NO: 7410433 - DNA, 22 bp, Homo sapiens
ataagctgtactctataaatgt

SEQ ID NO: 7410434 - DNA, 22 bp, Homo sapiens
ataacagagagctactgaactg

SEQ ID NO: 7410435 - DNA, 22 bp, Homo sapiens
ataacagagagctactgaactg

SEQ ID NO: 7410436 - DNA, 22 bp, Homo sapiens
ataacagagagctactgaactg

SEQ ID NO: 7410437 - DNA, 22 bp, Homo sapiens
ataacagagagctactgaactg

SEQ ID NO: 7410438 - DNA, 22 bp, Homo sapiens
ataaggaagatgtcctcatctg

SEQ ID NO: 7410439 - DNA, 22 bp, Homo sapiens
ataaggaacctgggcttaagag

SEQ ID NO: 7410440 - DNA, 22 bp, Homo sapiens
ataaggaacctgggcttaagag

SEQ ID NO: 7410441 - DNA, 22 bp, Homo sapiens
ataaggaagatgtcctcatctg

SEQ ID NO: 7410442 - DNA, 22 bp, Homo sapiens
ataaggaagatgtcctcatctg

SEQ ID NO: 7410443 - DNA, 22 bp, Homo sapiens
ataaggaacctgggcttaagag

SEQ ID NO: 7410444 - DNA, 22 bp, Homo sapiens
ataaggaacctgggcttaagag

SEQ ID NO: 7410445 - DNA, 22 bp, Homo sapiens
ataaggaaatgaaactctaata

SEQ ID NO: 7410446 - DNA, 22 bp, Homo sapiens
ataaggaaatgaaactctaata

SEQ ID NO: 7410447 - DNA, 22 bp, Homo sapiens
ataaggaaatgaaactctaata

SEQ ID NO: 7410448 - DNA, 22 bp, Homo sapiens
ataaggaaaattggagaaattg

SEQ ID NO: 7410449 - DNA, 22 bp, Homo sapiens
ataaggaaatgaaactctaata

SEQ ID NO: 7410450 - DNA, 22 bp, Homo sapiens
ataaggaaaattggagaaattg

SEQ ID NO: 7410451 - DNA, 22 bp, Homo sapiens
ataaggaaaattggagaaattg

SEQ ID NO: 7410452 - DNA, 22 bp, Homo sapiens
ataaggaaaattggagaaattg

SEQ ID NO: 7410453 - DNA, 22 bp, Homo sapiens
ataaggaaaattggagaaattg

SEQ ID NO: 7410454 - DNA, 22 bp, Homo sapiens
ataaggaatgatgtatcagttt

SEQ ID NO: 7410455 - DNA, 22 bp, Homo sapiens
ataaggaatgatgtatcagttt

SEQ ID NO: 7410456 - DNA, 22 bp, Homo sapiens
ataaggaatgatgtatcagttt

SEQ ID NO: 7410457 - DNA, 22 bp, Homo sapiens
ataaggaagttgcagaagtgga

SEQ ID NO: 7410458 - DNA, 22 bp, Homo sapiens
ataaggaagttgcagaagtgga

SEQ ID NO: 7410459 - DNA, 22 bp, Homo sapiens
ataaggaagttgcagaagtgga

SEQ ID NO: 7410460 - DNA, 22 bp, Homo sapiens
ataaggaagttgcagaagtgga

SEQ ID NO: 7410461 - DNA, 22 bp, Homo sapiens
ataaggaagttgcagaagtgga

SEQ ID NO: 7410462 - DNA, 22 bp, Homo sapiens
ataaggaatttagaatagggaa

SEQ ID NO: 7410463 - DNA, 22 bp, Homo sapiens
ataaggaatttagaatagggaa

SEQ ID NO: 7410464 - DNA, 22 bp, Homo sapiens
ataaggaatttagaatagggaa

SEQ ID NO: 7410465 - DNA, 22 bp, Homo sapiens
ataaggcacacatagatagggt

SEQ ID NO: 7410466 - DNA, 19 bp, Homo sapiens
ataaggcaattggatttgg

SEQ ID NO: 7410467 - DNA, 22 bp, Homo sapiens
ataaggcacacatagatagggt

SEQ ID NO: 7410468 - DNA, 22 bp, Homo sapiens
ataaggcagaaatgattctagt

SEQ ID NO: 7410469 - DNA, 22 bp, Homo sapiens
ataaggcagaaatagggaaagt

SEQ ID NO: 7410470 - DNA, 20 bp, Homo sapiens
atacaaagagattgatgtat

SEQ ID NO: 7410471 - DNA, 22 bp, Homo sapiens
atacaaagacaaatctcaatct

SEQ ID NO: 7410472 - DNA, 22 bp, Homo sapiens
ataaggtataaggcctattttt

SEQ ID NO: 7410473 - DNA, 22 bp, Homo sapiens
ataaggtatgaaaagtaaatgg

SEQ ID NO: 7410474 - DNA, 22 bp, Homo sapiens
ataaggtatgaaaagtaaatgg

SEQ ID NO: 7410475 - DNA, 22 bp, Homo sapiens
atacaaagacaaatctcaatct

SEQ ID NO: 7410476 - DNA, 22 bp, Homo sapiens
atacaaagacaaatctcaatct

SEQ ID NO: 7410477 - DNA, 17 bp, Homo sapiens
atacaaagccataaacc

SEQ ID NO: 7410478 - DNA, 22 bp, Homo sapiens
atacaagttgtgataatgtaaa

SEQ ID NO: 7410479 - DNA, 22 bp, Homo sapiens
atacaagttgcccaaatgatta

SEQ ID NO: 7410480 - DNA, 22 bp, Homo sapiens
atacaagttgtgataatgtaaa

SEQ ID NO: 7410481 - DNA, 22 bp, Homo sapiens
atacaagttgtgataatgtaaa

SEQ ID NO: 7410482 - DNA, 22 bp, Homo sapiens
atacaagttgtgataatgtaaa

SEQ ID NO: 7410483 - DNA, 22 bp, Homo sapiens
atacaagttgtgataatgtaaa

SEQ ID NO: 7410484 - DNA, 22 bp, Homo sapiens
atacaagttgtgataatgtaaa

SEQ ID NO: 7410485 - DNA, 22 bp, Homo sapiens
atacaagttgtgataatgtaaa

SEQ ID NO: 7410486 - DNA, 22 bp, Homo sapiens
ataaggtagcaagcacagtcct

SEQ ID NO: 7410487 - DNA, 22 bp, Homo sapiens
ataaggtataaggcctattttt

SEQ ID NO: 7410488 - DNA, 22 bp, Homo sapiens
ataaggtataaggcctattttt

SEQ ID NO: 7410489 - DNA, 22 bp, Homo sapiens
ataaggtataaggcctattttt

SEQ ID NO: 7410490 - DNA, 22 bp, Homo sapiens
ataaggcttctggctgctttct

SEQ ID NO: 7410491 - DNA, 22 bp, Homo sapiens
ataaggctttattagctattgt

SEQ ID NO: 7410492 - DNA, 22 bp, Homo sapiens
ataaggtaagggtattgtcaga

SEQ ID NO: 7410493 - DNA, 22 bp, Homo sapiens
ataaggcatatagtcacttttt

SEQ ID NO: 7410494 - DNA, 22 bp, Homo sapiens
ataaggctgaaagcagggagct

SEQ ID NO: 7410495 - DNA, 21 bp, Homo sapiens
ataaggctgctggatttgtta

SEQ ID NO: 7410496 - DNA, 20 bp, Homo sapiens
ataaggctgtgatagtctga

SEQ ID NO: 7410497 - DNA, 22 bp, Homo sapiens
ataaggcttctggctgctttct

SEQ ID NO: 7410498 - DNA, 22 bp, Homo sapiens
ataaggcttaaaccttgttgcc

SEQ ID NO: 7410499 - DNA, 23 bp, Homo sapiens
ataaggcataaaggtacattgga

SEQ ID NO: 7410500 - DNA, 23 bp, Homo sapiens
ataaggcataaaggtacattgga

SEQ ID NO: 7410501 - DNA, 22 bp, Homo sapiens
ataaggcatatagtcacttttt

SEQ ID NO: 7410502 - DNA, 22 bp, Homo sapiens
ataaggcagtcccttaacaagg

SEQ ID NO: 7410503 - DNA, 22 bp, Homo sapiens
ataaggcagtcactggaatgtt

SEQ ID NO: 7410504 - DNA, 22 bp, Homo sapiens
ataaggcagtcactggaatgtt

SEQ ID NO: 7410505 - DNA, 19 bp, Homo sapiens
ataaggcaggaggaaattt

SEQ ID NO: 7410506 - DNA, 22 bp, Homo sapiens
atagaacataattctcagccct

SEQ ID NO: 7410507 - DNA, 19 bp, Homo sapiens
atagaacctgcagtttcaa

SEQ ID NO: 7410508 - DNA, 22 bp, Homo sapiens
atagaactccatccctctgacc

SEQ ID NO: 7410509 - DNA, 22 bp, Homo sapiens
atagaacagggcactgtcatga

SEQ ID NO: 7410510 - DNA, 22 bp, Homo sapiens
atagaacagggcactgtcatga

SEQ ID NO: 7410511 - DNA, 22 bp, Homo sapiens
atagaacagaaacagatgcaca

SEQ ID NO: 7410512 - DNA, 22 bp, Homo sapiens
atagaacaggggcaggagcatt

SEQ ID NO: 7410513 - DNA, 22 bp, Homo sapiens
atagaacaggggcaggagcatt

SEQ ID NO: 7410514 - DNA, 22 bp, Homo sapiens
atagaacagaaacagatgcaca

SEQ ID NO: 7410515 - DNA, 22 bp, Homo sapiens
atagaacagaaacagatgcaca

SEQ ID NO: 7410516 - DNA, 22 bp, Homo sapiens
atagaacagaaacagatgcaca

SEQ ID NO: 7410517 - DNA, 22 bp, Homo sapiens
atagaacagaaacagatgcaca

SEQ ID NO: 7410518 - DNA, 22 bp, Homo sapiens
atagaacagaaacagatgcaca

SEQ ID NO: 7410519 - DNA, 22 bp, Homo sapiens
atagaacagaaacagatgcaca

SEQ ID NO: 7410520 - DNA, 22 bp, Homo sapiens
atagaacagaaacagatgcaca

SEQ ID NO: 7410521 - DNA, 21 bp, Homo sapiens
atagaacaccaggcatatata

SEQ ID NO: 7410522 - DNA, 21 bp, Homo sapiens
atagaacaccaggcatatata

SEQ ID NO: 7410523 - DNA, 22 bp, Homo sapiens
atagaacaaggtagacagcttt

SEQ ID NO: 7410524 - DNA, 22 bp, Homo sapiens
atagaacaaggtagacagcttt

SEQ ID NO: 7410525 - DNA, 22 bp, Homo sapiens
atagaagtggtctgcatttgca

SEQ ID NO: 7410526 - DNA, 20 bp, Homo sapiens
atagaagtattatgtaatgt

SEQ ID NO: 7410527 - DNA, 20 bp, Homo sapiens
atagaagtattatgtaatgt

SEQ ID NO: 7410528 - DNA, 20 bp, Homo sapiens
atagaagtattatgtaatgt

SEQ ID NO: 7410529 - DNA, 22 bp, Homo sapiens
atagaagtatcaagatcttgaa

SEQ ID NO: 7410530 - DNA, 22 bp, Homo sapiens
atagaagtatcaagatcttgaa

SEQ ID NO: 7410531 - DNA, 22 bp, Homo sapiens
atagaagtatcaagatcttgaa

SEQ ID NO: 7410532 - DNA, 22 bp, Homo sapiens
atagaagcttttaaataacagg

SEQ ID NO: 7410533 - DNA, 22 bp, Homo sapiens
atagaagcaagaacagaatgga

SEQ ID NO: 7410534 - DNA, 22 bp, Homo sapiens
atagaagcaagaacagaatgga

SEQ ID NO: 7410535 - DNA, 22 bp, Homo sapiens
atagaagcaagaacagaatgga

SEQ ID NO: 7410536 - DNA, 22 bp, Homo sapiens
atagaactcgggctttggaatc

SEQ ID NO: 7410537 - DNA, 22 bp, Homo sapiens
atagaactcgggctttggaatc

SEQ ID NO: 7410538 - DNA, 22 bp, Homo sapiens
atagaagatagcttttgtttct

SEQ ID NO: 7410539 - DNA, 22 bp, Homo sapiens
atacacttcatgttttcatctg

SEQ ID NO: 7410540 - DNA, 22 bp, Homo sapiens
atacacttcatgttttcatctg

SEQ ID NO: 7410541 - DNA, 22 bp, Homo sapiens
atacacttcatgttttcatctg

SEQ ID NO: 7410542 - DNA, 22 bp, Homo sapiens
atacactgttcactagatcttc

SEQ ID NO: 7410543 - DNA, 22 bp, Homo sapiens
atacactgttcactagatcttc

SEQ ID NO: 7410544 - DNA, 22 bp, Homo sapiens
atacactgttcactagatcttc

SEQ ID NO: 7410545 - DNA, 22 bp, Homo sapiens
atacacttccaaatattgatta

SEQ ID NO: 7410546 - DNA, 22 bp, Homo sapiens
atacacttccaaatattgatta

SEQ ID NO: 7410547 - DNA, 22 bp, Homo sapiens
atacacttccaaatattgatta

SEQ ID NO: 7410548 - DNA, 22 bp, Homo sapiens
atacactgatctttttatgggg

SEQ ID NO: 7410549 - DNA, 22 bp, Homo sapiens
atacactgatctttttatgggg

SEQ ID NO: 7410550 - DNA, 22 bp, Homo sapiens
atacactgctgccacacagctg

SEQ ID NO: 7410551 - DNA, 22 bp, Homo sapiens
atacactgctgccacacagctg

SEQ ID NO: 7410552 - DNA, 22 bp, Homo sapiens
atacactggacatcattgcatt

SEQ ID NO: 7410553 - DNA, 22 bp, Homo sapiens
atacactggcctttgcagagcc

SEQ ID NO: 7410554 - DNA, 22 bp, Homo sapiens
atacactggacatcattgcatt

SEQ ID NO: 7410555 - DNA, 22 bp, Homo sapiens
atacactggtttatgatattgt

SEQ ID NO: 7410556 - DNA, 22 bp, Homo sapiens
atacactggtttatgatattgt

SEQ ID NO: 7410557 - DNA, 22 bp, Homo sapiens
atacactggtttatgatattgt

SEQ ID NO: 7410558 - DNA, 22 bp, Homo sapiens
atacactggtttatgatattgt

SEQ ID NO: 7410559 - DNA, 22 bp, Homo sapiens
atacactggtttatgatattgt

SEQ ID NO: 7410560 - DNA, 22 bp, Homo sapiens
atacactggacatcattgcatt

SEQ ID NO: 7410561 - DNA, 20 bp, Homo sapiens
atacacttgcccagcttgtg

SEQ ID NO: 7410562 - DNA, 22 bp, Homo sapiens
atactgtttctcttctacatga

SEQ ID NO: 7410563 - DNA, 22 bp, Homo sapiens
atactgtttctcttctacatga

SEQ ID NO: 7410564 - DNA, 22 bp, Homo sapiens
atactgttggctttggtgatgg

SEQ ID NO: 7410565 - DNA, 20 bp, Homo sapiens
atacacttgcccagcttgtg

SEQ ID NO: 7410566 - DNA, 20 bp, Homo sapiens
atacacttgcccagcttgtg

SEQ ID NO: 7410567 - DNA, 22 bp, Homo sapiens
atacacttgacctggagtgaag

SEQ ID NO: 7410568 - DNA, 20 bp, Homo sapiens
atacacttgcccagcttgtg

SEQ ID NO: 7410569 - DNA, 22 bp, Homo sapiens
atacacttgacctggagtgaag

SEQ ID NO: 7410570 - DNA, 22 bp, Homo sapiens
atacacttgacctggagtgaag

SEQ ID NO: 7410571 - DNA, 22 bp, Homo sapiens
atactgttttgtgacttatctt

SEQ ID NO: 7410572 - DNA, 22 bp, Homo sapiens
atacttacttttcttcagacta

SEQ ID NO: 7410573 - DNA, 22 bp, Homo sapiens
atagaaatgtattttggactag

SEQ ID NO: 7410574 - DNA, 22 bp, Homo sapiens
actttagaaaagcatccataga

SEQ ID NO: 7410575 - DNA, 22 bp, Homo sapiens
actttactccccaacataaatg

SEQ ID NO: 7410576 - DNA, 22 bp, Homo sapiens
actttagaaaaggaacagagga

SEQ ID NO: 7410577 - DNA, 22 bp, Homo sapiens
actttagagaaatgtagaagta

SEQ ID NO: 7410578 - DNA, 22 bp, Homo sapiens
atagatgtgtgtaagtacataa

SEQ ID NO: 7410579 - DNA, 22 bp, Homo sapiens
atagcatataagttataaaact

SEQ ID NO: 7410580 - DNA, 22 bp, Homo sapiens
atagatgtgtgtaagtacataa

SEQ ID NO: 7410581 - DNA, 22 bp, Homo sapiens
atagatgtcattgtcatccatc

SEQ ID NO: 7410582 - DNA, 22 bp, Homo sapiens
atagatgtacgtatgtaaatca

SEQ ID NO: 7410583 - DNA, 22 bp, Homo sapiens
atagcatggcctgtgacacttt

SEQ ID NO: 7410584 - DNA, 22 bp, Homo sapiens
atagcatggcctgtgacacttt

SEQ ID NO: 7410585 - DNA, 23 bp, Homo sapiens
actttagataaattatgtgcaca

SEQ ID NO: 7410586 - DNA, 23 bp, Homo sapiens
actttagataaattatgtgcaca

SEQ ID NO: 7410587 - DNA, 22 bp, Homo sapiens
atagatgtacgtatgtaaatca

SEQ ID NO: 7410588 - DNA, 22 bp, Homo sapiens
atagatgtacgtatgtaaatca

SEQ ID NO: 7410589 - DNA, 22 bp, Homo sapiens
atagatccagaaaatttattat

SEQ ID NO: 7410590 - DNA, 22 bp, Homo sapiens
actttactccccaacataaatg

SEQ ID NO: 7410591 - DNA, 22 bp, Homo sapiens
actttactccccaacataaatg

SEQ ID NO: 7410592 - DNA, 22 bp, Homo sapiens
actttactcaacaaatatttat

SEQ ID NO: 7410593 - DNA, 22 bp, Homo sapiens
actttactacatccacagatgg

SEQ ID NO: 7410594 - DNA, 22 bp, Homo sapiens
actttactacatccacagatgg

SEQ ID NO: 7410595 - DNA, 22 bp, Homo sapiens
actttacatttgatctctctaa

SEQ ID NO: 7410596 - DNA, 22 bp, Homo sapiens
actttacatttgatctctctaa

SEQ ID NO: 7410597 - DNA, 22 bp, Homo sapiens
actttacaggcacttcaagtat

SEQ ID NO: 7410598 - DNA, 22 bp, Homo sapiens
actttacaggcacttcaagtat

SEQ ID NO: 7410599 - DNA, 22 bp, Homo sapiens
actttacaggcacttcaagtat

SEQ ID NO: 7410600 - DNA, 22 bp, Homo sapiens
actttacagatggtttcctgac

SEQ ID NO: 7410601 - DNA, 22 bp, Homo sapiens
actttacaggcacttcaagtat

SEQ ID NO: 7410602 - DNA, 22 bp, Homo sapiens
actttacaggcacttcaagtat

SEQ ID NO: 7410603 - DNA, 22 bp, Homo sapiens
atagaatagcatagaaaattga

SEQ ID NO: 7410604 - DNA, 22 bp, Homo sapiens
atagaatagcatagaaaattga

SEQ ID NO: 7410605 - DNA, 20 bp, Homo sapiens
actttacagagaagactgac

SEQ ID NO: 7410606 - DNA, 22 bp, Homo sapiens
atagaatagcatagaaaattga

SEQ ID NO: 7410607 - DNA, 22 bp, Homo sapiens
atagaatagcatagaaaattga

SEQ ID NO: 7410608 - DNA, 22 bp, Homo sapiens
atagaatagcatagaaaattga

SEQ ID NO: 7410609 - DNA, 22 bp, Homo sapiens
atagaatagcatagaaaattga

SEQ ID NO: 7410610 - DNA, 22 bp, Homo sapiens
atagaagtggtctgcatttgca

SEQ ID NO: 7410611 - DNA, 22 bp, Homo sapiens
atagaagtggtctgcatttgca

SEQ ID NO: 7410612 - DNA, 22 bp, Homo sapiens
atagaatacatttcatggagat

SEQ ID NO: 7410613 - DNA, 22 bp, Homo sapiens
atagaatacatttcatggagat

SEQ ID NO: 7410614 - DNA, 22 bp, Homo sapiens
atagctttcttaaatatataaa

SEQ ID NO: 7410615 - DNA, 22 bp, Homo sapiens
atagctttttgtcatagagtct

SEQ ID NO: 7410616 - DNA, 22 bp, Homo sapiens
atagctttttgtcatagagtct

SEQ ID NO: 7410617 - DNA, 22 bp, Homo sapiens
atagctttcttaaatatataaa

SEQ ID NO: 7410618 - DNA, 22 bp, Homo sapiens
atagctttcttaaatatataaa

SEQ ID NO: 7410619 - DNA, 22 bp, Homo sapiens
atagctttacagaagagtttag

SEQ ID NO: 7410620 - DNA, 22 bp, Homo sapiens
atagctttcttaaatatataaa

SEQ ID NO: 7410621 - DNA, 22 bp, Homo sapiens
atagctttcttaaatatataaa

SEQ ID NO: 7410622 - DNA, 22 bp, Homo sapiens
atagctttcttaaatatataaa

SEQ ID NO: 7410623 - DNA, 22 bp, Homo sapiens
ataggaaagaaaattatgtagg

SEQ ID NO: 7410624 - DNA, 22 bp, Homo sapiens
atagctttttgtcatagagtct

SEQ ID NO: 7410625 - DNA, 22 bp, Homo sapiens
atagctttgagggctccttagg

SEQ ID NO: 7410626 - DNA, 22 bp, Homo sapiens
atagctttgagggctccttagg

SEQ ID NO: 7410627 - DNA, 22 bp, Homo sapiens
atagctttttgtcatagagtct

SEQ ID NO: 7410628 - DNA, 22 bp, Homo sapiens
ataggaaagaaaattatgtagg

SEQ ID NO: 7410629 - DNA, 20 bp, Homo sapiens
ataggaaagggaggggcttt

SEQ ID NO: 7410630 - DNA, 20 bp, Homo sapiens
ataggaaagggaggggcttt

SEQ ID NO: 7410631 - DNA, 22 bp, Homo sapiens
ataggaaagaatggagggtggg

SEQ ID NO: 7410632 - DNA, 20 bp, Homo sapiens
ataggaaagggaggggcttt

SEQ ID NO: 7410633 - DNA, 22 bp, Homo sapiens
ataggaaagaaaattatgtagg

SEQ ID NO: 7410634 - DNA, 22 bp, Homo sapiens
atagctgtagaatgtatacaca

SEQ ID NO: 7410635 - DNA, 22 bp, Homo sapiens
atagctaccatgttggacagta

SEQ ID NO: 7410636 - DNA, 22 bp, Homo sapiens
atagccaggagatgatggggga

SEQ ID NO: 7410637 - DNA, 22 bp, Homo sapiens
atagccagcatatagcagggag

SEQ ID NO: 7410638 - DNA, 22 bp, Homo sapiens
atagccagcatatagcagggag

SEQ ID NO: 7410639 - DNA, 22 bp, Homo sapiens
atagctgttgccaatttccatg

SEQ ID NO: 7410640 - DNA, 22 bp, Homo sapiens
atagcttacaggtgatatcagc

SEQ ID NO: 7410641 - DNA, 22 bp, Homo sapiens
atagcttcagaattgagatatc

SEQ ID NO: 7410642 - DNA, 22 bp, Homo sapiens
atagctgtttttaggccaaata

SEQ ID NO: 7410643 - DNA, 19 bp, Homo sapiens
atagcttgtcagctgctcc

SEQ ID NO: 7410644 - DNA, 22 bp, Homo sapiens
atagctttacagaagagtttag

SEQ ID NO: 7410645 - DNA, 22 bp, Homo sapiens
ataggagatcaatatgcaattt

SEQ ID NO: 7410646 - DNA, 22 bp, Homo sapiens
ataggagccataaataaaatct

SEQ ID NO: 7410647 - DNA, 22 bp, Homo sapiens
atagtgtctttcttcacaggca

SEQ ID NO: 7410648 - DNA, 22 bp, Homo sapiens
atagtgtgtaaagtgcagtgat

SEQ ID NO: 7410649 - DNA, 22 bp, Homo sapiens
atagtgtgtaaagtgcagtgat

SEQ ID NO: 7410650 - DNA, 22 bp, Homo sapiens
atagtgtgactgaggagttgaa

SEQ ID NO: 7410651 - DNA, 22 bp, Homo sapiens
atagtggttgtggttctggcca

SEQ ID NO: 7410652 - DNA, 22 bp, Homo sapiens
atagtgtctttcttcacaggca

SEQ ID NO: 7410653 - DNA, 22 bp, Homo sapiens
atagtgtgactgaggagttgaa

SEQ ID NO: 7410654 - DNA, 22 bp, Homo sapiens
ataggacaagactgaccctggt

SEQ ID NO: 7410655 - DNA, 22 bp, Homo sapiens
ataggacaagactgaccctggt

SEQ ID NO: 7410656 - DNA, 22 bp, Homo sapiens
ataggaaatcgctattaaccta

SEQ ID NO: 7410657 - DNA, 22 bp, Homo sapiens
ataggaaatcgctattaaccta

SEQ ID NO: 7410658 - DNA, 22 bp, Homo sapiens
ataggaacctgaaaagctgtgc

SEQ ID NO: 7410659 - DNA, 22 bp, Homo sapiens
ataggaacctgaaaagctgtgc

SEQ ID NO: 7410660 - DNA, 22 bp, Homo sapiens
ataggactttgtatcaggatga

SEQ ID NO: 7410661 - DNA, 22 bp, Homo sapiens
ataggagactgttcttggcttc

SEQ ID NO: 7410662 - DNA, 22 bp, Homo sapiens
ataggactgagattgtcagttt

SEQ ID NO: 7410663 - DNA, 22 bp, Homo sapiens
atagtgttacccttcttaaagt

SEQ ID NO: 7410664 - DNA, 22 bp, Homo sapiens
atagtgtgttagtgacataggc

SEQ ID NO: 7410665 - DNA, 22 bp, Homo sapiens
atagtgtgtggtataggtagag

SEQ ID NO: 7410666 - DNA, 22 bp, Homo sapiens
atagtgttacccttcttaaagt

SEQ ID NO: 7410667 - DNA, 22 bp, Homo sapiens
atagtgttagagccagtatgtt

SEQ ID NO: 7410668 - DNA, 22 bp, Homo sapiens
atagtgtgtggtataggtagag

SEQ ID NO: 7410669 - DNA, 22 bp, Homo sapiens
atagtgttagagccagtatgtt

SEQ ID NO: 7410670 - DNA, 22 bp, Homo sapiens
atagtgttgatagcagtggagt

SEQ ID NO: 7410671 - DNA, 22 bp, Homo sapiens
atagttatgctctagacaagaa

SEQ ID NO: 7410672 - DNA, 22 bp, Homo sapiens
atagttatgctctagacaagaa

SEQ ID NO: 7410673 - DNA, 22 bp, Homo sapiens
atagttataagaaaacgttgaa

SEQ ID NO: 7410674 - DNA, 22 bp, Homo sapiens
atagttatgctctagacaagaa

SEQ ID NO: 7410675 - DNA, 22 bp, Homo sapiens
atagttacatacagaaatattt

SEQ ID NO: 7410676 - DNA, 22 bp, Homo sapiens
atagttacatacagaaatattt

SEQ ID NO: 7410677 - DNA, 22 bp, Homo sapiens
atagtgttgtatgtacagtctg

SEQ ID NO: 7410678 - DNA, 22 bp, Homo sapiens
atagtgttgtatgtacagtctg

SEQ ID NO: 7410679 - DNA, 22 bp, Homo sapiens
atagtgttgtatgtacagtctg

SEQ ID NO: 7410680 - DNA, 22 bp, Homo sapiens
atagtgttttacttagacttct

SEQ ID NO: 7410681 - DNA, 22 bp, Homo sapiens
atagtgttttacttagacttct

SEQ ID NO: 7410682 - DNA, 22 bp, Homo sapiens
atagttacaaagactttttaaa

SEQ ID NO: 7410683 - DNA, 22 bp, Homo sapiens
atagttacaaagactttttaaa

SEQ ID NO: 7410684 - DNA, 22 bp, Homo sapiens
agaaaaggattgatggatcaga

SEQ ID NO: 7410685 - DNA, 22 bp, Homo sapiens
agaaaaggcttgaagaggtttt

SEQ ID NO: 7410686 - DNA, 22 bp, Homo sapiens
agaaaaggcttgaagaggtttt

SEQ ID NO: 7410687 - DNA, 22 bp, Homo sapiens
agaaaaggcttgaagaggtttt

SEQ ID NO: 7410688 - DNA, 22 bp, Homo sapiens
agaaaagggcaggagggataca

SEQ ID NO: 7410689 - DNA, 22 bp, Homo sapiens
agaaaagggcaggagggataca

SEQ ID NO: 7410690 - DNA, 22 bp, Homo sapiens
agaaaagggcaggagggataca

SEQ ID NO: 7410691 - DNA, 22 bp, Homo sapiens
agaaaagggcaggagggataca

SEQ ID NO: 7410692 - DNA, 22 bp, Homo sapiens
agaaaaggattgatggatcaga

SEQ ID NO: 7410693 - DNA, 22 bp, Homo sapiens
agaaaaggattgatggatcaga

SEQ ID NO: 7410694 - DNA, 22 bp, Homo sapiens
agaaaaggattgatggatcaga

SEQ ID NO: 7410695 - DNA, 22 bp, Homo sapiens
agaaaaggattgatggatcaga

SEQ ID NO: 7410696 - DNA, 22 bp, Homo sapiens
agaaaaggattgatggatcaga

SEQ ID NO: 7410697 - DNA, 22 bp, Homo sapiens
agaaaaggattgatggatcaga

SEQ ID NO: 7410698 - DNA, 23 bp, Homo sapiens
agaaaagcttggacacatggcct

SEQ ID NO: 7410699 - DNA, 23 bp, Homo sapiens
agaaaagcttggacacatggcct

SEQ ID NO: 7410700 - DNA, 23 bp, Homo sapiens
agaaaagcttggacacatggcct

SEQ ID NO: 7410701 - DNA, 23 bp, Homo sapiens
agaaaagcttggacacatggcct

SEQ ID NO: 7410702 - DNA, 22 bp, Homo sapiens
agaaaagaggctttctaagcat

SEQ ID NO: 7410703 - DNA, 22 bp, Homo sapiens
agaaaagaggctttctaagcat

SEQ ID NO: 7410704 - DNA, 22 bp, Homo sapiens
agaaaagaggctttctaagcat

SEQ ID NO: 7410705 - DNA, 22 bp, Homo sapiens
agaaaagaggctttctaagcat

SEQ ID NO: 7410706 - DNA, 22 bp, Homo sapiens
agaaaagaggctttctaagcat

SEQ ID NO: 7410707 - DNA, 22 bp, Homo sapiens
agaaaagcggtcaggaccctca

SEQ ID NO: 7410708 - DNA, 22 bp, Homo sapiens
agaaaagaggctttctaagcat

SEQ ID NO: 7410709 - DNA, 22 bp, Homo sapiens
agaaaagcggtcaggaccctca

SEQ ID NO: 7410710 - DNA, 23 bp, Homo sapiens
agaaaagcttggacacatggcct

SEQ ID NO: 7410711 - DNA, 22 bp, Homo sapiens
agaaaagcggtcaggaccctca

SEQ ID NO: 7410712 - DNA, 17 bp, Homo sapiens
agaaaagagaccagcag

SEQ ID NO: 7410713 - DNA, 17 bp, Homo sapiens
agaaaagagaccagcag

SEQ ID NO: 7410714 - DNA, 22 bp, Homo sapiens
agaaaagaggctttctaagcat

SEQ ID NO: 7410715 - DNA, 22 bp, Homo sapiens
agaaaagaggctttctaagcat

SEQ ID NO: 7410716 - DNA, 22 bp, Homo sapiens
agaaaacttgctcgagcctgtt

SEQ ID NO: 7410717 - DNA, 22 bp, Homo sapiens
agaaaacttgctcgagcctgtt

SEQ ID NO: 7410718 - DNA, 22 bp, Homo sapiens
agaaaaatcttggcgcttgtct

SEQ ID NO: 7410719 - DNA, 20 bp, Homo sapiens
agaaaaagtgtggaaatttc

SEQ ID NO: 7410720 - DNA, 20 bp, Homo sapiens
agaaaaagtgtggaaatttc

SEQ ID NO: 7410721 - DNA, 20 bp, Homo sapiens
agaaaaagtgtggaaatttc

SEQ ID NO: 7410722 - DNA, 20 bp, Homo sapiens
agaaaaagtgtggaaatttc

SEQ ID NO: 7410723 - DNA, 20 bp, Homo sapiens
agaaaaagtgtggaaatttc

SEQ ID NO: 7410724 - DNA, 20 bp, Homo sapiens
agaaaaagtgtggaaatttc

SEQ ID NO: 7410725 - DNA, 20 bp, Homo sapiens
agaaaaagtgtggaaatttc

SEQ ID NO: 7410726 - DNA, 20 bp, Homo sapiens
agaaaaagtgtggaaatttc

SEQ ID NO: 7410727 - DNA, 20 bp, Homo sapiens
agaaaaagtgtggaaatttc

SEQ ID NO: 7410728 - DNA, 20 bp, Homo sapiens
agaaaaagtgtggaaatttc

SEQ ID NO: 7410729 - DNA, 20 bp, Homo sapiens
agaaaaagtgtggaaatttc

SEQ ID NO: 7410730 - DNA, 17 bp, Homo sapiens
agaaaagagaccagcag

SEQ ID NO: 7410731 - DNA, 17 bp, Homo sapiens
agaaaagagaccagcag

SEQ ID NO: 7410732 - DNA, 17 bp, Homo sapiens
agaaaagagaccagcag

SEQ ID NO: 7410733 - DNA, 22 bp, Homo sapiens
agaaaacttgtcacagctctca

SEQ ID NO: 7410734 - DNA, 22 bp, Homo sapiens
agaaaacttgtcacagctctca

SEQ ID NO: 7410735 - DNA, 22 bp, Homo sapiens
agaaaacttgctcgagcctgtt

SEQ ID NO: 7410736 - DNA, 22 bp, Homo sapiens
agaaaacttgtcacagctctca

SEQ ID NO: 7410737 - DNA, 22 bp, Homo sapiens
agaaaacttgctcgagcctgtt

SEQ ID NO: 7410738 - DNA, 22 bp, Homo sapiens
agaaaacttgtcacagctctca

SEQ ID NO: 7410739 - DNA, 22 bp, Homo sapiens
agaaaacttgtcacagctctca

SEQ ID NO: 7410740 - DNA, 22 bp, Homo sapiens
atagttggtccatgaaaaaagt

SEQ ID NO: 7410741 - DNA, 22 bp, Homo sapiens
atagttcttaagccatgttgct

SEQ ID NO: 7410742 - DNA, 22 bp, Homo sapiens
atagttggagttggaggttatg

SEQ ID NO: 7410743 - DNA, 22 bp, Homo sapiens
atagttctggatgtacttatag

SEQ ID NO: 7410744 - DNA, 22 bp, Homo sapiens
atagttctggatgtacttatag

SEQ ID NO: 7410745 - DNA, 22 bp, Homo sapiens
atagttctggatgtacttatag

SEQ ID NO: 7410746 - DNA, 22 bp, Homo sapiens
atagttctcactcagaatttga

SEQ ID NO: 7410747 - DNA, 22 bp, Homo sapiens
atagttctcactcagaatttga

SEQ ID NO: 7410748 - DNA, 23 bp, Homo sapiens
atagttctgcttagaaatcagtg

SEQ ID NO: 7410749 - DNA, 23 bp, Homo sapiens
atagttatgctgcatgcatgtac

SEQ ID NO: 7410750 - DNA, 23 bp, Homo sapiens
atagttatgctgcatgcatgtac

SEQ ID NO: 7410751 - DNA, 23 bp, Homo sapiens
atagttatgctgcatgcatgtac

SEQ ID NO: 7410752 - DNA, 22 bp, Homo sapiens
atagttatttctgtcactgtca

SEQ ID NO: 7410753 - DNA, 22 bp, Homo sapiens
atagttattagagaagctggta

SEQ ID NO: 7410754 - DNA, 22 bp, Homo sapiens
atagttatttctgtcactgtca

SEQ ID NO: 7410755 - DNA, 22 bp, Homo sapiens
atagttcctactttgcactaat

SEQ ID NO: 7410756 - DNA, 22 bp, Homo sapiens
atagttccagcatctttggtaa

SEQ ID NO: 7410757 - DNA, 22 bp, Homo sapiens
atagttctagacctatagttct

SEQ ID NO: 7410758 - DNA, 22 bp, Homo sapiens
atagttctagacctatagttct

SEQ ID NO: 7410759 - DNA, 22 bp, Homo sapiens
caattacttttgcaccaatata

SEQ ID NO: 7410760 - DNA, 22 bp, Homo sapiens
caattatatttagaatgataca

SEQ ID NO: 7410761 - DNA, 22 bp, Homo sapiens
caattatatttagaatgataca

SEQ ID NO: 7410762 - DNA, 22 bp, Homo sapiens
caattatatttagaatgataca

SEQ ID NO: 7410763 - DNA, 22 bp, Homo sapiens
caattagaggaggaagctcata

SEQ ID NO: 7410764 - DNA, 22 bp, Homo sapiens
caattatatttagaatgataca

SEQ ID NO: 7410765 - DNA, 22 bp, Homo sapiens
caattatatttagaatgataca

SEQ ID NO: 7410766 - DNA, 22 bp, Homo sapiens
caattatatttagaatgataca

SEQ ID NO: 7410767 - DNA, 22 bp, Homo sapiens
caattatatttagaatgataca

SEQ ID NO: 7410768 - DNA, 22 bp, Homo sapiens
caattatatttagaatgataca

SEQ ID NO: 7410769 - DNA, 22 bp, Homo sapiens
caattattcagtgacttaagag

SEQ ID NO: 7410770 - DNA, 22 bp, Homo sapiens
caattattcagtgacttaagag

SEQ ID NO: 7410771 - DNA, 22 bp, Homo sapiens
caattattcagtgacttaagag

SEQ ID NO: 7410772 - DNA, 22 bp, Homo sapiens
caattattcagtgacttaagag

SEQ ID NO: 7410773 - DNA, 22 bp, Homo sapiens
caattatatttagaatgataca

SEQ ID NO: 7410774 - DNA, 22 bp, Homo sapiens
caattattcagtgacttaagag

SEQ ID NO: 7410775 - DNA, 22 bp, Homo sapiens
caattattcagtgacttaagag

SEQ ID NO: 7410776 - DNA, 22 bp, Homo sapiens
caattattcagtgacttaagag

SEQ ID NO: 7410777 - DNA, 22 bp, Homo sapiens
caattacatttattgagcattc

SEQ ID NO: 7410778 - DNA, 22 bp, Homo sapiens
caattacatttattgagcattc

SEQ ID NO: 7410779 - DNA, 22 bp, Homo sapiens
caattacatttattgagcattc

SEQ ID NO: 7410780 - DNA, 22 bp, Homo sapiens
caattactggtccacagaaatt

SEQ ID NO: 7410781 - DNA, 22 bp, Homo sapiens
caattaaagaagacctgcctca

SEQ ID NO: 7410782 - DNA, 22 bp, Homo sapiens
caattaaagaagacctgcctca

SEQ ID NO: 7410783 - DNA, 22 bp, Homo sapiens
caattaaagaagacctgcctca

SEQ ID NO: 7410784 - DNA, 21 bp, Homo sapiens
caattacagatggctcagggg

SEQ ID NO: 7410785 - DNA, 22 bp, Homo sapiens
caattacatttattgagcattc

SEQ ID NO: 7410786 - DNA, 22 bp, Homo sapiens
caattacatttattgagcattc

SEQ ID NO: 7410787 - DNA, 22 bp, Homo sapiens
caattacatttattgagcattc

SEQ ID NO: 7410788 - DNA, 21 bp, Homo sapiens
caattacagatggctcagggg

SEQ ID NO: 7410789 - DNA, 21 bp, Homo sapiens
caattacagatggctcagggg

SEQ ID NO: 7410790 - DNA, 22 bp, Homo sapiens
caagtctgacctctgggtgaag

SEQ ID NO: 7410791 - DNA, 22 bp, Homo sapiens
caagtctagcttggtcacttgg

SEQ ID NO: 7410792 - DNA, 22 bp, Homo sapiens
caagtctgacctctgggtgaag

SEQ ID NO: 7410793 - DNA, 22 bp, Homo sapiens
caagtctgacctctgggtgaag

SEQ ID NO: 7410794 - DNA, 22 bp, Homo sapiens
caagtctgacctctgggtgaag

SEQ ID NO: 7410795 - DNA, 22 bp, Homo sapiens
caagtctagcttggtcacttgg

SEQ ID NO: 7410796 - DNA, 22 bp, Homo sapiens
caagtccttttcttggctcagg

SEQ ID NO: 7410797 - DNA, 22 bp, Homo sapiens
caagtccttttcttggctcagg

SEQ ID NO: 7410798 - DNA, 22 bp, Homo sapiens
caagtccttttcttggctcagg

SEQ ID NO: 7410799 - DNA, 22 bp, Homo sapiens
caagtcctcaaagggctctgct

SEQ ID NO: 7410800 - DNA, 22 bp, Homo sapiens
caatgattgctatttacataaa

SEQ ID NO: 7410801 - DNA, 22 bp, Homo sapiens
caatgtttttccttccttaata

SEQ ID NO: 7410802 - DNA, 22 bp, Homo sapiens
caatgtttttccttccttaata

SEQ ID NO: 7410803 - DNA, 22 bp, Homo sapiens
caatgatggctaggcagctgct

SEQ ID NO: 7410804 - DNA, 22 bp, Homo sapiens
caatgatgtttagataaaatcc

SEQ ID NO: 7410805 - DNA, 22 bp, Homo sapiens
caatgatatctaggaatgggac

SEQ ID NO: 7410806 - DNA, 22 bp, Homo sapiens
caatgatgtttagataaaatcc

SEQ ID NO: 7410807 - DNA, 22 bp, Homo sapiens
caatgattctgcaactgtgtgc

SEQ ID NO: 7410808 - DNA, 22 bp, Homo sapiens
caatgattgctatttacataaa

SEQ ID NO: 7410809 - DNA, 22 bp, Homo sapiens
caagtctgtctgctcctgtgtg

SEQ ID NO: 7410810 - DNA, 22 bp, Homo sapiens
caagtgaagatatacagaaaat

SEQ ID NO: 7410811 - DNA, 22 bp, Homo sapiens
caagtctgtctgctcctgtgtg

SEQ ID NO: 7410812 - DNA, 22 bp, Homo sapiens
caatgatagattttacaaatta

SEQ ID NO: 7410813 - DNA, 22 bp, Homo sapiens
caatgatagattttacaaatta

SEQ ID NO: 7410814 - DNA, 22 bp, Homo sapiens
caatgatagattttacaaatta

SEQ ID NO: 7410815 - DNA, 22 bp, Homo sapiens
caagtcattactgaaatgtcac

SEQ ID NO: 7410816 - DNA, 22 bp, Homo sapiens
caagtcattactgaaatgtcac

SEQ ID NO: 7410817 - DNA, 23 bp, Homo sapiens
caagtcatggattggagtttcag

SEQ ID NO: 7410818 - DNA, 23 bp, Homo sapiens
caagtcatggattggagtttcag

SEQ ID NO: 7410819 - DNA, 22 bp, Homo sapiens
caagtcatcatagaagttcccc

SEQ ID NO: 7410820 - DNA, 22 bp, Homo sapiens
caagtcatcatagaagttcccc

SEQ ID NO: 7410821 - DNA, 20 bp, Homo sapiens
caaggggagtagtatgggcc

SEQ ID NO: 7410822 - DNA, 20 bp, Homo sapiens
caaggggagtagtatgggcc

SEQ ID NO: 7410823 - DNA, 20 bp, Homo sapiens
caaggggagtagtatgggcc

SEQ ID NO: 7410824 - DNA, 20 bp, Homo sapiens
caaggggagtagtatgggcc

SEQ ID NO: 7410825 - DNA, 22 bp, Homo sapiens
caagggggagatttagggtaat

SEQ ID NO: 7410826 - DNA, 22 bp, Homo sapiens
caagtcacttatgtgcagatat

SEQ ID NO: 7410827 - DNA, 22 bp, Homo sapiens
caagtcacttatgtgcagatat

SEQ ID NO: 7410828 - DNA, 22 bp, Homo sapiens
caagggctgaacacaggtttca

SEQ ID NO: 7410829 - DNA, 22 bp, Homo sapiens
caagggctgctatcagctactg

SEQ ID NO: 7410830 - DNA, 22 bp, Homo sapiens
caagggctcttttgaggaatgt

SEQ ID NO: 7410831 - DNA, 22 bp, Homo sapiens
caagggcttcaagtggccaaga

SEQ ID NO: 7410832 - DNA, 22 bp, Homo sapiens
caagggctgctatcagctactg

SEQ ID NO: 7410833 - DNA, 22 bp, Homo sapiens
caagtccaggtgggcaaataaa

SEQ ID NO: 7410834 - DNA, 22 bp, Homo sapiens
caagtccaagatcaagaagcca

SEQ ID NO: 7410835 - DNA, 22 bp, Homo sapiens
caagtcattgtttagtcatgtt

SEQ ID NO: 7410836 - DNA, 22 bp, Homo sapiens
caagtcattgtttagtcatgtt

SEQ ID NO: 7410837 - DNA, 22 bp, Homo sapiens
caagtccaacagtttttcagac

SEQ ID NO: 7410838 - DNA, 22 bp, Homo sapiens
caagtccaacagtttttcagac

SEQ ID NO: 7410839 - DNA, 22 bp, Homo sapiens
caagtccaagatcaagaagcca

SEQ ID NO: 7410840 - DNA, 22 bp, Homo sapiens
caagtccaacagtttttcagac

SEQ ID NO: 7410841 - DNA, 22 bp, Homo sapiens
caagtccatcctactgccttct

SEQ ID NO: 7410842 - DNA, 22 bp, Homo sapiens
caagtccatgttagatgctggc

SEQ ID NO: 7410843 - DNA, 22 bp, Homo sapiens
caagtccatgttagatgctggc

SEQ ID NO: 7410844 - DNA, 22 bp, Homo sapiens
caagtcccccaagaacagaacc

SEQ ID NO: 7410845 - DNA, 22 bp, Homo sapiens
caagtccatcagataagcaaga

SEQ ID NO: 7410846 - DNA, 22 bp, Homo sapiens
caagtccatcctactgccttct

SEQ ID NO: 7410847 - DNA, 22 bp, Homo sapiens
caagggagttgctgcatgcagg

SEQ ID NO: 7410848 - DNA, 22 bp, Homo sapiens
caagggagttgctgcatgcagg

SEQ ID NO: 7410849 - DNA, 22 bp, Homo sapiens
caagggcagaggcagggccccg

SEQ ID NO: 7410850 - DNA, 22 bp, Homo sapiens
caagggcagaggcagggccccg

SEQ ID NO: 7410851 - DNA, 22 bp, Homo sapiens
caagggcagatagctggtccaa

SEQ ID NO: 7410852 - DNA, 22 bp, Homo sapiens
caagggagttgctgcatgcagg

SEQ ID NO: 7410853 - DNA, 22 bp, Homo sapiens
caagggagttgctgcatgcagg

SEQ ID NO: 7410854 - DNA, 22 bp, Homo sapiens
caagggagttgctgcatgcagg

SEQ ID NO: 7410855 - DNA, 22 bp, Homo sapiens
caagggagttgctgcatgcagg

SEQ ID NO: 7410856 - DNA, 22 bp, Homo sapiens
caagggagttactgagggcggg

SEQ ID NO: 7410857 - DNA, 22 bp, Homo sapiens
caagggagttactgagggcggg

SEQ ID NO: 7410858 - DNA, 22 bp, Homo sapiens
caagggagttactgagggcggg

SEQ ID NO: 7410859 - DNA, 22 bp, Homo sapiens
caagggagttactgagggcggg

SEQ ID NO: 7410860 - DNA, 22 bp, Homo sapiens
caagggagttactgagggcggg

SEQ ID NO: 7410861 - DNA, 22 bp, Homo sapiens
caagggacatttctcataggag

SEQ ID NO: 7410862 - DNA, 22 bp, Homo sapiens
caagggagttactgagggcggg

SEQ ID NO: 7410863 - DNA, 22 bp, Homo sapiens
caagggacagttatgagaccct

SEQ ID NO: 7410864 - DNA, 22 bp, Homo sapiens
caagggacagttatgagaccct

SEQ ID NO: 7410865 - DNA, 22 bp, Homo sapiens
caagggaattgtgtgtgagagg

SEQ ID NO: 7410866 - DNA, 22 bp, Homo sapiens
caagggaattgtgtgtgagagg

SEQ ID NO: 7410867 - DNA, 22 bp, Homo sapiens
caagggaattgtgtgtgagagg

SEQ ID NO: 7410868 - DNA, 22 bp, Homo sapiens
caagggaattgtgtgtgagagg

SEQ ID NO: 7410869 - DNA, 22 bp, Homo sapiens
caagggaaggctaagggcaaca

SEQ ID NO: 7410870 - DNA, 22 bp, Homo sapiens
caagggaaggctaagggcaaca

SEQ ID NO: 7410871 - DNA, 22 bp, Homo sapiens
caagggcagcagcctcaagcgg

SEQ ID NO: 7410872 - DNA, 22 bp, Homo sapiens
caagggcaggagaggatggatg

SEQ ID NO: 7410873 - DNA, 22 bp, Homo sapiens
caagggcaggagaggatggatg

SEQ ID NO: 7410874 - DNA, 22 bp, Homo sapiens
caagggcaggagaggatggatg

SEQ ID NO: 7410875 - DNA, 22 bp, Homo sapiens
caagggcagaggcagggccccg

SEQ ID NO: 7410876 - DNA, 22 bp, Homo sapiens
caagggcagatagctggtccaa

SEQ ID NO: 7410877 - DNA, 22 bp, Homo sapiens
caagggcagatagctggtccaa

SEQ ID NO: 7410878 - DNA, 21 bp, Homo sapiens
caagggccagtgagatgggat

SEQ ID NO: 7410879 - DNA, 21 bp, Homo sapiens
caagggccagtgagatgggat

SEQ ID NO: 7410880 - DNA, 22 bp, Homo sapiens
caagggcattgcttgggacctt

SEQ ID NO: 7410881 - DNA, 22 bp, Homo sapiens
caagggccatctgagggcactg

SEQ ID NO: 7410882 - DNA, 22 bp, Homo sapiens
caagggcattgcttgggacctt

SEQ ID NO: 7410883 - DNA, 22 bp, Homo sapiens
caagggcattgcttgggacctt

SEQ ID NO: 7410884 - DNA, 22 bp, Homo sapiens
caagggcaggagaggatggatg

SEQ ID NO: 7410885 - DNA, 22 bp, Homo sapiens
caagggccatctgagggcactg

SEQ ID NO: 7410886 - DNA, 22 bp, Homo sapiens
caagggccatctgagggcactg

SEQ ID NO: 7410887 - DNA, 22 bp, Homo sapiens
caagggccatctgagggcactg

SEQ ID NO: 7410888 - DNA, 22 bp, Homo sapiens
caagggccctcggatgatgatg

SEQ ID NO: 7410889 - DNA, 22 bp, Homo sapiens
caagggccctcggatgatgatg

SEQ ID NO: 7410890 - DNA, 22 bp, Homo sapiens
caagggcctccaccttgctcgt

SEQ ID NO: 7410891 - DNA, 22 bp, Homo sapiens
caagggccctgtctatgtatcc

SEQ ID NO: 7410892 - DNA, 22 bp, Homo sapiens
caagggccctcggatgatgatg

SEQ ID NO: 7410893 - DNA, 22 bp, Homo sapiens
caagggcctccaccttgctcgt

SEQ ID NO: 7410894 - DNA, 22 bp, Homo sapiens
caagggccctgtctatgtatcc

SEQ ID NO: 7410895 - DNA, 22 bp, Homo sapiens
caagggcctccaccttgctcgt

SEQ ID NO: 7410896 - DNA, 22 bp, Homo sapiens
caagggctcacggtctgctggg

SEQ ID NO: 7410897 - DNA, 22 bp, Homo sapiens
caagggctcacggtctgctggg

SEQ ID NO: 7410898 - DNA, 22 bp, Homo sapiens
caagggctcacggtctgctggg

SEQ ID NO: 7410899 - DNA, 22 bp, Homo sapiens
caagggctcacggtctgctggg

SEQ ID NO: 7410900 - DNA, 22 bp, Homo sapiens
caagcttgtttctcctgggggt

SEQ ID NO: 7410901 - DNA, 22 bp, Homo sapiens
caagcttgtttctcctgggggt

SEQ ID NO: 7410902 - DNA, 22 bp, Homo sapiens
caaggaaaaagcgagctcgggg

SEQ ID NO: 7410903 - DNA, 22 bp, Homo sapiens
caaggaaaaagcgagctcgggg

SEQ ID NO: 7410904 - DNA, 22 bp, Homo sapiens
caaggaaaaagcgagctcgggg

SEQ ID NO: 7410905 - DNA, 22 bp, Homo sapiens
caagctttccattacacacatt

SEQ ID NO: 7410906 - DNA, 22 bp, Homo sapiens
caaggaaaacagatgatcaaca

SEQ ID NO: 7410907 - DNA, 22 bp, Homo sapiens
caaggaaaacagatgatcaaca

SEQ ID NO: 7410908 - DNA, 22 bp, Homo sapiens
caaggaaaacagatgatcaaca

SEQ ID NO: 7410909 - DNA, 22 bp, Homo sapiens
caaggaaaacagatgatcaaca

SEQ ID NO: 7410910 - DNA, 22 bp, Homo sapiens
caaggaaaaagcgagctcgggg

SEQ ID NO: 7410911 - DNA, 22 bp, Homo sapiens
caaggaaaaagcgagctcgggg

SEQ ID NO: 7410912 - DNA, 22 bp, Homo sapiens
caaggaaaaagcgagctcgggg

SEQ ID NO: 7410913 - DNA, 22 bp, Homo sapiens
caagcttgtttctcctgggggt

SEQ ID NO: 7410914 - DNA, 22 bp, Homo sapiens
caagctttatccgccatgtagg

SEQ ID NO: 7410915 - DNA, 22 bp, Homo sapiens
caagcttggccttccagggacc

SEQ ID NO: 7410916 - DNA, 22 bp, Homo sapiens
caagctggtatcagctagagcg

SEQ ID NO: 7410917 - DNA, 22 bp, Homo sapiens
caagctggtatcagctagagcg

SEQ ID NO: 7410918 - DNA, 22 bp, Homo sapiens
caagctggtatcagctagagcg

SEQ ID NO: 7410919 - DNA, 22 bp, Homo sapiens
caagctggtatcagctagagcg

SEQ ID NO: 7410920 - DNA, 22 bp, Homo sapiens
caaggaaaacagatgatcaaca

SEQ ID NO: 7410921 - DNA, 22 bp, Homo sapiens
caaggaaaacagatgatcaaca

SEQ ID NO: 7410922 - DNA, 22 bp, Homo sapiens
caaggaaaacagatgatcaaca

SEQ ID NO: 7410923 - DNA, 22 bp, Homo sapiens
caaggaaaacagatgatcaaca

SEQ ID NO: 7410924 - DNA, 22 bp, Homo sapiens
caaggaaaacagatgatcaaca

SEQ ID NO: 7410925 - DNA, 22 bp, Homo sapiens
caaggaaaacagatgatcaaca

SEQ ID NO: 7410926 - DNA, 22 bp, Homo sapiens
caaggaaaacagatgatcaaca

SEQ ID NO: 7410927 - DNA, 22 bp, Homo sapiens
caaggaaaagaagtatttcaga

SEQ ID NO: 7410928 - DNA, 22 bp, Homo sapiens
caaggaaaagaagtatttcaga

SEQ ID NO: 7410929 - DNA, 22 bp, Homo sapiens
caaggaaaagaagtatttcaga

SEQ ID NO: 7410930 - DNA, 22 bp, Homo sapiens
caaggaaaagaagtatttcaga

SEQ ID NO: 7410931 - DNA, 22 bp, Homo sapiens
caaggaaaacagatgatcaaca

SEQ ID NO: 7410932 - DNA, 22 bp, Homo sapiens
caaggaaacatgaaatgcattg

SEQ ID NO: 7410933 - DNA, 22 bp, Homo sapiens
caaggaaacatgaaatgcattg

SEQ ID NO: 7410934 - DNA, 22 bp, Homo sapiens
caaggaaaagaagtatttcaga

SEQ ID NO: 7410935 - DNA, 22 bp, Homo sapiens
caaggaaaagaagtatttcaga

SEQ ID NO: 7410936 - DNA, 22 bp, Homo sapiens
caaggaaacatgaaatgcattg

SEQ ID NO: 7410937 - DNA, 22 bp, Homo sapiens
caaggaaacatgaaatgcattg

SEQ ID NO: 7410938 - DNA, 22 bp, Homo sapiens
caaggaaacatgaaatgcattg

SEQ ID NO: 7410939 - DNA, 22 bp, Homo sapiens
caaggaaacatgaaatgcattg

SEQ ID NO: 7410940 - DNA, 22 bp, Homo sapiens
caaggaaacatgaaatgcattg

SEQ ID NO: 7410941 - DNA, 22 bp, Homo sapiens
caaggaaacatgaaatgcattg

SEQ ID NO: 7410942 - DNA, 22 bp, Homo sapiens
caaggaaacatgaaatgcattg

SEQ ID NO: 7410943 - DNA, 22 bp, Homo sapiens
agcaattttcccttagtctttg

SEQ ID NO: 7410944 - DNA, 22 bp, Homo sapiens
agcaatttctcgcaccagacgc

SEQ ID NO: 7410945 - DNA, 22 bp, Homo sapiens
agcaatttctcgcaccagacgc

SEQ ID NO: 7410946 - DNA, 22 bp, Homo sapiens
agcaatttcccatctcttctgc

SEQ ID NO: 7410947 - DNA, 22 bp, Homo sapiens
agcaattttctaagcaaaatac

SEQ ID NO: 7410948 - DNA, 22 bp, Homo sapiens
agcaattttctaagcaaaatac

SEQ ID NO: 7410949 - DNA, 21 bp, Homo sapiens
agcaatttttcctcctctgca

SEQ ID NO: 7410950 - DNA, 22 bp, Homo sapiens
agcaattttctaagcaaaatac

SEQ ID NO: 7410951 - DNA, 22 bp, Homo sapiens
agcaattatggagttgttgacg

SEQ ID NO: 7410952 - DNA, 22 bp, Homo sapiens
agcaattatggagttgttgacg

SEQ ID NO: 7410953 - DNA, 22 bp, Homo sapiens
agcaattatggagttgttgacg

SEQ ID NO: 7410954 - DNA, 22 bp, Homo sapiens
agcaattattgtataagaacaa

SEQ ID NO: 7410955 - DNA, 21 bp, Homo sapiens
agcaatttcatttggtttaac

SEQ ID NO: 7410956 - DNA, 22 bp, Homo sapiens
caagctggctgggagaggcacg

SEQ ID NO: 7410957 - DNA, 22 bp, Homo sapiens
caagctggctgggagaggcacg

SEQ ID NO: 7410958 - DNA, 22 bp, Homo sapiens
caagctggctgggagaggcacg

SEQ ID NO: 7410959 - DNA, 22 bp, Homo sapiens
caagctggagttcctcagagtg

SEQ ID NO: 7410960 - DNA, 22 bp, Homo sapiens
caagctggagttcctcagagtg

SEQ ID NO: 7410961 - DNA, 22 bp, Homo sapiens
caagctggagttcctcagagtg

SEQ ID NO: 7410962 - DNA, 22 bp, Homo sapiens
caagctgggtgcgggcagtata

SEQ ID NO: 7410963 - DNA, 22 bp, Homo sapiens
caagctgggtcccaacaattac

SEQ ID NO: 7410964 - DNA, 22 bp, Homo sapiens
caagctgggtcccaacaattac

SEQ ID NO: 7410965 - DNA, 22 bp, Homo sapiens
caagctgggtcccaacaattac

SEQ ID NO: 7410966 - DNA, 22 bp, Homo sapiens
caagctggctgggagaggcacg

SEQ ID NO: 7410967 - DNA, 22 bp, Homo sapiens
caagcagaggtttatgtattag

SEQ ID NO: 7410968 - DNA, 22 bp, Homo sapiens
caagcagaggtttatgtattag

SEQ ID NO: 7410969 - DNA, 22 bp, Homo sapiens
caagcagagaggttagaacaca

SEQ ID NO: 7410970 - DNA, 22 bp, Homo sapiens
caagcagagaggttagaacaca

SEQ ID NO: 7410971 - DNA, 22 bp, Homo sapiens
caagcagatattttagtcaaga

SEQ ID NO: 7410972 - DNA, 22 bp, Homo sapiens
caagcagaggtttatgtattag

SEQ ID NO: 7410973 - DNA, 22 bp, Homo sapiens
caagcagaggtttatgtattag

SEQ ID NO: 7410974 - DNA, 22 bp, Homo sapiens
caagcagatattttagtcaaga

SEQ ID NO: 7410975 - DNA, 22 bp, Homo sapiens
caagcagatattttagtcaaga

SEQ ID NO: 7410976 - DNA, 22 bp, Homo sapiens
caagcagatattttagtcaaga

SEQ ID NO: 7410977 - DNA, 22 bp, Homo sapiens
caagctggaggttggagctact

SEQ ID NO: 7410978 - DNA, 22 bp, Homo sapiens
caagctggaggttggagctact

SEQ ID NO: 7410979 - DNA, 22 bp, Homo sapiens
caagggaaggctaagggcaaca

SEQ ID NO: 7410980 - DNA, 22 bp, Homo sapiens
caagggaaggctaagggcaaca

SEQ ID NO: 7410981 - DNA, 22 bp, Homo sapiens
caaggccaaagggccactgtca

SEQ ID NO: 7410982 - DNA, 22 bp, Homo sapiens
caagggaagaggacagggacct

SEQ ID NO: 7410983 - DNA, 22 bp, Homo sapiens
caagggaaggctaagggcaaca

SEQ ID NO: 7410984 - DNA, 22 bp, Homo sapiens
caagggaaggctaagggcaaca

SEQ ID NO: 7410985 - DNA, 22 bp, Homo sapiens
caaggcattcttgcaggtaggg

SEQ ID NO: 7410986 - DNA, 22 bp, Homo sapiens
caaggcatttcgcttagagaga

SEQ ID NO: 7410987 - DNA, 22 bp, Homo sapiens
caaggcatttcgcttagagaga

SEQ ID NO: 7410988 - DNA, 22 bp, Homo sapiens
caaggccaaagggccactgtca

SEQ ID NO: 7410989 - DNA, 22 bp, Homo sapiens
caaggcatttcgcttagagaga

SEQ ID NO: 7410990 - DNA, 22 bp, Homo sapiens
caaggccaaagggccactgtca

SEQ ID NO: 7410991 - DNA, 22 bp, Homo sapiens
caaggccaaagggccactgtca

SEQ ID NO: 7410992 - DNA, 22 bp, Homo sapiens
caaggccaaagggccactgtca

SEQ ID NO: 7410993 - DNA, 22 bp, Homo sapiens
caaggcatgtaacaatggcttt

SEQ ID NO: 7410994 - DNA, 22 bp, Homo sapiens
caaggcattaccatggctagag

SEQ ID NO: 7410995 - DNA, 22 bp, Homo sapiens
agcagagaccatatagcccaga

SEQ ID NO: 7410996 - DNA, 22 bp, Homo sapiens
caaggcattcttgcaggtaggg

SEQ ID NO: 7410997 - DNA, 22 bp, Homo sapiens
caaggcattctcaccaactctc

SEQ ID NO: 7410998 - DNA, 22 bp, Homo sapiens
caaggcattgtgtaagcacttg

SEQ ID NO: 7410999 - DNA, 22 bp, Homo sapiens
agcagagacatgaaatatgctt

SEQ ID NO: 7411000 - DNA, 22 bp, Homo sapiens
agcagagacatgaaatatgctt

SEQ ID NO: 7411001 - DNA, 22 bp, Homo sapiens
agcagagacatgaaatatgctt

SEQ ID NO: 7411002 - DNA, 22 bp, Homo sapiens
agcagagaccatatagcccaga

SEQ ID NO: 7411003 - DNA, 22 bp, Homo sapiens
agcagagaccatatagcccaga

SEQ ID NO: 7411004 - DNA, 22 bp, Homo sapiens
agcagagaccatatagcccaga

SEQ ID NO: 7411005 - DNA, 22 bp, Homo sapiens
agcagagaccatatagcccaga

SEQ ID NO: 7411006 - DNA, 22 bp, Homo sapiens
agcagagacatgaaatatgctt

SEQ ID NO: 7411007 - DNA, 22 bp, Homo sapiens
agcagagaagacacaggcttca

SEQ ID NO: 7411008 - DNA, 22 bp, Homo sapiens
agcagagacatgaaatatgctt

SEQ ID NO: 7411009 - DNA, 22 bp, Homo sapiens
agcagagacatgaaatatgctt

SEQ ID NO: 7411010 - DNA, 22 bp, Homo sapiens
agcagagacatgaaatatgctt

SEQ ID NO: 7411011 - DNA, 22 bp, Homo sapiens
agcagagacatgaaatatgctt

SEQ ID NO: 7411012 - DNA, 22 bp, Homo sapiens
agcagagaagacacaggcttca

SEQ ID NO: 7411013 - DNA, 22 bp, Homo sapiens
agcagagaagacacaggcttca

SEQ ID NO: 7411014 - DNA, 22 bp, Homo sapiens
agcagagaagacacaggcttca

SEQ ID NO: 7411015 - DNA, 22 bp, Homo sapiens
agcagagaagacacaggcttca

SEQ ID NO: 7411016 - DNA, 22 bp, Homo sapiens
agcagagaagacacaggcttca

SEQ ID NO: 7411017 - DNA, 22 bp, Homo sapiens
agcagaccaggagtgcacaggt

SEQ ID NO: 7411018 - DNA, 22 bp, Homo sapiens
agcagaccaggagtgcacaggt

SEQ ID NO: 7411019 - DNA, 22 bp, Homo sapiens
agcagacatggcttggatgtgg

SEQ ID NO: 7411020 - DNA, 22 bp, Homo sapiens
agcagacatggcttggatgtgg

SEQ ID NO: 7411021 - DNA, 22 bp, Homo sapiens
agcagacatggcttggatgtgg

SEQ ID NO: 7411022 - DNA, 22 bp, Homo sapiens
agcagacatggcttggatgtgg

SEQ ID NO: 7411023 - DNA, 22 bp, Homo sapiens
agcagacatggcttggatgtgg

SEQ ID NO: 7411024 - DNA, 21 bp, Homo sapiens
agcagactgaatacattctta

SEQ ID NO: 7411025 - DNA, 22 bp, Homo sapiens
agcagagaagacacaggcttca

SEQ ID NO: 7411026 - DNA, 22 bp, Homo sapiens
agcagagaagacacaggcttca

SEQ ID NO: 7411027 - DNA, 22 bp, Homo sapiens
agcagagaagacacaggcttca

SEQ ID NO: 7411028 - DNA, 22 bp, Homo sapiens
agcagagaagacacaggcttca

SEQ ID NO: 7411029 - DNA, 22 bp, Homo sapiens
agcagagaagacacaggcttca

SEQ ID NO: 7411030 - DNA, 21 bp, Homo sapiens
agcagacagcccaagaaaatc

SEQ ID NO: 7411031 - DNA, 21 bp, Homo sapiens
agcagacagcccaagaaaatc

SEQ ID NO: 7411032 - DNA, 21 bp, Homo sapiens
agcagacagcccaagaaaatc

SEQ ID NO: 7411033 - DNA, 22 bp, Homo sapiens
agcagacaggctgccacagtgc

SEQ ID NO: 7411034 - DNA, 22 bp, Homo sapiens
agcagacaggctgccacagtgc

SEQ ID NO: 7411035 - DNA, 22 bp, Homo sapiens
agcagacatatctcatgtcaca

SEQ ID NO: 7411036 - DNA, 22 bp, Homo sapiens
agcagacatatctcatgtcaca

SEQ ID NO: 7411037 - DNA, 22 bp, Homo sapiens
agcagacatatctcatgtcaca

SEQ ID NO: 7411038 - DNA, 22 bp, Homo sapiens
agcagacaggtaggaggataaa

SEQ ID NO: 7411039 - DNA, 22 bp, Homo sapiens
agcagacaggctgccacagtgc

SEQ ID NO: 7411040 - DNA, 22 bp, Homo sapiens
agcagacatatctcatgtcaca

SEQ ID NO: 7411041 - DNA, 22 bp, Homo sapiens
agcagacatatctcatgtcaca

SEQ ID NO: 7411042 - DNA, 22 bp, Homo sapiens
agcagacaggtaggaggataaa

SEQ ID NO: 7411043 - DNA, 22 bp, Homo sapiens
caaggaagttttaggagaggaa

SEQ ID NO: 7411044 - DNA, 22 bp, Homo sapiens
caaggaaggagagatgatgggt

SEQ ID NO: 7411045 - DNA, 22 bp, Homo sapiens
caaggaagttttaggagaggaa

SEQ ID NO: 7411046 - DNA, 22 bp, Homo sapiens
caaggaagttttaggagaggaa

SEQ ID NO: 7411047 - DNA, 22 bp, Homo sapiens
caaggaagttttaggagaggaa

SEQ ID NO: 7411048 - DNA, 21 bp, Homo sapiens
agcagacagatgcacgcacac

SEQ ID NO: 7411049 - DNA, 21 bp, Homo sapiens
agcagacagatgcacgcacac

SEQ ID NO: 7411050 - DNA, 21 bp, Homo sapiens
agcagacagatgcacgcacac

SEQ ID NO: 7411051 - DNA, 22 bp, Homo sapiens
caaggaagttttaggagaggaa

SEQ ID NO: 7411052 - DNA, 22 bp, Homo sapiens
caaggaagttttaggagaggaa

SEQ ID NO: 7411053 - DNA, 22 bp, Homo sapiens
caaggaagacccacgcagatat

SEQ ID NO: 7411054 - DNA, 22 bp, Homo sapiens
caaggaaggagagatgatgggt

SEQ ID NO: 7411055 - DNA, 22 bp, Homo sapiens
caaggaagacccacgcagatat

SEQ ID NO: 7411056 - DNA, 22 bp, Homo sapiens
caaggaaacatgaaatgcattg

SEQ ID NO: 7411057 - DNA, 22 bp, Homo sapiens
caaggaaggagagatgatgggt

SEQ ID NO: 7411058 - DNA, 22 bp, Homo sapiens
caaggaaggagagatgatgggt

SEQ ID NO: 7411059 - DNA, 22 bp, Homo sapiens
caaggaaggagagatgatgggt

SEQ ID NO: 7411060 - DNA, 22 bp, Homo sapiens
caaggaaggagagatgatgggt

SEQ ID NO: 7411061 - DNA, 22 bp, Homo sapiens
cacagctggggaagctgaggcc

SEQ ID NO: 7411062 - DNA, 22 bp, Homo sapiens
cacagctggggaagctgaggcc

SEQ ID NO: 7411063 - DNA, 22 bp, Homo sapiens
cacagctggggaagctgaggcc

SEQ ID NO: 7411064 - DNA, 22 bp, Homo sapiens
cacagctggggaagctgaggcc

SEQ ID NO: 7411065 - DNA, 22 bp, Homo sapiens
cacagctggggaagctgaggcc

SEQ ID NO: 7411066 - DNA, 22 bp, Homo sapiens
cacagctggggaagctgaggcc

SEQ ID NO: 7411067 - DNA, 22 bp, Homo sapiens
cacaggaaaaatgggtccttta

SEQ ID NO: 7411068 - DNA, 22 bp, Homo sapiens
cacaggaaaaatgggtccttta

SEQ ID NO: 7411069 - DNA, 22 bp, Homo sapiens
cacagctggggaagctgaggcc

SEQ ID NO: 7411070 - DNA, 22 bp, Homo sapiens
cacaggaaaaatgggtccttta

SEQ ID NO: 7411071 - DNA, 22 bp, Homo sapiens
cacagctggggaagctgaggcc

SEQ ID NO: 7411072 - DNA, 22 bp, Homo sapiens
cacagctgggaaaatttgtaca

SEQ ID NO: 7411073 - DNA, 22 bp, Homo sapiens
cacagctggaatggggtacctg

SEQ ID NO: 7411074 - DNA, 19 bp, Homo sapiens
cacagctggcgctgaccgc

SEQ ID NO: 7411075 - DNA, 19 bp, Homo sapiens
cacagctggcgctgaccgc

SEQ ID NO: 7411076 - DNA, 19 bp, Homo sapiens
cacagctggcgctgaccgc

SEQ ID NO: 7411077 - DNA, 19 bp, Homo sapiens
cacagctggcgctgaccgc

SEQ ID NO: 7411078 - DNA, 22 bp, Homo sapiens
cacaggaaatattaggagggat

SEQ ID NO: 7411079 - DNA, 22 bp, Homo sapiens
cacaggaaatattaggagggat

SEQ ID NO: 7411080 - DNA, 22 bp, Homo sapiens
cacaggaaagtcagccagaaga

SEQ ID NO: 7411081 - DNA, 22 bp, Homo sapiens
cacaggaaagtcagccagaaga

SEQ ID NO: 7411082 - DNA, 22 bp, Homo sapiens
cacaggaaagtcagccagaaga

SEQ ID NO: 7411083 - DNA, 22 bp, Homo sapiens
cacaggaaagtcagccagaaga

SEQ ID NO: 7411084 - DNA, 22 bp, Homo sapiens
cacaggaaagtcagccagaaga

SEQ ID NO: 7411085 - DNA, 22 bp, Homo sapiens
cacaggaaagtcagccagaaga

SEQ ID NO: 7411086 - DNA, 20 bp, Homo sapiens
cacaggaaagctactcagtt

SEQ ID NO: 7411087 - DNA, 20 bp, Homo sapiens
cacaggaaagctactcagtt

SEQ ID NO: 7411088 - DNA, 20 bp, Homo sapiens
cacaggaaagctactcagtt

SEQ ID NO: 7411089 - DNA, 20 bp, Homo sapiens
cacaggaaagctactcagtt

SEQ ID NO: 7411090 - DNA, 20 bp, Homo sapiens
cacaggaaagctactcagtt

SEQ ID NO: 7411091 - DNA, 20 bp, Homo sapiens
cacaggaaagctactcagtt

SEQ ID NO: 7411092 - DNA, 20 bp, Homo sapiens
cacaggaaagctactcagtt

SEQ ID NO: 7411093 - DNA, 22 bp, Homo sapiens
cacaggaaaataaaagatctaa

SEQ ID NO: 7411094 - DNA, 20 bp, Homo sapiens
cacaggaaagctactcagtt

SEQ ID NO: 7411095 - DNA, 22 bp, Homo sapiens
cacaggaaaataaaagatctaa

SEQ ID NO: 7411096 - DNA, 22 bp, Homo sapiens
cacaggaaaataaaagatctaa

SEQ ID NO: 7411097 - DNA, 22 bp, Homo sapiens
cacaggaaaataaaagatctaa

SEQ ID NO: 7411098 - DNA, 22 bp, Homo sapiens
cacaggaaaataaaagatctaa

SEQ ID NO: 7411099 - DNA, 22 bp, Homo sapiens
cacaggaaaataaaagatctaa

SEQ ID NO: 7411100 - DNA, 22 bp, Homo sapiens
cacaggaagaggtatacaattc

SEQ ID NO: 7411101 - DNA, 22 bp, Homo sapiens
cacaggaagaggtatacaattc

SEQ ID NO: 7411102 - DNA, 22 bp, Homo sapiens
cacaggaagaggtatacaattc

SEQ ID NO: 7411103 - DNA, 22 bp, Homo sapiens
cacaggaagaggtatacaattc

SEQ ID NO: 7411104 - DNA, 22 bp, Homo sapiens
cacaggaagatctcccagaggt

SEQ ID NO: 7411105 - DNA, 22 bp, Homo sapiens
cacaggaagatctcccagaggt

SEQ ID NO: 7411106 - DNA, 22 bp, Homo sapiens
cacaggaagatctcccagaggt

SEQ ID NO: 7411107 - DNA, 22 bp, Homo sapiens
cacaggaagatctcccagaggt

SEQ ID NO: 7411108 - DNA, 22 bp, Homo sapiens
cacaggaagatctcccagaggt

SEQ ID NO: 7411109 - DNA, 22 bp, Homo sapiens
cacaggaagatctcccagaggt

SEQ ID NO: 7411110 - DNA, 22 bp, Homo sapiens
cacaggaagatctcccagaggt

SEQ ID NO: 7411111 - DNA, 22 bp, Homo sapiens
cacaggaagatctcccagaggt

SEQ ID NO: 7411112 - DNA, 22 bp, Homo sapiens
cacaggaagatctcccagaggt

SEQ ID NO: 7411113 - DNA, 22 bp, Homo sapiens
cacaggaagcaagcctggggcc

SEQ ID NO: 7411114 - DNA, 22 bp, Homo sapiens
cacaggaagcaagcctggggcc

SEQ ID NO: 7411115 - DNA, 22 bp, Homo sapiens
agcaggcaggcccagcggctgg

SEQ ID NO: 7411116 - DNA, 22 bp, Homo sapiens
agcaggcaggcccagcggctgg

SEQ ID NO: 7411117 - DNA, 22 bp, Homo sapiens
agcaggcaggcccagcggctgg

SEQ ID NO: 7411118 - DNA, 22 bp, Homo sapiens
agcaggccactgcagctggagc

SEQ ID NO: 7411119 - DNA, 22 bp, Homo sapiens
agcaggcaggctgccagtgaat

SEQ ID NO: 7411120 - DNA, 22 bp, Homo sapiens
cacaggaacaaagaagacaatt

SEQ ID NO: 7411121 - DNA, 22 bp, Homo sapiens
cacaggaacaaagaagacaatt

SEQ ID NO: 7411122 - DNA, 22 bp, Homo sapiens
cacaggaacaaagaagacaatt

SEQ ID NO: 7411123 - DNA, 22 bp, Homo sapiens
cacaggaacaaagaagacaatt

SEQ ID NO: 7411124 - DNA, 22 bp, Homo sapiens
cacaggaacaaagaagacaatt

SEQ ID NO: 7411125 - DNA, 22 bp, Homo sapiens
cacaggaacaaagaagacaatt

SEQ ID NO: 7411126 - DNA, 22 bp, Homo sapiens
cacaggaacaaagaagacaatt

SEQ ID NO: 7411127 - DNA, 22 bp, Homo sapiens
cacaggaacttactggccactt

SEQ ID NO: 7411128 - DNA, 22 bp, Homo sapiens
cacaggaacttactggccactt

SEQ ID NO: 7411129 - DNA, 22 bp, Homo sapiens
cacaggaacttactggccactt

SEQ ID NO: 7411130 - DNA, 22 bp, Homo sapiens
cacaggaacttactggccactt

SEQ ID NO: 7411131 - DNA, 22 bp, Homo sapiens
cacaggaacttactggccactt

SEQ ID NO: 7411132 - DNA, 22 bp, Homo sapiens
cacaggaaatgattctgcagca

SEQ ID NO: 7411133 - DNA, 22 bp, Homo sapiens
cacaggaaatgattctgcagca

SEQ ID NO: 7411134 - DNA, 22 bp, Homo sapiens
cacaggaaatgattctgcagca

SEQ ID NO: 7411135 - DNA, 22 bp, Homo sapiens
cacaggaaatgattctgcagca

SEQ ID NO: 7411136 - DNA, 22 bp, Homo sapiens
cacaggaaatgattctgcagca

SEQ ID NO: 7411137 - DNA, 22 bp, Homo sapiens
cacaggaaatgattctgcagca

SEQ ID NO: 7411138 - DNA, 22 bp, Homo sapiens
cacaggaaatgattctgcagca

SEQ ID NO: 7411139 - DNA, 22 bp, Homo sapiens
cacaggaaatgattctgcagca

SEQ ID NO: 7411140 - DNA, 22 bp, Homo sapiens
cacaggaacaaagaagacaatt

SEQ ID NO: 7411141 - DNA, 22 bp, Homo sapiens
cacaggaacaaagaagacaatt

SEQ ID NO: 7411142 - DNA, 22 bp, Homo sapiens
cacagctggaatggggtacctg

SEQ ID NO: 7411143 - DNA, 22 bp, Homo sapiens
cacagctgcttgttagaatagc

SEQ ID NO: 7411144 - DNA, 22 bp, Homo sapiens
cacagctgcttgttagaatagc

SEQ ID NO: 7411145 - DNA, 22 bp, Homo sapiens
cacagctgccctactccatgtg

SEQ ID NO: 7411146 - DNA, 22 bp, Homo sapiens
cacagctgccctactccatgtg

SEQ ID NO: 7411147 - DNA, 22 bp, Homo sapiens
cacagctgccctactccatgtg

SEQ ID NO: 7411148 - DNA, 22 bp, Homo sapiens
cacagctgccctactccatgtg

SEQ ID NO: 7411149 - DNA, 22 bp, Homo sapiens
cacagctgccctactccatgtg

SEQ ID NO: 7411150 - DNA, 22 bp, Homo sapiens
cacagctgccctactccatgtg

SEQ ID NO: 7411151 - DNA, 22 bp, Homo sapiens
cacagctgccctactccatgtg

SEQ ID NO: 7411152 - DNA, 22 bp, Homo sapiens
cacagctgccccctctctaact

SEQ ID NO: 7411153 - DNA, 22 bp, Homo sapiens
cacagctgccccctctctaact

SEQ ID NO: 7411154 - DNA, 22 bp, Homo sapiens
cacagctgccccctctctaact

SEQ ID NO: 7411155 - DNA, 22 bp, Homo sapiens
cacagctgccccctctctaact

SEQ ID NO: 7411156 - DNA, 22 bp, Homo sapiens
cacagctgccctaactgtactc

SEQ ID NO: 7411157 - DNA, 22 bp, Homo sapiens
cacagctgccctaactgtactc

SEQ ID NO: 7411158 - DNA, 22 bp, Homo sapiens
cacagctgccctactccatgtg

SEQ ID NO: 7411159 - DNA, 22 bp, Homo sapiens
cacagctgccctactccatgtg

SEQ ID NO: 7411160 - DNA, 22 bp, Homo sapiens
cacagctgccctactccatgtg

SEQ ID NO: 7411161 - DNA, 22 bp, Homo sapiens
cacagctgccatggctgcactt

SEQ ID NO: 7411162 - DNA, 22 bp, Homo sapiens
cacagctgccatggctgcactt

SEQ ID NO: 7411163 - DNA, 22 bp, Homo sapiens
cacagctgccatggctgcactt

SEQ ID NO: 7411164 - DNA, 22 bp, Homo sapiens
cacagctgccatgcagtcagtg

SEQ ID NO: 7411165 - DNA, 22 bp, Homo sapiens
cacagctgccatggctgcactt

SEQ ID NO: 7411166 - DNA, 22 bp, Homo sapiens
cacagctgccatggctgcactt

SEQ ID NO: 7411167 - DNA, 22 bp, Homo sapiens
cacagctgccatggctgcactt

SEQ ID NO: 7411168 - DNA, 22 bp, Homo sapiens
cacagctgccatggctgcactt

SEQ ID NO: 7411169 - DNA, 22 bp, Homo sapiens
cacagctgccatggctgcactt

SEQ ID NO: 7411170 - DNA, 22 bp, Homo sapiens
cacagctgccatggctgcactt

SEQ ID NO: 7411171 - DNA, 22 bp, Homo sapiens
cacagctgcacagaggaggtgc

SEQ ID NO: 7411172 - DNA, 22 bp, Homo sapiens
cacagctgaccaccctgctccc

SEQ ID NO: 7411173 - DNA, 22 bp, Homo sapiens
cacagctgccatgcagtcagtg

SEQ ID NO: 7411174 - DNA, 22 bp, Homo sapiens
cacagctgccatgcagtcagtg

SEQ ID NO: 7411175 - DNA, 22 bp, Homo sapiens
cacagctgccatgcagtcagtg

SEQ ID NO: 7411176 - DNA, 22 bp, Homo sapiens
cacagctgcacagaggaggtgc

SEQ ID NO: 7411177 - DNA, 22 bp, Homo sapiens
cacagctgccatgcagtcagtg

SEQ ID NO: 7411178 - DNA, 22 bp, Homo sapiens
cacagctgccatgcagtcagtg

SEQ ID NO: 7411179 - DNA, 22 bp, Homo sapiens
cacagctgccatgcagtcagtg

SEQ ID NO: 7411180 - DNA, 22 bp, Homo sapiens
cacagctgccatgcagtcagtg

SEQ ID NO: 7411181 - DNA, 22 bp, Homo sapiens
cacagctgccatgcagtcagtg

SEQ ID NO: 7411182 - DNA, 22 bp, Homo sapiens
cacagctgccatgcagtcagtg

SEQ ID NO: 7411183 - DNA, 22 bp, Homo sapiens
cacagaacatccttagctcatg

SEQ ID NO: 7411184 - DNA, 22 bp, Homo sapiens
cacagcagccagaacatttttg

SEQ ID NO: 7411185 - DNA, 22 bp, Homo sapiens
cacagcagccagaacatttttg

SEQ ID NO: 7411186 - DNA, 22 bp, Homo sapiens
cacagcagccagaacatttttg

SEQ ID NO: 7411187 - DNA, 22 bp, Homo sapiens
cacagaacaccaaagaaccttc

SEQ ID NO: 7411188 - DNA, 22 bp, Homo sapiens
cacagaacaccaaagaaccttc

SEQ ID NO: 7411189 - DNA, 22 bp, Homo sapiens
cacagaacaccaaagaaccttc

SEQ ID NO: 7411190 - DNA, 22 bp, Homo sapiens
cacagaacaccaaagaaccttc

SEQ ID NO: 7411191 - DNA, 22 bp, Homo sapiens
cacagaacaccaaagaaccttc

SEQ ID NO: 7411192 - DNA, 22 bp, Homo sapiens
cacagcagcgttcctccgtgtg

SEQ ID NO: 7411193 - DNA, 22 bp, Homo sapiens
cacagcagcgttcctccgtgtg

SEQ ID NO: 7411194 - DNA, 22 bp, Homo sapiens
cacagcagcgttcctccgtgtg

SEQ ID NO: 7411195 - DNA, 22 bp, Homo sapiens
cacagcagcgttcctccgtgtg

SEQ ID NO: 7411196 - DNA, 22 bp, Homo sapiens
cacagcagcgttcctccgtgtg

SEQ ID NO: 7411197 - DNA, 22 bp, Homo sapiens
cacagctgaccaccctgctccc

SEQ ID NO: 7411198 - DNA, 22 bp, Homo sapiens
cacagctgaccaccctgctccc

SEQ ID NO: 7411199 - DNA, 22 bp, Homo sapiens
cacagctgaccaccctgctccc

SEQ ID NO: 7411200 - DNA, 22 bp, Homo sapiens
cacagctgaccaccctgctccc

SEQ ID NO: 7411201 - DNA, 20 bp, Homo sapiens
cacagaacaaattgcaggac

SEQ ID NO: 7411202 - DNA, 20 bp, Homo sapiens
cacagaacaaattgcaggac

SEQ ID NO: 7411203 - DNA, 22 bp, Homo sapiens
cacagaaattattaggatgctt

SEQ ID NO: 7411204 - DNA, 22 bp, Homo sapiens
cacagaaattattaggatgctt

SEQ ID NO: 7411205 - DNA, 22 bp, Homo sapiens
cacagaaattattaggatgctt

SEQ ID NO: 7411206 - DNA, 20 bp, Homo sapiens
cacagaacaaattgcaggac

SEQ ID NO: 7411207 - DNA, 22 bp, Homo sapiens
cacagaaattattaggatgctt

SEQ ID NO: 7411208 - DNA, 22 bp, Homo sapiens
cacagaaattattaggatgctt

SEQ ID NO: 7411209 - DNA, 22 bp, Homo sapiens
cacagaaattattaggatgctt

SEQ ID NO: 7411210 - DNA, 22 bp, Homo sapiens
cacagaaattattaggatgctt

SEQ ID NO: 7411211 - DNA, 22 bp, Homo sapiens
cacagaaatattgtgtcccttg

SEQ ID NO: 7411212 - DNA, 22 bp, Homo sapiens
cacagaaattattaggatgctt

SEQ ID NO: 7411213 - DNA, 22 bp, Homo sapiens
cacagaaattattaggatgctt

SEQ ID NO: 7411214 - DNA, 22 bp, Homo sapiens
cacagaaatattgtgtcccttg

SEQ ID NO: 7411215 - DNA, 22 bp, Homo sapiens
cacagaaatattgtgtcccttg

SEQ ID NO: 7411216 - DNA, 22 bp, Homo sapiens
cacagaaatattgtgtcccttg

SEQ ID NO: 7411217 - DNA, 22 bp, Homo sapiens
cacagaaatattgtgtcccttg

SEQ ID NO: 7411218 - DNA, 22 bp, Homo sapiens
cacagaaaggctcaaatcccaa

SEQ ID NO: 7411219 - DNA, 22 bp, Homo sapiens
cacagaaaggctcaaatcccaa

SEQ ID NO: 7411220 - DNA, 22 bp, Homo sapiens
cacagaaatattgtgtcccttg

SEQ ID NO: 7411221 - DNA, 22 bp, Homo sapiens
cacagaaatattgtgtcccttg

SEQ ID NO: 7411222 - DNA, 22 bp, Homo sapiens
cacagaaatattgtgtcccttg

SEQ ID NO: 7411223 - DNA, 22 bp, Homo sapiens
cacactttcaggtcctctttgc

SEQ ID NO: 7411224 - DNA, 22 bp, Homo sapiens
cacactttgtgctaatctattt

SEQ ID NO: 7411225 - DNA, 22 bp, Homo sapiens
cacactttgttgaagttttcat

SEQ ID NO: 7411226 - DNA, 22 bp, Homo sapiens
cacactttgtgctaatctattt

SEQ ID NO: 7411227 - DNA, 22 bp, Homo sapiens
cacacttttctggctcaggctc

SEQ ID NO: 7411228 - DNA, 22 bp, Homo sapiens
cacactttgttgaagttttcat

SEQ ID NO: 7411229 - DNA, 22 bp, Homo sapiens
cacacttttctggctcaggctc

SEQ ID NO: 7411230 - DNA, 22 bp, Homo sapiens
cacacttttggcatgtttggtt

SEQ ID NO: 7411231 - DNA, 22 bp, Homo sapiens
cacagaaaaaggcttgaaaatc

SEQ ID NO: 7411232 - DNA, 22 bp, Homo sapiens
cacagaaaaaggcttgaaaatc

SEQ ID NO: 7411233 - DNA, 22 bp, Homo sapiens
cacagaaaaaggcttgaaaatc

SEQ ID NO: 7411234 - DNA, 22 bp, Homo sapiens
cacagaaaaaggcttgaaaatc

SEQ ID NO: 7411235 - DNA, 22 bp, Homo sapiens
cacagaaaaaggcttgaaaatc

SEQ ID NO: 7411236 - DNA, 22 bp, Homo sapiens
cacagaaaaaggcttgaaaatc

SEQ ID NO: 7411237 - DNA, 22 bp, Homo sapiens
cacagaaaaaggcttgaaaatc

SEQ ID NO: 7411238 - DNA, 22 bp, Homo sapiens
cacagaaaggctcaaatcccaa

SEQ ID NO: 7411239 - DNA, 22 bp, Homo sapiens
cacagaaaggctcaaatcccaa

SEQ ID NO: 7411240 - DNA, 22 bp, Homo sapiens
cacagaaaggctcaaatcccaa

SEQ ID NO: 7411241 - DNA, 22 bp, Homo sapiens
cacagaaaggctcaaatcccaa

SEQ ID NO: 7411242 - DNA, 22 bp, Homo sapiens
cacagaaaaaggcttgaaaatc

SEQ ID NO: 7411243 - DNA, 22 bp, Homo sapiens
cacagaaaaaggcttgaaaatc

SEQ ID NO: 7411244 - DNA, 22 bp, Homo sapiens
cacagaaaaaggcttgaaaatc

SEQ ID NO: 7411245 - DNA, 22 bp, Homo sapiens
cacactgttgaggacgagatgt

SEQ ID NO: 7411246 - DNA, 22 bp, Homo sapiens
cacacttgtgaccgatataatg

SEQ ID NO: 7411247 - DNA, 22 bp, Homo sapiens
cacactttcaggtcctctttgc

SEQ ID NO: 7411248 - DNA, 22 bp, Homo sapiens
cacactgttgaggacgagatgt

SEQ ID NO: 7411249 - DNA, 22 bp, Homo sapiens
cacacatgtgtgcagcttagaa

SEQ ID NO: 7411250 - DNA, 22 bp, Homo sapiens
cacacatgtgagcagagaggcg

SEQ ID NO: 7411251 - DNA, 22 bp, Homo sapiens
cacacatgtgagcagagaggcg

SEQ ID NO: 7411252 - DNA, 22 bp, Homo sapiens
cacacatgtgagcagagaggcg

SEQ ID NO: 7411253 - DNA, 22 bp, Homo sapiens
cacacatgtctctccatgctct

SEQ ID NO: 7411254 - DNA, 22 bp, Homo sapiens
cacacatgtctctccatgctct

SEQ ID NO: 7411255 - DNA, 22 bp, Homo sapiens
cacacatgtgggatccgcaggg

SEQ ID NO: 7411256 - DNA, 22 bp, Homo sapiens
cacacatgtgggatccgcaggg

SEQ ID NO: 7411257 - DNA, 22 bp, Homo sapiens
cacacatgtgggatccgcaggg

SEQ ID NO: 7411258 - DNA, 22 bp, Homo sapiens
cacacatgtgagcagagaggcg

SEQ ID NO: 7411259 - DNA, 22 bp, Homo sapiens
cacacatggctgccagggaggt

SEQ ID NO: 7411260 - DNA, 22 bp, Homo sapiens
cacacatggctgccagggaggt

SEQ ID NO: 7411261 - DNA, 22 bp, Homo sapiens
cacacatggctgccagggaggt

SEQ ID NO: 7411262 - DNA, 22 bp, Homo sapiens
cacacatgcatgtaagacctct

SEQ ID NO: 7411263 - DNA, 22 bp, Homo sapiens
cacacatgcatgtaagacctct

SEQ ID NO: 7411264 - DNA, 22 bp, Homo sapiens
cacacatgcatgtaagacctct

SEQ ID NO: 7411265 - DNA, 22 bp, Homo sapiens
cacacatgcatgtaagacctct

SEQ ID NO: 7411266 - DNA, 22 bp, Homo sapiens
cacacatgacccacttttaccg

SEQ ID NO: 7411267 - DNA, 22 bp, Homo sapiens
cacacatgacccacttttaccg

SEQ ID NO: 7411268 - DNA, 22 bp, Homo sapiens
cacacatgcatgtaagacctct

SEQ ID NO: 7411269 - DNA, 22 bp, Homo sapiens
cacacatgagtctccccattgg

SEQ ID NO: 7411270 - DNA, 22 bp, Homo sapiens
cacacatgagtctccccattgg

SEQ ID NO: 7411271 - DNA, 22 bp, Homo sapiens
cacacatgagtctccccattgg

SEQ ID NO: 7411272 - DNA, 22 bp, Homo sapiens
cacacatgaagttgctgagcta

SEQ ID NO: 7411273 - DNA, 22 bp, Homo sapiens
cacacatgaagttgctgagcta

SEQ ID NO: 7411274 - DNA, 22 bp, Homo sapiens
cacacatgaagttgctgagcta

SEQ ID NO: 7411275 - DNA, 22 bp, Homo sapiens
cacacagacagctctctgaaga

SEQ ID NO: 7411276 - DNA, 22 bp, Homo sapiens
cacacatgaagttgctgagcta

SEQ ID NO: 7411277 - DNA, 22 bp, Homo sapiens
cacacatgaatccctagtacct

SEQ ID NO: 7411278 - DNA, 22 bp, Homo sapiens
cacacatgaatccctagtacct

SEQ ID NO: 7411279 - DNA, 22 bp, Homo sapiens
cacacatgaatccctagtacct

SEQ ID NO: 7411280 - DNA, 22 bp, Homo sapiens
cacacatgtctctccatgctct

SEQ ID NO: 7411281 - DNA, 22 bp, Homo sapiens
cacacatgtctctccatgctct

SEQ ID NO: 7411282 - DNA, 22 bp, Homo sapiens
cacacatgtctctccatgctct

SEQ ID NO: 7411283 - DNA, 22 bp, Homo sapiens
cacacatgtctctccatgctct

SEQ ID NO: 7411284 - DNA, 22 bp, Homo sapiens
cacacatgtctctccatgctct

SEQ ID NO: 7411285 - DNA, 22 bp, Homo sapiens
cacacatggttccgcaggatgc

SEQ ID NO: 7411286 - DNA, 22 bp, Homo sapiens
cacacatggttccgcaggatgc

SEQ ID NO: 7411287 - DNA, 22 bp, Homo sapiens
cacacatggttccgcaggatgc

SEQ ID NO: 7411288 - DNA, 22 bp, Homo sapiens
cacacatggtcagtggctactc

SEQ ID NO: 7411289 - DNA, 22 bp, Homo sapiens
cacacatggtcagtggctactc

SEQ ID NO: 7411290 - DNA, 22 bp, Homo sapiens
cacacatggtagcaggtacaag

SEQ ID NO: 7411291 - DNA, 22 bp, Homo sapiens
cacacatggtagcaggtacaag

SEQ ID NO: 7411292 - DNA, 22 bp, Homo sapiens
cacacatggtagcaggtacaag

SEQ ID NO: 7411293 - DNA, 22 bp, Homo sapiens
cacacatggtagcaggtacaag

SEQ ID NO: 7411294 - DNA, 22 bp, Homo sapiens
cacacatggctgccagggaggt

SEQ ID NO: 7411295 - DNA, 22 bp, Homo sapiens
cacacatggtagcaggtacaag

SEQ ID NO: 7411296 - DNA, 22 bp, Homo sapiens
cacacatggtagcaggtacaag

SEQ ID NO: 7411297 - DNA, 22 bp, Homo sapiens
caattttattggtccaaataca

SEQ ID NO: 7411298 - DNA, 22 bp, Homo sapiens
caattttattggtccaaataca

SEQ ID NO: 7411299 - DNA, 22 bp, Homo sapiens
caattttattggtccaaataca

SEQ ID NO: 7411300 - DNA, 22 bp, Homo sapiens
caattttattggtccaaataca

SEQ ID NO: 7411301 - DNA, 18 bp, Homo sapiens
caattttacccagtccct

SEQ ID NO: 7411302 - DNA, 18 bp, Homo sapiens
caattttacccagtccct

SEQ ID NO: 7411303 - DNA, 22 bp, Homo sapiens
caattttactcttcctcttcca

SEQ ID NO: 7411304 - DNA, 22 bp, Homo sapiens
caattttactcttcctcttcca

SEQ ID NO: 7411305 - DNA, 22 bp, Homo sapiens
caattttactcttcctcttcca

SEQ ID NO: 7411306 - DNA, 22 bp, Homo sapiens
caattttattggtccaaataca

SEQ ID NO: 7411307 - DNA, 22 bp, Homo sapiens
caattttattggtccaaataca

SEQ ID NO: 7411308 - DNA, 22 bp, Homo sapiens
caattttcaattccttcagata

SEQ ID NO: 7411309 - DNA, 22 bp, Homo sapiens
caattttcaattccttcagata

SEQ ID NO: 7411310 - DNA, 22 bp, Homo sapiens
caatttttaaactatgaagttg

SEQ ID NO: 7411311 - DNA, 22 bp, Homo sapiens
caatttttaaactatgaagttg

SEQ ID NO: 7411312 - DNA, 22 bp, Homo sapiens
caatttttaaactatgaagttg

SEQ ID NO: 7411313 - DNA, 22 bp, Homo sapiens
caattttcaattccttcagata

SEQ ID NO: 7411314 - DNA, 22 bp, Homo sapiens
caatttttaaactatgaagttg

SEQ ID NO: 7411315 - DNA, 22 bp, Homo sapiens
caatttttaaactatgaagttg

SEQ ID NO: 7411316 - DNA, 22 bp, Homo sapiens
caatttttaaactatgaagttg

SEQ ID NO: 7411317 - DNA, 22 bp, Homo sapiens
caatttttgtacttatagtact

SEQ ID NO: 7411318 - DNA, 22 bp, Homo sapiens
caatttttgtacttatagtact

SEQ ID NO: 7411319 - DNA, 22 bp, Homo sapiens
caatttttgtacttatagtact

SEQ ID NO: 7411320 - DNA, 22 bp, Homo sapiens
caatttttgtacttatagtact

SEQ ID NO: 7411321 - DNA, 22 bp, Homo sapiens
caatttttaaactatgaagttg

SEQ ID NO: 7411322 - DNA, 22 bp, Homo sapiens
caatttttgtacttatagtact

SEQ ID NO: 7411323 - DNA, 22 bp, Homo sapiens
caatttttgtacttatagtact

SEQ ID NO: 7411324 - DNA, 22 bp, Homo sapiens
cacacagaaccgctcgccactt

SEQ ID NO: 7411325 - DNA, 22 bp, Homo sapiens
cacacagaaccgctcgccactt

SEQ ID NO: 7411326 - DNA, 22 bp, Homo sapiens
cacacatcttatcccagttatt

SEQ ID NO: 7411327 - DNA, 22 bp, Homo sapiens
cacacatcttatcccagttatt

SEQ ID NO: 7411328 - DNA, 22 bp, Homo sapiens
cacacatcaacctagacattgt

SEQ ID NO: 7411329 - DNA, 22 bp, Homo sapiens
caatttttgtacttatagtact

SEQ ID NO: 7411330 - DNA, 22 bp, Homo sapiens
cacacagaaccgctcgccactt

SEQ ID NO: 7411331 - DNA, 22 bp, Homo sapiens
caatttgattaataccatactt

SEQ ID NO: 7411332 - DNA, 22 bp, Homo sapiens
caatttgccctgttaaattttc

SEQ ID NO: 7411333 - DNA, 22 bp, Homo sapiens
caatttcttgttaattctcagg

SEQ ID NO: 7411334 - DNA, 22 bp, Homo sapiens
caatttgtctaatgaaactcag

SEQ ID NO: 7411335 - DNA, 22 bp, Homo sapiens
caatttgtctaatgaaactcag

SEQ ID NO: 7411336 - DNA, 18 bp, Homo sapiens
caattttacccagtccct

SEQ ID NO: 7411337 - DNA, 18 bp, Homo sapiens
caattttacccagtccct

SEQ ID NO: 7411338 - DNA, 22 bp, Homo sapiens
caatttctggaactaattctga

SEQ ID NO: 7411339 - DNA, 22 bp, Homo sapiens
caatttctgggcctcacacaag

SEQ ID NO: 7411340 - DNA, 22 bp, Homo sapiens
caatttcttgttaattctcagg

SEQ ID NO: 7411341 - DNA, 22 bp, Homo sapiens
caatttcttgttaattctcagg

SEQ ID NO: 7411342 - DNA, 22 bp, Homo sapiens
caatttcttgttaattctcagg

SEQ ID NO: 7411343 - DNA, 22 bp, Homo sapiens
caattcaatggcaaagtattgt

SEQ ID NO: 7411344 - DNA, 22 bp, Homo sapiens
caattcaagttgagtacagctt

SEQ ID NO: 7411345 - DNA, 22 bp, Homo sapiens
caattcaatggcaaagtattgt

SEQ ID NO: 7411346 - DNA, 22 bp, Homo sapiens
caatttctggaactaattctga

SEQ ID NO: 7411347 - DNA, 22 bp, Homo sapiens
caattcaatggcaaagtattgt

SEQ ID NO: 7411348 - DNA, 22 bp, Homo sapiens
caattcaatggcaaagtattgt

SEQ ID NO: 7411349 - DNA, 22 bp, Homo sapiens
caatttctctttatatctcaca

SEQ ID NO: 7411350 - DNA, 22 bp, Homo sapiens
caatttctggaactaattctga

SEQ ID NO: 7411351 - DNA, 18 bp, Homo sapiens
caattcaagagcctacag

SEQ ID NO: 7411352 - DNA, 22 bp, Homo sapiens
caattcaagttgagtacagctt

SEQ ID NO: 7411353 - DNA, 18 bp, Homo sapiens
caattcaagagcctacag

SEQ ID NO: 7411354 - DNA, 22 bp, Homo sapiens
caattcaagttgagtacagctt

SEQ ID NO: 7411355 - DNA, 22 bp, Homo sapiens
caattcaacctaagtgcatcca

SEQ ID NO: 7411356 - DNA, 22 bp, Homo sapiens
caattcaacctaagtgcatcca

SEQ ID NO: 7411357 - DNA, 22 bp, Homo sapiens
caattcaacttgcctttgtagc

SEQ ID NO: 7411358 - DNA, 22 bp, Homo sapiens
caattcaacttgcctttgtagc

SEQ ID NO: 7411359 - DNA, 22 bp, Homo sapiens
caattcaacctaagtgcatcca

SEQ ID NO: 7411360 - DNA, 22 bp, Homo sapiens
caattcaaatgcatagttcaca

SEQ ID NO: 7411361 - DNA, 22 bp, Homo sapiens
caattcaaatgcatagttcaca

SEQ ID NO: 7411362 - DNA, 22 bp, Homo sapiens
caattattcagtgacttaagag

SEQ ID NO: 7411363 - DNA, 22 bp, Homo sapiens
caattcaaaccagtctgtctct

SEQ ID NO: 7411364 - DNA, 22 bp, Homo sapiens
caattcaaaccagtctgtctct

SEQ ID NO: 7411365 - DNA, 22 bp, Homo sapiens
caattcaaaccagtctgtctct

SEQ ID NO: 7411366 - DNA, 22 bp, Homo sapiens
caattcaaatgcatagttcaca

SEQ ID NO: 7411367 - DNA, 22 bp, Homo sapiens
cactgggtaaatttgaggctga

SEQ ID NO: 7411368 - DNA, 22 bp, Homo sapiens
cactgggtcaggatagagccca

SEQ ID NO: 7411369 - DNA, 22 bp, Homo sapiens
cactggtacactgaatggcgtt

SEQ ID NO: 7411370 - DNA, 22 bp, Homo sapiens
cactgggtaaatttgaggctga

SEQ ID NO: 7411371 - DNA, 22 bp, Homo sapiens
cactggtacgtaggttggggca

SEQ ID NO: 7411372 - DNA, 22 bp, Homo sapiens
cactggtagagagaagacaagg

SEQ ID NO: 7411373 - DNA, 21 bp, Homo sapiens
cactggtagatggcccgcagg

SEQ ID NO: 7411374 - DNA, 23 bp, Homo sapiens
cactgggggctgctacagagagg

SEQ ID NO: 7411375 - DNA, 23 bp, Homo sapiens
cactgggggctgctacagagagg

SEQ ID NO: 7411376 - DNA, 23 bp, Homo sapiens
cactgggggctgctacagagagg

SEQ ID NO: 7411377 - DNA, 22 bp, Homo sapiens
cactggggtgggcctggtagag

SEQ ID NO: 7411378 - DNA, 22 bp, Homo sapiens
cactggggtgggcctggtagag

SEQ ID NO: 7411379 - DNA, 22 bp, Homo sapiens
cactggggtgggcctggtagag

SEQ ID NO: 7411380 - DNA, 22 bp, Homo sapiens
cactggggtgggcctggtagag

SEQ ID NO: 7411381 - DNA, 22 bp, Homo sapiens
cactggggtgggcctggtagag

SEQ ID NO: 7411382 - DNA, 22 bp, Homo sapiens
cactttgcagggtggtgggagg

SEQ ID NO: 7411383 - DNA, 22 bp, Homo sapiens
cactttgcagggtggtgggagg

SEQ ID NO: 7411384 - DNA, 20 bp, Homo sapiens
cactttggacctgatgtatc

SEQ ID NO: 7411385 - DNA, 22 bp, Homo sapiens
cactttgcttagagaacaaggc

SEQ ID NO: 7411386 - DNA, 22 bp, Homo sapiens
cactttgcttagagaacaaggc

SEQ ID NO: 7411387 - DNA, 22 bp, Homo sapiens
cactttgatgcagggctcagta

SEQ ID NO: 7411388 - DNA, 22 bp, Homo sapiens
cactttgatgcagggctcagta

SEQ ID NO: 7411389 - DNA, 22 bp, Homo sapiens
cactggtcagcatggtagacca

SEQ ID NO: 7411390 - DNA, 22 bp, Homo sapiens
cactggtatttgaaaatagatg

SEQ ID NO: 7411391 - DNA, 22 bp, Homo sapiens
cactggtagagagaagacaagg

SEQ ID NO: 7411392 - DNA, 22 bp, Homo sapiens
cactggtagcagttaagttagg

SEQ ID NO: 7411393 - DNA, 22 bp, Homo sapiens
cactggtagtttcagcaaccag

SEQ ID NO: 7411394 - DNA, 22 bp, Homo sapiens
agcattttctgagagtatagat

SEQ ID NO: 7411395 - DNA, 22 bp, Homo sapiens
agcattttctgagagtatagat

SEQ ID NO: 7411396 - DNA, 22 bp, Homo sapiens
agcattttctgagagtatagat

SEQ ID NO: 7411397 - DNA, 22 bp, Homo sapiens
agcattttctgagagtatagat

SEQ ID NO: 7411398 - DNA, 22 bp, Homo sapiens
cactgggcaattctgagcctaa

SEQ ID NO: 7411399 - DNA, 22 bp, Homo sapiens
agccaaaacatgtgagttttga

SEQ ID NO: 7411400 - DNA, 22 bp, Homo sapiens
agccaaaacatgtgagttttga

SEQ ID NO: 7411401 - DNA, 22 bp, Homo sapiens
agcattttctgagagtatagat

SEQ ID NO: 7411402 - DNA, 22 bp, Homo sapiens
agcattttctgagagtatagat

SEQ ID NO: 7411403 - DNA, 20 bp, Homo sapiens
agcattttatggtaggaaac

SEQ ID NO: 7411404 - DNA, 20 bp, Homo sapiens
agcattttatggtaggaaac

SEQ ID NO: 7411405 - DNA, 19 bp, Homo sapiens
agcatttggaattctacac

SEQ ID NO: 7411406 - DNA, 17 bp, Homo sapiens
agcatttgtgttaacag

SEQ ID NO: 7411407 - DNA, 20 bp, Homo sapiens
cactgggctggagtcagggc

SEQ ID NO: 7411408 - DNA, 20 bp, Homo sapiens
cactgggctggagtcagggc

SEQ ID NO: 7411409 - DNA, 20 bp, Homo sapiens
cactgggctggagtcagggc

SEQ ID NO: 7411410 - DNA, 22 bp, Homo sapiens
cactgggctgataccaggcttc

SEQ ID NO: 7411411 - DNA, 22 bp, Homo sapiens
cactgggctgataccaggcttc

SEQ ID NO: 7411412 - DNA, 22 bp, Homo sapiens
cactgggctgataccaggcttc

SEQ ID NO: 7411413 - DNA, 22 bp, Homo sapiens
cactgggctgataccaggcttc

SEQ ID NO: 7411414 - DNA, 22 bp, Homo sapiens
cactggggaaaacaggcttctt

SEQ ID NO: 7411415 - DNA, 22 bp, Homo sapiens
cactggggaaaacaggcttctt

SEQ ID NO: 7411416 - DNA, 22 bp, Homo sapiens
cactgggctttgtagttagcat

SEQ ID NO: 7411417 - DNA, 22 bp, Homo sapiens
cactgggcgtgtcctgggtgag

SEQ ID NO: 7411418 - DNA, 22 bp, Homo sapiens
cactgggcgtgtcctgggtgag

SEQ ID NO: 7411419 - DNA, 22 bp, Homo sapiens
cactgggcgtgtcctgggtgag

SEQ ID NO: 7411420 - DNA, 23 bp, Homo sapiens
cactgggcccagggtgtggaggc

SEQ ID NO: 7411421 - DNA, 23 bp, Homo sapiens
cactgggcccagggtgtggaggc

SEQ ID NO: 7411422 - DNA, 22 bp, Homo sapiens
cactgggcgccagctgctgagc

SEQ ID NO: 7411423 - DNA, 22 bp, Homo sapiens
cactgggcgccagctgctgagc

SEQ ID NO: 7411424 - DNA, 22 bp, Homo sapiens
cagaaactatgtaagaaagtga

SEQ ID NO: 7411425 - DNA, 22 bp, Homo sapiens
cagaaactgcttgtggtcatct

SEQ ID NO: 7411426 - DNA, 22 bp, Homo sapiens
cagaaactatgtaagaaagtga

SEQ ID NO: 7411427 - DNA, 22 bp, Homo sapiens
cagaaactagatttagacacaa

SEQ ID NO: 7411428 - DNA, 22 bp, Homo sapiens
cagaaactagatttagacacaa

SEQ ID NO: 7411429 - DNA, 22 bp, Homo sapiens
cagaaactagatttagacacaa

SEQ ID NO: 7411430 - DNA, 22 bp, Homo sapiens
cagaaacatgtataaagttgta

SEQ ID NO: 7411431 - DNA, 22 bp, Homo sapiens
cagaaacatgtataaagttgta

SEQ ID NO: 7411432 - DNA, 22 bp, Homo sapiens
cagaaacatgtataaagttgta

SEQ ID NO: 7411433 - DNA, 22 bp, Homo sapiens
cagaaaccaaatgggatgggga

SEQ ID NO: 7411434 - DNA, 22 bp, Homo sapiens
cagaaaccaaatgggatgggga

SEQ ID NO: 7411435 - DNA, 22 bp, Homo sapiens
cagaaacctccctgaatatttt

SEQ ID NO: 7411436 - DNA, 22 bp, Homo sapiens
cagaaacctgtctggagtggga

SEQ ID NO: 7411437 - DNA, 22 bp, Homo sapiens
cagaaacctccctgaatatttt

SEQ ID NO: 7411438 - DNA, 22 bp, Homo sapiens
cagaaacctgtctggagtggga

SEQ ID NO: 7411439 - DNA, 22 bp, Homo sapiens
cagaaactagatttagacacaa

SEQ ID NO: 7411440 - DNA, 20 bp, Homo sapiens
cagaaagaaggtagattttt

SEQ ID NO: 7411441 - DNA, 20 bp, Homo sapiens
cagaaagaaggtagattttt

SEQ ID NO: 7411442 - DNA, 20 bp, Homo sapiens
cagaaagaaggtagattttt

SEQ ID NO: 7411443 - DNA, 20 bp, Homo sapiens
cagaaagaaggtagattttt

SEQ ID NO: 7411444 - DNA, 20 bp, Homo sapiens
cagaaagaaggtagattttt

SEQ ID NO: 7411445 - DNA, 20 bp, Homo sapiens
cagaaagaaggtagattttt

SEQ ID NO: 7411446 - DNA, 20 bp, Homo sapiens
cagaaagaaggtagattttt

SEQ ID NO: 7411447 - DNA, 22 bp, Homo sapiens
cagaaacttttgatgagtgtat

SEQ ID NO: 7411448 - DNA, 22 bp, Homo sapiens
cagaaacttttgatgagtgtat

SEQ ID NO: 7411449 - DNA, 22 bp, Homo sapiens
cagaaactttggccctcaagcc

SEQ ID NO: 7411450 - DNA, 22 bp, Homo sapiens
cagaaactttctttactgagca

SEQ ID NO: 7411451 - DNA, 22 bp, Homo sapiens
cagaaactttctttactgagca

SEQ ID NO: 7411452 - DNA, 22 bp, Homo sapiens
cagaaactttctttactgagca

SEQ ID NO: 7411453 - DNA, 21 bp, Homo sapiens
cagaaacttgctttgccttct

SEQ ID NO: 7411454 - DNA, 22 bp, Homo sapiens
cagaaacttctggtgtcaaata

SEQ ID NO: 7411455 - DNA, 22 bp, Homo sapiens
cagaaacttctggtgtcaaata

SEQ ID NO: 7411456 - DNA, 22 bp, Homo sapiens
cagaaactgtttgttaatattt

SEQ ID NO: 7411457 - DNA, 22 bp, Homo sapiens
cagaaactgtttgttaatattt

SEQ ID NO: 7411458 - DNA, 22 bp, Homo sapiens
cagaaacttctggtgtcaaata

SEQ ID NO: 7411459 - DNA, 22 bp, Homo sapiens
cagaaactgtttgttaatattt

SEQ ID NO: 7411460 - DNA, 22 bp, Homo sapiens
cagaaactgtggattcattaaa

SEQ ID NO: 7411461 - DNA, 22 bp, Homo sapiens
agccaaaggcaccagagacact

SEQ ID NO: 7411462 - DNA, 22 bp, Homo sapiens
agccaaaggcaccagagacact

SEQ ID NO: 7411463 - DNA, 20 bp, Homo sapiens
agccaaaggagaacagtgct

SEQ ID NO: 7411464 - DNA, 20 bp, Homo sapiens
agccaaaggagaacagtgct

SEQ ID NO: 7411465 - DNA, 20 bp, Homo sapiens
agccaaaggagaacagtgct

SEQ ID NO: 7411466 - DNA, 22 bp, Homo sapiens
agccaaagatcagtgtgcaagt

SEQ ID NO: 7411467 - DNA, 22 bp, Homo sapiens
agccaaagatcagtgtgcaagt

SEQ ID NO: 7411468 - DNA, 22 bp, Homo sapiens
agccaaagatcagtgtgcaagt

SEQ ID NO: 7411469 - DNA, 22 bp, Homo sapiens
agccaacagccagcatcaacca

SEQ ID NO: 7411470 - DNA, 22 bp, Homo sapiens
agccaacaactctgagcccagt

SEQ ID NO: 7411471 - DNA, 22 bp, Homo sapiens
agccaacagccagcatcaacca

SEQ ID NO: 7411472 - DNA, 22 bp, Homo sapiens
agccaaagtccaaatgcagtgt

SEQ ID NO: 7411473 - DNA, 22 bp, Homo sapiens
agccaaaggcaccagagacact

SEQ ID NO: 7411474 - DNA, 22 bp, Homo sapiens
agccaaagtccaaatgcagtgt

SEQ ID NO: 7411475 - DNA, 22 bp, Homo sapiens
agccaaagtggtatatagggaa

SEQ ID NO: 7411476 - DNA, 22 bp, Homo sapiens
agccaaatacaaactggggtgg

SEQ ID NO: 7411477 - DNA, 22 bp, Homo sapiens
cagaaagacctgattggcagtt

SEQ ID NO: 7411478 - DNA, 22 bp, Homo sapiens
cagaaagacctgattggcagtt

SEQ ID NO: 7411479 - DNA, 22 bp, Homo sapiens
cagaaagacctgattggcagtt

SEQ ID NO: 7411480 - DNA, 22 bp, Homo sapiens
cagaaagacctgattggcagtt

SEQ ID NO: 7411481 - DNA, 22 bp, Homo sapiens
cagaaagacctgattggcagtt

SEQ ID NO: 7411482 - DNA, 22 bp, Homo sapiens
cagaaagacctgattggcagtt

SEQ ID NO: 7411483 - DNA, 22 bp, Homo sapiens
cagaaagacctgattggcagtt

SEQ ID NO: 7411484 - DNA, 20 bp, Homo sapiens
cagaaagaaggtagattttt

SEQ ID NO: 7411485 - DNA, 20 bp, Homo sapiens
cagaaagaaggtagattttt

SEQ ID NO: 7411486 - DNA, 20 bp, Homo sapiens
cagaaagaaggtagattttt

SEQ ID NO: 7411487 - DNA, 22 bp, Homo sapiens
cagaaagacctgggctcaagag

SEQ ID NO: 7411488 - DNA, 22 bp, Homo sapiens
cagaaagacctgggctcaagag

SEQ ID NO: 7411489 - DNA, 22 bp, Homo sapiens
cagaaagacctgggctcaagag

SEQ ID NO: 7411490 - DNA, 22 bp, Homo sapiens
cagaaagacctgggctcaagag

SEQ ID NO: 7411491 - DNA, 22 bp, Homo sapiens
cagaaagacctgggctcaagag

SEQ ID NO: 7411492 - DNA, 22 bp, Homo sapiens
cagaaagacctgattggcagtt

SEQ ID NO: 7411493 - DNA, 22 bp, Homo sapiens
cagaaagacctgggctcaagag

SEQ ID NO: 7411494 - DNA, 22 bp, Homo sapiens
cagaaagacctgggctcaagag

SEQ ID NO: 7411495 - DNA, 22 bp, Homo sapiens
cagaaagacctgggctcaagag

SEQ ID NO: 7411496 - DNA, 22 bp, Homo sapiens
agccaaagatcagtgtgcaagt

SEQ ID NO: 7411497 - DNA, 22 bp, Homo sapiens
agcatttccgccctcttctgcc

SEQ ID NO: 7411498 - DNA, 22 bp, Homo sapiens
agcatttatttcttagaaattg

SEQ ID NO: 7411499 - DNA, 22 bp, Homo sapiens
agcatttatttcttagaaattg

SEQ ID NO: 7411500 - DNA, 22 bp, Homo sapiens
agcatttgatatgtttaaaaag

SEQ ID NO: 7411501 - DNA, 22 bp, Homo sapiens
agcatttatgactaatgtaaaa

SEQ ID NO: 7411502 - DNA, 22 bp, Homo sapiens
agcatttatgactaatgtaaaa

SEQ ID NO: 7411503 - DNA, 22 bp, Homo sapiens
agcatttattgagtgccctggg

SEQ ID NO: 7411504 - DNA, 22 bp, Homo sapiens
agcatttatttcttagaaattg

SEQ ID NO: 7411505 - DNA, 22 bp, Homo sapiens
agcatttatttcttagaaattg

SEQ ID NO: 7411506 - DNA, 22 bp, Homo sapiens
agcatttatttcttagaaattg

SEQ ID NO: 7411507 - DNA, 22 bp, Homo sapiens
agcatttagttagtaaatgttt

SEQ ID NO: 7411508 - DNA, 22 bp, Homo sapiens
agcatttagttagtaaatgttt

SEQ ID NO: 7411509 - DNA, 22 bp, Homo sapiens
agcatttagtctttattgcagc

SEQ ID NO: 7411510 - DNA, 22 bp, Homo sapiens
agcatttagttagtaaatgttt

SEQ ID NO: 7411511 - DNA, 22 bp, Homo sapiens
agcatttagttagtaaatgttt

SEQ ID NO: 7411512 - DNA, 22 bp, Homo sapiens
agcatttagtctttattgcagc

SEQ ID NO: 7411513 - DNA, 22 bp, Homo sapiens
agcatttaggagaatttgagaa

SEQ ID NO: 7411514 - DNA, 22 bp, Homo sapiens
agcatttaggagaatttgagaa

SEQ ID NO: 7411515 - DNA, 22 bp, Homo sapiens
agcatttaggagaatttgagaa

SEQ ID NO: 7411516 - DNA, 22 bp, Homo sapiens
agcatttaggagaatttgagaa

SEQ ID NO: 7411517 - DNA, 22 bp, Homo sapiens
agcatttatgactaatgtaaaa

SEQ ID NO: 7411518 - DNA, 22 bp, Homo sapiens
agcatttatgactaatgtaaaa

SEQ ID NO: 7411519 - DNA, 22 bp, Homo sapiens
agcatttatcttttgtttgagt

SEQ ID NO: 7411520 - DNA, 22 bp, Homo sapiens
agcatttatgactaatgtaaaa

SEQ ID NO: 7411521 - DNA, 22 bp, Homo sapiens
agcatttagttagtaaatgttt

SEQ ID NO: 7411522 - DNA, 22 bp, Homo sapiens
agcatttagttagtaaatgttt

SEQ ID NO: 7411523 - DNA, 22 bp, Homo sapiens
agcatttatagataccctatgg

SEQ ID NO: 7411524 - DNA, 22 bp, Homo sapiens
agcatttatagataccctatgg

SEQ ID NO: 7411525 - DNA, 22 bp, Homo sapiens
agcatttatagcccctatcatc

SEQ ID NO: 7411526 - DNA, 22 bp, Homo sapiens
agcatttatagcccctatcatc

SEQ ID NO: 7411527 - DNA, 22 bp, Homo sapiens
agcatttatcttttgtttgagt

SEQ ID NO: 7411528 - DNA, 22 bp, Homo sapiens
agcatttatcttttgtttgagt

SEQ ID NO: 7411529 - DNA, 21 bp, Homo sapiens
agcattcaaaagatgccataa

SEQ ID NO: 7411530 - DNA, 22 bp, Homo sapiens
agcatttaggagaatttgagaa

SEQ ID NO: 7411531 - DNA, 22 bp, Homo sapiens
agcatttaggagaatttgagaa

SEQ ID NO: 7411532 - DNA, 22 bp, Homo sapiens
agcattcaagtaattcacttgg

SEQ ID NO: 7411533 - DNA, 22 bp, Homo sapiens
agcattcaagtaattcacttgg

SEQ ID NO: 7411534 - DNA, 21 bp, Homo sapiens
agcattcaaaagatgccataa

SEQ ID NO: 7411535 - DNA, 21 bp, Homo sapiens
agcattcaaaagatgccataa

SEQ ID NO: 7411536 - DNA, 22 bp, Homo sapiens
cactgcacttcagcctgggtga

SEQ ID NO: 7411537 - DNA, 22 bp, Homo sapiens
cactgcacttcagcctgggtga

SEQ ID NO: 7411538 - DNA, 22 bp, Homo sapiens
cactgcacttcagcctgggtga

SEQ ID NO: 7411539 - DNA, 22 bp, Homo sapiens
agcattaggtgtgtttcagagg

SEQ ID NO: 7411540 - DNA, 22 bp, Homo sapiens
cactgcacttcagcctgggtga

SEQ ID NO: 7411541 - DNA, 22 bp, Homo sapiens
cactgcacttcagcctgggtga

SEQ ID NO: 7411542 - DNA, 22 bp, Homo sapiens
cactgcacttcagcctgggtga

SEQ ID NO: 7411543 - DNA, 22 bp, Homo sapiens
cactgcacttcagcctgggtga

SEQ ID NO: 7411544 - DNA, 22 bp, Homo sapiens
cactgcacttcagcctgggtga

SEQ ID NO: 7411545 - DNA, 22 bp, Homo sapiens
cactgcacttcagcctgggtga

SEQ ID NO: 7411546 - DNA, 22 bp, Homo sapiens
cactgcacttcagcctgggtga

SEQ ID NO: 7411547 - DNA, 22 bp, Homo sapiens
cactgcacttcagcctgggtga

SEQ ID NO: 7411548 - DNA, 22 bp, Homo sapiens
cactgcactccatcctgggaaa

SEQ ID NO: 7411549 - DNA, 22 bp, Homo sapiens
cactgcactccatcctgggaaa

SEQ ID NO: 7411550 - DNA, 22 bp, Homo sapiens
cactgcactccatcctgggaaa

SEQ ID NO: 7411551 - DNA, 22 bp, Homo sapiens
cactgcactccatcctgggaaa

SEQ ID NO: 7411552 - DNA, 22 bp, Homo sapiens
cactgcacttcagcctgggtga

SEQ ID NO: 7411553 - DNA, 22 bp, Homo sapiens
cactgcacttcagcctgggtga

SEQ ID NO: 7411554 - DNA, 22 bp, Homo sapiens
cactgcacttcagcctgggtga

SEQ ID NO: 7411555 - DNA, 22 bp, Homo sapiens
cactgcacttcagcctgggtga

SEQ ID NO: 7411556 - DNA, 22 bp, Homo sapiens
cactgcacttcagcctgggtga

SEQ ID NO: 7411557 - DNA, 22 bp, Homo sapiens
cactgcacttcagcctgggtga

SEQ ID NO: 7411558 - DNA, 22 bp, Homo sapiens
cactgcacttcagcctgggtga

SEQ ID NO: 7411559 - DNA, 22 bp, Homo sapiens
cactgcactccagcactccagc

SEQ ID NO: 7411560 - DNA, 22 bp, Homo sapiens
cactgcactccagcactccagc

SEQ ID NO: 7411561 - DNA, 22 bp, Homo sapiens
cactgcactccagcccgggcaa

SEQ ID NO: 7411562 - DNA, 22 bp, Homo sapiens
cactgcactccagcccgggcaa

SEQ ID NO: 7411563 - DNA, 22 bp, Homo sapiens
cactgcactccagcccgggcaa

SEQ ID NO: 7411564 - DNA, 22 bp, Homo sapiens
cactgcactccagcccgggcaa

SEQ ID NO: 7411565 - DNA, 22 bp, Homo sapiens
cactgcactccagcccgggcaa

SEQ ID NO: 7411566 - DNA, 22 bp, Homo sapiens
cactgcaccctcaaactcctgg

SEQ ID NO: 7411567 - DNA, 22 bp, Homo sapiens
cactgcactccagcactccagc

SEQ ID NO: 7411568 - DNA, 22 bp, Homo sapiens
cactgcactccagcactccagc

SEQ ID NO: 7411569 - DNA, 22 bp, Homo sapiens
cactgcacaggtgagatgtggg

SEQ ID NO: 7411570 - DNA, 22 bp, Homo sapiens
cactgcacaggtgagatgtggg

SEQ ID NO: 7411571 - DNA, 23 bp, Homo sapiens
cactgcaatctctgcctcctggg

SEQ ID NO: 7411572 - DNA, 23 bp, Homo sapiens
cactgcaatctctgcctcctggg

SEQ ID NO: 7411573 - DNA, 23 bp, Homo sapiens
cactgcaatctctgcctcctggg

SEQ ID NO: 7411574 - DNA, 22 bp, Homo sapiens
cactgcaatatctgcatcctgg

SEQ ID NO: 7411575 - DNA, 22 bp, Homo sapiens
cactgcaatatctgcatcctgg

SEQ ID NO: 7411576 - DNA, 22 bp, Homo sapiens
cactgcaatctccatctcctgg

SEQ ID NO: 7411577 - DNA, 22 bp, Homo sapiens
cactgcaatctccatctcctgg

SEQ ID NO: 7411578 - DNA, 20 bp, Homo sapiens
cactgcaagtatttaaccca

SEQ ID NO: 7411579 - DNA, 22 bp, Homo sapiens
cactgcaagctctgccacctgg

SEQ ID NO: 7411580 - DNA, 22 bp, Homo sapiens
cactgcaagctccgcctctggg

SEQ ID NO: 7411581 - DNA, 22 bp, Homo sapiens
cactgcaagctccgcctcctgg

SEQ ID NO: 7411582 - DNA, 22 bp, Homo sapiens
cactgcaacctctgcctcctgg

SEQ ID NO: 7411583 - DNA, 22 bp, Homo sapiens
cactgcaacctccgcctcttgg

SEQ ID NO: 7411584 - DNA, 22 bp, Homo sapiens
cactgcaacctctgccacctgg

SEQ ID NO: 7411585 - DNA, 22 bp, Homo sapiens
cactgcaacctccatcttctgg

SEQ ID NO: 7411586 - DNA, 22 bp, Homo sapiens
cactgcaacctccgcctaccgg

SEQ ID NO: 7411587 - DNA, 22 bp, Homo sapiens
cactgcaacctccgcctcctgg

SEQ ID NO: 7411588 - DNA, 22 bp, Homo sapiens
cactgcaacctccagctctcag

SEQ ID NO: 7411589 - DNA, 22 bp, Homo sapiens
cactgcaacctccatcttctgg

SEQ ID NO: 7411590 - DNA, 22 bp, Homo sapiens
cactgcaacctccacctcctgg

SEQ ID NO: 7411591 - DNA, 22 bp, Homo sapiens
cactgcaacctccacctcctgg

SEQ ID NO: 7411592 - DNA, 22 bp, Homo sapiens
cactgcaacctccacctcctgg

SEQ ID NO: 7411593 - DNA, 22 bp, Homo sapiens
cactgcaacctccacctcctgg

SEQ ID NO: 7411594 - DNA, 22 bp, Homo sapiens
cactgcactccatcctgggaaa

SEQ ID NO: 7411595 - DNA, 22 bp, Homo sapiens
cactgcactccatcctgggaaa

SEQ ID NO: 7411596 - DNA, 22 bp, Homo sapiens
cactgcactccatcctgggaaa

SEQ ID NO: 7411597 - DNA, 22 bp, Homo sapiens
cactgcactccatcctgggaaa

SEQ ID NO: 7411598 - DNA, 22 bp, Homo sapiens
cactgcactccatcctgggaaa

SEQ ID NO: 7411599 - DNA, 22 bp, Homo sapiens
cactgcactccatcctgggaaa

SEQ ID NO: 7411600 - DNA, 22 bp, Homo sapiens
cactgcactccatcctgggaaa

SEQ ID NO: 7411601 - DNA, 22 bp, Homo sapiens
cactgcactccatcctgggaaa

SEQ ID NO: 7411602 - DNA, 22 bp, Homo sapiens
cactgcactccatcctgggaaa

SEQ ID NO: 7411603 - DNA, 22 bp, Homo sapiens
cactgcactccatcctgggaaa

SEQ ID NO: 7411604 - DNA, 22 bp, Homo sapiens
cactgcactccatcctgggaaa

SEQ ID NO: 7411605 - DNA, 22 bp, Homo sapiens
cactgcactccatcctgggaaa

SEQ ID NO: 7411606 - DNA, 22 bp, Homo sapiens
cactgcactccatcctgggaaa

SEQ ID NO: 7411607 - DNA, 22 bp, Homo sapiens
cactgcactccatcctgggaaa

SEQ ID NO: 7411608 - DNA, 22 bp, Homo sapiens
cactgcactccatcctgggaaa

SEQ ID NO: 7411609 - DNA, 22 bp, Homo sapiens
cactgcactccagcccgggcaa

SEQ ID NO: 7411610 - DNA, 22 bp, Homo sapiens
cactgcactccagcccgggcaa

SEQ ID NO: 7411611 - DNA, 22 bp, Homo sapiens
cactgcactccagcccgggcaa

SEQ ID NO: 7411612 - DNA, 22 bp, Homo sapiens
cactgcactccatcctgggaaa

SEQ ID NO: 7411613 - DNA, 22 bp, Homo sapiens
cactgcactccatcctgggaaa

SEQ ID NO: 7411614 - DNA, 22 bp, Homo sapiens
cactgcactccagcccgggcaa

SEQ ID NO: 7411615 - DNA, 22 bp, Homo sapiens
cactgcactccagcctcggtga

SEQ ID NO: 7411616 - DNA, 22 bp, Homo sapiens
cactgcactccagcctcggtga

SEQ ID NO: 7411617 - DNA, 22 bp, Homo sapiens
cactgcactccagcccgggcaa

SEQ ID NO: 7411618 - DNA, 22 bp, Homo sapiens
cactgcactccagcccgggcaa

SEQ ID NO: 7411619 - DNA, 22 bp, Homo sapiens
cactgcactccagcccgggcaa

SEQ ID NO: 7411620 - DNA, 22 bp, Homo sapiens
cactgcactccagcccgggcaa

SEQ ID NO: 7411621 - DNA, 22 bp, Homo sapiens
cactgcactccagcccgggcaa

SEQ ID NO: 7411622 - DNA, 22 bp, Homo sapiens
cactgcactccagcccgggcaa

SEQ ID NO: 7411623 - DNA, 22 bp, Homo sapiens
cactgcactccagcccgggcaa

SEQ ID NO: 7411624 - DNA, 22 bp, Homo sapiens
cactgcactccagcccgggcaa

SEQ ID NO: 7411625 - DNA, 22 bp, Homo sapiens
cactgcactccagcccgggcaa

SEQ ID NO: 7411626 - DNA, 22 bp, Homo sapiens
cacgggcagtgagcacagcctg

SEQ ID NO: 7411627 - DNA, 22 bp, Homo sapiens
cacgggtggaatcagggactcc

SEQ ID NO: 7411628 - DNA, 22 bp, Homo sapiens
cacgggagacgtgatcttggac

SEQ ID NO: 7411629 - DNA, 22 bp, Homo sapiens
cacgggcagtgagcacagcctg

SEQ ID NO: 7411630 - DNA, 22 bp, Homo sapiens
cacggtggaaagtagttagttg

SEQ ID NO: 7411631 - DNA, 22 bp, Homo sapiens
cacctgccaaatggggatgctg

SEQ ID NO: 7411632 - DNA, 22 bp, Homo sapiens
cacgtccacccaggctgcccag

SEQ ID NO: 7411633 - DNA, 22 bp, Homo sapiens
cacggtggcccacaggtgcaag

SEQ ID NO: 7411634 - DNA, 22 bp, Homo sapiens
cacggtggcccacaggtgcaag

SEQ ID NO: 7411635 - DNA, 22 bp, Homo sapiens
cacggtttacttaacaagccca

SEQ ID NO: 7411636 - DNA, 22 bp, Homo sapiens
cacgtttgcatagctgatgttg

SEQ ID NO: 7411637 - DNA, 22 bp, Homo sapiens
cacgtgttccaggcatggttct

SEQ ID NO: 7411638 - DNA, 22 bp, Homo sapiens
cacgttaacagctaacagatga

SEQ ID NO: 7411639 - DNA, 22 bp, Homo sapiens
cacgttaacagctaacagatga

SEQ ID NO: 7411640 - DNA, 22 bp, Homo sapiens
cacgtgcaggtcttaggagaca

SEQ ID NO: 7411641 - DNA, 22 bp, Homo sapiens
cacgtgagaccttgcagaggtg

SEQ ID NO: 7411642 - DNA, 22 bp, Homo sapiens
cacgttttatgacagaagaagc

SEQ ID NO: 7411643 - DNA, 22 bp, Homo sapiens
cactaaaactacattggaaaca

SEQ ID NO: 7411644 - DNA, 22 bp, Homo sapiens
cactaaaactacattggaaaca

SEQ ID NO: 7411645 - DNA, 22 bp, Homo sapiens
cactaaatgtttcaatgtggga

SEQ ID NO: 7411646 - DNA, 22 bp, Homo sapiens
cacctgccaaatggggatgctg

SEQ ID NO: 7411647 - DNA, 22 bp, Homo sapiens
cacctgcagggggagtcaagag

SEQ ID NO: 7411648 - DNA, 22 bp, Homo sapiens
cacctgccaaatggggatgctg

SEQ ID NO: 7411649 - DNA, 22 bp, Homo sapiens
cacggcctgtaaggacccagga

SEQ ID NO: 7411650 - DNA, 22 bp, Homo sapiens
cacggcctgtaaggacccagga

SEQ ID NO: 7411651 - DNA, 22 bp, Homo sapiens
cacgggagacgtgatcttggac

SEQ ID NO: 7411652 - DNA, 22 bp, Homo sapiens
cacatttaatcctttataagta

SEQ ID NO: 7411653 - DNA, 22 bp, Homo sapiens
cacctgagtgtcagtattctca

SEQ ID NO: 7411654 - DNA, 22 bp, Homo sapiens
cacctgagtgtcagtattctca

SEQ ID NO: 7411655 - DNA, 22 bp, Homo sapiens
cacctgagtgtcagtattctca

SEQ ID NO: 7411656 - DNA, 22 bp, Homo sapiens
cacctgcaaggagctttcattt

SEQ ID NO: 7411657 - DNA, 22 bp, Homo sapiens
cacatttaagtgcttgttcaga

SEQ ID NO: 7411658 - DNA, 22 bp, Homo sapiens
cacatttaagtgcttgttcaga

SEQ ID NO: 7411659 - DNA, 22 bp, Homo sapiens
cacatttaagtgcttgttcaga

SEQ ID NO: 7411660 - DNA, 22 bp, Homo sapiens
cacatttaagtgcttgttcaga

SEQ ID NO: 7411661 - DNA, 22 bp, Homo sapiens
cacatttaagtgcttgttcaga

SEQ ID NO: 7411662 - DNA, 22 bp, Homo sapiens
cacatttaagtgcttgttcaga

SEQ ID NO: 7411663 - DNA, 22 bp, Homo sapiens
cacatttaagtgcttgttcaga

SEQ ID NO: 7411664 - DNA, 22 bp, Homo sapiens
cacattgctaggctcttcctca

SEQ ID NO: 7411665 - DNA, 22 bp, Homo sapiens
cacattgggcttgcatgcacgg

SEQ ID NO: 7411666 - DNA, 22 bp, Homo sapiens
cacattggcaaacggggttgca

SEQ ID NO: 7411667 - DNA, 22 bp, Homo sapiens
cacattgctaggctcttcctca

SEQ ID NO: 7411668 - DNA, 22 bp, Homo sapiens
cacattgtaggtctcagctctt

SEQ ID NO: 7411669 - DNA, 22 bp, Homo sapiens
cacattgtaggtctcagctctt

SEQ ID NO: 7411670 - DNA, 22 bp, Homo sapiens
cacattgtagagattagaaaga

SEQ ID NO: 7411671 - DNA, 22 bp, Homo sapiens
cacattgtagagattagaaaga

SEQ ID NO: 7411672 - DNA, 22 bp, Homo sapiens
cacattgtagagattagaaaga

SEQ ID NO: 7411673 - DNA, 23 bp, Homo sapiens
cacattgaacactctctttcctg

SEQ ID NO: 7411674 - DNA, 22 bp, Homo sapiens
cacattgattcagtcctgtgtg

SEQ ID NO: 7411675 - DNA, 22 bp, Homo sapiens
cacattgattcagtcctgtgtg

SEQ ID NO: 7411676 - DNA, 22 bp, Homo sapiens
cacattgataattaaggcctcc

SEQ ID NO: 7411677 - DNA, 21 bp, Homo sapiens
cacattgaatacagagatgga

SEQ ID NO: 7411678 - DNA, 22 bp, Homo sapiens
cacattgaacttgtctggtggg

SEQ ID NO: 7411679 - DNA, 22 bp, Homo sapiens
cacatttaagcagatgtggacc

SEQ ID NO: 7411680 - DNA, 22 bp, Homo sapiens
cacatttaaaggttgaagctga

SEQ ID NO: 7411681 - DNA, 22 bp, Homo sapiens
cacatttaaaggttgaagctga

SEQ ID NO: 7411682 - DNA, 22 bp, Homo sapiens
cacatttaagcagatgtggacc

SEQ ID NO: 7411683 - DNA, 22 bp, Homo sapiens
cacatttaagcagatgtggacc

SEQ ID NO: 7411684 - DNA, 22 bp, Homo sapiens
cacatttaagcagatgtggacc

SEQ ID NO: 7411685 - DNA, 22 bp, Homo sapiens
cacatttaaaggttgaagctga

SEQ ID NO: 7411686 - DNA, 22 bp, Homo sapiens
cacatttaaaggttgaagctga

SEQ ID NO: 7411687 - DNA, 22 bp, Homo sapiens
cacatttaaaaaatccacgatc

SEQ ID NO: 7411688 - DNA, 22 bp, Homo sapiens
cacatttaaaaaatccacgatc

SEQ ID NO: 7411689 - DNA, 22 bp, Homo sapiens
cacatttaaaaaatccacgatc

SEQ ID NO: 7411690 - DNA, 21 bp, Homo sapiens
cacattgttccaggtttgggt

SEQ ID NO: 7411691 - DNA, 22 bp, Homo sapiens
cactagaaccaatgacatttct

SEQ ID NO: 7411692 - DNA, 22 bp, Homo sapiens
cactagatagtggctgcttgga

SEQ ID NO: 7411693 - DNA, 22 bp, Homo sapiens
cactagaaaggtacagattatg

SEQ ID NO: 7411694 - DNA, 22 bp, Homo sapiens
cactacttgaaagaattacaga

SEQ ID NO: 7411695 - DNA, 20 bp, Homo sapiens
cactacttgtttttgtcaat

SEQ ID NO: 7411696 - DNA, 20 bp, Homo sapiens
cactacttgtttttgtcaat

SEQ ID NO: 7411697 - DNA, 22 bp, Homo sapiens
cactagaaaggtacagattatg

SEQ ID NO: 7411698 - DNA, 22 bp, Homo sapiens
cactagatgataatcagctgga

SEQ ID NO: 7411699 - DNA, 22 bp, Homo sapiens
cactaggagacaaggcaaacca

SEQ ID NO: 7411700 - DNA, 22 bp, Homo sapiens
cactaggcatctgtgagggtag

SEQ ID NO: 7411701 - DNA, 22 bp, Homo sapiens
cactaggcgccgggtggctgtg

SEQ ID NO: 7411702 - DNA, 22 bp, Homo sapiens
cactaggcgccgggtggctgtg

SEQ ID NO: 7411703 - DNA, 22 bp, Homo sapiens
agcaggtggacagaggaagaaa

SEQ ID NO: 7411704 - DNA, 22 bp, Homo sapiens
agcaggtggacagaggaagaaa

SEQ ID NO: 7411705 - DNA, 22 bp, Homo sapiens
cactaggctggagtgcagtggc

SEQ ID NO: 7411706 - DNA, 22 bp, Homo sapiens
cactaggctggagtgcagtggc

SEQ ID NO: 7411707 - DNA, 22 bp, Homo sapiens
agcaggtggacagaggaagaaa

SEQ ID NO: 7411708 - DNA, 22 bp, Homo sapiens
agcaggtggatttagacgggag

SEQ ID NO: 7411709 - DNA, 22 bp, Homo sapiens
agcaggtggacagaggaagaaa

SEQ ID NO: 7411710 - DNA, 22 bp, Homo sapiens
cactaattaatgaaattccagg

SEQ ID NO: 7411711 - DNA, 22 bp, Homo sapiens
cactaattaatgaaattccagg

SEQ ID NO: 7411712 - DNA, 22 bp, Homo sapiens
cactaattaacacgtcgtctct

SEQ ID NO: 7411713 - DNA, 22 bp, Homo sapiens
cactaagttggtgttaattagt

SEQ ID NO: 7411714 - DNA, 22 bp, Homo sapiens
cactaaatgcctaggaagaagc

SEQ ID NO: 7411715 - DNA, 20 bp, Homo sapiens
cactaactgctcatgactcc

SEQ ID NO: 7411716 - DNA, 19 bp, Homo sapiens
cactaagatgagatatagc

SEQ ID NO: 7411717 - DNA, 19 bp, Homo sapiens
cactaagatgagatatagc

SEQ ID NO: 7411718 - DNA, 22 bp, Homo sapiens
cactaagatttaaagtattagt

SEQ ID NO: 7411719 - DNA, 22 bp, Homo sapiens
cactaagatttaaagtattagt

SEQ ID NO: 7411720 - DNA, 22 bp, Homo sapiens
cactaagatttaaagtattagt

SEQ ID NO: 7411721 - DNA, 22 bp, Homo sapiens
cactaattctggagacaactca

SEQ ID NO: 7411722 - DNA, 22 bp, Homo sapiens
cactaattccatctccttttcc

SEQ ID NO: 7411723 - DNA, 22 bp, Homo sapiens
cactaattacaaagagatggga

SEQ ID NO: 7411724 - DNA, 22 bp, Homo sapiens
cactacagaatcaaatacgggc

SEQ ID NO: 7411725 - DNA, 22 bp, Homo sapiens
cactacaggggtccacagctga

SEQ ID NO: 7411726 - DNA, 22 bp, Homo sapiens
cactacaggggtccacagctga

SEQ ID NO: 7411727 - DNA, 22 bp, Homo sapiens
cactacaggggtccacagctga

SEQ ID NO: 7411728 - DNA, 22 bp, Homo sapiens
cactaattctggagacaactca

SEQ ID NO: 7411729 - DNA, 22 bp, Homo sapiens
cactacaggggtccacagctga

SEQ ID NO: 7411730 - DNA, 22 bp, Homo sapiens
agcaggtggcctcctgtctgtc

SEQ ID NO: 7411731 - DNA, 22 bp, Homo sapiens
agcaggtggcctcctgtctgtc

SEQ ID NO: 7411732 - DNA, 18 bp, Homo sapiens
agcaggtggcgtctgcag

SEQ ID NO: 7411733 - DNA, 22 bp, Homo sapiens
agcaggtgggatcaagctggca

SEQ ID NO: 7411734 - DNA, 22 bp, Homo sapiens
agcaggtgggatcaagctggca

SEQ ID NO: 7411735 - DNA, 22 bp, Homo sapiens
agcaggtgggatcaagctggca

SEQ ID NO: 7411736 - DNA, 22 bp, Homo sapiens
agcaggtgggatcaagctggca

SEQ ID NO: 7411737 - DNA, 22 bp, Homo sapiens
agcaggtgggcatgaaagctga

SEQ ID NO: 7411738 - DNA, 22 bp, Homo sapiens
agcaggtgggatcaagctggca

SEQ ID NO: 7411739 - DNA, 22 bp, Homo sapiens
agcaggtgggatcaagctggca

SEQ ID NO: 7411740 - DNA, 22 bp, Homo sapiens
agcaggtggccacgaggaggag

SEQ ID NO: 7411741 - DNA, 22 bp, Homo sapiens
cactgaaatcgaaaaatgtagg

SEQ ID NO: 7411742 - DNA, 22 bp, Homo sapiens
cactgaaatcgaaaaatgtagg

SEQ ID NO: 7411743 - DNA, 22 bp, Homo sapiens
cactgaaatcgaaaaatgtagg

SEQ ID NO: 7411744 - DNA, 22 bp, Homo sapiens
cactgaacaacaaatagtgaat

SEQ ID NO: 7411745 - DNA, 22 bp, Homo sapiens
agcaggtggcctcctgtctgtc

SEQ ID NO: 7411746 - DNA, 22 bp, Homo sapiens
agcaggtggcctcctgtctgtc

SEQ ID NO: 7411747 - DNA, 22 bp, Homo sapiens
agcaggtggccacgaggaggag

SEQ ID NO: 7411748 - DNA, 22 bp, Homo sapiens
agcaggtggccacgaggaggag

SEQ ID NO: 7411749 - DNA, 22 bp, Homo sapiens
agcaggtggccacgaggaggag

SEQ ID NO: 7411750 - DNA, 22 bp, Homo sapiens
agcaggtggccacgaggaggag

SEQ ID NO: 7411751 - DNA, 22 bp, Homo sapiens
agcaggtggccacgaggaggag

SEQ ID NO: 7411752 - DNA, 22 bp, Homo sapiens
agcaggtggccacgaggaggag

SEQ ID NO: 7411753 - DNA, 22 bp, Homo sapiens
agcaggtggatttagacgggag

SEQ ID NO: 7411754 - DNA, 22 bp, Homo sapiens
agcaggtggatttagacgggag

SEQ ID NO: 7411755 - DNA, 22 bp, Homo sapiens
cacaggctctccagggcctgga

SEQ ID NO: 7411756 - DNA, 22 bp, Homo sapiens
cacaggctctccagggcctgga

SEQ ID NO: 7411757 - DNA, 22 bp, Homo sapiens
cacaggctctccagggcctgga

SEQ ID NO: 7411758 - DNA, 22 bp, Homo sapiens
cacaggctctccagggcctgga

SEQ ID NO: 7411759 - DNA, 22 bp, Homo sapiens
cacaggctcttctcacttgatt

SEQ ID NO: 7411760 - DNA, 22 bp, Homo sapiens
cacaggctctccagggcctgga

SEQ ID NO: 7411761 - DNA, 22 bp, Homo sapiens
cacaggctcttctcacttgatt

SEQ ID NO: 7411762 - DNA, 22 bp, Homo sapiens
cacaggctgcccgcagctggga

SEQ ID NO: 7411763 - DNA, 22 bp, Homo sapiens
cacaggctgcccgcagctggga

SEQ ID NO: 7411764 - DNA, 22 bp, Homo sapiens
cacaggctgcccgcagctggga

SEQ ID NO: 7411765 - DNA, 22 bp, Homo sapiens
cacaggctcttctcacttgatt

SEQ ID NO: 7411766 - DNA, 22 bp, Homo sapiens
cacaggctcttctcacttgatt

SEQ ID NO: 7411767 - DNA, 22 bp, Homo sapiens
cacaggctgcccgcagctggga

SEQ ID NO: 7411768 - DNA, 22 bp, Homo sapiens
cacaggctgcccgcagctggga

SEQ ID NO: 7411769 - DNA, 22 bp, Homo sapiens
cacatgaacatgctggaaaagc

SEQ ID NO: 7411770 - DNA, 22 bp, Homo sapiens
cacatggcagaatcatgcatct

SEQ ID NO: 7411771 - DNA, 22 bp, Homo sapiens
cacatggcagaatcatgcatct

SEQ ID NO: 7411772 - DNA, 22 bp, Homo sapiens
cacatggcagaatcatgcatct

SEQ ID NO: 7411773 - DNA, 22 bp, Homo sapiens
cacatggcagaatcatgcatct

SEQ ID NO: 7411774 - DNA, 23 bp, Homo sapiens
cacatggattaaatgagaccaca

SEQ ID NO: 7411775 - DNA, 23 bp, Homo sapiens
cacatggattaaatgagaccaca

SEQ ID NO: 7411776 - DNA, 23 bp, Homo sapiens
cacatggattaaatgagaccaca

SEQ ID NO: 7411777 - DNA, 23 bp, Homo sapiens
cacatggaggaccgttcttataa

SEQ ID NO: 7411778 - DNA, 22 bp, Homo sapiens
cacatggaagagatacagtgag

SEQ ID NO: 7411779 - DNA, 23 bp, Homo sapiens
cacatggaatcttcagagtcacc

SEQ ID NO: 7411780 - DNA, 22 bp, Homo sapiens
cacatgaagacctaattggatt

SEQ ID NO: 7411781 - DNA, 22 bp, Homo sapiens
cacatgaacatgctggaaaagc

SEQ ID NO: 7411782 - DNA, 22 bp, Homo sapiens
cacatgaagacctaattggatt

SEQ ID NO: 7411783 - DNA, 22 bp, Homo sapiens
cacatgaagacctaattggatt

SEQ ID NO: 7411784 - DNA, 22 bp, Homo sapiens
cacatgaagagagtctagtaat

SEQ ID NO: 7411785 - DNA, 22 bp, Homo sapiens
cacatgaagagagtctagtaat

SEQ ID NO: 7411786 - DNA, 22 bp, Homo sapiens
cacatgcttcttttgattatga

SEQ ID NO: 7411787 - DNA, 22 bp, Homo sapiens
cacatggaagagatacagtgag

SEQ ID NO: 7411788 - DNA, 22 bp, Homo sapiens
cacatgtcctggcgctgagccc

SEQ ID NO: 7411789 - DNA, 22 bp, Homo sapiens
cacatgtcccctctaggggctt

SEQ ID NO: 7411790 - DNA, 22 bp, Homo sapiens
cacatgtagtaagcaggcaatg

SEQ ID NO: 7411791 - DNA, 22 bp, Homo sapiens
cacatgtcctgggaaaataact

SEQ ID NO: 7411792 - DNA, 22 bp, Homo sapiens
cacatgtcctggcgctgagccc

SEQ ID NO: 7411793 - DNA, 22 bp, Homo sapiens
cacatgtcctggcgctgagccc

SEQ ID NO: 7411794 - DNA, 17 bp, Homo sapiens
cacatgtctacatggat

SEQ ID NO: 7411795 - DNA, 22 bp, Homo sapiens
cacatgtcctgggaaaataact

SEQ ID NO: 7411796 - DNA, 22 bp, Homo sapiens
cacatgtcctgggaaaataact

SEQ ID NO: 7411797 - DNA, 17 bp, Homo sapiens
cacatgtctacatggat

SEQ ID NO: 7411798 - DNA, 22 bp, Homo sapiens
cacatgggtgtgcctggaggaa

SEQ ID NO: 7411799 - DNA, 22 bp, Homo sapiens
cacatgggtgtgcctggaggaa

SEQ ID NO: 7411800 - DNA, 22 bp, Homo sapiens
cacatggtggtgcttgataagc

SEQ ID NO: 7411801 - DNA, 22 bp, Homo sapiens
cacatgtacagaagcaggctgg

SEQ ID NO: 7411802 - DNA, 22 bp, Homo sapiens
cacatggttatatttgtaaagc

SEQ ID NO: 7411803 - DNA, 22 bp, Homo sapiens
cacatgggtgtgcctggaggaa

SEQ ID NO: 7411804 - DNA, 22 bp, Homo sapiens
cacatgggtgtgcctggaggaa

SEQ ID NO: 7411805 - DNA, 22 bp, Homo sapiens
cacatgggtggatggatgcatg

SEQ ID NO: 7411806 - DNA, 22 bp, Homo sapiens
cacatgggtggatggatgcatg

SEQ ID NO: 7411807 - DNA, 22 bp, Homo sapiens
cacatggggcgctgcattggcc

SEQ ID NO: 7411808 - DNA, 22 bp, Homo sapiens
cacatggggcgctgcattggcc

SEQ ID NO: 7411809 - DNA, 22 bp, Homo sapiens
cacatgggcttagcaggcaggg

SEQ ID NO: 7411810 - DNA, 22 bp, Homo sapiens
cacatgggcttagcaggcaggg

SEQ ID NO: 7411811 - DNA, 22 bp, Homo sapiens
cacatggcctgtgtggccagac

SEQ ID NO: 7411812 - DNA, 22 bp, Homo sapiens
cacatggcctgtgtggccagac

SEQ ID NO: 7411813 - DNA, 22 bp, Homo sapiens
cacatggcctgtgtggccagac

SEQ ID NO: 7411814 - DNA, 22 bp, Homo sapiens
cacatggcctgtgtggccagac

SEQ ID NO: 7411815 - DNA, 22 bp, Homo sapiens
cacatggcctgtgtggccagac

SEQ ID NO: 7411816 - DNA, 22 bp, Homo sapiens
cacatggcagaatcatgcatct

SEQ ID NO: 7411817 - DNA, 22 bp, Homo sapiens
cacatggcagaatcatgcatct

SEQ ID NO: 7411818 - DNA, 22 bp, Homo sapiens
cacatgggcttagcaggcaggg

SEQ ID NO: 7411819 - DNA, 22 bp, Homo sapiens
cacatgggcgtaatgtccatgg

SEQ ID NO: 7411820 - DNA, 22 bp, Homo sapiens
cacatgggcgtaatgtccatgg

SEQ ID NO: 7411821 - DNA, 22 bp, Homo sapiens
cacatgggcacagagaacttgg

SEQ ID NO: 7411822 - DNA, 22 bp, Homo sapiens
agcaggcctcatgcaccagcta

SEQ ID NO: 7411823 - DNA, 22 bp, Homo sapiens
agcaggcctcatgcaccagcta

SEQ ID NO: 7411824 - DNA, 22 bp, Homo sapiens
agcaggcctcatgcaccagcta

SEQ ID NO: 7411825 - DNA, 22 bp, Homo sapiens
agcaggcctcatgcaccagcta

SEQ ID NO: 7411826 - DNA, 22 bp, Homo sapiens
agcaggcctgccacctcggggt

SEQ ID NO: 7411827 - DNA, 22 bp, Homo sapiens
agcaggcctcatgcaccagcta

SEQ ID NO: 7411828 - DNA, 22 bp, Homo sapiens
agcaggcccagggcttctcagc

SEQ ID NO: 7411829 - DNA, 21 bp, Homo sapiens
agcaggcccaatggagggggc

SEQ ID NO: 7411830 - DNA, 21 bp, Homo sapiens
agcaggcccaatggagggggc

SEQ ID NO: 7411831 - DNA, 21 bp, Homo sapiens
agcaggcccaatggagggggc

SEQ ID NO: 7411832 - DNA, 19 bp, Homo sapiens
agcaggccaggcaggtggc

SEQ ID NO: 7411833 - DNA, 22 bp, Homo sapiens
agcaggcccaagctggggggaa

SEQ ID NO: 7411834 - DNA, 22 bp, Homo sapiens
agcaggcccaagctggggggaa

SEQ ID NO: 7411835 - DNA, 21 bp, Homo sapiens
agcaggcccaatggagggggc

SEQ ID NO: 7411836 - DNA, 22 bp, Homo sapiens
agcaggcccaagctggggggaa

SEQ ID NO: 7411837 - DNA, 19 bp, Homo sapiens
agcaggccaggcaggtggc

SEQ ID NO: 7411838 - DNA, 19 bp, Homo sapiens
agcaggccaggcaggtggc

SEQ ID NO: 7411839 - DNA, 19 bp, Homo sapiens
agcaggccaggcaggtggc

SEQ ID NO: 7411840 - DNA, 19 bp, Homo sapiens
agcaggccaggcaggtggc

SEQ ID NO: 7411841 - DNA, 19 bp, Homo sapiens
agcaggccaggcaggtggc

SEQ ID NO: 7411842 - DNA, 22 bp, Homo sapiens
agcaggccactgcagctggagc

SEQ ID NO: 7411843 - DNA, 20 bp, Homo sapiens
agcaggccttggggagagga

SEQ ID NO: 7411844 - DNA, 18 bp, Homo sapiens
agcaggcgttgcctggga

SEQ ID NO: 7411845 - DNA, 20 bp, Homo sapiens
agcaggccttggggagagga

SEQ ID NO: 7411846 - DNA, 20 bp, Homo sapiens
agcaggccttggggagagga

SEQ ID NO: 7411847 - DNA, 20 bp, Homo sapiens
agcaggccttggggagagga

SEQ ID NO: 7411848 - DNA, 22 bp, Homo sapiens
agcaggcctgccacctcggggt

SEQ ID NO: 7411849 - DNA, 22 bp, Homo sapiens
agcaggcctgccacctcggggt

SEQ ID NO: 7411850 - DNA, 22 bp, Homo sapiens
agcaggctactcctgtgttcgt

SEQ ID NO: 7411851 - DNA, 22 bp, Homo sapiens
agcaggctactcctgtgttcgt

SEQ ID NO: 7411852 - DNA, 22 bp, Homo sapiens
agcaggctactcctgtgttcgt

SEQ ID NO: 7411853 - DNA, 22 bp, Homo sapiens
agcaggctaatcttgctgaaca

SEQ ID NO: 7411854 - DNA, 22 bp, Homo sapiens
agcaggctaatcttgctgaaca

SEQ ID NO: 7411855 - DNA, 22 bp, Homo sapiens
cacaggctccggccttgcagcc

SEQ ID NO: 7411856 - DNA, 22 bp, Homo sapiens
cacaggctccggccttgcagcc

SEQ ID NO: 7411857 - DNA, 22 bp, Homo sapiens
cacaggctccggccttgcagcc

SEQ ID NO: 7411858 - DNA, 18 bp, Homo sapiens
cacaggctcccagtgagg

SEQ ID NO: 7411859 - DNA, 22 bp, Homo sapiens
cacaggctccggccttgcagcc

SEQ ID NO: 7411860 - DNA, 18 bp, Homo sapiens
cacaggctcccagtgagg

SEQ ID NO: 7411861 - DNA, 22 bp, Homo sapiens
cacaggctccggccttgcagcc

SEQ ID NO: 7411862 - DNA, 22 bp, Homo sapiens
cacaggctccggccttgcagcc

SEQ ID NO: 7411863 - DNA, 22 bp, Homo sapiens
cacaggctccggccttgcagcc

SEQ ID NO: 7411864 - DNA, 22 bp, Homo sapiens
cacaggctccggccttgcagcc

SEQ ID NO: 7411865 - DNA, 22 bp, Homo sapiens
cacaggctccggccttgcagcc

SEQ ID NO: 7411866 - DNA, 20 bp, Homo sapiens
cacaggctatatgagagcca

SEQ ID NO: 7411867 - DNA, 20 bp, Homo sapiens
cacaggctatatgagagcca

SEQ ID NO: 7411868 - DNA, 18 bp, Homo sapiens
cacaggctcccagtgagg

SEQ ID NO: 7411869 - DNA, 20 bp, Homo sapiens
cacaggctatatgagagcca

SEQ ID NO: 7411870 - DNA, 18 bp, Homo sapiens
cacaggctcccagtgagg

SEQ ID NO: 7411871 - DNA, 18 bp, Homo sapiens
cacaggctcccagtgagg

SEQ ID NO: 7411872 - DNA, 18 bp, Homo sapiens
cacaggctcccagtgagg

SEQ ID NO: 7411873 - DNA, 18 bp, Homo sapiens
cacaggctcccagtgagg

SEQ ID NO: 7411874 - DNA, 18 bp, Homo sapiens
cacaggctcccagtgagg

SEQ ID NO: 7411875 - DNA, 19 bp, Homo sapiens
agcaggctaggctgcctct

SEQ ID NO: 7411876 - DNA, 19 bp, Homo sapiens
agcaggctaggctgcctct

SEQ ID NO: 7411877 - DNA, 19 bp, Homo sapiens
agcaggctaggctgcctct

SEQ ID NO: 7411878 - DNA, 22 bp, Homo sapiens
agcaggctaggaacctcactgc

SEQ ID NO: 7411879 - DNA, 22 bp, Homo sapiens
agcaggctaggaacctcactgc

SEQ ID NO: 7411880 - DNA, 22 bp, Homo sapiens
agcaggctaggaacctcactgc

SEQ ID NO: 7411881 - DNA, 22 bp, Homo sapiens
agcaggctaggaacctcactgc

SEQ ID NO: 7411882 - DNA, 22 bp, Homo sapiens
agcaggctaggaacctcactgc

SEQ ID NO: 7411883 - DNA, 22 bp, Homo sapiens
agcaggctaggaacctcactgc

SEQ ID NO: 7411884 - DNA, 20 bp, Homo sapiens
cacaggctatatgagagcca

SEQ ID NO: 7411885 - DNA, 20 bp, Homo sapiens
cacaggctatatgagagcca

SEQ ID NO: 7411886 - DNA, 20 bp, Homo sapiens
cacaggctatatgagagcca

SEQ ID NO: 7411887 - DNA, 20 bp, Homo sapiens
agcaggccttggggagagga

SEQ ID NO: 7411888 - DNA, 19 bp, Homo sapiens
agcaggctaggctgcctct

SEQ ID NO: 7411889 - DNA, 19 bp, Homo sapiens
agcaggctaggctgcctct

SEQ ID NO: 7411890 - DNA, 22 bp, Homo sapiens
agcgccactgcactccagcctg

SEQ ID NO: 7411891 - DNA, 22 bp, Homo sapiens
agcgccactgcactccagcctg

SEQ ID NO: 7411892 - DNA, 22 bp, Homo sapiens
agcgccactgcactccagcctg

SEQ ID NO: 7411893 - DNA, 22 bp, Homo sapiens
agcgccactgcactccagcctg

SEQ ID NO: 7411894 - DNA, 22 bp, Homo sapiens
agcgccactgcactccagcctg

SEQ ID NO: 7411895 - DNA, 22 bp, Homo sapiens
agcgccactgcactccagcctg

SEQ ID NO: 7411896 - DNA, 22 bp, Homo sapiens
agcgccactgcactccagcctg

SEQ ID NO: 7411897 - DNA, 22 bp, Homo sapiens
agcgcaggaacacgtctgcctt

SEQ ID NO: 7411898 - DNA, 22 bp, Homo sapiens
agcgaggttttgcagatacagc

SEQ ID NO: 7411899 - DNA, 22 bp, Homo sapiens
agcgaggtgagtcctccagctc

SEQ ID NO: 7411900 - DNA, 22 bp, Homo sapiens
agcgagtgggtcagcgttgcag

SEQ ID NO: 7411901 - DNA, 22 bp, Homo sapiens
agcgagtgggtcagcgttgcag

SEQ ID NO: 7411902 - DNA, 22 bp, Homo sapiens
agcgcaggaacacgtctgcctt

SEQ ID NO: 7411903 - DNA, 22 bp, Homo sapiens
agcgccactgcactccagcctg

SEQ ID NO: 7411904 - DNA, 22 bp, Homo sapiens
agcgcccaggggcagggctctc

SEQ ID NO: 7411905 - DNA, 21 bp, Homo sapiens
agcgcctgcaacaaggcagat

SEQ ID NO: 7411906 - DNA, 21 bp, Homo sapiens
agcgcctgcaacaaggcagat

SEQ ID NO: 7411907 - DNA, 22 bp, Homo sapiens
agcgccactgcactccagcctg

SEQ ID NO: 7411908 - DNA, 22 bp, Homo sapiens
agcgccactgcactccagcctg

SEQ ID NO: 7411909 - DNA, 22 bp, Homo sapiens
agcgccactgcactccagcctg

SEQ ID NO: 7411910 - DNA, 22 bp, Homo sapiens
agcgccactgcactccagcctg

SEQ ID NO: 7411911 - DNA, 22 bp, Homo sapiens
agcgccactgcactccagcctg

SEQ ID NO: 7411912 - DNA, 22 bp, Homo sapiens
agcgctgtgggcgtgcgaggag

SEQ ID NO: 7411913 - DNA, 22 bp, Homo sapiens
agcgctgtgggcgtgcgaggag

SEQ ID NO: 7411914 - DNA, 22 bp, Homo sapiens
agcgctgtgggcgtgcgaggag

SEQ ID NO: 7411915 - DNA, 22 bp, Homo sapiens
agcgctggctggcgctccttcc

SEQ ID NO: 7411916 - DNA, 22 bp, Homo sapiens
agcgctggtgatctctattttg

SEQ ID NO: 7411917 - DNA, 22 bp, Homo sapiens
agcgctggctggcgctccttcc

SEQ ID NO: 7411918 - DNA, 22 bp, Homo sapiens
agcgctggctggcgctccttcc

SEQ ID NO: 7411919 - DNA, 22 bp, Homo sapiens
agcgcggctcagcctggaaacc

SEQ ID NO: 7411920 - DNA, 22 bp, Homo sapiens
agcgctggctggcgctccttcc

SEQ ID NO: 7411921 - DNA, 22 bp, Homo sapiens
agcgcctgcggtgtgagcctgc

SEQ ID NO: 7411922 - DNA, 22 bp, Homo sapiens
agcgcctgcaccactctgcggc

SEQ ID NO: 7411923 - DNA, 22 bp, Homo sapiens
agcgcctgcaccactctgcggc

SEQ ID NO: 7411924 - DNA, 22 bp, Homo sapiens
agcgcctgcggtgtgagcctgc

SEQ ID NO: 7411925 - DNA, 22 bp, Homo sapiens
agcgacaccgcctgcaggccat

SEQ ID NO: 7411926 - DNA, 22 bp, Homo sapiens
agccttttggagttattctggg

SEQ ID NO: 7411927 - DNA, 22 bp, Homo sapiens
agccttttggagttattctggg

SEQ ID NO: 7411928 - DNA, 22 bp, Homo sapiens
agccttttggagttattctggg

SEQ ID NO: 7411929 - DNA, 22 bp, Homo sapiens
cagcatgtatctttcaggtgtg

SEQ ID NO: 7411930 - DNA, 22 bp, Homo sapiens
cagcatgtggattcctcccact

SEQ ID NO: 7411931 - DNA, 22 bp, Homo sapiens
cagcatgtatctttcaggtgtg

SEQ ID NO: 7411932 - DNA, 22 bp, Homo sapiens
agcgagcacattgagtgaagaa

SEQ ID NO: 7411933 - DNA, 22 bp, Homo sapiens
agcgacagaaaccaaggacaag

SEQ ID NO: 7411934 - DNA, 22 bp, Homo sapiens
agcgagagattcaacagcaagt

SEQ ID NO: 7411935 - DNA, 22 bp, Homo sapiens
agcgagggaggtctgaggacag

SEQ ID NO: 7411936 - DNA, 22 bp, Homo sapiens
cagcatgtaagccactgccctg

SEQ ID NO: 7411937 - DNA, 22 bp, Homo sapiens
cagcatggttgggttctgggga

SEQ ID NO: 7411938 - DNA, 22 bp, Homo sapiens
cagcatggttgggttctgggga

SEQ ID NO: 7411939 - DNA, 22 bp, Homo sapiens
cagcatggtggagctgctcttt

SEQ ID NO: 7411940 - DNA, 22 bp, Homo sapiens
cagcatggtggagctgctcttt

SEQ ID NO: 7411941 - DNA, 22 bp, Homo sapiens
cagcatggtggagctgctcttt

SEQ ID NO: 7411942 - DNA, 22 bp, Homo sapiens
cagcatggtgccagtgagtcca

SEQ ID NO: 7411943 - DNA, 22 bp, Homo sapiens
cagcatggtgccagtgagtcca

SEQ ID NO: 7411944 - DNA, 22 bp, Homo sapiens
cagcatggtgccagtgagtcca

SEQ ID NO: 7411945 - DNA, 22 bp, Homo sapiens
cagcatggtgccagtgagtcca

SEQ ID NO: 7411946 - DNA, 22 bp, Homo sapiens
cagcatggtgccagtgagtcca

SEQ ID NO: 7411947 - DNA, 22 bp, Homo sapiens
cagcatgggttccgggggcctg

SEQ ID NO: 7411948 - DNA, 22 bp, Homo sapiens
cagcatggtgccagtgagtcca

SEQ ID NO: 7411949 - DNA, 22 bp, Homo sapiens
cagcatgggttccgggggcctg

SEQ ID NO: 7411950 - DNA, 22 bp, Homo sapiens
cagcatgggttccgggggcctg

SEQ ID NO: 7411951 - DNA, 22 bp, Homo sapiens
cagcatgggttccgggggcctg

SEQ ID NO: 7411952 - DNA, 22 bp, Homo sapiens
cagcatgggttccgggggcctg

SEQ ID NO: 7411953 - DNA, 22 bp, Homo sapiens
cagcatggggcttggagtcagc

SEQ ID NO: 7411954 - DNA, 22 bp, Homo sapiens
cagcatggggcttggagtcagc

SEQ ID NO: 7411955 - DNA, 22 bp, Homo sapiens
cagcatggggcttggagtcagc

SEQ ID NO: 7411956 - DNA, 22 bp, Homo sapiens
cagcatggggcttggagtcagc

SEQ ID NO: 7411957 - DNA, 22 bp, Homo sapiens
cagcatggggcttggagtcagc

SEQ ID NO: 7411958 - DNA, 22 bp, Homo sapiens
cagcatggggcttggagtcagc

SEQ ID NO: 7411959 - DNA, 22 bp, Homo sapiens
cagcatgggggcaattcaggtg

SEQ ID NO: 7411960 - DNA, 22 bp, Homo sapiens
cagcatggggcttggagtcagc

SEQ ID NO: 7411961 - DNA, 22 bp, Homo sapiens
cagcatggggcttggagtcagc

SEQ ID NO: 7411962 - DNA, 22 bp, Homo sapiens
cagcatggggcttggagtcagc

SEQ ID NO: 7411963 - DNA, 22 bp, Homo sapiens
cagcagaaaatgtgggtgattt

SEQ ID NO: 7411964 - DNA, 22 bp, Homo sapiens
cagcagaaacccagcaaagcca

SEQ ID NO: 7411965 - DNA, 22 bp, Homo sapiens
cagcagaaaatgtgggtgattt

SEQ ID NO: 7411966 - DNA, 22 bp, Homo sapiens
cagcagaaacccagcaaagcca

SEQ ID NO: 7411967 - DNA, 22 bp, Homo sapiens
cagcagaaacccagcaaagcca

SEQ ID NO: 7411968 - DNA, 22 bp, Homo sapiens
cagcagaaaatgtgggtgattt

SEQ ID NO: 7411969 - DNA, 22 bp, Homo sapiens
cagcagaaaatacctgtaactc

SEQ ID NO: 7411970 - DNA, 22 bp, Homo sapiens
cagcagaaaatacctgtaactc

SEQ ID NO: 7411971 - DNA, 22 bp, Homo sapiens
cagcagaaaatacctgtaactc

SEQ ID NO: 7411972 - DNA, 22 bp, Homo sapiens
cagcagaaaatacctgtaactc

SEQ ID NO: 7411973 - DNA, 22 bp, Homo sapiens
cagcatcaccgccatttctgat

SEQ ID NO: 7411974 - DNA, 22 bp, Homo sapiens
cagcatcaccaacttgagcaat

SEQ ID NO: 7411975 - DNA, 22 bp, Homo sapiens
cagcatcagcctggctcaggcc

SEQ ID NO: 7411976 - DNA, 22 bp, Homo sapiens
cagcatggacaggggtggcgtt

SEQ ID NO: 7411977 - DNA, 22 bp, Homo sapiens
cagcatggacaggggtggcgtt

SEQ ID NO: 7411978 - DNA, 22 bp, Homo sapiens
cagcatcatactacctaaatga

SEQ ID NO: 7411979 - DNA, 22 bp, Homo sapiens
cagcatggacaggggtggcgtt

SEQ ID NO: 7411980 - DNA, 22 bp, Homo sapiens
cagcatggggatcactgtaggc

SEQ ID NO: 7411981 - DNA, 22 bp, Homo sapiens
cagcatggggatcactgtaggc

SEQ ID NO: 7411982 - DNA, 22 bp, Homo sapiens
cagcatggggatcactgtaggc

SEQ ID NO: 7411983 - DNA, 22 bp, Homo sapiens
cagcatggcttgagtgtttcct

SEQ ID NO: 7411984 - DNA, 22 bp, Homo sapiens
cagcatggcttgagtgtttcct

SEQ ID NO: 7411985 - DNA, 22 bp, Homo sapiens
cagcatggccatttctcgctgc

SEQ ID NO: 7411986 - DNA, 22 bp, Homo sapiens
cagcatggccatttctcgctgc

SEQ ID NO: 7411987 - DNA, 22 bp, Homo sapiens
cagcatggacccatcgctgagt

SEQ ID NO: 7411988 - DNA, 22 bp, Homo sapiens
cagcatggacccatcgctgagt

SEQ ID NO: 7411989 - DNA, 22 bp, Homo sapiens
cagcatggacaggggtggcgtt

SEQ ID NO: 7411990 - DNA, 22 bp, Homo sapiens
cagcatggagacaaagtgggca

SEQ ID NO: 7411991 - DNA, 22 bp, Homo sapiens
cagcatggacccatcgctgagt

SEQ ID NO: 7411992 - DNA, 22 bp, Homo sapiens
cagcatggagacaaagtgggca

SEQ ID NO: 7411993 - DNA, 22 bp, Homo sapiens
cagcatggacaggggtggcgtt

SEQ ID NO: 7411994 - DNA, 22 bp, Homo sapiens
cagcatggagacaaagtgggca

SEQ ID NO: 7411995 - DNA, 22 bp, Homo sapiens
cagcatggagacaaagtgggca

SEQ ID NO: 7411996 - DNA, 22 bp, Homo sapiens
cagcacttggtgccattgagtg

SEQ ID NO: 7411997 - DNA, 22 bp, Homo sapiens
cagcacttggtgccattgagtg

SEQ ID NO: 7411998 - DNA, 22 bp, Homo sapiens
cagcacttgagctttcatgtaa

SEQ ID NO: 7411999 - DNA, 22 bp, Homo sapiens
cagcacttgagctttcatgtaa

SEQ ID NO: 7412000 - DNA, 22 bp, Homo sapiens
cagcacttgagctttcatgtaa

SEQ ID NO: 7412001 - DNA, 22 bp, Homo sapiens
cagcactttgagggctcttaat

SEQ ID NO: 7412002 - DNA, 22 bp, Homo sapiens
cagcagaaaatacctgtaactc

SEQ ID NO: 7412003 - DNA, 22 bp, Homo sapiens
cagcagaaaatacctgtaactc

SEQ ID NO: 7412004 - DNA, 22 bp, Homo sapiens
cagcactttagcggaggcatca

SEQ ID NO: 7412005 - DNA, 22 bp, Homo sapiens
cagcactttgagggctcttaat

SEQ ID NO: 7412006 - DNA, 22 bp, Homo sapiens
cagcactttgagggctcttaat

SEQ ID NO: 7412007 - DNA, 22 bp, Homo sapiens
cagcacttggtgccattgagtg

SEQ ID NO: 7412008 - DNA, 22 bp, Homo sapiens
cagcacttcagcattcagattt

SEQ ID NO: 7412009 - DNA, 22 bp, Homo sapiens
cagcactgttcccagaccactg

SEQ ID NO: 7412010 - DNA, 22 bp, Homo sapiens
cagcacttcaatgagcatttca

SEQ ID NO: 7412011 - DNA, 22 bp, Homo sapiens
cagcacttcaatgagcatttca

SEQ ID NO: 7412012 - DNA, 22 bp, Homo sapiens
cagcactgttcccagaccactg

SEQ ID NO: 7412013 - DNA, 22 bp, Homo sapiens
cagcactgttcccagaccactg

SEQ ID NO: 7412014 - DNA, 22 bp, Homo sapiens
cagcactgttcccagaccactg

SEQ ID NO: 7412015 - DNA, 22 bp, Homo sapiens
cagcactgtgataactgagcca

SEQ ID NO: 7412016 - DNA, 22 bp, Homo sapiens
cagcactggggccactggagtt

SEQ ID NO: 7412017 - DNA, 22 bp, Homo sapiens
cagcactggggccactggagtt

SEQ ID NO: 7412018 - DNA, 22 bp, Homo sapiens
cagcactggggccactggagtt

SEQ ID NO: 7412019 - DNA, 22 bp, Homo sapiens
cagcactgggaccactagaaca

SEQ ID NO: 7412020 - DNA, 22 bp, Homo sapiens
cagcactgggaccactagaaca

SEQ ID NO: 7412021 - DNA, 22 bp, Homo sapiens
cagcactgcttcgcagccaggg

SEQ ID NO: 7412022 - DNA, 22 bp, Homo sapiens
cagcactgcttcgcagccaggg

SEQ ID NO: 7412023 - DNA, 22 bp, Homo sapiens
cagcactgcttcgcagccaggg

SEQ ID NO: 7412024 - DNA, 22 bp, Homo sapiens
cagcactgcttcgcagccaggg

SEQ ID NO: 7412025 - DNA, 22 bp, Homo sapiens
cagcactggggggattcggagc

SEQ ID NO: 7412026 - DNA, 22 bp, Homo sapiens
cagcactgtgataactgagcca

SEQ ID NO: 7412027 - DNA, 22 bp, Homo sapiens
cagcactgtgataactgagcca

SEQ ID NO: 7412028 - DNA, 22 bp, Homo sapiens
cagcactgtgataactgagcca

SEQ ID NO: 7412029 - DNA, 22 bp, Homo sapiens
cagcactgtgataactgagcca

SEQ ID NO: 7412030 - DNA, 22 bp, Homo sapiens
cagcactgtgataactgagcca

SEQ ID NO: 7412031 - DNA, 22 bp, Homo sapiens
cagcactgtgataactgagcca

SEQ ID NO: 7412032 - DNA, 22 bp, Homo sapiens
cagcactgtgataactgagcca

SEQ ID NO: 7412033 - DNA, 22 bp, Homo sapiens
cagcactggggccactggagtt

SEQ ID NO: 7412034 - DNA, 22 bp, Homo sapiens
cagcactggggccactggagtt

SEQ ID NO: 7412035 - DNA, 22 bp, Homo sapiens
cagcactggggccactggagtt

SEQ ID NO: 7412036 - DNA, 22 bp, Homo sapiens
cagcctctctgtatctcaggat

SEQ ID NO: 7412037 - DNA, 22 bp, Homo sapiens
cagcctctctgtatctcaggat

SEQ ID NO: 7412038 - DNA, 22 bp, Homo sapiens
cagcctctaagcacagcctctc

SEQ ID NO: 7412039 - DNA, 22 bp, Homo sapiens
cagcctctctgtatctcaggat

SEQ ID NO: 7412040 - DNA, 22 bp, Homo sapiens
cagcctctaagcacagcctctc

SEQ ID NO: 7412041 - DNA, 22 bp, Homo sapiens
cagcctctaagcacagcctctc

SEQ ID NO: 7412042 - DNA, 22 bp, Homo sapiens
cagcctctaagcacagcctctc

SEQ ID NO: 7412043 - DNA, 22 bp, Homo sapiens
cagcctcctgggacactcaccg

SEQ ID NO: 7412044 - DNA, 22 bp, Homo sapiens
cagcctcctgggacactcaccg

SEQ ID NO: 7412045 - DNA, 22 bp, Homo sapiens
cagcctcctgggacactcaccg

SEQ ID NO: 7412046 - DNA, 22 bp, Homo sapiens
cagcctcctgggacactcaccg

SEQ ID NO: 7412047 - DNA, 22 bp, Homo sapiens
cagcctctaagcacagcctctc

SEQ ID NO: 7412048 - DNA, 22 bp, Homo sapiens
cagcctcctgggacactcaccg

SEQ ID NO: 7412049 - DNA, 22 bp, Homo sapiens
cagcctctaagcacagcctctc

SEQ ID NO: 7412050 - DNA, 22 bp, Homo sapiens
cagccccacacggtctagctct

SEQ ID NO: 7412051 - DNA, 22 bp, Homo sapiens
cagccccacacggtctagctct

SEQ ID NO: 7412052 - DNA, 22 bp, Homo sapiens
cagccccacacggtctagctct

SEQ ID NO: 7412053 - DNA, 22 bp, Homo sapiens
cagccccacacggtctagctct

SEQ ID NO: 7412054 - DNA, 22 bp, Homo sapiens
cagccccacacggtctagctct

SEQ ID NO: 7412055 - DNA, 22 bp, Homo sapiens
cagcccattcctgccatgccgc

SEQ ID NO: 7412056 - DNA, 22 bp, Homo sapiens
cagcccattcctgccatgccgc

SEQ ID NO: 7412057 - DNA, 22 bp, Homo sapiens
cagcccattcctgccatgccgc

SEQ ID NO: 7412058 - DNA, 22 bp, Homo sapiens
cagcccattccttcctgggggt

SEQ ID NO: 7412059 - DNA, 22 bp, Homo sapiens
cagcccattccttcctgggggt

SEQ ID NO: 7412060 - DNA, 22 bp, Homo sapiens
cagcccatttctgggacctgag

SEQ ID NO: 7412061 - DNA, 22 bp, Homo sapiens
cagcccatttctgggacctgag

SEQ ID NO: 7412062 - DNA, 22 bp, Homo sapiens
cagcccatttctgggacctgag

SEQ ID NO: 7412063 - DNA, 22 bp, Homo sapiens
cagcctcctgggacactcaccg

SEQ ID NO: 7412064 - DNA, 22 bp, Homo sapiens
cagcctcctgggacactcaccg

SEQ ID NO: 7412065 - DNA, 22 bp, Homo sapiens
cagccctggtgaggttggctat

SEQ ID NO: 7412066 - DNA, 22 bp, Homo sapiens
cagccctggtgaggttggctat

SEQ ID NO: 7412067 - DNA, 22 bp, Homo sapiens
cagccctggtgaggttggctat

SEQ ID NO: 7412068 - DNA, 22 bp, Homo sapiens
cagccctggtgaggttggctat

SEQ ID NO: 7412069 - DNA, 22 bp, Homo sapiens
cagccctggtgaggttggctat

SEQ ID NO: 7412070 - DNA, 22 bp, Homo sapiens
cagccctggtgaggttggctat

SEQ ID NO: 7412071 - DNA, 22 bp, Homo sapiens
cagcccaggtctctcttccagt

SEQ ID NO: 7412072 - DNA, 22 bp, Homo sapiens
cagcccaggtctctcttccagt

SEQ ID NO: 7412073 - DNA, 22 bp, Homo sapiens
cagcccaggtctctcttccagt

SEQ ID NO: 7412074 - DNA, 22 bp, Homo sapiens
cagcccaggtctctcttccagt

SEQ ID NO: 7412075 - DNA, 22 bp, Homo sapiens
cagcccaggtctctcttccagt

SEQ ID NO: 7412076 - DNA, 22 bp, Homo sapiens
cagcccaggtctctcttccagt

SEQ ID NO: 7412077 - DNA, 22 bp, Homo sapiens
cagcccaggtctctcttccagt

SEQ ID NO: 7412078 - DNA, 19 bp, Homo sapiens
cagcccagggtgctaccaa

SEQ ID NO: 7412079 - DNA, 19 bp, Homo sapiens
cagcccagggtgctaccaa

SEQ ID NO: 7412080 - DNA, 19 bp, Homo sapiens
cagcccagggtgctaccaa

SEQ ID NO: 7412081 - DNA, 19 bp, Homo sapiens
cagcccagggtgctaccaa

SEQ ID NO: 7412082 - DNA, 19 bp, Homo sapiens
cagcccagggtgctaccaa

SEQ ID NO: 7412083 - DNA, 22 bp, Homo sapiens
cagcccaggtggcggaggttgc

SEQ ID NO: 7412084 - DNA, 22 bp, Homo sapiens
cagcccaggtggcggaggttgc

SEQ ID NO: 7412085 - DNA, 22 bp, Homo sapiens
cagcccaggtggcggaggttgc

SEQ ID NO: 7412086 - DNA, 22 bp, Homo sapiens
cagcccaggtggcggaggttgc

SEQ ID NO: 7412087 - DNA, 22 bp, Homo sapiens
cagcccaggtctctcttccagt

SEQ ID NO: 7412088 - DNA, 22 bp, Homo sapiens
cagcccaggtctctcttccagt

SEQ ID NO: 7412089 - DNA, 22 bp, Homo sapiens
cagcccaggtctctcttccagt

SEQ ID NO: 7412090 - DNA, 22 bp, Homo sapiens
cagcccaggtctctcttccagt

SEQ ID NO: 7412091 - DNA, 22 bp, Homo sapiens
cagcccaggtctctcttccagt

SEQ ID NO: 7412092 - DNA, 22 bp, Homo sapiens
cagcccaggtctctcttccagt

SEQ ID NO: 7412093 - DNA, 22 bp, Homo sapiens
cagcccagtaccaagcagttgg

SEQ ID NO: 7412094 - DNA, 22 bp, Homo sapiens
cagcccagtaccaagcagttgg

SEQ ID NO: 7412095 - DNA, 22 bp, Homo sapiens
cagcccagtaccaagcagttgg

SEQ ID NO: 7412096 - DNA, 22 bp, Homo sapiens
cagcccagtaccaagcagttgg

SEQ ID NO: 7412097 - DNA, 22 bp, Homo sapiens
cagcccaggtggcggaggttgc

SEQ ID NO: 7412098 - DNA, 22 bp, Homo sapiens
cagcccagtaccaagcagttgg

SEQ ID NO: 7412099 - DNA, 22 bp, Homo sapiens
cagcccaggtggcggaggttgc

SEQ ID NO: 7412100 - DNA, 22 bp, Homo sapiens
cagcccagtgcacgcccgtttc

SEQ ID NO: 7412101 - DNA, 22 bp, Homo sapiens
cagcccagtaccaagcagttgg

SEQ ID NO: 7412102 - DNA, 22 bp, Homo sapiens
cagcccagtgcacgcccgtttc

SEQ ID NO: 7412103 - DNA, 22 bp, Homo sapiens
cagcccagtgcacgcccgtttc

SEQ ID NO: 7412104 - DNA, 22 bp, Homo sapiens
cagcccagtgcacgcccgtttc

SEQ ID NO: 7412105 - DNA, 22 bp, Homo sapiens
cagcccagtgcacgcccgtttc

SEQ ID NO: 7412106 - DNA, 22 bp, Homo sapiens
cagcccatggtttgtggccagt

SEQ ID NO: 7412107 - DNA, 22 bp, Homo sapiens
cagcccatggtttgtggccagt

SEQ ID NO: 7412108 - DNA, 22 bp, Homo sapiens
cagcccatggtttgtggccagt

SEQ ID NO: 7412109 - DNA, 22 bp, Homo sapiens
cagcccatctagctttagagat

SEQ ID NO: 7412110 - DNA, 22 bp, Homo sapiens
cagcccatctagctttagagat

SEQ ID NO: 7412111 - DNA, 23 bp, Homo sapiens
cagcccatggcattttttacagt

SEQ ID NO: 7412112 - DNA, 23 bp, Homo sapiens
cagcccatggcattttttacagt

SEQ ID NO: 7412113 - DNA, 22 bp, Homo sapiens
cagcccatccaaggcttggcat

SEQ ID NO: 7412114 - DNA, 22 bp, Homo sapiens
cagcccatccaaggcttggcat

SEQ ID NO: 7412115 - DNA, 22 bp, Homo sapiens
cagcccatccaaggcttggcat

SEQ ID NO: 7412116 - DNA, 22 bp, Homo sapiens
cagcccagtgcatttgtgtact

SEQ ID NO: 7412117 - DNA, 22 bp, Homo sapiens
cagcccataccagaagtggagt

SEQ ID NO: 7412118 - DNA, 22 bp, Homo sapiens
cagcccataccagaagtggagt

SEQ ID NO: 7412119 - DNA, 22 bp, Homo sapiens
cagcccagtgcatttgtgtact

SEQ ID NO: 7412120 - DNA, 22 bp, Homo sapiens
cagcccagtgcatttgtgtact

SEQ ID NO: 7412121 - DNA, 22 bp, Homo sapiens
cagcccagtgcatttgtgtact

SEQ ID NO: 7412122 - DNA, 22 bp, Homo sapiens
cagcccagtgcacgcccgtttc

SEQ ID NO: 7412123 - DNA, 22 bp, Homo sapiens
cagcccagtgcacgcccgtttc

SEQ ID NO: 7412124 - DNA, 22 bp, Homo sapiens
cagcccacttcccagcacctac

SEQ ID NO: 7412125 - DNA, 22 bp, Homo sapiens
cagcccacttcccagcacctac

SEQ ID NO: 7412126 - DNA, 22 bp, Homo sapiens
cagcccacttcccagcacctac

SEQ ID NO: 7412127 - DNA, 22 bp, Homo sapiens
cagcccacttcccagcacctac

SEQ ID NO: 7412128 - DNA, 22 bp, Homo sapiens
cagcccacttcccagcacctac

SEQ ID NO: 7412129 - DNA, 22 bp, Homo sapiens
cagcccacttcccagcacctac

SEQ ID NO: 7412130 - DNA, 22 bp, Homo sapiens
cagcccacttcccagcacctac

SEQ ID NO: 7412131 - DNA, 22 bp, Homo sapiens
cagcccagaactcacgtctcca

SEQ ID NO: 7412132 - DNA, 22 bp, Homo sapiens
cagcccagaactcacgtctcca

SEQ ID NO: 7412133 - DNA, 22 bp, Homo sapiens
cagcccagaactcacgtctcca

SEQ ID NO: 7412134 - DNA, 22 bp, Homo sapiens
cagcccagaactcacgtctcca

SEQ ID NO: 7412135 - DNA, 22 bp, Homo sapiens
cagcccagaactcacgtctcca

SEQ ID NO: 7412136 - DNA, 22 bp, Homo sapiens
cagcccagagaaggggcccgtg

SEQ ID NO: 7412137 - DNA, 22 bp, Homo sapiens
cagcccagagaaggggcccgtg

SEQ ID NO: 7412138 - DNA, 22 bp, Homo sapiens
cagcccagacaccatcattcta

SEQ ID NO: 7412139 - DNA, 22 bp, Homo sapiens
cagcccagagaaggggcccgtg

SEQ ID NO: 7412140 - DNA, 22 bp, Homo sapiens
cagcccagacaccatcattcta

SEQ ID NO: 7412141 - DNA, 22 bp, Homo sapiens
cagcccagacaccatcattcta

SEQ ID NO: 7412142 - DNA, 22 bp, Homo sapiens
cagcccagacaccatcattcta

SEQ ID NO: 7412143 - DNA, 22 bp, Homo sapiens
cagcccagaactcacgtctcca

SEQ ID NO: 7412144 - DNA, 22 bp, Homo sapiens
cagcccagaactcacgtctcca

SEQ ID NO: 7412145 - DNA, 22 bp, Homo sapiens
cagcccagaactcacgtctcca

SEQ ID NO: 7412146 - DNA, 22 bp, Homo sapiens
cagcccagaactcacgtctcca

SEQ ID NO: 7412147 - DNA, 22 bp, Homo sapiens
cagcccagagaaggggcccgtg

SEQ ID NO: 7412148 - DNA, 22 bp, Homo sapiens
cagcccagagaaggggcccgtg

SEQ ID NO: 7412149 - DNA, 22 bp, Homo sapiens
cagcccagagaaggggcccgtg

SEQ ID NO: 7412150 - DNA, 22 bp, Homo sapiens
cagcccagagaaggggcccgtg

SEQ ID NO: 7412151 - DNA, 22 bp, Homo sapiens
cagcccagagaaggggcccgtg

SEQ ID NO: 7412152 - DNA, 22 bp, Homo sapiens
cagcccagagaaggggcccgtg

SEQ ID NO: 7412153 - DNA, 22 bp, Homo sapiens
cagcccagagatgttatctagt

SEQ ID NO: 7412154 - DNA, 22 bp, Homo sapiens
cagcccagagatgttatctagt

SEQ ID NO: 7412155 - DNA, 22 bp, Homo sapiens
cagcccagagaaggggcccgtg

SEQ ID NO: 7412156 - DNA, 22 bp, Homo sapiens
cagcccagagaaggggcccgtg

SEQ ID NO: 7412157 - DNA, 19 bp, Homo sapiens
cagcccagggtgctaccaa

SEQ ID NO: 7412158 - DNA, 19 bp, Homo sapiens
cagcccagggtgctaccaa

SEQ ID NO: 7412159 - DNA, 16 bp, Homo sapiens
cagcccaggggcgggc

SEQ ID NO: 7412160 - DNA, 19 bp, Homo sapiens
cagcccagggtgctaccaa

SEQ ID NO: 7412161 - DNA, 19 bp, Homo sapiens
cagcccagggtgctaccaa

SEQ ID NO: 7412162 - DNA, 16 bp, Homo sapiens
cagcccaggggcgggc

SEQ ID NO: 7412163 - DNA, 16 bp, Homo sapiens
cagcccaggggcgggc

SEQ ID NO: 7412164 - DNA, 16 bp, Homo sapiens
cagcccaggggcgggc

SEQ ID NO: 7412165 - DNA, 16 bp, Homo sapiens
cagcccaggggcgggc

SEQ ID NO: 7412166 - DNA, 21 bp, Homo sapiens
cagcccagagcagtggggcca

SEQ ID NO: 7412167 - DNA, 21 bp, Homo sapiens
cagcccagagcagtggggcca

SEQ ID NO: 7412168 - DNA, 21 bp, Homo sapiens
cagcccagagcagtggggcca

SEQ ID NO: 7412169 - DNA, 21 bp, Homo sapiens
cagcccagagcagtggggcca

SEQ ID NO: 7412170 - DNA, 21 bp, Homo sapiens
cagcccagagcagtggggcca

SEQ ID NO: 7412171 - DNA, 21 bp, Homo sapiens
cagcccagagcagtggggcca

SEQ ID NO: 7412172 - DNA, 21 bp, Homo sapiens
cagcccagagcagtggggcca

SEQ ID NO: 7412173 - DNA, 21 bp, Homo sapiens
cagcccagagcagtggggcca

SEQ ID NO: 7412174 - DNA, 22 bp, Homo sapiens
cagccagctggcactgtgagta

SEQ ID NO: 7412175 - DNA, 22 bp, Homo sapiens
cagccagctggcactgtgagta

SEQ ID NO: 7412176 - DNA, 22 bp, Homo sapiens
cagccagtgtgaccgaggagga

SEQ ID NO: 7412177 - DNA, 22 bp, Homo sapiens
cagccagtggttgaagatgcag

SEQ ID NO: 7412178 - DNA, 22 bp, Homo sapiens
cagccagtgtgaccgaggagga

SEQ ID NO: 7412179 - DNA, 22 bp, Homo sapiens
agcggaaggcctggctgatccg

SEQ ID NO: 7412180 - DNA, 22 bp, Homo sapiens
cagccagtgtgaccgaggagga

SEQ ID NO: 7412181 - DNA, 22 bp, Homo sapiens
cagccagtgtgaccgaggagga

SEQ ID NO: 7412182 - DNA, 22 bp, Homo sapiens
cagccagctggcactgtgagta

SEQ ID NO: 7412183 - DNA, 22 bp, Homo sapiens
agcggaaggcctggctgatccg

SEQ ID NO: 7412184 - DNA, 22 bp, Homo sapiens
agcggaaggcctggctgatccg

SEQ ID NO: 7412185 - DNA, 20 bp, Homo sapiens
agcggaccaggccattgttg

SEQ ID NO: 7412186 - DNA, 22 bp, Homo sapiens
agcgcttgccgcactccaagca

SEQ ID NO: 7412187 - DNA, 22 bp, Homo sapiens
agcgctgtgggcgtgcgaggag

SEQ ID NO: 7412188 - DNA, 22 bp, Homo sapiens
cagccatcccagcctgtggttc

SEQ ID NO: 7412189 - DNA, 22 bp, Homo sapiens
cagccatcagtaaagacagctt

SEQ ID NO: 7412190 - DNA, 22 bp, Homo sapiens
cagccatcagtaaagacagctt

SEQ ID NO: 7412191 - DNA, 22 bp, Homo sapiens
cagccatcagtaaagacagctt

SEQ ID NO: 7412192 - DNA, 22 bp, Homo sapiens
cagccatcagtaaagacagctt

SEQ ID NO: 7412193 - DNA, 22 bp, Homo sapiens
cagccatgagtctaagcagttt

SEQ ID NO: 7412194 - DNA, 22 bp, Homo sapiens
cagccatgagtctaagcagttt

SEQ ID NO: 7412195 - DNA, 23 bp, Homo sapiens
cagcccaaagagagagctacttt

SEQ ID NO: 7412196 - DNA, 22 bp, Homo sapiens
cagcccaaagccccaggctaga

SEQ ID NO: 7412197 - DNA, 22 bp, Homo sapiens
cagcccacctggcacgtgtgtt

SEQ ID NO: 7412198 - DNA, 22 bp, Homo sapiens
cagcccacgtcagggccactca

SEQ ID NO: 7412199 - DNA, 22 bp, Homo sapiens
cagcccaaagccccaggctaga

SEQ ID NO: 7412200 - DNA, 22 bp, Homo sapiens
cagcccacctggcacgtgtgtt

SEQ ID NO: 7412201 - DNA, 22 bp, Homo sapiens
cagcccacgtcagggccactca

SEQ ID NO: 7412202 - DNA, 22 bp, Homo sapiens
cagcccacgtcagggccactca

SEQ ID NO: 7412203 - DNA, 22 bp, Homo sapiens
cagcccacgtcagggccactca

SEQ ID NO: 7412204 - DNA, 22 bp, Homo sapiens
cagcccacgtcagggccactca

SEQ ID NO: 7412205 - DNA, 22 bp, Homo sapiens
cagcccactgcctctgtggtag

SEQ ID NO: 7412206 - DNA, 22 bp, Homo sapiens
cagcccactgcctctgtggtag

SEQ ID NO: 7412207 - DNA, 22 bp, Homo sapiens
cagcccactgcctctgtggtag

SEQ ID NO: 7412208 - DNA, 22 bp, Homo sapiens
cagcccacgtcagggccactca

SEQ ID NO: 7412209 - DNA, 18 bp, Homo sapiens
cagctgccagctcatgga

SEQ ID NO: 7412210 - DNA, 18 bp, Homo sapiens
cagctgccagctcatgga

SEQ ID NO: 7412211 - DNA, 22 bp, Homo sapiens
cagctgccagcttctctccatc

SEQ ID NO: 7412212 - DNA, 22 bp, Homo sapiens
cagctgccagcttctctccatc

SEQ ID NO: 7412213 - DNA, 22 bp, Homo sapiens
cagctgccagcttctctccatc

SEQ ID NO: 7412214 - DNA, 22 bp, Homo sapiens
cagctgccagcttctctccatc

SEQ ID NO: 7412215 - DNA, 22 bp, Homo sapiens
cagctgccacttgctctcggct

SEQ ID NO: 7412216 - DNA, 18 bp, Homo sapiens
cagctgccagctcatgga

SEQ ID NO: 7412217 - DNA, 18 bp, Homo sapiens
cagctgccagctcatgga

SEQ ID NO: 7412218 - DNA, 18 bp, Homo sapiens
cagctgccagctcatgga

SEQ ID NO: 7412219 - DNA, 18 bp, Homo sapiens
cagctgccagctcatgga

SEQ ID NO: 7412220 - DNA, 18 bp, Homo sapiens
cagctgccagctcatgga

SEQ ID NO: 7412221 - DNA, 22 bp, Homo sapiens
cagctgagcatcactagtctgg

SEQ ID NO: 7412222 - DNA, 22 bp, Homo sapiens
cagctgagagtagaaatggagg

SEQ ID NO: 7412223 - DNA, 22 bp, Homo sapiens
cagctgagcatcactagtctgg

SEQ ID NO: 7412224 - DNA, 22 bp, Homo sapiens
cagctgagcatcactagtctgg

SEQ ID NO: 7412225 - DNA, 22 bp, Homo sapiens
cagctgccagcttctctccatc

SEQ ID NO: 7412226 - DNA, 22 bp, Homo sapiens
cagctgccagcttctctccatc

SEQ ID NO: 7412227 - DNA, 22 bp, Homo sapiens
cagctgccagcttctctccatc

SEQ ID NO: 7412228 - DNA, 22 bp, Homo sapiens
cagctgccagcttctctccatc

SEQ ID NO: 7412229 - DNA, 22 bp, Homo sapiens
cagctgccatgacatgtcctgc

SEQ ID NO: 7412230 - DNA, 22 bp, Homo sapiens
cagctgccagcttctctccatc

SEQ ID NO: 7412231 - DNA, 22 bp, Homo sapiens
cagctgccagcttctctccatc

SEQ ID NO: 7412232 - DNA, 22 bp, Homo sapiens
cagctgccagcttctctccatc

SEQ ID NO: 7412233 - DNA, 22 bp, Homo sapiens
cagctgccatgacatgtcctgc

SEQ ID NO: 7412234 - DNA, 22 bp, Homo sapiens
cagctgccatgacatgtcctgc

SEQ ID NO: 7412235 - DNA, 22 bp, Homo sapiens
cagctgccatgacatgtcctgc

SEQ ID NO: 7412236 - DNA, 22 bp, Homo sapiens
cagctgccatgacatgtcctgc

SEQ ID NO: 7412237 - DNA, 22 bp, Homo sapiens
cagctgcccaagccccagatgt

SEQ ID NO: 7412238 - DNA, 22 bp, Homo sapiens
cagctgcccaagccccagatgt

SEQ ID NO: 7412239 - DNA, 22 bp, Homo sapiens
cagctgcccaagccccagatgt

SEQ ID NO: 7412240 - DNA, 22 bp, Homo sapiens
cagctgcccaagccccagatgt

SEQ ID NO: 7412241 - DNA, 22 bp, Homo sapiens
cagctgcccaagccccagatgt

SEQ ID NO: 7412242 - DNA, 22 bp, Homo sapiens
cagctgcccaagccccagatgt

SEQ ID NO: 7412243 - DNA, 22 bp, Homo sapiens
cagctgcccaggccacctggag

SEQ ID NO: 7412244 - DNA, 22 bp, Homo sapiens
cagctgcccaggccacctggag

SEQ ID NO: 7412245 - DNA, 22 bp, Homo sapiens
cagctgcccaggccacctggag

SEQ ID NO: 7412246 - DNA, 22 bp, Homo sapiens
cagctgcccaggccacctggag

SEQ ID NO: 7412247 - DNA, 22 bp, Homo sapiens
cagctgcccaggccacctggag

SEQ ID NO: 7412248 - DNA, 22 bp, Homo sapiens
agctctggagccggaggatttc

SEQ ID NO: 7412249 - DNA, 21 bp, Homo sapiens
agctctggagcagcaatcaag

SEQ ID NO: 7412250 - DNA, 21 bp, Homo sapiens
agctctggagcagcaatcaag

SEQ ID NO: 7412251 - DNA, 21 bp, Homo sapiens
agctctggagcagcaatcaag

SEQ ID NO: 7412252 - DNA, 21 bp, Homo sapiens
agctctggagcagcaatcaag

SEQ ID NO: 7412253 - DNA, 22 bp, Homo sapiens
agctctggagccggaggatttc

SEQ ID NO: 7412254 - DNA, 22 bp, Homo sapiens
agctctggagccggaggatttc

SEQ ID NO: 7412255 - DNA, 22 bp, Homo sapiens
agctctggagccggaggatttc

SEQ ID NO: 7412256 - DNA, 22 bp, Homo sapiens
agctctggagccggaggatttc

SEQ ID NO: 7412257 - DNA, 22 bp, Homo sapiens
agctctggaataatgatgtgat

SEQ ID NO: 7412258 - DNA, 22 bp, Homo sapiens
agctctggaataatgatgtgat

SEQ ID NO: 7412259 - DNA, 22 bp, Homo sapiens
agctctggaataatgatgtgat

SEQ ID NO: 7412260 - DNA, 22 bp, Homo sapiens
agctctggaataatgatgtgat

SEQ ID NO: 7412261 - DNA, 22 bp, Homo sapiens
agctctggaataatgatgtgat

SEQ ID NO: 7412262 - DNA, 22 bp, Homo sapiens
agctctggaataatgatgtgat

SEQ ID NO: 7412263 - DNA, 21 bp, Homo sapiens
agctctggagcagcaatcaag

SEQ ID NO: 7412264 - DNA, 22 bp, Homo sapiens
agctctggacctgacatctggt

SEQ ID NO: 7412265 - DNA, 21 bp, Homo sapiens
agctctggagcagcaatcaag

SEQ ID NO: 7412266 - DNA, 22 bp, Homo sapiens
agctctggacctgacatctggt

SEQ ID NO: 7412267 - DNA, 22 bp, Homo sapiens
agctctggaataatgatgtgat

SEQ ID NO: 7412268 - DNA, 22 bp, Homo sapiens
agctctggacctgacatctggt

SEQ ID NO: 7412269 - DNA, 22 bp, Homo sapiens
agctctggacctgacatctggt

SEQ ID NO: 7412270 - DNA, 22 bp, Homo sapiens
agctctggacctgacatctggt

SEQ ID NO: 7412271 - DNA, 22 bp, Homo sapiens
agctctggaataatgatgtgat

SEQ ID NO: 7412272 - DNA, 22 bp, Homo sapiens
cagctgcccatcctgggaaatg

SEQ ID NO: 7412273 - DNA, 22 bp, Homo sapiens
cagctgcccatcctgggaaatg

SEQ ID NO: 7412274 - DNA, 22 bp, Homo sapiens
cagctgccccataaatcacagt

SEQ ID NO: 7412275 - DNA, 22 bp, Homo sapiens
cagctgccccgctggctgacca

SEQ ID NO: 7412276 - DNA, 22 bp, Homo sapiens
cagctgcccaggccacctggag

SEQ ID NO: 7412277 - DNA, 22 bp, Homo sapiens
cagctgccccgctggctgacca

SEQ ID NO: 7412278 - DNA, 22 bp, Homo sapiens
cagctgccccgctggctgacca

SEQ ID NO: 7412279 - DNA, 22 bp, Homo sapiens
cagctgcccctccagggctggg

SEQ ID NO: 7412280 - DNA, 22 bp, Homo sapiens
agctctggaagccctggtagtt

SEQ ID NO: 7412281 - DNA, 22 bp, Homo sapiens
cagctgcccatcctgggaaatg

SEQ ID NO: 7412282 - DNA, 22 bp, Homo sapiens
cagctgccccataaatcacagt

SEQ ID NO: 7412283 - DNA, 22 bp, Homo sapiens
cagctgccccgctggctgacca

SEQ ID NO: 7412284 - DNA, 22 bp, Homo sapiens
cagcctctgagccttggcagat

SEQ ID NO: 7412285 - DNA, 22 bp, Homo sapiens
cagcctctgagccttggcagat

SEQ ID NO: 7412286 - DNA, 22 bp, Homo sapiens
cagcctctgagccttggcagat

SEQ ID NO: 7412287 - DNA, 18 bp, Homo sapiens
cagcctctgattggttgc

SEQ ID NO: 7412288 - DNA, 22 bp, Homo sapiens
cagcctctgtggctgccacacc

SEQ ID NO: 7412289 - DNA, 22 bp, Homo sapiens
cagcctctgtggctgccacacc

SEQ ID NO: 7412290 - DNA, 22 bp, Homo sapiens
cagcctctgtggctgccacacc

SEQ ID NO: 7412291 - DNA, 22 bp, Homo sapiens
cagcctctgacaccacagtcgt

SEQ ID NO: 7412292 - DNA, 22 bp, Homo sapiens
cagcctctgacaccacagtcgt

SEQ ID NO: 7412293 - DNA, 22 bp, Homo sapiens
cagcctctgacaccacagtcgt

SEQ ID NO: 7412294 - DNA, 22 bp, Homo sapiens
cagcctctgagccttggcagat

SEQ ID NO: 7412295 - DNA, 22 bp, Homo sapiens
cagcctctgagccttggcagat

SEQ ID NO: 7412296 - DNA, 22 bp, Homo sapiens
cagcctttatctcctgggctca

SEQ ID NO: 7412297 - DNA, 22 bp, Homo sapiens
cagcctttatggaaaggcctgg

SEQ ID NO: 7412298 - DNA, 22 bp, Homo sapiens
cagcctttccaattgctgctgc

SEQ ID NO: 7412299 - DNA, 22 bp, Homo sapiens
cagcctttctgtttcctaaggt

SEQ ID NO: 7412300 - DNA, 22 bp, Homo sapiens
cagcctttctgtttcctaaggt

SEQ ID NO: 7412301 - DNA, 22 bp, Homo sapiens
cagcctttaagcttggataggt

SEQ ID NO: 7412302 - DNA, 22 bp, Homo sapiens
cagcctttagcattaattccaa

SEQ ID NO: 7412303 - DNA, 22 bp, Homo sapiens
cagccttgatggatgaggaagt

SEQ ID NO: 7412304 - DNA, 18 bp, Homo sapiens
cagcctctgattggttgc

SEQ ID NO: 7412305 - DNA, 22 bp, Homo sapiens
cagccttgatggatgaggaagt

SEQ ID NO: 7412306 - DNA, 22 bp, Homo sapiens
cagcctcttgcactttgaaggc

SEQ ID NO: 7412307 - DNA, 22 bp, Homo sapiens
cagcctcttgcactttgaaggc

SEQ ID NO: 7412308 - DNA, 22 bp, Homo sapiens
cagcctcttgcactttgaaggc

SEQ ID NO: 7412309 - DNA, 22 bp, Homo sapiens
cagcctctgtggctgccacacc

SEQ ID NO: 7412310 - DNA, 22 bp, Homo sapiens
cagcctctgtggctgccacacc

SEQ ID NO: 7412311 - DNA, 22 bp, Homo sapiens
cagcctctgtggctgccacacc

SEQ ID NO: 7412312 - DNA, 22 bp, Homo sapiens
cagccttcgacagttggagtag

SEQ ID NO: 7412313 - DNA, 22 bp, Homo sapiens
cagccttctgaatgaacgtact

SEQ ID NO: 7412314 - DNA, 22 bp, Homo sapiens
cagccttcgacagttggagtag

SEQ ID NO: 7412315 - DNA, 22 bp, Homo sapiens
cagccttcgacagttggagtag

SEQ ID NO: 7412316 - DNA, 22 bp, Homo sapiens
cagcgctggggtaggagcacct

SEQ ID NO: 7412317 - DNA, 22 bp, Homo sapiens
cagcgctggggtaggagcacct

SEQ ID NO: 7412318 - DNA, 22 bp, Homo sapiens
cagcgctggggtaggagcacct

SEQ ID NO: 7412319 - DNA, 22 bp, Homo sapiens
cagcgctgtgggaacagggcta

SEQ ID NO: 7412320 - DNA, 22 bp, Homo sapiens
cagcggaggacagatgggagct

SEQ ID NO: 7412321 - DNA, 22 bp, Homo sapiens
cagcggaggacagatgggagct

SEQ ID NO: 7412322 - DNA, 22 bp, Homo sapiens
cagcggaggacagatgggagct

SEQ ID NO: 7412323 - DNA, 22 bp, Homo sapiens
cagcggaggacagatgggagct

SEQ ID NO: 7412324 - DNA, 22 bp, Homo sapiens
cagcgtctcgttgtgggcctcg

SEQ ID NO: 7412325 - DNA, 22 bp, Homo sapiens
cagcggtggcaaggtgactgtg

SEQ ID NO: 7412326 - DNA, 22 bp, Homo sapiens
cagctgagagtagaaatggagg

SEQ ID NO: 7412327 - DNA, 22 bp, Homo sapiens
cagcgtctcgttgtgggcctcg

SEQ ID NO: 7412328 - DNA, 22 bp, Homo sapiens
cagcggccggtgaggaagggga

SEQ ID NO: 7412329 - DNA, 22 bp, Homo sapiens
cagcggagggcagccttgcagc

SEQ ID NO: 7412330 - DNA, 22 bp, Homo sapiens
cagcggccggtgaggaagggga

SEQ ID NO: 7412331 - DNA, 22 bp, Homo sapiens
cagcggccggtgaggaagggga

SEQ ID NO: 7412332 - DNA, 22 bp, Homo sapiens
cagcggccggtgaggaagggga

SEQ ID NO: 7412333 - DNA, 22 bp, Homo sapiens
cagcggggcctgtgctggggag

SEQ ID NO: 7412334 - DNA, 22 bp, Homo sapiens
cagcggggcctgtgctggggag

SEQ ID NO: 7412335 - DNA, 22 bp, Homo sapiens
cagcggggcctgtgctggggag

SEQ ID NO: 7412336 - DNA, 22 bp, Homo sapiens
cagccttttcttaaaatgcaag

SEQ ID NO: 7412337 - DNA, 22 bp, Homo sapiens
cagccttttcttaaaatgcaag

SEQ ID NO: 7412338 - DNA, 22 bp, Homo sapiens
cagcctttgtgaacatcaggtg

SEQ ID NO: 7412339 - DNA, 22 bp, Homo sapiens
cagcctttgggtcagaagattc

SEQ ID NO: 7412340 - DNA, 22 bp, Homo sapiens
cagcctttgggtcagaagattc

SEQ ID NO: 7412341 - DNA, 22 bp, Homo sapiens
cagcctttgggtcagaagattc

SEQ ID NO: 7412342 - DNA, 22 bp, Homo sapiens
cagcctttcttgactgtgtgtt

SEQ ID NO: 7412343 - DNA, 22 bp, Homo sapiens
cagcctttcttgactgtgtgtt

SEQ ID NO: 7412344 - DNA, 22 bp, Homo sapiens
cagcgaggtgaagggtacaagc

SEQ ID NO: 7412345 - DNA, 22 bp, Homo sapiens
cagcgcaggcgtgtgaaggcgc

SEQ ID NO: 7412346 - DNA, 22 bp, Homo sapiens
cagcgctggggtaggagcacct

SEQ ID NO: 7412347 - DNA, 22 bp, Homo sapiens
cagcgcagtgtaggtggggggc

SEQ ID NO: 7412348 - DNA, 22 bp, Homo sapiens
cagcgcctcctggacctcctct

SEQ ID NO: 7412349 - DNA, 22 bp, Homo sapiens
cagcgctggggtaggagcacct

SEQ ID NO: 7412350 - DNA, 22 bp, Homo sapiens
cagcgcctcctggacctcctct

SEQ ID NO: 7412351 - DNA, 22 bp, Homo sapiens
agctctggctaagctgataaat

SEQ ID NO: 7412352 - DNA, 22 bp, Homo sapiens
agctctgggagtagttccacct

SEQ ID NO: 7412353 - DNA, 22 bp, Homo sapiens
agctctggctaagctgataaat

SEQ ID NO: 7412354 - DNA, 23 bp, Homo sapiens
agctctggcgttggggaggtagt

SEQ ID NO: 7412355 - DNA, 23 bp, Homo sapiens
agctctggcgttggggaggtagt

SEQ ID NO: 7412356 - DNA, 23 bp, Homo sapiens
agctctggcgttggggaggtagt

SEQ ID NO: 7412357 - DNA, 18 bp, Homo sapiens
agctctggcatacttgaa

SEQ ID NO: 7412358 - DNA, 18 bp, Homo sapiens
agctctggcatacttgaa

SEQ ID NO: 7412359 - DNA, 23 bp, Homo sapiens
agctctggcgttggggaggtagt

SEQ ID NO: 7412360 - DNA, 23 bp, Homo sapiens
agctctggcgttggggaggtagt

SEQ ID NO: 7412361 - DNA, 18 bp, Homo sapiens
agctctggcatacttgaa

SEQ ID NO: 7412362 - DNA, 18 bp, Homo sapiens
agctctggcatacttgaa

SEQ ID NO: 7412363 - DNA, 22 bp, Homo sapiens
agctctggcactggcgcgggat

SEQ ID NO: 7412364 - DNA, 22 bp, Homo sapiens
agctctggcactggcgcgggat

SEQ ID NO: 7412365 - DNA, 22 bp, Homo sapiens
agctctggcactggcgcgggat

SEQ ID NO: 7412366 - DNA, 19 bp, Homo sapiens
agctctggattaaatttct

SEQ ID NO: 7412367 - DNA, 19 bp, Homo sapiens
agctctggattaaatttct

SEQ ID NO: 7412368 - DNA, 19 bp, Homo sapiens
agctctggattaaatttct

SEQ ID NO: 7412369 - DNA, 22 bp, Homo sapiens
agctctggcactggcgcgggat

SEQ ID NO: 7412370 - DNA, 22 bp, Homo sapiens
agctctggcactggcgcgggat

SEQ ID NO: 7412371 - DNA, 22 bp, Homo sapiens
agctctggcactggcgcgggat

SEQ ID NO: 7412372 - DNA, 22 bp, Homo sapiens
agctctggcactggcgcgggat

SEQ ID NO: 7412373 - DNA, 22 bp, Homo sapiens
agctctggcactggcgcgggat

SEQ ID NO: 7412374 - DNA, 20 bp, Homo sapiens
agctgaagatctggatgggg

SEQ ID NO: 7412375 - DNA, 20 bp, Homo sapiens
agctgaagatctggatgggg

SEQ ID NO: 7412376 - DNA, 20 bp, Homo sapiens
agctgaagatctggatgggg

SEQ ID NO: 7412377 - DNA, 22 bp, Homo sapiens
agctgagcatttgatccacctc

SEQ ID NO: 7412378 - DNA, 22 bp, Homo sapiens
agctgaagcaacaacaggatgg

SEQ ID NO: 7412379 - DNA, 22 bp, Homo sapiens
agctgaagcaacaacaggatgg

SEQ ID NO: 7412380 - DNA, 22 bp, Homo sapiens
agctgagcatttgatccacctc

SEQ ID NO: 7412381 - DNA, 22 bp, Homo sapiens
agctgagccagcagcaacagga

SEQ ID NO: 7412382 - DNA, 22 bp, Homo sapiens
agctgagccagcagcaacagga

SEQ ID NO: 7412383 - DNA, 22 bp, Homo sapiens
agctgaagatccagggttgggg

SEQ ID NO: 7412384 - DNA, 22 bp, Homo sapiens
agctgaagatccagggttgggg

SEQ ID NO: 7412385 - DNA, 22 bp, Homo sapiens
agctctgggagtagttccacct

SEQ ID NO: 7412386 - DNA, 22 bp, Homo sapiens
agctctgggattctcaggccac

SEQ ID NO: 7412387 - DNA, 22 bp, Homo sapiens
agctctgggattctcaggccac

SEQ ID NO: 7412388 - DNA, 22 bp, Homo sapiens
agctctgggattctcaggccac

SEQ ID NO: 7412389 - DNA, 22 bp, Homo sapiens
agctgaagacctcaagtaagag

SEQ ID NO: 7412390 - DNA, 22 bp, Homo sapiens
agctctgggattctcaggccac

SEQ ID NO: 7412391 - DNA, 22 bp, Homo sapiens
agctctgggagtagttccacct

SEQ ID NO: 7412392 - DNA, 22 bp, Homo sapiens
agctctgggagtagttccacct

SEQ ID NO: 7412393 - DNA, 22 bp, Homo sapiens
agctctgggagtagttccacct

SEQ ID NO: 7412394 - DNA, 22 bp, Homo sapiens
agctctgggagtagttccacct

SEQ ID NO: 7412395 - DNA, 22 bp, Homo sapiens
agctgaggaggaatgatgggta

SEQ ID NO: 7412396 - DNA, 22 bp, Homo sapiens
agctgaggaggaatgatgggta

SEQ ID NO: 7412397 - DNA, 22 bp, Homo sapiens
agctgaggaggaatgatgggta

SEQ ID NO: 7412398 - DNA, 22 bp, Homo sapiens
agctgaggaggaatgatgggta

SEQ ID NO: 7412399 - DNA, 22 bp, Homo sapiens
agctgaggaggaatgatgggta

SEQ ID NO: 7412400 - DNA, 22 bp, Homo sapiens
agctgaggaggaatgatgggta

SEQ ID NO: 7412401 - DNA, 22 bp, Homo sapiens
agctgaggaggaatgatgggta

SEQ ID NO: 7412402 - DNA, 22 bp, Homo sapiens
agctgaggaggaatgatgggta

SEQ ID NO: 7412403 - DNA, 22 bp, Homo sapiens
agctgaggaataataacaaggt

SEQ ID NO: 7412404 - DNA, 22 bp, Homo sapiens
agctgaggaataataacaaggt

SEQ ID NO: 7412405 - DNA, 17 bp, Homo sapiens
agctgagctggccaggg

SEQ ID NO: 7412406 - DNA, 22 bp, Homo sapiens
agctgaggacgtgaagggcggc

SEQ ID NO: 7412407 - DNA, 22 bp, Homo sapiens
agctgaggacgtgaagggcggc

SEQ ID NO: 7412408 - DNA, 22 bp, Homo sapiens
agctgaggacgtgaagggcggc

SEQ ID NO: 7412409 - DNA, 22 bp, Homo sapiens
agctgaggacgtgaagggcggc

SEQ ID NO: 7412410 - DNA, 17 bp, Homo sapiens
agctgagctggccaggg

SEQ ID NO: 7412411 - DNA, 17 bp, Homo sapiens
agctgagctggccaggg

SEQ ID NO: 7412412 - DNA, 17 bp, Homo sapiens
agctgagctggccaggg

SEQ ID NO: 7412413 - DNA, 22 bp, Homo sapiens
agctgagctgcagatgactgta

SEQ ID NO: 7412414 - DNA, 22 bp, Homo sapiens
agctgagctgcagatgactgta

SEQ ID NO: 7412415 - DNA, 21 bp, Homo sapiens
agctgagcccagaagactggt

SEQ ID NO: 7412416 - DNA, 22 bp, Homo sapiens
agctgagctagtagttccagtg

SEQ ID NO: 7412417 - DNA, 22 bp, Homo sapiens
agctgagctcaggctgatgtaa

SEQ ID NO: 7412418 - DNA, 22 bp, Homo sapiens
cagctgctttcagcaggaggga

SEQ ID NO: 7412419 - DNA, 22 bp, Homo sapiens
cagctgctttcagcaggaggga

SEQ ID NO: 7412420 - DNA, 22 bp, Homo sapiens
cagctgctttcagcaggaggga

SEQ ID NO: 7412421 - DNA, 22 bp, Homo sapiens
cagctgctttcagcaggaggga

SEQ ID NO: 7412422 - DNA, 22 bp, Homo sapiens
cagctgctttcagcaggaggga

SEQ ID NO: 7412423 - DNA, 22 bp, Homo sapiens
cagctgctttcagcaggaggga

SEQ ID NO: 7412424 - DNA, 22 bp, Homo sapiens
cagctgctttcagcaggaggga

SEQ ID NO: 7412425 - DNA, 22 bp, Homo sapiens
cagctgctttcagcaggaggga

SEQ ID NO: 7412426 - DNA, 22 bp, Homo sapiens
cagctgctttcagcaggaggga

SEQ ID NO: 7412427 - DNA, 20 bp, Homo sapiens
agctgaggcacctgaggtta

SEQ ID NO: 7412428 - DNA, 20 bp, Homo sapiens
agctgaggcacctgaggtta

SEQ ID NO: 7412429 - DNA, 20 bp, Homo sapiens
agctgaggcacctgaggtta

SEQ ID NO: 7412430 - DNA, 23 bp, Homo sapiens
agctgaggcagaggggcattctc

SEQ ID NO: 7412431 - DNA, 23 bp, Homo sapiens
agctgaggcagaggggcattctc

SEQ ID NO: 7412432 - DNA, 20 bp, Homo sapiens
agctgaggcacctgaggtta

SEQ ID NO: 7412433 - DNA, 20 bp, Homo sapiens
agctgaggcacctgaggtta

SEQ ID NO: 7412434 - DNA, 22 bp, Homo sapiens
cagctggaggagcagcttccag

SEQ ID NO: 7412435 - DNA, 22 bp, Homo sapiens
cagctggatctgcctcgagcca

SEQ ID NO: 7412436 - DNA, 22 bp, Homo sapiens
cagctggatccctgcagaactt

SEQ ID NO: 7412437 - DNA, 22 bp, Homo sapiens
cagctggatccctgcagaactt

SEQ ID NO: 7412438 - DNA, 22 bp, Homo sapiens
cagctggatctgcctcgagcca

SEQ ID NO: 7412439 - DNA, 22 bp, Homo sapiens
cagctggatctgcctcgagcca

SEQ ID NO: 7412440 - DNA, 22 bp, Homo sapiens
cagctggatctgcctcgagcca

SEQ ID NO: 7412441 - DNA, 22 bp, Homo sapiens
cagctggatctgcctcgagcca

SEQ ID NO: 7412442 - DNA, 19 bp, Homo sapiens
cagctggaatcatctgagg

SEQ ID NO: 7412443 - DNA, 19 bp, Homo sapiens
cagctggaatcatctgagg

SEQ ID NO: 7412444 - DNA, 19 bp, Homo sapiens
cagctggaatcatctgagg

SEQ ID NO: 7412445 - DNA, 19 bp, Homo sapiens
cagctggaatcatctgagg

SEQ ID NO: 7412446 - DNA, 19 bp, Homo sapiens
cagctggaatcatctgagg

SEQ ID NO: 7412447 - DNA, 22 bp, Homo sapiens
cagctggactgggatgtagcga

SEQ ID NO: 7412448 - DNA, 22 bp, Homo sapiens
cagctggactgggatgtagcga

SEQ ID NO: 7412449 - DNA, 22 bp, Homo sapiens
cagctggcatacctgggcccgg

SEQ ID NO: 7412450 - DNA, 22 bp, Homo sapiens
cagctggcatacctgggcccgg

SEQ ID NO: 7412451 - DNA, 22 bp, Homo sapiens
cagctggcagccctggccctgc

SEQ ID NO: 7412452 - DNA, 22 bp, Homo sapiens
cagctggcagccctggccctgc

SEQ ID NO: 7412453 - DNA, 22 bp, Homo sapiens
cagctggcagccctggccctgc

SEQ ID NO: 7412454 - DNA, 22 bp, Homo sapiens
cagctggcagccctggccctgc

SEQ ID NO: 7412455 - DNA, 22 bp, Homo sapiens
cagctggcagccctggccctgc

SEQ ID NO: 7412456 - DNA, 22 bp, Homo sapiens
cagctggcagccctggccctgc

SEQ ID NO: 7412457 - DNA, 22 bp, Homo sapiens
cagctgggtgatcttgggcagg

SEQ ID NO: 7412458 - DNA, 22 bp, Homo sapiens
cagctgggtgatcttgggcagg

SEQ ID NO: 7412459 - DNA, 22 bp, Homo sapiens
cagctgggtggctcttctgctc

SEQ ID NO: 7412460 - DNA, 22 bp, Homo sapiens
cagctgggtgatcttgggcagg

SEQ ID NO: 7412461 - DNA, 22 bp, Homo sapiens
cagctgggtggctcttctgctc

SEQ ID NO: 7412462 - DNA, 22 bp, Homo sapiens
cagctgggtggctcttctgctc

SEQ ID NO: 7412463 - DNA, 22 bp, Homo sapiens
cagctgggtggctcttctgctc

SEQ ID NO: 7412464 - DNA, 22 bp, Homo sapiens
cagctgggtggctcttctgctc

SEQ ID NO: 7412465 - DNA, 22 bp, Homo sapiens
cagctgggtggctcttctgctc

SEQ ID NO: 7412466 - DNA, 22 bp, Homo sapiens
cagctgggtggctcttctgctc

SEQ ID NO: 7412467 - DNA, 22 bp, Homo sapiens
cagctgggtggctcttctgctc

SEQ ID NO: 7412468 - DNA, 22 bp, Homo sapiens
cagctggcaagtggagcagggt

SEQ ID NO: 7412469 - DNA, 22 bp, Homo sapiens
cagctggcaagtggagcagggt

SEQ ID NO: 7412470 - DNA, 22 bp, Homo sapiens
cagctggcaagtggagcagggt

SEQ ID NO: 7412471 - DNA, 22 bp, Homo sapiens
cagctggcagaacctgcatcca

SEQ ID NO: 7412472 - DNA, 22 bp, Homo sapiens
cagctggcagaacctgcatcca

SEQ ID NO: 7412473 - DNA, 22 bp, Homo sapiens
cagctggcagaacctgcatcca

SEQ ID NO: 7412474 - DNA, 22 bp, Homo sapiens
cagctggcagaacctgcatcca

SEQ ID NO: 7412475 - DNA, 22 bp, Homo sapiens
cagctggcagaacctgcatcca

SEQ ID NO: 7412476 - DNA, 22 bp, Homo sapiens
cagctggcaagtggagcagggt

SEQ ID NO: 7412477 - DNA, 22 bp, Homo sapiens
cagctggcaagtggagcagggt

SEQ ID NO: 7412478 - DNA, 22 bp, Homo sapiens
cagctggcaagtggagcagggt

SEQ ID NO: 7412479 - DNA, 22 bp, Homo sapiens
cagctggcaagtggagcagggt

SEQ ID NO: 7412480 - DNA, 22 bp, Homo sapiens
cagctggcaagtggagcagggt

SEQ ID NO: 7412481 - DNA, 22 bp, Homo sapiens
cagctggcaagtggagcagggt

SEQ ID NO: 7412482 - DNA, 22 bp, Homo sapiens
cagctggatgggagaccatgtt

SEQ ID NO: 7412483 - DNA, 22 bp, Homo sapiens
cagctggatgggagaccatgtt

SEQ ID NO: 7412484 - DNA, 22 bp, Homo sapiens
cagctggatgggagaccatgtt

SEQ ID NO: 7412485 - DNA, 22 bp, Homo sapiens
agcctagggggtcctgggccac

SEQ ID NO: 7412486 - DNA, 22 bp, Homo sapiens
agcctaggaggttggggctgca

SEQ ID NO: 7412487 - DNA, 22 bp, Homo sapiens
agcctaggaggttggggctgca

SEQ ID NO: 7412488 - DNA, 22 bp, Homo sapiens
agcctagggggtcctgggccac

SEQ ID NO: 7412489 - DNA, 22 bp, Homo sapiens
agcctagggggtcctgggccac

SEQ ID NO: 7412490 - DNA, 22 bp, Homo sapiens
agcctagggggtcctgggccac

SEQ ID NO: 7412491 - DNA, 22 bp, Homo sapiens
agcctagggggtcctgggccac

SEQ ID NO: 7412492 - DNA, 22 bp, Homo sapiens
agcctagggggtcctgggccac

SEQ ID NO: 7412493 - DNA, 22 bp, Homo sapiens
agcctagggggtcctgggccac

SEQ ID NO: 7412494 - DNA, 21 bp, Homo sapiens
agccgtaagataagtaaatgt

SEQ ID NO: 7412495 - DNA, 22 bp, Homo sapiens
agccgtgggcaggcccaggaca

SEQ ID NO: 7412496 - DNA, 22 bp, Homo sapiens
agccggccatgtggtcttgtgc

SEQ ID NO: 7412497 - DNA, 22 bp, Homo sapiens
agcctaatgcttttcccaaagt

SEQ ID NO: 7412498 - DNA, 22 bp, Homo sapiens
agccgctgtctcttgggccgcg

SEQ ID NO: 7412499 - DNA, 22 bp, Homo sapiens
agccggccatgtggtcttgtgc

SEQ ID NO: 7412500 - DNA, 22 bp, Homo sapiens
agccggccatgtggtcttgtgc

SEQ ID NO: 7412501 - DNA, 17 bp, Homo sapiens
agccgcctgggtcctgt

SEQ ID NO: 7412502 - DNA, 22 bp, Homo sapiens
agccgagagtatttgccagagc

SEQ ID NO: 7412503 - DNA, 22 bp, Homo sapiens
agccctttccaatttgatttat

SEQ ID NO: 7412504 - DNA, 22 bp, Homo sapiens
agccctttccaatttgatttat

SEQ ID NO: 7412505 - DNA, 22 bp, Homo sapiens
agcccttgcagactgtcagcat

SEQ ID NO: 7412506 - DNA, 22 bp, Homo sapiens
agcccttgcagactgtcagcat

SEQ ID NO: 7412507 - DNA, 22 bp, Homo sapiens
agcccttcaagagctctgtcct

SEQ ID NO: 7412508 - DNA, 22 bp, Homo sapiens
agcccttcaacctgcctactcc

SEQ ID NO: 7412509 - DNA, 22 bp, Homo sapiens
agcccttagtacatttctcaag

SEQ ID NO: 7412510 - DNA, 22 bp, Homo sapiens
agcccttagtacatttctcaag

SEQ ID NO: 7412511 - DNA, 22 bp, Homo sapiens
agcccttcaacctgcctactcc

SEQ ID NO: 7412512 - DNA, 22 bp, Homo sapiens
agcccttcaagagctctgtcct

SEQ ID NO: 7412513 - DNA, 22 bp, Homo sapiens
agcccttcaacctgcctactcc

SEQ ID NO: 7412514 - DNA, 22 bp, Homo sapiens
agcccttcaagagctctgtcct

SEQ ID NO: 7412515 - DNA, 22 bp, Homo sapiens
agcccttcaagagctctgtcct

SEQ ID NO: 7412516 - DNA, 22 bp, Homo sapiens
agcctattccaggatgagctca

SEQ ID NO: 7412517 - DNA, 22 bp, Homo sapiens
cagatatgtggattctattagc

SEQ ID NO: 7412518 - DNA, 22 bp, Homo sapiens
agcctattccaggatgagctca

SEQ ID NO: 7412519 - DNA, 22 bp, Homo sapiens
agcctattccaggatgagctca

SEQ ID NO: 7412520 - DNA, 22 bp, Homo sapiens
cagatattaggagctcaataat

SEQ ID NO: 7412521 - DNA, 22 bp, Homo sapiens
cagatatgtggattctattagc

SEQ ID NO: 7412522 - DNA, 22 bp, Homo sapiens
cagatcaagctgtatggtcaga

SEQ ID NO: 7412523 - DNA, 22 bp, Homo sapiens
agcctattccaggatgagctca

SEQ ID NO: 7412524 - DNA, 22 bp, Homo sapiens
agcctaggtctgggtctagcag

SEQ ID NO: 7412525 - DNA, 22 bp, Homo sapiens
agcctaggtctgggtctagcag

SEQ ID NO: 7412526 - DNA, 22 bp, Homo sapiens
agcctaggtctgggtctagcag

SEQ ID NO: 7412527 - DNA, 22 bp, Homo sapiens
agcctaggtctgggtctagcag

SEQ ID NO: 7412528 - DNA, 22 bp, Homo sapiens
agcctaggtctgggtctagcag

SEQ ID NO: 7412529 - DNA, 22 bp, Homo sapiens
agcctagggttctgatgtcact

SEQ ID NO: 7412530 - DNA, 22 bp, Homo sapiens
agcctagggttctgatgtcact

SEQ ID NO: 7412531 - DNA, 22 bp, Homo sapiens
cagatcctttatagcagtgtcc

SEQ ID NO: 7412532 - DNA, 22 bp, Homo sapiens
cagatcctttatagcagtgtcc

SEQ ID NO: 7412533 - DNA, 22 bp, Homo sapiens
cagatccacccttgtagtgaca

SEQ ID NO: 7412534 - DNA, 22 bp, Homo sapiens
cagatccagccgctcctgggaa

SEQ ID NO: 7412535 - DNA, 18 bp, Homo sapiens
cagatccaggcagctatt

SEQ ID NO: 7412536 - DNA, 22 bp, Homo sapiens
cagatcatgggactgtctcagc

SEQ ID NO: 7412537 - DNA, 22 bp, Homo sapiens
cagatcatgggactgtctcagc

SEQ ID NO: 7412538 - DNA, 22 bp, Homo sapiens
cagatccacccttgtagtgaca

SEQ ID NO: 7412539 - DNA, 22 bp, Homo sapiens
cagatcataacagatacataga

SEQ ID NO: 7412540 - DNA, 23 bp, Homo sapiens
cagatcatatatccagctgtaag

SEQ ID NO: 7412541 - DNA, 21 bp, Homo sapiens
cagatcaatttacttgtccct

SEQ ID NO: 7412542 - DNA, 22 bp, Homo sapiens
cagatcataacagatacataga

SEQ ID NO: 7412543 - DNA, 22 bp, Homo sapiens
cagatctgtagtaaaagatctc

SEQ ID NO: 7412544 - DNA, 22 bp, Homo sapiens
cagatctgtagtaaaagatctc

SEQ ID NO: 7412545 - DNA, 21 bp, Homo sapiens
cagatctgtaggtactaccat

SEQ ID NO: 7412546 - DNA, 21 bp, Homo sapiens
cagatctgtaggtactaccat

SEQ ID NO: 7412547 - DNA, 22 bp, Homo sapiens
cagatctgctcctctgtccatg

SEQ ID NO: 7412548 - DNA, 22 bp, Homo sapiens
cagatctgagccaagctcgatg

SEQ ID NO: 7412549 - DNA, 22 bp, Homo sapiens
cagatctgctcctctgtccatg

SEQ ID NO: 7412550 - DNA, 22 bp, Homo sapiens
cagatctatctgttgatggtgc

SEQ ID NO: 7412551 - DNA, 22 bp, Homo sapiens
cagatcctgccaggctgagttg

SEQ ID NO: 7412552 - DNA, 22 bp, Homo sapiens
cagatctctgtgtagttcagtc

SEQ ID NO: 7412553 - DNA, 22 bp, Homo sapiens
cagatctctgtgtagttcagtc

SEQ ID NO: 7412554 - DNA, 22 bp, Homo sapiens
cagatctgtttgccagatcagc

SEQ ID NO: 7412555 - DNA, 22 bp, Homo sapiens
cagatctgtttgccagatcagc

SEQ ID NO: 7412556 - DNA, 22 bp, Homo sapiens
cagatcttgtactcattattga

SEQ ID NO: 7412557 - DNA, 22 bp, Homo sapiens
cagatcttgtactcattattga

SEQ ID NO: 7412558 - DNA, 22 bp, Homo sapiens
cagatgaactaggctgcacttg

SEQ ID NO: 7412559 - DNA, 22 bp, Homo sapiens
cagatgaactctatcctgtggc

SEQ ID NO: 7412560 - DNA, 22 bp, Homo sapiens
cagatgaactgtgactgaaaat

SEQ ID NO: 7412561 - DNA, 22 bp, Homo sapiens
cagatgaactgtgactgaaaat

SEQ ID NO: 7412562 - DNA, 22 bp, Homo sapiens
cagatgaactaggctgcacttg

SEQ ID NO: 7412563 - DNA, 22 bp, Homo sapiens
cagatgaactgtgactgaaaat

SEQ ID NO: 7412564 - DNA, 22 bp, Homo sapiens
cagatgaactgtgactgaaaat

SEQ ID NO: 7412565 - DNA, 22 bp, Homo sapiens
agcctgcttgagagtcctggct

SEQ ID NO: 7412566 - DNA, 22 bp, Homo sapiens
agcctgagtgcttaggactgtt

SEQ ID NO: 7412567 - DNA, 22 bp, Homo sapiens
agcctgcttggcagccctccca

SEQ ID NO: 7412568 - DNA, 22 bp, Homo sapiens
agcctggaattaaggaaatgca

SEQ ID NO: 7412569 - DNA, 22 bp, Homo sapiens
agcctggaagaacctgaagtct

SEQ ID NO: 7412570 - DNA, 22 bp, Homo sapiens
agcctggaagaacctgaagtct

SEQ ID NO: 7412571 - DNA, 22 bp, Homo sapiens
agcctgcttggcagccctccca

SEQ ID NO: 7412572 - DNA, 22 bp, Homo sapiens
agcctgagctgcctgccgcctc

SEQ ID NO: 7412573 - DNA, 22 bp, Homo sapiens
agcctgagtgcttaggactgtt

SEQ ID NO: 7412574 - DNA, 22 bp, Homo sapiens
agcctgagtgcttaggactgtt

SEQ ID NO: 7412575 - DNA, 22 bp, Homo sapiens
cagatgaagatcatagaatagt

SEQ ID NO: 7412576 - DNA, 22 bp, Homo sapiens
cagatgaactgtgactgaaaat

SEQ ID NO: 7412577 - DNA, 22 bp, Homo sapiens
agcctgagtgcttaggactgtt

SEQ ID NO: 7412578 - DNA, 22 bp, Homo sapiens
cagatgaagatcatagaatagt

SEQ ID NO: 7412579 - DNA, 22 bp, Homo sapiens
cagatgaactgtgactgaaaat

SEQ ID NO: 7412580 - DNA, 22 bp, Homo sapiens
cagatgaactgtgactgaaaat

SEQ ID NO: 7412581 - DNA, 22 bp, Homo sapiens
cagatgaagatcatagaatagt

SEQ ID NO: 7412582 - DNA, 22 bp, Homo sapiens
cagcactgcttcgcagccaggg

SEQ ID NO: 7412583 - DNA, 22 bp, Homo sapiens
cagcactgcttcgcagccaggg

SEQ ID NO: 7412584 - DNA, 22 bp, Homo sapiens
cagcactgcttcgcagccaggg

SEQ ID NO: 7412585 - DNA, 22 bp, Homo sapiens
cagcactgcttcgcagccaggg

SEQ ID NO: 7412586 - DNA, 22 bp, Homo sapiens
cagcactgctgctgtacacaca

SEQ ID NO: 7412587 - DNA, 22 bp, Homo sapiens
agcctggaggtaatgaggaaac

SEQ ID NO: 7412588 - DNA, 18 bp, Homo sapiens
agcctggagggttgaagt

SEQ ID NO: 7412589 - DNA, 18 bp, Homo sapiens
agcctggagggttgaagt

SEQ ID NO: 7412590 - DNA, 19 bp, Homo sapiens
agcctggagggctggtcac

SEQ ID NO: 7412591 - DNA, 19 bp, Homo sapiens
agcctggagggctggtcac

SEQ ID NO: 7412592 - DNA, 22 bp, Homo sapiens
agcctggaggccaggagacagt

SEQ ID NO: 7412593 - DNA, 22 bp, Homo sapiens
agcctggaggccaggagacagt

SEQ ID NO: 7412594 - DNA, 22 bp, Homo sapiens
agcctggaggccaggagacagt

SEQ ID NO: 7412595 - DNA, 22 bp, Homo sapiens
agcctggaggccaggagacagt

SEQ ID NO: 7412596 - DNA, 22 bp, Homo sapiens
agcctggaggaggagttgagca

SEQ ID NO: 7412597 - DNA, 22 bp, Homo sapiens
agcctggaggaggagttgagca

SEQ ID NO: 7412598 - DNA, 22 bp, Homo sapiens
agcctggaggaggagttgagca

SEQ ID NO: 7412599 - DNA, 22 bp, Homo sapiens
agcctggagcttgagttatgag

SEQ ID NO: 7412600 - DNA, 22 bp, Homo sapiens
agcctggagaggcgccatacac

SEQ ID NO: 7412601 - DNA, 22 bp, Homo sapiens
agcctggaccaggggcctcaga

SEQ ID NO: 7412602 - DNA, 22 bp, Homo sapiens
agcctggagaagatgtgtattg

SEQ ID NO: 7412603 - DNA, 22 bp, Homo sapiens
agcctggaccaggggcctcaga

SEQ ID NO: 7412604 - DNA, 22 bp, Homo sapiens
agcctgcttgagagtcctggct

SEQ ID NO: 7412605 - DNA, 22 bp, Homo sapiens
agcctggacagctacggagaac

SEQ ID NO: 7412606 - DNA, 22 bp, Homo sapiens
agcctggacagctacggagaac

SEQ ID NO: 7412607 - DNA, 22 bp, Homo sapiens
agcctggacagctacggagaac

SEQ ID NO: 7412608 - DNA, 22 bp, Homo sapiens
agccctctgctgttctagtctc

SEQ ID NO: 7412609 - DNA, 22 bp, Homo sapiens
agccctctgctgttctagtctc

SEQ ID NO: 7412610 - DNA, 22 bp, Homo sapiens
agccctctgctgttctagtctc

SEQ ID NO: 7412611 - DNA, 22 bp, Homo sapiens
agccctctgagctagtcaccat

SEQ ID NO: 7412612 - DNA, 22 bp, Homo sapiens
agccctctgagcctgggttgta

SEQ ID NO: 7412613 - DNA, 22 bp, Homo sapiens
agccctctgagctagtcaccat

SEQ ID NO: 7412614 - DNA, 22 bp, Homo sapiens
agccctctgagctagtcaccat

SEQ ID NO: 7412615 - DNA, 22 bp, Homo sapiens
agccctctgcaaacacctgata

SEQ ID NO: 7412616 - DNA, 22 bp, Homo sapiens
agccctctctttagagatctga

SEQ ID NO: 7412617 - DNA, 22 bp, Homo sapiens
agccctctctttagagatctga

SEQ ID NO: 7412618 - DNA, 22 bp, Homo sapiens
agccctctctttagagatctga

SEQ ID NO: 7412619 - DNA, 22 bp, Homo sapiens
agccctctctatggccctcttg

SEQ ID NO: 7412620 - DNA, 22 bp, Homo sapiens
agccctctctatggccctcttg

SEQ ID NO: 7412621 - DNA, 22 bp, Homo sapiens
agccctctctatggccctcttg

SEQ ID NO: 7412622 - DNA, 22 bp, Homo sapiens
agccctctctatggccctcttg

SEQ ID NO: 7412623 - DNA, 22 bp, Homo sapiens
agccctctccaccttcgaaaaa

SEQ ID NO: 7412624 - DNA, 22 bp, Homo sapiens
agccctctccctttcttcttag

SEQ ID NO: 7412625 - DNA, 22 bp, Homo sapiens
agccctctaagcaagagaggaa

SEQ ID NO: 7412626 - DNA, 22 bp, Homo sapiens
agccctctaagcaagagaggaa

SEQ ID NO: 7412627 - DNA, 22 bp, Homo sapiens
agccctctaagcaagagaggaa

SEQ ID NO: 7412628 - DNA, 21 bp, Homo sapiens
agccctctccaattccctttt

SEQ ID NO: 7412629 - DNA, 22 bp, Homo sapiens
agccctcttccagccagcacag

SEQ ID NO: 7412630 - DNA, 22 bp, Homo sapiens
agccctcttccagccagcacag

SEQ ID NO: 7412631 - DNA, 22 bp, Homo sapiens
agccctcttccagccagcacag

SEQ ID NO: 7412632 - DNA, 22 bp, Homo sapiens
agccctcttccagccagcacag

SEQ ID NO: 7412633 - DNA, 20 bp, Homo sapiens
agccctcttccagatgaagg

SEQ ID NO: 7412634 - DNA, 20 bp, Homo sapiens
agccctcttccagatgaagg

SEQ ID NO: 7412635 - DNA, 22 bp, Homo sapiens
agccctcttcccagatgcctca

SEQ ID NO: 7412636 - DNA, 22 bp, Homo sapiens
agccctcttcccagatgcctca

SEQ ID NO: 7412637 - DNA, 22 bp, Homo sapiens
agccctgagccagcctggtcag

SEQ ID NO: 7412638 - DNA, 22 bp, Homo sapiens
agccctgacctgtcctgttctg

SEQ ID NO: 7412639 - DNA, 22 bp, Homo sapiens
agccctgagccagcctggtcag

SEQ ID NO: 7412640 - DNA, 22 bp, Homo sapiens
agccctgaagctggccatgtcc

SEQ ID NO: 7412641 - DNA, 22 bp, Homo sapiens
agccctgaagctggccatgtcc

SEQ ID NO: 7412642 - DNA, 22 bp, Homo sapiens
agccctcttcccagatgcctca

SEQ ID NO: 7412643 - DNA, 20 bp, Homo sapiens
agccctcttgctttagggta

SEQ ID NO: 7412644 - DNA, 22 bp, Homo sapiens
agcccttagtacatttctcaag

SEQ ID NO: 7412645 - DNA, 20 bp, Homo sapiens
agccctgtttcctggagaga

SEQ ID NO: 7412646 - DNA, 21 bp, Homo sapiens
agcccttaggacataagagag

SEQ ID NO: 7412647 - DNA, 22 bp, Homo sapiens
agccctgggctgtagataagca

SEQ ID NO: 7412648 - DNA, 22 bp, Homo sapiens
agccctgggctgtagataagca

SEQ ID NO: 7412649 - DNA, 22 bp, Homo sapiens
agccctgggctgtagataagca

SEQ ID NO: 7412650 - DNA, 22 bp, Homo sapiens
agccctgagccagcctggtcag

SEQ ID NO: 7412651 - DNA, 22 bp, Homo sapiens
agccctgggctgtagataagca

SEQ ID NO: 7412652 - DNA, 22 bp, Homo sapiens
agccctgggctgtagataagca

SEQ ID NO: 7412653 - DNA, 22 bp, Homo sapiens
agccctgggctgtagataagca

SEQ ID NO: 7412654 - DNA, 22 bp, Homo sapiens
agccctgggctgtagataagca

SEQ ID NO: 7412655 - DNA, 22 bp, Homo sapiens
agccctcctggggccacgctgg

SEQ ID NO: 7412656 - DNA, 22 bp, Homo sapiens
agccctcctttgttcatgctgc

SEQ ID NO: 7412657 - DNA, 22 bp, Homo sapiens
agccctcctttgttcatgctgc

SEQ ID NO: 7412658 - DNA, 22 bp, Homo sapiens
agccctcctttgttcatgctgc

SEQ ID NO: 7412659 - DNA, 22 bp, Homo sapiens
agccctcctttgttcatgctgc

SEQ ID NO: 7412660 - DNA, 22 bp, Homo sapiens
agccctcctttgttcatgctgc

SEQ ID NO: 7412661 - DNA, 22 bp, Homo sapiens
agccctcctttgttcatgctgc

SEQ ID NO: 7412662 - DNA, 22 bp, Homo sapiens
agccctcgtttctgcatcctgt

SEQ ID NO: 7412663 - DNA, 22 bp, Homo sapiens
agccctcgtttctgcatcctgt

SEQ ID NO: 7412664 - DNA, 22 bp, Homo sapiens
agccctctaaaaatgataacta

SEQ ID NO: 7412665 - DNA, 22 bp, Homo sapiens
agccctcctggggccacgctgg

SEQ ID NO: 7412666 - DNA, 22 bp, Homo sapiens
agccctcctggggccacgctgg

SEQ ID NO: 7412667 - DNA, 22 bp, Homo sapiens
agccctcctggggccacgctgg

SEQ ID NO: 7412668 - DNA, 18 bp, Homo sapiens
cagagtgggccaagagac

SEQ ID NO: 7412669 - DNA, 22 bp, Homo sapiens
cagagtggcgaccccctcagct

SEQ ID NO: 7412670 - DNA, 18 bp, Homo sapiens
cagagtgggccaagagac

SEQ ID NO: 7412671 - DNA, 22 bp, Homo sapiens
cagagtggcgaccccctcagct

SEQ ID NO: 7412672 - DNA, 22 bp, Homo sapiens
cagagtggcgaccccctcagct

SEQ ID NO: 7412673 - DNA, 22 bp, Homo sapiens
cagagtggcactctgctggatg

SEQ ID NO: 7412674 - DNA, 22 bp, Homo sapiens
cagagtggagtttttcagcggg

SEQ ID NO: 7412675 - DNA, 22 bp, Homo sapiens
cagagtggagtttttcagcggg

SEQ ID NO: 7412676 - DNA, 22 bp, Homo sapiens
cagagtggagatgtgtgtggaa

SEQ ID NO: 7412677 - DNA, 22 bp, Homo sapiens
cagagtggagatgtgtgtggaa

SEQ ID NO: 7412678 - DNA, 22 bp, Homo sapiens
cagagtggagatgtgtgtggaa

SEQ ID NO: 7412679 - DNA, 22 bp, Homo sapiens
cagagtggagatgtgtgtggaa

SEQ ID NO: 7412680 - DNA, 22 bp, Homo sapiens
cagagtggcagtcccaggccca

SEQ ID NO: 7412681 - DNA, 22 bp, Homo sapiens
cagagtggcactctgctggatg

SEQ ID NO: 7412682 - DNA, 22 bp, Homo sapiens
cagagtggcactctgctggatg

SEQ ID NO: 7412683 - DNA, 22 bp, Homo sapiens
cagagtggcagtcccaggccca

SEQ ID NO: 7412684 - DNA, 22 bp, Homo sapiens
cagagtggcatgaatgaagcct

SEQ ID NO: 7412685 - DNA, 22 bp, Homo sapiens
cagagtggcagtcccaggccca

SEQ ID NO: 7412686 - DNA, 22 bp, Homo sapiens
cagagtggcatgaatgaagcct

SEQ ID NO: 7412687 - DNA, 22 bp, Homo sapiens
cagagtggcatgaatgaagcct

SEQ ID NO: 7412688 - DNA, 22 bp, Homo sapiens
cagagtggcatgaatgaagcct

SEQ ID NO: 7412689 - DNA, 18 bp, Homo sapiens
cagaggagagacattcag

SEQ ID NO: 7412690 - DNA, 18 bp, Homo sapiens
cagaggagagacattcag

SEQ ID NO: 7412691 - DNA, 18 bp, Homo sapiens
cagaggagagacattcag

SEQ ID NO: 7412692 - DNA, 18 bp, Homo sapiens
cagaggagagacattcag

SEQ ID NO: 7412693 - DNA, 18 bp, Homo sapiens
cagaggagagacattcag

SEQ ID NO: 7412694 - DNA, 22 bp, Homo sapiens
cagaggagaattgcgggatcat

SEQ ID NO: 7412695 - DNA, 22 bp, Homo sapiens
cagaggagaattgcgggatcat

SEQ ID NO: 7412696 - DNA, 22 bp, Homo sapiens
cagaggagaattgcgggatcat

SEQ ID NO: 7412697 - DNA, 22 bp, Homo sapiens
cagagcttcagggaataagaat

SEQ ID NO: 7412698 - DNA, 22 bp, Homo sapiens
cagagcttaaaactccatggaa

SEQ ID NO: 7412699 - DNA, 18 bp, Homo sapiens
cagaggagagacattcag

SEQ ID NO: 7412700 - DNA, 18 bp, Homo sapiens
cagaggagagacattcag

SEQ ID NO: 7412701 - DNA, 18 bp, Homo sapiens
cagaggagagacattcag

SEQ ID NO: 7412702 - DNA, 18 bp, Homo sapiens
cagaggagagacattcag

SEQ ID NO: 7412703 - DNA, 18 bp, Homo sapiens
cagaggagagacattcag

SEQ ID NO: 7412704 - DNA, 17 bp, Homo sapiens
cagaggagctttggggg

SEQ ID NO: 7412705 - DNA, 17 bp, Homo sapiens
cagaggagctttggggg

SEQ ID NO: 7412706 - DNA, 17 bp, Homo sapiens
cagaggagctttggggg

SEQ ID NO: 7412707 - DNA, 17 bp, Homo sapiens
cagaggagctttggggg

SEQ ID NO: 7412708 - DNA, 17 bp, Homo sapiens
cagaggagctttggggg

SEQ ID NO: 7412709 - DNA, 22 bp, Homo sapiens
cagaggaggccaccgcataggc

SEQ ID NO: 7412710 - DNA, 22 bp, Homo sapiens
cagaggaggccaccgcataggc

SEQ ID NO: 7412711 - DNA, 22 bp, Homo sapiens
cagaggaggccaccgcataggc

SEQ ID NO: 7412712 - DNA, 22 bp, Homo sapiens
cagaggaggccaccgcataggc

SEQ ID NO: 7412713 - DNA, 22 bp, Homo sapiens
cagaggaggccaccgcataggc

SEQ ID NO: 7412714 - DNA, 22 bp, Homo sapiens
cagaggaggccaccgcataggc

SEQ ID NO: 7412715 - DNA, 17 bp, Homo sapiens
cagaggagctttggggg

SEQ ID NO: 7412716 - DNA, 17 bp, Homo sapiens
cagaggagctttggggg

SEQ ID NO: 7412717 - DNA, 22 bp, Homo sapiens
cagaggaggccaccgcataggc

SEQ ID NO: 7412718 - DNA, 22 bp, Homo sapiens
cagaggaggcggtatacactgc

SEQ ID NO: 7412719 - DNA, 22 bp, Homo sapiens
cagaggaggcggtatacactgc

SEQ ID NO: 7412720 - DNA, 22 bp, Homo sapiens
cagaggaggcggtatacactgc

SEQ ID NO: 7412721 - DNA, 22 bp, Homo sapiens
cagaggaggccaccgcataggc

SEQ ID NO: 7412722 - DNA, 22 bp, Homo sapiens
cagaggaggcggtatacactgc

SEQ ID NO: 7412723 - DNA, 22 bp, Homo sapiens
cagaggaggcggtatacactgc

SEQ ID NO: 7412724 - DNA, 22 bp, Homo sapiens
cagaggaggcggtatacactgc

SEQ ID NO: 7412725 - DNA, 22 bp, Homo sapiens
cagaggagtgggccgttatggt

SEQ ID NO: 7412726 - DNA, 22 bp, Homo sapiens
cagaggagtgggccgttatggt

SEQ ID NO: 7412727 - DNA, 22 bp, Homo sapiens
cagaggagtgggccgttatggt

SEQ ID NO: 7412728 - DNA, 22 bp, Homo sapiens
cagaggagtgggccgttatggt

SEQ ID NO: 7412729 - DNA, 20 bp, Homo sapiens
cagaggagtacatatgttca

SEQ ID NO: 7412730 - DNA, 20 bp, Homo sapiens
cagaggagtacatatgttca

SEQ ID NO: 7412731 - DNA, 20 bp, Homo sapiens
cagaggagtacatatgttca

SEQ ID NO: 7412732 - DNA, 20 bp, Homo sapiens
cagaggagtacatatgttca

SEQ ID NO: 7412733 - DNA, 22 bp, Homo sapiens
cagaggagttcagtacacagcc

SEQ ID NO: 7412734 - DNA, 22 bp, Homo sapiens
cagaggagttcagtacacagcc

SEQ ID NO: 7412735 - DNA, 22 bp, Homo sapiens
cagaggagttcagtacacagcc

SEQ ID NO: 7412736 - DNA, 22 bp, Homo sapiens
cagaggagttcagtacacagcc

SEQ ID NO: 7412737 - DNA, 22 bp, Homo sapiens
cagaggagttcagtacacagcc

SEQ ID NO: 7412738 - DNA, 22 bp, Homo sapiens
cagaggagttcagtacacagcc

SEQ ID NO: 7412739 - DNA, 22 bp, Homo sapiens
cagaggtgctggagtgagtcct

SEQ ID NO: 7412740 - DNA, 22 bp, Homo sapiens
cagaggtgctggagtgagtcct

SEQ ID NO: 7412741 - DNA, 21 bp, Homo sapiens
cagaggtggcctgacctctga

SEQ ID NO: 7412742 - DNA, 22 bp, Homo sapiens
cagagtgaaataggggatcaag

SEQ ID NO: 7412743 - DNA, 21 bp, Homo sapiens
cagaggtggcctgacctctga

SEQ ID NO: 7412744 - DNA, 22 bp, Homo sapiens
cagagtgcatggtgctgttcat

SEQ ID NO: 7412745 - DNA, 22 bp, Homo sapiens
cagagtggagaaacgcttcgtc

SEQ ID NO: 7412746 - DNA, 22 bp, Homo sapiens
cagagtggagaaacgcttcgtc

SEQ ID NO: 7412747 - DNA, 22 bp, Homo sapiens
cagagtgcatggtgctgttcat

SEQ ID NO: 7412748 - DNA, 22 bp, Homo sapiens
cagagtgatggcacctgctggg

SEQ ID NO: 7412749 - DNA, 22 bp, Homo sapiens
cagagtgatggcacctgctggg

SEQ ID NO: 7412750 - DNA, 22 bp, Homo sapiens
cagagtgatggcacctgctggg

SEQ ID NO: 7412751 - DNA, 22 bp, Homo sapiens
cagagtgatggcacctgctggg

SEQ ID NO: 7412752 - DNA, 22 bp, Homo sapiens
cagagtgattatggaggattgc

SEQ ID NO: 7412753 - DNA, 22 bp, Homo sapiens
cagagtgacattttcccttctc

SEQ ID NO: 7412754 - DNA, 22 bp, Homo sapiens
cagagtgaacagtgggatgtgc

SEQ ID NO: 7412755 - DNA, 21 bp, Homo sapiens
cagaggtggcctgacctctga

SEQ ID NO: 7412756 - DNA, 22 bp, Homo sapiens
cagagtgagggcctgcacctgc

SEQ ID NO: 7412757 - DNA, 22 bp, Homo sapiens
cagagtgataaatatagaaatt

SEQ ID NO: 7412758 - DNA, 22 bp, Homo sapiens
cagagtgataaatatagaaatt

SEQ ID NO: 7412759 - DNA, 22 bp, Homo sapiens
cagagtgataaatatagaaatt

SEQ ID NO: 7412760 - DNA, 22 bp, Homo sapiens
cagagtgaaataggggatcaag

SEQ ID NO: 7412761 - DNA, 22 bp, Homo sapiens
cagagtgaaataggggatcaag

SEQ ID NO: 7412762 - DNA, 22 bp, Homo sapiens
cagagtgaaataggggatcaag

SEQ ID NO: 7412763 - DNA, 22 bp, Homo sapiens
cagagtgaaataggggatcaag

SEQ ID NO: 7412764 - DNA, 22 bp, Homo sapiens
cagagtgaacagtgggatgtgc

SEQ ID NO: 7412765 - DNA, 22 bp, Homo sapiens
agccagggatggcagtgcccag

SEQ ID NO: 7412766 - DNA, 22 bp, Homo sapiens
agccagggatgcagcacagtga

SEQ ID NO: 7412767 - DNA, 22 bp, Homo sapiens
agccagggatgcagcacagtga

SEQ ID NO: 7412768 - DNA, 22 bp, Homo sapiens
agccagggatgcagcacagtga

SEQ ID NO: 7412769 - DNA, 22 bp, Homo sapiens
agccagggatggcagtgcccag

SEQ ID NO: 7412770 - DNA, 22 bp, Homo sapiens
agccagggatggcagtgcccag

SEQ ID NO: 7412771 - DNA, 22 bp, Homo sapiens
agccagggatggcagtgcccag

SEQ ID NO: 7412772 - DNA, 22 bp, Homo sapiens
agccagggatggcagtgcccag

SEQ ID NO: 7412773 - DNA, 22 bp, Homo sapiens
agccagggatggcagtgcccag

SEQ ID NO: 7412774 - DNA, 22 bp, Homo sapiens
agccagggatggcagtgcccag

SEQ ID NO: 7412775 - DNA, 22 bp, Homo sapiens
agccagggatggcagtgcccag

SEQ ID NO: 7412776 - DNA, 23 bp, Homo sapiens
agccagggcactggtggagattg

SEQ ID NO: 7412777 - DNA, 23 bp, Homo sapiens
agccagggcactggtggagattg

SEQ ID NO: 7412778 - DNA, 23 bp, Homo sapiens
agccagggcactggtggagattg

SEQ ID NO: 7412779 - DNA, 23 bp, Homo sapiens
agccagggcactggtggagattg

SEQ ID NO: 7412780 - DNA, 22 bp, Homo sapiens
agccagggctctccttcgcgtg

SEQ ID NO: 7412781 - DNA, 23 bp, Homo sapiens
agccagggcactggtggagattg

SEQ ID NO: 7412782 - DNA, 22 bp, Homo sapiens
agccagggacgctgcaggctac

SEQ ID NO: 7412783 - DNA, 22 bp, Homo sapiens
agccagggacgctgcaggctac

SEQ ID NO: 7412784 - DNA, 22 bp, Homo sapiens
agccagggacgctgcaggctac

SEQ ID NO: 7412785 - DNA, 22 bp, Homo sapiens
agccagggaggattacacccca

SEQ ID NO: 7412786 - DNA, 22 bp, Homo sapiens
agccagggaggtggaggttgca

SEQ ID NO: 7412787 - DNA, 22 bp, Homo sapiens
agccagggaggattacacccca

SEQ ID NO: 7412788 - DNA, 22 bp, Homo sapiens
agccagggatgcagcacagtga

SEQ ID NO: 7412789 - DNA, 22 bp, Homo sapiens
agccagggatgcagcacagtga

SEQ ID NO: 7412790 - DNA, 22 bp, Homo sapiens
agccagggatgcagcacagtga

SEQ ID NO: 7412791 - DNA, 22 bp, Homo sapiens
agccagggatgcagcacagtga

SEQ ID NO: 7412792 - DNA, 22 bp, Homo sapiens
agccagggatgcagcacagtga

SEQ ID NO: 7412793 - DNA, 22 bp, Homo sapiens
agccagggatgcagcacagtga

SEQ ID NO: 7412794 - DNA, 22 bp, Homo sapiens
agccagggaggtggaggttgca

SEQ ID NO: 7412795 - DNA, 22 bp, Homo sapiens
agccagggaggtggaggttgca

SEQ ID NO: 7412796 - DNA, 22 bp, Homo sapiens
agccagggaggtggaggttgca

SEQ ID NO: 7412797 - DNA, 22 bp, Homo sapiens
cagagcagggtgcaccttgggc

SEQ ID NO: 7412798 - DNA, 22 bp, Homo sapiens
cagagcaggtatctttggtgaa

SEQ ID NO: 7412799 - DNA, 22 bp, Homo sapiens
cagagcaggtatctttggtgaa

SEQ ID NO: 7412800 - DNA, 22 bp, Homo sapiens
cagagcagggtgcaccttgggc

SEQ ID NO: 7412801 - DNA, 22 bp, Homo sapiens
cagagcagggtgcaccttgggc

SEQ ID NO: 7412802 - DNA, 22 bp, Homo sapiens
cagagcagggtgcaccttgggc

SEQ ID NO: 7412803 - DNA, 22 bp, Homo sapiens
cagagcagggtgcaccttgggc

SEQ ID NO: 7412804 - DNA, 22 bp, Homo sapiens
cagagcaggggtttcccaggtt

SEQ ID NO: 7412805 - DNA, 22 bp, Homo sapiens
cagagcaggggtttcccaggtt

SEQ ID NO: 7412806 - DNA, 22 bp, Homo sapiens
agccaggggagtcagctgctgg

SEQ ID NO: 7412807 - DNA, 22 bp, Homo sapiens
cagagcaccagtgggagacaag

SEQ ID NO: 7412808 - DNA, 22 bp, Homo sapiens
cagagcaccagtgggagacaag

SEQ ID NO: 7412809 - DNA, 22 bp, Homo sapiens
agccaggggagtcagctgctgg

SEQ ID NO: 7412810 - DNA, 22 bp, Homo sapiens
agccaggggagtcagctgctgg

SEQ ID NO: 7412811 - DNA, 22 bp, Homo sapiens
agccaggggagtcagctgctgg

SEQ ID NO: 7412812 - DNA, 22 bp, Homo sapiens
agccaggggagtcagctgctgg

SEQ ID NO: 7412813 - DNA, 22 bp, Homo sapiens
agccaggggagtcagctgctgg

SEQ ID NO: 7412814 - DNA, 22 bp, Homo sapiens
agccaggggagtcagctgctgg

SEQ ID NO: 7412815 - DNA, 22 bp, Homo sapiens
agccaggggagtcagctgctgg

SEQ ID NO: 7412816 - DNA, 22 bp, Homo sapiens
agccaggggagtcagctgctgg

SEQ ID NO: 7412817 - DNA, 22 bp, Homo sapiens
agccaggggagtcagctgctgg

SEQ ID NO: 7412818 - DNA, 22 bp, Homo sapiens
agccagggctgcgagcagacag

SEQ ID NO: 7412819 - DNA, 22 bp, Homo sapiens
agccagggctgcgagcagacag

SEQ ID NO: 7412820 - DNA, 22 bp, Homo sapiens
agccagggctgcgagcagacag

SEQ ID NO: 7412821 - DNA, 22 bp, Homo sapiens
agccagggctgcgagcagacag

SEQ ID NO: 7412822 - DNA, 22 bp, Homo sapiens
agccagggctgcaggttccttg

SEQ ID NO: 7412823 - DNA, 22 bp, Homo sapiens
agccagggctgcaggttccttg

SEQ ID NO: 7412824 - DNA, 22 bp, Homo sapiens
agccagggctgcgagcagacag

SEQ ID NO: 7412825 - DNA, 22 bp, Homo sapiens
agccagggctgcgagcagacag

SEQ ID NO: 7412826 - DNA, 22 bp, Homo sapiens
agccagggctgcgagcagacag

SEQ ID NO: 7412827 - DNA, 22 bp, Homo sapiens
agccagggctgcgagcagacag

SEQ ID NO: 7412828 - DNA, 22 bp, Homo sapiens
agccagggctgcgagcagacag

SEQ ID NO: 7412829 - DNA, 22 bp, Homo sapiens
agccagggaagaggcctacctc

SEQ ID NO: 7412830 - DNA, 22 bp, Homo sapiens
agccagggaagaggcctacctc

SEQ ID NO: 7412831 - DNA, 22 bp, Homo sapiens
agccagggaagaggcctacctc

SEQ ID NO: 7412832 - DNA, 16 bp, Homo sapiens
agccaggctgcctcgg

SEQ ID NO: 7412833 - DNA, 16 bp, Homo sapiens
agccaggctgcctcgg

SEQ ID NO: 7412834 - DNA, 16 bp, Homo sapiens
agccaggctgcctcgg

SEQ ID NO: 7412835 - DNA, 16 bp, Homo sapiens
agccaggctgcctcgg

SEQ ID NO: 7412836 - DNA, 16 bp, Homo sapiens
agccaggctgcctcgg

SEQ ID NO: 7412837 - DNA, 22 bp, Homo sapiens
agccaggctgcagttggctggc

SEQ ID NO: 7412838 - DNA, 22 bp, Homo sapiens
agccaggctgcagttggctggc

SEQ ID NO: 7412839 - DNA, 22 bp, Homo sapiens
agccaggctgcagttggctggc

SEQ ID NO: 7412840 - DNA, 22 bp, Homo sapiens
agccaggctgcagttggctggc

SEQ ID NO: 7412841 - DNA, 22 bp, Homo sapiens
agccaggctgcagttggctggc

SEQ ID NO: 7412842 - DNA, 22 bp, Homo sapiens
agccaggctgcagttggctggc

SEQ ID NO: 7412843 - DNA, 22 bp, Homo sapiens
agccaggctcaaggcctgctcc

SEQ ID NO: 7412844 - DNA, 22 bp, Homo sapiens
agccagggacgctgcaggctac

SEQ ID NO: 7412845 - DNA, 22 bp, Homo sapiens
agccagggacgctgcaggctac

SEQ ID NO: 7412846 - DNA, 22 bp, Homo sapiens
agccagggacgctgcaggctac

SEQ ID NO: 7412847 - DNA, 22 bp, Homo sapiens
agccagggacgctgcaggctac

SEQ ID NO: 7412848 - DNA, 22 bp, Homo sapiens
agccagggacgctgcaggctac

SEQ ID NO: 7412849 - DNA, 22 bp, Homo sapiens
agccagggacgctgcaggctac

SEQ ID NO: 7412850 - DNA, 22 bp, Homo sapiens
agccagggacgctgcaggctac

SEQ ID NO: 7412851 - DNA, 22 bp, Homo sapiens
agccagggacgctgcaggctac

SEQ ID NO: 7412852 - DNA, 22 bp, Homo sapiens
agccagggacgctgcaggctac

SEQ ID NO: 7412853 - DNA, 22 bp, Homo sapiens
agccagggacgctgcaggctac

SEQ ID NO: 7412854 - DNA, 22 bp, Homo sapiens
agccagggacgctgcaggctac

SEQ ID NO: 7412855 - DNA, 22 bp, Homo sapiens
agccagggaagaggcctacctc

SEQ ID NO: 7412856 - DNA, 22 bp, Homo sapiens
agccagggaaggataacaagaa

SEQ ID NO: 7412857 - DNA, 22 bp, Homo sapiens
agccagggaagaggcctacctc

SEQ ID NO: 7412858 - DNA, 22 bp, Homo sapiens
agccagggacgctgcaggctac

SEQ ID NO: 7412859 - DNA, 22 bp, Homo sapiens
agccagggacgctgcaggctac

SEQ ID NO: 7412860 - DNA, 22 bp, Homo sapiens
agccagggaaggataacaagaa

SEQ ID NO: 7412861 - DNA, 22 bp, Homo sapiens
agccagggaaggataacaagaa

SEQ ID NO: 7412862 - DNA, 22 bp, Homo sapiens
agccaggccttttctcaaggtt

SEQ ID NO: 7412863 - DNA, 22 bp, Homo sapiens
agccaggccttttctcaaggtt

SEQ ID NO: 7412864 - DNA, 22 bp, Homo sapiens
agccaggccttttctcaaggtt

SEQ ID NO: 7412865 - DNA, 22 bp, Homo sapiens
agccaggctcaaggcctgctcc

SEQ ID NO: 7412866 - DNA, 22 bp, Homo sapiens
agccaggcgcagtggcttatgc

SEQ ID NO: 7412867 - DNA, 22 bp, Homo sapiens
agccaggctcaaggcctgctcc

SEQ ID NO: 7412868 - DNA, 22 bp, Homo sapiens
agccaagcactcaactcctgga

SEQ ID NO: 7412869 - DNA, 22 bp, Homo sapiens
agccaagcactcaactcctgga

SEQ ID NO: 7412870 - DNA, 22 bp, Homo sapiens
agccaagaggagcctaaagcga

SEQ ID NO: 7412871 - DNA, 22 bp, Homo sapiens
agccaagacatttagaaaagct

SEQ ID NO: 7412872 - DNA, 22 bp, Homo sapiens
agccaagacatttagaaaagct

SEQ ID NO: 7412873 - DNA, 22 bp, Homo sapiens
agccaagagacagatgcccacc

SEQ ID NO: 7412874 - DNA, 22 bp, Homo sapiens
agccaagagacagatgcccacc

SEQ ID NO: 7412875 - DNA, 22 bp, Homo sapiens
agccaagagacagatgcccacc

SEQ ID NO: 7412876 - DNA, 22 bp, Homo sapiens
agccaagagatgaggctgcagg

SEQ ID NO: 7412877 - DNA, 22 bp, Homo sapiens
agccaagagatgaggctgcagg

SEQ ID NO: 7412878 - DNA, 22 bp, Homo sapiens
agccaagagatgaggctgcagg

SEQ ID NO: 7412879 - DNA, 22 bp, Homo sapiens
agccaagagatgaggctgcagg

SEQ ID NO: 7412880 - DNA, 22 bp, Homo sapiens
agccaagaatcatgagctaata

SEQ ID NO: 7412881 - DNA, 20 bp, Homo sapiens
agccaagaacaggcagaacc

SEQ ID NO: 7412882 - DNA, 22 bp, Homo sapiens
agccaactccctctcattgagc

SEQ ID NO: 7412883 - DNA, 22 bp, Homo sapiens
agccaacttagaagaaatttga

SEQ ID NO: 7412884 - DNA, 22 bp, Homo sapiens
agccaacttggaaagtcagatt

SEQ ID NO: 7412885 - DNA, 22 bp, Homo sapiens
cagagccaggtctaggagtctc

SEQ ID NO: 7412886 - DNA, 22 bp, Homo sapiens
cagagccaggtctaggagtctc

SEQ ID NO: 7412887 - DNA, 22 bp, Homo sapiens
cagagccaggtcttgaactcag

SEQ ID NO: 7412888 - DNA, 22 bp, Homo sapiens
cagagccaggtcttgaactcag

SEQ ID NO: 7412889 - DNA, 22 bp, Homo sapiens
cagagccaggtcttgaactcag

SEQ ID NO: 7412890 - DNA, 22 bp, Homo sapiens
cagagccaggtggtgttggggc

SEQ ID NO: 7412891 - DNA, 22 bp, Homo sapiens
cagagccaggtggtgttggggc

SEQ ID NO: 7412892 - DNA, 22 bp, Homo sapiens
cagagccagtcagtcagaaact

SEQ ID NO: 7412893 - DNA, 20 bp, Homo sapiens
cagagccagggttttgtttt

SEQ ID NO: 7412894 - DNA, 20 bp, Homo sapiens
cagagccagggttttgtttt

SEQ ID NO: 7412895 - DNA, 22 bp, Homo sapiens
cagagccaggtctaggagtctc

SEQ ID NO: 7412896 - DNA, 22 bp, Homo sapiens
cagagccaggtctaggagtctc

SEQ ID NO: 7412897 - DNA, 22 bp, Homo sapiens
cagagccaggtctaggagtctc

SEQ ID NO: 7412898 - DNA, 22 bp, Homo sapiens
cagagccaggtctaggagtctc

SEQ ID NO: 7412899 - DNA, 19 bp, Homo sapiens
cagagccaggcctttggcc

SEQ ID NO: 7412900 - DNA, 22 bp, Homo sapiens
cagagccagggctaggaactgg

SEQ ID NO: 7412901 - DNA, 22 bp, Homo sapiens
cagagccagggctaggaactgg

SEQ ID NO: 7412902 - DNA, 19 bp, Homo sapiens
cagagccaggcctttggcc

SEQ ID NO: 7412903 - DNA, 22 bp, Homo sapiens
cagagccagggttgcacccctg

SEQ ID NO: 7412904 - DNA, 22 bp, Homo sapiens
cagagccaggcctgccctcttt

SEQ ID NO: 7412905 - DNA, 22 bp, Homo sapiens
cagagccaggcctgccctcttt

SEQ ID NO: 7412906 - DNA, 19 bp, Homo sapiens
cagagccaggcctttggcc

SEQ ID NO: 7412907 - DNA, 22 bp, Homo sapiens
cagagccaggcctgccctcttt

SEQ ID NO: 7412908 - DNA, 22 bp, Homo sapiens
cagagcagtctggagatccagc

SEQ ID NO: 7412909 - DNA, 22 bp, Homo sapiens
cagagcagtctggagatccagc

SEQ ID NO: 7412910 - DNA, 22 bp, Homo sapiens
cagagccaggcctgccctcttt

SEQ ID NO: 7412911 - DNA, 22 bp, Homo sapiens
cagagcagtctggagatccagc

SEQ ID NO: 7412912 - DNA, 22 bp, Homo sapiens
cagagcagtctggagatccagc

SEQ ID NO: 7412913 - DNA, 22 bp, Homo sapiens
cagagcagtctggagatccagc

SEQ ID NO: 7412914 - DNA, 22 bp, Homo sapiens
cagagcagtctggagatccagc

SEQ ID NO: 7412915 - DNA, 22 bp, Homo sapiens
cagagcagtctggagatccagc

SEQ ID NO: 7412916 - DNA, 22 bp, Homo sapiens
cagagcagtctggagatccagc

SEQ ID NO: 7412917 - DNA, 22 bp, Homo sapiens
cagagcaggtatctttggtgaa

SEQ ID NO: 7412918 - DNA, 22 bp, Homo sapiens
cagagcagggtgcaccttgggc

SEQ ID NO: 7412919 - DNA, 22 bp, Homo sapiens
cagagcagtaaatctggggcac

SEQ ID NO: 7412920 - DNA, 22 bp, Homo sapiens
cagagcagtaaatctggggcac

SEQ ID NO: 7412921 - DNA, 22 bp, Homo sapiens
cagagcagtaaatctggggcac

SEQ ID NO: 7412922 - DNA, 22 bp, Homo sapiens
cagagcagtaaatctggggcac

SEQ ID NO: 7412923 - DNA, 22 bp, Homo sapiens
cagagcagtaaatctggggcac

SEQ ID NO: 7412924 - DNA, 22 bp, Homo sapiens
cagagcagtaaatctggggcac

SEQ ID NO: 7412925 - DNA, 22 bp, Homo sapiens
cagagcagtaaatctggggcac

SEQ ID NO: 7412926 - DNA, 22 bp, Homo sapiens
cagagcagtaaatctggggcac

SEQ ID NO: 7412927 - DNA, 22 bp, Homo sapiens
cagagcagtagaaaacagcctt

SEQ ID NO: 7412928 - DNA, 22 bp, Homo sapiens
cagagcagtagaaaacagcctt

SEQ ID NO: 7412929 - DNA, 22 bp, Homo sapiens
cagagcagtagaaaacagcctt

SEQ ID NO: 7412930 - DNA, 22 bp, Homo sapiens
cagagcagtagaaaacagcctt

SEQ ID NO: 7412931 - DNA, 22 bp, Homo sapiens
cagagcagtagaaaacagcctt

SEQ ID NO: 7412932 - DNA, 22 bp, Homo sapiens
cagagcagtagaaaacagcctt

SEQ ID NO: 7412933 - DNA, 22 bp, Homo sapiens
cagagcagtagaaaacagcctt

SEQ ID NO: 7412934 - DNA, 22 bp, Homo sapiens
cagagcagtagaaaacagcctt

SEQ ID NO: 7412935 - DNA, 22 bp, Homo sapiens
cagagcagtctggagatccagc

SEQ ID NO: 7412936 - DNA, 22 bp, Homo sapiens
cagagcagtctggagatccagc

SEQ ID NO: 7412937 - DNA, 22 bp, Homo sapiens
cagagcagtctggagatccagc

SEQ ID NO: 7412938 - DNA, 22 bp, Homo sapiens
cagagcagtctggagatccagc

SEQ ID NO: 7412939 - DNA, 22 bp, Homo sapiens
cagagcagtccttgtcaatcag

SEQ ID NO: 7412940 - DNA, 22 bp, Homo sapiens
cagagcagtccttgtcaatcag

SEQ ID NO: 7412941 - DNA, 22 bp, Homo sapiens
cagagcagtccttgtcaatcag

SEQ ID NO: 7412942 - DNA, 22 bp, Homo sapiens
cagagcagtccttgtcaatcag

SEQ ID NO: 7412943 - DNA, 22 bp, Homo sapiens
cagagcagtccttgtcaatcag

SEQ ID NO: 7412944 - DNA, 22 bp, Homo sapiens
cagagcagtccttgtcaatcag

SEQ ID NO: 7412945 - DNA, 22 bp, Homo sapiens
cagagcagtccttgtcaatcag

SEQ ID NO: 7412946 - DNA, 22 bp, Homo sapiens
cagagcagtccttgtcaatcag

SEQ ID NO: 7412947 - DNA, 22 bp, Homo sapiens
cagagcagtccttgtcaatcag

SEQ ID NO: 7412948 - DNA, 18 bp, Homo sapiens
cagagcagtatgaatgtt

SEQ ID NO: 7412949 - DNA, 22 bp, Homo sapiens
cagagcagtagaaaacagcctt

SEQ ID NO: 7412950 - DNA, 18 bp, Homo sapiens
cagagcagtatgaatgtt

SEQ ID NO: 7412951 - DNA, 18 bp, Homo sapiens
cagagcagtatgaatgtt

SEQ ID NO: 7412952 - DNA, 22 bp, Homo sapiens
cagagcagtagaaaacagcctt

SEQ ID NO: 7412953 - DNA, 22 bp, Homo sapiens
cagagcagtagaaaacagcctt

SEQ ID NO: 7412954 - DNA, 22 bp, Homo sapiens
cagagcagtagaaaacagcctt

SEQ ID NO: 7412955 - DNA, 18 bp, Homo sapiens
cagagcagtatgaatgtt

SEQ ID NO: 7412956 - DNA, 18 bp, Homo sapiens
cagagcagtatgaatgtt

SEQ ID NO: 7412957 - DNA, 18 bp, Homo sapiens
cagagcagtatgaatgtt

SEQ ID NO: 7412958 - DNA, 18 bp, Homo sapiens
cagagcagtatgaatgtt

SEQ ID NO: 7412959 - DNA, 18 bp, Homo sapiens
cagagcagtatgaatgtt

SEQ ID NO: 7412960 - DNA, 22 bp, Homo sapiens
cagagccatcatgatatggagt

SEQ ID NO: 7412961 - DNA, 22 bp, Homo sapiens
cagagccatcatgatatggagt

SEQ ID NO: 7412962 - DNA, 22 bp, Homo sapiens
cagagccatccaggtgcctgtt

SEQ ID NO: 7412963 - DNA, 22 bp, Homo sapiens
cagagccatccaggtgcctgtt

SEQ ID NO: 7412964 - DNA, 22 bp, Homo sapiens
cagagccatccaggtgcctgtt

SEQ ID NO: 7412965 - DNA, 22 bp, Homo sapiens
cagagccataaaggtgaaagag

SEQ ID NO: 7412966 - DNA, 22 bp, Homo sapiens
cagagccataaaggtgaaagag

SEQ ID NO: 7412967 - DNA, 22 bp, Homo sapiens
cagagccataaaggtgaaagag

SEQ ID NO: 7412968 - DNA, 22 bp, Homo sapiens
cagagccagtcagtcagaaact

SEQ ID NO: 7412969 - DNA, 22 bp, Homo sapiens
cagagccatcatgatatggagt

SEQ ID NO: 7412970 - DNA, 22 bp, Homo sapiens
cagagccatcccagcctgtggt

SEQ ID NO: 7412971 - DNA, 22 bp, Homo sapiens
cagagccatcccagcctgtggt

SEQ ID NO: 7412972 - DNA, 22 bp, Homo sapiens
cagagccatcccagcctgtggt

SEQ ID NO: 7412973 - DNA, 22 bp, Homo sapiens
cagagccatcccagcctgtggt

SEQ ID NO: 7412974 - DNA, 22 bp, Homo sapiens
cagagccatccaggtgcctgtt

SEQ ID NO: 7412975 - DNA, 22 bp, Homo sapiens
cagagccatcccagcctgtggt

SEQ ID NO: 7412976 - DNA, 22 bp, Homo sapiens
cagagccatggtatgggcttgt

SEQ ID NO: 7412977 - DNA, 22 bp, Homo sapiens
cagagccattatggagacttgc

SEQ ID NO: 7412978 - DNA, 22 bp, Homo sapiens
cagagccatcccagcctgtggt

SEQ ID NO: 7412979 - DNA, 23 bp, Homo sapiens
cagagctggctcagagctgcctg

SEQ ID NO: 7412980 - DNA, 23 bp, Homo sapiens
cagagctggctcagagctgcctg

SEQ ID NO: 7412981 - DNA, 23 bp, Homo sapiens
cagagctggctcagagctgcctg

SEQ ID NO: 7412982 - DNA, 21 bp, Homo sapiens
cagagctgtccaaaccctgac

SEQ ID NO: 7412983 - DNA, 21 bp, Homo sapiens
cagagctgtccaaaccctgac

SEQ ID NO: 7412984 - DNA, 22 bp, Homo sapiens
cagagctgtcatttgccagtga

SEQ ID NO: 7412985 - DNA, 22 bp, Homo sapiens
cagagctgtcatttgccagtga

SEQ ID NO: 7412986 - DNA, 21 bp, Homo sapiens
cagagctgtccaaaccctgac

SEQ ID NO: 7412987 - DNA, 21 bp, Homo sapiens
cagagctgtccaaaccctgac

SEQ ID NO: 7412988 - DNA, 21 bp, Homo sapiens
cagagctgtccaaaccctgac

SEQ ID NO: 7412989 - DNA, 21 bp, Homo sapiens
cagagctgtccaaaccctgac

SEQ ID NO: 7412990 - DNA, 20 bp, Homo sapiens
cagagctgttatggatgatg

SEQ ID NO: 7412991 - DNA, 20 bp, Homo sapiens
cagagctgttatggatgatg

SEQ ID NO: 7412992 - DNA, 20 bp, Homo sapiens
cagagctgttatggatgatg

SEQ ID NO: 7412993 - DNA, 20 bp, Homo sapiens
cagagctgttatggatgatg

SEQ ID NO: 7412994 - DNA, 20 bp, Homo sapiens
cagagctgttatggatgatg

SEQ ID NO: 7412995 - DNA, 22 bp, Homo sapiens
cagagctgttactattcatgaa

SEQ ID NO: 7412996 - DNA, 22 bp, Homo sapiens
cagagctgttactattcatgaa

SEQ ID NO: 7412997 - DNA, 20 bp, Homo sapiens
cagagctgttatggatgatg

SEQ ID NO: 7412998 - DNA, 20 bp, Homo sapiens
cagagctgttatggatgatg

SEQ ID NO: 7412999 - DNA, 22 bp, Homo sapiens
cagagctgttgcggggcttggc

SEQ ID NO: 7413000 - DNA, 22 bp, Homo sapiens
cagagctgttgcggggcttggc

SEQ ID NO: 7413001 - DNA, 22 bp, Homo sapiens
cagagctgttgcggggcttggc

SEQ ID NO: 7413002 - DNA, 22 bp, Homo sapiens
cagagctgttgcggggcttggc

SEQ ID NO: 7413003 - DNA, 22 bp, Homo sapiens
cagagctgttgcggggcttggc

SEQ ID NO: 7413004 - DNA, 22 bp, Homo sapiens
cagagctgttgcggggcttggc

SEQ ID NO: 7413005 - DNA, 22 bp, Homo sapiens
cagagctgttgcggggcttggc

SEQ ID NO: 7413006 - DNA, 22 bp, Homo sapiens
cagagcttaaaactccatggaa

SEQ ID NO: 7413007 - DNA, 22 bp, Homo sapiens
cagagctgtccaaaccctgaca

SEQ ID NO: 7413008 - DNA, 22 bp, Homo sapiens
cagagctgtccaaaccctgaca

SEQ ID NO: 7413009 - DNA, 22 bp, Homo sapiens
cagagctgtccaaaccctgaca

SEQ ID NO: 7413010 - DNA, 22 bp, Homo sapiens
cagagctgtccaaaccctgaca

SEQ ID NO: 7413011 - DNA, 22 bp, Homo sapiens
cagagctgtccaaaccctgaca

SEQ ID NO: 7413012 - DNA, 22 bp, Homo sapiens
cagagctgtccaaaccctgaca

SEQ ID NO: 7413013 - DNA, 22 bp, Homo sapiens
cagagctgtccaaaccctgaca

SEQ ID NO: 7413014 - DNA, 22 bp, Homo sapiens
cagagctgtgataaatagatat

SEQ ID NO: 7413015 - DNA, 22 bp, Homo sapiens
cagagctgttactattcatgaa

SEQ ID NO: 7413016 - DNA, 22 bp, Homo sapiens
cagagctgttactattcatgaa

SEQ ID NO: 7413017 - DNA, 22 bp, Homo sapiens
cagagctgtgataaatagatat

SEQ ID NO: 7413018 - DNA, 22 bp, Homo sapiens
cagagctgtgataaatagatat

SEQ ID NO: 7413019 - DNA, 22 bp, Homo sapiens
cagagctgtgataaatagatat

SEQ ID NO: 7413020 - DNA, 22 bp, Homo sapiens
agcaatgaaatgaaatcagtct

SEQ ID NO: 7413021 - DNA, 23 bp, Homo sapiens
agcaatctgtgtttcagcaagcc

SEQ ID NO: 7413022 - DNA, 22 bp, Homo sapiens
agcaatgaccagtgatcttgta

SEQ ID NO: 7413023 - DNA, 22 bp, Homo sapiens
agcaatgaaaacaataaggtga

SEQ ID NO: 7413024 - DNA, 22 bp, Homo sapiens
agcaatcatgacaaattatctt

SEQ ID NO: 7413025 - DNA, 22 bp, Homo sapiens
caaataattactatcctcactt

SEQ ID NO: 7413026 - DNA, 22 bp, Homo sapiens
caaataattactatcctcactt

SEQ ID NO: 7413027 - DNA, 22 bp, Homo sapiens
agcaatcatgacaaattatctt

SEQ ID NO: 7413028 - DNA, 22 bp, Homo sapiens
agcaatgactttgaaatcatga

SEQ ID NO: 7413029 - DNA, 22 bp, Homo sapiens
agcaatgactttgaaatcatga

SEQ ID NO: 7413030 - DNA, 22 bp, Homo sapiens
agcaatgatgttttcaagtagg

SEQ ID NO: 7413031 - DNA, 22 bp, Homo sapiens
agcaatgatgttttcaagtagg

SEQ ID NO: 7413032 - DNA, 22 bp, Homo sapiens
agcaatgactttgaaatcatga

SEQ ID NO: 7413033 - DNA, 22 bp, Homo sapiens
agcaatgactggctatatgatt

SEQ ID NO: 7413034 - DNA, 22 bp, Homo sapiens
agcaatgactggctatatgatt

SEQ ID NO: 7413035 - DNA, 22 bp, Homo sapiens
agcaatgactggctatatgatt

SEQ ID NO: 7413036 - DNA, 22 bp, Homo sapiens
agcaatgtaaaccctgaagttg

SEQ ID NO: 7413037 - DNA, 23 bp, Homo sapiens
agcaatgctgggagactctgtaa

SEQ ID NO: 7413038 - DNA, 22 bp, Homo sapiens
agcaatgcttattgctgactat

SEQ ID NO: 7413039 - DNA, 22 bp, Homo sapiens
agcaatgtgacccctgacagca

SEQ ID NO: 7413040 - DNA, 22 bp, Homo sapiens
agcaatgtctttttggccatct

SEQ ID NO: 7413041 - DNA, 22 bp, Homo sapiens
agcaatgttggggttagaggac

SEQ ID NO: 7413042 - DNA, 22 bp, Homo sapiens
agcaatgttggggttagaggac

SEQ ID NO: 7413043 - DNA, 22 bp, Homo sapiens
agcaatgttggcctatatacct

SEQ ID NO: 7413044 - DNA, 22 bp, Homo sapiens
agcaatgtggaccagctcaggg

SEQ ID NO: 7413045 - DNA, 22 bp, Homo sapiens
agcaatgcaatcttaaccttga

SEQ ID NO: 7413046 - DNA, 23 bp, Homo sapiens
agcaatgctgggagactctgtaa

SEQ ID NO: 7413047 - DNA, 22 bp, Homo sapiens
agcaatgcttattgctgactat

SEQ ID NO: 7413048 - DNA, 23 bp, Homo sapiens
agcaatgctgggagactctgtaa

SEQ ID NO: 7413049 - DNA, 22 bp, Homo sapiens
agcaatgctaccgggtgattcg

SEQ ID NO: 7413050 - DNA, 23 bp, Homo sapiens
agcaatgctgggagactctgtaa

SEQ ID NO: 7413051 - DNA, 22 bp, Homo sapiens
agcaatgcaatcttaaccttga

SEQ ID NO: 7413052 - DNA, 22 bp, Homo sapiens
agcaatgcaatcttaaccttga

SEQ ID NO: 7413053 - DNA, 22 bp, Homo sapiens
agcaatgcaatcttaaccttga

SEQ ID NO: 7413054 - DNA, 22 bp, Homo sapiens
agcaatgctaccgggtgattcg

SEQ ID NO: 7413055 - DNA, 22 bp, Homo sapiens
caaataagcaattccattcttc

SEQ ID NO: 7413056 - DNA, 22 bp, Homo sapiens
caaataagaaccacaggggagt

SEQ ID NO: 7413057 - DNA, 22 bp, Homo sapiens
caaataagaaccacaggggagt

SEQ ID NO: 7413058 - DNA, 22 bp, Homo sapiens
caaataagcaattccattcttc

SEQ ID NO: 7413059 - DNA, 22 bp, Homo sapiens
caaataagcaattccattcttc

SEQ ID NO: 7413060 - DNA, 22 bp, Homo sapiens
caaataagcaattccattcttc

SEQ ID NO: 7413061 - DNA, 22 bp, Homo sapiens
caaataagcaattccattcttc

SEQ ID NO: 7413062 - DNA, 22 bp, Homo sapiens
caaataagaaccacaggggagt

SEQ ID NO: 7413063 - DNA, 22 bp, Homo sapiens
caaagttttagtaaacatatat

SEQ ID NO: 7413064 - DNA, 22 bp, Homo sapiens
caaagttttagtaaacatatat

SEQ ID NO: 7413065 - DNA, 22 bp, Homo sapiens
caaagttttagtaaacatatat

SEQ ID NO: 7413066 - DNA, 22 bp, Homo sapiens
caaagttttagtaaacatatat

SEQ ID NO: 7413067 - DNA, 22 bp, Homo sapiens
caaagttttagtaaacatatat

SEQ ID NO: 7413068 - DNA, 22 bp, Homo sapiens
caaagttttagtaaacatatat

SEQ ID NO: 7413069 - DNA, 22 bp, Homo sapiens
caaagttttagtaaacatatat

SEQ ID NO: 7413070 - DNA, 22 bp, Homo sapiens
caaagtttggctctcatgacat

SEQ ID NO: 7413071 - DNA, 22 bp, Homo sapiens
caaagtttggctctcatgacat

SEQ ID NO: 7413072 - DNA, 22 bp, Homo sapiens
caaagtttggctctcatgacat

SEQ ID NO: 7413073 - DNA, 22 bp, Homo sapiens
caaagtttggctctcatgacat

SEQ ID NO: 7413074 - DNA, 22 bp, Homo sapiens
caaagtgggtgccctgatgctc

SEQ ID NO: 7413075 - DNA, 22 bp, Homo sapiens
caaagttatgaatgataagatt

SEQ ID NO: 7413076 - DNA, 22 bp, Homo sapiens
caaagttatcaactgcaacatt

SEQ ID NO: 7413077 - DNA, 22 bp, Homo sapiens
caaagttatcaactgcaacatt

SEQ ID NO: 7413078 - DNA, 22 bp, Homo sapiens
caaagtggagagcctgtggttg

SEQ ID NO: 7413079 - DNA, 22 bp, Homo sapiens
caaagtggagagcctgtggttg

SEQ ID NO: 7413080 - DNA, 22 bp, Homo sapiens
caaagtggaggctctggggcca

SEQ ID NO: 7413081 - DNA, 22 bp, Homo sapiens
caaagtggaggctctggggcca

SEQ ID NO: 7413082 - DNA, 22 bp, Homo sapiens
caaagtggctggccgggagatc

SEQ ID NO: 7413083 - DNA, 22 bp, Homo sapiens
caaagtggctggccgggagatc

SEQ ID NO: 7413084 - DNA, 22 bp, Homo sapiens
caaagtttaaagtagatttcag

SEQ ID NO: 7413085 - DNA, 22 bp, Homo sapiens
caaagtttggctctcatgacat

SEQ ID NO: 7413086 - DNA, 22 bp, Homo sapiens
caaagtttggctctcatgacat

SEQ ID NO: 7413087 - DNA, 22 bp, Homo sapiens
caaagtttaaagtagatttcag

SEQ ID NO: 7413088 - DNA, 22 bp, Homo sapiens
caaagtttaaagtagatttcag

SEQ ID NO: 7413089 - DNA, 22 bp, Homo sapiens
caaagttatgaatgataagatt

SEQ ID NO: 7413090 - DNA, 22 bp, Homo sapiens
caaagttatgaatgataagatt

SEQ ID NO: 7413091 - DNA, 22 bp, Homo sapiens
caaagttgcagttatgtgatta

SEQ ID NO: 7413092 - DNA, 22 bp, Homo sapiens
caaagtttaaagtagatttcag

SEQ ID NO: 7413093 - DNA, 22 bp, Homo sapiens
caaagtttaaagtagatttcag

SEQ ID NO: 7413094 - DNA, 22 bp, Homo sapiens
caaacatttgttggaacccctg

SEQ ID NO: 7413095 - DNA, 22 bp, Homo sapiens
caaacatttgttggaacccctg

SEQ ID NO: 7413096 - DNA, 22 bp, Homo sapiens
caaacatttgttggaacccctg

SEQ ID NO: 7413097 - DNA, 22 bp, Homo sapiens
caaacattttaaataagggata

SEQ ID NO: 7413098 - DNA, 22 bp, Homo sapiens
caaacattttaaataagggata

SEQ ID NO: 7413099 - DNA, 22 bp, Homo sapiens
caaacattttaaataagggata

SEQ ID NO: 7413100 - DNA, 22 bp, Homo sapiens
caaacattttaaataagggata

SEQ ID NO: 7413101 - DNA, 22 bp, Homo sapiens
caaacattttctacttccagga

SEQ ID NO: 7413102 - DNA, 22 bp, Homo sapiens
caaacattttctacttccagga

SEQ ID NO: 7413103 - DNA, 22 bp, Homo sapiens
caaacattttctacttccagga

SEQ ID NO: 7413104 - DNA, 22 bp, Homo sapiens
caaacattttgagtggtttctg

SEQ ID NO: 7413105 - DNA, 22 bp, Homo sapiens
caaacattttgagtggtttctg

SEQ ID NO: 7413106 - DNA, 22 bp, Homo sapiens
caaacattttgagtggtttctg

SEQ ID NO: 7413107 - DNA, 22 bp, Homo sapiens
caaacattttgagtggtttctg

SEQ ID NO: 7413108 - DNA, 22 bp, Homo sapiens
caaagggctctagactcagcag

SEQ ID NO: 7413109 - DNA, 22 bp, Homo sapiens
caaacattttgagtggtttctg

SEQ ID NO: 7413110 - DNA, 22 bp, Homo sapiens
caaacattttgagtggtttctg

SEQ ID NO: 7413111 - DNA, 22 bp, Homo sapiens
caaacattttgagtggtttctg

SEQ ID NO: 7413112 - DNA, 22 bp, Homo sapiens
caaacattttgagtggtttctg

SEQ ID NO: 7413113 - DNA, 22 bp, Homo sapiens
caaacattttctacttccagga

SEQ ID NO: 7413114 - DNA, 22 bp, Homo sapiens
caaaggtaaagatctgctgtgg

SEQ ID NO: 7413115 - DNA, 22 bp, Homo sapiens
caaaggtagtatatatattgtt

SEQ ID NO: 7413116 - DNA, 22 bp, Homo sapiens
caaaggtataagttaatataca

SEQ ID NO: 7413117 - DNA, 22 bp, Homo sapiens
caaagtgctgggattacaggct

SEQ ID NO: 7413118 - DNA, 22 bp, Homo sapiens
caaagtgctgggattacaggtg

SEQ ID NO: 7413119 - DNA, 22 bp, Homo sapiens
caaagtgctgggattacaggtg

SEQ ID NO: 7413120 - DNA, 22 bp, Homo sapiens
caaagtgctgggattacaggct

SEQ ID NO: 7413121 - DNA, 22 bp, Homo sapiens
caaagtgctgggattacaggct

SEQ ID NO: 7413122 - DNA, 22 bp, Homo sapiens
caaagtgctgggattacaggct

SEQ ID NO: 7413123 - DNA, 22 bp, Homo sapiens
caaagtgctgggattataggca

SEQ ID NO: 7413124 - DNA, 22 bp, Homo sapiens
caaagtgctgggattataggca

SEQ ID NO: 7413125 - DNA, 22 bp, Homo sapiens
caaagtgctgggattataggca

SEQ ID NO: 7413126 - DNA, 22 bp, Homo sapiens
caaagtgctgggattagtgctg

SEQ ID NO: 7413127 - DNA, 22 bp, Homo sapiens
caaagtgctgggattagtgctg

SEQ ID NO: 7413128 - DNA, 22 bp, Homo sapiens
caaagtgctgggattagtgctg

SEQ ID NO: 7413129 - DNA, 22 bp, Homo sapiens
caaagtgctgggattagtgctg

SEQ ID NO: 7413130 - DNA, 22 bp, Homo sapiens
caaagtgctgggattagtgctg

SEQ ID NO: 7413131 - DNA, 22 bp, Homo sapiens
caaagtgctgggattacaggtg

SEQ ID NO: 7413132 - DNA, 22 bp, Homo sapiens
caaagtgctgggattacaggtg

SEQ ID NO: 7413133 - DNA, 22 bp, Homo sapiens
caaagtgctgggattacaggtg

SEQ ID NO: 7413134 - DNA, 22 bp, Homo sapiens
caaagtgctgggattacaggtg

SEQ ID NO: 7413135 - DNA, 22 bp, Homo sapiens
agcaatcagcttctttgtgttt

SEQ ID NO: 7413136 - DNA, 22 bp, Homo sapiens
caaacattgctaccagaggttt

SEQ ID NO: 7413137 - DNA, 22 bp, Homo sapiens
agcaatatttcagctagcaggt

SEQ ID NO: 7413138 - DNA, 22 bp, Homo sapiens
agcaatcaaataaatgtcctgg

SEQ ID NO: 7413139 - DNA, 22 bp, Homo sapiens
agcaatcaccacctctatattt

SEQ ID NO: 7413140 - DNA, 22 bp, Homo sapiens
agcaatatttcagctagcaggt

SEQ ID NO: 7413141 - DNA, 22 bp, Homo sapiens
agcaataagggatcctctataa

SEQ ID NO: 7413142 - DNA, 22 bp, Homo sapiens
agcaatagacacaagatggata

SEQ ID NO: 7413143 - DNA, 22 bp, Homo sapiens
agcaatagacacaagatggata

SEQ ID NO: 7413144 - DNA, 22 bp, Homo sapiens
agcaataatttaggcctttcct

SEQ ID NO: 7413145 - DNA, 22 bp, Homo sapiens
agcaatagataaaacatttacc

SEQ ID NO: 7413146 - DNA, 22 bp, Homo sapiens
agcaatatgacattgctacatc

SEQ ID NO: 7413147 - DNA, 22 bp, Homo sapiens
agcaatataaatgttgggtaga

SEQ ID NO: 7413148 - DNA, 22 bp, Homo sapiens
agcaatatgacattgctacatc

SEQ ID NO: 7413149 - DNA, 22 bp, Homo sapiens
agcaatatgacattgctacatc

SEQ ID NO: 7413150 - DNA, 22 bp, Homo sapiens
caaacattgggggcttcaacac

SEQ ID NO: 7413151 - DNA, 22 bp, Homo sapiens
caaacattgggggcttcaacac

SEQ ID NO: 7413152 - DNA, 22 bp, Homo sapiens
caaacattgggggcttcaacac

SEQ ID NO: 7413153 - DNA, 22 bp, Homo sapiens
caaacattgggggcttcaacac

SEQ ID NO: 7413154 - DNA, 22 bp, Homo sapiens
caaacattgggggcttcaacac

SEQ ID NO: 7413155 - DNA, 22 bp, Homo sapiens
caaacattgggggcttcaacac

SEQ ID NO: 7413156 - DNA, 22 bp, Homo sapiens
caaacattgctaccagaggttt

SEQ ID NO: 7413157 - DNA, 22 bp, Homo sapiens
caaacattgctaccagaggttt

SEQ ID NO: 7413158 - DNA, 22 bp, Homo sapiens
caaacattgctaccagaggttt

SEQ ID NO: 7413159 - DNA, 22 bp, Homo sapiens
caaacattgctaccagaggttt

SEQ ID NO: 7413160 - DNA, 22 bp, Homo sapiens
caaacattgctaccagaggttt

SEQ ID NO: 7413161 - DNA, 22 bp, Homo sapiens
caaacattgctaccagaggttt

SEQ ID NO: 7413162 - DNA, 22 bp, Homo sapiens
caaacattgctaccagaggttt

SEQ ID NO: 7413163 - DNA, 22 bp, Homo sapiens
caaacatttgacttctctcagg

SEQ ID NO: 7413164 - DNA, 22 bp, Homo sapiens
caaacatttgacttctctcagg

SEQ ID NO: 7413165 - DNA, 22 bp, Homo sapiens
caaacatttgacttctctcagg

SEQ ID NO: 7413166 - DNA, 22 bp, Homo sapiens
caaacatttgacttctctcagg

SEQ ID NO: 7413167 - DNA, 22 bp, Homo sapiens
caaacatttaggaggagggagg

SEQ ID NO: 7413168 - DNA, 22 bp, Homo sapiens
caaacatttaggaggagggagg

SEQ ID NO: 7413169 - DNA, 22 bp, Homo sapiens
caaacatttaggaggagggagg

SEQ ID NO: 7413170 - DNA, 22 bp, Homo sapiens
caaacatttgacttctctcagg

SEQ ID NO: 7413171 - DNA, 22 bp, Homo sapiens
caaacatttgacttctctcagg

SEQ ID NO: 7413172 - DNA, 22 bp, Homo sapiens
caaacatttaggaggagggagg

SEQ ID NO: 7413173 - DNA, 22 bp, Homo sapiens
caaacatttgacttctctcagg

SEQ ID NO: 7413174 - DNA, 22 bp, Homo sapiens
caaacatttgacttctctcagg

SEQ ID NO: 7413175 - DNA, 23 bp, Homo sapiens
attttttgtctttgtaactagat

SEQ ID NO: 7413176 - DNA, 23 bp, Homo sapiens
attttttgtctttgtaactagat

SEQ ID NO: 7413177 - DNA, 23 bp, Homo sapiens
attttttgtctttgtaactagat

SEQ ID NO: 7413178 - DNA, 23 bp, Homo sapiens
attttttgtctttgtaactagat

SEQ ID NO: 7413179 - DNA, 22 bp, Homo sapiens
attttttgttaactcaggatag

SEQ ID NO: 7413180 - DNA, 22 bp, Homo sapiens
attttttgttaactcaggatag

SEQ ID NO: 7413181 - DNA, 23 bp, Homo sapiens
attttttgtctttgtaactagat

SEQ ID NO: 7413182 - DNA, 22 bp, Homo sapiens
attttttctgtaaactggcctt

SEQ ID NO: 7413183 - DNA, 22 bp, Homo sapiens
attttttctgtaaactggcctt

SEQ ID NO: 7413184 - DNA, 22 bp, Homo sapiens
attttttctgtaaactggcctt

SEQ ID NO: 7413185 - DNA, 22 bp, Homo sapiens
attttttcccagttagccagga

SEQ ID NO: 7413186 - DNA, 22 bp, Homo sapiens
attttttctgtaaactggcctt

SEQ ID NO: 7413187 - DNA, 22 bp, Homo sapiens
attttttctgtaaactggcctt

SEQ ID NO: 7413188 - DNA, 22 bp, Homo sapiens
attttttctgtaaactggcctt

SEQ ID NO: 7413189 - DNA, 22 bp, Homo sapiens
attttttctgtaaactggcctt

SEQ ID NO: 7413190 - DNA, 22 bp, Homo sapiens
attttttcccagttagccagga

SEQ ID NO: 7413191 - DNA, 22 bp, Homo sapiens
attttttcccagttagccagga

SEQ ID NO: 7413192 - DNA, 22 bp, Homo sapiens
attttttcccagttagccagga

SEQ ID NO: 7413193 - DNA, 22 bp, Homo sapiens
attttttcccagttagccagga

SEQ ID NO: 7413194 - DNA, 22 bp, Homo sapiens
attttttcccagttagccagga

SEQ ID NO: 7413195 - DNA, 22 bp, Homo sapiens
attttttcccagttagccagga

SEQ ID NO: 7413196 - DNA, 22 bp, Homo sapiens
agcaaggctaaatttcagttat

SEQ ID NO: 7413197 - DNA, 22 bp, Homo sapiens
agcaaggctcggtcagggtgat

SEQ ID NO: 7413198 - DNA, 22 bp, Homo sapiens
agcaaggctcggtcagggtgat

SEQ ID NO: 7413199 - DNA, 22 bp, Homo sapiens
agcaaggctcggtcagggtgat

SEQ ID NO: 7413200 - DNA, 22 bp, Homo sapiens
agcaaggctcggtcagggtgat

SEQ ID NO: 7413201 - DNA, 22 bp, Homo sapiens
agcaaggctcttaatgcccaaa

SEQ ID NO: 7413202 - DNA, 20 bp, Homo sapiens
agcaaggctaaatcatgatt

SEQ ID NO: 7413203 - DNA, 22 bp, Homo sapiens
agcaaggcctacagagaggggc

SEQ ID NO: 7413204 - DNA, 20 bp, Homo sapiens
agcaaggctaaatcatgatt

SEQ ID NO: 7413205 - DNA, 20 bp, Homo sapiens
agcaaggctaaatcatgatt

SEQ ID NO: 7413206 - DNA, 22 bp, Homo sapiens
agcaaggctaaatttcagttat

SEQ ID NO: 7413207 - DNA, 22 bp, Homo sapiens
agcaaggctaaatttcagttat

SEQ ID NO: 7413208 - DNA, 22 bp, Homo sapiens
agcaagatgcattatttcttat

SEQ ID NO: 7413209 - DNA, 20 bp, Homo sapiens
agcaagagtgtacctggcca

SEQ ID NO: 7413210 - DNA, 22 bp, Homo sapiens
agcaagatgaaggattcaagac

SEQ ID NO: 7413211 - DNA, 20 bp, Homo sapiens
agcaagagtgtacctggcca

SEQ ID NO: 7413212 - DNA, 22 bp, Homo sapiens
attttttgttaactcaggatag

SEQ ID NO: 7413213 - DNA, 22 bp, Homo sapiens
agcaataacagaaaactttcct

SEQ ID NO: 7413214 - DNA, 22 bp, Homo sapiens
agcaataaccactctaatttat

SEQ ID NO: 7413215 - DNA, 22 bp, Homo sapiens
agcaataacagaaaactttcct

SEQ ID NO: 7413216 - DNA, 22 bp, Homo sapiens
agcaataaccactctaatttat

SEQ ID NO: 7413217 - DNA, 23 bp, Homo sapiens
agcaataagaagggatacatgtg

SEQ ID NO: 7413218 - DNA, 23 bp, Homo sapiens
agcaataagaagggatacatgtg

SEQ ID NO: 7413219 - DNA, 23 bp, Homo sapiens
agcaataagaagggatacatgtg

SEQ ID NO: 7413220 - DNA, 23 bp, Homo sapiens
agcaataagaagggatacatgtg

SEQ ID NO: 7413221 - DNA, 23 bp, Homo sapiens
agcaataagaagggatacatgtg

SEQ ID NO: 7413222 - DNA, 23 bp, Homo sapiens
agcaataagaagggatacatgtg

SEQ ID NO: 7413223 - DNA, 22 bp, Homo sapiens
agcaataaccactctaatttat

SEQ ID NO: 7413224 - DNA, 22 bp, Homo sapiens
agcaataacagaaaactttcct

SEQ ID NO: 7413225 - DNA, 22 bp, Homo sapiens
agcaataaatgtaaaggttaag

SEQ ID NO: 7413226 - DNA, 22 bp, Homo sapiens
agcaataacagaaaactttcct

SEQ ID NO: 7413227 - DNA, 22 bp, Homo sapiens
agcaataacagaaaactttcct

SEQ ID NO: 7413228 - DNA, 22 bp, Homo sapiens
agcaataaatgtaaaggttaag

SEQ ID NO: 7413229 - DNA, 22 bp, Homo sapiens
agcaataaatgtaaaggttaag

SEQ ID NO: 7413230 - DNA, 22 bp, Homo sapiens
agcaataaatgtaaaggttaag

SEQ ID NO: 7413231 - DNA, 22 bp, Homo sapiens
agcaataaatgtaaaggttaag

SEQ ID NO: 7413232 - DNA, 22 bp, Homo sapiens
agcaataaatgtaaaggttaag

SEQ ID NO: 7413233 - DNA, 22 bp, Homo sapiens
agcaagtgtaagaatgcagaat

SEQ ID NO: 7413234 - DNA, 22 bp, Homo sapiens
agcaagtgtaagaatgcagaat

SEQ ID NO: 7413235 - DNA, 22 bp, Homo sapiens
agcaagtgtaagaatgcagaat

SEQ ID NO: 7413236 - DNA, 22 bp, Homo sapiens
agcaagtcacatgaccaagccc

SEQ ID NO: 7413237 - DNA, 22 bp, Homo sapiens
agcaagtagtaccaagtagctc

SEQ ID NO: 7413238 - DNA, 22 bp, Homo sapiens
agcaagtagtaccaagtagctc

SEQ ID NO: 7413239 - DNA, 22 bp, Homo sapiens
agcaaggctgggtctaatgggg

SEQ ID NO: 7413240 - DNA, 22 bp, Homo sapiens
agcaaggctcttaatgcccaaa

SEQ ID NO: 7413241 - DNA, 20 bp, Homo sapiens
agcaaggctggagcttatgg

SEQ ID NO: 7413242 - DNA, 20 bp, Homo sapiens
agcaaggctggagcttatgg

SEQ ID NO: 7413243 - DNA, 22 bp, Homo sapiens
agcaaggcttcagagctgtctg

SEQ ID NO: 7413244 - DNA, 22 bp, Homo sapiens
agcaaggcttcagagctgtctg

SEQ ID NO: 7413245 - DNA, 22 bp, Homo sapiens
agcaaggggcagtgaaagtgtg

SEQ ID NO: 7413246 - DNA, 22 bp, Homo sapiens
agcaaggggcagtgaaagtgtg

SEQ ID NO: 7413247 - DNA, 22 bp, Homo sapiens
agcaaggcttcagagctgtctg

SEQ ID NO: 7413248 - DNA, 22 bp, Homo sapiens
agcaaggcttcagagctgtctg

SEQ ID NO: 7413249 - DNA, 22 bp, Homo sapiens
agcaaggcttcagagctgtctg

SEQ ID NO: 7413250 - DNA, 17 bp, Homo sapiens
agcaaggcttaagtaaa

SEQ ID NO: 7413251 - DNA, 22 bp, Homo sapiens
agcaaggtggagaaggatgggt

SEQ ID NO: 7413252 - DNA, 22 bp, Homo sapiens
agcaaggtggagaaggatgggt

SEQ ID NO: 7413253 - DNA, 19 bp, Homo sapiens
agcaaggtgcctcctcccc

SEQ ID NO: 7413254 - DNA, 22 bp, Homo sapiens
agcaaggtgacatcatgctgag

SEQ ID NO: 7413255 - DNA, 19 bp, Homo sapiens
agcaaggtgcctcctcccc

SEQ ID NO: 7413256 - DNA, 22 bp, Homo sapiens
agcaaggggcagtgaaagtgtg

SEQ ID NO: 7413257 - DNA, 22 bp, Homo sapiens
agcaaggggcagtgaaagtgtg

SEQ ID NO: 7413258 - DNA, 22 bp, Homo sapiens
agcaaggggcagtgaaagtgtg

SEQ ID NO: 7413259 - DNA, 22 bp, Homo sapiens
agcaaggggcagtgaaagtgtg

SEQ ID NO: 7413260 - DNA, 22 bp, Homo sapiens
attttgtgaaccctcaagcaat

SEQ ID NO: 7413261 - DNA, 22 bp, Homo sapiens
attttgtgaaccctcaagcaat

SEQ ID NO: 7413262 - DNA, 22 bp, Homo sapiens
attttgtgaaccctcaagcaat

SEQ ID NO: 7413263 - DNA, 22 bp, Homo sapiens
attttgtgaaccctcaagcaat

SEQ ID NO: 7413264 - DNA, 22 bp, Homo sapiens
attttgtggcagatgcagaacc

SEQ ID NO: 7413265 - DNA, 22 bp, Homo sapiens
attttgtggcagatgcagaacc

SEQ ID NO: 7413266 - DNA, 22 bp, Homo sapiens
attttgtggcagatgcagaacc

SEQ ID NO: 7413267 - DNA, 22 bp, Homo sapiens
attttgttatagaactctgtga

SEQ ID NO: 7413268 - DNA, 22 bp, Homo sapiens
attttgttatagaactctgtga

SEQ ID NO: 7413269 - DNA, 22 bp, Homo sapiens
attttgttatagaactctgtga

SEQ ID NO: 7413270 - DNA, 22 bp, Homo sapiens
attttgttatagaactctgtga

SEQ ID NO: 7413271 - DNA, 22 bp, Homo sapiens
attttgttatagaactctgtga

SEQ ID NO: 7413272 - DNA, 22 bp, Homo sapiens
attttgttatagaactctgtga

SEQ ID NO: 7413273 - DNA, 22 bp, Homo sapiens
attttgttaatgtcaccgtgct

SEQ ID NO: 7413274 - DNA, 22 bp, Homo sapiens
attttgttaatgtcaccgtgct

SEQ ID NO: 7413275 - DNA, 22 bp, Homo sapiens
attttgtgggttctgctgatgt

SEQ ID NO: 7413276 - DNA, 22 bp, Homo sapiens
attttgtgggttctgctgatgt

SEQ ID NO: 7413277 - DNA, 22 bp, Homo sapiens
attttgtgggttctgctgatgt

SEQ ID NO: 7413278 - DNA, 22 bp, Homo sapiens
attttgtgggttctgctgatgt

SEQ ID NO: 7413279 - DNA, 22 bp, Homo sapiens
attttgtggcagatgcagaacc

SEQ ID NO: 7413280 - DNA, 22 bp, Homo sapiens
attttgttgaggtaattgtcaa

SEQ ID NO: 7413281 - DNA, 22 bp, Homo sapiens
attttgttgaggtaattgtcaa

SEQ ID NO: 7413282 - DNA, 22 bp, Homo sapiens
attttgttgaggtaattgtcaa

SEQ ID NO: 7413283 - DNA, 22 bp, Homo sapiens
attttgttgaggtaattgtcaa

SEQ ID NO: 7413284 - DNA, 22 bp, Homo sapiens
attttgttgaggtaattgtcaa

SEQ ID NO: 7413285 - DNA, 22 bp, Homo sapiens
attttgttgaggtaattgtcaa

SEQ ID NO: 7413286 - DNA, 22 bp, Homo sapiens
attttgttatcagggctttgca

SEQ ID NO: 7413287 - DNA, 22 bp, Homo sapiens
attttgttatcagggctttgca

SEQ ID NO: 7413288 - DNA, 22 bp, Homo sapiens
attttgttatcagggctttgca

SEQ ID NO: 7413289 - DNA, 22 bp, Homo sapiens
attttgttatcagggctttgca

SEQ ID NO: 7413290 - DNA, 22 bp, Homo sapiens
attttgttatcagggctttgca

SEQ ID NO: 7413291 - DNA, 22 bp, Homo sapiens
attttgttataggagctgaaat

SEQ ID NO: 7413292 - DNA, 22 bp, Homo sapiens
attttgttataggagctgaaat

SEQ ID NO: 7413293 - DNA, 22 bp, Homo sapiens
attttgttataggagctgaaat

SEQ ID NO: 7413294 - DNA, 22 bp, Homo sapiens
attttgttatagaactctgtga

SEQ ID NO: 7413295 - DNA, 22 bp, Homo sapiens
attttgttataggagctgaaat

SEQ ID NO: 7413296 - DNA, 22 bp, Homo sapiens
attttgttataggagctgaaat

SEQ ID NO: 7413297 - DNA, 22 bp, Homo sapiens
attttgttataggagctgaaat

SEQ ID NO: 7413298 - DNA, 22 bp, Homo sapiens
attttgttataggagctgaaat

SEQ ID NO: 7413299 - DNA, 22 bp, Homo sapiens
attttgttgatggtggagtagc

SEQ ID NO: 7413300 - DNA, 22 bp, Homo sapiens
attttgttgatggtggagtagc

SEQ ID NO: 7413301 - DNA, 22 bp, Homo sapiens
attttgttgatggtggagtagc

SEQ ID NO: 7413302 - DNA, 20 bp, Homo sapiens
attttgtttatgttcctctc

SEQ ID NO: 7413303 - DNA, 22 bp, Homo sapiens
attttgttgatggtggagtagc

SEQ ID NO: 7413304 - DNA, 20 bp, Homo sapiens
attttgtttatgttcctctc

SEQ ID NO: 7413305 - DNA, 20 bp, Homo sapiens
attttgtttatgttcctctc

SEQ ID NO: 7413306 - DNA, 20 bp, Homo sapiens
attttgtttatgttcctctc

SEQ ID NO: 7413307 - DNA, 22 bp, Homo sapiens
attttttagaacctggcctgat

SEQ ID NO: 7413308 - DNA, 22 bp, Homo sapiens
attttttagccaagactctgca

SEQ ID NO: 7413309 - DNA, 22 bp, Homo sapiens
attttttagccaagactctgca

SEQ ID NO: 7413310 - DNA, 22 bp, Homo sapiens
attttttagccaagactctgca

SEQ ID NO: 7413311 - DNA, 22 bp, Homo sapiens
attttttagccaagactctgca

SEQ ID NO: 7413312 - DNA, 22 bp, Homo sapiens
attttttagccaagactctgca

SEQ ID NO: 7413313 - DNA, 22 bp, Homo sapiens
attttttagccaagactctgca

SEQ ID NO: 7413314 - DNA, 22 bp, Homo sapiens
attttttagccaagactctgca

SEQ ID NO: 7413315 - DNA, 22 bp, Homo sapiens
attttttagccaagactctgca

SEQ ID NO: 7413316 - DNA, 22 bp, Homo sapiens
attttttatataccaaggtggg

SEQ ID NO: 7413317 - DNA, 22 bp, Homo sapiens
attttttatataccaaggtggg

SEQ ID NO: 7413318 - DNA, 22 bp, Homo sapiens
attttttatataccaaggtggg

SEQ ID NO: 7413319 - DNA, 22 bp, Homo sapiens
attttttatataccaaggtggg

SEQ ID NO: 7413320 - DNA, 22 bp, Homo sapiens
attttttatataccaaggtggg

SEQ ID NO: 7413321 - DNA, 22 bp, Homo sapiens
attttttagccaagactctgca

SEQ ID NO: 7413322 - DNA, 22 bp, Homo sapiens
attttttatataccaaggtggg

SEQ ID NO: 7413323 - DNA, 22 bp, Homo sapiens
attttttatataccaaggtggg

SEQ ID NO: 7413324 - DNA, 22 bp, Homo sapiens
attttttatataccaaggtggg

SEQ ID NO: 7413325 - DNA, 22 bp, Homo sapiens
attttttcagattgagtgttaa

SEQ ID NO: 7413326 - DNA, 22 bp, Homo sapiens
attttttcagattgagtgttaa

SEQ ID NO: 7413327 - DNA, 22 bp, Homo sapiens
attttttcagattgagtgttaa

SEQ ID NO: 7413328 - DNA, 22 bp, Homo sapiens
attttttatataccaaggtggg

SEQ ID NO: 7413329 - DNA, 22 bp, Homo sapiens
attttttatataccaaggtggg

SEQ ID NO: 7413330 - DNA, 22 bp, Homo sapiens
attttttcagattgagtgttaa

SEQ ID NO: 7413331 - DNA, 22 bp, Homo sapiens
attttttcagattgagtgttaa

SEQ ID NO: 7413332 - DNA, 22 bp, Homo sapiens
attttttcagattgagtgttaa

SEQ ID NO: 7413333 - DNA, 22 bp, Homo sapiens
attttttcagattgagtgttaa

SEQ ID NO: 7413334 - DNA, 22 bp, Homo sapiens
attttttcagattgagtgttaa

SEQ ID NO: 7413335 - DNA, 21 bp, Homo sapiens
agatgaggatactgaggccta

SEQ ID NO: 7413336 - DNA, 21 bp, Homo sapiens
agatgaggatactgaggccta

SEQ ID NO: 7413337 - DNA, 22 bp, Homo sapiens
agatgagaatttttagagtgct

SEQ ID NO: 7413338 - DNA, 21 bp, Homo sapiens
agatgaggatactgaggccta

SEQ ID NO: 7413339 - DNA, 21 bp, Homo sapiens
agatgaggatactgaggccta

SEQ ID NO: 7413340 - DNA, 21 bp, Homo sapiens
agatgaggatactgaggccta

SEQ ID NO: 7413341 - DNA, 22 bp, Homo sapiens
agatgaggggtagaaaggactt

SEQ ID NO: 7413342 - DNA, 22 bp, Homo sapiens
agatgaggggtagaaaggactt

SEQ ID NO: 7413343 - DNA, 22 bp, Homo sapiens
agatgagtaaatggagtcttcc

SEQ ID NO: 7413344 - DNA, 22 bp, Homo sapiens
agatgaggggtagaaaggactt

SEQ ID NO: 7413345 - DNA, 23 bp, Homo sapiens
agatgaggcttctccatgttggt

SEQ ID NO: 7413346 - DNA, 23 bp, Homo sapiens
agatgaggcttctccatgttggt

SEQ ID NO: 7413347 - DNA, 23 bp, Homo sapiens
agatgaggcttctccatgttggt

SEQ ID NO: 7413348 - DNA, 22 bp, Homo sapiens
agatgacaatgaggttgttatt

SEQ ID NO: 7413349 - DNA, 22 bp, Homo sapiens
agatgacacacacgcacccgga

SEQ ID NO: 7413350 - DNA, 22 bp, Homo sapiens
agatgacagctacgggatgaaa

SEQ ID NO: 7413351 - DNA, 22 bp, Homo sapiens
agatgacacaccatttttactt

SEQ ID NO: 7413352 - DNA, 22 bp, Homo sapiens
agatgacagccaaggagatgaa

SEQ ID NO: 7413353 - DNA, 22 bp, Homo sapiens
agatgacagccaaggagatgaa

SEQ ID NO: 7413354 - DNA, 22 bp, Homo sapiens
agatgacatgggagcaagcact

SEQ ID NO: 7413355 - DNA, 22 bp, Homo sapiens
agatgacatgggagcaagcact

SEQ ID NO: 7413356 - DNA, 22 bp, Homo sapiens
agatgacaggtttttttggctt

SEQ ID NO: 7413357 - DNA, 22 bp, Homo sapiens
agatgacatggttcaagtttcc

SEQ ID NO: 7413358 - DNA, 22 bp, Homo sapiens
agatgacatggttcaagtttcc

SEQ ID NO: 7413359 - DNA, 22 bp, Homo sapiens
agatgactaacatagtattgct

SEQ ID NO: 7413360 - DNA, 22 bp, Homo sapiens
atttgaaatctgggttactctg

SEQ ID NO: 7413361 - DNA, 22 bp, Homo sapiens
atttgaaatctgggttactctg

SEQ ID NO: 7413362 - DNA, 22 bp, Homo sapiens
atttgaaatcccttctactgta

SEQ ID NO: 7413363 - DNA, 22 bp, Homo sapiens
atttgaaatctgggttactctg

SEQ ID NO: 7413364 - DNA, 22 bp, Homo sapiens
atttgaaatcccttctactgta

SEQ ID NO: 7413365 - DNA, 22 bp, Homo sapiens
atttgaaatcccttctactgta

SEQ ID NO: 7413366 - DNA, 22 bp, Homo sapiens
atttgaaatcccttctactgta

SEQ ID NO: 7413367 - DNA, 22 bp, Homo sapiens
atttgaaatcccttctactgta

SEQ ID NO: 7413368 - DNA, 19 bp, Homo sapiens
atttgaaagctgtgcttgc

SEQ ID NO: 7413369 - DNA, 19 bp, Homo sapiens
atttgaaagctgtgcttgc

SEQ ID NO: 7413370 - DNA, 19 bp, Homo sapiens
atttgaaagctgtgcttgc

SEQ ID NO: 7413371 - DNA, 19 bp, Homo sapiens
atttgaaagctgtgcttgc

SEQ ID NO: 7413372 - DNA, 19 bp, Homo sapiens
atttgaaagctgtgcttgc

SEQ ID NO: 7413373 - DNA, 19 bp, Homo sapiens
atttgaaagctgtgcttgc

SEQ ID NO: 7413374 - DNA, 22 bp, Homo sapiens
atttgaagtcttcatgatttct

SEQ ID NO: 7413375 - DNA, 22 bp, Homo sapiens
atttgaatgcaggtagctgagt

SEQ ID NO: 7413376 - DNA, 22 bp, Homo sapiens
atttgaatgcaggtagctgagt

SEQ ID NO: 7413377 - DNA, 22 bp, Homo sapiens
atttgaagtcttcatgatttct

SEQ ID NO: 7413378 - DNA, 22 bp, Homo sapiens
atttgaagtaagtaatgagtat

SEQ ID NO: 7413379 - DNA, 22 bp, Homo sapiens
atttgaagtaagtaatgagtat

SEQ ID NO: 7413380 - DNA, 22 bp, Homo sapiens
atttgaagaaagttttctagat

SEQ ID NO: 7413381 - DNA, 22 bp, Homo sapiens
atttgaagaaagttttctagat

SEQ ID NO: 7413382 - DNA, 22 bp, Homo sapiens
atttgaaccactcagaactcat

SEQ ID NO: 7413383 - DNA, 22 bp, Homo sapiens
atttgaagaaagttttctagat

SEQ ID NO: 7413384 - DNA, 22 bp, Homo sapiens
atttgacaacttctggtggcat

SEQ ID NO: 7413385 - DNA, 22 bp, Homo sapiens
agatgacaagagcttgctgcag

SEQ ID NO: 7413386 - DNA, 22 bp, Homo sapiens
agatgacaagagcttgctgcag

SEQ ID NO: 7413387 - DNA, 22 bp, Homo sapiens
agatgacaatgaaggaaaatgt

SEQ ID NO: 7413388 - DNA, 22 bp, Homo sapiens
agatgacaatgaaggaaaatgt

SEQ ID NO: 7413389 - DNA, 22 bp, Homo sapiens
atttgaatggcttaacacaacg

SEQ ID NO: 7413390 - DNA, 22 bp, Homo sapiens
atttgaatggcttaacacaacg

SEQ ID NO: 7413391 - DNA, 22 bp, Homo sapiens
atttgaatggcttaacacaacg

SEQ ID NO: 7413392 - DNA, 22 bp, Homo sapiens
atttgaatggcttaacacaacg

SEQ ID NO: 7413393 - DNA, 22 bp, Homo sapiens
atttgaatggcttaacacaacg

SEQ ID NO: 7413394 - DNA, 22 bp, Homo sapiens
atttgaatgcaggtagctgagt

SEQ ID NO: 7413395 - DNA, 22 bp, Homo sapiens
atttctttctggccacggtttt

SEQ ID NO: 7413396 - DNA, 22 bp, Homo sapiens
atttctttctggccacggtttt

SEQ ID NO: 7413397 - DNA, 22 bp, Homo sapiens
atttctttctggccacggtttt

SEQ ID NO: 7413398 - DNA, 22 bp, Homo sapiens
atttcttttcaagagggtgctt

SEQ ID NO: 7413399 - DNA, 22 bp, Homo sapiens
atttcttttcaagagggtgctt

SEQ ID NO: 7413400 - DNA, 22 bp, Homo sapiens
atttcttttcaagagggtgctt

SEQ ID NO: 7413401 - DNA, 22 bp, Homo sapiens
atttcttttcaagagggtgctt

SEQ ID NO: 7413402 - DNA, 22 bp, Homo sapiens
atttcttttcaagagggtgctt

SEQ ID NO: 7413403 - DNA, 22 bp, Homo sapiens
atttcttttcaagagggtgctt

SEQ ID NO: 7413404 - DNA, 23 bp, Homo sapiens
atttgaaactttcttgtttccag

SEQ ID NO: 7413405 - DNA, 23 bp, Homo sapiens
atttgaaactttcttgtttccag

SEQ ID NO: 7413406 - DNA, 23 bp, Homo sapiens
atttgaaactttcttgtttccag

SEQ ID NO: 7413407 - DNA, 22 bp, Homo sapiens
atttcttttcaagagggtgctt

SEQ ID NO: 7413408 - DNA, 22 bp, Homo sapiens
atttcttttcaagagggtgctt

SEQ ID NO: 7413409 - DNA, 22 bp, Homo sapiens
atttgaaaacctgagcctcccg

SEQ ID NO: 7413410 - DNA, 22 bp, Homo sapiens
atttgaaaacctgagcctcccg

SEQ ID NO: 7413411 - DNA, 22 bp, Homo sapiens
atttctgataaacgtaagctgc

SEQ ID NO: 7413412 - DNA, 22 bp, Homo sapiens
atttctgataaacgtaagctgc

SEQ ID NO: 7413413 - DNA, 22 bp, Homo sapiens
atttcttgcccctgctccctga

SEQ ID NO: 7413414 - DNA, 22 bp, Homo sapiens
atttctgataaacgtaagctgc

SEQ ID NO: 7413415 - DNA, 22 bp, Homo sapiens
atttctcttcctcctagggttg

SEQ ID NO: 7413416 - DNA, 22 bp, Homo sapiens
atttctcttcctcctagggttg

SEQ ID NO: 7413417 - DNA, 22 bp, Homo sapiens
atttctcttcctcctagggttg

SEQ ID NO: 7413418 - DNA, 22 bp, Homo sapiens
atttctttctggccacggtttt

SEQ ID NO: 7413419 - DNA, 22 bp, Homo sapiens
atttctttctggccacggtttt

SEQ ID NO: 7413420 - DNA, 22 bp, Homo sapiens
atttctttctggccacggtttt

SEQ ID NO: 7413421 - DNA, 22 bp, Homo sapiens
atttcttgcccctgctccctga

SEQ ID NO: 7413422 - DNA, 23 bp, Homo sapiens
atttacaggttaaatgaaatcag

SEQ ID NO: 7413423 - DNA, 22 bp, Homo sapiens
atttacaggtagaattttaagt

SEQ ID NO: 7413424 - DNA, 22 bp, Homo sapiens
atttacaggtagaattttaagt

SEQ ID NO: 7413425 - DNA, 22 bp, Homo sapiens
atttacaggtagaattttaagt

SEQ ID NO: 7413426 - DNA, 22 bp, Homo sapiens
atttacaggtagaattttaagt

SEQ ID NO: 7413427 - DNA, 22 bp, Homo sapiens
atttacaggtagaattttaagt

SEQ ID NO: 7413428 - DNA, 22 bp, Homo sapiens
atttacagccttgaaaacagca

SEQ ID NO: 7413429 - DNA, 22 bp, Homo sapiens
atttacagccttgaaaacagca

SEQ ID NO: 7413430 - DNA, 22 bp, Homo sapiens
atttacagccttgccatctata

SEQ ID NO: 7413431 - DNA, 22 bp, Homo sapiens
atttacagccttgaaaacagca

SEQ ID NO: 7413432 - DNA, 22 bp, Homo sapiens
atttacagccttgccatctata

SEQ ID NO: 7413433 - DNA, 22 bp, Homo sapiens
atttacagccttgccatctata

SEQ ID NO: 7413434 - DNA, 22 bp, Homo sapiens
atttacagccttgccatctata

SEQ ID NO: 7413435 - DNA, 23 bp, Homo sapiens
atttacagctgtgtgagcaagtt

SEQ ID NO: 7413436 - DNA, 22 bp, Homo sapiens
atttacagatgatgctatttga

SEQ ID NO: 7413437 - DNA, 22 bp, Homo sapiens
atttacagccttgaaaacagca

SEQ ID NO: 7413438 - DNA, 22 bp, Homo sapiens
atttacagatgatgctatttga

SEQ ID NO: 7413439 - DNA, 22 bp, Homo sapiens
atttacagccttgaaaacagca

SEQ ID NO: 7413440 - DNA, 22 bp, Homo sapiens
atttacagccttgaaaacagca

SEQ ID NO: 7413441 - DNA, 22 bp, Homo sapiens
atttacagccttgaaaacagca

SEQ ID NO: 7413442 - DNA, 23 bp, Homo sapiens
atttacagctgtgtgagcaagtt

SEQ ID NO: 7413443 - DNA, 23 bp, Homo sapiens
atttacagctgtgtgagcaagtt

SEQ ID NO: 7413444 - DNA, 23 bp, Homo sapiens
atttacagctgtgtgagcaagtt

SEQ ID NO: 7413445 - DNA, 22 bp, Homo sapiens
atttacaggacagcttggcatt

SEQ ID NO: 7413446 - DNA, 22 bp, Homo sapiens
atttacaggacagcttggcatt

SEQ ID NO: 7413447 - DNA, 22 bp, Homo sapiens
atttacaggacagcttggcatt

SEQ ID NO: 7413448 - DNA, 22 bp, Homo sapiens
atttacaggacagcttggcatt

SEQ ID NO: 7413449 - DNA, 22 bp, Homo sapiens
atttacaggtagaattttaagt

SEQ ID NO: 7413450 - DNA, 22 bp, Homo sapiens
atttacaggtagaattttaagt

SEQ ID NO: 7413451 - DNA, 22 bp, Homo sapiens
atttacaggtagaattttaagt

SEQ ID NO: 7413452 - DNA, 22 bp, Homo sapiens
atttacaggacagcttggcatt

SEQ ID NO: 7413453 - DNA, 22 bp, Homo sapiens
atttacaggacagcttggcatt

SEQ ID NO: 7413454 - DNA, 22 bp, Homo sapiens
atttacaggacagcttggcatt

SEQ ID NO: 7413455 - DNA, 22 bp, Homo sapiens
atttacaggacagcttggcatt

SEQ ID NO: 7413456 - DNA, 22 bp, Homo sapiens
agatgatcccaagaagatgctg

SEQ ID NO: 7413457 - DNA, 22 bp, Homo sapiens
agatgatgaccatgggaatgga

SEQ ID NO: 7413458 - DNA, 22 bp, Homo sapiens
agatgatcccaagaagatgctg

SEQ ID NO: 7413459 - DNA, 22 bp, Homo sapiens
agatgatggccatgtcctctcc

SEQ ID NO: 7413460 - DNA, 22 bp, Homo sapiens
agatgagtaggtagcattagta

SEQ ID NO: 7413461 - DNA, 22 bp, Homo sapiens
agatgtttgtgcagtggcatgc

SEQ ID NO: 7413462 - DNA, 22 bp, Homo sapiens
agatgtttgtgttatctccatt

SEQ ID NO: 7413463 - DNA, 22 bp, Homo sapiens
agatgtttcagtaatttatctt

SEQ ID NO: 7413464 - DNA, 21 bp, Homo sapiens
agatgtttcccccttggcttc

SEQ ID NO: 7413465 - DNA, 22 bp, Homo sapiens
agatgtttgtaaacacactgct

SEQ ID NO: 7413466 - DNA, 22 bp, Homo sapiens
agatgtttgtaaacacactgct

SEQ ID NO: 7413467 - DNA, 22 bp, Homo sapiens
agatgtttcagtaatttatctt

SEQ ID NO: 7413468 - DNA, 22 bp, Homo sapiens
agatgtttcagtaatttatctt

SEQ ID NO: 7413469 - DNA, 22 bp, Homo sapiens
agatgtttcagtaatttatctt

SEQ ID NO: 7413470 - DNA, 22 bp, Homo sapiens
agatgatggccatgtcctctcc

SEQ ID NO: 7413471 - DNA, 22 bp, Homo sapiens
agatgatgttggagtctgtgct

SEQ ID NO: 7413472 - DNA, 22 bp, Homo sapiens
agatgatggccatgtcctctcc

SEQ ID NO: 7413473 - DNA, 22 bp, Homo sapiens
agatgatggccatgtcctctcc

SEQ ID NO: 7413474 - DNA, 22 bp, Homo sapiens
agattcagttaaggctggtaga

SEQ ID NO: 7413475 - DNA, 22 bp, Homo sapiens
agattcagttaaggctggtaga

SEQ ID NO: 7413476 - DNA, 21 bp, Homo sapiens
agattcataatctgtaaaatg

SEQ ID NO: 7413477 - DNA, 22 bp, Homo sapiens
agattcatgggaaagctttagg

SEQ ID NO: 7413478 - DNA, 22 bp, Homo sapiens
agattcatgggaaagctttagg

SEQ ID NO: 7413479 - DNA, 22 bp, Homo sapiens
agatgtttgtgttatctccatt

SEQ ID NO: 7413480 - DNA, 22 bp, Homo sapiens
agatgtttgtgttatctccatt

SEQ ID NO: 7413481 - DNA, 22 bp, Homo sapiens
agattcaggactggccacagcc

SEQ ID NO: 7413482 - DNA, 22 bp, Homo sapiens
agattcaggactggccacagcc

SEQ ID NO: 7413483 - DNA, 22 bp, Homo sapiens
agattcaggactggccacagcc

SEQ ID NO: 7413484 - DNA, 22 bp, Homo sapiens
agattcaggcatgtcttcattt

SEQ ID NO: 7413485 - DNA, 22 bp, Homo sapiens
agattcaggcatgtcttcattt

SEQ ID NO: 7413486 - DNA, 22 bp, Homo sapiens
agattcattgctttaggcattg

SEQ ID NO: 7413487 - DNA, 22 bp, Homo sapiens
agattcattgctttaggcattg

SEQ ID NO: 7413488 - DNA, 22 bp, Homo sapiens
agattcattgtggatattttct

SEQ ID NO: 7413489 - DNA, 22 bp, Homo sapiens
agattccagatcccaaaaatga

SEQ ID NO: 7413490 - DNA, 22 bp, Homo sapiens
agattcattattaatgtgatct

SEQ ID NO: 7413491 - DNA, 22 bp, Homo sapiens
agattcattatcttctttgtac

SEQ ID NO: 7413492 - DNA, 22 bp, Homo sapiens
agattcattatcttctttgtac

SEQ ID NO: 7413493 - DNA, 22 bp, Homo sapiens
agattcattatcttctttgtac

SEQ ID NO: 7413494 - DNA, 22 bp, Homo sapiens
agattcattaggagacattcag

SEQ ID NO: 7413495 - DNA, 22 bp, Homo sapiens
agattcattaggagacattcag

SEQ ID NO: 7413496 - DNA, 22 bp, Homo sapiens
agattcattaggagacattcag

SEQ ID NO: 7413497 - DNA, 22 bp, Homo sapiens
agattcatgggtctaaccagtg

SEQ ID NO: 7413498 - DNA, 22 bp, Homo sapiens
agattcatgggaaagctttagg

SEQ ID NO: 7413499 - DNA, 22 bp, Homo sapiens
agattgtagaaactgtagcatt

SEQ ID NO: 7413500 - DNA, 22 bp, Homo sapiens
agattggttgaactgatttgca

SEQ ID NO: 7413501 - DNA, 19 bp, Homo sapiens
agattggttccttttgagg

SEQ ID NO: 7413502 - DNA, 22 bp, Homo sapiens
agattggttccttgctttgaaa

SEQ ID NO: 7413503 - DNA, 22 bp, Homo sapiens
agattggtgttgcagaaccatg

SEQ ID NO: 7413504 - DNA, 22 bp, Homo sapiens
agattgggctctatggtgccac

SEQ ID NO: 7413505 - DNA, 22 bp, Homo sapiens
agattggggtccagactcctga

SEQ ID NO: 7413506 - DNA, 22 bp, Homo sapiens
agattggggtccagactcctga

SEQ ID NO: 7413507 - DNA, 22 bp, Homo sapiens
agattgggtttgcttctgtgcc

SEQ ID NO: 7413508 - DNA, 20 bp, Homo sapiens
agattggatgttaagactgg

SEQ ID NO: 7413509 - DNA, 22 bp, Homo sapiens
agattgggctccagttaaaacg

SEQ ID NO: 7413510 - DNA, 22 bp, Homo sapiens
agattggagatggaagaaaagt

SEQ ID NO: 7413511 - DNA, 22 bp, Homo sapiens
agattgcattgacttgatacga

SEQ ID NO: 7413512 - DNA, 22 bp, Homo sapiens
agattgacaaaacagaagattt

SEQ ID NO: 7413513 - DNA, 22 bp, Homo sapiens
agattgcaaaatgggtgattta

SEQ ID NO: 7413514 - DNA, 22 bp, Homo sapiens
agattgcaattccttacatgca

SEQ ID NO: 7413515 - DNA, 22 bp, Homo sapiens
agattccaggcctggggccaag

SEQ ID NO: 7413516 - DNA, 22 bp, Homo sapiens
agattccagatcccaaaaatga

SEQ ID NO: 7413517 - DNA, 22 bp, Homo sapiens
agattccaggcctggggccaag

SEQ ID NO: 7413518 - DNA, 22 bp, Homo sapiens
agattcctagtgttatttctgt

SEQ ID NO: 7413519 - DNA, 22 bp, Homo sapiens
agattccagggggacattggag

SEQ ID NO: 7413520 - DNA, 22 bp, Homo sapiens
agattccagggggacattggag

SEQ ID NO: 7413521 - DNA, 22 bp, Homo sapiens
agattcctaaagtaagatatca

SEQ ID NO: 7413522 - DNA, 22 bp, Homo sapiens
agattcctaaagtaagatatca

SEQ ID NO: 7413523 - DNA, 22 bp, Homo sapiens
agattcctgaaactgccattgg

SEQ ID NO: 7413524 - DNA, 22 bp, Homo sapiens
agattcctgaaactgccattgg

SEQ ID NO: 7413525 - DNA, 22 bp, Homo sapiens
agattccttgagcaggttacaa

SEQ ID NO: 7413526 - DNA, 22 bp, Homo sapiens
agattctcggtccgggcagccc

SEQ ID NO: 7413527 - DNA, 22 bp, Homo sapiens
agattctccaaatgcacttcta

SEQ ID NO: 7413528 - DNA, 22 bp, Homo sapiens
agattctcggtccgggcagccc

SEQ ID NO: 7413529 - DNA, 22 bp, Homo sapiens
agattctcaacaaagagtagca

SEQ ID NO: 7413530 - DNA, 22 bp, Homo sapiens
agattctcaacaaagagtagca

SEQ ID NO: 7413531 - DNA, 22 bp, Homo sapiens
agattctaccagagctagtttg

SEQ ID NO: 7413532 - DNA, 22 bp, Homo sapiens
agattcgaaacctttaggtctt

SEQ ID NO: 7413533 - DNA, 22 bp, Homo sapiens
agattctaaacttgattctgct

SEQ ID NO: 7413534 - DNA, 22 bp, Homo sapiens
agatttaaatttgctacaattc

SEQ ID NO: 7413535 - DNA, 23 bp, Homo sapiens
agatttaatgttatattctgggc

SEQ ID NO: 7413536 - DNA, 22 bp, Homo sapiens
agatttaaatttgctacaattc

SEQ ID NO: 7413537 - DNA, 22 bp, Homo sapiens
agatttaaatttgctacaattc

SEQ ID NO: 7413538 - DNA, 22 bp, Homo sapiens
agatttaaatttgctacaattc

SEQ ID NO: 7413539 - DNA, 22 bp, Homo sapiens
agatttaaagcagtattcgcaa

SEQ ID NO: 7413540 - DNA, 22 bp, Homo sapiens
agatttaaatttgctacaattc

SEQ ID NO: 7413541 - DNA, 22 bp, Homo sapiens
agatttaaatttgctacaattc

SEQ ID NO: 7413542 - DNA, 23 bp, Homo sapiens
agattgttattcccagttcatgt

SEQ ID NO: 7413543 - DNA, 23 bp, Homo sapiens
agattgttattcccagttcatgt

SEQ ID NO: 7413544 - DNA, 22 bp, Homo sapiens
agattgtatcctcggagacttc

SEQ ID NO: 7413545 - DNA, 21 bp, Homo sapiens
agattgtatggaggtgagagg

SEQ ID NO: 7413546 - DNA, 22 bp, Homo sapiens
agattgtagaaactgtagcatt

SEQ ID NO: 7413547 - DNA, 22 bp, Homo sapiens
agattgtagaaactgtagcatt

SEQ ID NO: 7413548 - DNA, 22 bp, Homo sapiens
agattgtctctttttcagaaga

SEQ ID NO: 7413549 - DNA, 22 bp, Homo sapiens
agattgtcattgacgatgagca

SEQ ID NO: 7413550 - DNA, 22 bp, Homo sapiens
agatttacaaaggatttgcttt

SEQ ID NO: 7413551 - DNA, 19 bp, Homo sapiens
agatttacctcatatagtt

SEQ ID NO: 7413552 - DNA, 22 bp, Homo sapiens
agatttacaaaggatttgcttt

SEQ ID NO: 7413553 - DNA, 22 bp, Homo sapiens
agatttacaaaggatttgcttt

SEQ ID NO: 7413554 - DNA, 22 bp, Homo sapiens
agatttacaaaggatttgcttt

SEQ ID NO: 7413555 - DNA, 19 bp, Homo sapiens
agatttacctcatatagtt

SEQ ID NO: 7413556 - DNA, 19 bp, Homo sapiens
agatttacctcatatagtt

SEQ ID NO: 7413557 - DNA, 20 bp, Homo sapiens
agatttacctttgagccttc

SEQ ID NO: 7413558 - DNA, 22 bp, Homo sapiens
agatttactcagctcctggaaa

SEQ ID NO: 7413559 - DNA, 22 bp, Homo sapiens
agatttactccctgcttccgcc

SEQ ID NO: 7413560 - DNA, 22 bp, Homo sapiens
agatttatgtggtcacactcag

SEQ ID NO: 7413561 - DNA, 22 bp, Homo sapiens
agatttatgtggtcacactcag

SEQ ID NO: 7413562 - DNA, 22 bp, Homo sapiens
agatttagtggtggaattttgg

SEQ ID NO: 7413563 - DNA, 22 bp, Homo sapiens
agatttagctgtgaacagcttg

SEQ ID NO: 7413564 - DNA, 22 bp, Homo sapiens
agatttagctgtgaacagcttg

SEQ ID NO: 7413565 - DNA, 22 bp, Homo sapiens
agatttagactgccttaatcat

SEQ ID NO: 7413566 - DNA, 22 bp, Homo sapiens
agatttagactgccttaatcat

SEQ ID NO: 7413567 - DNA, 22 bp, Homo sapiens
agatttagcaaatcttactagc

SEQ ID NO: 7413568 - DNA, 22 bp, Homo sapiens
agatttactgagaactgattac

SEQ ID NO: 7413569 - DNA, 22 bp, Homo sapiens
agatttactggagtctttggtg

SEQ ID NO: 7413570 - DNA, 22 bp, Homo sapiens
attttggcaacagccatgagcc

SEQ ID NO: 7413571 - DNA, 22 bp, Homo sapiens
attttctgtgtgcagataaata

SEQ ID NO: 7413572 - DNA, 22 bp, Homo sapiens
attttctgtgtgcagataaata

SEQ ID NO: 7413573 - DNA, 22 bp, Homo sapiens
attttctgtgtgcagataaata

SEQ ID NO: 7413574 - DNA, 22 bp, Homo sapiens
agatttcaatgtgagcattagt

SEQ ID NO: 7413575 - DNA, 22 bp, Homo sapiens
attttctgtaactatttctata

SEQ ID NO: 7413576 - DNA, 21 bp, Homo sapiens
attttctgtgatagctgtctc

SEQ ID NO: 7413577 - DNA, 21 bp, Homo sapiens
attttgtacatagaatttgtc

SEQ ID NO: 7413578 - DNA, 21 bp, Homo sapiens
attttgtacatagaatttgtc

SEQ ID NO: 7413579 - DNA, 20 bp, Homo sapiens
attttggtgaacacagcttc

SEQ ID NO: 7413580 - DNA, 22 bp, Homo sapiens
attttggtggtatattaggatt

SEQ ID NO: 7413581 - DNA, 22 bp, Homo sapiens
attttggtggtatattaggatt

SEQ ID NO: 7413582 - DNA, 21 bp, Homo sapiens
attttgtacatagaatttgtc

SEQ ID NO: 7413583 - DNA, 22 bp, Homo sapiens
attttggtggtatattaggatt

SEQ ID NO: 7413584 - DNA, 21 bp, Homo sapiens
attttgtacatagaatttgtc

SEQ ID NO: 7413585 - DNA, 22 bp, Homo sapiens
attttggctgttgggaattatt

SEQ ID NO: 7413586 - DNA, 22 bp, Homo sapiens
attttggctgttgggaattatt

SEQ ID NO: 7413587 - DNA, 22 bp, Homo sapiens
attttggcaacagccatgagcc

SEQ ID NO: 7413588 - DNA, 22 bp, Homo sapiens
attttggctgtcagggtattat

SEQ ID NO: 7413589 - DNA, 20 bp, Homo sapiens
attttggtgaacacagcttc

SEQ ID NO: 7413590 - DNA, 20 bp, Homo sapiens
attttggtgaacacagcttc

SEQ ID NO: 7413591 - DNA, 22 bp, Homo sapiens
agatttatgtggtcacactcag

SEQ ID NO: 7413592 - DNA, 22 bp, Homo sapiens
agatttatgtggtcacactcag

SEQ ID NO: 7413593 - DNA, 22 bp, Homo sapiens
agatttatgtggtcacactcag

SEQ ID NO: 7413594 - DNA, 22 bp, Homo sapiens
agatttatgtggtcacactcag

SEQ ID NO: 7413595 - DNA, 22 bp, Homo sapiens
agatttatgtggtcacactcag

SEQ ID NO: 7413596 - DNA, 22 bp, Homo sapiens
agatttatgtggtcacactcag

SEQ ID NO: 7413597 - DNA, 22 bp, Homo sapiens
agatttatgtggtcacactcag

SEQ ID NO: 7413598 - DNA, 22 bp, Homo sapiens
agatttatgtggtcacactcag

SEQ ID NO: 7413599 - DNA, 22 bp, Homo sapiens
agatttatgtggtcacactcag

SEQ ID NO: 7413600 - DNA, 22 bp, Homo sapiens
agatttatgtggtcacactcag

SEQ ID NO: 7413601 - DNA, 22 bp, Homo sapiens
agatttatgtggtcacactcag

SEQ ID NO: 7413602 - DNA, 22 bp, Homo sapiens
agatttatgtggtcacactcag

SEQ ID NO: 7413603 - DNA, 22 bp, Homo sapiens
agatttatgtggtcacactcag

SEQ ID NO: 7413604 - DNA, 22 bp, Homo sapiens
agatttcaatgtgagcattagt

SEQ ID NO: 7413605 - DNA, 22 bp, Homo sapiens
agatttcaatggatattgcaag

SEQ ID NO: 7413606 - DNA, 22 bp, Homo sapiens
agatttatgtggtcacactcag

SEQ ID NO: 7413607 - DNA, 22 bp, Homo sapiens
agatttatgtggtcacactcag

SEQ ID NO: 7413608 - DNA, 22 bp, Homo sapiens
agatttatgtggtcacactcag

SEQ ID NO: 7413609 - DNA, 22 bp, Homo sapiens
attcgacaaccttgttttgtac

SEQ ID NO: 7413610 - DNA, 22 bp, Homo sapiens
attcctttggactcctccttgc

SEQ ID NO: 7413611 - DNA, 22 bp, Homo sapiens
attcctttggactcctccttgc

SEQ ID NO: 7413612 - DNA, 22 bp, Homo sapiens
attcccatctctgagtggaagg

SEQ ID NO: 7413613 - DNA, 22 bp, Homo sapiens
attcccatgtctttacctgttg

SEQ ID NO: 7413614 - DNA, 22 bp, Homo sapiens
attcccatgtctttacctgttg

SEQ ID NO: 7413615 - DNA, 22 bp, Homo sapiens
attcccatttgtgtggtctgga

SEQ ID NO: 7413616 - DNA, 22 bp, Homo sapiens
attcccaggtaaaagtagagct

SEQ ID NO: 7413617 - DNA, 22 bp, Homo sapiens
attcccaggtaaaagtagagct

SEQ ID NO: 7413618 - DNA, 22 bp, Homo sapiens
attcccataggcaatgcgtgat

SEQ ID NO: 7413619 - DNA, 22 bp, Homo sapiens
attcccatatatgtttgtcgct

SEQ ID NO: 7413620 - DNA, 22 bp, Homo sapiens
attcaaagaacctttagcattg

SEQ ID NO: 7413621 - DNA, 22 bp, Homo sapiens
attcaaagaacctttagcattg

SEQ ID NO: 7413622 - DNA, 22 bp, Homo sapiens
attcaaagaacctttagcattg

SEQ ID NO: 7413623 - DNA, 21 bp, Homo sapiens
attcaaagaagaggaaggccc

SEQ ID NO: 7413624 - DNA, 22 bp, Homo sapiens
attcaaagagctgccagaactg

SEQ ID NO: 7413625 - DNA, 22 bp, Homo sapiens
attcaaagagctgccagaactg

SEQ ID NO: 7413626 - DNA, 22 bp, Homo sapiens
attcccacctgaaaaaggtagg

SEQ ID NO: 7413627 - DNA, 22 bp, Homo sapiens
attcccactagctctttataga

SEQ ID NO: 7413628 - DNA, 22 bp, Homo sapiens
attcccactagctctttataga

SEQ ID NO: 7413629 - DNA, 22 bp, Homo sapiens
attcaaaagaccatgcagactc

SEQ ID NO: 7413630 - DNA, 22 bp, Homo sapiens
attcaaaagaccatgcagactc

SEQ ID NO: 7413631 - DNA, 22 bp, Homo sapiens
attcaaaagaccatgcagactc

SEQ ID NO: 7413632 - DNA, 22 bp, Homo sapiens
attcaaaagaccatgcagactc

SEQ ID NO: 7413633 - DNA, 22 bp, Homo sapiens
attcaaaagaccatgcagactc

SEQ ID NO: 7413634 - DNA, 22 bp, Homo sapiens
attcaaaagaccatgcagactc

SEQ ID NO: 7413635 - DNA, 22 bp, Homo sapiens
attcaaaagaccatgcagactc

SEQ ID NO: 7413636 - DNA, 22 bp, Homo sapiens
attcaaaagaccatgcagactc

SEQ ID NO: 7413637 - DNA, 22 bp, Homo sapiens
attcaaaagaccatgcagactc

SEQ ID NO: 7413638 - DNA, 22 bp, Homo sapiens
attcaaaagaccatgcagactc

SEQ ID NO: 7413639 - DNA, 22 bp, Homo sapiens
attcaaactgtgttaggcagca

SEQ ID NO: 7413640 - DNA, 22 bp, Homo sapiens
attcaaacctcatttattgttc

SEQ ID NO: 7413641 - DNA, 22 bp, Homo sapiens
attcaaacaggccaattgacct

SEQ ID NO: 7413642 - DNA, 22 bp, Homo sapiens
attcaaaccccatagacaactt

SEQ ID NO: 7413643 - DNA, 22 bp, Homo sapiens
attcaaaccccatagacaactt

SEQ ID NO: 7413644 - DNA, 22 bp, Homo sapiens
attcaaacactttgagaagttc

SEQ ID NO: 7413645 - DNA, 22 bp, Homo sapiens
attcaaacaggaagaaatcatt

SEQ ID NO: 7413646 - DNA, 22 bp, Homo sapiens
attcaaacaggaagaaatcatt

SEQ ID NO: 7413647 - DNA, 22 bp, Homo sapiens
attcaaacaggaagaaatcatt

SEQ ID NO: 7413648 - DNA, 22 bp, Homo sapiens
attcaaacaggccaattgacct

SEQ ID NO: 7413649 - DNA, 22 bp, Homo sapiens
attctaaatgtaatttagaatt

SEQ ID NO: 7413650 - DNA, 22 bp, Homo sapiens
attctaaatgtaatttagaatt

SEQ ID NO: 7413651 - DNA, 22 bp, Homo sapiens
attctaaatgtaatttagaatt

SEQ ID NO: 7413652 - DNA, 22 bp, Homo sapiens
attctaaatcagagagctctgt

SEQ ID NO: 7413653 - DNA, 22 bp, Homo sapiens
attctaaatcagagagctctgt

SEQ ID NO: 7413654 - DNA, 22 bp, Homo sapiens
attctaaatcagagagctctgt

SEQ ID NO: 7413655 - DNA, 22 bp, Homo sapiens
attctaaatgtaatttagaatt

SEQ ID NO: 7413656 - DNA, 22 bp, Homo sapiens
attcgctgacttgcacatttgg

SEQ ID NO: 7413657 - DNA, 20 bp, Homo sapiens
attctaaagctctgctcttt

SEQ ID NO: 7413658 - DNA, 20 bp, Homo sapiens
attctaaagctctgctcttt

SEQ ID NO: 7413659 - DNA, 20 bp, Homo sapiens
attctaaagctctgctcttt

SEQ ID NO: 7413660 - DNA, 22 bp, Homo sapiens
attctaaagcttgtggagctta

SEQ ID NO: 7413661 - DNA, 22 bp, Homo sapiens
attctaaagcttgtggagctta

SEQ ID NO: 7413662 - DNA, 22 bp, Homo sapiens
attctaaagcttgtggagctta

SEQ ID NO: 7413663 - DNA, 22 bp, Homo sapiens
attctaaatcagagagctctgt

SEQ ID NO: 7413664 - DNA, 22 bp, Homo sapiens
attctaagcacgctgaagtctt

SEQ ID NO: 7413665 - DNA, 22 bp, Homo sapiens
attctaagcacgctgaagtctt

SEQ ID NO: 7413666 - DNA, 22 bp, Homo sapiens
attctaagcacgctgaagtctt

SEQ ID NO: 7413667 - DNA, 22 bp, Homo sapiens
attctaattagttctacatgtt

SEQ ID NO: 7413668 - DNA, 22 bp, Homo sapiens
attctaatggcagagactcctg

SEQ ID NO: 7413669 - DNA, 22 bp, Homo sapiens
attctaatggcagagactcctg

SEQ ID NO: 7413670 - DNA, 22 bp, Homo sapiens
attctaatgccctggccccagc

SEQ ID NO: 7413671 - DNA, 22 bp, Homo sapiens
attctaatgccctggccccagc

SEQ ID NO: 7413672 - DNA, 22 bp, Homo sapiens
attctaatgccctggccccagc

SEQ ID NO: 7413673 - DNA, 22 bp, Homo sapiens
attctaagtcttgttcacattc

SEQ ID NO: 7413674 - DNA, 22 bp, Homo sapiens
attctaagtgcttgtggtggtt

SEQ ID NO: 7413675 - DNA, 22 bp, Homo sapiens
attctacaacccaataataatt

SEQ ID NO: 7413676 - DNA, 22 bp, Homo sapiens
attctacaacccaataataatt

SEQ ID NO: 7413677 - DNA, 22 bp, Homo sapiens
attctacaacccaataataatt

SEQ ID NO: 7413678 - DNA, 22 bp, Homo sapiens
attctacaaaagaactggatct

SEQ ID NO: 7413679 - DNA, 22 bp, Homo sapiens
attctaattagttctacatgtt

SEQ ID NO: 7413680 - DNA, 22 bp, Homo sapiens
attctacaaaagaactggatct

SEQ ID NO: 7413681 - DNA, 22 bp, Homo sapiens
attctaattagttctacatgtt

SEQ ID NO: 7413682 - DNA, 22 bp, Homo sapiens
attctaatggcagagactcctg

SEQ ID NO: 7413683 - DNA, 22 bp, Homo sapiens
attctaattagttctacatgtt

SEQ ID NO: 7413684 - DNA, 22 bp, Homo sapiens
attctaattagttctacatgtt

SEQ ID NO: 7413685 - DNA, 22 bp, Homo sapiens
attctaattagttctacatgtt

SEQ ID NO: 7413686 - DNA, 22 bp, Homo sapiens
attctctgaagtcaatggaaat

SEQ ID NO: 7413687 - DNA, 22 bp, Homo sapiens
attctctgaagtcaatggaaat

SEQ ID NO: 7413688 - DNA, 22 bp, Homo sapiens
attctctgaagtctttcagggc

SEQ ID NO: 7413689 - DNA, 20 bp, Homo sapiens
attctctgacaccgcccccg

SEQ ID NO: 7413690 - DNA, 22 bp, Homo sapiens
attctctgatgcaggtggaaga

SEQ ID NO: 7413691 - DNA, 22 bp, Homo sapiens
attctctgccattgcggtggat

SEQ ID NO: 7413692 - DNA, 22 bp, Homo sapiens
attctctggctaaaacctgaag

SEQ ID NO: 7413693 - DNA, 20 bp, Homo sapiens
attctctgctcaagtggcac

SEQ ID NO: 7413694 - DNA, 22 bp, Homo sapiens
attctctggaagaagataaaaa

SEQ ID NO: 7413695 - DNA, 22 bp, Homo sapiens
attctctgggttccagtaaatg

SEQ ID NO: 7413696 - DNA, 22 bp, Homo sapiens
attctctggctaaaacctgaag

SEQ ID NO: 7413697 - DNA, 22 bp, Homo sapiens
attctctgggttccagtaaatg

SEQ ID NO: 7413698 - DNA, 22 bp, Homo sapiens
attctctgggttccagtaaatg

SEQ ID NO: 7413699 - DNA, 22 bp, Homo sapiens
attctctgtacagaaggtaccg

SEQ ID NO: 7413700 - DNA, 19 bp, Homo sapiens
attctctggtttgctggct

SEQ ID NO: 7413701 - DNA, 22 bp, Homo sapiens
attctctggtcattgagcatat

SEQ ID NO: 7413702 - DNA, 22 bp, Homo sapiens
attctctggtcattgagcatat

SEQ ID NO: 7413703 - DNA, 22 bp, Homo sapiens
attctctggtcattgagtataa

SEQ ID NO: 7413704 - DNA, 22 bp, Homo sapiens
attgaaaaatgactattgctta

SEQ ID NO: 7413705 - DNA, 22 bp, Homo sapiens
attgaaaaatgactattgctta

SEQ ID NO: 7413706 - DNA, 22 bp, Homo sapiens
attgaaaaatgactattgctta

SEQ ID NO: 7413707 - DNA, 22 bp, Homo sapiens
attcttctgcctactttcatcc

SEQ ID NO: 7413708 - DNA, 22 bp, Homo sapiens
attcttctgcctactttcatcc

SEQ ID NO: 7413709 - DNA, 22 bp, Homo sapiens
attcttctgcctactttcatcc

SEQ ID NO: 7413710 - DNA, 22 bp, Homo sapiens
attcttctgcctactttcatcc

SEQ ID NO: 7413711 - DNA, 22 bp, Homo sapiens
attcttctgcctactttcatcc

SEQ ID NO: 7413712 - DNA, 19 bp, Homo sapiens
attcttctcttcctgctgt

SEQ ID NO: 7413713 - DNA, 22 bp, Homo sapiens
attctctgtctttttgaaaaca

SEQ ID NO: 7413714 - DNA, 22 bp, Homo sapiens
attctctgtgcagatttaagac

SEQ ID NO: 7413715 - DNA, 22 bp, Homo sapiens
attctctgtagatggcttgaga

SEQ ID NO: 7413716 - DNA, 22 bp, Homo sapiens
attctctgtgcagatttaagac

SEQ ID NO: 7413717 - DNA, 22 bp, Homo sapiens
attctctagtctcttccataaa

SEQ ID NO: 7413718 - DNA, 22 bp, Homo sapiens
attctctagtctcttccataaa

SEQ ID NO: 7413719 - DNA, 22 bp, Homo sapiens
attctccttctattaagttatt

SEQ ID NO: 7413720 - DNA, 22 bp, Homo sapiens
attctccttctattaagttatt

SEQ ID NO: 7413721 - DNA, 22 bp, Homo sapiens
attctccttattctgaaaaaag

SEQ ID NO: 7413722 - DNA, 22 bp, Homo sapiens
attctccttattctgaaaaaag

SEQ ID NO: 7413723 - DNA, 22 bp, Homo sapiens
attctccttattctgaaaaaag

SEQ ID NO: 7413724 - DNA, 22 bp, Homo sapiens
attctccctgttcctcgacacc

SEQ ID NO: 7413725 - DNA, 20 bp, Homo sapiens
attctccctatactcacttt

SEQ ID NO: 7413726 - DNA, 22 bp, Homo sapiens
attctccatcaccactggcact

SEQ ID NO: 7413727 - DNA, 19 bp, Homo sapiens
attctccctagaattttga

SEQ ID NO: 7413728 - DNA, 20 bp, Homo sapiens
attctccctatactcacttt

SEQ ID NO: 7413729 - DNA, 22 bp, Homo sapiens
attctccctgttcctcgacacc

SEQ ID NO: 7413730 - DNA, 22 bp, Homo sapiens
attctctctctatgaaaactga

SEQ ID NO: 7413731 - DNA, 22 bp, Homo sapiens
attctctcttctgctgcccgtg

SEQ ID NO: 7413732 - DNA, 22 bp, Homo sapiens
attctctctctatgaaaactga

SEQ ID NO: 7413733 - DNA, 22 bp, Homo sapiens
attctctcatttatctgtccta

SEQ ID NO: 7413734 - DNA, 19 bp, Homo sapiens
attctctagtggtgcaatg

SEQ ID NO: 7413735 - DNA, 22 bp, Homo sapiens
attctctctagaagctgagatg

SEQ ID NO: 7413736 - DNA, 20 bp, Homo sapiens
attctacaagaataagcatg

SEQ ID NO: 7413737 - DNA, 22 bp, Homo sapiens
attctacaatcatgtagatcct

SEQ ID NO: 7413738 - DNA, 20 bp, Homo sapiens
attctacaagaataagcatg

SEQ ID NO: 7413739 - DNA, 20 bp, Homo sapiens
attctacaagaataagcatg

SEQ ID NO: 7413740 - DNA, 22 bp, Homo sapiens
attctacaacccaataataatt

SEQ ID NO: 7413741 - DNA, 22 bp, Homo sapiens
attctacaacccaataataatt

SEQ ID NO: 7413742 - DNA, 20 bp, Homo sapiens
attctacaagaataagcatg

SEQ ID NO: 7413743 - DNA, 20 bp, Homo sapiens
attctacaagaataagcatg

SEQ ID NO: 7413744 - DNA, 22 bp, Homo sapiens
attctccactgtaaggttatta

SEQ ID NO: 7413745 - DNA, 22 bp, Homo sapiens
attctacaatcatgtagatcct

SEQ ID NO: 7413746 - DNA, 22 bp, Homo sapiens
attctacaatcatgtagatcct

SEQ ID NO: 7413747 - DNA, 22 bp, Homo sapiens
attctccagtagtcattctatc

SEQ ID NO: 7413748 - DNA, 22 bp, Homo sapiens
attctccagtagtcattctatc

SEQ ID NO: 7413749 - DNA, 22 bp, Homo sapiens
attctccagctcactgtccata

SEQ ID NO: 7413750 - DNA, 22 bp, Homo sapiens
attctccagctcactgtccata

SEQ ID NO: 7413751 - DNA, 19 bp, Homo sapiens
attctccctagaattttga

SEQ ID NO: 7413752 - DNA, 22 bp, Homo sapiens
agaggccgggtgcctgctcaga

SEQ ID NO: 7413753 - DNA, 22 bp, Homo sapiens
agaggccgggtgcctgctcaga

SEQ ID NO: 7413754 - DNA, 22 bp, Homo sapiens
agaggccggccgagcccatggg

SEQ ID NO: 7413755 - DNA, 22 bp, Homo sapiens
agaggccggccgagcccatggg

SEQ ID NO: 7413756 - DNA, 22 bp, Homo sapiens
agaggccggccgagcccatggg

SEQ ID NO: 7413757 - DNA, 22 bp, Homo sapiens
agaggccggccgagcccatggg

SEQ ID NO: 7413758 - DNA, 22 bp, Homo sapiens
agaggccggccgagcccatggg

SEQ ID NO: 7413759 - DNA, 22 bp, Homo sapiens
agaggccggccgagcccatggg

SEQ ID NO: 7413760 - DNA, 22 bp, Homo sapiens
agaggccggccgagcccatggg

SEQ ID NO: 7413761 - DNA, 22 bp, Homo sapiens
agaggccggccgagcccatggg

SEQ ID NO: 7413762 - DNA, 22 bp, Homo sapiens
agaggccctgggctggtgtgct

SEQ ID NO: 7413763 - DNA, 22 bp, Homo sapiens
agaggccctgggctggtgtgct

SEQ ID NO: 7413764 - DNA, 22 bp, Homo sapiens
agaggccctggctagagcagct

SEQ ID NO: 7413765 - DNA, 22 bp, Homo sapiens
agaggccctggctagagcagct

SEQ ID NO: 7413766 - DNA, 19 bp, Homo sapiens
agaggcctcagcagctggc

SEQ ID NO: 7413767 - DNA, 22 bp, Homo sapiens
agaggcctccctcccagctggt

SEQ ID NO: 7413768 - DNA, 22 bp, Homo sapiens
agaggcctccgaaaggtgggct

SEQ ID NO: 7413769 - DNA, 22 bp, Homo sapiens
agaggcctaaccaagatgtcct

SEQ ID NO: 7413770 - DNA, 22 bp, Homo sapiens
agaggcctaaccaagatgtcct

SEQ ID NO: 7413771 - DNA, 22 bp, Homo sapiens
agaggcctaaccaagatgtcct

SEQ ID NO: 7413772 - DNA, 22 bp, Homo sapiens
agaggcctaattgctacccttt

SEQ ID NO: 7413773 - DNA, 22 bp, Homo sapiens
agaggcctaaccaagatgtcct

SEQ ID NO: 7413774 - DNA, 22 bp, Homo sapiens
agaggcctcaaaccagacctga

SEQ ID NO: 7413775 - DNA, 22 bp, Homo sapiens
agaggcctcaaaccagacctga

SEQ ID NO: 7413776 - DNA, 22 bp, Homo sapiens
agaggcctcaaaccagacctga

SEQ ID NO: 7413777 - DNA, 19 bp, Homo sapiens
agaggcctcagcagctggc

SEQ ID NO: 7413778 - DNA, 22 bp, Homo sapiens
attatttctcactcacataata

SEQ ID NO: 7413779 - DNA, 22 bp, Homo sapiens
attatttctcactcacataata

SEQ ID NO: 7413780 - DNA, 22 bp, Homo sapiens
attatttctcactcacataata

SEQ ID NO: 7413781 - DNA, 22 bp, Homo sapiens
attatttctcactcacataata

SEQ ID NO: 7413782 - DNA, 22 bp, Homo sapiens
attatttgacttgagaacaggt

SEQ ID NO: 7413783 - DNA, 22 bp, Homo sapiens
attatttgacttgagaacaggt

SEQ ID NO: 7413784 - DNA, 22 bp, Homo sapiens
attatttgacttgagaacaggt

SEQ ID NO: 7413785 - DNA, 22 bp, Homo sapiens
attatttctcactcacataata

SEQ ID NO: 7413786 - DNA, 22 bp, Homo sapiens
attatttctcactcacataata

SEQ ID NO: 7413787 - DNA, 22 bp, Homo sapiens
agaggcctctagggcccctcag

SEQ ID NO: 7413788 - DNA, 22 bp, Homo sapiens
agaggcctctagggcccctcag

SEQ ID NO: 7413789 - DNA, 22 bp, Homo sapiens
agaggcctctagggcccctcag

SEQ ID NO: 7413790 - DNA, 22 bp, Homo sapiens
agaggcctctttgcaagtaggt

SEQ ID NO: 7413791 - DNA, 22 bp, Homo sapiens
agaggcctctgttgttcagacg

SEQ ID NO: 7413792 - DNA, 22 bp, Homo sapiens
attattttatgtgcggcctgat

SEQ ID NO: 7413793 - DNA, 22 bp, Homo sapiens
attattttatgtgcggcctgat

SEQ ID NO: 7413794 - DNA, 22 bp, Homo sapiens
attattttatgtgcggcctgat

SEQ ID NO: 7413795 - DNA, 22 bp, Homo sapiens
attattttatgtgcggcctgat

SEQ ID NO: 7413796 - DNA, 22 bp, Homo sapiens
attattttatgtgcggcctgat

SEQ ID NO: 7413797 - DNA, 22 bp, Homo sapiens
attattttatgtgcggcctgat

SEQ ID NO: 7413798 - DNA, 22 bp, Homo sapiens
attattttatgtgcggcctgat

SEQ ID NO: 7413799 - DNA, 22 bp, Homo sapiens
attattttatgtgcggcctgat

SEQ ID NO: 7413800 - DNA, 22 bp, Homo sapiens
attatttggaataggcattgca

SEQ ID NO: 7413801 - DNA, 22 bp, Homo sapiens
attatttgtgtccacagaatac

SEQ ID NO: 7413802 - DNA, 22 bp, Homo sapiens
attatttgtgtccacagaatac

SEQ ID NO: 7413803 - DNA, 22 bp, Homo sapiens
attatttgtgtccacagaatac

SEQ ID NO: 7413804 - DNA, 22 bp, Homo sapiens
attatttggaataggcattgca

SEQ ID NO: 7413805 - DNA, 22 bp, Homo sapiens
attatttgcttggctcatctaa

SEQ ID NO: 7413806 - DNA, 22 bp, Homo sapiens
agaggaagccattgcttactga

SEQ ID NO: 7413807 - DNA, 21 bp, Homo sapiens
agaggaagaagagtgtattat

SEQ ID NO: 7413808 - DNA, 22 bp, Homo sapiens
agaggaagattttattaaccag

SEQ ID NO: 7413809 - DNA, 22 bp, Homo sapiens
agaggaagattttattaaccag

SEQ ID NO: 7413810 - DNA, 22 bp, Homo sapiens
agaggaagccattgcttactga

SEQ ID NO: 7413811 - DNA, 22 bp, Homo sapiens
agaggaagccattgcttactga

SEQ ID NO: 7413812 - DNA, 22 bp, Homo sapiens
agaggaagccattgcttactga

SEQ ID NO: 7413813 - DNA, 22 bp, Homo sapiens
agaggaagccattgcttactga

SEQ ID NO: 7413814 - DNA, 22 bp, Homo sapiens
agaggaagccattgcttactga

SEQ ID NO: 7413815 - DNA, 22 bp, Homo sapiens
agaggaagccattgcttactga

SEQ ID NO: 7413816 - DNA, 22 bp, Homo sapiens
agaggaagccattgcttactga

SEQ ID NO: 7413817 - DNA, 22 bp, Homo sapiens
agaggaagccattgcttactga

SEQ ID NO: 7413818 - DNA, 22 bp, Homo sapiens
agaggccagggacactgctcaa

SEQ ID NO: 7413819 - DNA, 22 bp, Homo sapiens
agaggccagggacactgctcaa

SEQ ID NO: 7413820 - DNA, 22 bp, Homo sapiens
agaggccagggacactgctcaa

SEQ ID NO: 7413821 - DNA, 22 bp, Homo sapiens
agaggccagggacactgctcaa

SEQ ID NO: 7413822 - DNA, 22 bp, Homo sapiens
agaggccaggtccagagtttgt

SEQ ID NO: 7413823 - DNA, 22 bp, Homo sapiens
agaggccagggacactgctcaa

SEQ ID NO: 7413824 - DNA, 22 bp, Homo sapiens
agaggccaggtccagagtttgt

SEQ ID NO: 7413825 - DNA, 22 bp, Homo sapiens
agaggccaggtccagagtttgt

SEQ ID NO: 7413826 - DNA, 22 bp, Homo sapiens
agaggccctctctgctcagtct

SEQ ID NO: 7413827 - DNA, 22 bp, Homo sapiens
agaggccctggctagagcagct

SEQ ID NO: 7413828 - DNA, 22 bp, Homo sapiens
agaggccctggctagagcagct

SEQ ID NO: 7413829 - DNA, 22 bp, Homo sapiens
agaggccctctctgctcagtct

SEQ ID NO: 7413830 - DNA, 22 bp, Homo sapiens
agaggccctggctagagcagct

SEQ ID NO: 7413831 - DNA, 22 bp, Homo sapiens
agaggaaaatgagttccagaat

SEQ ID NO: 7413832 - DNA, 22 bp, Homo sapiens
agaggaaaatgagttccagaat

SEQ ID NO: 7413833 - DNA, 22 bp, Homo sapiens
agaggaaaatgagttccagaat

SEQ ID NO: 7413834 - DNA, 22 bp, Homo sapiens
agaggaaacataggtttttaaa

SEQ ID NO: 7413835 - DNA, 22 bp, Homo sapiens
agaggaaacataggtttttaaa

SEQ ID NO: 7413836 - DNA, 22 bp, Homo sapiens
agaggaaacataggtttttaaa

SEQ ID NO: 7413837 - DNA, 22 bp, Homo sapiens
agaggaaacataggtttttaaa

SEQ ID NO: 7413838 - DNA, 21 bp, Homo sapiens
agaggaagaagagtgtattat

SEQ ID NO: 7413839 - DNA, 21 bp, Homo sapiens
agaggaagaagagtgtattat

SEQ ID NO: 7413840 - DNA, 22 bp, Homo sapiens
agaggaacccagacagggcttt

SEQ ID NO: 7413841 - DNA, 21 bp, Homo sapiens
agaggaagaagagtgtattat

SEQ ID NO: 7413842 - DNA, 21 bp, Homo sapiens
agaggaagaagagtgtattat

SEQ ID NO: 7413843 - DNA, 22 bp, Homo sapiens
agaggaaatggataaagggtga

SEQ ID NO: 7413844 - DNA, 22 bp, Homo sapiens
agaggaaatggataaagggtga

SEQ ID NO: 7413845 - DNA, 22 bp, Homo sapiens
agaggaaatggataaagggtga

SEQ ID NO: 7413846 - DNA, 22 bp, Homo sapiens
agaggaaatggataaagggtga

SEQ ID NO: 7413847 - DNA, 22 bp, Homo sapiens
agaggaaatggataaagggtga

SEQ ID NO: 7413848 - DNA, 22 bp, Homo sapiens
agaggaacccagacagggcttt

SEQ ID NO: 7413849 - DNA, 22 bp, Homo sapiens
agagcttttctgtaataacatc

SEQ ID NO: 7413850 - DNA, 22 bp, Homo sapiens
agagctttgtttgattgtcaga

SEQ ID NO: 7413851 - DNA, 23 bp, Homo sapiens
agagctttctaaaatgtaaatct

SEQ ID NO: 7413852 - DNA, 23 bp, Homo sapiens
agagctttctaaaatgtaaatct

SEQ ID NO: 7413853 - DNA, 23 bp, Homo sapiens
agagctttctaaaatgtaaatct

SEQ ID NO: 7413854 - DNA, 22 bp, Homo sapiens
agagctttgggacatttgctag

SEQ ID NO: 7413855 - DNA, 22 bp, Homo sapiens
agagctttgggacatttgctag

SEQ ID NO: 7413856 - DNA, 22 bp, Homo sapiens
attaatacattatagggattgt

SEQ ID NO: 7413857 - DNA, 22 bp, Homo sapiens
agagcttagaatttcagatgat

SEQ ID NO: 7413858 - DNA, 22 bp, Homo sapiens
agagctgtttgtctagagagtg

SEQ ID NO: 7413859 - DNA, 22 bp, Homo sapiens
attaatatacactgttagcatg

SEQ ID NO: 7413860 - DNA, 22 bp, Homo sapiens
agagcttcactggagagcacat

SEQ ID NO: 7413861 - DNA, 22 bp, Homo sapiens
agagcttagggggctttgcatc

SEQ ID NO: 7413862 - DNA, 23 bp, Homo sapiens
agagcttagggaattcacatgag

SEQ ID NO: 7413863 - DNA, 22 bp, Homo sapiens
agagcttatatcttggccatcc

SEQ ID NO: 7413864 - DNA, 22 bp, Homo sapiens
attaataaaataccactttgtt

SEQ ID NO: 7413865 - DNA, 22 bp, Homo sapiens
attaataaaataccactttgtt

SEQ ID NO: 7413866 - DNA, 22 bp, Homo sapiens
attaataaaataccactttgtt

SEQ ID NO: 7413867 - DNA, 22 bp, Homo sapiens
attaatacattatagggattgt

SEQ ID NO: 7413868 - DNA, 22 bp, Homo sapiens
attaataaaataccactttgtt

SEQ ID NO: 7413869 - DNA, 22 bp, Homo sapiens
attaatacattatagggattgt

SEQ ID NO: 7413870 - DNA, 22 bp, Homo sapiens
attaataaaataccactttgtt

SEQ ID NO: 7413871 - DNA, 22 bp, Homo sapiens
attaataaaataccactttgtt

SEQ ID NO: 7413872 - DNA, 22 bp, Homo sapiens
attaataaaataccactttgtt

SEQ ID NO: 7413873 - DNA, 22 bp, Homo sapiens
attaataaaataccactttgtt

SEQ ID NO: 7413874 - DNA, 22 bp, Homo sapiens
attaataaaataccactttgtt

SEQ ID NO: 7413875 - DNA, 22 bp, Homo sapiens
attaataaaataccactttgtt

SEQ ID NO: 7413876 - DNA, 22 bp, Homo sapiens
attaataaaataccactttgtt

SEQ ID NO: 7413877 - DNA, 22 bp, Homo sapiens
attaataaaataccactttgtt

SEQ ID NO: 7413878 - DNA, 22 bp, Homo sapiens
attgaaatccctacctcagagg

SEQ ID NO: 7413879 - DNA, 22 bp, Homo sapiens
attgaaattgatgaaattcttg

SEQ ID NO: 7413880 - DNA, 22 bp, Homo sapiens
attgaaattgatgaaattcttg

SEQ ID NO: 7413881 - DNA, 22 bp, Homo sapiens
attgagaaaattcgagcaagtt

SEQ ID NO: 7413882 - DNA, 22 bp, Homo sapiens
attgagaaaattcgagcaagtt

SEQ ID NO: 7413883 - DNA, 22 bp, Homo sapiens
attgagaaaattcgagcaagtt

SEQ ID NO: 7413884 - DNA, 22 bp, Homo sapiens
attgagaaaataagtatggata

SEQ ID NO: 7413885 - DNA, 22 bp, Homo sapiens
attgagaaaggcttatgtttgc

SEQ ID NO: 7413886 - DNA, 22 bp, Homo sapiens
attgagaaaggcttatgtttgc

SEQ ID NO: 7413887 - DNA, 22 bp, Homo sapiens
attgagaaatataatctggaaa

SEQ ID NO: 7413888 - DNA, 22 bp, Homo sapiens
attgagaaaggcttatgtttgc

SEQ ID NO: 7413889 - DNA, 22 bp, Homo sapiens
attgagaaggagattggcatct

SEQ ID NO: 7413890 - DNA, 22 bp, Homo sapiens
attgagaagcttgcagattttt

SEQ ID NO: 7413891 - DNA, 22 bp, Homo sapiens
attgagaagcttgcagattttt

SEQ ID NO: 7413892 - DNA, 22 bp, Homo sapiens
attgagaagaaaatctaatata

SEQ ID NO: 7413893 - DNA, 22 bp, Homo sapiens
attgagaagaaaatctaatata

SEQ ID NO: 7413894 - DNA, 22 bp, Homo sapiens
attgagaaatataatctggaaa

SEQ ID NO: 7413895 - DNA, 22 bp, Homo sapiens
attgagaagaaaatctaatata

SEQ ID NO: 7413896 - DNA, 22 bp, Homo sapiens
attgagaagaaaatctaatata

SEQ ID NO: 7413897 - DNA, 21 bp, Homo sapiens
attgaaagtcaacaatcagtt

SEQ ID NO: 7413898 - DNA, 22 bp, Homo sapiens
attgaaaggttttgagcagata

SEQ ID NO: 7413899 - DNA, 22 bp, Homo sapiens
attgaaacctgctcaggctctc

SEQ ID NO: 7413900 - DNA, 22 bp, Homo sapiens
attgaaatacataaaattgcca

SEQ ID NO: 7413901 - DNA, 22 bp, Homo sapiens
attgaaatacataaaattgcca

SEQ ID NO: 7413902 - DNA, 22 bp, Homo sapiens
attgaaatacataaaattgcca

SEQ ID NO: 7413903 - DNA, 22 bp, Homo sapiens
attgaaatacataaaattgcca

SEQ ID NO: 7413904 - DNA, 22 bp, Homo sapiens
attgaaagcacaaagaacaagt

SEQ ID NO: 7413905 - DNA, 22 bp, Homo sapiens
attgaaagcacaaagaacaagt

SEQ ID NO: 7413906 - DNA, 22 bp, Homo sapiens
attgaaagatatactgttctca

SEQ ID NO: 7413907 - DNA, 22 bp, Homo sapiens
attgaaagatatactgttctca

SEQ ID NO: 7413908 - DNA, 22 bp, Homo sapiens
attgaaagatatactgttctca

SEQ ID NO: 7413909 - DNA, 22 bp, Homo sapiens
attgaaagcacaaagaacaagt

SEQ ID NO: 7413910 - DNA, 22 bp, Homo sapiens
attgaaagcacaaagaacaagt

SEQ ID NO: 7413911 - DNA, 22 bp, Homo sapiens
attgaaagcatggatttggatt

SEQ ID NO: 7413912 - DNA, 22 bp, Homo sapiens
attgaaagcatggatttggatt

SEQ ID NO: 7413913 - DNA, 22 bp, Homo sapiens
attgaaaataaggccagaaaca

SEQ ID NO: 7413914 - DNA, 22 bp, Homo sapiens
attgaaaataaggccagaaaca

SEQ ID NO: 7413915 - DNA, 22 bp, Homo sapiens
attgaaaataaggccagaaaca

SEQ ID NO: 7413916 - DNA, 22 bp, Homo sapiens
attgaaaataaggccagaaaca

SEQ ID NO: 7413917 - DNA, 22 bp, Homo sapiens
attgaaaataaggccagaaaca

SEQ ID NO: 7413918 - DNA, 22 bp, Homo sapiens
attgaaaataaggccagaaaca

SEQ ID NO: 7413919 - DNA, 22 bp, Homo sapiens
attgaaaataaggccagaaaca

SEQ ID NO: 7413920 - DNA, 22 bp, Homo sapiens
attgaaaaattcacaattctgg

SEQ ID NO: 7413921 - DNA, 22 bp, Homo sapiens
attgaaaaattcacaattctgg

SEQ ID NO: 7413922 - DNA, 22 bp, Homo sapiens
attgaaaaattcacaattctgg

SEQ ID NO: 7413923 - DNA, 22 bp, Homo sapiens
attgaaaaattcacaattctgg

SEQ ID NO: 7413924 - DNA, 22 bp, Homo sapiens
attgaaaaatgactattgctta

SEQ ID NO: 7413925 - DNA, 22 bp, Homo sapiens
attgaaaaatgactattgctta

SEQ ID NO: 7413926 - DNA, 22 bp, Homo sapiens
attgaaaaatgactattgctta

SEQ ID NO: 7413927 - DNA, 22 bp, Homo sapiens
attgaaaaattcacaattctgg

SEQ ID NO: 7413928 - DNA, 22 bp, Homo sapiens
attgaaaaattcacaattctgg

SEQ ID NO: 7413929 - DNA, 22 bp, Homo sapiens
attgaaaaattcacaattctgg

SEQ ID NO: 7413930 - DNA, 22 bp, Homo sapiens
attgaaagagttttctgctgca

SEQ ID NO: 7413931 - DNA, 22 bp, Homo sapiens
attgaaagataggctactgtgg

SEQ ID NO: 7413932 - DNA, 22 bp, Homo sapiens
attgaaagataggctactgtgg

SEQ ID NO: 7413933 - DNA, 22 bp, Homo sapiens
attgaaaccctggattgtccta

SEQ ID NO: 7413934 - DNA, 22 bp, Homo sapiens
attgaaacctgctcaggctctc

SEQ ID NO: 7413935 - DNA, 22 bp, Homo sapiens
attgaaaccctggattgtccta

SEQ ID NO: 7413936 - DNA, 22 bp, Homo sapiens
attgaaacaagttgctttctat

SEQ ID NO: 7413937 - DNA, 22 bp, Homo sapiens
attgaaaatataattctaggag

SEQ ID NO: 7413938 - DNA, 22 bp, Homo sapiens
attgaaaatataattctaggag

SEQ ID NO: 7413939 - DNA, 22 bp, Homo sapiens
attgaaaataaggccagaaaca

SEQ ID NO: 7413940 - DNA, 22 bp, Homo sapiens
attgaaaatataattctaggag

SEQ ID NO: 7413941 - DNA, 22 bp, Homo sapiens
attgaaaatgacatttgtgccc

SEQ ID NO: 7413942 - DNA, 22 bp, Homo sapiens
attgaaaatgacatttgtgccc

SEQ ID NO: 7413943 - DNA, 22 bp, Homo sapiens
attgaaaatataattctaggag

SEQ ID NO: 7413944 - DNA, 22 bp, Homo sapiens
attgaaaatgacatttgtgccc

SEQ ID NO: 7413945 - DNA, 22 bp, Homo sapiens
attgagggctgagaagggccct

SEQ ID NO: 7413946 - DNA, 22 bp, Homo sapiens
attggtctgtgagctgttgaca

SEQ ID NO: 7413947 - DNA, 22 bp, Homo sapiens
attgaggagcagagatggggta

SEQ ID NO: 7413948 - DNA, 22 bp, Homo sapiens
attgagggctgagaagggccct

SEQ ID NO: 7413949 - DNA, 22 bp, Homo sapiens
attgaggactggtggggagagc

SEQ ID NO: 7413950 - DNA, 22 bp, Homo sapiens
attgaggagcagagatggggta

SEQ ID NO: 7413951 - DNA, 22 bp, Homo sapiens
attgagcaggcaaagtatcata

SEQ ID NO: 7413952 - DNA, 22 bp, Homo sapiens
attgagcaggcaaagtatcata

SEQ ID NO: 7413953 - DNA, 22 bp, Homo sapiens
attgagcacaaacgttactaga

SEQ ID NO: 7413954 - DNA, 22 bp, Homo sapiens
attgagatctgcatcataagct

SEQ ID NO: 7413955 - DNA, 22 bp, Homo sapiens
attgagcacctacagtattacc

SEQ ID NO: 7413956 - DNA, 23 bp, Homo sapiens
attgagaaggatacattgttctc

SEQ ID NO: 7413957 - DNA, 23 bp, Homo sapiens
attgagaaggatacattgttctc

SEQ ID NO: 7413958 - DNA, 22 bp, Homo sapiens
attgagaatatgatttagtata

SEQ ID NO: 7413959 - DNA, 22 bp, Homo sapiens
attgagaatatgatttagtata

SEQ ID NO: 7413960 - DNA, 22 bp, Homo sapiens
attgagaatattgtgacagtgt

SEQ ID NO: 7413961 - DNA, 22 bp, Homo sapiens
attgagaatccatttgagatga

SEQ ID NO: 7413962 - DNA, 22 bp, Homo sapiens
attgagaatccatttgagatga

SEQ ID NO: 7413963 - DNA, 22 bp, Homo sapiens
attgagaatccatttgagatga

SEQ ID NO: 7413964 - DNA, 22 bp, Homo sapiens
attgagaatccatttgagatga

SEQ ID NO: 7413965 - DNA, 22 bp, Homo sapiens
attgagaatgaagggacatttt

SEQ ID NO: 7413966 - DNA, 22 bp, Homo sapiens
attgagaatctgagagcctagg

SEQ ID NO: 7413967 - DNA, 22 bp, Homo sapiens
attgagaatgcaatctactatg

SEQ ID NO: 7413968 - DNA, 22 bp, Homo sapiens
attgagaatgcaatctactatg

SEQ ID NO: 7413969 - DNA, 22 bp, Homo sapiens
attgagaattgtgagtttggag

SEQ ID NO: 7413970 - DNA, 22 bp, Homo sapiens
attgagaatgcaatctactatg

SEQ ID NO: 7413971 - DNA, 22 bp, Homo sapiens
attgagaattgtgagtttggag

SEQ ID NO: 7413972 - DNA, 22 bp, Homo sapiens
attgagagtgtatagctgatct

SEQ ID NO: 7413973 - DNA, 22 bp, Homo sapiens
attgtataagtctatttacaat

SEQ ID NO: 7413974 - DNA, 22 bp, Homo sapiens
attgtataagtctatttacaat

SEQ ID NO: 7413975 - DNA, 22 bp, Homo sapiens
attgtataattgtattgccaaa

SEQ ID NO: 7413976 - DNA, 22 bp, Homo sapiens
attgtataatcagttactggaa

SEQ ID NO: 7413977 - DNA, 22 bp, Homo sapiens
attgtataagtctatttacaat

SEQ ID NO: 7413978 - DNA, 22 bp, Homo sapiens
attgtataagtctatttacaat

SEQ ID NO: 7413979 - DNA, 22 bp, Homo sapiens
attgtataagtctatttacaat

SEQ ID NO: 7413980 - DNA, 22 bp, Homo sapiens
attgtataagtctatttacaat

SEQ ID NO: 7413981 - DNA, 22 bp, Homo sapiens
attgtataagtctatttacaat

SEQ ID NO: 7413982 - DNA, 22 bp, Homo sapiens
attgtatgcagcattaagcaat

SEQ ID NO: 7413983 - DNA, 22 bp, Homo sapiens
attgtattagcacaatacaatt

SEQ ID NO: 7413984 - DNA, 22 bp, Homo sapiens
attgtattagcacaatacaatt

SEQ ID NO: 7413985 - DNA, 22 bp, Homo sapiens
attgtattagcacaatacaatt

SEQ ID NO: 7413986 - DNA, 22 bp, Homo sapiens
attgtattagcacaatacaatt

SEQ ID NO: 7413987 - DNA, 22 bp, Homo sapiens
attgtatgatgtgcttcacttt

SEQ ID NO: 7413988 - DNA, 22 bp, Homo sapiens
attgtatcttgtcattatgcat

SEQ ID NO: 7413989 - DNA, 22 bp, Homo sapiens
attgtatcttgtcattatgcat

SEQ ID NO: 7413990 - DNA, 22 bp, Homo sapiens
attgtatacaagcttaattgtt

SEQ ID NO: 7413991 - DNA, 22 bp, Homo sapiens
attgtatacaagcttaattgtt

SEQ ID NO: 7413992 - DNA, 22 bp, Homo sapiens
attgtatacaagcttaattgtt

SEQ ID NO: 7413993 - DNA, 22 bp, Homo sapiens
attgtatacaagcttaattgtt

SEQ ID NO: 7413994 - DNA, 22 bp, Homo sapiens
attgtatacaagcttaattgtt

SEQ ID NO: 7413995 - DNA, 22 bp, Homo sapiens
attgtatacaagcttaattgtt

SEQ ID NO: 7413996 - DNA, 22 bp, Homo sapiens
attgtataacagcatgtatttt

SEQ ID NO: 7413997 - DNA, 22 bp, Homo sapiens
attgtataacagcatgtatttt

SEQ ID NO: 7413998 - DNA, 22 bp, Homo sapiens
attgtataacagcatgtatttt

SEQ ID NO: 7413999 - DNA, 22 bp, Homo sapiens
attgtataacagcatgtatttt

SEQ ID NO: 7414000 - DNA, 22 bp, Homo sapiens
attggtggtgaggacatgccag

SEQ ID NO: 7414001 - DNA, 22 bp, Homo sapiens
attgtataacagcatgtatttt

SEQ ID NO: 7414002 - DNA, 22 bp, Homo sapiens
attgtataagtctatttacaat

SEQ ID NO: 7414003 - DNA, 22 bp, Homo sapiens
attgtataagtctatttacaat

SEQ ID NO: 7414004 - DNA, 22 bp, Homo sapiens
attgtataagtctatttacaat

SEQ ID NO: 7414005 - DNA, 22 bp, Homo sapiens
attgtataagtctatttacaat

SEQ ID NO: 7414006 - DNA, 22 bp, Homo sapiens
attgtataagtctatttacaat

SEQ ID NO: 7414007 - DNA, 22 bp, Homo sapiens
attgtataagtctatttacaat

SEQ ID NO: 7414008 - DNA, 22 bp, Homo sapiens
attgtataacagcatgtatttt

SEQ ID NO: 7414009 - DNA, 22 bp, Homo sapiens
attggtggtgaggacatgccag

SEQ ID NO: 7414010 - DNA, 22 bp, Homo sapiens
attgtataacagcatgtatttt

SEQ ID NO: 7414011 - DNA, 22 bp, Homo sapiens
attggtggtgaggacatgccag

SEQ ID NO: 7414012 - DNA, 22 bp, Homo sapiens
attggtggtgaggacatgccag

SEQ ID NO: 7414013 - DNA, 22 bp, Homo sapiens
attggtgctctggcacattcct

SEQ ID NO: 7414014 - DNA, 22 bp, Homo sapiens
attgtattagcacaatacaatt

SEQ ID NO: 7414015 - DNA, 22 bp, Homo sapiens
attgtattagcacaatacaatt

SEQ ID NO: 7414016 - DNA, 22 bp, Homo sapiens
attgtattataattaggccaaa

SEQ ID NO: 7414017 - DNA, 22 bp, Homo sapiens
attgtattataattaggccaaa

SEQ ID NO: 7414018 - DNA, 22 bp, Homo sapiens
attgtattagcacaatacaatt

SEQ ID NO: 7414019 - DNA, 22 bp, Homo sapiens
attgtattagcacaatacaatt

SEQ ID NO: 7414020 - DNA, 22 bp, Homo sapiens
attgtattagcacaatacaatt

SEQ ID NO: 7414021 - DNA, 22 bp, Homo sapiens
attgtattagcacaatacaatt

SEQ ID NO: 7414022 - DNA, 22 bp, Homo sapiens
attgtattctgcacctttgtta

SEQ ID NO: 7414023 - DNA, 22 bp, Homo sapiens
attgtattcagttacaggtctt

SEQ ID NO: 7414024 - DNA, 22 bp, Homo sapiens
attgtattcagttacaggtctt

SEQ ID NO: 7414025 - DNA, 22 bp, Homo sapiens
attgtattcagttacaggtctt

SEQ ID NO: 7414026 - DNA, 22 bp, Homo sapiens
attgtatttccagcttgaatgt

SEQ ID NO: 7414027 - DNA, 22 bp, Homo sapiens
attgtatttccagcttgaatgt

SEQ ID NO: 7414028 - DNA, 22 bp, Homo sapiens
attgtatttaggagaaaagggt

SEQ ID NO: 7414029 - DNA, 22 bp, Homo sapiens
attgtatttaggagaaaagggt

SEQ ID NO: 7414030 - DNA, 22 bp, Homo sapiens
attgtattctgcacctttgtta

SEQ ID NO: 7414031 - DNA, 22 bp, Homo sapiens
attgtgctgctgctgacgttta

SEQ ID NO: 7414032 - DNA, 22 bp, Homo sapiens
attgtgctgcctcatggaagca

SEQ ID NO: 7414033 - DNA, 22 bp, Homo sapiens
attgtgctcacagcttgtttct

SEQ ID NO: 7414034 - DNA, 22 bp, Homo sapiens
attgtgctcagaatctgtcgtg

SEQ ID NO: 7414035 - DNA, 22 bp, Homo sapiens
attgtgctataagcgtggttct

SEQ ID NO: 7414036 - DNA, 22 bp, Homo sapiens
attgtgctttagatcacagtct

SEQ ID NO: 7414037 - DNA, 22 bp, Homo sapiens
attgtgctttagatcacagtct

SEQ ID NO: 7414038 - DNA, 22 bp, Homo sapiens
attgtgctttaattgaactgcc

SEQ ID NO: 7414039 - DNA, 22 bp, Homo sapiens
attgtgcttcctgaaatttgat

SEQ ID NO: 7414040 - DNA, 22 bp, Homo sapiens
attgtgctttgtatttggctag

SEQ ID NO: 7414041 - DNA, 22 bp, Homo sapiens
attgtgctttgcatcttgttcc

SEQ ID NO: 7414042 - DNA, 22 bp, Homo sapiens
attgtatttgtacaagacatgt

SEQ ID NO: 7414043 - DNA, 22 bp, Homo sapiens
attgtatttgtacaagacatgt

SEQ ID NO: 7414044 - DNA, 22 bp, Homo sapiens
attgtatttgtacaagacatgt

SEQ ID NO: 7414045 - DNA, 22 bp, Homo sapiens
attgtatttgtacaagacatgt

SEQ ID NO: 7414046 - DNA, 22 bp, Homo sapiens
attgtatttgtacaagacatgt

SEQ ID NO: 7414047 - DNA, 18 bp, Homo sapiens
attgtgctaatggtttcc

SEQ ID NO: 7414048 - DNA, 22 bp, Homo sapiens
attgtgctaagcccaggaggga

SEQ ID NO: 7414049 - DNA, 22 bp, Homo sapiens
attgtatttccagcttgaatgt

SEQ ID NO: 7414050 - DNA, 22 bp, Homo sapiens
attgtatttccagcttgaatgt

SEQ ID NO: 7414051 - DNA, 22 bp, Homo sapiens
attgtatttccagcttgaatgt

SEQ ID NO: 7414052 - DNA, 22 bp, Homo sapiens
attgtatttccagcttgaatgt

SEQ ID NO: 7414053 - DNA, 22 bp, Homo sapiens
attgtggtgtcagttataggca

SEQ ID NO: 7414054 - DNA, 22 bp, Homo sapiens
attgtggctagacagtcacaat

SEQ ID NO: 7414055 - DNA, 22 bp, Homo sapiens
attgtggtgtcagttataggca

SEQ ID NO: 7414056 - DNA, 22 bp, Homo sapiens
attgtggtgtcagttataggca

SEQ ID NO: 7414057 - DNA, 22 bp, Homo sapiens
attgtggtgtcagttataggca

SEQ ID NO: 7414058 - DNA, 22 bp, Homo sapiens
attgtggccacagagatccaat

SEQ ID NO: 7414059 - DNA, 22 bp, Homo sapiens
attgtggacccactcccaaata

SEQ ID NO: 7414060 - DNA, 22 bp, Homo sapiens
attgtggactgatcagggctag

SEQ ID NO: 7414061 - DNA, 22 bp, Homo sapiens
attgtggaccaggtagagcttt

SEQ ID NO: 7414062 - DNA, 22 bp, Homo sapiens
attgtggaccaggtagagcttt

SEQ ID NO: 7414063 - DNA, 22 bp, Homo sapiens
attgtggacccactcccaaata

SEQ ID NO: 7414064 - DNA, 22 bp, Homo sapiens
attgtggtgtcagttataggca

SEQ ID NO: 7414065 - DNA, 22 bp, Homo sapiens
attgtggccacagagatccaat

SEQ ID NO: 7414066 - DNA, 22 bp, Homo sapiens
attgtgtcctcattgaccttca

SEQ ID NO: 7414067 - DNA, 22 bp, Homo sapiens
attgtgtcctcattgaccttca

SEQ ID NO: 7414068 - DNA, 22 bp, Homo sapiens
attgtgtcctcattgaccttca

SEQ ID NO: 7414069 - DNA, 22 bp, Homo sapiens
attgtgtcctcattgaccttca

SEQ ID NO: 7414070 - DNA, 22 bp, Homo sapiens
attgtgtaggggcagtctggga

SEQ ID NO: 7414071 - DNA, 22 bp, Homo sapiens
attgtgtaggggcagtctggga

SEQ ID NO: 7414072 - DNA, 22 bp, Homo sapiens
attgtggtgtcagttataggca

SEQ ID NO: 7414073 - DNA, 22 bp, Homo sapiens
attgttaaaaaggtggaaatgc

SEQ ID NO: 7414074 - DNA, 22 bp, Homo sapiens
attgttaaaaaggtggaaatgc

SEQ ID NO: 7414075 - DNA, 22 bp, Homo sapiens
attgttaaaaaggtggaaatgc

SEQ ID NO: 7414076 - DNA, 22 bp, Homo sapiens
attgttaaactgaagcattact

SEQ ID NO: 7414077 - DNA, 22 bp, Homo sapiens
attgttaaactgaagcattact

SEQ ID NO: 7414078 - DNA, 22 bp, Homo sapiens
attgttaaactgaagcattact

SEQ ID NO: 7414079 - DNA, 22 bp, Homo sapiens
attgttaaactgaagcattact

SEQ ID NO: 7414080 - DNA, 22 bp, Homo sapiens
attgttaaactgaagcattact

SEQ ID NO: 7414081 - DNA, 22 bp, Homo sapiens
attgttaaagtaataaccatgg

SEQ ID NO: 7414082 - DNA, 22 bp, Homo sapiens
attgttaaagtaataaccatgg

SEQ ID NO: 7414083 - DNA, 22 bp, Homo sapiens
attgttaaagtaataaccatgg

SEQ ID NO: 7414084 - DNA, 22 bp, Homo sapiens
attgttaaagtaataaccatgg

SEQ ID NO: 7414085 - DNA, 22 bp, Homo sapiens
attgttaaagtaataaccatgg

SEQ ID NO: 7414086 - DNA, 22 bp, Homo sapiens
attgttaaagtaataaccatgg

SEQ ID NO: 7414087 - DNA, 22 bp, Homo sapiens
attgttaataactattacattg

SEQ ID NO: 7414088 - DNA, 22 bp, Homo sapiens
attgttaaagtaataaccatgg

SEQ ID NO: 7414089 - DNA, 22 bp, Homo sapiens
attgttaactatagcatctggt

SEQ ID NO: 7414090 - DNA, 22 bp, Homo sapiens
agatacacagaggtaaagatga

SEQ ID NO: 7414091 - DNA, 22 bp, Homo sapiens
agatacacagaggtaaagatga

SEQ ID NO: 7414092 - DNA, 22 bp, Homo sapiens
agatacaccggaacctgaggct

SEQ ID NO: 7414093 - DNA, 22 bp, Homo sapiens
agatacacagccctgccatcac

SEQ ID NO: 7414094 - DNA, 22 bp, Homo sapiens
agatacacagccctgccatcac

SEQ ID NO: 7414095 - DNA, 23 bp, Homo sapiens
agatacagatctacgtgtcaatg

SEQ ID NO: 7414096 - DNA, 22 bp, Homo sapiens
agatacagacctcttattaagg

SEQ ID NO: 7414097 - DNA, 22 bp, Homo sapiens
agatacagaatggttgtttgtc

SEQ ID NO: 7414098 - DNA, 22 bp, Homo sapiens
atttacagatgatgctatttga

SEQ ID NO: 7414099 - DNA, 22 bp, Homo sapiens
atttacagacgtggattagtgc

SEQ ID NO: 7414100 - DNA, 22 bp, Homo sapiens
atttacagatgatgctatttga

SEQ ID NO: 7414101 - DNA, 22 bp, Homo sapiens
atttacagatgatgctatttga

SEQ ID NO: 7414102 - DNA, 22 bp, Homo sapiens
agatacagcctgccaggttctt

SEQ ID NO: 7414103 - DNA, 23 bp, Homo sapiens
agatacagatctacgtgtcaatg

SEQ ID NO: 7414104 - DNA, 22 bp, Homo sapiens
agatacagcctgccaggttctt

SEQ ID NO: 7414105 - DNA, 22 bp, Homo sapiens
atttacagacgtggattagtgc

SEQ ID NO: 7414106 - DNA, 22 bp, Homo sapiens
agatacaactgtttaaacatta

SEQ ID NO: 7414107 - DNA, 22 bp, Homo sapiens
agatacaactgtttaaacatta

SEQ ID NO: 7414108 - DNA, 22 bp, Homo sapiens
agatacaactgtttaaacatta

SEQ ID NO: 7414109 - DNA, 22 bp, Homo sapiens
agatacaactgtttaaacatta

SEQ ID NO: 7414110 - DNA, 22 bp, Homo sapiens
agatacaactgtttaaacatta

SEQ ID NO: 7414111 - DNA, 22 bp, Homo sapiens
agatacaactgtttaaacatta

SEQ ID NO: 7414112 - DNA, 22 bp, Homo sapiens
agatacaactgtttaaacatta

SEQ ID NO: 7414113 - DNA, 22 bp, Homo sapiens
agatacacagagcatcttcaga

SEQ ID NO: 7414114 - DNA, 22 bp, Homo sapiens
agatacaagttaagagaaagga

SEQ ID NO: 7414115 - DNA, 22 bp, Homo sapiens
agatacaagttaagagaaagga

SEQ ID NO: 7414116 - DNA, 22 bp, Homo sapiens
agatacaagttaagagaaagga

SEQ ID NO: 7414117 - DNA, 22 bp, Homo sapiens
agatacaagttaagagaaagga

SEQ ID NO: 7414118 - DNA, 22 bp, Homo sapiens
agatacaaggcagagatgtgca

SEQ ID NO: 7414119 - DNA, 22 bp, Homo sapiens
agatacaaggcagagatgtgca

SEQ ID NO: 7414120 - DNA, 22 bp, Homo sapiens
agatacaaggcagagatgtgca

SEQ ID NO: 7414121 - DNA, 22 bp, Homo sapiens
agatacaaggcagagatgtgca

SEQ ID NO: 7414122 - DNA, 22 bp, Homo sapiens
agatacaagttaagagaaagga

SEQ ID NO: 7414123 - DNA, 22 bp, Homo sapiens
agatacaaaggcctacagagca

SEQ ID NO: 7414124 - DNA, 22 bp, Homo sapiens
agatacaaaagataagatttag

SEQ ID NO: 7414125 - DNA, 22 bp, Homo sapiens
agatacaaaagataagatttag

SEQ ID NO: 7414126 - DNA, 22 bp, Homo sapiens
agatacaaaagataagatttag

SEQ ID NO: 7414127 - DNA, 22 bp, Homo sapiens
agataatttgagtaaattaatt

SEQ ID NO: 7414128 - DNA, 22 bp, Homo sapiens
agatacaaaaagggagaagatt

SEQ ID NO: 7414129 - DNA, 22 bp, Homo sapiens
agatacaaaaagggagaagatt

SEQ ID NO: 7414130 - DNA, 22 bp, Homo sapiens
agatacaaaaagggagaagatt

SEQ ID NO: 7414131 - DNA, 22 bp, Homo sapiens
agataatttgagtaaattaatt

SEQ ID NO: 7414132 - DNA, 22 bp, Homo sapiens
agatacaactcagaagtgtggt

SEQ ID NO: 7414133 - DNA, 22 bp, Homo sapiens
agatacaaaggcctacagagca

SEQ ID NO: 7414134 - DNA, 22 bp, Homo sapiens
agatacaaaggcctacagagca

SEQ ID NO: 7414135 - DNA, 22 bp, Homo sapiens
agatacaaaggcctacagagca

SEQ ID NO: 7414136 - DNA, 22 bp, Homo sapiens
agatacaaaggcctacagagca

SEQ ID NO: 7414137 - DNA, 22 bp, Homo sapiens
agatacaaaggcctacagagca

SEQ ID NO: 7414138 - DNA, 22 bp, Homo sapiens
agatacaactgtttaaacatta

SEQ ID NO: 7414139 - DNA, 22 bp, Homo sapiens
agatacaactgtttaaacatta

SEQ ID NO: 7414140 - DNA, 22 bp, Homo sapiens
agatacaactgtttaaacatta

SEQ ID NO: 7414141 - DNA, 22 bp, Homo sapiens
agatacaactgtttaaacatta

SEQ ID NO: 7414142 - DNA, 22 bp, Homo sapiens
agatacaactgtttaaacatta

SEQ ID NO: 7414143 - DNA, 22 bp, Homo sapiens
agatacaactcagaagtgtggt

SEQ ID NO: 7414144 - DNA, 22 bp, Homo sapiens
agatacaactcagaagtgtggt

SEQ ID NO: 7414145 - DNA, 22 bp, Homo sapiens
agataattatgtcaatttcttg

SEQ ID NO: 7414146 - DNA, 22 bp, Homo sapiens
agataattatttacttcaaagt

SEQ ID NO: 7414147 - DNA, 22 bp, Homo sapiens
agataattatttacttcaaagt

SEQ ID NO: 7414148 - DNA, 22 bp, Homo sapiens
agataaattcctaagatttcag

SEQ ID NO: 7414149 - DNA, 22 bp, Homo sapiens
agataaattcctaagatttcag

SEQ ID NO: 7414150 - DNA, 22 bp, Homo sapiens
agataattatttacttcaaagt

SEQ ID NO: 7414151 - DNA, 22 bp, Homo sapiens
agataattatttacttcaaagt

SEQ ID NO: 7414152 - DNA, 22 bp, Homo sapiens
agataattatttacttcaaagt

SEQ ID NO: 7414153 - DNA, 22 bp, Homo sapiens
agataattatttacttcaaagt

SEQ ID NO: 7414154 - DNA, 22 bp, Homo sapiens
agataattatttacttcaaagt

SEQ ID NO: 7414155 - DNA, 22 bp, Homo sapiens
agataattatttacttcaaagt

SEQ ID NO: 7414156 - DNA, 22 bp, Homo sapiens
attgttaataactattacattg

SEQ ID NO: 7414157 - DNA, 22 bp, Homo sapiens
attgttaataactattacattg

SEQ ID NO: 7414158 - DNA, 22 bp, Homo sapiens
attgttaataactattacattg

SEQ ID NO: 7414159 - DNA, 22 bp, Homo sapiens
agataaattcctaagatttcag

SEQ ID NO: 7414160 - DNA, 22 bp, Homo sapiens
agataaattcctaagatttcag

SEQ ID NO: 7414161 - DNA, 22 bp, Homo sapiens
atgggcagtaacagtggcagtc

SEQ ID NO: 7414162 - DNA, 22 bp, Homo sapiens
atgggcagtaacagtggcagtc

SEQ ID NO: 7414163 - DNA, 22 bp, Homo sapiens
atgggcagtaacagtggcagtc

SEQ ID NO: 7414164 - DNA, 22 bp, Homo sapiens
atgggcagtaacagtggcagtc

SEQ ID NO: 7414165 - DNA, 22 bp, Homo sapiens
atgggcagtaacagtggcagtc

SEQ ID NO: 7414166 - DNA, 22 bp, Homo sapiens
atgggcagtaacagtggcagtc

SEQ ID NO: 7414167 - DNA, 18 bp, Homo sapiens
atgggaggggccaagaga

SEQ ID NO: 7414168 - DNA, 18 bp, Homo sapiens
atgggaggggccaagaga

SEQ ID NO: 7414169 - DNA, 18 bp, Homo sapiens
atgggaggggccaagaga

SEQ ID NO: 7414170 - DNA, 18 bp, Homo sapiens
atgggaggggccaagaga

SEQ ID NO: 7414171 - DNA, 22 bp, Homo sapiens
atggacaggtggataggtggat

SEQ ID NO: 7414172 - DNA, 22 bp, Homo sapiens
atggacaggtggataggtggat

SEQ ID NO: 7414173 - DNA, 22 bp, Homo sapiens
atggacaggtggataggtggat

SEQ ID NO: 7414174 - DNA, 22 bp, Homo sapiens
atggacaggtggataggtggat

SEQ ID NO: 7414175 - DNA, 18 bp, Homo sapiens
atgggaggggccaagaga

SEQ ID NO: 7414176 - DNA, 18 bp, Homo sapiens
atgggaggggccaagaga

SEQ ID NO: 7414177 - DNA, 18 bp, Homo sapiens
atgggaggggccaagaga

SEQ ID NO: 7414178 - DNA, 18 bp, Homo sapiens
atgggaggggccaagaga

SEQ ID NO: 7414179 - DNA, 23 bp, Homo sapiens
atggacagggtttcagggtcaca

SEQ ID NO: 7414180 - DNA, 23 bp, Homo sapiens
atggacagggtttcagggtcaca

SEQ ID NO: 7414181 - DNA, 22 bp, Homo sapiens
atggacaggtactgcagtgggt

SEQ ID NO: 7414182 - DNA, 22 bp, Homo sapiens
atggacaggtactgcagtgggt

SEQ ID NO: 7414183 - DNA, 22 bp, Homo sapiens
atggacaggtactgcagtgggt

SEQ ID NO: 7414184 - DNA, 22 bp, Homo sapiens
atggacaggtactgcagtgggt

SEQ ID NO: 7414185 - DNA, 22 bp, Homo sapiens
atggacaggtactgcagtgggt

SEQ ID NO: 7414186 - DNA, 22 bp, Homo sapiens
atggacaggtactgcagtgggt

SEQ ID NO: 7414187 - DNA, 22 bp, Homo sapiens
atggacaggtactgcagtgggt

SEQ ID NO: 7414188 - DNA, 22 bp, Homo sapiens
atggacaggtactgcagtgggt

SEQ ID NO: 7414189 - DNA, 22 bp, Homo sapiens
atggacagctggcctcaaggga

SEQ ID NO: 7414190 - DNA, 22 bp, Homo sapiens
atggacaggaactcccttggca

SEQ ID NO: 7414191 - DNA, 22 bp, Homo sapiens
atggacaggctgagcttcctca

SEQ ID NO: 7414192 - DNA, 22 bp, Homo sapiens
atggacaggctgagcttcctca

SEQ ID NO: 7414193 - DNA, 22 bp, Homo sapiens
atggacaggcttataacagcaa

SEQ ID NO: 7414194 - DNA, 22 bp, Homo sapiens
atggacagggcacaggcgcaga

SEQ ID NO: 7414195 - DNA, 23 bp, Homo sapiens
atggacagggtttcagggtcaca

SEQ ID NO: 7414196 - DNA, 23 bp, Homo sapiens
atggacagggtttcagggtcaca

SEQ ID NO: 7414197 - DNA, 23 bp, Homo sapiens
atggacagggtttcagggtcaca

SEQ ID NO: 7414198 - DNA, 23 bp, Homo sapiens
atggacagggtttcagggtcaca

SEQ ID NO: 7414199 - DNA, 22 bp, Homo sapiens
atggacagggcacaggcgcaga

SEQ ID NO: 7414200 - DNA, 22 bp, Homo sapiens
atggacagggcacaggcgcaga

SEQ ID NO: 7414201 - DNA, 22 bp, Homo sapiens
atggacagggcacaggcgcaga

SEQ ID NO: 7414202 - DNA, 22 bp, Homo sapiens
atgggcagttaggaggccagga

SEQ ID NO: 7414203 - DNA, 22 bp, Homo sapiens
atgggcagttaggaggccagga

SEQ ID NO: 7414204 - DNA, 22 bp, Homo sapiens
atgggcagttaggaggccagga

SEQ ID NO: 7414205 - DNA, 22 bp, Homo sapiens
atgggcagttaggaggccagga

SEQ ID NO: 7414206 - DNA, 22 bp, Homo sapiens
atgggcagttaggaggccagga

SEQ ID NO: 7414207 - DNA, 22 bp, Homo sapiens
atgggcagttaggaggccagga

SEQ ID NO: 7414208 - DNA, 22 bp, Homo sapiens
atgggcagtgtattggaaggaa

SEQ ID NO: 7414209 - DNA, 22 bp, Homo sapiens
atgggcagtgtattggaaggaa

SEQ ID NO: 7414210 - DNA, 22 bp, Homo sapiens
atgggcagtgtattggaaggaa

SEQ ID NO: 7414211 - DNA, 22 bp, Homo sapiens
atgggcagtgtattggaaggaa

SEQ ID NO: 7414212 - DNA, 16 bp, Homo sapiens
atgggcagtgaggaag

SEQ ID NO: 7414213 - DNA, 16 bp, Homo sapiens
atgggcagtgaggaag

SEQ ID NO: 7414214 - DNA, 16 bp, Homo sapiens
atgggcagtgaggaag

SEQ ID NO: 7414215 - DNA, 22 bp, Homo sapiens
atgggcagtaacagtggcagtc

SEQ ID NO: 7414216 - DNA, 22 bp, Homo sapiens
atgggcagtaacagtggcagtc

SEQ ID NO: 7414217 - DNA, 22 bp, Homo sapiens
atgggcagtaacagtggcagtc

SEQ ID NO: 7414218 - DNA, 22 bp, Homo sapiens
atgggcagtgtattggaaggaa

SEQ ID NO: 7414219 - DNA, 22 bp, Homo sapiens
atgggcagtgtattggaaggaa

SEQ ID NO: 7414220 - DNA, 22 bp, Homo sapiens
atgggcagtgtattggaaggaa

SEQ ID NO: 7414221 - DNA, 22 bp, Homo sapiens
atgggcagtgtattggaaggaa

SEQ ID NO: 7414222 - DNA, 16 bp, Homo sapiens
atgggcagtgaggaag

SEQ ID NO: 7414223 - DNA, 22 bp, Homo sapiens
atgggcagttaggaggccagga

SEQ ID NO: 7414224 - DNA, 22 bp, Homo sapiens
atgggcatgcttctagttgaaa

SEQ ID NO: 7414225 - DNA, 22 bp, Homo sapiens
atgggccaagtaaacattctca

SEQ ID NO: 7414226 - DNA, 22 bp, Homo sapiens
atgggccaagtaaacattctca

SEQ ID NO: 7414227 - DNA, 23 bp, Homo sapiens
atgggccaagcaagacccatgac

SEQ ID NO: 7414228 - DNA, 22 bp, Homo sapiens
atgggcatgatattagtaccta

SEQ ID NO: 7414229 - DNA, 23 bp, Homo sapiens
atgggccaagcaagacccatgac

SEQ ID NO: 7414230 - DNA, 22 bp, Homo sapiens
atgggccaagtaaacattctca

SEQ ID NO: 7414231 - DNA, 22 bp, Homo sapiens
atgggccacacacgattgggtg

SEQ ID NO: 7414232 - DNA, 22 bp, Homo sapiens
atgggccacacacgattgggtg

SEQ ID NO: 7414233 - DNA, 22 bp, Homo sapiens
atgggccacacacgattgggtg

SEQ ID NO: 7414234 - DNA, 22 bp, Homo sapiens
atgggccacacacgattgggtg

SEQ ID NO: 7414235 - DNA, 22 bp, Homo sapiens
atgggccagcaccatgttaagc

SEQ ID NO: 7414236 - DNA, 22 bp, Homo sapiens
atgggccaggcttgggatgaca

SEQ ID NO: 7414237 - DNA, 22 bp, Homo sapiens
atgggccaggcttgggatgaca

SEQ ID NO: 7414238 - DNA, 22 bp, Homo sapiens
atgggccaggcttgggatgaca

SEQ ID NO: 7414239 - DNA, 21 bp, Homo sapiens
atgggccagggatacagagag

SEQ ID NO: 7414240 - DNA, 21 bp, Homo sapiens
atgggccagggatacagagag

SEQ ID NO: 7414241 - DNA, 21 bp, Homo sapiens
atgggccagggatacagagag

SEQ ID NO: 7414242 - DNA, 21 bp, Homo sapiens
atgggccagggatacagagag

SEQ ID NO: 7414243 - DNA, 22 bp, Homo sapiens
atgggcctgttcctatgctggt

SEQ ID NO: 7414244 - DNA, 19 bp, Homo sapiens
atggacagacagtttggcc

SEQ ID NO: 7414245 - DNA, 22 bp, Homo sapiens
atggacagattaacacagtaga

SEQ ID NO: 7414246 - DNA, 22 bp, Homo sapiens
atggacagagctgagctccacc

SEQ ID NO: 7414247 - DNA, 22 bp, Homo sapiens
atggacagagctgagctccacc

SEQ ID NO: 7414248 - DNA, 22 bp, Homo sapiens
atggacagagctgagctccacc

SEQ ID NO: 7414249 - DNA, 22 bp, Homo sapiens
atggacagattaacacagtaga

SEQ ID NO: 7414250 - DNA, 22 bp, Homo sapiens
atggacagattaacacagtaga

SEQ ID NO: 7414251 - DNA, 22 bp, Homo sapiens
atggacagattaacacagtaga

SEQ ID NO: 7414252 - DNA, 22 bp, Homo sapiens
atggacagcaactggaagcttc

SEQ ID NO: 7414253 - DNA, 22 bp, Homo sapiens
atggacagacactggccttctg

SEQ ID NO: 7414254 - DNA, 23 bp, Homo sapiens
atggacagaatgtttgtgttccc

SEQ ID NO: 7414255 - DNA, 22 bp, Homo sapiens
atggacagacactggccttctg

SEQ ID NO: 7414256 - DNA, 23 bp, Homo sapiens
atggacagaatgtttgtgttccc

SEQ ID NO: 7414257 - DNA, 23 bp, Homo sapiens
atggacagaatgtttgtgttccc

SEQ ID NO: 7414258 - DNA, 22 bp, Homo sapiens
atggacagaaggtagcacctat

SEQ ID NO: 7414259 - DNA, 22 bp, Homo sapiens
atggacagaaggtagcacctat

SEQ ID NO: 7414260 - DNA, 22 bp, Homo sapiens
atggacagaaggtagcacctat

SEQ ID NO: 7414261 - DNA, 22 bp, Homo sapiens
atggacagaaggtagcacctat

SEQ ID NO: 7414262 - DNA, 22 bp, Homo sapiens
atggacagctggcctcaaggga

SEQ ID NO: 7414263 - DNA, 22 bp, Homo sapiens
atggacagctggcctcaaggga

SEQ ID NO: 7414264 - DNA, 22 bp, Homo sapiens
atggacagctgacactcacatt

SEQ ID NO: 7414265 - DNA, 22 bp, Homo sapiens
atggacagctgacactcacatt

SEQ ID NO: 7414266 - DNA, 22 bp, Homo sapiens
atggacagctgacactcacatt

SEQ ID NO: 7414267 - DNA, 22 bp, Homo sapiens
atggacagctcttatgtgggca

SEQ ID NO: 7414268 - DNA, 22 bp, Homo sapiens
atggacagctcttatgtgggca

SEQ ID NO: 7414269 - DNA, 22 bp, Homo sapiens
atggacagcaactggaagcttc

SEQ ID NO: 7414270 - DNA, 22 bp, Homo sapiens
atggacagctcttatgtgggca

SEQ ID NO: 7414271 - DNA, 22 bp, Homo sapiens
atggacagctcttatgtgggca

SEQ ID NO: 7414272 - DNA, 22 bp, Homo sapiens
atggacagctcttatgtgggca

SEQ ID NO: 7414273 - DNA, 22 bp, Homo sapiens
atggacagcaactggaagcttc

SEQ ID NO: 7414274 - DNA, 22 bp, Homo sapiens
atggacagcaactggaagcttc

SEQ ID NO: 7414275 - DNA, 22 bp, Homo sapiens
atggacagcaactggaagcttc

SEQ ID NO: 7414276 - DNA, 22 bp, Homo sapiens
atggaatgtttcctcttttatt

SEQ ID NO: 7414277 - DNA, 22 bp, Homo sapiens
atggaatgtttcctcttttatt

SEQ ID NO: 7414278 - DNA, 22 bp, Homo sapiens
atggaattaaaagtcaagtaat

SEQ ID NO: 7414279 - DNA, 22 bp, Homo sapiens
agagaagacttacagccacagt

SEQ ID NO: 7414280 - DNA, 22 bp, Homo sapiens
agagaagacttacagccacagt

SEQ ID NO: 7414281 - DNA, 22 bp, Homo sapiens
atggaatttctccggctccacc

SEQ ID NO: 7414282 - DNA, 22 bp, Homo sapiens
atggaattgaagacagcatagg

SEQ ID NO: 7414283 - DNA, 22 bp, Homo sapiens
atggaatttggagattaggcat

SEQ ID NO: 7414284 - DNA, 22 bp, Homo sapiens
atggaatttgcaataacaggat

SEQ ID NO: 7414285 - DNA, 22 bp, Homo sapiens
atggaatttggactggaagtcc

SEQ ID NO: 7414286 - DNA, 22 bp, Homo sapiens
atggacaaacagcaggttttgg

SEQ ID NO: 7414287 - DNA, 22 bp, Homo sapiens
atggacaatgccaatacagttt

SEQ ID NO: 7414288 - DNA, 21 bp, Homo sapiens
atggacaattgagtgtctgtc

SEQ ID NO: 7414289 - DNA, 22 bp, Homo sapiens
atggacacatgagttacgattg

SEQ ID NO: 7414290 - DNA, 22 bp, Homo sapiens
atggacaatgtgaaactacaag

SEQ ID NO: 7414291 - DNA, 21 bp, Homo sapiens
atggacaattgagtgtctgtc

SEQ ID NO: 7414292 - DNA, 21 bp, Homo sapiens
atggacaattgagtgtctgtc

SEQ ID NO: 7414293 - DNA, 22 bp, Homo sapiens
agagaacattagcaaaaacagc

SEQ ID NO: 7414294 - DNA, 22 bp, Homo sapiens
agagaacattagcaaaaacagc

SEQ ID NO: 7414295 - DNA, 22 bp, Homo sapiens
agagaacattagcaaaaacagc

SEQ ID NO: 7414296 - DNA, 22 bp, Homo sapiens
agagaacattagcaaaaacagc

SEQ ID NO: 7414297 - DNA, 22 bp, Homo sapiens
agagaacatgacgtaatagtgg

SEQ ID NO: 7414298 - DNA, 22 bp, Homo sapiens
agagaacatgacgtaatagtgg

SEQ ID NO: 7414299 - DNA, 22 bp, Homo sapiens
agagaacatgacgtaatagtgg

SEQ ID NO: 7414300 - DNA, 22 bp, Homo sapiens
agagaagacttacagccacagt

SEQ ID NO: 7414301 - DNA, 22 bp, Homo sapiens
agagaagacttacagccacagt

SEQ ID NO: 7414302 - DNA, 22 bp, Homo sapiens
agagaagacttacagccacagt

SEQ ID NO: 7414303 - DNA, 22 bp, Homo sapiens
agagaagacttacagccacagt

SEQ ID NO: 7414304 - DNA, 22 bp, Homo sapiens
agagaagacttacagccacagt

SEQ ID NO: 7414305 - DNA, 22 bp, Homo sapiens
agagaagacttacagccacagt

SEQ ID NO: 7414306 - DNA, 22 bp, Homo sapiens
agagaacttctcctaaatctca

SEQ ID NO: 7414307 - DNA, 22 bp, Homo sapiens
agagaactactttttatatgtg

SEQ ID NO: 7414308 - DNA, 22 bp, Homo sapiens
agagaactgtttctggggtctt

SEQ ID NO: 7414309 - DNA, 22 bp, Homo sapiens
agagaactgtttctggggtctt

SEQ ID NO: 7414310 - DNA, 22 bp, Homo sapiens
agagaacatattttgtatgatt

SEQ ID NO: 7414311 - DNA, 22 bp, Homo sapiens
agagaacagtgttttgaaggag

SEQ ID NO: 7414312 - DNA, 22 bp, Homo sapiens
agagaacagtgttttgaaggag

SEQ ID NO: 7414313 - DNA, 22 bp, Homo sapiens
agagaacatgacgtaatagtgg

SEQ ID NO: 7414314 - DNA, 22 bp, Homo sapiens
agagaacatattttgtatgatt

SEQ ID NO: 7414315 - DNA, 22 bp, Homo sapiens
agagaacatattttgtatgatt

SEQ ID NO: 7414316 - DNA, 22 bp, Homo sapiens
agagaacagcctcctagagaaa

SEQ ID NO: 7414317 - DNA, 22 bp, Homo sapiens
agagaacagcctcctagagaaa

SEQ ID NO: 7414318 - DNA, 22 bp, Homo sapiens
agagaacagcctcctagagaaa

SEQ ID NO: 7414319 - DNA, 22 bp, Homo sapiens
agagaacagcctcctagagaaa

SEQ ID NO: 7414320 - DNA, 22 bp, Homo sapiens
agagaacagcctcctagagaaa

SEQ ID NO: 7414321 - DNA, 22 bp, Homo sapiens
agagaacagcctcctagagaaa

SEQ ID NO: 7414322 - DNA, 22 bp, Homo sapiens
agagaacagcctcctagagaaa

SEQ ID NO: 7414323 - DNA, 22 bp, Homo sapiens
agagaacagcattgcagctttg

SEQ ID NO: 7414324 - DNA, 22 bp, Homo sapiens
agagaacagcctcctagagaaa

SEQ ID NO: 7414325 - DNA, 22 bp, Homo sapiens
agagaacagcattgcagctttg

SEQ ID NO: 7414326 - DNA, 22 bp, Homo sapiens
agagaacagcctcctagagaaa

SEQ ID NO: 7414327 - DNA, 22 bp, Homo sapiens
agagaacagcctcctagagaaa

SEQ ID NO: 7414328 - DNA, 22 bp, Homo sapiens
agagactgtacgtggcaagtat

SEQ ID NO: 7414329 - DNA, 22 bp, Homo sapiens
agagactgtacgtggcaagtat

SEQ ID NO: 7414330 - DNA, 22 bp, Homo sapiens
agagactgtcacataacagagg

SEQ ID NO: 7414331 - DNA, 22 bp, Homo sapiens
agagactgtcacataacagagg

SEQ ID NO: 7414332 - DNA, 21 bp, Homo sapiens
agagactgtcactgcagtacc

SEQ ID NO: 7414333 - DNA, 22 bp, Homo sapiens
agagactgtgccagccccatgc

SEQ ID NO: 7414334 - DNA, 21 bp, Homo sapiens
agagactgtcactgcagtacc

SEQ ID NO: 7414335 - DNA, 21 bp, Homo sapiens
agagactgtcactgcagtacc

SEQ ID NO: 7414336 - DNA, 21 bp, Homo sapiens
agagactgtcactgcagtacc

SEQ ID NO: 7414337 - DNA, 17 bp, Homo sapiens
agagagaaaagggccat

SEQ ID NO: 7414338 - DNA, 22 bp, Homo sapiens
agagactttgtctattttgttc

SEQ ID NO: 7414339 - DNA, 22 bp, Homo sapiens
agagacttctgccttagcaaga

SEQ ID NO: 7414340 - DNA, 22 bp, Homo sapiens
agagacttctgccttagcaaga

SEQ ID NO: 7414341 - DNA, 22 bp, Homo sapiens
agagacttctgccttagcaaga

SEQ ID NO: 7414342 - DNA, 22 bp, Homo sapiens
agagactgtgtccatcgtgcct

SEQ ID NO: 7414343 - DNA, 22 bp, Homo sapiens
agagacttaaaactgttttcac

SEQ ID NO: 7414344 - DNA, 22 bp, Homo sapiens
agagactgtgtccatcgtgcct

SEQ ID NO: 7414345 - DNA, 22 bp, Homo sapiens
agagagaagcaatcagtggcca

SEQ ID NO: 7414346 - DNA, 22 bp, Homo sapiens
agagagaagcaatcagtggcca

SEQ ID NO: 7414347 - DNA, 22 bp, Homo sapiens
agagagaagcaatcagtggcca

SEQ ID NO: 7414348 - DNA, 22 bp, Homo sapiens
agagagaagcaatcagtggcca

SEQ ID NO: 7414349 - DNA, 17 bp, Homo sapiens
agagagaaaagggccat

SEQ ID NO: 7414350 - DNA, 17 bp, Homo sapiens
agagagaaaagggccat

SEQ ID NO: 7414351 - DNA, 17 bp, Homo sapiens
agagagaaaagggccat

SEQ ID NO: 7414352 - DNA, 17 bp, Homo sapiens
agagagaaaagggccat

SEQ ID NO: 7414353 - DNA, 22 bp, Homo sapiens
agagagaacaccctcggcatgg

SEQ ID NO: 7414354 - DNA, 17 bp, Homo sapiens
agagagaaaagggccat

SEQ ID NO: 7414355 - DNA, 22 bp, Homo sapiens
atgtacatagcatcatctagga

SEQ ID NO: 7414356 - DNA, 22 bp, Homo sapiens
atgtacatagcatcatctagga

SEQ ID NO: 7414357 - DNA, 22 bp, Homo sapiens
atgtagggaactaaattcactg

SEQ ID NO: 7414358 - DNA, 22 bp, Homo sapiens
atgtaggattgagtgatagagg

SEQ ID NO: 7414359 - DNA, 22 bp, Homo sapiens
agagactgcaaatcataagaat

SEQ ID NO: 7414360 - DNA, 22 bp, Homo sapiens
agagactgcaaatcataagaat

SEQ ID NO: 7414361 - DNA, 22 bp, Homo sapiens
agagactgatggatcaccaaat

SEQ ID NO: 7414362 - DNA, 22 bp, Homo sapiens
atgggctctatgtctaggagat

SEQ ID NO: 7414363 - DNA, 22 bp, Homo sapiens
atgggctctatgtctaggagat

SEQ ID NO: 7414364 - DNA, 22 bp, Homo sapiens
agagactgatggagctcactct

SEQ ID NO: 7414365 - DNA, 22 bp, Homo sapiens
agagactgcaatgagtggtagg

SEQ ID NO: 7414366 - DNA, 22 bp, Homo sapiens
agagactgcaatgagtggtagg

SEQ ID NO: 7414367 - DNA, 22 bp, Homo sapiens
agagactgcaatgagtggtagg

SEQ ID NO: 7414368 - DNA, 22 bp, Homo sapiens
agagactgcaatgagtggtagg

SEQ ID NO: 7414369 - DNA, 21 bp, Homo sapiens
atgggccagggatacagagag

SEQ ID NO: 7414370 - DNA, 22 bp, Homo sapiens
atgggccttgacacatggagtg

SEQ ID NO: 7414371 - DNA, 22 bp, Homo sapiens
atgggccttgacacatggagtg

SEQ ID NO: 7414372 - DNA, 22 bp, Homo sapiens
atgggctaaacttagaggatat

SEQ ID NO: 7414373 - DNA, 22 bp, Homo sapiens
atgggctatcaaatggaggtat

SEQ ID NO: 7414374 - DNA, 22 bp, Homo sapiens
atgggctatcaaatggaggtat

SEQ ID NO: 7414375 - DNA, 19 bp, Homo sapiens
atgggctatggtgctgttt

SEQ ID NO: 7414376 - DNA, 22 bp, Homo sapiens
atgggctcggcgctgctgggat

SEQ ID NO: 7414377 - DNA, 22 bp, Homo sapiens
atgggctcggcgctgctgggat

SEQ ID NO: 7414378 - DNA, 22 bp, Homo sapiens
atgggctcggcgctgctgggat

SEQ ID NO: 7414379 - DNA, 22 bp, Homo sapiens
atgggctcggcgctgctgggat

SEQ ID NO: 7414380 - DNA, 22 bp, Homo sapiens
atgggctctatgtctaggagat

SEQ ID NO: 7414381 - DNA, 22 bp, Homo sapiens
atgggctctatgtctaggagat

SEQ ID NO: 7414382 - DNA, 22 bp, Homo sapiens
atgggctcggcgctgctgggat

SEQ ID NO: 7414383 - DNA, 22 bp, Homo sapiens
agagactggagatgggcagtgt

SEQ ID NO: 7414384 - DNA, 22 bp, Homo sapiens
agagactggagatgggcagtgt

SEQ ID NO: 7414385 - DNA, 22 bp, Homo sapiens
agagactggagatgggcagtgt

SEQ ID NO: 7414386 - DNA, 22 bp, Homo sapiens
agagactggagatgggcagtgt

SEQ ID NO: 7414387 - DNA, 22 bp, Homo sapiens
agagactgctttatattgtact

SEQ ID NO: 7414388 - DNA, 22 bp, Homo sapiens
agagactgcgtgtcagcgctgg

SEQ ID NO: 7414389 - DNA, 22 bp, Homo sapiens
agagactgcgtgtcagcgctgg

SEQ ID NO: 7414390 - DNA, 19 bp, Homo sapiens
agagactgccaccagctgt

SEQ ID NO: 7414391 - DNA, 19 bp, Homo sapiens
agagactgccaccagctgt

SEQ ID NO: 7414392 - DNA, 22 bp, Homo sapiens
agagactggcttctaaaatggc

SEQ ID NO: 7414393 - DNA, 22 bp, Homo sapiens
agagactggagttacgagttca

SEQ ID NO: 7414394 - DNA, 22 bp, Homo sapiens
agagactgcaatgagtggtagg

SEQ ID NO: 7414395 - DNA, 22 bp, Homo sapiens
agagactggagatgggcagtgt

SEQ ID NO: 7414396 - DNA, 22 bp, Homo sapiens
agagactggagatgggcagtgt

SEQ ID NO: 7414397 - DNA, 22 bp, Homo sapiens
agagactggagttacgagttca

SEQ ID NO: 7414398 - DNA, 22 bp, Homo sapiens
agagactggagttacgagttca

SEQ ID NO: 7414399 - DNA, 22 bp, Homo sapiens
agagactgtacgtggcaagtat

SEQ ID NO: 7414400 - DNA, 22 bp, Homo sapiens
agagactgtaatgagaggtaca

SEQ ID NO: 7414401 - DNA, 22 bp, Homo sapiens
agagactgtaatgagaggtaca

SEQ ID NO: 7414402 - DNA, 22 bp, Homo sapiens
agagactgtaatgagaggtaca

SEQ ID NO: 7414403 - DNA, 22 bp, Homo sapiens
agagactgtaatgagaggtaca

SEQ ID NO: 7414404 - DNA, 22 bp, Homo sapiens
agagactgtaatgagaggtaca

SEQ ID NO: 7414405 - DNA, 22 bp, Homo sapiens
atgtatatgtgaaagatgttta

SEQ ID NO: 7414406 - DNA, 22 bp, Homo sapiens
atgtatatgcatgcattcaaag

SEQ ID NO: 7414407 - DNA, 22 bp, Homo sapiens
atgtatatgcatgcattcaaag

SEQ ID NO: 7414408 - DNA, 17 bp, Homo sapiens
atgtatattaactctga

SEQ ID NO: 7414409 - DNA, 17 bp, Homo sapiens
atgtatattaactctga

SEQ ID NO: 7414410 - DNA, 22 bp, Homo sapiens
atgtatatgtgaaagatgttta

SEQ ID NO: 7414411 - DNA, 22 bp, Homo sapiens
agagatggcgtctcagagcctg

SEQ ID NO: 7414412 - DNA, 22 bp, Homo sapiens
agagatggcgtctcagagcctg

SEQ ID NO: 7414413 - DNA, 20 bp, Homo sapiens
atgtatattactggctgtga

SEQ ID NO: 7414414 - DNA, 20 bp, Homo sapiens
agagatggggtatcaccgta

SEQ ID NO: 7414415 - DNA, 22 bp, Homo sapiens
agagatggtagaacagtcataa

SEQ ID NO: 7414416 - DNA, 18 bp, Homo sapiens
agagatgggagttggaaa

SEQ ID NO: 7414417 - DNA, 22 bp, Homo sapiens
agagatgggcgggggcttctgc

SEQ ID NO: 7414418 - DNA, 22 bp, Homo sapiens
agagatgggcgggggcttctgc

SEQ ID NO: 7414419 - DNA, 18 bp, Homo sapiens
agagatgggagttggaaa

SEQ ID NO: 7414420 - DNA, 22 bp, Homo sapiens
agagatgggaaggcagacttca

SEQ ID NO: 7414421 - DNA, 22 bp, Homo sapiens
atgtatatgaagctagtatttt

SEQ ID NO: 7414422 - DNA, 22 bp, Homo sapiens
atgtatatgaagctagtatttt

SEQ ID NO: 7414423 - DNA, 22 bp, Homo sapiens
atgtatatgaagctagtatttt

SEQ ID NO: 7414424 - DNA, 22 bp, Homo sapiens
atgtatatacttacatgtgtgg

SEQ ID NO: 7414425 - DNA, 22 bp, Homo sapiens
atgtatatacttacatgtgtgg

SEQ ID NO: 7414426 - DNA, 22 bp, Homo sapiens
atgtatatacttacatgtgtgg

SEQ ID NO: 7414427 - DNA, 22 bp, Homo sapiens
atgtataatgctaattagctag

SEQ ID NO: 7414428 - DNA, 22 bp, Homo sapiens
atgtataatgctaattagctag

SEQ ID NO: 7414429 - DNA, 22 bp, Homo sapiens
atgtataatgctaattagctag

SEQ ID NO: 7414430 - DNA, 22 bp, Homo sapiens
atgtatacgtgcaggtcacagg

SEQ ID NO: 7414431 - DNA, 22 bp, Homo sapiens
atgtatacgtgcaagtcacagg

SEQ ID NO: 7414432 - DNA, 22 bp, Homo sapiens
atgtataggagttatctgttgt

SEQ ID NO: 7414433 - DNA, 22 bp, Homo sapiens
atgtataggagttatctgttgt

SEQ ID NO: 7414434 - DNA, 22 bp, Homo sapiens
atgtatagtggtgatgattaca

SEQ ID NO: 7414435 - DNA, 22 bp, Homo sapiens
atgtatagtggtgatgattaca

SEQ ID NO: 7414436 - DNA, 22 bp, Homo sapiens
atgtagtatttggaaatgtaaa

SEQ ID NO: 7414437 - DNA, 21 bp, Homo sapiens
atgtagtgacttcattccttc

SEQ ID NO: 7414438 - DNA, 21 bp, Homo sapiens
atgtagtgacttcattccttc

SEQ ID NO: 7414439 - DNA, 22 bp, Homo sapiens
atgtagtgccctttgtcatcta

SEQ ID NO: 7414440 - DNA, 22 bp, Homo sapiens
atgtagtgtagagattagtctc

SEQ ID NO: 7414441 - DNA, 22 bp, Homo sapiens
atgtagtgccctttgtcatcta

SEQ ID NO: 7414442 - DNA, 22 bp, Homo sapiens
atgtagtatctatatttcatgg

SEQ ID NO: 7414443 - DNA, 22 bp, Homo sapiens
atgtagtactgggtatgtttct

SEQ ID NO: 7414444 - DNA, 22 bp, Homo sapiens
atgtagtactgggtatgtttct

SEQ ID NO: 7414445 - DNA, 22 bp, Homo sapiens
atgtagttgaagtgctataaag

SEQ ID NO: 7414446 - DNA, 22 bp, Homo sapiens
atgtagttgaagtgctataaag

SEQ ID NO: 7414447 - DNA, 22 bp, Homo sapiens
atgtagtgtagagattagtctc

SEQ ID NO: 7414448 - DNA, 22 bp, Homo sapiens
atgtagtgtagagattagtctc

SEQ ID NO: 7414449 - DNA, 22 bp, Homo sapiens
atgtagttagaagattcaaaca

SEQ ID NO: 7414450 - DNA, 22 bp, Homo sapiens
atgtataagtacacagtcggaa

SEQ ID NO: 7414451 - DNA, 22 bp, Homo sapiens
atgtagttgaagtgctataaag

SEQ ID NO: 7414452 - DNA, 22 bp, Homo sapiens
atgtagtttggggctagattta

SEQ ID NO: 7414453 - DNA, 22 bp, Homo sapiens
atgtagttttggatggttgctg

SEQ ID NO: 7414454 - DNA, 22 bp, Homo sapiens
atgtagttgaagtgctataaag

SEQ ID NO: 7414455 - DNA, 22 bp, Homo sapiens
atgtagtttggggctagattta

SEQ ID NO: 7414456 - DNA, 22 bp, Homo sapiens
atgtagtttggggctagattta

SEQ ID NO: 7414457 - DNA, 22 bp, Homo sapiens
agagccaggatctgttttgggg

SEQ ID NO: 7414458 - DNA, 22 bp, Homo sapiens
agagccaggatctgttttgggg

SEQ ID NO: 7414459 - DNA, 22 bp, Homo sapiens
agagccaggatgtcttctgggg

SEQ ID NO: 7414460 - DNA, 22 bp, Homo sapiens
agagccaggatgtcttctgggg

SEQ ID NO: 7414461 - DNA, 22 bp, Homo sapiens
agagccaggatgtcttctgggg

SEQ ID NO: 7414462 - DNA, 22 bp, Homo sapiens
agagccaggatgtcttctgggg

SEQ ID NO: 7414463 - DNA, 22 bp, Homo sapiens
agagccaggactgtgtctcact

SEQ ID NO: 7414464 - DNA, 22 bp, Homo sapiens
agagccaggactgtgtctcact

SEQ ID NO: 7414465 - DNA, 22 bp, Homo sapiens
agagccaggactgtgtctcact

SEQ ID NO: 7414466 - DNA, 22 bp, Homo sapiens
agagccaggaagtggcgtgggg

SEQ ID NO: 7414467 - DNA, 22 bp, Homo sapiens
agagccaggactgtgtctcact

SEQ ID NO: 7414468 - DNA, 22 bp, Homo sapiens
agagccaggactgtgtctcact

SEQ ID NO: 7414469 - DNA, 22 bp, Homo sapiens
agagccaggactgtgtctcact

SEQ ID NO: 7414470 - DNA, 22 bp, Homo sapiens
agagccaggactgtgtctcact

SEQ ID NO: 7414471 - DNA, 22 bp, Homo sapiens
agagccaggaagtggcgtgggg

SEQ ID NO: 7414472 - DNA, 22 bp, Homo sapiens
agagccaggaagtggcgtgggg

SEQ ID NO: 7414473 - DNA, 22 bp, Homo sapiens
agagccaggaagtggcgtgggg

SEQ ID NO: 7414474 - DNA, 22 bp, Homo sapiens
agagccaggaagtggcgtgggg

SEQ ID NO: 7414475 - DNA, 22 bp, Homo sapiens
atgttacagaaagcaaagatga

SEQ ID NO: 7414476 - DNA, 22 bp, Homo sapiens
atgttacagaaagcaaagatga

SEQ ID NO: 7414477 - DNA, 22 bp, Homo sapiens
atgttacagaaagcaaagatga

SEQ ID NO: 7414478 - DNA, 22 bp, Homo sapiens
atgttacagaaagcaaagatga

SEQ ID NO: 7414479 - DNA, 22 bp, Homo sapiens
atgttacagaaagcaaagatga

SEQ ID NO: 7414480 - DNA, 22 bp, Homo sapiens
atgttattttggaaaatacaaa

SEQ ID NO: 7414481 - DNA, 22 bp, Homo sapiens
atgttattttggaaaatacaaa

SEQ ID NO: 7414482 - DNA, 22 bp, Homo sapiens
atgttacagaaactaagaggct

SEQ ID NO: 7414483 - DNA, 22 bp, Homo sapiens
atgttacagaaactaagaggct

SEQ ID NO: 7414484 - DNA, 22 bp, Homo sapiens
atgttacactgtttcacgttcc

SEQ ID NO: 7414485 - DNA, 22 bp, Homo sapiens
atgttacactgtttcacgttcc

SEQ ID NO: 7414486 - DNA, 22 bp, Homo sapiens
atgttacacataggcataaatg

SEQ ID NO: 7414487 - DNA, 22 bp, Homo sapiens
agagccaggcaggcaatgttga

SEQ ID NO: 7414488 - DNA, 22 bp, Homo sapiens
agagccaggcaggcaatgttga

SEQ ID NO: 7414489 - DNA, 22 bp, Homo sapiens
agagccaggcaggcaatgttga

SEQ ID NO: 7414490 - DNA, 22 bp, Homo sapiens
agagccaggatgtcttctgggg

SEQ ID NO: 7414491 - DNA, 22 bp, Homo sapiens
agagccaggatgtcttctgggg

SEQ ID NO: 7414492 - DNA, 22 bp, Homo sapiens
atgtgcagttggtggccaggag

SEQ ID NO: 7414493 - DNA, 22 bp, Homo sapiens
atgtgcatgtgcacacatgcgt

SEQ ID NO: 7414494 - DNA, 22 bp, Homo sapiens
atgtgcatgtgcacacatgcgt

SEQ ID NO: 7414495 - DNA, 22 bp, Homo sapiens
atgtgcatgcacttacatgtgt

SEQ ID NO: 7414496 - DNA, 22 bp, Homo sapiens
atgtgcatgcacttacatgtgt

SEQ ID NO: 7414497 - DNA, 22 bp, Homo sapiens
agagccagcaagtgaatagtga

SEQ ID NO: 7414498 - DNA, 22 bp, Homo sapiens
atgtgccaacgtgcaggtttgt

SEQ ID NO: 7414499 - DNA, 22 bp, Homo sapiens
atgtgcattaaatgtcaatgtt

SEQ ID NO: 7414500 - DNA, 22 bp, Homo sapiens
atgtgcattaaatgtcaatgtt

SEQ ID NO: 7414501 - DNA, 19 bp, Homo sapiens
atgtgcatttgtgtgaggt

SEQ ID NO: 7414502 - DNA, 22 bp, Homo sapiens
agagccagcatttgacactggc

SEQ ID NO: 7414503 - DNA, 22 bp, Homo sapiens
agagccagcatttgacactggc

SEQ ID NO: 7414504 - DNA, 22 bp, Homo sapiens
agagccagcatttgacactggc

SEQ ID NO: 7414505 - DNA, 22 bp, Homo sapiens
agagccagcatttgacactggc

SEQ ID NO: 7414506 - DNA, 22 bp, Homo sapiens
agagccagcatttgacactggc

SEQ ID NO: 7414507 - DNA, 22 bp, Homo sapiens
agagccagcatttgggccctgc

SEQ ID NO: 7414508 - DNA, 22 bp, Homo sapiens
agagccagcatttgggccctgc

SEQ ID NO: 7414509 - DNA, 22 bp, Homo sapiens
agagccagcatttgggccctgc

SEQ ID NO: 7414510 - DNA, 22 bp, Homo sapiens
agagccagcatttgggccctgc

SEQ ID NO: 7414511 - DNA, 22 bp, Homo sapiens
agagccagcatttgacactggc

SEQ ID NO: 7414512 - DNA, 22 bp, Homo sapiens
agagccagcatttgacactggc

SEQ ID NO: 7414513 - DNA, 22 bp, Homo sapiens
agagccagcatttgacactggc

SEQ ID NO: 7414514 - DNA, 22 bp, Homo sapiens
agagccagcatttgggccctgc

SEQ ID NO: 7414515 - DNA, 22 bp, Homo sapiens
agagccagcatttgggccctgc

SEQ ID NO: 7414516 - DNA, 22 bp, Homo sapiens
agagccagcatttgggccctgc

SEQ ID NO: 7414517 - DNA, 22 bp, Homo sapiens
agagccagccttctcagcttac

SEQ ID NO: 7414518 - DNA, 22 bp, Homo sapiens
agagccagccttctcagcttac

SEQ ID NO: 7414519 - DNA, 22 bp, Homo sapiens
agagccagcatttgggccctgc

SEQ ID NO: 7414520 - DNA, 22 bp, Homo sapiens
agagccagccttctcagcttac

SEQ ID NO: 7414521 - DNA, 22 bp, Homo sapiens
agagccaggaagtggcgtgggg

SEQ ID NO: 7414522 - DNA, 22 bp, Homo sapiens
agagccaggaagtggcgtgggg

SEQ ID NO: 7414523 - DNA, 22 bp, Homo sapiens
agagccaggaagtggcgtgggg

SEQ ID NO: 7414524 - DNA, 22 bp, Homo sapiens
agagccaggaagtggcgtgggg

SEQ ID NO: 7414525 - DNA, 22 bp, Homo sapiens
atgtgattcccactgaatcact

SEQ ID NO: 7414526 - DNA, 22 bp, Homo sapiens
atgtgattcccactgaatcact

SEQ ID NO: 7414527 - DNA, 22 bp, Homo sapiens
atgtcttgggtttcagtttact

SEQ ID NO: 7414528 - DNA, 22 bp, Homo sapiens
atgtcttgggtttcagtttact

SEQ ID NO: 7414529 - DNA, 22 bp, Homo sapiens
atgtgatactccttctagtgga

SEQ ID NO: 7414530 - DNA, 22 bp, Homo sapiens
atgtgagtgctatgatagacag

SEQ ID NO: 7414531 - DNA, 22 bp, Homo sapiens
atgtcttctgtggagacaggta

SEQ ID NO: 7414532 - DNA, 22 bp, Homo sapiens
atgtcttctgtggagacaggta

SEQ ID NO: 7414533 - DNA, 22 bp, Homo sapiens
atgtcttgatattttactgttt

SEQ ID NO: 7414534 - DNA, 22 bp, Homo sapiens
atgtcttgggtttcagtttact

SEQ ID NO: 7414535 - DNA, 22 bp, Homo sapiens
agagattctgtgtcaaaacgaa

SEQ ID NO: 7414536 - DNA, 22 bp, Homo sapiens
agagattaatactctataattt

SEQ ID NO: 7414537 - DNA, 22 bp, Homo sapiens
agagattagcctggattatgca

SEQ ID NO: 7414538 - DNA, 22 bp, Homo sapiens
agagattcatgtttactgtagg

SEQ ID NO: 7414539 - DNA, 22 bp, Homo sapiens
agagattcctttggggaaagca

SEQ ID NO: 7414540 - DNA, 22 bp, Homo sapiens
agagatggtagaacagtcataa

SEQ ID NO: 7414541 - DNA, 22 bp, Homo sapiens
agagatggtagaacagtcataa

SEQ ID NO: 7414542 - DNA, 18 bp, Homo sapiens
agagatggtgtagagttt

SEQ ID NO: 7414543 - DNA, 18 bp, Homo sapiens
agagatggtgtagagttt

SEQ ID NO: 7414544 - DNA, 18 bp, Homo sapiens
agagatggtgtagagttt

SEQ ID NO: 7414545 - DNA, 22 bp, Homo sapiens
agagatgttcattcagcatgtt

SEQ ID NO: 7414546 - DNA, 22 bp, Homo sapiens
agagattagcctggattatgca

SEQ ID NO: 7414547 - DNA, 22 bp, Homo sapiens
agagattaatactctataattt

SEQ ID NO: 7414548 - DNA, 22 bp, Homo sapiens
agagatgttcattcagcatgtt

SEQ ID NO: 7414549 - DNA, 22 bp, Homo sapiens
agagatgtcgccttgcccaggg

SEQ ID NO: 7414550 - DNA, 22 bp, Homo sapiens
agagatgtctgaccactagact

SEQ ID NO: 7414551 - DNA, 22 bp, Homo sapiens
agagatgtacagttacttatct

SEQ ID NO: 7414552 - DNA, 22 bp, Homo sapiens
agagatgtagcaaagaaccaca

SEQ ID NO: 7414553 - DNA, 22 bp, Homo sapiens
agagatgtagcaaagaaccaca

SEQ ID NO: 7414554 - DNA, 22 bp, Homo sapiens
atgtgcaaatccaatgtgaatg

SEQ ID NO: 7414555 - DNA, 22 bp, Homo sapiens
atgtgcaattattaagaagaga

SEQ ID NO: 7414556 - DNA, 22 bp, Homo sapiens
atgtgcacacagtgtcatgcaa

SEQ ID NO: 7414557 - DNA, 22 bp, Homo sapiens
atgtgcacacagtgtcatgcaa

SEQ ID NO: 7414558 - DNA, 22 bp, Homo sapiens
atgtgcaatggtgtcaccacat

SEQ ID NO: 7414559 - DNA, 22 bp, Homo sapiens
atgtgcaacttcagcagaaagg

SEQ ID NO: 7414560 - DNA, 22 bp, Homo sapiens
atgtgcagttggtggccaggag

SEQ ID NO: 7414561 - DNA, 22 bp, Homo sapiens
atgtgcataaacatattgttgg

SEQ ID NO: 7414562 - DNA, 22 bp, Homo sapiens
atgtgcagttggtggccaggag

SEQ ID NO: 7414563 - DNA, 22 bp, Homo sapiens
atgtgcagttggtggccaggag

SEQ ID NO: 7414564 - DNA, 22 bp, Homo sapiens
atgtgcatactcttggccagct

SEQ ID NO: 7414565 - DNA, 22 bp, Homo sapiens
atgtgcatactcttggccagct

SEQ ID NO: 7414566 - DNA, 22 bp, Homo sapiens
atgtgcatgcacctggactgtg

SEQ ID NO: 7414567 - DNA, 22 bp, Homo sapiens
atgtgcatgcacttacatgtgt

SEQ ID NO: 7414568 - DNA, 22 bp, Homo sapiens
atgtgcatgcacttacatgtgt

SEQ ID NO: 7414569 - DNA, 22 bp, Homo sapiens
atgtgcagcctttcttcatcat

SEQ ID NO: 7414570 - DNA, 21 bp, Homo sapiens
atgtgcagcaagcagcatgct

SEQ ID NO: 7414571 - DNA, 21 bp, Homo sapiens
atgtgcagcaagcagcatgct

SEQ ID NO: 7414572 - DNA, 22 bp, Homo sapiens
atgtgcagaggcttccttgact

SEQ ID NO: 7414573 - DNA, 22 bp, Homo sapiens
atgtgcagacctgggttagaac

SEQ ID NO: 7414574 - DNA, 22 bp, Homo sapiens
atgtgcacggtgtcaaacgggg

SEQ ID NO: 7414575 - DNA, 22 bp, Homo sapiens
atgtgcagacctgggttagaac

SEQ ID NO: 7414576 - DNA, 22 bp, Homo sapiens
atgtgcagacctgggttagaac

SEQ ID NO: 7414577 - DNA, 23 bp, Homo sapiens
atgtgcacatctccttgtccacc

SEQ ID NO: 7414578 - DNA, 23 bp, Homo sapiens
atgtgcacatctccttgtccacc

SEQ ID NO: 7414579 - DNA, 22 bp, Homo sapiens
atgtgcacagtgctttttccca

SEQ ID NO: 7414580 - DNA, 22 bp, Homo sapiens
atgtgcacagtgctttttccca

SEQ ID NO: 7414581 - DNA, 22 bp, Homo sapiens
atgtgcagcttttctagagaag

SEQ ID NO: 7414582 - DNA, 21 bp, Homo sapiens
atgtgcagcaagcagcatgct

SEQ ID NO: 7414583 - DNA, 21 bp, Homo sapiens
atgtgcagcaagcagcatgct

SEQ ID NO: 7414584 - DNA, 22 bp, Homo sapiens
attaagtgactaaagtaatgct

SEQ ID NO: 7414585 - DNA, 22 bp, Homo sapiens
attaagtgactaaagtaatgct

SEQ ID NO: 7414586 - DNA, 22 bp, Homo sapiens
attaagtgactaaagtaatgct

SEQ ID NO: 7414587 - DNA, 22 bp, Homo sapiens
attaagtgttttacatacatta

SEQ ID NO: 7414588 - DNA, 22 bp, Homo sapiens
attaagtgtgacatgctgctct

SEQ ID NO: 7414589 - DNA, 22 bp, Homo sapiens
attaagtgtgacatgctgctct

SEQ ID NO: 7414590 - DNA, 22 bp, Homo sapiens
attaagtgtcaggcagggagtg

SEQ ID NO: 7414591 - DNA, 22 bp, Homo sapiens
attaagtgactaaagtaatgct

SEQ ID NO: 7414592 - DNA, 22 bp, Homo sapiens
attaagtgactaaagtaatgct

SEQ ID NO: 7414593 - DNA, 22 bp, Homo sapiens
attaagtgactaaagtaatgct

SEQ ID NO: 7414594 - DNA, 22 bp, Homo sapiens
attaagtgactaaagtaatgct

SEQ ID NO: 7414595 - DNA, 22 bp, Homo sapiens
attaagtgactaaagtaatgct

SEQ ID NO: 7414596 - DNA, 22 bp, Homo sapiens
attaaggtgtcaatgtatttgg

SEQ ID NO: 7414597 - DNA, 22 bp, Homo sapiens
attaaggctgcactggccttaa

SEQ ID NO: 7414598 - DNA, 22 bp, Homo sapiens
attaaggctgcactggccttaa

SEQ ID NO: 7414599 - DNA, 22 bp, Homo sapiens
attaaggctgcactggccttaa

SEQ ID NO: 7414600 - DNA, 22 bp, Homo sapiens
attaaggcgttggcgtgcttat

SEQ ID NO: 7414601 - DNA, 22 bp, Homo sapiens
attaaggctcccatttccaatt

SEQ ID NO: 7414602 - DNA, 22 bp, Homo sapiens
attaaggctcccatttccaatt

SEQ ID NO: 7414603 - DNA, 18 bp, Homo sapiens
attaaggctttgatagta

SEQ ID NO: 7414604 - DNA, 18 bp, Homo sapiens
attaaggctttgatagta

SEQ ID NO: 7414605 - DNA, 18 bp, Homo sapiens
attaaggctttgatagta

SEQ ID NO: 7414606 - DNA, 18 bp, Homo sapiens
attaaggctttgatagta

SEQ ID NO: 7414607 - DNA, 22 bp, Homo sapiens
attaaggaatgtaggcaagaag

SEQ ID NO: 7414608 - DNA, 22 bp, Homo sapiens
attaaggaagcctattctctcc

SEQ ID NO: 7414609 - DNA, 22 bp, Homo sapiens
attaaggaagcctattctctcc

SEQ ID NO: 7414610 - DNA, 22 bp, Homo sapiens
attaaggaagcctattctctcc

SEQ ID NO: 7414611 - DNA, 22 bp, Homo sapiens
attaaggaatgtaggcaagaag

SEQ ID NO: 7414612 - DNA, 22 bp, Homo sapiens
attaaggaatgtaggcaagaag

SEQ ID NO: 7414613 - DNA, 18 bp, Homo sapiens
attaaggaattctttaga

SEQ ID NO: 7414614 - DNA, 22 bp, Homo sapiens
attaaggcacttgagcatgatg

SEQ ID NO: 7414615 - DNA, 22 bp, Homo sapiens
attaaggattatactctccttt

SEQ ID NO: 7414616 - DNA, 22 bp, Homo sapiens
attaaggcacttgagcatgatg

SEQ ID NO: 7414617 - DNA, 22 bp, Homo sapiens
attaaggcacttgagcatgatg

SEQ ID NO: 7414618 - DNA, 22 bp, Homo sapiens
attaaggcgttggcgtgcttat

SEQ ID NO: 7414619 - DNA, 22 bp, Homo sapiens
attaaggcgttggcgtgcttat

SEQ ID NO: 7414620 - DNA, 22 bp, Homo sapiens
attaaggaggtaaactatggtt

SEQ ID NO: 7414621 - DNA, 22 bp, Homo sapiens
attaaggagggctgggcatgat

SEQ ID NO: 7414622 - DNA, 22 bp, Homo sapiens
attaaggaggtaaactatggtt

SEQ ID NO: 7414623 - DNA, 18 bp, Homo sapiens
attaaggaattctttaga

SEQ ID NO: 7414624 - DNA, 18 bp, Homo sapiens
attaaggaattctttaga

SEQ ID NO: 7414625 - DNA, 22 bp, Homo sapiens
attaaggagggctgggcatgat

SEQ ID NO: 7414626 - DNA, 22 bp, Homo sapiens
attaaggaagcctattctctcc

SEQ ID NO: 7414627 - DNA, 22 bp, Homo sapiens
attaaggaacaaagccttttga

SEQ ID NO: 7414628 - DNA, 22 bp, Homo sapiens
attaagctggtccagacaagtt

SEQ ID NO: 7414629 - DNA, 22 bp, Homo sapiens
attaagctctccaggaaatgta

SEQ ID NO: 7414630 - DNA, 22 bp, Homo sapiens
attaaatactgcaggctaagca

SEQ ID NO: 7414631 - DNA, 22 bp, Homo sapiens
attaaatactgcaggctaagca

SEQ ID NO: 7414632 - DNA, 22 bp, Homo sapiens
attaaatactgcaggctaagca

SEQ ID NO: 7414633 - DNA, 22 bp, Homo sapiens
agagctcctgcattcttccctg

SEQ ID NO: 7414634 - DNA, 22 bp, Homo sapiens
agagctcctgcattcttccctg

SEQ ID NO: 7414635 - DNA, 22 bp, Homo sapiens
agagctctcaatggtcaatgct

SEQ ID NO: 7414636 - DNA, 22 bp, Homo sapiens
agagctctgcagctggcctcag

SEQ ID NO: 7414637 - DNA, 22 bp, Homo sapiens
agagctctgcagctggcctcag

SEQ ID NO: 7414638 - DNA, 22 bp, Homo sapiens
agagctctgcagctggcctcag

SEQ ID NO: 7414639 - DNA, 22 bp, Homo sapiens
agagctctgtgtctctttgggt

SEQ ID NO: 7414640 - DNA, 22 bp, Homo sapiens
agagctctggcctattggggcc

SEQ ID NO: 7414641 - DNA, 22 bp, Homo sapiens
agagctctgtgtctctttgggt

SEQ ID NO: 7414642 - DNA, 22 bp, Homo sapiens
agagctctggcctattggggcc

SEQ ID NO: 7414643 - DNA, 22 bp, Homo sapiens
agagctctgcagctggcctcag

SEQ ID NO: 7414644 - DNA, 22 bp, Homo sapiens
agagctcctaaatgtagccaac

SEQ ID NO: 7414645 - DNA, 22 bp, Homo sapiens
agagctccgtgcctggctgcca

SEQ ID NO: 7414646 - DNA, 22 bp, Homo sapiens
agagctccgtgcctggctgcca

SEQ ID NO: 7414647 - DNA, 22 bp, Homo sapiens
agagctcctcacttcgggttca

SEQ ID NO: 7414648 - DNA, 22 bp, Homo sapiens
agagctctcaatggtcaatgct

SEQ ID NO: 7414649 - DNA, 22 bp, Homo sapiens
agagctccaagaagtcctgcag

SEQ ID NO: 7414650 - DNA, 22 bp, Homo sapiens
agagctccaagaagtcctgcag

SEQ ID NO: 7414651 - DNA, 22 bp, Homo sapiens
agagctccagggttttgtagtg

SEQ ID NO: 7414652 - DNA, 22 bp, Homo sapiens
agagctcccgagacaatgtatt

SEQ ID NO: 7414653 - DNA, 22 bp, Homo sapiens
agagctcccgagacaatgtatt

SEQ ID NO: 7414654 - DNA, 22 bp, Homo sapiens
agagctccagggttttgtagtg

SEQ ID NO: 7414655 - DNA, 22 bp, Homo sapiens
agagctatatacagattattga

SEQ ID NO: 7414656 - DNA, 22 bp, Homo sapiens
agagctcaagacgctcacagta

SEQ ID NO: 7414657 - DNA, 22 bp, Homo sapiens
agagctatgatcaaggcagggt

SEQ ID NO: 7414658 - DNA, 22 bp, Homo sapiens
agagctatttcttaaaagctgt

SEQ ID NO: 7414659 - DNA, 22 bp, Homo sapiens
agagctatttcttaaaagctgt

SEQ ID NO: 7414660 - DNA, 21 bp, Homo sapiens
agagctcaaggcaaaaataat

SEQ ID NO: 7414661 - DNA, 22 bp, Homo sapiens
agagctcaagacgctcacagta

SEQ ID NO: 7414662 - DNA, 22 bp, Homo sapiens
agagctcaagacgctcacagta

SEQ ID NO: 7414663 - DNA, 22 bp, Homo sapiens
agagctcaagacgctcacagta

SEQ ID NO: 7414664 - DNA, 22 bp, Homo sapiens
agagctcagtgtgttatggtta

SEQ ID NO: 7414665 - DNA, 22 bp, Homo sapiens
agagcggggatagttaatattc

SEQ ID NO: 7414666 - DNA, 22 bp, Homo sapiens
agagctaagaaacagaattgct

SEQ ID NO: 7414667 - DNA, 22 bp, Homo sapiens
agagctaagaaacagaattgct

SEQ ID NO: 7414668 - DNA, 22 bp, Homo sapiens
agagctaagaaacagaattgct

SEQ ID NO: 7414669 - DNA, 22 bp, Homo sapiens
agagcggggatagttaatattc

SEQ ID NO: 7414670 - DNA, 22 bp, Homo sapiens
agagcggggatagttaatattc

SEQ ID NO: 7414671 - DNA, 22 bp, Homo sapiens
agagcggggatagttaatattc

SEQ ID NO: 7414672 - DNA, 22 bp, Homo sapiens
agagctagcaaatagagcttca

SEQ ID NO: 7414673 - DNA, 22 bp, Homo sapiens
agagctactgtccagttgctac

SEQ ID NO: 7414674 - DNA, 22 bp, Homo sapiens
agagctactgtccagttgctac

SEQ ID NO: 7414675 - DNA, 22 bp, Homo sapiens
agagctaagaaacagaattgct

SEQ ID NO: 7414676 - DNA, 22 bp, Homo sapiens
agagctaaatcagactttcttt

SEQ ID NO: 7414677 - DNA, 22 bp, Homo sapiens
agagcgagtctggggctcggat

SEQ ID NO: 7414678 - DNA, 22 bp, Homo sapiens
agagccttgaagatctggaaaa

SEQ ID NO: 7414679 - DNA, 20 bp, Homo sapiens
agagccttgaggaagatgat

SEQ ID NO: 7414680 - DNA, 20 bp, Homo sapiens
agagccttgaggaagatgat

SEQ ID NO: 7414681 - DNA, 22 bp, Homo sapiens
atgttcctttaaaatatagatt

SEQ ID NO: 7414682 - DNA, 22 bp, Homo sapiens
atgttctacagatggaaagggg

SEQ ID NO: 7414683 - DNA, 22 bp, Homo sapiens
atgttctacagatggaaagggg

SEQ ID NO: 7414684 - DNA, 22 bp, Homo sapiens
atgttctacagatggaaagggg

SEQ ID NO: 7414685 - DNA, 22 bp, Homo sapiens
atgttctaatccctgctatgta

SEQ ID NO: 7414686 - DNA, 22 bp, Homo sapiens
atgttctaatccctgctatgta

SEQ ID NO: 7414687 - DNA, 22 bp, Homo sapiens
atgttctacagatggaaagggg

SEQ ID NO: 7414688 - DNA, 22 bp, Homo sapiens
atgttctacagatggaaagggg

SEQ ID NO: 7414689 - DNA, 22 bp, Homo sapiens
atgttctacagatggaaagggg

SEQ ID NO: 7414690 - DNA, 22 bp, Homo sapiens
atgttctacagatggaaagggg

SEQ ID NO: 7414691 - DNA, 22 bp, Homo sapiens
atgttctacagatggaaagggg

SEQ ID NO: 7414692 - DNA, 22 bp, Homo sapiens
atgttctacagatggaaagggg

SEQ ID NO: 7414693 - DNA, 22 bp, Homo sapiens
atgttctacagatggaaagggg

SEQ ID NO: 7414694 - DNA, 22 bp, Homo sapiens
atgttctacagatggaaagggg

SEQ ID NO: 7414695 - DNA, 22 bp, Homo sapiens
atgttctatatcattattgtga

SEQ ID NO: 7414696 - DNA, 22 bp, Homo sapiens
atgttctatatcattattgtga

SEQ ID NO: 7414697 - DNA, 19 bp, Homo sapiens
atgttctatcctccaagtt

SEQ ID NO: 7414698 - DNA, 22 bp, Homo sapiens
atgttctatatcattattgtga

SEQ ID NO: 7414699 - DNA, 22 bp, Homo sapiens
atgttctacagatggaaagggg

SEQ ID NO: 7414700 - DNA, 22 bp, Homo sapiens
agagcctgttttgtgggagatg

SEQ ID NO: 7414701 - DNA, 22 bp, Homo sapiens
atgttccttccagagagcagaa

SEQ ID NO: 7414702 - DNA, 22 bp, Homo sapiens
atgttccttccagagagcagaa

SEQ ID NO: 7414703 - DNA, 22 bp, Homo sapiens
atgttcctggtatatcatgacc

SEQ ID NO: 7414704 - DNA, 22 bp, Homo sapiens
atgttcctgatcctcgttctat

SEQ ID NO: 7414705 - DNA, 22 bp, Homo sapiens
atgttcccaagggatagaaaga

SEQ ID NO: 7414706 - DNA, 22 bp, Homo sapiens
atgttcattttcttaatgtgcc

SEQ ID NO: 7414707 - DNA, 22 bp, Homo sapiens
atgttcctcactattttggccc

SEQ ID NO: 7414708 - DNA, 22 bp, Homo sapiens
atgttcatcaacacattacaag

SEQ ID NO: 7414709 - DNA, 22 bp, Homo sapiens
atgttcatgattggttttggcg

SEQ ID NO: 7414710 - DNA, 22 bp, Homo sapiens
atgttcatgtggctgctggcag

SEQ ID NO: 7414711 - DNA, 22 bp, Homo sapiens
atgttcattagtcaacatttct

SEQ ID NO: 7414712 - DNA, 22 bp, Homo sapiens
atgttcatttgacaagtagtga

SEQ ID NO: 7414713 - DNA, 22 bp, Homo sapiens
atgttcagcattctataaatat

SEQ ID NO: 7414714 - DNA, 22 bp, Homo sapiens
atgttcagcattctataaatat

SEQ ID NO: 7414715 - DNA, 22 bp, Homo sapiens
atgttcagcattctataaatat

SEQ ID NO: 7414716 - DNA, 22 bp, Homo sapiens
atgttcagtgcagtggcctgag

SEQ ID NO: 7414717 - DNA, 22 bp, Homo sapiens
atgttcagttagcactgaagtc

SEQ ID NO: 7414718 - DNA, 22 bp, Homo sapiens
atgttcagttagcactgaagtc

SEQ ID NO: 7414719 - DNA, 22 bp, Homo sapiens
atgttcagcattctataaatat

SEQ ID NO: 7414720 - DNA, 22 bp, Homo sapiens
atgttcatatccccattctgat

SEQ ID NO: 7414721 - DNA, 18 bp, Homo sapiens
atgttcatatttttaggg

SEQ ID NO: 7414722 - DNA, 22 bp, Homo sapiens
atgttcaaactttttacacacc

SEQ ID NO: 7414723 - DNA, 22 bp, Homo sapiens
atgttcaaactttttacacacc

SEQ ID NO: 7414724 - DNA, 22 bp, Homo sapiens
atgttcacaaagactctgtaag

SEQ ID NO: 7414725 - DNA, 22 bp, Homo sapiens
atgttcaagtacctttgtgtct

SEQ ID NO: 7414726 - DNA, 22 bp, Homo sapiens
atgttcaaagatcgtgctatcc

SEQ ID NO: 7414727 - DNA, 22 bp, Homo sapiens
atcttacactgttgggtttctc

SEQ ID NO: 7414728 - DNA, 22 bp, Homo sapiens
atcttacacgataactgttagt

SEQ ID NO: 7414729 - DNA, 22 bp, Homo sapiens
atcttacacgataactgttagt

SEQ ID NO: 7414730 - DNA, 22 bp, Homo sapiens
atcttacacgataactgttagt

SEQ ID NO: 7414731 - DNA, 22 bp, Homo sapiens
atcttacacgataactgttagt

SEQ ID NO: 7414732 - DNA, 22 bp, Homo sapiens
atcttacagcagcaaggaagta

SEQ ID NO: 7414733 - DNA, 22 bp, Homo sapiens
atcttacagcagcaaggaagta

SEQ ID NO: 7414734 - DNA, 19 bp, Homo sapiens
atcttacagagcagagtac

SEQ ID NO: 7414735 - DNA, 19 bp, Homo sapiens
atcttacagagcagagtac

SEQ ID NO: 7414736 - DNA, 19 bp, Homo sapiens
atcttacagagcagagtac

SEQ ID NO: 7414737 - DNA, 22 bp, Homo sapiens
atcttaatcgagtccatgaaaa

SEQ ID NO: 7414738 - DNA, 22 bp, Homo sapiens
atcttaatcgagtccatgaaaa

SEQ ID NO: 7414739 - DNA, 22 bp, Homo sapiens
atcttacacgataactgttagt

SEQ ID NO: 7414740 - DNA, 22 bp, Homo sapiens
atcttacacgataactgttagt

SEQ ID NO: 7414741 - DNA, 22 bp, Homo sapiens
atcttacacgataactgttagt

SEQ ID NO: 7414742 - DNA, 22 bp, Homo sapiens
atcttacaattacaagacactc

SEQ ID NO: 7414743 - DNA, 22 bp, Homo sapiens
atcttacaattacaagacactc

SEQ ID NO: 7414744 - DNA, 22 bp, Homo sapiens
atcttacaattacaagacactc

SEQ ID NO: 7414745 - DNA, 22 bp, Homo sapiens
atcttacaattacaagacactc

SEQ ID NO: 7414746 - DNA, 22 bp, Homo sapiens
atcttacaattacaagacactc

SEQ ID NO: 7414747 - DNA, 22 bp, Homo sapiens
atcttagaagtttgataaaatc

SEQ ID NO: 7414748 - DNA, 22 bp, Homo sapiens
atcttagagagtcgtgttttgt

SEQ ID NO: 7414749 - DNA, 22 bp, Homo sapiens
atcttagacccttggtagaaaa

SEQ ID NO: 7414750 - DNA, 23 bp, Homo sapiens
atcttacatatttagcacctgaa

SEQ ID NO: 7414751 - DNA, 22 bp, Homo sapiens
atcttacattccctcaccattt

SEQ ID NO: 7414752 - DNA, 22 bp, Homo sapiens
atcttacattccctcaccattt

SEQ ID NO: 7414753 - DNA, 22 bp, Homo sapiens
atcttacattccctcaccattt

SEQ ID NO: 7414754 - DNA, 23 bp, Homo sapiens
atcttacatatttagcacctgaa

SEQ ID NO: 7414755 - DNA, 22 bp, Homo sapiens
atgacaatatagctttgatttt

SEQ ID NO: 7414756 - DNA, 22 bp, Homo sapiens
atgacaatacttcaataagctg

SEQ ID NO: 7414757 - DNA, 22 bp, Homo sapiens
atgacaatacttcaataagctg

SEQ ID NO: 7414758 - DNA, 22 bp, Homo sapiens
atgacaatacttcaataagctg

SEQ ID NO: 7414759 - DNA, 22 bp, Homo sapiens
atcttagagagtcgtgttttgt

SEQ ID NO: 7414760 - DNA, 19 bp, Homo sapiens
atgactcttattgtctgaa

SEQ ID NO: 7414761 - DNA, 22 bp, Homo sapiens
atgactctgctgaggcacccgg

SEQ ID NO: 7414762 - DNA, 19 bp, Homo sapiens
atgactcttattgtctgaa

SEQ ID NO: 7414763 - DNA, 22 bp, Homo sapiens
atgactgctctgggctcccatg

SEQ ID NO: 7414764 - DNA, 22 bp, Homo sapiens
atgactgaagggttttaaacag

SEQ ID NO: 7414765 - DNA, 22 bp, Homo sapiens
atgactgattacccaagcctct

SEQ ID NO: 7414766 - DNA, 22 bp, Homo sapiens
atgacttattacaagtcatatt

SEQ ID NO: 7414767 - DNA, 22 bp, Homo sapiens
atgactagaggagggatggcca

SEQ ID NO: 7414768 - DNA, 22 bp, Homo sapiens
atgactaatggaaaatacaatg

SEQ ID NO: 7414769 - DNA, 21 bp, Homo sapiens
atgacctgggaagatgctcaa

SEQ ID NO: 7414770 - DNA, 22 bp, Homo sapiens
atgactcaaaattattgttttg

SEQ ID NO: 7414771 - DNA, 22 bp, Homo sapiens
atgactctccagagctgcagat

SEQ ID NO: 7414772 - DNA, 22 bp, Homo sapiens
atgacctgaggccttactctag

SEQ ID NO: 7414773 - DNA, 21 bp, Homo sapiens
atgacctgggaagatgctcaa

SEQ ID NO: 7414774 - DNA, 22 bp, Homo sapiens
atgacccttactgcatcataca

SEQ ID NO: 7414775 - DNA, 22 bp, Homo sapiens
atgacccctaaaatttactgtc

SEQ ID NO: 7414776 - DNA, 22 bp, Homo sapiens
atgacccctaaaatttactgtc

SEQ ID NO: 7414777 - DNA, 22 bp, Homo sapiens
atgaccagccgagataaacaga

SEQ ID NO: 7414778 - DNA, 22 bp, Homo sapiens
atgaccagccgagataaacaga

SEQ ID NO: 7414779 - DNA, 22 bp, Homo sapiens
atgacatttatacagtgagctt

SEQ ID NO: 7414780 - DNA, 22 bp, Homo sapiens
atgaccagactctcagtggggt

SEQ ID NO: 7414781 - DNA, 22 bp, Homo sapiens
atgaccagactctcagtggggt

SEQ ID NO: 7414782 - DNA, 22 bp, Homo sapiens
atgacaatatagctttgatttt

SEQ ID NO: 7414783 - DNA, 22 bp, Homo sapiens
atgacattgacagacctgctgc

SEQ ID NO: 7414784 - DNA, 22 bp, Homo sapiens
atgacatttatacagtgagctt

SEQ ID NO: 7414785 - DNA, 22 bp, Homo sapiens
atgaccagccgagataaacaga

SEQ ID NO: 7414786 - DNA, 22 bp, Homo sapiens
atgaccagccgagataaacaga

SEQ ID NO: 7414787 - DNA, 22 bp, Homo sapiens
atgacattgacagacctgctgc

SEQ ID NO: 7414788 - DNA, 22 bp, Homo sapiens
atgaccagccgagataaacaga

SEQ ID NO: 7414789 - DNA, 22 bp, Homo sapiens
atgaccagccgagataaacaga

SEQ ID NO: 7414790 - DNA, 22 bp, Homo sapiens
atgaccagtgttgctggccccg

SEQ ID NO: 7414791 - DNA, 22 bp, Homo sapiens
atgaccagtgttgctggccccg

SEQ ID NO: 7414792 - DNA, 22 bp, Homo sapiens
atgaccagtgttgctggccccg

SEQ ID NO: 7414793 - DNA, 22 bp, Homo sapiens
atgaccagccgagataaacaga

SEQ ID NO: 7414794 - DNA, 19 bp, Homo sapiens
atgaccagttccatgccct

SEQ ID NO: 7414795 - DNA, 19 bp, Homo sapiens
atgaccagttccatgccct

SEQ ID NO: 7414796 - DNA, 22 bp, Homo sapiens
atgaccagtttccccactgtcc

SEQ ID NO: 7414797 - DNA, 22 bp, Homo sapiens
atgaccagtttccccactgtcc

SEQ ID NO: 7414798 - DNA, 22 bp, Homo sapiens
atgaccagtttccccactgtcc

SEQ ID NO: 7414799 - DNA, 22 bp, Homo sapiens
atgacccaagctcatggctccc

SEQ ID NO: 7414800 - DNA, 22 bp, Homo sapiens
atgaccagtttccccactgtcc

SEQ ID NO: 7414801 - DNA, 22 bp, Homo sapiens
atctggggcctgggctagccat

SEQ ID NO: 7414802 - DNA, 22 bp, Homo sapiens
atctggggcctgggctagccat

SEQ ID NO: 7414803 - DNA, 22 bp, Homo sapiens
atctggggcctgggctagccat

SEQ ID NO: 7414804 - DNA, 22 bp, Homo sapiens
atctggggccccggaagttcct

SEQ ID NO: 7414805 - DNA, 22 bp, Homo sapiens
atctggggccccggaagttcct

SEQ ID NO: 7414806 - DNA, 22 bp, Homo sapiens
atctggggccccggaagttcct

SEQ ID NO: 7414807 - DNA, 22 bp, Homo sapiens
atctggggaggtatctgtagtc

SEQ ID NO: 7414808 - DNA, 22 bp, Homo sapiens
atctggggaggtatctgtagtc

SEQ ID NO: 7414809 - DNA, 22 bp, Homo sapiens
atctggggaggtatctgtagtc

SEQ ID NO: 7414810 - DNA, 22 bp, Homo sapiens
atctgggctcgaatcctagctc

SEQ ID NO: 7414811 - DNA, 22 bp, Homo sapiens
atctgggctcgaatcctagctc

SEQ ID NO: 7414812 - DNA, 22 bp, Homo sapiens
atctgggggagctgctcatgga

SEQ ID NO: 7414813 - DNA, 22 bp, Homo sapiens
atctgggggagctgctcatgga

SEQ ID NO: 7414814 - DNA, 22 bp, Homo sapiens
atctgggggagctgctcatgga

SEQ ID NO: 7414815 - DNA, 22 bp, Homo sapiens
atctgggggagctgctcatgga

SEQ ID NO: 7414816 - DNA, 22 bp, Homo sapiens
atctggggcctgggctagccat

SEQ ID NO: 7414817 - DNA, 22 bp, Homo sapiens
atctgggggagctgctcatgga

SEQ ID NO: 7414818 - DNA, 22 bp, Homo sapiens
atctggggtcagacagccctgg

SEQ ID NO: 7414819 - DNA, 22 bp, Homo sapiens
atctggggtcagacagccctgg

SEQ ID NO: 7414820 - DNA, 22 bp, Homo sapiens
atctgggtccaagttctgagca

SEQ ID NO: 7414821 - DNA, 22 bp, Homo sapiens
atctgggtctggctcttaagtc

SEQ ID NO: 7414822 - DNA, 22 bp, Homo sapiens
atctgggtaaagtggtatattt

SEQ ID NO: 7414823 - DNA, 22 bp, Homo sapiens
atctggggtcagacagccctgg

SEQ ID NO: 7414824 - DNA, 22 bp, Homo sapiens
atctgggttccctcccccaatt

SEQ ID NO: 7414825 - DNA, 22 bp, Homo sapiens
atctgggtgtggaatatatagg

SEQ ID NO: 7414826 - DNA, 22 bp, Homo sapiens
atctgttgttttctcatatgtt

SEQ ID NO: 7414827 - DNA, 22 bp, Homo sapiens
atctgttgtttttcaccaccca

SEQ ID NO: 7414828 - DNA, 22 bp, Homo sapiens
atctgttgtttgtttgctaaag

SEQ ID NO: 7414829 - DNA, 22 bp, Homo sapiens
atctgtttaattcattttcaca

SEQ ID NO: 7414830 - DNA, 22 bp, Homo sapiens
atctgttgtttttcaccaccca

SEQ ID NO: 7414831 - DNA, 21 bp, Homo sapiens
atcttaaaaggtcttaacttt

SEQ ID NO: 7414832 - DNA, 22 bp, Homo sapiens
atcttaaacagaggaatgactt

SEQ ID NO: 7414833 - DNA, 22 bp, Homo sapiens
atcttaaacagaggaatgactt

SEQ ID NO: 7414834 - DNA, 22 bp, Homo sapiens
atcttaaacagaggaatgactt

SEQ ID NO: 7414835 - DNA, 21 bp, Homo sapiens
atcttaaaaggtcttaacttt

SEQ ID NO: 7414836 - DNA, 21 bp, Homo sapiens
atcttaaaaggtcttaacttt

SEQ ID NO: 7414837 - DNA, 22 bp, Homo sapiens
atctggcttacgaagcactggt

SEQ ID NO: 7414838 - DNA, 22 bp, Homo sapiens
atctggcttacgaagcactggt

SEQ ID NO: 7414839 - DNA, 22 bp, Homo sapiens
atctggcttgactttgcgactt

SEQ ID NO: 7414840 - DNA, 22 bp, Homo sapiens
atctggctttcttaatgactta

SEQ ID NO: 7414841 - DNA, 22 bp, Homo sapiens
atctggcttgggtgtgggtagc

SEQ ID NO: 7414842 - DNA, 22 bp, Homo sapiens
atctggcttgggtgtgggtagc

SEQ ID NO: 7414843 - DNA, 22 bp, Homo sapiens
atctggcttttaccccacggcc

SEQ ID NO: 7414844 - DNA, 22 bp, Homo sapiens
atctggcttttaccccacggcc

SEQ ID NO: 7414845 - DNA, 22 bp, Homo sapiens
atctggcttacctagggtgcct

SEQ ID NO: 7414846 - DNA, 22 bp, Homo sapiens
atctggctggattcttagcgtt

SEQ ID NO: 7414847 - DNA, 17 bp, Homo sapiens
atctggctgcttctaga

SEQ ID NO: 7414848 - DNA, 22 bp, Homo sapiens
atctggctgactttgtgggaca

SEQ ID NO: 7414849 - DNA, 22 bp, Homo sapiens
atctggctgagcgaggcccaca

SEQ ID NO: 7414850 - DNA, 22 bp, Homo sapiens
atctggaaaacacagtgtagac

SEQ ID NO: 7414851 - DNA, 22 bp, Homo sapiens
atctgggagcggaggttgcagt

SEQ ID NO: 7414852 - DNA, 23 bp, Homo sapiens
atctgggcatctggagtggtcct

SEQ ID NO: 7414853 - DNA, 22 bp, Homo sapiens
atctgggagtcttggctctgct

SEQ ID NO: 7414854 - DNA, 22 bp, Homo sapiens
atctgggagtcttggctctgct

SEQ ID NO: 7414855 - DNA, 22 bp, Homo sapiens
atctggcttttactgaattgct

SEQ ID NO: 7414856 - DNA, 22 bp, Homo sapiens
atctgggaatggaagccttctg

SEQ ID NO: 7414857 - DNA, 22 bp, Homo sapiens
atctgggagacccttgcgggaa

SEQ ID NO: 7414858 - DNA, 22 bp, Homo sapiens
atctgggccaatcctagtacca

SEQ ID NO: 7414859 - DNA, 22 bp, Homo sapiens
atctgggccagccccaagagac

SEQ ID NO: 7414860 - DNA, 23 bp, Homo sapiens
atctgggcatctggagtggtcct

SEQ ID NO: 7414861 - DNA, 23 bp, Homo sapiens
atctgggcatctggagtggtcct

SEQ ID NO: 7414862 - DNA, 22 bp, Homo sapiens
atgaggcaatagaatattgaat

SEQ ID NO: 7414863 - DNA, 22 bp, Homo sapiens
atgaggcaatagaatattgaat

SEQ ID NO: 7414864 - DNA, 22 bp, Homo sapiens
atgaggcaatcatggtccagtt

SEQ ID NO: 7414865 - DNA, 22 bp, Homo sapiens
atgaggcaaggctggccgtgtt

SEQ ID NO: 7414866 - DNA, 22 bp, Homo sapiens
atgaggcaatagaatattgaat

SEQ ID NO: 7414867 - DNA, 22 bp, Homo sapiens
atgaggcaatcatggtccagtt

SEQ ID NO: 7414868 - DNA, 22 bp, Homo sapiens
atgaggcaatcatggtccagtt

SEQ ID NO: 7414869 - DNA, 22 bp, Homo sapiens
atgaggcacagagatgttaatg

SEQ ID NO: 7414870 - DNA, 22 bp, Homo sapiens
atgaggcacagagatgttaatg

SEQ ID NO: 7414871 - DNA, 22 bp, Homo sapiens
atgaggcaatcatggtccagtt

SEQ ID NO: 7414872 - DNA, 22 bp, Homo sapiens
atgatatatgtgttgagcttgc

SEQ ID NO: 7414873 - DNA, 22 bp, Homo sapiens
atgatatagagagtagattaaa

SEQ ID NO: 7414874 - DNA, 22 bp, Homo sapiens
atgaggcacgtgttactggcct

SEQ ID NO: 7414875 - DNA, 22 bp, Homo sapiens
atgaggcacatcacagccaatg

SEQ ID NO: 7414876 - DNA, 22 bp, Homo sapiens
atgaggcacatcacagccaatg

SEQ ID NO: 7414877 - DNA, 22 bp, Homo sapiens
atgaggcacatcacagccaatg

SEQ ID NO: 7414878 - DNA, 22 bp, Homo sapiens
atgaggcacatcacagccaatg

SEQ ID NO: 7414879 - DNA, 22 bp, Homo sapiens
atgaggcaaaggtggaggtggg

SEQ ID NO: 7414880 - DNA, 22 bp, Homo sapiens
atgaggcaaaggtggaggtggg

SEQ ID NO: 7414881 - DNA, 22 bp, Homo sapiens
atgaggcaaaggtggaggtggg

SEQ ID NO: 7414882 - DNA, 22 bp, Homo sapiens
atgaggatgttagtggactgga

SEQ ID NO: 7414883 - DNA, 22 bp, Homo sapiens
atgaggatgttagtggactgga

SEQ ID NO: 7414884 - DNA, 22 bp, Homo sapiens
atgaggagtcaaggagtcggag

SEQ ID NO: 7414885 - DNA, 22 bp, Homo sapiens
atgaggatgggaagggagccaa

SEQ ID NO: 7414886 - DNA, 22 bp, Homo sapiens
atgaggatgggaagggagccaa

SEQ ID NO: 7414887 - DNA, 22 bp, Homo sapiens
atgaggagtcaaggagtcggag

SEQ ID NO: 7414888 - DNA, 22 bp, Homo sapiens
atgaggataccgcagggggcag

SEQ ID NO: 7414889 - DNA, 22 bp, Homo sapiens
atgaggataccgcagggggcag

SEQ ID NO: 7414890 - DNA, 22 bp, Homo sapiens
atgaggcaaggatcaggtaagg

SEQ ID NO: 7414891 - DNA, 22 bp, Homo sapiens
atgaggcaaaggtggaggtggg

SEQ ID NO: 7414892 - DNA, 22 bp, Homo sapiens
atgaggcaaggatcaggtaagg

SEQ ID NO: 7414893 - DNA, 22 bp, Homo sapiens
atgaggcaaggatcaggtaagg

SEQ ID NO: 7414894 - DNA, 22 bp, Homo sapiens
atgaggcaaaggtggaggtggg

SEQ ID NO: 7414895 - DNA, 22 bp, Homo sapiens
atgaggcaaggctggccgtgtt

SEQ ID NO: 7414896 - DNA, 22 bp, Homo sapiens
atgaggcaaggctggccgtgtt

SEQ ID NO: 7414897 - DNA, 22 bp, Homo sapiens
atgaggcaaggatcaggtaagg

SEQ ID NO: 7414898 - DNA, 22 bp, Homo sapiens
atgaggcaaggctggccgtgtt

SEQ ID NO: 7414899 - DNA, 22 bp, Homo sapiens
atgaggcaaggctggccgtgtt

SEQ ID NO: 7414900 - DNA, 22 bp, Homo sapiens
atgactttcctggcaaaagttg

SEQ ID NO: 7414901 - DNA, 22 bp, Homo sapiens
atgagaaaattcattccatcca

SEQ ID NO: 7414902 - DNA, 22 bp, Homo sapiens
atgagaaaattgaggcccatag

SEQ ID NO: 7414903 - DNA, 22 bp, Homo sapiens
atgagaaaattgaggcccatag

SEQ ID NO: 7414904 - DNA, 22 bp, Homo sapiens
atgactttgttgttttccagcg

SEQ ID NO: 7414905 - DNA, 22 bp, Homo sapiens
atgactttcctggcaaaagttg

SEQ ID NO: 7414906 - DNA, 22 bp, Homo sapiens
atgacttttaaaagctggtact

SEQ ID NO: 7414907 - DNA, 22 bp, Homo sapiens
atgacttttaggagcagtgctc

SEQ ID NO: 7414908 - DNA, 22 bp, Homo sapiens
atgactttgttgttttccagcg

SEQ ID NO: 7414909 - DNA, 22 bp, Homo sapiens
atgactttcctggcaaaagttg

SEQ ID NO: 7414910 - DNA, 22 bp, Homo sapiens
atgacttattacaagtcatatt

SEQ ID NO: 7414911 - DNA, 22 bp, Homo sapiens
atgacttattacaagtcatatt

SEQ ID NO: 7414912 - DNA, 22 bp, Homo sapiens
atgacttcgttttctctctgca

SEQ ID NO: 7414913 - DNA, 22 bp, Homo sapiens
atgaggagctgttttaactgct

SEQ ID NO: 7414914 - DNA, 22 bp, Homo sapiens
atgaggagctccttgaaatgag

SEQ ID NO: 7414915 - DNA, 22 bp, Homo sapiens
atgaggagctccttgaaatgag

SEQ ID NO: 7414916 - DNA, 22 bp, Homo sapiens
atgaggagctccttgaaatgag

SEQ ID NO: 7414917 - DNA, 22 bp, Homo sapiens
atgaggagccctcatttaggtt

SEQ ID NO: 7414918 - DNA, 22 bp, Homo sapiens
atgaggagccctcatttaggtt

SEQ ID NO: 7414919 - DNA, 22 bp, Homo sapiens
atgaggagtcaaggagtcggag

SEQ ID NO: 7414920 - DNA, 22 bp, Homo sapiens
atgaggaggccagtaagagcct

SEQ ID NO: 7414921 - DNA, 22 bp, Homo sapiens
atgaggaggtcaggccttacaa

SEQ ID NO: 7414922 - DNA, 22 bp, Homo sapiens
atgaggaggccagtaagagcct

SEQ ID NO: 7414923 - DNA, 22 bp, Homo sapiens
atgaggagctccttgaaatgag

SEQ ID NO: 7414924 - DNA, 22 bp, Homo sapiens
atgaggaggccagtaagagcct

SEQ ID NO: 7414925 - DNA, 22 bp, Homo sapiens
atgaggaagtctgataatggta

SEQ ID NO: 7414926 - DNA, 22 bp, Homo sapiens
atgaggaagtctgataatggta

SEQ ID NO: 7414927 - DNA, 22 bp, Homo sapiens
atgaggaagtctgataatggta

SEQ ID NO: 7414928 - DNA, 22 bp, Homo sapiens
atgagaaagagttgtatctaga

SEQ ID NO: 7414929 - DNA, 22 bp, Homo sapiens
atgagaaaattcattccatcca

SEQ ID NO: 7414930 - DNA, 22 bp, Homo sapiens
atgagaaagagttgtatctaga

SEQ ID NO: 7414931 - DNA, 22 bp, Homo sapiens
atgaggagccctcatttaggtt

SEQ ID NO: 7414932 - DNA, 22 bp, Homo sapiens
atgaggagccctcatttaggtt

SEQ ID NO: 7414933 - DNA, 22 bp, Homo sapiens
atgaggagaccaaggcctgatg

SEQ ID NO: 7414934 - DNA, 22 bp, Homo sapiens
atgaggagaccaaggcctgatg

SEQ ID NO: 7414935 - DNA, 22 bp, Homo sapiens
atgattgtctataaaggaaggg

SEQ ID NO: 7414936 - DNA, 22 bp, Homo sapiens
atgattgagaaaacttgcaatt

SEQ ID NO: 7414937 - DNA, 22 bp, Homo sapiens
atgattgagaaaacttgcaatt

SEQ ID NO: 7414938 - DNA, 22 bp, Homo sapiens
atgatttaaagtcattgtgaac

SEQ ID NO: 7414939 - DNA, 22 bp, Homo sapiens
atgatttaaagtcattgtgaac

SEQ ID NO: 7414940 - DNA, 22 bp, Homo sapiens
atgatttaaagtcattgtgaac

SEQ ID NO: 7414941 - DNA, 19 bp, Homo sapiens
atgattgtctatggaggaa

SEQ ID NO: 7414942 - DNA, 19 bp, Homo sapiens
atgattgtctatggaggaa

SEQ ID NO: 7414943 - DNA, 22 bp, Homo sapiens
atgatttaaagtcattgtgaac

SEQ ID NO: 7414944 - DNA, 22 bp, Homo sapiens
atgatttaaagtcattgtgaac

SEQ ID NO: 7414945 - DNA, 22 bp, Homo sapiens
atgatttaaagtcattgtgaac

SEQ ID NO: 7414946 - DNA, 22 bp, Homo sapiens
atgatttctatataaacttaaa

SEQ ID NO: 7414947 - DNA, 22 bp, Homo sapiens
atgatttctatataaacttaaa

SEQ ID NO: 7414948 - DNA, 22 bp, Homo sapiens
atgattttctgataaagaactg

SEQ ID NO: 7414949 - DNA, 22 bp, Homo sapiens
atgattttctgataaagaactg

SEQ ID NO: 7414950 - DNA, 22 bp, Homo sapiens
atgattttctgataaagaactg

SEQ ID NO: 7414951 - DNA, 22 bp, Homo sapiens
atgatttgttaacagacttaat

SEQ ID NO: 7414952 - DNA, 22 bp, Homo sapiens
atgatttgttaacagacttaat

SEQ ID NO: 7414953 - DNA, 22 bp, Homo sapiens
atgattttctgataaagaactg

SEQ ID NO: 7414954 - DNA, 22 bp, Homo sapiens
atgatttgttaacagacttaat

SEQ ID NO: 7414955 - DNA, 22 bp, Homo sapiens
atgattttctgataaagaactg

SEQ ID NO: 7414956 - DNA, 22 bp, Homo sapiens
atgcaaattaacatatagtaga

SEQ ID NO: 7414957 - DNA, 22 bp, Homo sapiens
atgcaaattaacatatagtaga

SEQ ID NO: 7414958 - DNA, 22 bp, Homo sapiens
atgcaaattaacatatagtaga

SEQ ID NO: 7414959 - DNA, 22 bp, Homo sapiens
atgcaaatgtttaagttactat

SEQ ID NO: 7414960 - DNA, 22 bp, Homo sapiens
atgcaaatgtttaagttactat

SEQ ID NO: 7414961 - DNA, 22 bp, Homo sapiens
atgcaaatgtttaagttactat

SEQ ID NO: 7414962 - DNA, 22 bp, Homo sapiens
atgcaaatgtttaagttactat

SEQ ID NO: 7414963 - DNA, 22 bp, Homo sapiens
atgcaaattaacatatagtaga

SEQ ID NO: 7414964 - DNA, 22 bp, Homo sapiens
atgcaaattcttaggctccatc

SEQ ID NO: 7414965 - DNA, 22 bp, Homo sapiens
atgcaaattaacatatagtaga

SEQ ID NO: 7414966 - DNA, 22 bp, Homo sapiens
atgcaaattaacatatagtaga

SEQ ID NO: 7414967 - DNA, 22 bp, Homo sapiens
atgcaaatgctagagaatgttg

SEQ ID NO: 7414968 - DNA, 22 bp, Homo sapiens
atgattttctgataaagaactg

SEQ ID NO: 7414969 - DNA, 22 bp, Homo sapiens
atgcaaatggcaatgagtgacc

SEQ ID NO: 7414970 - DNA, 22 bp, Homo sapiens
atgcaaatggcaatgagtgacc

SEQ ID NO: 7414971 - DNA, 22 bp, Homo sapiens
atgcaaatgtcaccacttctaa

SEQ ID NO: 7414972 - DNA, 22 bp, Homo sapiens
atgcaaatgtcaccacttctaa

SEQ ID NO: 7414973 - DNA, 22 bp, Homo sapiens
atgcaaatgtcaccacttctaa

SEQ ID NO: 7414974 - DNA, 22 bp, Homo sapiens
atgcaaatgtcaccacttctaa

SEQ ID NO: 7414975 - DNA, 22 bp, Homo sapiens
atgcaaatgtcaccacttctaa

SEQ ID NO: 7414976 - DNA, 22 bp, Homo sapiens
atgatatatgtgttgagcttgc

SEQ ID NO: 7414977 - DNA, 22 bp, Homo sapiens
atgatatatgtgttgagcttgc

SEQ ID NO: 7414978 - DNA, 22 bp, Homo sapiens
atgattcaggattgaaccattt

SEQ ID NO: 7414979 - DNA, 20 bp, Homo sapiens
atgattcatgatgatgtctc

SEQ ID NO: 7414980 - DNA, 22 bp, Homo sapiens
atgattcagggagttttcagga

SEQ ID NO: 7414981 - DNA, 22 bp, Homo sapiens
atgattcagggagttttcagga

SEQ ID NO: 7414982 - DNA, 22 bp, Homo sapiens
atgattcagggagttttcagga

SEQ ID NO: 7414983 - DNA, 22 bp, Homo sapiens
atgattctaaacttaaggggga

SEQ ID NO: 7414984 - DNA, 22 bp, Homo sapiens
atgattctaggcattgaagata

SEQ ID NO: 7414985 - DNA, 22 bp, Homo sapiens
atgattctaggcattgaagata

SEQ ID NO: 7414986 - DNA, 22 bp, Homo sapiens
atgattctaaacttaaggggga

SEQ ID NO: 7414987 - DNA, 19 bp, Homo sapiens
atgattcccagggaggggg

SEQ ID NO: 7414988 - DNA, 22 bp, Homo sapiens
atgattccttgaagcctcatga

SEQ ID NO: 7414989 - DNA, 22 bp, Homo sapiens
atgattctctgctactctaaat

SEQ ID NO: 7414990 - DNA, 22 bp, Homo sapiens
atgattctctgctactctaaat

SEQ ID NO: 7414991 - DNA, 22 bp, Homo sapiens
atgattctggcaaatttattat

SEQ ID NO: 7414992 - DNA, 22 bp, Homo sapiens
atgattctggcaaatttattat

SEQ ID NO: 7414993 - DNA, 22 bp, Homo sapiens
atgattctggcaaatttattat

SEQ ID NO: 7414994 - DNA, 21 bp, Homo sapiens
atgattctgcaaatgagtagt

SEQ ID NO: 7414995 - DNA, 21 bp, Homo sapiens
atgattctgcaaatgagtagt

SEQ ID NO: 7414996 - DNA, 22 bp, Homo sapiens
atgattctcattttactgtgat

SEQ ID NO: 7414997 - DNA, 22 bp, Homo sapiens
atgattctcattttataaactt

SEQ ID NO: 7414998 - DNA, 22 bp, Homo sapiens
atgattctcattttactgtgat

SEQ ID NO: 7414999 - DNA, 22 bp, Homo sapiens
atgattctcattttataaactt

SEQ ID NO: 7415000 - DNA, 22 bp, Homo sapiens
atgattctcattttataaactt

SEQ ID NO: 7415001 - DNA, 22 bp, Homo sapiens
atgattgaccatctgctgggct

SEQ ID NO: 7415002 - DNA, 22 bp, Homo sapiens
atgattgaccatctgctgggct

SEQ ID NO: 7415003 - DNA, 22 bp, Homo sapiens
atgattgaccatctgctgggct

SEQ ID NO: 7415004 - DNA, 22 bp, Homo sapiens
atgattgaaaatgacattgcca

SEQ ID NO: 7415005 - DNA, 22 bp, Homo sapiens
atgattgaaaatgacattgcca

SEQ ID NO: 7415006 - DNA, 22 bp, Homo sapiens
atgattgaaaatgacattgcca

SEQ ID NO: 7415007 - DNA, 22 bp, Homo sapiens
atgattgaaaatgacattgcca

SEQ ID NO: 7415008 - DNA, 22 bp, Homo sapiens
atgattgaaaatgacattgcca

SEQ ID NO: 7415009 - DNA, 22 bp, Homo sapiens
atgattgaaaatgacattgcca

SEQ ID NO: 7415010 - DNA, 20 bp, Homo sapiens
atgattctgggctacactgg

SEQ ID NO: 7415011 - DNA, 22 bp, Homo sapiens
atgattctggcaaatttattat

SEQ ID NO: 7415012 - DNA, 20 bp, Homo sapiens
atgattctgggctacactgg

SEQ ID NO: 7415013 - DNA, 22 bp, Homo sapiens
atgattctggggcaaaagctgg

SEQ ID NO: 7415014 - DNA, 22 bp, Homo sapiens
atgattctggtgagaatgagga

SEQ ID NO: 7415015 - DNA, 22 bp, Homo sapiens
atgattctggtgagaatgagga

SEQ ID NO: 7415016 - DNA, 22 bp, Homo sapiens
atgattgaaaatgacattgcca

SEQ ID NO: 7415017 - DNA, 22 bp, Homo sapiens
atgattgaaaatgacattgcca

SEQ ID NO: 7415018 - DNA, 22 bp, Homo sapiens
atgattctggtgagaatgagga

SEQ ID NO: 7415019 - DNA, 22 bp, Homo sapiens
atgattcttttggatagatgat

SEQ ID NO: 7415020 - DNA, 22 bp, Homo sapiens
atgcttaatgagggtatatatg

SEQ ID NO: 7415021 - DNA, 22 bp, Homo sapiens
atgcttaatgagggtatatatg

SEQ ID NO: 7415022 - DNA, 22 bp, Homo sapiens
atgcttaatgagggtatatatg

SEQ ID NO: 7415023 - DNA, 22 bp, Homo sapiens
atgcttaggttaaatttgtaat

SEQ ID NO: 7415024 - DNA, 18 bp, Homo sapiens
atgctgccctctgagggt

SEQ ID NO: 7415025 - DNA, 18 bp, Homo sapiens
atgctgccctctgagggt

SEQ ID NO: 7415026 - DNA, 22 bp, Homo sapiens
atgctgcagctgcaggatcaga

SEQ ID NO: 7415027 - DNA, 22 bp, Homo sapiens
atgctgcagtcaggccagattg

SEQ ID NO: 7415028 - DNA, 22 bp, Homo sapiens
atgctgatctgtaataagattt

SEQ ID NO: 7415029 - DNA, 22 bp, Homo sapiens
atgctgatctgtaataagattt

SEQ ID NO: 7415030 - DNA, 22 bp, Homo sapiens
atgctgataggagttaatggtg

SEQ ID NO: 7415031 - DNA, 22 bp, Homo sapiens
atgctgatgaggtcaggaagac

SEQ ID NO: 7415032 - DNA, 22 bp, Homo sapiens
atgctgatgaggtcaggaagac

SEQ ID NO: 7415033 - DNA, 22 bp, Homo sapiens
atgctgatgctgcttttgccct

SEQ ID NO: 7415034 - DNA, 22 bp, Homo sapiens
atgctgatgctgttaaccctaa

SEQ ID NO: 7415035 - DNA, 22 bp, Homo sapiens
atgctgcacaagccacatgtag

SEQ ID NO: 7415036 - DNA, 22 bp, Homo sapiens
atgctgatgtcagccccatctc

SEQ ID NO: 7415037 - DNA, 22 bp, Homo sapiens
atgctgattcctgggctccacc

SEQ ID NO: 7415038 - DNA, 22 bp, Homo sapiens
atgctgattttatagaataaag

SEQ ID NO: 7415039 - DNA, 22 bp, Homo sapiens
atgctgagcagagctgacatgc

SEQ ID NO: 7415040 - DNA, 22 bp, Homo sapiens
atgctgagatcctcaggccaga

SEQ ID NO: 7415041 - DNA, 22 bp, Homo sapiens
atgctgagcagagctgacatgc

SEQ ID NO: 7415042 - DNA, 22 bp, Homo sapiens
atgctgaggacaaagagatcaa

SEQ ID NO: 7415043 - DNA, 22 bp, Homo sapiens
atgctgaggacaaagagatcaa

SEQ ID NO: 7415044 - DNA, 22 bp, Homo sapiens
atgctgataactttcagtgaca

SEQ ID NO: 7415045 - DNA, 22 bp, Homo sapiens
atgctgataactttcagtgaca

SEQ ID NO: 7415046 - DNA, 22 bp, Homo sapiens
atgctgataggagttaatggtg

SEQ ID NO: 7415047 - DNA, 22 bp, Homo sapiens
atgctgagaaacagacgtgttg

SEQ ID NO: 7415048 - DNA, 22 bp, Homo sapiens
atgctgagactggagcagctgg

SEQ ID NO: 7415049 - DNA, 22 bp, Homo sapiens
atgctgagatcctcaggccaga

SEQ ID NO: 7415050 - DNA, 22 bp, Homo sapiens
atgctgagatcctcaggccaga

SEQ ID NO: 7415051 - DNA, 22 bp, Homo sapiens
atgctgagataaggctttagtc

SEQ ID NO: 7415052 - DNA, 22 bp, Homo sapiens
atgctgagactggagcagctgg

SEQ ID NO: 7415053 - DNA, 22 bp, Homo sapiens
atgctgaatattagcctcatga

SEQ ID NO: 7415054 - DNA, 22 bp, Homo sapiens
atgctgaatgaaagaaattagt

SEQ ID NO: 7415055 - DNA, 22 bp, Homo sapiens
atgctgaattgatgcgagggag

SEQ ID NO: 7415056 - DNA, 22 bp, Homo sapiens
atgctgaagagttcatgattat

SEQ ID NO: 7415057 - DNA, 22 bp, Homo sapiens
atgctgaagagtgcacaggcta

SEQ ID NO: 7415058 - DNA, 22 bp, Homo sapiens
atgctgaagagtgcacaggcta

SEQ ID NO: 7415059 - DNA, 22 bp, Homo sapiens
atgctgaagagtgcacaggcta

SEQ ID NO: 7415060 - DNA, 22 bp, Homo sapiens
atgctgaatagttcactcttct

SEQ ID NO: 7415061 - DNA, 22 bp, Homo sapiens
atgctgaaggtgaattgacaat

SEQ ID NO: 7415062 - DNA, 22 bp, Homo sapiens
atgctgaaggtgaattgacaat

SEQ ID NO: 7415063 - DNA, 22 bp, Homo sapiens
atgcgtagaaagaaggtggcct

SEQ ID NO: 7415064 - DNA, 22 bp, Homo sapiens
atgcgtgtttgtatacacacaa

SEQ ID NO: 7415065 - DNA, 22 bp, Homo sapiens
atgcgtgtaggaacagtgtcta

SEQ ID NO: 7415066 - DNA, 22 bp, Homo sapiens
atgcgtgtgtgcaaaccattgc

SEQ ID NO: 7415067 - DNA, 22 bp, Homo sapiens
atgcgtgcaggggtcctcctgg

SEQ ID NO: 7415068 - DNA, 22 bp, Homo sapiens
agacatatattgcaattcactg

SEQ ID NO: 7415069 - DNA, 22 bp, Homo sapiens
agacataggattccacatagca

SEQ ID NO: 7415070 - DNA, 22 bp, Homo sapiens
agacataggattccacatagca

SEQ ID NO: 7415071 - DNA, 22 bp, Homo sapiens
atgctaaaaacttgatcattat

SEQ ID NO: 7415072 - DNA, 22 bp, Homo sapiens
atgctgaagaatcacagggact

SEQ ID NO: 7415073 - DNA, 22 bp, Homo sapiens
agagaacaaattaaaggtggtt

SEQ ID NO: 7415074 - DNA, 22 bp, Homo sapiens
agagaaacaggtcagctgggag

SEQ ID NO: 7415075 - DNA, 22 bp, Homo sapiens
agagaacaaattaaaggtggtt

SEQ ID NO: 7415076 - DNA, 22 bp, Homo sapiens
agagaacaaattaaaggtggtt

SEQ ID NO: 7415077 - DNA, 22 bp, Homo sapiens
agagaacaaattaaaggtggtt

SEQ ID NO: 7415078 - DNA, 22 bp, Homo sapiens
agagaacaaattaaaggtggtt

SEQ ID NO: 7415079 - DNA, 22 bp, Homo sapiens
agagaacacgtgcatctgcaat

SEQ ID NO: 7415080 - DNA, 22 bp, Homo sapiens
agagaacaaattaaaggtggtt

SEQ ID NO: 7415081 - DNA, 22 bp, Homo sapiens
agagaacacgtgcatctgcaat

SEQ ID NO: 7415082 - DNA, 22 bp, Homo sapiens
agagaacacgtgcatctgcaat

SEQ ID NO: 7415083 - DNA, 22 bp, Homo sapiens
agagaacagacagatgcaatga

SEQ ID NO: 7415084 - DNA, 22 bp, Homo sapiens
agagaacagacagatgcaatga

SEQ ID NO: 7415085 - DNA, 22 bp, Homo sapiens
agagaacagacagatgcaatga

SEQ ID NO: 7415086 - DNA, 22 bp, Homo sapiens
agagaacagacagatgcaatga

SEQ ID NO: 7415087 - DNA, 22 bp, Homo sapiens
agagaacagacagatgcaatga

SEQ ID NO: 7415088 - DNA, 22 bp, Homo sapiens
agagaacagcattgcagctttg

SEQ ID NO: 7415089 - DNA, 22 bp, Homo sapiens
agagaacagcattgcagctttg

SEQ ID NO: 7415090 - DNA, 22 bp, Homo sapiens
agagaacagcattgcagctttg

SEQ ID NO: 7415091 - DNA, 22 bp, Homo sapiens
agagaacagacagatgcaatga

SEQ ID NO: 7415092 - DNA, 22 bp, Homo sapiens
atgcttcttgagatagaaacac

SEQ ID NO: 7415093 - DNA, 22 bp, Homo sapiens
atgcttcttgagatagaaacac

SEQ ID NO: 7415094 - DNA, 22 bp, Homo sapiens
atgcttctgttgcttaggaggt

SEQ ID NO: 7415095 - DNA, 22 bp, Homo sapiens
atgcttcttgtatttggctgac

SEQ ID NO: 7415096 - DNA, 22 bp, Homo sapiens
atgcttctggtataagaaaaat

SEQ ID NO: 7415097 - DNA, 22 bp, Homo sapiens
atgcttctggtataagaaaaat

SEQ ID NO: 7415098 - DNA, 22 bp, Homo sapiens
atgcttctggtataagaaaaat

SEQ ID NO: 7415099 - DNA, 22 bp, Homo sapiens
atgcttctgtaatgtgggaatg

SEQ ID NO: 7415100 - DNA, 22 bp, Homo sapiens
atgcttctgtgtatgtttcagg

SEQ ID NO: 7415101 - DNA, 22 bp, Homo sapiens
atgcttctgtgtatgtttcagg

SEQ ID NO: 7415102 - DNA, 22 bp, Homo sapiens
atgcttctgttgcttaggaggt

SEQ ID NO: 7415103 - DNA, 22 bp, Homo sapiens
agagaaaagagttcaggctttg

SEQ ID NO: 7415104 - DNA, 22 bp, Homo sapiens
agagaaaagccatcccagccaa

SEQ ID NO: 7415105 - DNA, 20 bp, Homo sapiens
atgcttgagatcacaatcct

SEQ ID NO: 7415106 - DNA, 22 bp, Homo sapiens
agagaacaaattaaaggtggtt

SEQ ID NO: 7415107 - DNA, 22 bp, Homo sapiens
agagaaaagccatcccagccaa

SEQ ID NO: 7415108 - DNA, 22 bp, Homo sapiens
agagaaaagccatcccagccaa

SEQ ID NO: 7415109 - DNA, 22 bp, Homo sapiens
agagaaaagccatcccagccaa

SEQ ID NO: 7415110 - DNA, 22 bp, Homo sapiens
agagaaacaggtcagctgggag

SEQ ID NO: 7415111 - DNA, 22 bp, Homo sapiens
atgcttctgctcatatttcatt

SEQ ID NO: 7415112 - DNA, 18 bp, Homo sapiens
atgcttctgatagaagca

SEQ ID NO: 7415113 - DNA, 22 bp, Homo sapiens
atgcttctgctcatatttcatt

SEQ ID NO: 7415114 - DNA, 22 bp, Homo sapiens
atgcttctgctcatatttcatt

SEQ ID NO: 7415115 - DNA, 22 bp, Homo sapiens
atgcttctggtataagaaaaat

SEQ ID NO: 7415116 - DNA, 18 bp, Homo sapiens
atgcttctgatagaagca

SEQ ID NO: 7415117 - DNA, 22 bp, Homo sapiens
atgcttctgaagaagaaaagac

SEQ ID NO: 7415118 - DNA, 18 bp, Homo sapiens
atgcttctgatagaagca

SEQ ID NO: 7415119 - DNA, 22 bp, Homo sapiens
atgcttctgaagaagaaaagac

SEQ ID NO: 7415120 - DNA, 18 bp, Homo sapiens
atgcttctgatagaagca

SEQ ID NO: 7415121 - DNA, 18 bp, Homo sapiens
atgcttctgatagaagca

SEQ ID NO: 7415122 - DNA, 22 bp, Homo sapiens
atgcttctcagctcaaggcaaa

SEQ ID NO: 7415123 - DNA, 22 bp, Homo sapiens
atgcttcctttttcccttaagg

SEQ ID NO: 7415124 - DNA, 22 bp, Homo sapiens
atgcttctcctgaacatccctg

SEQ ID NO: 7415125 - DNA, 22 bp, Homo sapiens
atgcttctcagctcaaggcaaa

SEQ ID NO: 7415126 - DNA, 22 bp, Homo sapiens
atgcttctgaagaagaaaagac

SEQ ID NO: 7415127 - DNA, 22 bp, Homo sapiens
atgcttcctctacggcctctga

SEQ ID NO: 7415128 - DNA, 22 bp, Homo sapiens
atgcttcctctacggcctctga

SEQ ID NO: 7415129 - DNA, 22 bp, Homo sapiens
atgcttcctcccttccactcaa

SEQ ID NO: 7415130 - DNA, 22 bp, Homo sapiens
atgcttcctcccttccactcaa

SEQ ID NO: 7415131 - DNA, 22 bp, Homo sapiens
atgcttccctcacatatcctgg

SEQ ID NO: 7415132 - DNA, 22 bp, Homo sapiens
atgcttccctcacatatcctgg

SEQ ID NO: 7415133 - DNA, 22 bp, Homo sapiens
atgcttcccctctcatttcagc

SEQ ID NO: 7415134 - DNA, 22 bp, Homo sapiens
atgcttccatgaacgttcttgt

SEQ ID NO: 7415135 - DNA, 22 bp, Homo sapiens
atgcttccatgaacgttcttgt

SEQ ID NO: 7415136 - DNA, 22 bp, Homo sapiens
atgcttcctaaccatggccgtg

SEQ ID NO: 7415137 - DNA, 22 bp, Homo sapiens
atgcttccctttgctccacatg

SEQ ID NO: 7415138 - DNA, 23 bp, Homo sapiens
atgcttccacagagcttgcagcc

SEQ ID NO: 7415139 - DNA, 22 bp, Homo sapiens
atgcttccactgttctgctctc

SEQ ID NO: 7415140 - DNA, 22 bp, Homo sapiens
atgcttccactgttctgctctc

SEQ ID NO: 7415141 - DNA, 22 bp, Homo sapiens
atgcttccaatattctcccttt

SEQ ID NO: 7415142 - DNA, 23 bp, Homo sapiens
atgcttccacagagcttgcagcc

SEQ ID NO: 7415143 - DNA, 22 bp, Homo sapiens
atgcttcatgatttggccatgt

SEQ ID NO: 7415144 - DNA, 22 bp, Homo sapiens
atgcttcatgatttggccatgt

SEQ ID NO: 7415145 - DNA, 22 bp, Homo sapiens
atgcttccaacagttctgtgaa

SEQ ID NO: 7415146 - DNA, 22 bp, Homo sapiens
atgcttcagtgctaccttcaaa

SEQ ID NO: 7415147 - DNA, 22 bp, Homo sapiens
agacagtgtgagttcagggtgg

SEQ ID NO: 7415148 - DNA, 22 bp, Homo sapiens
agacagtgtgagttcagggtgg

SEQ ID NO: 7415149 - DNA, 22 bp, Homo sapiens
agacagtgtaatgtaattgtta

SEQ ID NO: 7415150 - DNA, 22 bp, Homo sapiens
agacagtgtaatgtaattgtta

SEQ ID NO: 7415151 - DNA, 20 bp, Homo sapiens
agacagtggggagctcctag

SEQ ID NO: 7415152 - DNA, 20 bp, Homo sapiens
agacagtggggagctcctag

SEQ ID NO: 7415153 - DNA, 22 bp, Homo sapiens
agacagtggctcagccccagtc

SEQ ID NO: 7415154 - DNA, 20 bp, Homo sapiens
agacagtgtggagattcctt

SEQ ID NO: 7415155 - DNA, 20 bp, Homo sapiens
agacagtgtggagattcctt

SEQ ID NO: 7415156 - DNA, 22 bp, Homo sapiens
agacagtgtggttggtggttcc

SEQ ID NO: 7415157 - DNA, 22 bp, Homo sapiens
agacagtgtggttggtggttcc

SEQ ID NO: 7415158 - DNA, 20 bp, Homo sapiens
agacagtgtggagattcctt

SEQ ID NO: 7415159 - DNA, 22 bp, Homo sapiens
agacagtgtgagttcagggtgg

SEQ ID NO: 7415160 - DNA, 22 bp, Homo sapiens
agacataaacttactgaaatac

SEQ ID NO: 7415161 - DNA, 22 bp, Homo sapiens
agacataaacttactgaaatac

SEQ ID NO: 7415162 - DNA, 19 bp, Homo sapiens
agacataaagagtttgcaa

SEQ ID NO: 7415163 - DNA, 22 bp, Homo sapiens
agacataaacttactgaaatac

SEQ ID NO: 7415164 - DNA, 22 bp, Homo sapiens
agacagttgatatactataaaa

SEQ ID NO: 7415165 - DNA, 22 bp, Homo sapiens
agacagttgatatactataaaa

SEQ ID NO: 7415166 - DNA, 22 bp, Homo sapiens
agacagttgatatactataaaa

SEQ ID NO: 7415167 - DNA, 22 bp, Homo sapiens
agacagtgtgtgtatatatggt

SEQ ID NO: 7415168 - DNA, 22 bp, Homo sapiens
agacagtgtgtgtatatatggt

SEQ ID NO: 7415169 - DNA, 22 bp, Homo sapiens
agacataagccagtcactcact

SEQ ID NO: 7415170 - DNA, 22 bp, Homo sapiens
agacataagccagtcactcact

SEQ ID NO: 7415171 - DNA, 19 bp, Homo sapiens
agacataaagagtttgcaa

SEQ ID NO: 7415172 - DNA, 22 bp, Homo sapiens
agacataagcgagcatcacagg

SEQ ID NO: 7415173 - DNA, 22 bp, Homo sapiens
agacataagcgagcatcacagg

SEQ ID NO: 7415174 - DNA, 22 bp, Homo sapiens
agacataagcgagcatcacagg

SEQ ID NO: 7415175 - DNA, 22 bp, Homo sapiens
agacataagtgctatgacattg

SEQ ID NO: 7415176 - DNA, 22 bp, Homo sapiens
agacataagtgctatgacattg

SEQ ID NO: 7415177 - DNA, 22 bp, Homo sapiens
agacataagtgctatgacattg

SEQ ID NO: 7415178 - DNA, 22 bp, Homo sapiens
agacataagtgctatgacattg

SEQ ID NO: 7415179 - DNA, 22 bp, Homo sapiens
agacatagaaaatcattaggaa

SEQ ID NO: 7415180 - DNA, 22 bp, Homo sapiens
agacataagtggcattttccaa

SEQ ID NO: 7415181 - DNA, 22 bp, Homo sapiens
agacataattaattagttctac

SEQ ID NO: 7415182 - DNA, 22 bp, Homo sapiens
agacatagataggcactgattg

SEQ ID NO: 7415183 - DNA, 22 bp, Homo sapiens
agacatagaaaatcattaggaa

SEQ ID NO: 7415184 - DNA, 22 bp, Homo sapiens
agacatagactttctactgtgt

SEQ ID NO: 7415185 - DNA, 22 bp, Homo sapiens
agacatagactttctactgtgt

SEQ ID NO: 7415186 - DNA, 22 bp, Homo sapiens
agacatagataggcactgattg

SEQ ID NO: 7415187 - DNA, 22 bp, Homo sapiens
atgccagggtcccttcagagat

SEQ ID NO: 7415188 - DNA, 22 bp, Homo sapiens
atgccagggtcatcccctgggt

SEQ ID NO: 7415189 - DNA, 22 bp, Homo sapiens
atgccagggtcatcccctgggt

SEQ ID NO: 7415190 - DNA, 22 bp, Homo sapiens
atgccagggtcacagtcatatt

SEQ ID NO: 7415191 - DNA, 22 bp, Homo sapiens
atgccagggtcatcccctgggt

SEQ ID NO: 7415192 - DNA, 22 bp, Homo sapiens
atgccaggctgtttggcctcag

SEQ ID NO: 7415193 - DNA, 22 bp, Homo sapiens
atgccaggctgtttggcctcag

SEQ ID NO: 7415194 - DNA, 22 bp, Homo sapiens
atgccaggtacaggggtagggt

SEQ ID NO: 7415195 - DNA, 22 bp, Homo sapiens
atgccaggtacaggggtagggt

SEQ ID NO: 7415196 - DNA, 22 bp, Homo sapiens
atgccaggtacaggggtagggt

SEQ ID NO: 7415197 - DNA, 22 bp, Homo sapiens
atgccaggtacaggggtagggt

SEQ ID NO: 7415198 - DNA, 22 bp, Homo sapiens
atgccaggtacaggggtagggt

SEQ ID NO: 7415199 - DNA, 22 bp, Homo sapiens
atgccaggtacaggggtagggt

SEQ ID NO: 7415200 - DNA, 22 bp, Homo sapiens
atgccagtaagtctcagctagg

SEQ ID NO: 7415201 - DNA, 22 bp, Homo sapiens
atgccagtgttataaatagata

SEQ ID NO: 7415202 - DNA, 22 bp, Homo sapiens
atgccatttcaaaataagattt

SEQ ID NO: 7415203 - DNA, 22 bp, Homo sapiens
atgccatttcaaaataagattt

SEQ ID NO: 7415204 - DNA, 22 bp, Homo sapiens
atgccattgctttaaaattaag

SEQ ID NO: 7415205 - DNA, 22 bp, Homo sapiens
atgccatttgctggaaggaagt

SEQ ID NO: 7415206 - DNA, 22 bp, Homo sapiens
atgccatctgaaatctgtcata

SEQ ID NO: 7415207 - DNA, 22 bp, Homo sapiens
atgccattgtatattcattgat

SEQ ID NO: 7415208 - DNA, 22 bp, Homo sapiens
atgccattgtatattcattgat

SEQ ID NO: 7415209 - DNA, 22 bp, Homo sapiens
atgccattgctttaaaattaag

SEQ ID NO: 7415210 - DNA, 23 bp, Homo sapiens
agacagtggccgagaggtactag

SEQ ID NO: 7415211 - DNA, 22 bp, Homo sapiens
agacagtggatcgggatgcact

SEQ ID NO: 7415212 - DNA, 22 bp, Homo sapiens
agacagtggatcgggatgcact

SEQ ID NO: 7415213 - DNA, 22 bp, Homo sapiens
agacagtggatcgggatgcact

SEQ ID NO: 7415214 - DNA, 22 bp, Homo sapiens
agacagtggatcgggatgcact

SEQ ID NO: 7415215 - DNA, 23 bp, Homo sapiens
agacagtggccgagaggtactag

SEQ ID NO: 7415216 - DNA, 23 bp, Homo sapiens
agacagtggccgagaggtactag

SEQ ID NO: 7415217 - DNA, 19 bp, Homo sapiens
agacagtggctaggactta

SEQ ID NO: 7415218 - DNA, 19 bp, Homo sapiens
agacagtggctaggactta

SEQ ID NO: 7415219 - DNA, 22 bp, Homo sapiens
atgcaacaaattgtgtgcaata

SEQ ID NO: 7415220 - DNA, 22 bp, Homo sapiens
atgcaacaaattgtgtgcaata

SEQ ID NO: 7415221 - DNA, 22 bp, Homo sapiens
atgcaacaaatgctacgaatcg

SEQ ID NO: 7415222 - DNA, 22 bp, Homo sapiens
atgcaacaaatgctacgaatcg

SEQ ID NO: 7415223 - DNA, 22 bp, Homo sapiens
atgcaacaatgtatttatgtat

SEQ ID NO: 7415224 - DNA, 22 bp, Homo sapiens
atgcaacaaattgtgtgcaata

SEQ ID NO: 7415225 - DNA, 22 bp, Homo sapiens
atgcaacaaatgctacgaatcg

SEQ ID NO: 7415226 - DNA, 19 bp, Homo sapiens
atgcaacaaaagtgtaaga

SEQ ID NO: 7415227 - DNA, 19 bp, Homo sapiens
atgcaacaaaagtgtaaga

SEQ ID NO: 7415228 - DNA, 19 bp, Homo sapiens
atgcaacaaaagtgtaaga

SEQ ID NO: 7415229 - DNA, 22 bp, Homo sapiens
atgcaaattgccataaagtggg

SEQ ID NO: 7415230 - DNA, 22 bp, Homo sapiens
atgcaaattgccataaagtggg

SEQ ID NO: 7415231 - DNA, 22 bp, Homo sapiens
atgcaaattctttgcttcttct

SEQ ID NO: 7415232 - DNA, 22 bp, Homo sapiens
atgcaaattctttgcttcttct

SEQ ID NO: 7415233 - DNA, 22 bp, Homo sapiens
atgcaaattcttaggctccatc

SEQ ID NO: 7415234 - DNA, 22 bp, Homo sapiens
atgcaaattctttgcttcttct

SEQ ID NO: 7415235 - DNA, 22 bp, Homo sapiens
atgcaaattctttgcttcttct

SEQ ID NO: 7415236 - DNA, 22 bp, Homo sapiens
atgcaaattctttgcttcttct

SEQ ID NO: 7415237 - DNA, 19 bp, Homo sapiens
atgcaacaaaagtgtaaga

SEQ ID NO: 7415238 - DNA, 22 bp, Homo sapiens
atgcaaattgccataaagtggg

SEQ ID NO: 7415239 - DNA, 22 bp, Homo sapiens
atgcaaattgccataaagtggg

SEQ ID NO: 7415240 - DNA, 22 bp, Homo sapiens
atgcaaattgccataaagtggg

SEQ ID NO: 7415241 - DNA, 22 bp, Homo sapiens
atgcaaattgccataaagtggg

SEQ ID NO: 7415242 - DNA, 22 bp, Homo sapiens
atgcaacacatttgatgagcga

SEQ ID NO: 7415243 - DNA, 22 bp, Homo sapiens
atgcaacaatgtatttatgtat

SEQ ID NO: 7415244 - DNA, 22 bp, Homo sapiens
atgcaacacatttgatgagcga

SEQ ID NO: 7415245 - DNA, 22 bp, Homo sapiens
atgcaacacccctatggatgga

SEQ ID NO: 7415246 - DNA, 22 bp, Homo sapiens
atgcaacacccctatggatgga

SEQ ID NO: 7415247 - DNA, 22 bp, Homo sapiens
atgcaacagagaaaatattgag

SEQ ID NO: 7415248 - DNA, 22 bp, Homo sapiens
atgcaacagagaaaatattgag

SEQ ID NO: 7415249 - DNA, 22 bp, Homo sapiens
atgcaacagagaaaatattgag

SEQ ID NO: 7415250 - DNA, 22 bp, Homo sapiens
atgcaacagaaaattgcctggg

SEQ ID NO: 7415251 - DNA, 22 bp, Homo sapiens
atgcaacagaaaattgcctggg

SEQ ID NO: 7415252 - DNA, 22 bp, Homo sapiens
atgcaacagttcatagttttat

SEQ ID NO: 7415253 - DNA, 22 bp, Homo sapiens
atgcaacagtcagtacatccgg

SEQ ID NO: 7415254 - DNA, 22 bp, Homo sapiens
atgcaacagtcagtacatccgg

SEQ ID NO: 7415255 - DNA, 22 bp, Homo sapiens
atgcaacagggttgggaggcgg

SEQ ID NO: 7415256 - DNA, 22 bp, Homo sapiens
atgcaacagtcagtacatccgg

SEQ ID NO: 7415257 - DNA, 22 bp, Homo sapiens
atgcaacagctgggaatatgta

SEQ ID NO: 7415258 - DNA, 22 bp, Homo sapiens
atgcaacagctgggaatatgta

SEQ ID NO: 7415259 - DNA, 22 bp, Homo sapiens
atgcaacagggttgggaggcgg

SEQ ID NO: 7415260 - DNA, 22 bp, Homo sapiens
atgcaacaggtcagccaggaag

SEQ ID NO: 7415261 - DNA, 22 bp, Homo sapiens
atgcaacaggtcagccaggaag

SEQ ID NO: 7415262 - DNA, 22 bp, Homo sapiens
atgccaggccccacgctgggca

SEQ ID NO: 7415263 - DNA, 22 bp, Homo sapiens
atgccaggccccacgctgggca

SEQ ID NO: 7415264 - DNA, 22 bp, Homo sapiens
atgccaggccccacgctgggca

SEQ ID NO: 7415265 - DNA, 22 bp, Homo sapiens
atgccaggagatggagcagagt

SEQ ID NO: 7415266 - DNA, 23 bp, Homo sapiens
atgccaggctgcctggccagcct

SEQ ID NO: 7415267 - DNA, 22 bp, Homo sapiens
atgccaggctgtttggcctcag

SEQ ID NO: 7415268 - DNA, 22 bp, Homo sapiens
atgccaggctgtttggcctcag

SEQ ID NO: 7415269 - DNA, 22 bp, Homo sapiens
atgccaggaacaaacagtggtg

SEQ ID NO: 7415270 - DNA, 22 bp, Homo sapiens
atgccaggaacaaacagtggtg

SEQ ID NO: 7415271 - DNA, 22 bp, Homo sapiens
atgccaggaacaaacagtggtg

SEQ ID NO: 7415272 - DNA, 22 bp, Homo sapiens
atgccaggaacaaacagtggtg

SEQ ID NO: 7415273 - DNA, 22 bp, Homo sapiens
atgccaggaacaaacagtggtg

SEQ ID NO: 7415274 - DNA, 22 bp, Homo sapiens
atgccaggagatggagcagagt

SEQ ID NO: 7415275 - DNA, 22 bp, Homo sapiens
atgccagacattaacgactatg

SEQ ID NO: 7415276 - DNA, 22 bp, Homo sapiens
atgccagcctctaagcacttta

SEQ ID NO: 7415277 - DNA, 22 bp, Homo sapiens
atgccaggaacaaacagtggtg

SEQ ID NO: 7415278 - DNA, 22 bp, Homo sapiens
atgccagcctctaagcacttta

SEQ ID NO: 7415279 - DNA, 22 bp, Homo sapiens
atgccagctatagacttgttat

SEQ ID NO: 7415280 - DNA, 22 bp, Homo sapiens
atgccacataattacaaataga

SEQ ID NO: 7415281 - DNA, 22 bp, Homo sapiens
atgcaacagttcatagttttat

SEQ ID NO: 7415282 - DNA, 22 bp, Homo sapiens
atgccactgacatggacaattt

SEQ ID NO: 7415283 - DNA, 22 bp, Homo sapiens
atgccactgcactccagcctag

SEQ ID NO: 7415284 - DNA, 22 bp, Homo sapiens
atgccacttcattccagcctcg

SEQ ID NO: 7415285 - DNA, 22 bp, Homo sapiens
atgccacttcattccagcctcg

SEQ ID NO: 7415286 - DNA, 22 bp, Homo sapiens
atgccacttcattccagcctcg

SEQ ID NO: 7415287 - DNA, 22 bp, Homo sapiens
atgccacttcattccagcctcg

SEQ ID NO: 7415288 - DNA, 22 bp, Homo sapiens
atgccactgcactccagcctag

SEQ ID NO: 7415289 - DNA, 22 bp, Homo sapiens
atgccacttctctaagtcatgt

SEQ ID NO: 7415290 - DNA, 22 bp, Homo sapiens
atgccagaaaatgatggctgca

SEQ ID NO: 7415291 - DNA, 22 bp, Homo sapiens
atgccagaaaatgatggctgca

SEQ ID NO: 7415292 - DNA, 22 bp, Homo sapiens
atgccacttctctaagtcatgt

SEQ ID NO: 7415293 - DNA, 22 bp, Homo sapiens
atgccacttcattccagcctcg

SEQ ID NO: 7415294 - DNA, 22 bp, Homo sapiens
atgccacttcattccagcctcg

SEQ ID NO: 7415295 - DNA, 22 bp, Homo sapiens
atgccagaagccaaaaaatatt

SEQ ID NO: 7415296 - DNA, 22 bp, Homo sapiens
atgccagaaaatgatggctgca

SEQ ID NO: 7415297 - DNA, 22 bp, Homo sapiens
acaaatatttactgaatccact

SEQ ID NO: 7415298 - DNA, 22 bp, Homo sapiens
acaaatatttactgaatccact

SEQ ID NO: 7415299 - DNA, 22 bp, Homo sapiens
acaaatatttactgaatccact

SEQ ID NO: 7415300 - DNA, 22 bp, Homo sapiens
acaaatatttactgaatccact

SEQ ID NO: 7415301 - DNA, 22 bp, Homo sapiens
acaaatatttactgaatccact

SEQ ID NO: 7415302 - DNA, 22 bp, Homo sapiens
acaaagctagagaagagaattg

SEQ ID NO: 7415303 - DNA, 22 bp, Homo sapiens
aagaatctgacataatttcctg

SEQ ID NO: 7415304 - DNA, 22 bp, Homo sapiens
acaaagctagagaagagaattg

SEQ ID NO: 7415305 - DNA, 22 bp, Homo sapiens
acaaagctagagaagagaattg

SEQ ID NO: 7415306 - DNA, 22 bp, Homo sapiens
acaaagctctggaaggctcgtc

SEQ ID NO: 7415307 - DNA, 22 bp, Homo sapiens
acaaagctctggaaggctcgtc

SEQ ID NO: 7415308 - DNA, 19 bp, Homo sapiens
acaaagctgtgagcagctt

SEQ ID NO: 7415309 - DNA, 22 bp, Homo sapiens
acaaatatttactgaatccact

SEQ ID NO: 7415310 - DNA, 22 bp, Homo sapiens
acaaatatttactgaatccact

SEQ ID NO: 7415311 - DNA, 22 bp, Homo sapiens
acaaatatttactgaatccact

SEQ ID NO: 7415312 - DNA, 22 bp, Homo sapiens
acaaatatttactgaatccact

SEQ ID NO: 7415313 - DNA, 22 bp, Homo sapiens
acaaatatttactgaatccact

SEQ ID NO: 7415314 - DNA, 22 bp, Homo sapiens
acaaatatttactgaatccact

SEQ ID NO: 7415315 - DNA, 22 bp, Homo sapiens
acaaatatttactgaatccact

SEQ ID NO: 7415316 - DNA, 22 bp, Homo sapiens
acaaatatttactgaatccact

SEQ ID NO: 7415317 - DNA, 22 bp, Homo sapiens
acaaatatttactgaatccact

SEQ ID NO: 7415318 - DNA, 22 bp, Homo sapiens
aagaatctatggtacatccaag

SEQ ID NO: 7415319 - DNA, 22 bp, Homo sapiens
aagaatctatggtacatccaag

SEQ ID NO: 7415320 - DNA, 22 bp, Homo sapiens
aagaatcattgtaaagttctgt

SEQ ID NO: 7415321 - DNA, 22 bp, Homo sapiens
aagaatcattgtaaagttctgt

SEQ ID NO: 7415322 - DNA, 22 bp, Homo sapiens
aagaatctatggtacatccaag

SEQ ID NO: 7415323 - DNA, 22 bp, Homo sapiens
aagaatctccatctgattcact

SEQ ID NO: 7415324 - DNA, 22 bp, Homo sapiens
aagaatctccatctgattcact

SEQ ID NO: 7415325 - DNA, 23 bp, Homo sapiens
aagaatctcagaattagaaatac

SEQ ID NO: 7415326 - DNA, 22 bp, Homo sapiens
aagaatctctctactttattac

SEQ ID NO: 7415327 - DNA, 22 bp, Homo sapiens
aagaatctgacataatttcctg

SEQ ID NO: 7415328 - DNA, 22 bp, Homo sapiens
acaaagctagagaagagaattg

SEQ ID NO: 7415329 - DNA, 22 bp, Homo sapiens
acaaatgaacatataagcttga

SEQ ID NO: 7415330 - DNA, 22 bp, Homo sapiens
acaaatgaacatataagcttga

SEQ ID NO: 7415331 - DNA, 22 bp, Homo sapiens
acaaatctgttttatagacttt

SEQ ID NO: 7415332 - DNA, 22 bp, Homo sapiens
acaaatctgttttatagacttt

SEQ ID NO: 7415333 - DNA, 22 bp, Homo sapiens
acaaatctgttttatagacttt

SEQ ID NO: 7415334 - DNA, 22 bp, Homo sapiens
acaaatctgttttatagacttt

SEQ ID NO: 7415335 - DNA, 22 bp, Homo sapiens
acaaatctgttttatagacttt

SEQ ID NO: 7415336 - DNA, 22 bp, Homo sapiens
acaaatctgttttatagacttt

SEQ ID NO: 7415337 - DNA, 22 bp, Homo sapiens
acaaatccagtgaactccagtg

SEQ ID NO: 7415338 - DNA, 22 bp, Homo sapiens
acaaatccagtgaactccagtg

SEQ ID NO: 7415339 - DNA, 22 bp, Homo sapiens
acaaatgaacatataagcttga

SEQ ID NO: 7415340 - DNA, 22 bp, Homo sapiens
acaaatgaacatataagcttga

SEQ ID NO: 7415341 - DNA, 22 bp, Homo sapiens
acaaatgaacatataagcttga

SEQ ID NO: 7415342 - DNA, 22 bp, Homo sapiens
acaaatgaacctgaaatctcag

SEQ ID NO: 7415343 - DNA, 22 bp, Homo sapiens
acaaatgaacatataagcttga

SEQ ID NO: 7415344 - DNA, 22 bp, Homo sapiens
acaaatgaacatataagcttga

SEQ ID NO: 7415345 - DNA, 22 bp, Homo sapiens
acaaatgaacctgaaatctcag

SEQ ID NO: 7415346 - DNA, 22 bp, Homo sapiens
acaaatgaacctgaaatctcag

SEQ ID NO: 7415347 - DNA, 22 bp, Homo sapiens
acaaatgaacctgaaatctcag

SEQ ID NO: 7415348 - DNA, 22 bp, Homo sapiens
acaaatgaacctgaaatctcag

SEQ ID NO: 7415349 - DNA, 22 bp, Homo sapiens
acaaatgaacctgaaatctcag

SEQ ID NO: 7415350 - DNA, 22 bp, Homo sapiens
acaaatgaacctgaaatctcag

SEQ ID NO: 7415351 - DNA, 22 bp, Homo sapiens
acaaatgaacctgaaatctcag

SEQ ID NO: 7415352 - DNA, 22 bp, Homo sapiens
acaaatgaacctgaaatctcag

SEQ ID NO: 7415353 - DNA, 22 bp, Homo sapiens
acaaatgaatcatacataatgt

SEQ ID NO: 7415354 - DNA, 22 bp, Homo sapiens
acaaatgaatcatacataatgt

SEQ ID NO: 7415355 - DNA, 22 bp, Homo sapiens
acaaatgaatcatacataatgt

SEQ ID NO: 7415356 - DNA, 22 bp, Homo sapiens
acaaatgaacctgaaatctcag

SEQ ID NO: 7415357 - DNA, 22 bp, Homo sapiens
acaaatgaatcatacataatgt

SEQ ID NO: 7415358 - DNA, 22 bp, Homo sapiens
acaaatgaatcatacataatgt

SEQ ID NO: 7415359 - DNA, 22 bp, Homo sapiens
acaaatgaatcatacataatgt

SEQ ID NO: 7415360 - DNA, 22 bp, Homo sapiens
acaaatgaatcatacataatgt

SEQ ID NO: 7415361 - DNA, 22 bp, Homo sapiens
acaaatgaatcatacataatgt

SEQ ID NO: 7415362 - DNA, 22 bp, Homo sapiens
acaaatgaatcatacataatgt

SEQ ID NO: 7415363 - DNA, 22 bp, Homo sapiens
acaaatgaatcatacataatgt

SEQ ID NO: 7415364 - DNA, 22 bp, Homo sapiens
acaaatgaatcatacataatgt

SEQ ID NO: 7415365 - DNA, 22 bp, Homo sapiens
acaaatgaatcatacataatgt

SEQ ID NO: 7415366 - DNA, 22 bp, Homo sapiens
acaaatgactatttggtacagg

SEQ ID NO: 7415367 - DNA, 22 bp, Homo sapiens
acaaatgactatttggtacagg

SEQ ID NO: 7415368 - DNA, 22 bp, Homo sapiens
acaaatgaatcatacataatgt

SEQ ID NO: 7415369 - DNA, 22 bp, Homo sapiens
acaaatgaatcatacataatgt

SEQ ID NO: 7415370 - DNA, 19 bp, Homo sapiens
acaaattgtcctcatcaag

SEQ ID NO: 7415371 - DNA, 22 bp, Homo sapiens
acaaatgactatttggtacagg

SEQ ID NO: 7415372 - DNA, 22 bp, Homo sapiens
acaaatgactatttggtacagg

SEQ ID NO: 7415373 - DNA, 20 bp, Homo sapiens
acaaattggcagaatgacaa

SEQ ID NO: 7415374 - DNA, 20 bp, Homo sapiens
acaaattggcagaatgacaa

SEQ ID NO: 7415375 - DNA, 22 bp, Homo sapiens
acaaaagaataagatgagtcat

SEQ ID NO: 7415376 - DNA, 22 bp, Homo sapiens
acaaaagaataagatgagtcat

SEQ ID NO: 7415377 - DNA, 22 bp, Homo sapiens
acaaaagaataagatgagtcat

SEQ ID NO: 7415378 - DNA, 22 bp, Homo sapiens
acaaaagaataagatgagtcat

SEQ ID NO: 7415379 - DNA, 22 bp, Homo sapiens
acaaaagaataagatgagtcat

SEQ ID NO: 7415380 - DNA, 21 bp, Homo sapiens
acaaaagaagctgccttttaa

SEQ ID NO: 7415381 - DNA, 21 bp, Homo sapiens
acaaaagaagctgccttttaa

SEQ ID NO: 7415382 - DNA, 21 bp, Homo sapiens
acaaaagaagctgccttttaa

SEQ ID NO: 7415383 - DNA, 22 bp, Homo sapiens
acaaaactcttgctgggatttt

SEQ ID NO: 7415384 - DNA, 22 bp, Homo sapiens
acaaaaccagaaaatctctacc

SEQ ID NO: 7415385 - DNA, 22 bp, Homo sapiens
acaaaacagtgttcctgcccct

SEQ ID NO: 7415386 - DNA, 22 bp, Homo sapiens
acaaaaccagaaaatctctacc

SEQ ID NO: 7415387 - DNA, 22 bp, Homo sapiens
acaaaagaataagatgagtcat

SEQ ID NO: 7415388 - DNA, 22 bp, Homo sapiens
acaaaagaataagatgagtcat

SEQ ID NO: 7415389 - DNA, 22 bp, Homo sapiens
acaaaagaataagatgagtcat

SEQ ID NO: 7415390 - DNA, 22 bp, Homo sapiens
acaaaagaataagatgagtcat

SEQ ID NO: 7415391 - DNA, 22 bp, Homo sapiens
acaaaagaataagatgagtcat

SEQ ID NO: 7415392 - DNA, 22 bp, Homo sapiens
acaaaagcactgcagagtaagc

SEQ ID NO: 7415393 - DNA, 22 bp, Homo sapiens
acaaaagcactgcagagtaagc

SEQ ID NO: 7415394 - DNA, 22 bp, Homo sapiens
acaaaagcactgcagagtaagc

SEQ ID NO: 7415395 - DNA, 22 bp, Homo sapiens
acaaaagaataagatgagtcat

SEQ ID NO: 7415396 - DNA, 22 bp, Homo sapiens
acaaaagtgagtgtgtctcaga

SEQ ID NO: 7415397 - DNA, 22 bp, Homo sapiens
acaaaagtgagtgtgtctcaga

SEQ ID NO: 7415398 - DNA, 22 bp, Homo sapiens
acaaaagtagttgcggtttttg

SEQ ID NO: 7415399 - DNA, 22 bp, Homo sapiens
acaaaagtgagtgtgtctcaga

SEQ ID NO: 7415400 - DNA, 22 bp, Homo sapiens
acaaaagtgagtgtgtctcaga

SEQ ID NO: 7415401 - DNA, 22 bp, Homo sapiens
acaaaagtgagtgtgtctcaga

SEQ ID NO: 7415402 - DNA, 22 bp, Homo sapiens
acaaaagtagttgcggtttttg

SEQ ID NO: 7415403 - DNA, 22 bp, Homo sapiens
acaaaagcttttggagggttgt

SEQ ID NO: 7415404 - DNA, 22 bp, Homo sapiens
acaaaagcttttggagggttgt

SEQ ID NO: 7415405 - DNA, 22 bp, Homo sapiens
acaaaagcactgcagagtaagc

SEQ ID NO: 7415406 - DNA, 22 bp, Homo sapiens
acaaaagcactgcagagtaagc

SEQ ID NO: 7415407 - DNA, 22 bp, Homo sapiens
acaaaagtgtaggaattcctta

SEQ ID NO: 7415408 - DNA, 22 bp, Homo sapiens
acaaaagtgtaggaattcctta

SEQ ID NO: 7415409 - DNA, 22 bp, Homo sapiens
acaaaagtgtaggaattcctta

SEQ ID NO: 7415410 - DNA, 22 bp, Homo sapiens
acaaaagtgagtgtgtctcaga

SEQ ID NO: 7415411 - DNA, 22 bp, Homo sapiens
acaaaagtgtaggaattcctta

SEQ ID NO: 7415412 - DNA, 22 bp, Homo sapiens
acaaaagtgtaggaattcctta

SEQ ID NO: 7415413 - DNA, 22 bp, Homo sapiens
acaaaagtgtaggaattcctta

SEQ ID NO: 7415414 - DNA, 22 bp, Homo sapiens
acaaaagtgtaggaattcctta

SEQ ID NO: 7415415 - DNA, 22 bp, Homo sapiens
acaaaagtgtaggaattcctta

SEQ ID NO: 7415416 - DNA, 22 bp, Homo sapiens
acaaaagtgtaggaattcctta

SEQ ID NO: 7415417 - DNA, 22 bp, Homo sapiens
acaaaagtgtaggaattcctta

SEQ ID NO: 7415418 - DNA, 22 bp, Homo sapiens
acaaaagtgtaggaattcctta

SEQ ID NO: 7415419 - DNA, 22 bp, Homo sapiens
acaaaagtgtaggaattcctta

SEQ ID NO: 7415420 - DNA, 22 bp, Homo sapiens
aagaatcatcctgcaagagtct

SEQ ID NO: 7415421 - DNA, 22 bp, Homo sapiens
aagaatcatcctgcaagagtct

SEQ ID NO: 7415422 - DNA, 22 bp, Homo sapiens
aagaatcatctgaactttgagg

SEQ ID NO: 7415423 - DNA, 22 bp, Homo sapiens
aagaatcatctgaactttgagg

SEQ ID NO: 7415424 - DNA, 22 bp, Homo sapiens
aagaatcattgtaaagttctgt

SEQ ID NO: 7415425 - DNA, 17 bp, Homo sapiens
aagaatcattagagaag

SEQ ID NO: 7415426 - DNA, 17 bp, Homo sapiens
aagaatcattagagaag

SEQ ID NO: 7415427 - DNA, 17 bp, Homo sapiens
aagaatcattagagaag

SEQ ID NO: 7415428 - DNA, 23 bp, Homo sapiens
aagaatcagtaagtaaggagacc

SEQ ID NO: 7415429 - DNA, 22 bp, Homo sapiens
aagaatcatcctgcaagagtct

SEQ ID NO: 7415430 - DNA, 22 bp, Homo sapiens
aagaatcatcctgcaagagtct

SEQ ID NO: 7415431 - DNA, 22 bp, Homo sapiens
aagaatcatcctgcaagagtct

SEQ ID NO: 7415432 - DNA, 22 bp, Homo sapiens
aagaatcatcctgcaagagtct

SEQ ID NO: 7415433 - DNA, 22 bp, Homo sapiens
aagaatcatcctgcaagagtct

SEQ ID NO: 7415434 - DNA, 22 bp, Homo sapiens
aagaatatttcctgcacttggg

SEQ ID NO: 7415435 - DNA, 23 bp, Homo sapiens
aagaatcagtaagtaaggagacc

SEQ ID NO: 7415436 - DNA, 22 bp, Homo sapiens
aagaatatagattttttgaagt

SEQ ID NO: 7415437 - DNA, 22 bp, Homo sapiens
aagaatatctgttttatttagg

SEQ ID NO: 7415438 - DNA, 22 bp, Homo sapiens
aagaatatagattttttgaagt

SEQ ID NO: 7415439 - DNA, 22 bp, Homo sapiens
aagaatatagattttttgaagt

SEQ ID NO: 7415440 - DNA, 22 bp, Homo sapiens
acaaaatagagttctcccctgg

SEQ ID NO: 7415441 - DNA, 22 bp, Homo sapiens
acaaaatagagttctcccctgg

SEQ ID NO: 7415442 - DNA, 22 bp, Homo sapiens
acaaaatagagttctcccctgg

SEQ ID NO: 7415443 - DNA, 22 bp, Homo sapiens
acaaaatagagttctcccctgg

SEQ ID NO: 7415444 - DNA, 22 bp, Homo sapiens
acaaaatagagttctcccctgg

SEQ ID NO: 7415445 - DNA, 22 bp, Homo sapiens
aagaatatctgttttatttagg

SEQ ID NO: 7415446 - DNA, 22 bp, Homo sapiens
aagaatatctgttttatttagg

SEQ ID NO: 7415447 - DNA, 22 bp, Homo sapiens
aagaatatctgttttatttagg

SEQ ID NO: 7415448 - DNA, 22 bp, Homo sapiens
aagaatatctgttttatttagg

SEQ ID NO: 7415449 - DNA, 22 bp, Homo sapiens
aagaatatctgttttatttagg

SEQ ID NO: 7415450 - DNA, 22 bp, Homo sapiens
aagaatatctgttttatttagg

SEQ ID NO: 7415451 - DNA, 22 bp, Homo sapiens
aagaatatctgttttatttagg

SEQ ID NO: 7415452 - DNA, 22 bp, Homo sapiens
aagaatatctgttttatttagg

SEQ ID NO: 7415453 - DNA, 22 bp, Homo sapiens
aagaatatctgttttatttagg

SEQ ID NO: 7415454 - DNA, 22 bp, Homo sapiens
aagaatatctgttttatttagg

SEQ ID NO: 7415455 - DNA, 19 bp, Homo sapiens
aagaagcaataagctgtga

SEQ ID NO: 7415456 - DNA, 19 bp, Homo sapiens
aagaagcaataagctgtga

SEQ ID NO: 7415457 - DNA, 21 bp, Homo sapiens
aagaagcaatttattggaagg

SEQ ID NO: 7415458 - DNA, 21 bp, Homo sapiens
aagaagcaatttattggaagg

SEQ ID NO: 7415459 - DNA, 21 bp, Homo sapiens
aagaagcaatttattggaagg

SEQ ID NO: 7415460 - DNA, 22 bp, Homo sapiens
aagaagatggttaactttcagt

SEQ ID NO: 7415461 - DNA, 22 bp, Homo sapiens
aagaagatggttaactttcagt

SEQ ID NO: 7415462 - DNA, 19 bp, Homo sapiens
aagaagcaataagctgtga

SEQ ID NO: 7415463 - DNA, 19 bp, Homo sapiens
aagaagcaataagctgtga

SEQ ID NO: 7415464 - DNA, 19 bp, Homo sapiens
aagaagcaataagctgtga

SEQ ID NO: 7415465 - DNA, 19 bp, Homo sapiens
aagaagcaataagctgtga

SEQ ID NO: 7415466 - DNA, 19 bp, Homo sapiens
aagaagcaataagctgtga

SEQ ID NO: 7415467 - DNA, 22 bp, Homo sapiens
acaaaaagggagatgaggtaga

SEQ ID NO: 7415468 - DNA, 22 bp, Homo sapiens
acaaaaattagctgggcatggt

SEQ ID NO: 7415469 - DNA, 22 bp, Homo sapiens
acaaaaagggagatgaggtaga

SEQ ID NO: 7415470 - DNA, 22 bp, Homo sapiens
acaaaaattagctgggcatggt

SEQ ID NO: 7415471 - DNA, 22 bp, Homo sapiens
acaaaaattagctgggcatggt

SEQ ID NO: 7415472 - DNA, 22 bp, Homo sapiens
aattttatctctaagcaggctt

SEQ ID NO: 7415473 - DNA, 22 bp, Homo sapiens
aattttatctctaagcaggctt

SEQ ID NO: 7415474 - DNA, 22 bp, Homo sapiens
acaaaacagtgttcctgcccct

SEQ ID NO: 7415475 - DNA, 22 bp, Homo sapiens
acaaaacagtgttcctgcccct

SEQ ID NO: 7415476 - DNA, 22 bp, Homo sapiens
acaaaaattagctgggcatggt

SEQ ID NO: 7415477 - DNA, 22 bp, Homo sapiens
acaaaaattagctgggcatggt

SEQ ID NO: 7415478 - DNA, 22 bp, Homo sapiens
acaaaaattagctgggcatggt

SEQ ID NO: 7415479 - DNA, 22 bp, Homo sapiens
acaaaacagtgttcctgcccct

SEQ ID NO: 7415480 - DNA, 22 bp, Homo sapiens
acaaaacagtgttcctgcccct

SEQ ID NO: 7415481 - DNA, 22 bp, Homo sapiens
acaaaacagtgttcctgcccct

SEQ ID NO: 7415482 - DNA, 22 bp, Homo sapiens
acaaaacagtgttcctgcccct

SEQ ID NO: 7415483 - DNA, 22 bp, Homo sapiens
aagaagagaaatgtgctgctgg

SEQ ID NO: 7415484 - DNA, 22 bp, Homo sapiens
aagaagaagtgttatttttaga

SEQ ID NO: 7415485 - DNA, 22 bp, Homo sapiens
aagaagaattattccctaatca

SEQ ID NO: 7415486 - DNA, 22 bp, Homo sapiens
aagaagaattattccctaatca

SEQ ID NO: 7415487 - DNA, 22 bp, Homo sapiens
aagaagaattattccctaatca

SEQ ID NO: 7415488 - DNA, 22 bp, Homo sapiens
aagaagaattattccctaatca

SEQ ID NO: 7415489 - DNA, 22 bp, Homo sapiens
aagaagagaactggcatcctaa

SEQ ID NO: 7415490 - DNA, 22 bp, Homo sapiens
aagaagagaactggcatcctaa

SEQ ID NO: 7415491 - DNA, 22 bp, Homo sapiens
aagaagagaaatgtgctgctgg

SEQ ID NO: 7415492 - DNA, 22 bp, Homo sapiens
aagaagagaaatgtgctgctgg

SEQ ID NO: 7415493 - DNA, 22 bp, Homo sapiens
aagaacttttggcaagtgttat

SEQ ID NO: 7415494 - DNA, 22 bp, Homo sapiens
aagaacttttggcaagtgttat

SEQ ID NO: 7415495 - DNA, 23 bp, Homo sapiens
aagaactttggtcctgcagagtc

SEQ ID NO: 7415496 - DNA, 23 bp, Homo sapiens
aagaactttggtcctgcagagtc

SEQ ID NO: 7415497 - DNA, 22 bp, Homo sapiens
aagaagaagtgttatttttaga

SEQ ID NO: 7415498 - DNA, 22 bp, Homo sapiens
aagaagaagtgttatttttaga

SEQ ID NO: 7415499 - DNA, 22 bp, Homo sapiens
aagaagaagtgttatttttaga

SEQ ID NO: 7415500 - DNA, 22 bp, Homo sapiens
aagaagaagtgttatttttaga

SEQ ID NO: 7415501 - DNA, 22 bp, Homo sapiens
aagaactgtatcaagatgtagt

SEQ ID NO: 7415502 - DNA, 22 bp, Homo sapiens
aagaactgtatcaagatgtagt

SEQ ID NO: 7415503 - DNA, 22 bp, Homo sapiens
aagaactgtatcaagatgtagt

SEQ ID NO: 7415504 - DNA, 22 bp, Homo sapiens
aagaactgtatcaagatgtagt

SEQ ID NO: 7415505 - DNA, 22 bp, Homo sapiens
aagaactgtgctccaggctcca

SEQ ID NO: 7415506 - DNA, 22 bp, Homo sapiens
aagaactgtttacaattttcac

SEQ ID NO: 7415507 - DNA, 22 bp, Homo sapiens
aagaactgtttacaattttcac

SEQ ID NO: 7415508 - DNA, 22 bp, Homo sapiens
aagaacttcctaatatattttc

SEQ ID NO: 7415509 - DNA, 22 bp, Homo sapiens
aagaacttcctaatatattttc

SEQ ID NO: 7415510 - DNA, 22 bp, Homo sapiens
aagaactttaaagcacttatga

SEQ ID NO: 7415511 - DNA, 22 bp, Homo sapiens
aagaacttgggctgagtgaaag

SEQ ID NO: 7415512 - DNA, 22 bp, Homo sapiens
aagaacttgggctgagtgaaag

SEQ ID NO: 7415513 - DNA, 22 bp, Homo sapiens
aagaactttaaagcacttatga

SEQ ID NO: 7415514 - DNA, 22 bp, Homo sapiens
aagaactttaaagcacttatga

SEQ ID NO: 7415515 - DNA, 22 bp, Homo sapiens
aagaactttgatttcattgcat

SEQ ID NO: 7415516 - DNA, 22 bp, Homo sapiens
aagaactttgatttcattgcat

SEQ ID NO: 7415517 - DNA, 22 bp, Homo sapiens
aagaactttgatttcattgcat

SEQ ID NO: 7415518 - DNA, 22 bp, Homo sapiens
aagaactttgatttcattgcat

SEQ ID NO: 7415519 - DNA, 22 bp, Homo sapiens
aagaactagtcttacagcctca

SEQ ID NO: 7415520 - DNA, 22 bp, Homo sapiens
aagaaccaaaatgaagctaggt

SEQ ID NO: 7415521 - DNA, 22 bp, Homo sapiens
aagaactatctctggctgtagg

SEQ ID NO: 7415522 - DNA, 19 bp, Homo sapiens
aagaactatgtgattacag

SEQ ID NO: 7415523 - DNA, 21 bp, Homo sapiens
aagaactattgaggtacacag

SEQ ID NO: 7415524 - DNA, 23 bp, Homo sapiens
aagaactgcgaatggagaaagta

SEQ ID NO: 7415525 - DNA, 22 bp, Homo sapiens
aagaactgagtacgttaataaa

SEQ ID NO: 7415526 - DNA, 23 bp, Homo sapiens
aagaactgcgaatggagaaagta

SEQ ID NO: 7415527 - DNA, 23 bp, Homo sapiens
aagaactgcgaatggagaaagta

SEQ ID NO: 7415528 - DNA, 22 bp, Homo sapiens
aagaactgagtacgttaataaa

SEQ ID NO: 7415529 - DNA, 22 bp, Homo sapiens
aagaactggttatgttatcttg

SEQ ID NO: 7415530 - DNA, 21 bp, Homo sapiens
aagaactattgaggtacacag

SEQ ID NO: 7415531 - DNA, 19 bp, Homo sapiens
aagaactatgtgattacag

SEQ ID NO: 7415532 - DNA, 18 bp, Homo sapiens
aagaactgaggtcctaga

SEQ ID NO: 7415533 - DNA, 18 bp, Homo sapiens
aagaactgaggtcctaga

SEQ ID NO: 7415534 - DNA, 22 bp, Homo sapiens
aagaactgagtacgttaataaa

SEQ ID NO: 7415535 - DNA, 22 bp, Homo sapiens
aagaacattttgtagaatgaca

SEQ ID NO: 7415536 - DNA, 22 bp, Homo sapiens
aagaacattttgtagaatgaca

SEQ ID NO: 7415537 - DNA, 22 bp, Homo sapiens
aagaacattttgtagaatgaca

SEQ ID NO: 7415538 - DNA, 22 bp, Homo sapiens
aagaacattttgtagaatgaca

SEQ ID NO: 7415539 - DNA, 22 bp, Homo sapiens
aagaacattttgtagaatgaca

SEQ ID NO: 7415540 - DNA, 22 bp, Homo sapiens
aagaacattttgtagaatgaca

SEQ ID NO: 7415541 - DNA, 22 bp, Homo sapiens
aagaaccaaaatgaagctaggt

SEQ ID NO: 7415542 - DNA, 22 bp, Homo sapiens
aagaaccaaaatgaagctaggt

SEQ ID NO: 7415543 - DNA, 22 bp, Homo sapiens
aagaacattttgtagaatgaca

SEQ ID NO: 7415544 - DNA, 22 bp, Homo sapiens
aagaacattttgtagaatgaca

SEQ ID NO: 7415545 - DNA, 22 bp, Homo sapiens
aagaacattttgtagaatgaca

SEQ ID NO: 7415546 - DNA, 22 bp, Homo sapiens
aagaacattttgtagaatgaca

SEQ ID NO: 7415547 - DNA, 22 bp, Homo sapiens
aagaacattttgtagaatgaca

SEQ ID NO: 7415548 - DNA, 22 bp, Homo sapiens
aagaacattttgtagaatgaca

SEQ ID NO: 7415549 - DNA, 22 bp, Homo sapiens
aagaacattttgtagaatgaca

SEQ ID NO: 7415550 - DNA, 22 bp, Homo sapiens
aagaacattttgtagaatgaca

SEQ ID NO: 7415551 - DNA, 22 bp, Homo sapiens
aagaacattgatattgtctatg

SEQ ID NO: 7415552 - DNA, 22 bp, Homo sapiens
aagaacattgatattgtctatg

SEQ ID NO: 7415553 - DNA, 22 bp, Homo sapiens
aagaacattgatattgtctatg

SEQ ID NO: 7415554 - DNA, 22 bp, Homo sapiens
aagaacatttatgatggcattt

SEQ ID NO: 7415555 - DNA, 22 bp, Homo sapiens
aagaacatttatgatggcattt

SEQ ID NO: 7415556 - DNA, 22 bp, Homo sapiens
aagaacatttatgatggcattt

SEQ ID NO: 7415557 - DNA, 22 bp, Homo sapiens
aatgtacaagggttccagtttt

SEQ ID NO: 7415558 - DNA, 22 bp, Homo sapiens
aatgtacaagggttccagtttt

SEQ ID NO: 7415559 - DNA, 22 bp, Homo sapiens
aatgtacaagggttccagtttt

SEQ ID NO: 7415560 - DNA, 22 bp, Homo sapiens
aatgtacaagggttccagtttt

SEQ ID NO: 7415561 - DNA, 22 bp, Homo sapiens
aatgtacaagggttccagtttt

SEQ ID NO: 7415562 - DNA, 22 bp, Homo sapiens
aatgtacaagggttccagtttt

SEQ ID NO: 7415563 - DNA, 22 bp, Homo sapiens
aatgtacaagggttccagtttt

SEQ ID NO: 7415564 - DNA, 22 bp, Homo sapiens
aatgtacaagggttccagtttt

SEQ ID NO: 7415565 - DNA, 22 bp, Homo sapiens
aatgtacaagggttccagtttt

SEQ ID NO: 7415566 - DNA, 22 bp, Homo sapiens
aatgtacaagggttccagtttt

SEQ ID NO: 7415567 - DNA, 22 bp, Homo sapiens
aatgtacaataagacaaagagg

SEQ ID NO: 7415568 - DNA, 22 bp, Homo sapiens
aatgtacaataagacaaagagg

SEQ ID NO: 7415569 - DNA, 22 bp, Homo sapiens
aatgtacaataagacaaagagg

SEQ ID NO: 7415570 - DNA, 22 bp, Homo sapiens
aatgtacaataagacaaagagg

SEQ ID NO: 7415571 - DNA, 22 bp, Homo sapiens
aatgtacaataagacaaagagg

SEQ ID NO: 7415572 - DNA, 22 bp, Homo sapiens
aatgtacaataagacaaagagg

SEQ ID NO: 7415573 - DNA, 22 bp, Homo sapiens
aagaacaggttctagaaccatt

SEQ ID NO: 7415574 - DNA, 22 bp, Homo sapiens
aagaacaggttctagaaccatt

SEQ ID NO: 7415575 - DNA, 22 bp, Homo sapiens
aagaacaggttctagaaccatt

SEQ ID NO: 7415576 - DNA, 22 bp, Homo sapiens
aagaacaggttctagaaccatt

SEQ ID NO: 7415577 - DNA, 22 bp, Homo sapiens
aagaacaggttctagaaccatt

SEQ ID NO: 7415578 - DNA, 22 bp, Homo sapiens
aagaacaggttctagaaccatt

SEQ ID NO: 7415579 - DNA, 22 bp, Homo sapiens
aagaacaggttctagaaccatt

SEQ ID NO: 7415580 - DNA, 22 bp, Homo sapiens
aatgtacaataagacaaagagg

SEQ ID NO: 7415581 - DNA, 22 bp, Homo sapiens
aagaacaggttctagaaccatt

SEQ ID NO: 7415582 - DNA, 22 bp, Homo sapiens
aagaacaggttctagaaccatt

SEQ ID NO: 7415583 - DNA, 22 bp, Homo sapiens
aagaacaggttctagaaccatt

SEQ ID NO: 7415584 - DNA, 22 bp, Homo sapiens
aagaacatgttaaaagattcac

SEQ ID NO: 7415585 - DNA, 22 bp, Homo sapiens
aagaacagtgtcctgggactcg

SEQ ID NO: 7415586 - DNA, 22 bp, Homo sapiens
aagaacagtgtcctgggactcg

SEQ ID NO: 7415587 - DNA, 22 bp, Homo sapiens
aagaacagtgtcctgggactcg

SEQ ID NO: 7415588 - DNA, 22 bp, Homo sapiens
aagaacatgttaaaagattcac

SEQ ID NO: 7415589 - DNA, 22 bp, Homo sapiens
aagaacatgttaaaagattcac

SEQ ID NO: 7415590 - DNA, 22 bp, Homo sapiens
aagaacatgttaaaagattcac

SEQ ID NO: 7415591 - DNA, 22 bp, Homo sapiens
aagaacatgttaaaagattcac

SEQ ID NO: 7415592 - DNA, 22 bp, Homo sapiens
aagaacattgatattgtctatg

SEQ ID NO: 7415593 - DNA, 22 bp, Homo sapiens
aagaacattgatattgtctatg

SEQ ID NO: 7415594 - DNA, 22 bp, Homo sapiens
aagaacattgatattgtctatg

SEQ ID NO: 7415595 - DNA, 22 bp, Homo sapiens
aagaacattgatattgtctatg

SEQ ID NO: 7415596 - DNA, 22 bp, Homo sapiens
aagaacattgatattgtctatg

SEQ ID NO: 7415597 - DNA, 22 bp, Homo sapiens
aagaacattgactaagaggggc

SEQ ID NO: 7415598 - DNA, 22 bp, Homo sapiens
aagaacattgactaagaggggc

SEQ ID NO: 7415599 - DNA, 22 bp, Homo sapiens
aagaacatgttaaaagattcac

SEQ ID NO: 7415600 - DNA, 22 bp, Homo sapiens
acaatagtaaggtatattgtca

SEQ ID NO: 7415601 - DNA, 22 bp, Homo sapiens
acaatagtaaggtatattgtca

SEQ ID NO: 7415602 - DNA, 22 bp, Homo sapiens
acaatagtaaggtatattgtca

SEQ ID NO: 7415603 - DNA, 20 bp, Homo sapiens
acaatagatttgagcaaagt

SEQ ID NO: 7415604 - DNA, 20 bp, Homo sapiens
acaatagatttgagcaaagt

SEQ ID NO: 7415605 - DNA, 22 bp, Homo sapiens
acaatagtatgagccttttaga

SEQ ID NO: 7415606 - DNA, 22 bp, Homo sapiens
acaatagtgcctggcatagagt

SEQ ID NO: 7415607 - DNA, 22 bp, Homo sapiens
acaatatacacatcctaatggg

SEQ ID NO: 7415608 - DNA, 20 bp, Homo sapiens
acaatagatttgagcaaagt

SEQ ID NO: 7415609 - DNA, 22 bp, Homo sapiens
acaatagatactgggcacatat

SEQ ID NO: 7415610 - DNA, 22 bp, Homo sapiens
acaatagatactgggcacatat

SEQ ID NO: 7415611 - DNA, 22 bp, Homo sapiens
acaatagagttctcataggaca

SEQ ID NO: 7415612 - DNA, 22 bp, Homo sapiens
acaatagagttctcataggaca

SEQ ID NO: 7415613 - DNA, 22 bp, Homo sapiens
acaatagagttctcataggaca

SEQ ID NO: 7415614 - DNA, 22 bp, Homo sapiens
acaatagagttctcataggaca

SEQ ID NO: 7415615 - DNA, 22 bp, Homo sapiens
acaatagagttctcataggaca

SEQ ID NO: 7415616 - DNA, 22 bp, Homo sapiens
acaatagagttctcataggaca

SEQ ID NO: 7415617 - DNA, 22 bp, Homo sapiens
acaatagagttctcataggaca

SEQ ID NO: 7415618 - DNA, 22 bp, Homo sapiens
acaatagacccatgacacatac

SEQ ID NO: 7415619 - DNA, 21 bp, Homo sapiens
acaatagacataagcagagca

SEQ ID NO: 7415620 - DNA, 22 bp, Homo sapiens
acaatagacccatgacacatac

SEQ ID NO: 7415621 - DNA, 22 bp, Homo sapiens
acaatagacccatgacacatac

SEQ ID NO: 7415622 - DNA, 21 bp, Homo sapiens
acaatagacataagcagagca

SEQ ID NO: 7415623 - DNA, 21 bp, Homo sapiens
acaatagacataagcagagca

SEQ ID NO: 7415624 - DNA, 22 bp, Homo sapiens
acaaggcttcacacagtatgaa

SEQ ID NO: 7415625 - DNA, 22 bp, Homo sapiens
acaaggcttatagttgcttttt

SEQ ID NO: 7415626 - DNA, 22 bp, Homo sapiens
acaaggcttcacacagtatgaa

SEQ ID NO: 7415627 - DNA, 22 bp, Homo sapiens
acaaggcttcacacagtatgaa

SEQ ID NO: 7415628 - DNA, 22 bp, Homo sapiens
acaaggcttcatattcttttta

SEQ ID NO: 7415629 - DNA, 22 bp, Homo sapiens
acaaggcttcatattcttttta

SEQ ID NO: 7415630 - DNA, 22 bp, Homo sapiens
acaacaaaatcactagtcttcc

SEQ ID NO: 7415631 - DNA, 22 bp, Homo sapiens
acaacaaaatcactagtcttcc

SEQ ID NO: 7415632 - DNA, 22 bp, Homo sapiens
acaacaaaatcactagtcttcc

SEQ ID NO: 7415633 - DNA, 22 bp, Homo sapiens
acaacaaaatcactagtcttcc

SEQ ID NO: 7415634 - DNA, 22 bp, Homo sapiens
acaacaaaatcactagtcttcc

SEQ ID NO: 7415635 - DNA, 22 bp, Homo sapiens
acaaggcttatagttgcttttt

SEQ ID NO: 7415636 - DNA, 22 bp, Homo sapiens
acaacaaaatcactagtcttcc

SEQ ID NO: 7415637 - DNA, 22 bp, Homo sapiens
acaaattgttgggactcagccc

SEQ ID NO: 7415638 - DNA, 22 bp, Homo sapiens
acaaattgttgcttcatgaatg

SEQ ID NO: 7415639 - DNA, 22 bp, Homo sapiens
acaaattgttgcttcatgaatg

SEQ ID NO: 7415640 - DNA, 22 bp, Homo sapiens
acaaattgttgcttcatgaatg

SEQ ID NO: 7415641 - DNA, 22 bp, Homo sapiens
acaaattgttgcttcatgaatg

SEQ ID NO: 7415642 - DNA, 22 bp, Homo sapiens
acaaattgttgcttcatgaatg

SEQ ID NO: 7415643 - DNA, 21 bp, Homo sapiens
acaaattgtttatataggaag

SEQ ID NO: 7415644 - DNA, 22 bp, Homo sapiens
acaaatttattgaagggcatat

SEQ ID NO: 7415645 - DNA, 22 bp, Homo sapiens
acaaattgttgggactcagccc

SEQ ID NO: 7415646 - DNA, 21 bp, Homo sapiens
acaaattgtttatataggaag

SEQ ID NO: 7415647 - DNA, 21 bp, Homo sapiens
acaaattgtttatataggaag

SEQ ID NO: 7415648 - DNA, 22 bp, Homo sapiens
acaaatttcataggcaaatttt

SEQ ID NO: 7415649 - DNA, 22 bp, Homo sapiens
acaaatttcataggcaaatttt

SEQ ID NO: 7415650 - DNA, 22 bp, Homo sapiens
acaaatttcataggcaaatttt

SEQ ID NO: 7415651 - DNA, 22 bp, Homo sapiens
acaaatttcataggcaaatttt

SEQ ID NO: 7415652 - DNA, 22 bp, Homo sapiens
acaaatttcataggcaaatttt

SEQ ID NO: 7415653 - DNA, 22 bp, Homo sapiens
acaaatttcataggcaaatttt

SEQ ID NO: 7415654 - DNA, 22 bp, Homo sapiens
acaaatttcataggcaaatttt

SEQ ID NO: 7415655 - DNA, 22 bp, Homo sapiens
acaaatttcataggcaaatttt

SEQ ID NO: 7415656 - DNA, 22 bp, Homo sapiens
acaaatttcataggcaaatttt

SEQ ID NO: 7415657 - DNA, 22 bp, Homo sapiens
acaaatttgtgtagttatggca

SEQ ID NO: 7415658 - DNA, 22 bp, Homo sapiens
acaacaaaatcactagtcttcc

SEQ ID NO: 7415659 - DNA, 22 bp, Homo sapiens
acaacaaaatcactagtcttcc

SEQ ID NO: 7415660 - DNA, 22 bp, Homo sapiens
acaacaaaatcactagtcttcc

SEQ ID NO: 7415661 - DNA, 22 bp, Homo sapiens
acaacaaaatcactagtcttcc

SEQ ID NO: 7415662 - DNA, 22 bp, Homo sapiens
acaaatttgtgtagttatggca

SEQ ID NO: 7415663 - DNA, 22 bp, Homo sapiens
acaaatttgtgtagttatggca

SEQ ID NO: 7415664 - DNA, 22 bp, Homo sapiens
acaaatttggtgagagtaaata

SEQ ID NO: 7415665 - DNA, 22 bp, Homo sapiens
acaaatttggtgagagtaaata

SEQ ID NO: 7415666 - DNA, 22 bp, Homo sapiens
acaaatttggtgagagtaaata

SEQ ID NO: 7415667 - DNA, 22 bp, Homo sapiens
acaaatttgtgtagttatggca

SEQ ID NO: 7415668 - DNA, 22 bp, Homo sapiens
acaaatttgtgtagttatggca

SEQ ID NO: 7415669 - DNA, 22 bp, Homo sapiens
acaaatttgtgtagttatggca

SEQ ID NO: 7415670 - DNA, 22 bp, Homo sapiens
acaaatttgaatcctgacttct

SEQ ID NO: 7415671 - DNA, 22 bp, Homo sapiens
acaaatttcataggcaaatttt

SEQ ID NO: 7415672 - DNA, 22 bp, Homo sapiens
acaaatttgaatcctgacttct

SEQ ID NO: 7415673 - DNA, 22 bp, Homo sapiens
acaaatttgaatcctgacttct

SEQ ID NO: 7415674 - DNA, 22 bp, Homo sapiens
acaaatttggtgagagtaaata

SEQ ID NO: 7415675 - DNA, 22 bp, Homo sapiens
acaaatttggtgagagtaaata

SEQ ID NO: 7415676 - DNA, 22 bp, Homo sapiens
acaaatttgaatcctgacttct

SEQ ID NO: 7415677 - DNA, 22 bp, Homo sapiens
acaaatttggtgagagtaaata

SEQ ID NO: 7415678 - DNA, 22 bp, Homo sapiens
acaaatttggtgagagtaaata

SEQ ID NO: 7415679 - DNA, 22 bp, Homo sapiens
acaatgtagttgtcatgagaca

SEQ ID NO: 7415680 - DNA, 22 bp, Homo sapiens
acaatgtagttgtcatgagaca

SEQ ID NO: 7415681 - DNA, 21 bp, Homo sapiens
acaatgtcaaggtcagacatt

SEQ ID NO: 7415682 - DNA, 22 bp, Homo sapiens
acaatgtcacctctcatgtttt

SEQ ID NO: 7415683 - DNA, 21 bp, Homo sapiens
acaatgtcaaggtcagacatt

SEQ ID NO: 7415684 - DNA, 21 bp, Homo sapiens
acaatgtcaaggtcagacatt

SEQ ID NO: 7415685 - DNA, 22 bp, Homo sapiens
acaatgtcaaaataggaaacat

SEQ ID NO: 7415686 - DNA, 22 bp, Homo sapiens
acaatgtcaaaataggaaacat

SEQ ID NO: 7415687 - DNA, 22 bp, Homo sapiens
acaatgtagttgtcatgagaca

SEQ ID NO: 7415688 - DNA, 22 bp, Homo sapiens
acaatgtaggatatgtacttgt

SEQ ID NO: 7415689 - DNA, 22 bp, Homo sapiens
acaatgtaggagtatgacagta

SEQ ID NO: 7415690 - DNA, 22 bp, Homo sapiens
acaatgtaggagtatgacagta

SEQ ID NO: 7415691 - DNA, 22 bp, Homo sapiens
acaatgtaggatatgtacttgt

SEQ ID NO: 7415692 - DNA, 22 bp, Homo sapiens
acaatgtaggagtatgacagta

SEQ ID NO: 7415693 - DNA, 22 bp, Homo sapiens
acaatgtgataatttaaagata

SEQ ID NO: 7415694 - DNA, 22 bp, Homo sapiens
acaatgtgcttatgaaggcagt

SEQ ID NO: 7415695 - DNA, 22 bp, Homo sapiens
acaatgtgggcatgagaaacca

SEQ ID NO: 7415696 - DNA, 22 bp, Homo sapiens
acaatgtgataatttaaagata

SEQ ID NO: 7415697 - DNA, 22 bp, Homo sapiens
acaatgtgataatttaaagata

SEQ ID NO: 7415698 - DNA, 22 bp, Homo sapiens
acaatgtgacctgacagtgtta

SEQ ID NO: 7415699 - DNA, 22 bp, Homo sapiens
acaatgtgacctgacagtgtta

SEQ ID NO: 7415700 - DNA, 22 bp, Homo sapiens
acaatgttctacatatacataa

SEQ ID NO: 7415701 - DNA, 22 bp, Homo sapiens
acaatgttctacatatacataa

SEQ ID NO: 7415702 - DNA, 22 bp, Homo sapiens
acaatgttctacatatacataa

SEQ ID NO: 7415703 - DNA, 22 bp, Homo sapiens
acaatgtgtttttatacatttg

SEQ ID NO: 7415704 - DNA, 22 bp, Homo sapiens
acaatgtgtttttatacatttg

SEQ ID NO: 7415705 - DNA, 22 bp, Homo sapiens
acaatgtgtttttatacatttg

SEQ ID NO: 7415706 - DNA, 22 bp, Homo sapiens
acaatgtgggcatgagaaacca

SEQ ID NO: 7415707 - DNA, 22 bp, Homo sapiens
acaatgtctcatattcgtgttc

SEQ ID NO: 7415708 - DNA, 22 bp, Homo sapiens
acaatgtctcatattcgtgttc

SEQ ID NO: 7415709 - DNA, 22 bp, Homo sapiens
acaatgtctcatattcgtgttc

SEQ ID NO: 7415710 - DNA, 22 bp, Homo sapiens
acaatgtcacctctcatgtttt

SEQ ID NO: 7415711 - DNA, 22 bp, Homo sapiens
acaatgtcacctctcatgtttt

SEQ ID NO: 7415712 - DNA, 23 bp, Homo sapiens
acaatgtctgttcataaaatacc

SEQ ID NO: 7415713 - DNA, 23 bp, Homo sapiens
acaatgtctgttcataaaatacc

SEQ ID NO: 7415714 - DNA, 23 bp, Homo sapiens
acaatgtctgttcataaaatacc

SEQ ID NO: 7415715 - DNA, 23 bp, Homo sapiens
acaatgtctgttcataaaatacc

SEQ ID NO: 7415716 - DNA, 22 bp, Homo sapiens
acaatcacacatgcaattatac

SEQ ID NO: 7415717 - DNA, 22 bp, Homo sapiens
acaatatttgggggcagtttgt

SEQ ID NO: 7415718 - DNA, 22 bp, Homo sapiens
acaatgtagagtaaaatatgtt

SEQ ID NO: 7415719 - DNA, 22 bp, Homo sapiens
acaatgtagagtaaaatatgtt

SEQ ID NO: 7415720 - DNA, 22 bp, Homo sapiens
acaatgtagagtaaaatatgtt

SEQ ID NO: 7415721 - DNA, 22 bp, Homo sapiens
acaatatttgggggcagtttgt

SEQ ID NO: 7415722 - DNA, 22 bp, Homo sapiens
acaatattgtacccagaagttt

SEQ ID NO: 7415723 - DNA, 22 bp, Homo sapiens
acaatatttgggggcagtttgt

SEQ ID NO: 7415724 - DNA, 22 bp, Homo sapiens
acaatatttgggggcagtttgt

SEQ ID NO: 7415725 - DNA, 22 bp, Homo sapiens
acaatatttgggggcagtttgt

SEQ ID NO: 7415726 - DNA, 20 bp, Homo sapiens
acaatatgtagatgaatagc

SEQ ID NO: 7415727 - DNA, 22 bp, Homo sapiens
acaatattgtacccagaagttt

SEQ ID NO: 7415728 - DNA, 22 bp, Homo sapiens
acaatattgtacccagaagttt

SEQ ID NO: 7415729 - DNA, 22 bp, Homo sapiens
acaatattgtacccagaagttt

SEQ ID NO: 7415730 - DNA, 22 bp, Homo sapiens
acaatattgtacccagaagttt

SEQ ID NO: 7415731 - DNA, 22 bp, Homo sapiens
acaatattgtacccagaagttt

SEQ ID NO: 7415732 - DNA, 22 bp, Homo sapiens
acaatattgtacccagaagttt

SEQ ID NO: 7415733 - DNA, 22 bp, Homo sapiens
acaatattgtacccagaagttt

SEQ ID NO: 7415734 - DNA, 22 bp, Homo sapiens
acaatattgtacccagaagttt

SEQ ID NO: 7415735 - DNA, 22 bp, Homo sapiens
acaatattgtacccagaagttt

SEQ ID NO: 7415736 - DNA, 22 bp, Homo sapiens
acaatatagtccatgagcatgc

SEQ ID NO: 7415737 - DNA, 22 bp, Homo sapiens
acaatatctcagacagaaagac

SEQ ID NO: 7415738 - DNA, 22 bp, Homo sapiens
acaatatgggatatacatttta

SEQ ID NO: 7415739 - DNA, 20 bp, Homo sapiens
acaatatgtagatgaatagc

SEQ ID NO: 7415740 - DNA, 20 bp, Homo sapiens
acaatatgtagatgaatagc

SEQ ID NO: 7415741 - DNA, 22 bp, Homo sapiens
acaatatgggatatacatttta

SEQ ID NO: 7415742 - DNA, 22 bp, Homo sapiens
acaatatgggatatacatttta

SEQ ID NO: 7415743 - DNA, 22 bp, Homo sapiens
acaatatgggatatacatttta

SEQ ID NO: 7415744 - DNA, 22 bp, Homo sapiens
acaatatagtccatgagcatgc

SEQ ID NO: 7415745 - DNA, 22 bp, Homo sapiens
acaatatacacatcctaatggg

SEQ ID NO: 7415746 - DNA, 22 bp, Homo sapiens
acaatatagtccatgagcatgc

SEQ ID NO: 7415747 - DNA, 22 bp, Homo sapiens
acaatatagtccatgagcatgc

SEQ ID NO: 7415748 - DNA, 22 bp, Homo sapiens
acaatatagtccatgagcatgc

SEQ ID NO: 7415749 - DNA, 22 bp, Homo sapiens
acaatatagtccatgagcatgc

SEQ ID NO: 7415750 - DNA, 22 bp, Homo sapiens
acaatatagtccatgagcatgc

SEQ ID NO: 7415751 - DNA, 22 bp, Homo sapiens
acaatatagtccatgagcatgc

SEQ ID NO: 7415752 - DNA, 22 bp, Homo sapiens
acaatatagtccatgagcatgc

SEQ ID NO: 7415753 - DNA, 22 bp, Homo sapiens
acacagagctggaactgcttca

SEQ ID NO: 7415754 - DNA, 22 bp, Homo sapiens
acacagagctggaactgcttca

SEQ ID NO: 7415755 - DNA, 22 bp, Homo sapiens
acacagagccagggaatacagt

SEQ ID NO: 7415756 - DNA, 22 bp, Homo sapiens
acacagagccagggaatacagt

SEQ ID NO: 7415757 - DNA, 22 bp, Homo sapiens
acacagagccagggaatacagt

SEQ ID NO: 7415758 - DNA, 22 bp, Homo sapiens
acacagagccagggaatacagt

SEQ ID NO: 7415759 - DNA, 22 bp, Homo sapiens
acacagagccagggaatacagt

SEQ ID NO: 7415760 - DNA, 22 bp, Homo sapiens
acacagagccaaaccatatcac

SEQ ID NO: 7415761 - DNA, 22 bp, Homo sapiens
acacagagcaaatcatgacaga

SEQ ID NO: 7415762 - DNA, 22 bp, Homo sapiens
acacagagcaaatcatgacaga

SEQ ID NO: 7415763 - DNA, 22 bp, Homo sapiens
acacagagcaaatcatgacaga

SEQ ID NO: 7415764 - DNA, 22 bp, Homo sapiens
acacagagcaaatcatgacaga

SEQ ID NO: 7415765 - DNA, 22 bp, Homo sapiens
acacagagcaaatcatgacaga

SEQ ID NO: 7415766 - DNA, 22 bp, Homo sapiens
acacagagcaaatcatgacaga

SEQ ID NO: 7415767 - DNA, 22 bp, Homo sapiens
acacagagcaaatcatgacaga

SEQ ID NO: 7415768 - DNA, 22 bp, Homo sapiens
acacagagcaaatcatgacaga

SEQ ID NO: 7415769 - DNA, 22 bp, Homo sapiens
acacagagcaaatcatgacaga

SEQ ID NO: 7415770 - DNA, 22 bp, Homo sapiens
acacagagcttctcaactggga

SEQ ID NO: 7415771 - DNA, 22 bp, Homo sapiens
acacagcaacttgcagtatgga

SEQ ID NO: 7415772 - DNA, 22 bp, Homo sapiens
acacagcaacttgcagtatgga

SEQ ID NO: 7415773 - DNA, 22 bp, Homo sapiens
acacagagcttctcaactggga

SEQ ID NO: 7415774 - DNA, 22 bp, Homo sapiens
acacagagcttctcaactggga

SEQ ID NO: 7415775 - DNA, 22 bp, Homo sapiens
acacagagcttctcaactggga

SEQ ID NO: 7415776 - DNA, 22 bp, Homo sapiens
acacagagctggaactgcttca

SEQ ID NO: 7415777 - DNA, 22 bp, Homo sapiens
acacagagctggaactgcttca

SEQ ID NO: 7415778 - DNA, 22 bp, Homo sapiens
acacagagctggaactgcttca

SEQ ID NO: 7415779 - DNA, 22 bp, Homo sapiens
acacagagctggaactgcttca

SEQ ID NO: 7415780 - DNA, 22 bp, Homo sapiens
acacagagctggaactgcttca

SEQ ID NO: 7415781 - DNA, 22 bp, Homo sapiens
acacagagctggaactgcttca

SEQ ID NO: 7415782 - DNA, 22 bp, Homo sapiens
acacagcaaggtctgactttgg

SEQ ID NO: 7415783 - DNA, 22 bp, Homo sapiens
acacagcaaggtctgactttgg

SEQ ID NO: 7415784 - DNA, 22 bp, Homo sapiens
acacagcaaggtctgactttgg

SEQ ID NO: 7415785 - DNA, 22 bp, Homo sapiens
acacagcaacttgcagtatgga

SEQ ID NO: 7415786 - DNA, 22 bp, Homo sapiens
acacagcaacttgcagtatgga

SEQ ID NO: 7415787 - DNA, 22 bp, Homo sapiens
acacagcaacttgcagtatgga

SEQ ID NO: 7415788 - DNA, 22 bp, Homo sapiens
acacagcaacttgcagtatgga

SEQ ID NO: 7415789 - DNA, 22 bp, Homo sapiens
acacagcaacttgcagtatgga

SEQ ID NO: 7415790 - DNA, 22 bp, Homo sapiens
acacagcaacttgcagtatgga

SEQ ID NO: 7415791 - DNA, 17 bp, Homo sapiens
acacagacaggcagaca

SEQ ID NO: 7415792 - DNA, 22 bp, Homo sapiens
acacagaagctttttctattcc

SEQ ID NO: 7415793 - DNA, 17 bp, Homo sapiens
acacagacaggcagaca

SEQ ID NO: 7415794 - DNA, 17 bp, Homo sapiens
acacagacaggcagaca

SEQ ID NO: 7415795 - DNA, 17 bp, Homo sapiens
acacagacaggcagaca

SEQ ID NO: 7415796 - DNA, 17 bp, Homo sapiens
acacagacaggcagaca

SEQ ID NO: 7415797 - DNA, 17 bp, Homo sapiens
acacagacaggcagaca

SEQ ID NO: 7415798 - DNA, 17 bp, Homo sapiens
acacagacaggcagaca

SEQ ID NO: 7415799 - DNA, 20 bp, Homo sapiens
acacagactcagcttggatg

SEQ ID NO: 7415800 - DNA, 17 bp, Homo sapiens
acacagagattaacaca

SEQ ID NO: 7415801 - DNA, 17 bp, Homo sapiens
acacagagattaacaca

SEQ ID NO: 7415802 - DNA, 17 bp, Homo sapiens
acacagagattaacaca

SEQ ID NO: 7415803 - DNA, 17 bp, Homo sapiens
acacagagattaacaca

SEQ ID NO: 7415804 - DNA, 17 bp, Homo sapiens
acacagagattaacaca

SEQ ID NO: 7415805 - DNA, 22 bp, Homo sapiens
acacacatgcctttcctaagta

SEQ ID NO: 7415806 - DNA, 22 bp, Homo sapiens
acacacatgcctttcctaagta

SEQ ID NO: 7415807 - DNA, 22 bp, Homo sapiens
acacacatgcctttcctaagta

SEQ ID NO: 7415808 - DNA, 22 bp, Homo sapiens
acacacatgcctttcctaagta

SEQ ID NO: 7415809 - DNA, 22 bp, Homo sapiens
acaatgttctctgagttgtgtg

SEQ ID NO: 7415810 - DNA, 22 bp, Homo sapiens
acaatgttctgtctgacttgtc

SEQ ID NO: 7415811 - DNA, 22 bp, Homo sapiens
acaatgttctacatatacataa

SEQ ID NO: 7415812 - DNA, 22 bp, Homo sapiens
acacacatgcctttcctaagta

SEQ ID NO: 7415813 - DNA, 22 bp, Homo sapiens
acacacatgcctttcctaagta

SEQ ID NO: 7415814 - DNA, 22 bp, Homo sapiens
acacacatgcctttcctaagta

SEQ ID NO: 7415815 - DNA, 22 bp, Homo sapiens
acacacatgcctttcctaagta

SEQ ID NO: 7415816 - DNA, 22 bp, Homo sapiens
acacacatgcctttcctaagta

SEQ ID NO: 7415817 - DNA, 22 bp, Homo sapiens
acacagaagatctcttaatgct

SEQ ID NO: 7415818 - DNA, 22 bp, Homo sapiens
acacagaagctttttctattcc

SEQ ID NO: 7415819 - DNA, 22 bp, Homo sapiens
acacagaagctttttctattcc

SEQ ID NO: 7415820 - DNA, 22 bp, Homo sapiens
acacagaagctttttctattcc

SEQ ID NO: 7415821 - DNA, 22 bp, Homo sapiens
acacagaagctttttctattcc

SEQ ID NO: 7415822 - DNA, 22 bp, Homo sapiens
acacagaagctttttctattcc

SEQ ID NO: 7415823 - DNA, 22 bp, Homo sapiens
acacagaagctttttctattcc

SEQ ID NO: 7415824 - DNA, 22 bp, Homo sapiens
acacagaagctttttctattcc

SEQ ID NO: 7415825 - DNA, 22 bp, Homo sapiens
acacagcagaaggcccgtgtct

SEQ ID NO: 7415826 - DNA, 22 bp, Homo sapiens
acacagcagaaggcccgtgtct

SEQ ID NO: 7415827 - DNA, 22 bp, Homo sapiens
acacagcagaaggcccgtgtct

SEQ ID NO: 7415828 - DNA, 22 bp, Homo sapiens
acacagcaaggtctgactttgg

SEQ ID NO: 7415829 - DNA, 22 bp, Homo sapiens
acacagcaaggtctgactttgg

SEQ ID NO: 7415830 - DNA, 22 bp, Homo sapiens
acacagcaaggtctgactttgg

SEQ ID NO: 7415831 - DNA, 17 bp, Homo sapiens
acacagccaggttctcc

SEQ ID NO: 7415832 - DNA, 17 bp, Homo sapiens
acacagccaggttctcc

SEQ ID NO: 7415833 - DNA, 17 bp, Homo sapiens
acacagccaggttctcc

SEQ ID NO: 7415834 - DNA, 22 bp, Homo sapiens
acacagccagggtagtaaggct

SEQ ID NO: 7415835 - DNA, 22 bp, Homo sapiens
acacagccagggtagtaaggct

SEQ ID NO: 7415836 - DNA, 22 bp, Homo sapiens
acacagccgtgaatctgcttct

SEQ ID NO: 7415837 - DNA, 22 bp, Homo sapiens
acacagccgtgaatctgcttct

SEQ ID NO: 7415838 - DNA, 22 bp, Homo sapiens
acacagctagtgagtggcagag

SEQ ID NO: 7415839 - DNA, 22 bp, Homo sapiens
acacagccgtgaatctgcttct

SEQ ID NO: 7415840 - DNA, 22 bp, Homo sapiens
acacagctagtgagtggcagag

SEQ ID NO: 7415841 - DNA, 22 bp, Homo sapiens
acacagccccacggtgagcaaa

SEQ ID NO: 7415842 - DNA, 22 bp, Homo sapiens
acacagccccacggtgagcaaa

SEQ ID NO: 7415843 - DNA, 22 bp, Homo sapiens
acacagccccacggtgagcaaa

SEQ ID NO: 7415844 - DNA, 22 bp, Homo sapiens
acacagccccacggtgagcaaa

SEQ ID NO: 7415845 - DNA, 22 bp, Homo sapiens
acacagccccacggtgagcaaa

SEQ ID NO: 7415846 - DNA, 22 bp, Homo sapiens
acacagctatggggtaggaaac

SEQ ID NO: 7415847 - DNA, 22 bp, Homo sapiens
acacagctatggggtaggaaac

SEQ ID NO: 7415848 - DNA, 22 bp, Homo sapiens
acacagctatggggtaggaaac

SEQ ID NO: 7415849 - DNA, 22 bp, Homo sapiens
acacagctatggggtaggaaac

SEQ ID NO: 7415850 - DNA, 22 bp, Homo sapiens
acacagctagtgagtggcagag

SEQ ID NO: 7415851 - DNA, 22 bp, Homo sapiens
acacagctagtgagtggcagag

SEQ ID NO: 7415852 - DNA, 22 bp, Homo sapiens
acacagctcacaacgtgtgcat

SEQ ID NO: 7415853 - DNA, 22 bp, Homo sapiens
acacagctatggggtaggaaac

SEQ ID NO: 7415854 - DNA, 22 bp, Homo sapiens
acacagctagtgagtggcagag

SEQ ID NO: 7415855 - DNA, 22 bp, Homo sapiens
acacagctcacaacgtgtgcat

SEQ ID NO: 7415856 - DNA, 22 bp, Homo sapiens
acacagctcacaacgtgtgcat

SEQ ID NO: 7415857 - DNA, 22 bp, Homo sapiens
acacagctcagtgcctccaaga

SEQ ID NO: 7415858 - DNA, 21 bp, Homo sapiens
acacagctgccggagacggat

SEQ ID NO: 7415859 - DNA, 21 bp, Homo sapiens
acacagctgccggagacggat

SEQ ID NO: 7415860 - DNA, 22 bp, Homo sapiens
acacagctcagtgcctccaaga

SEQ ID NO: 7415861 - DNA, 21 bp, Homo sapiens
acacagctgccggagacggat

SEQ ID NO: 7415862 - DNA, 21 bp, Homo sapiens
acacagctgccggagacggat

SEQ ID NO: 7415863 - DNA, 22 bp, Homo sapiens
acacagcttcaaagtctaattc

SEQ ID NO: 7415864 - DNA, 22 bp, Homo sapiens
acacagctgtgcagttttttca

SEQ ID NO: 7415865 - DNA, 22 bp, Homo sapiens
acacagctgtgcagttttttca

SEQ ID NO: 7415866 - DNA, 22 bp, Homo sapiens
acacagctgtgcagttttttca

SEQ ID NO: 7415867 - DNA, 22 bp, Homo sapiens
acacagctttcagtcattatct

SEQ ID NO: 7415868 - DNA, 22 bp, Homo sapiens
acacagctttcagtcattatct

SEQ ID NO: 7415869 - DNA, 22 bp, Homo sapiens
acacagcttcaaagtctaattc

SEQ ID NO: 7415870 - DNA, 22 bp, Homo sapiens
acacagcttcaaagtctaattc

SEQ ID NO: 7415871 - DNA, 22 bp, Homo sapiens
acacagcttcaaagtctaattc

SEQ ID NO: 7415872 - DNA, 22 bp, Homo sapiens
aagataatattcattaactaga

SEQ ID NO: 7415873 - DNA, 22 bp, Homo sapiens
aagataatattcattaactaga

SEQ ID NO: 7415874 - DNA, 22 bp, Homo sapiens
aagataatattcattaactaga

SEQ ID NO: 7415875 - DNA, 22 bp, Homo sapiens
aagataatattcattaactaga

SEQ ID NO: 7415876 - DNA, 22 bp, Homo sapiens
aagataatattcattaactaga

SEQ ID NO: 7415877 - DNA, 22 bp, Homo sapiens
aagataatgtgtctgtctttgc

SEQ ID NO: 7415878 - DNA, 22 bp, Homo sapiens
aagataagtaacgagcctcagt

SEQ ID NO: 7415879 - DNA, 22 bp, Homo sapiens
aagataatattcattaactaga

SEQ ID NO: 7415880 - DNA, 22 bp, Homo sapiens
aagataatattcattaactaga

SEQ ID NO: 7415881 - DNA, 22 bp, Homo sapiens
aagataatattcattaactaga

SEQ ID NO: 7415882 - DNA, 22 bp, Homo sapiens
aagataatattcattaactaga

SEQ ID NO: 7415883 - DNA, 22 bp, Homo sapiens
aagagtttccagttgtggctca

SEQ ID NO: 7415884 - DNA, 22 bp, Homo sapiens
aagagtttccagttgtggctca

SEQ ID NO: 7415885 - DNA, 22 bp, Homo sapiens
acacagctttcagtcattatct

SEQ ID NO: 7415886 - DNA, 22 bp, Homo sapiens
aagataacaggaggagtttgta

SEQ ID NO: 7415887 - DNA, 22 bp, Homo sapiens
aagatacaaatgtcaatattgg

SEQ ID NO: 7415888 - DNA, 22 bp, Homo sapiens
aagatacaaatgtcaatattgg

SEQ ID NO: 7415889 - DNA, 22 bp, Homo sapiens
aagatacaaatgtcaatattgg

SEQ ID NO: 7415890 - DNA, 22 bp, Homo sapiens
aagatacaaatgtcaatattgg

SEQ ID NO: 7415891 - DNA, 22 bp, Homo sapiens
aagatacaaatgtcaatattgg

SEQ ID NO: 7415892 - DNA, 22 bp, Homo sapiens
aagatacaaatgtcaatattgg

SEQ ID NO: 7415893 - DNA, 22 bp, Homo sapiens
aagataatgttctagctgtcag

SEQ ID NO: 7415894 - DNA, 22 bp, Homo sapiens
aagataatgtgtctgtctttgc

SEQ ID NO: 7415895 - DNA, 22 bp, Homo sapiens
aagataatgtgtctgtctttgc

SEQ ID NO: 7415896 - DNA, 22 bp, Homo sapiens
aagatacacggtcaactctcaa

SEQ ID NO: 7415897 - DNA, 22 bp, Homo sapiens
aagatacacggtcaactctcaa

SEQ ID NO: 7415898 - DNA, 22 bp, Homo sapiens
aagatacaccaagagcctagta

SEQ ID NO: 7415899 - DNA, 22 bp, Homo sapiens
aagatacaaatgtcaatattgg

SEQ ID NO: 7415900 - DNA, 22 bp, Homo sapiens
acagacattttaagacacttta

SEQ ID NO: 7415901 - DNA, 22 bp, Homo sapiens
acagacattttaagacacttta

SEQ ID NO: 7415902 - DNA, 22 bp, Homo sapiens
acagacattttaagacacttta

SEQ ID NO: 7415903 - DNA, 22 bp, Homo sapiens
acagacattttaagacacttta

SEQ ID NO: 7415904 - DNA, 19 bp, Homo sapiens
acagacatttgcaattagc

SEQ ID NO: 7415905 - DNA, 22 bp, Homo sapiens
acagacatttaataaatgctga

SEQ ID NO: 7415906 - DNA, 22 bp, Homo sapiens
acagacatttaataaatgctga

SEQ ID NO: 7415907 - DNA, 22 bp, Homo sapiens
acagacatttaataaatgctga

SEQ ID NO: 7415908 - DNA, 22 bp, Homo sapiens
acagaccaaaaaaggatattgg

SEQ ID NO: 7415909 - DNA, 22 bp, Homo sapiens
acagacattttctgtattgcct

SEQ ID NO: 7415910 - DNA, 22 bp, Homo sapiens
acagacattttaattattaaat

SEQ ID NO: 7415911 - DNA, 22 bp, Homo sapiens
acagacattttaagacacttta

SEQ ID NO: 7415912 - DNA, 22 bp, Homo sapiens
acagacatttaataaatgctga

SEQ ID NO: 7415913 - DNA, 23 bp, Homo sapiens
acagacattgtacatcttgtttt

SEQ ID NO: 7415914 - DNA, 23 bp, Homo sapiens
acagacattgtacatcttgtttt

SEQ ID NO: 7415915 - DNA, 23 bp, Homo sapiens
acagacattgtacatcttgtttt

SEQ ID NO: 7415916 - DNA, 23 bp, Homo sapiens
acagacattgtacatcttgtttt

SEQ ID NO: 7415917 - DNA, 23 bp, Homo sapiens
acagacattgtacatcttgtttt

SEQ ID NO: 7415918 - DNA, 23 bp, Homo sapiens
acagacattccataatgtacacc

SEQ ID NO: 7415919 - DNA, 23 bp, Homo sapiens
acagacattccataatgtacacc

SEQ ID NO: 7415920 - DNA, 23 bp, Homo sapiens
acagacattccataatgtacacc

SEQ ID NO: 7415921 - DNA, 23 bp, Homo sapiens
acagacaacactgatgagagaaa

SEQ ID NO: 7415922 - DNA, 23 bp, Homo sapiens
acagacaacactgatgagagaaa

SEQ ID NO: 7415923 - DNA, 23 bp, Homo sapiens
acagacaacactgatgagagaaa

SEQ ID NO: 7415924 - DNA, 23 bp, Homo sapiens
acagacaacactgatgagagaaa

SEQ ID NO: 7415925 - DNA, 23 bp, Homo sapiens
acagacaacactgatgagagaaa

SEQ ID NO: 7415926 - DNA, 23 bp, Homo sapiens
acagacaacactgatgagagaaa

SEQ ID NO: 7415927 - DNA, 23 bp, Homo sapiens
acagacattccataatgtacacc

SEQ ID NO: 7415928 - DNA, 23 bp, Homo sapiens
acagacattccataatgtacacc

SEQ ID NO: 7415929 - DNA, 23 bp, Homo sapiens
acagacattccataatgtacacc

SEQ ID NO: 7415930 - DNA, 22 bp, Homo sapiens
acagaaatgatgtttggcaata

SEQ ID NO: 7415931 - DNA, 23 bp, Homo sapiens
acagacaacactgatgagagaaa

SEQ ID NO: 7415932 - DNA, 23 bp, Homo sapiens
acagacaacactgatgagagaaa

SEQ ID NO: 7415933 - DNA, 22 bp, Homo sapiens
acagaaatgatgtttggcaata

SEQ ID NO: 7415934 - DNA, 22 bp, Homo sapiens
acagaaatgatgtttggcaata

SEQ ID NO: 7415935 - DNA, 22 bp, Homo sapiens
acagaaatgatgtttggcaata

SEQ ID NO: 7415936 - DNA, 22 bp, Homo sapiens
acagaaatgatgtttggcaata

SEQ ID NO: 7415937 - DNA, 22 bp, Homo sapiens
acagaaatgatgtttggcaata

SEQ ID NO: 7415938 - DNA, 22 bp, Homo sapiens
acagaaatgatgtttggcaata

SEQ ID NO: 7415939 - DNA, 22 bp, Homo sapiens
acagaaatgatgtttggcaata

SEQ ID NO: 7415940 - DNA, 23 bp, Homo sapiens
acagaaatcatttgtaaggtacc

SEQ ID NO: 7415941 - DNA, 23 bp, Homo sapiens
acagaaatcatttgtaaggtacc

SEQ ID NO: 7415942 - DNA, 23 bp, Homo sapiens
acagaaatcatttgtaaggtacc

SEQ ID NO: 7415943 - DNA, 23 bp, Homo sapiens
acagaaatcatttgtaaggtacc

SEQ ID NO: 7415944 - DNA, 23 bp, Homo sapiens
acagaaatcatttgtaaggtacc

SEQ ID NO: 7415945 - DNA, 23 bp, Homo sapiens
acagaaatcatttgtaaggtacc

SEQ ID NO: 7415946 - DNA, 23 bp, Homo sapiens
acagaaatcatttgtaaggtacc

SEQ ID NO: 7415947 - DNA, 23 bp, Homo sapiens
acagaaatcatttgtaaggtacc

SEQ ID NO: 7415948 - DNA, 23 bp, Homo sapiens
acagaaatcatttgtaaggtacc

SEQ ID NO: 7415949 - DNA, 23 bp, Homo sapiens
acagaaatcatttgtaaggtacc

SEQ ID NO: 7415950 - DNA, 22 bp, Homo sapiens
acagaaatattcgtggtgcttg

SEQ ID NO: 7415951 - DNA, 22 bp, Homo sapiens
acagaaatattcgtggtgcttg

SEQ ID NO: 7415952 - DNA, 22 bp, Homo sapiens
acagaaatattcgtggtgcttg

SEQ ID NO: 7415953 - DNA, 22 bp, Homo sapiens
acagaaatattcgtggtgcttg

SEQ ID NO: 7415954 - DNA, 22 bp, Homo sapiens
acagaaatattcgtggtgcttg

SEQ ID NO: 7415955 - DNA, 22 bp, Homo sapiens
acagaaatatagaaggtaggaa

SEQ ID NO: 7415956 - DNA, 22 bp, Homo sapiens
acagaaataactttttatgttt

SEQ ID NO: 7415957 - DNA, 23 bp, Homo sapiens
acagaaagttctgctggacagag

SEQ ID NO: 7415958 - DNA, 22 bp, Homo sapiens
acagaaataactttttatgttt

SEQ ID NO: 7415959 - DNA, 22 bp, Homo sapiens
acagaaataactttttatgttt

SEQ ID NO: 7415960 - DNA, 22 bp, Homo sapiens
acagaaataactttttatgttt

SEQ ID NO: 7415961 - DNA, 22 bp, Homo sapiens
acagaaataactttttatgttt

SEQ ID NO: 7415962 - DNA, 22 bp, Homo sapiens
acagaaatatagaaggtaggaa

SEQ ID NO: 7415963 - DNA, 22 bp, Homo sapiens
acagaaatatagaaggtaggaa

SEQ ID NO: 7415964 - DNA, 22 bp, Homo sapiens
acagaaatatagaaggtaggaa

SEQ ID NO: 7415965 - DNA, 22 bp, Homo sapiens
acagaaatatagaaggtaggaa

SEQ ID NO: 7415966 - DNA, 22 bp, Homo sapiens
acagaaatatagaaggtaggaa

SEQ ID NO: 7415967 - DNA, 18 bp, Homo sapiens
acagaaatagctgtgcct

SEQ ID NO: 7415968 - DNA, 18 bp, Homo sapiens
acagaaatagctgtgcct

SEQ ID NO: 7415969 - DNA, 18 bp, Homo sapiens
acagaaatagctgtgcct

SEQ ID NO: 7415970 - DNA, 18 bp, Homo sapiens
acagaaatagctgtgcct

SEQ ID NO: 7415971 - DNA, 18 bp, Homo sapiens
acagaaatagctgtgcct

SEQ ID NO: 7415972 - DNA, 18 bp, Homo sapiens
acagaaatagctgtgcct

SEQ ID NO: 7415973 - DNA, 18 bp, Homo sapiens
acagaaatagctgtgcct

SEQ ID NO: 7415974 - DNA, 22 bp, Homo sapiens
acagagcaatgcgtgttctcta

SEQ ID NO: 7415975 - DNA, 22 bp, Homo sapiens
acagagcaatgcgtgttctcta

SEQ ID NO: 7415976 - DNA, 22 bp, Homo sapiens
acagagcaataacagggagagg

SEQ ID NO: 7415977 - DNA, 22 bp, Homo sapiens
acagagcaatgcgtgttctcta

SEQ ID NO: 7415978 - DNA, 22 bp, Homo sapiens
acagagcaatgcgtgttctcta

SEQ ID NO: 7415979 - DNA, 22 bp, Homo sapiens
acagagcaataacagggagagg

SEQ ID NO: 7415980 - DNA, 22 bp, Homo sapiens
acagagcaataacagggagagg

SEQ ID NO: 7415981 - DNA, 22 bp, Homo sapiens
acagagcaataacagggagagg

SEQ ID NO: 7415982 - DNA, 22 bp, Homo sapiens
acagagcaataacagggagagg

SEQ ID NO: 7415983 - DNA, 22 bp, Homo sapiens
acagagcaactttatttcatgg

SEQ ID NO: 7415984 - DNA, 22 bp, Homo sapiens
acagagcaacttgagtatcctc

SEQ ID NO: 7415985 - DNA, 22 bp, Homo sapiens
acagagcaacttgagtatcctc

SEQ ID NO: 7415986 - DNA, 22 bp, Homo sapiens
acagagcaactttatttcatgg

SEQ ID NO: 7415987 - DNA, 22 bp, Homo sapiens
acagagatgtcagattggcagc

SEQ ID NO: 7415988 - DNA, 22 bp, Homo sapiens
acagagcaacttgagtatcctc

SEQ ID NO: 7415989 - DNA, 22 bp, Homo sapiens
acagagatgtcagattggcagc

SEQ ID NO: 7415990 - DNA, 22 bp, Homo sapiens
acagagatgtggatgagggatt

SEQ ID NO: 7415991 - DNA, 22 bp, Homo sapiens
acagagatgaattagacagggt

SEQ ID NO: 7415992 - DNA, 22 bp, Homo sapiens
acagagatgaattagacagggt

SEQ ID NO: 7415993 - DNA, 22 bp, Homo sapiens
acagagatgagtcaacacagct

SEQ ID NO: 7415994 - DNA, 22 bp, Homo sapiens
acagagatgagtcaacacagct

SEQ ID NO: 7415995 - DNA, 22 bp, Homo sapiens
acagagatgagtcaacacagct

SEQ ID NO: 7415996 - DNA, 22 bp, Homo sapiens
acagagatggcacagagaaggt

SEQ ID NO: 7415997 - DNA, 22 bp, Homo sapiens
acagagatgcaagtgtgtattt

SEQ ID NO: 7415998 - DNA, 22 bp, Homo sapiens
acagagatgcaagtgtgtattt

SEQ ID NO: 7415999 - DNA, 22 bp, Homo sapiens
acagagatgaattagacagggt

SEQ ID NO: 7416000 - DNA, 22 bp, Homo sapiens
acagagatggcttttcagaggc

SEQ ID NO: 7416001 - DNA, 22 bp, Homo sapiens
acagagatggcacagagaaggt

SEQ ID NO: 7416002 - DNA, 22 bp, Homo sapiens
acagagatgcaagtgtgtattt

SEQ ID NO: 7416003 - DNA, 22 bp, Homo sapiens
acagagatggcacagagaaggt

SEQ ID NO: 7416004 - DNA, 22 bp, Homo sapiens
acagagatgggaacattcaggt

SEQ ID NO: 7416005 - DNA, 22 bp, Homo sapiens
acagagatgggaacattcaggt

SEQ ID NO: 7416006 - DNA, 22 bp, Homo sapiens
acagagatgggaacattcaggt

SEQ ID NO: 7416007 - DNA, 22 bp, Homo sapiens
acagagatgtcagattggcagc

SEQ ID NO: 7416008 - DNA, 22 bp, Homo sapiens
acagagatggcttttcagaggc

SEQ ID NO: 7416009 - DNA, 22 bp, Homo sapiens
acagagatgtcagattggcagc

SEQ ID NO: 7416010 - DNA, 22 bp, Homo sapiens
acagagatgtcagattggcagc

SEQ ID NO: 7416011 - DNA, 22 bp, Homo sapiens
acagaccagctttcattccctt

SEQ ID NO: 7416012 - DNA, 22 bp, Homo sapiens
acagacctatggcagctgccat

SEQ ID NO: 7416013 - DNA, 22 bp, Homo sapiens
acagacctatggcagctgccat

SEQ ID NO: 7416014 - DNA, 22 bp, Homo sapiens
acagaccaagtttccagcaggt

SEQ ID NO: 7416015 - DNA, 22 bp, Homo sapiens
acagaccaagtttccagcaggt

SEQ ID NO: 7416016 - DNA, 22 bp, Homo sapiens
acagaccaagtttccagcaggt

SEQ ID NO: 7416017 - DNA, 22 bp, Homo sapiens
acagaccaagtttccagcaggt

SEQ ID NO: 7416018 - DNA, 22 bp, Homo sapiens
acagactaaaattgcacagtgg

SEQ ID NO: 7416019 - DNA, 22 bp, Homo sapiens
acagacctggccccgcacggtg

SEQ ID NO: 7416020 - DNA, 22 bp, Homo sapiens
acagacctctagattacatttg

SEQ ID NO: 7416021 - DNA, 22 bp, Homo sapiens
acagactgattcattgctcagg

SEQ ID NO: 7416022 - DNA, 22 bp, Homo sapiens
acagactgagtcatcttcttaa

SEQ ID NO: 7416023 - DNA, 22 bp, Homo sapiens
acagactgattcattgctcagg

SEQ ID NO: 7416024 - DNA, 22 bp, Homo sapiens
acagactaaaattgcacagtgg

SEQ ID NO: 7416025 - DNA, 22 bp, Homo sapiens
acagactccccaggttatctca

SEQ ID NO: 7416026 - DNA, 22 bp, Homo sapiens
acagactcctttccatccgtgg

SEQ ID NO: 7416027 - DNA, 22 bp, Homo sapiens
acagactcctttccatccgtgg

SEQ ID NO: 7416028 - DNA, 22 bp, Homo sapiens
acagacgggacaacgtgcagct

SEQ ID NO: 7416029 - DNA, 22 bp, Homo sapiens
acagactgaagatatttccccc

SEQ ID NO: 7416030 - DNA, 22 bp, Homo sapiens
acagactggagcccttttgccc

SEQ ID NO: 7416031 - DNA, 22 bp, Homo sapiens
acagactggagcccttttgccc

SEQ ID NO: 7416032 - DNA, 22 bp, Homo sapiens
acagactggaggagaatagttt

SEQ ID NO: 7416033 - DNA, 22 bp, Homo sapiens
acagactggaggagaatagttt

SEQ ID NO: 7416034 - DNA, 22 bp, Homo sapiens
acagactggagtgagagaaata

SEQ ID NO: 7416035 - DNA, 22 bp, Homo sapiens
acagagatgaattagacagggt

SEQ ID NO: 7416036 - DNA, 22 bp, Homo sapiens
acagagatgaataatacaggtg

SEQ ID NO: 7416037 - DNA, 22 bp, Homo sapiens
acagagatgaataatacaggtg

SEQ ID NO: 7416038 - DNA, 22 bp, Homo sapiens
acagagatgaataatacaggtg

SEQ ID NO: 7416039 - DNA, 23 bp, Homo sapiens
acagagatcttgacttgtatgga

SEQ ID NO: 7416040 - DNA, 22 bp, Homo sapiens
acagagatgaataatacaggtg

SEQ ID NO: 7416041 - DNA, 23 bp, Homo sapiens
acagagatcttgacttgtatgga

SEQ ID NO: 7416042 - DNA, 23 bp, Homo sapiens
acagagatcttgacttgtatgga

SEQ ID NO: 7416043 - DNA, 20 bp, Homo sapiens
acagagatcctctctttatc

SEQ ID NO: 7416044 - DNA, 20 bp, Homo sapiens
acagagatcagctgatgggc

SEQ ID NO: 7416045 - DNA, 20 bp, Homo sapiens
acagagatcctctctttatc

SEQ ID NO: 7416046 - DNA, 20 bp, Homo sapiens
acagagatcctctctttatc

SEQ ID NO: 7416047 - DNA, 22 bp, Homo sapiens
acagactggagtgagagaaata

SEQ ID NO: 7416048 - DNA, 22 bp, Homo sapiens
acagactggagtgagagaaata

SEQ ID NO: 7416049 - DNA, 22 bp, Homo sapiens
acagactggagtgagagaaata

SEQ ID NO: 7416050 - DNA, 22 bp, Homo sapiens
acagactggcctgtctcgcacc

SEQ ID NO: 7416051 - DNA, 22 bp, Homo sapiens
acagactggcctgtctcgcacc

SEQ ID NO: 7416052 - DNA, 22 bp, Homo sapiens
acagactggggtggggaatagg

SEQ ID NO: 7416053 - DNA, 22 bp, Homo sapiens
acagactggggtggggaatagg

SEQ ID NO: 7416054 - DNA, 22 bp, Homo sapiens
acagactggggtggggaatagg

SEQ ID NO: 7416055 - DNA, 23 bp, Homo sapiens
acagactgtattcaaagtaggac

SEQ ID NO: 7416056 - DNA, 23 bp, Homo sapiens
acagactgtattcaaagtaggac

SEQ ID NO: 7416057 - DNA, 23 bp, Homo sapiens
acagactgtattcaaagtaggac

SEQ ID NO: 7416058 - DNA, 23 bp, Homo sapiens
acagactgtattcaaagtaggac

SEQ ID NO: 7416059 - DNA, 22 bp, Homo sapiens
acagagatcagaggcataagca

SEQ ID NO: 7416060 - DNA, 22 bp, Homo sapiens
acacttctctttgaagaacaat

SEQ ID NO: 7416061 - DNA, 22 bp, Homo sapiens
acacttctcccatctcctgttg

SEQ ID NO: 7416062 - DNA, 22 bp, Homo sapiens
acacttctctttgaagaacaat

SEQ ID NO: 7416063 - DNA, 22 bp, Homo sapiens
acacttctcatttgatactaac

SEQ ID NO: 7416064 - DNA, 22 bp, Homo sapiens
acacttctattccctgcacaaa

SEQ ID NO: 7416065 - DNA, 18 bp, Homo sapiens
acacttcctggtggtgtg

SEQ ID NO: 7416066 - DNA, 18 bp, Homo sapiens
acacttcctggtggtgtg

SEQ ID NO: 7416067 - DNA, 22 bp, Homo sapiens
acacttcatagcaaggttggag

SEQ ID NO: 7416068 - DNA, 21 bp, Homo sapiens
acacttcagtttttaaaggga

SEQ ID NO: 7416069 - DNA, 22 bp, Homo sapiens
acacttcagctccacaaacatt

SEQ ID NO: 7416070 - DNA, 22 bp, Homo sapiens
acacttcaggactctggggcaa

SEQ ID NO: 7416071 - DNA, 22 bp, Homo sapiens
acacttcatgcattcttcactc

SEQ ID NO: 7416072 - DNA, 22 bp, Homo sapiens
acacttcatgcattcttcactc

SEQ ID NO: 7416073 - DNA, 20 bp, Homo sapiens
acacttcatttgcagcagct

SEQ ID NO: 7416074 - DNA, 22 bp, Homo sapiens
acacttcatttacattataggc

SEQ ID NO: 7416075 - DNA, 22 bp, Homo sapiens
acacttcagctccacaaacatt

SEQ ID NO: 7416076 - DNA, 22 bp, Homo sapiens
acactgtaaacatctcaagcac

SEQ ID NO: 7416077 - DNA, 22 bp, Homo sapiens
acactgtaaacatctcaagcac

SEQ ID NO: 7416078 - DNA, 22 bp, Homo sapiens
acacttcaggactctggggcaa

SEQ ID NO: 7416079 - DNA, 22 bp, Homo sapiens
acacttcagctccacaaacatt

SEQ ID NO: 7416080 - DNA, 22 bp, Homo sapiens
acactggttgttaatagtaaca

SEQ ID NO: 7416081 - DNA, 19 bp, Homo sapiens
acactggttgttcaagggc

SEQ ID NO: 7416082 - DNA, 20 bp, Homo sapiens
acagaaagctgccttgtccc

SEQ ID NO: 7416083 - DNA, 20 bp, Homo sapiens
acagaaagctgccttgtccc

SEQ ID NO: 7416084 - DNA, 20 bp, Homo sapiens
acagaaagctgccttgtccc

SEQ ID NO: 7416085 - DNA, 20 bp, Homo sapiens
acagaaagctgccttgtccc

SEQ ID NO: 7416086 - DNA, 20 bp, Homo sapiens
acagaaagctgccttgtccc

SEQ ID NO: 7416087 - DNA, 20 bp, Homo sapiens
acagaaagctgccttgtccc

SEQ ID NO: 7416088 - DNA, 23 bp, Homo sapiens
acagaaagttctgctggacagag

SEQ ID NO: 7416089 - DNA, 23 bp, Homo sapiens
acagaaagttctgctggacagag

SEQ ID NO: 7416090 - DNA, 23 bp, Homo sapiens
acagaaagttctgctggacagag

SEQ ID NO: 7416091 - DNA, 20 bp, Homo sapiens
acagaaagctgccttgtccc

SEQ ID NO: 7416092 - DNA, 23 bp, Homo sapiens
acagaaagttctgctggacagag

SEQ ID NO: 7416093 - DNA, 23 bp, Homo sapiens
acagaaagttctgctggacagag

SEQ ID NO: 7416094 - DNA, 23 bp, Homo sapiens
acagaaagttctgctggacagag

SEQ ID NO: 7416095 - DNA, 22 bp, Homo sapiens
acactttaagcatttcacactg

SEQ ID NO: 7416096 - DNA, 22 bp, Homo sapiens
acactttaagcatttcacactg

SEQ ID NO: 7416097 - DNA, 22 bp, Homo sapiens
acagaaagatgatttgaaatgg

SEQ ID NO: 7416098 - DNA, 22 bp, Homo sapiens
acagaaagatgatttgaaatgg

SEQ ID NO: 7416099 - DNA, 22 bp, Homo sapiens
acagaaagatgatttgaaatgg

SEQ ID NO: 7416100 - DNA, 22 bp, Homo sapiens
acagaaagatgatttgaaatgg

SEQ ID NO: 7416101 - DNA, 22 bp, Homo sapiens
acacttggagcaacacttatgg

SEQ ID NO: 7416102 - DNA, 22 bp, Homo sapiens
acacttggagcaacacttatgg

SEQ ID NO: 7416103 - DNA, 22 bp, Homo sapiens
acacttggctctgagtcactac

SEQ ID NO: 7416104 - DNA, 22 bp, Homo sapiens
acacttggagcaacacttatgg

SEQ ID NO: 7416105 - DNA, 22 bp, Homo sapiens
acacttggagcaacacttatgg

SEQ ID NO: 7416106 - DNA, 22 bp, Homo sapiens
acacttggagcaacacttatgg

SEQ ID NO: 7416107 - DNA, 22 bp, Homo sapiens
acacttggagcaacacttatgg

SEQ ID NO: 7416108 - DNA, 22 bp, Homo sapiens
acacttgccatgctgcacactg

SEQ ID NO: 7416109 - DNA, 22 bp, Homo sapiens
acacttgataggtcaaatcagt

SEQ ID NO: 7416110 - DNA, 22 bp, Homo sapiens
acacttgccatgctgcacactg

SEQ ID NO: 7416111 - DNA, 22 bp, Homo sapiens
acacttgataggtcaaatcagt

SEQ ID NO: 7416112 - DNA, 22 bp, Homo sapiens
acacttgaggtttttaggtgcg

SEQ ID NO: 7416113 - DNA, 22 bp, Homo sapiens
acacttgaggtttttaggtgcg

SEQ ID NO: 7416114 - DNA, 22 bp, Homo sapiens
acacttgaggaatgtggtgatt

SEQ ID NO: 7416115 - DNA, 20 bp, Homo sapiens
acacttgacaccagaaatgg

SEQ ID NO: 7416116 - DNA, 22 bp, Homo sapiens
acacttgaggaatgtggtgatt

SEQ ID NO: 7416117 - DNA, 20 bp, Homo sapiens
acacttgacaccagaaatgg

SEQ ID NO: 7416118 - DNA, 22 bp, Homo sapiens
acacatataccactgtaaatga

SEQ ID NO: 7416119 - DNA, 22 bp, Homo sapiens
acacatataccactgtaaatga

SEQ ID NO: 7416120 - DNA, 20 bp, Homo sapiens
acacatagataagaagctga

SEQ ID NO: 7416121 - DNA, 22 bp, Homo sapiens
acacatagaaaataaatagtta

SEQ ID NO: 7416122 - DNA, 20 bp, Homo sapiens
acacatagataagaagctga

SEQ ID NO: 7416123 - DNA, 22 bp, Homo sapiens
acacatataccactgtaaatga

SEQ ID NO: 7416124 - DNA, 20 bp, Homo sapiens
acacatagataagaagctga

SEQ ID NO: 7416125 - DNA, 22 bp, Homo sapiens
acacatataccactgtaaatga

SEQ ID NO: 7416126 - DNA, 22 bp, Homo sapiens
acacatataccactgtaaatga

SEQ ID NO: 7416127 - DNA, 22 bp, Homo sapiens
acacatataccactgtaaatga

SEQ ID NO: 7416128 - DNA, 22 bp, Homo sapiens
acacatataccactgtaaatga

SEQ ID NO: 7416129 - DNA, 22 bp, Homo sapiens
acacatataccactgtaaatga

SEQ ID NO: 7416130 - DNA, 22 bp, Homo sapiens
acacatataccactgtaaatga

SEQ ID NO: 7416131 - DNA, 22 bp, Homo sapiens
acacatataccactgtaaatga

SEQ ID NO: 7416132 - DNA, 22 bp, Homo sapiens
acacataagcctaatcatctcc

SEQ ID NO: 7416133 - DNA, 22 bp, Homo sapiens
acacataagcctaatcatctcc

SEQ ID NO: 7416134 - DNA, 22 bp, Homo sapiens
acacataagcctaatcatctcc

SEQ ID NO: 7416135 - DNA, 22 bp, Homo sapiens
acacatacatggggaagatgag

SEQ ID NO: 7416136 - DNA, 17 bp, Homo sapiens
acacatacatgggccat

SEQ ID NO: 7416137 - DNA, 22 bp, Homo sapiens
acacatacatggggaagatgag

SEQ ID NO: 7416138 - DNA, 22 bp, Homo sapiens
acacatagaaaataaatagtta

SEQ ID NO: 7416139 - DNA, 20 bp, Homo sapiens
acacatatagcagcataaac

SEQ ID NO: 7416140 - DNA, 20 bp, Homo sapiens
acacatatagcagcataaac

SEQ ID NO: 7416141 - DNA, 22 bp, Homo sapiens
acacatataccactgtaaatga

SEQ ID NO: 7416142 - DNA, 20 bp, Homo sapiens
acacatatagcagcataaac

SEQ ID NO: 7416143 - DNA, 20 bp, Homo sapiens
acacatatagcagcataaac

SEQ ID NO: 7416144 - DNA, 20 bp, Homo sapiens
acacatatagcagcataaac

SEQ ID NO: 7416145 - DNA, 20 bp, Homo sapiens
acacatatagcagcataaac

SEQ ID NO: 7416146 - DNA, 20 bp, Homo sapiens
acacatatagcagcataaac

SEQ ID NO: 7416147 - DNA, 20 bp, Homo sapiens
acacatatagcagcataaac

SEQ ID NO: 7416148 - DNA, 20 bp, Homo sapiens
acacatatagcagcataaac

SEQ ID NO: 7416149 - DNA, 22 bp, Homo sapiens
acacatatatacatatttgtgc

SEQ ID NO: 7416150 - DNA, 22 bp, Homo sapiens
acacatatatacatatttgtgc

SEQ ID NO: 7416151 - DNA, 22 bp, Homo sapiens
acacatatatacatatttgtgc

SEQ ID NO: 7416152 - DNA, 22 bp, Homo sapiens
acacatatatacatatttgtgc

SEQ ID NO: 7416153 - DNA, 20 bp, Homo sapiens
acacatatagcagcataaac

SEQ ID NO: 7416154 - DNA, 20 bp, Homo sapiens
acacatatagcagcataaac

SEQ ID NO: 7416155 - DNA, 20 bp, Homo sapiens
acacatatagcagcataaac

SEQ ID NO: 7416156 - DNA, 22 bp, Homo sapiens
acacatatatacatatttgtgc

SEQ ID NO: 7416157 - DNA, 22 bp, Homo sapiens
acacatatatacatatttgtgc

SEQ ID NO: 7416158 - DNA, 22 bp, Homo sapiens
acactggttctcaagactaggt

SEQ ID NO: 7416159 - DNA, 22 bp, Homo sapiens
acactggttctcaagactaggt

SEQ ID NO: 7416160 - DNA, 22 bp, Homo sapiens
aagatacatcaaagcaaattgg

SEQ ID NO: 7416161 - DNA, 22 bp, Homo sapiens
aagatacatcaaagcaaattgg

SEQ ID NO: 7416162 - DNA, 22 bp, Homo sapiens
acacataagcctaatcatctcc

SEQ ID NO: 7416163 - DNA, 22 bp, Homo sapiens
acacataagcctaatcatctcc

SEQ ID NO: 7416164 - DNA, 22 bp, Homo sapiens
acacataagcctaatcatctcc

SEQ ID NO: 7416165 - DNA, 22 bp, Homo sapiens
acacataagcctaatcatctcc

SEQ ID NO: 7416166 - DNA, 22 bp, Homo sapiens
acacataagcctaatcatctcc

SEQ ID NO: 7416167 - DNA, 22 bp, Homo sapiens
acacataagcctaatcatctcc

SEQ ID NO: 7416168 - DNA, 22 bp, Homo sapiens
acacataagcctaatcatctcc

SEQ ID NO: 7416169 - DNA, 22 bp, Homo sapiens
aagatacataaaggtagagtct

SEQ ID NO: 7416170 - DNA, 22 bp, Homo sapiens
aagatacataaaggtagagtct

SEQ ID NO: 7416171 - DNA, 22 bp, Homo sapiens
aagatacagtgaaagggcattg

SEQ ID NO: 7416172 - DNA, 22 bp, Homo sapiens
aagatacagtgaaagggcattg

SEQ ID NO: 7416173 - DNA, 22 bp, Homo sapiens
aagatacatatttgttctagtg

SEQ ID NO: 7416174 - DNA, 22 bp, Homo sapiens
aagatacataaaggtagagtct

SEQ ID NO: 7416175 - DNA, 22 bp, Homo sapiens
aagatacataaaggtagagtct

SEQ ID NO: 7416176 - DNA, 22 bp, Homo sapiens
aagatacatcaaagcaaattgg

SEQ ID NO: 7416177 - DNA, 22 bp, Homo sapiens
aagatacatatttgttctagtg

SEQ ID NO: 7416178 - DNA, 22 bp, Homo sapiens
aagatacatatttgttctagtg

SEQ ID NO: 7416179 - DNA, 22 bp, Homo sapiens
aagatacatatttgttctagtg

SEQ ID NO: 7416180 - DNA, 22 bp, Homo sapiens
aagatacatatttgttctagtg

SEQ ID NO: 7416181 - DNA, 22 bp, Homo sapiens
aagatacatatttgttctagtg

SEQ ID NO: 7416182 - DNA, 22 bp, Homo sapiens
aagatacacgttgtattgaata

SEQ ID NO: 7416183 - DNA, 22 bp, Homo sapiens
aagatacacgttgtattgaata

SEQ ID NO: 7416184 - DNA, 22 bp, Homo sapiens
aagatacacgttgtattgaata

SEQ ID NO: 7416185 - DNA, 22 bp, Homo sapiens
aagatacacgttgtattgaata

SEQ ID NO: 7416186 - DNA, 22 bp, Homo sapiens
aagatacacgttgtattgaata

SEQ ID NO: 7416187 - DNA, 22 bp, Homo sapiens
aagatacacgttgtattgaata

SEQ ID NO: 7416188 - DNA, 22 bp, Homo sapiens
aagatacacgttgtattgaata

SEQ ID NO: 7416189 - DNA, 22 bp, Homo sapiens
aagatacacgttgtattgaata

SEQ ID NO: 7416190 - DNA, 22 bp, Homo sapiens
aagatacacggtcaactctcaa

SEQ ID NO: 7416191 - DNA, 23 bp, Homo sapiens
aagatacaggtgtggaatggttt

SEQ ID NO: 7416192 - DNA, 23 bp, Homo sapiens
aagatacaggtgtggaatggttt

SEQ ID NO: 7416193 - DNA, 23 bp, Homo sapiens
aagatacaggtgtggaatggttt

SEQ ID NO: 7416194 - DNA, 23 bp, Homo sapiens
aagatacaggtgtggaatggttt

SEQ ID NO: 7416195 - DNA, 22 bp, Homo sapiens
aagatacagacagagccaaaat

SEQ ID NO: 7416196 - DNA, 22 bp, Homo sapiens
aagatacagacagagccaaaat

SEQ ID NO: 7416197 - DNA, 22 bp, Homo sapiens
aagatacagacagagccaaaat

SEQ ID NO: 7416198 - DNA, 22 bp, Homo sapiens
aagatacagacagagccaaaat

SEQ ID NO: 7416199 - DNA, 22 bp, Homo sapiens
aagatacacgttgtattgaata

SEQ ID NO: 7416200 - DNA, 22 bp, Homo sapiens
aagatacacgttgtattgaata

SEQ ID NO: 7416201 - DNA, 22 bp, Homo sapiens
aagatacacgttgtattgaata

SEQ ID NO: 7416202 - DNA, 22 bp, Homo sapiens
acagctgctttctcttactatg

SEQ ID NO: 7416203 - DNA, 22 bp, Homo sapiens
acagctgctttctcttactatg

SEQ ID NO: 7416204 - DNA, 22 bp, Homo sapiens
acagctggacaggggagagttt

SEQ ID NO: 7416205 - DNA, 22 bp, Homo sapiens
acagctgctgtggaggttttca

SEQ ID NO: 7416206 - DNA, 22 bp, Homo sapiens
acagctgctgtttttgaaggac

SEQ ID NO: 7416207 - DNA, 22 bp, Homo sapiens
acagctgctgtggaggttttca

SEQ ID NO: 7416208 - DNA, 22 bp, Homo sapiens
acagctgctgtttttgaaggac

SEQ ID NO: 7416209 - DNA, 22 bp, Homo sapiens
acagctgctgtttttgaaggac

SEQ ID NO: 7416210 - DNA, 22 bp, Homo sapiens
acagctgctttctcttactatg

SEQ ID NO: 7416211 - DNA, 22 bp, Homo sapiens
acagctgctgcttctcactggg

SEQ ID NO: 7416212 - DNA, 22 bp, Homo sapiens
acagctgctgcttctcactggg

SEQ ID NO: 7416213 - DNA, 22 bp, Homo sapiens
acagctgctgcttctcactggg

SEQ ID NO: 7416214 - DNA, 22 bp, Homo sapiens
acagctgctgtggaggttttca

SEQ ID NO: 7416215 - DNA, 22 bp, Homo sapiens
acagctgctctatatctcagcc

SEQ ID NO: 7416216 - DNA, 22 bp, Homo sapiens
acagctgctctatatctcagcc

SEQ ID NO: 7416217 - DNA, 22 bp, Homo sapiens
acagctgctctatatctcagcc

SEQ ID NO: 7416218 - DNA, 22 bp, Homo sapiens
acagctgctgcttctcactggg

SEQ ID NO: 7416219 - DNA, 22 bp, Homo sapiens
acagctgctgcttctcactggg

SEQ ID NO: 7416220 - DNA, 22 bp, Homo sapiens
acagctgctgcttctcactggg

SEQ ID NO: 7416221 - DNA, 22 bp, Homo sapiens
aagcccctcgggtgcgcacgcg

SEQ ID NO: 7416222 - DNA, 22 bp, Homo sapiens
aagcccctcgggtgcgcacgcg

SEQ ID NO: 7416223 - DNA, 22 bp, Homo sapiens
aagcccggttgggaacgtggtg

SEQ ID NO: 7416224 - DNA, 22 bp, Homo sapiens
aagcccctcgggtgcgcacgcg

SEQ ID NO: 7416225 - DNA, 22 bp, Homo sapiens
aagccctcatccccatgggcgt

SEQ ID NO: 7416226 - DNA, 21 bp, Homo sapiens
aagcccgtagagccaggactc

SEQ ID NO: 7416227 - DNA, 22 bp, Homo sapiens
aagccctcagagcctctttgac

SEQ ID NO: 7416228 - DNA, 23 bp, Homo sapiens
aagccctgaaggtttcaggccct

SEQ ID NO: 7416229 - DNA, 22 bp, Homo sapiens
aagccctgacctgagagtccgt

SEQ ID NO: 7416230 - DNA, 22 bp, Homo sapiens
aagccctgacctgagagtccgt

SEQ ID NO: 7416231 - DNA, 22 bp, Homo sapiens
aagccctgacctgagagtccgt

SEQ ID NO: 7416232 - DNA, 22 bp, Homo sapiens
acagctgctctatatctcagcc

SEQ ID NO: 7416233 - DNA, 22 bp, Homo sapiens
acagctgctctatatctcagcc

SEQ ID NO: 7416234 - DNA, 23 bp, Homo sapiens
aagccctgaaggtttcaggccct

SEQ ID NO: 7416235 - DNA, 23 bp, Homo sapiens
aagccctgaaggtttcaggccct

SEQ ID NO: 7416236 - DNA, 23 bp, Homo sapiens
aagccctgaaggtttcaggccct

SEQ ID NO: 7416237 - DNA, 22 bp, Homo sapiens
aagccctccgtacgtgctagct

SEQ ID NO: 7416238 - DNA, 22 bp, Homo sapiens
aagccctcattagccatagccc

SEQ ID NO: 7416239 - DNA, 22 bp, Homo sapiens
aagccctcattagccatagccc

SEQ ID NO: 7416240 - DNA, 22 bp, Homo sapiens
aagccctcattagccatagccc

SEQ ID NO: 7416241 - DNA, 22 bp, Homo sapiens
aagcccagtttcacactgagac

SEQ ID NO: 7416242 - DNA, 22 bp, Homo sapiens
aagcccagtttcacactgagac

SEQ ID NO: 7416243 - DNA, 22 bp, Homo sapiens
aagcccagtttcacactgagac

SEQ ID NO: 7416244 - DNA, 22 bp, Homo sapiens
aagcccagtttcacactgagac

SEQ ID NO: 7416245 - DNA, 22 bp, Homo sapiens
aagcccagtttcacactgagac

SEQ ID NO: 7416246 - DNA, 19 bp, Homo sapiens
aagcccagtgtatgctctt

SEQ ID NO: 7416247 - DNA, 22 bp, Homo sapiens
aagcccagtttcacactgagac

SEQ ID NO: 7416248 - DNA, 23 bp, Homo sapiens
aagccccaaggaacttcctggga

SEQ ID NO: 7416249 - DNA, 22 bp, Homo sapiens
aagcccattcggctgccctgca

SEQ ID NO: 7416250 - DNA, 22 bp, Homo sapiens
aagcccatgaaatggcctcaat

SEQ ID NO: 7416251 - DNA, 22 bp, Homo sapiens
aagcccatgaaatggcctcaat

SEQ ID NO: 7416252 - DNA, 20 bp, Homo sapiens
aagcccattaccatgcttgg

SEQ ID NO: 7416253 - DNA, 22 bp, Homo sapiens
aagcccagtttcacactgagac

SEQ ID NO: 7416254 - DNA, 22 bp, Homo sapiens
aagcccataaaaagaggtccct

SEQ ID NO: 7416255 - DNA, 22 bp, Homo sapiens
aagcccataaaaagaggtccct

SEQ ID NO: 7416256 - DNA, 22 bp, Homo sapiens
aagcccagtaccttcagtgagg

SEQ ID NO: 7416257 - DNA, 22 bp, Homo sapiens
aagcccagtaccttcagtgagg

SEQ ID NO: 7416258 - DNA, 22 bp, Homo sapiens
aagcccagtaccttcagtgagg

SEQ ID NO: 7416259 - DNA, 22 bp, Homo sapiens
aagcccagtaccttcagtgagg

SEQ ID NO: 7416260 - DNA, 22 bp, Homo sapiens
aagcccaggtaagtggctcatg

SEQ ID NO: 7416261 - DNA, 22 bp, Homo sapiens
aagcccagtaccttcagtgagg

SEQ ID NO: 7416262 - DNA, 19 bp, Homo sapiens
aagcccagtgtatgctctt

SEQ ID NO: 7416263 - DNA, 19 bp, Homo sapiens
aagcccagtgtatgctctt

SEQ ID NO: 7416264 - DNA, 19 bp, Homo sapiens
aagcccagtgtatgctctt

SEQ ID NO: 7416265 - DNA, 19 bp, Homo sapiens
aagcccagtgtatgctctt

SEQ ID NO: 7416266 - DNA, 22 bp, Homo sapiens
aagcccagtaccttcagtgagg

SEQ ID NO: 7416267 - DNA, 22 bp, Homo sapiens
aagcccaggtaagtggctcatg

SEQ ID NO: 7416268 - DNA, 22 bp, Homo sapiens
aagcccaggtaagtggctcatg

SEQ ID NO: 7416269 - DNA, 22 bp, Homo sapiens
aagcccagggaatggtcgggag

SEQ ID NO: 7416270 - DNA, 22 bp, Homo sapiens
aagcccaggtaagtggctcatg

SEQ ID NO: 7416271 - DNA, 22 bp, Homo sapiens
aagcccaggtaagtggctcatg

SEQ ID NO: 7416272 - DNA, 22 bp, Homo sapiens
aagcccaggtaagtggctcatg

SEQ ID NO: 7416273 - DNA, 22 bp, Homo sapiens
aagcccagggaatggtcgggag

SEQ ID NO: 7416274 - DNA, 22 bp, Homo sapiens
aagcccagctgaaagcattttt

SEQ ID NO: 7416275 - DNA, 22 bp, Homo sapiens
aagcccagctgaaagcattttt

SEQ ID NO: 7416276 - DNA, 22 bp, Homo sapiens
aagcccagctgaaagcattttt

SEQ ID NO: 7416277 - DNA, 22 bp, Homo sapiens
aagcccagctctgcctgctctg

SEQ ID NO: 7416278 - DNA, 22 bp, Homo sapiens
aagcccagctgaaagcattttt

SEQ ID NO: 7416279 - DNA, 22 bp, Homo sapiens
aagcccagctctgcctgctctg

SEQ ID NO: 7416280 - DNA, 22 bp, Homo sapiens
aagcccagctctgcctgctctg

SEQ ID NO: 7416281 - DNA, 22 bp, Homo sapiens
aagcccagctctgcctgctctg

SEQ ID NO: 7416282 - DNA, 22 bp, Homo sapiens
aagcccagctctgcctgctctg

SEQ ID NO: 7416283 - DNA, 22 bp, Homo sapiens
aagcccagctctgcctgctctg

SEQ ID NO: 7416284 - DNA, 22 bp, Homo sapiens
aagcccagctctgcctgctctg

SEQ ID NO: 7416285 - DNA, 22 bp, Homo sapiens
aagcccagcatccctgcaccag

SEQ ID NO: 7416286 - DNA, 22 bp, Homo sapiens
aagcccagcatccctgcaccag

SEQ ID NO: 7416287 - DNA, 22 bp, Homo sapiens
acagccagatctgagagatctt

SEQ ID NO: 7416288 - DNA, 22 bp, Homo sapiens
acagccagatctgagagatctt

SEQ ID NO: 7416289 - DNA, 22 bp, Homo sapiens
acagccagatctgagagatctt

SEQ ID NO: 7416290 - DNA, 22 bp, Homo sapiens
acagccagatctgagagatctt

SEQ ID NO: 7416291 - DNA, 22 bp, Homo sapiens
acagccagatctgagagatctt

SEQ ID NO: 7416292 - DNA, 22 bp, Homo sapiens
acagccagatctgagagatctt

SEQ ID NO: 7416293 - DNA, 22 bp, Homo sapiens
acagcaggttacagtggcacag

SEQ ID NO: 7416294 - DNA, 22 bp, Homo sapiens
acagccagatctgagagatctt

SEQ ID NO: 7416295 - DNA, 22 bp, Homo sapiens
acagcaggttacagtggcacag

SEQ ID NO: 7416296 - DNA, 22 bp, Homo sapiens
acagcaggttacagtggcacag

SEQ ID NO: 7416297 - DNA, 22 bp, Homo sapiens
acagcaggttacagtggcacag

SEQ ID NO: 7416298 - DNA, 22 bp, Homo sapiens
acagcaggttacagtggcacag

SEQ ID NO: 7416299 - DNA, 22 bp, Homo sapiens
acagcaggttacagtggcacag

SEQ ID NO: 7416300 - DNA, 19 bp, Homo sapiens
acagcaggtgtggggataa

SEQ ID NO: 7416301 - DNA, 22 bp, Homo sapiens
acagcaggttacagtggcacag

SEQ ID NO: 7416302 - DNA, 22 bp, Homo sapiens
acagccagcagagctgtttcct

SEQ ID NO: 7416303 - DNA, 22 bp, Homo sapiens
acagccagcagagctgtttcct

SEQ ID NO: 7416304 - DNA, 22 bp, Homo sapiens
acagccagcttgatgggatccg

SEQ ID NO: 7416305 - DNA, 22 bp, Homo sapiens
acagccagcagagctgtttcct

SEQ ID NO: 7416306 - DNA, 22 bp, Homo sapiens
acagccagcttgatgggatccg

SEQ ID NO: 7416307 - DNA, 21 bp, Homo sapiens
acagccaggaacatgaggggc

SEQ ID NO: 7416308 - DNA, 21 bp, Homo sapiens
acagccaggaacatgaggggc

SEQ ID NO: 7416309 - DNA, 21 bp, Homo sapiens
acagccaggaacatgaggggc

SEQ ID NO: 7416310 - DNA, 22 bp, Homo sapiens
acagccaggaattctggagaag

SEQ ID NO: 7416311 - DNA, 21 bp, Homo sapiens
acagccaggaacatgaggggc

SEQ ID NO: 7416312 - DNA, 21 bp, Homo sapiens
acagccaggaacatgaggggc

SEQ ID NO: 7416313 - DNA, 21 bp, Homo sapiens
acagccaggaacatgaggggc

SEQ ID NO: 7416314 - DNA, 22 bp, Homo sapiens
acagccaggagccatgggcagg

SEQ ID NO: 7416315 - DNA, 22 bp, Homo sapiens
acagccaggacttggccctctt

SEQ ID NO: 7416316 - DNA, 22 bp, Homo sapiens
acagccaggacttggccctctt

SEQ ID NO: 7416317 - DNA, 22 bp, Homo sapiens
acagccaggacttggccctctt

SEQ ID NO: 7416318 - DNA, 22 bp, Homo sapiens
acagccaggacttggccctctt

SEQ ID NO: 7416319 - DNA, 22 bp, Homo sapiens
acagccaggacttggccctctt

SEQ ID NO: 7416320 - DNA, 22 bp, Homo sapiens
acagccaggaattctggagaag

SEQ ID NO: 7416321 - DNA, 22 bp, Homo sapiens
acagccaggaattctggagaag

SEQ ID NO: 7416322 - DNA, 22 bp, Homo sapiens
acagccaggaattctggagaag

SEQ ID NO: 7416323 - DNA, 22 bp, Homo sapiens
acagccaggcccagcacgcagg

SEQ ID NO: 7416324 - DNA, 22 bp, Homo sapiens
acagccaggcccagcacgcagg

SEQ ID NO: 7416325 - DNA, 22 bp, Homo sapiens
acagccaggcccagcacgcagg

SEQ ID NO: 7416326 - DNA, 22 bp, Homo sapiens
acagccaggcccagcacgcagg

SEQ ID NO: 7416327 - DNA, 23 bp, Homo sapiens
acagccaggatgggagcagaagc

SEQ ID NO: 7416328 - DNA, 22 bp, Homo sapiens
acagccaggcccagcacgcagg

SEQ ID NO: 7416329 - DNA, 23 bp, Homo sapiens
acagccaggatgggagcagaagc

SEQ ID NO: 7416330 - DNA, 23 bp, Homo sapiens
acagccaggatgggagcagaagc

SEQ ID NO: 7416331 - DNA, 23 bp, Homo sapiens
acagccaggatgggagcagaagc

SEQ ID NO: 7416332 - DNA, 22 bp, Homo sapiens
acagccaggaggaactcagtga

SEQ ID NO: 7416333 - DNA, 22 bp, Homo sapiens
acagccaggaggaactcagtga

SEQ ID NO: 7416334 - DNA, 22 bp, Homo sapiens
acagccaggaggaactcagtga

SEQ ID NO: 7416335 - DNA, 22 bp, Homo sapiens
acagccaggaggaactcagtga

SEQ ID NO: 7416336 - DNA, 22 bp, Homo sapiens
acagccaggaggaactcagtga

SEQ ID NO: 7416337 - DNA, 22 bp, Homo sapiens
acagccaggaggaactcagtga

SEQ ID NO: 7416338 - DNA, 22 bp, Homo sapiens
acagccaggagccatgggcagg

SEQ ID NO: 7416339 - DNA, 22 bp, Homo sapiens
acagccaggagccatgggcagg

SEQ ID NO: 7416340 - DNA, 22 bp, Homo sapiens
acagccaggagccatgggcagg

SEQ ID NO: 7416341 - DNA, 22 bp, Homo sapiens
acagccaggagccatgggcagg

SEQ ID NO: 7416342 - DNA, 22 bp, Homo sapiens
aagccaggtttgaaatatccca

SEQ ID NO: 7416343 - DNA, 22 bp, Homo sapiens
aagccaggtttgaaatatccca

SEQ ID NO: 7416344 - DNA, 22 bp, Homo sapiens
aagccaggttccatggaggagc

SEQ ID NO: 7416345 - DNA, 22 bp, Homo sapiens
aagccaggttccatggaggagc

SEQ ID NO: 7416346 - DNA, 22 bp, Homo sapiens
aagccaggttccatggaggagc

SEQ ID NO: 7416347 - DNA, 22 bp, Homo sapiens
aagcccagcatccctgcaccag

SEQ ID NO: 7416348 - DNA, 22 bp, Homo sapiens
aagcccagcatccctgcaccag

SEQ ID NO: 7416349 - DNA, 22 bp, Homo sapiens
aagcccagcatccctgcaccag

SEQ ID NO: 7416350 - DNA, 22 bp, Homo sapiens
aagcccagcatccctgcaccag

SEQ ID NO: 7416351 - DNA, 22 bp, Homo sapiens
aagcccagatgtgagaactgag

SEQ ID NO: 7416352 - DNA, 22 bp, Homo sapiens
acagccagggacatacaatggt

SEQ ID NO: 7416353 - DNA, 22 bp, Homo sapiens
acagccagggacatacaatggt

SEQ ID NO: 7416354 - DNA, 22 bp, Homo sapiens
acagccagggacatacaatggt

SEQ ID NO: 7416355 - DNA, 22 bp, Homo sapiens
acagccagggacatacaatggt

SEQ ID NO: 7416356 - DNA, 22 bp, Homo sapiens
acagccaggcccagcacgcagg

SEQ ID NO: 7416357 - DNA, 22 bp, Homo sapiens
acagccaggcccagcacgcagg

SEQ ID NO: 7416358 - DNA, 22 bp, Homo sapiens
acagccagggacatacaatggt

SEQ ID NO: 7416359 - DNA, 22 bp, Homo sapiens
aagccaggttccatggaggagc

SEQ ID NO: 7416360 - DNA, 22 bp, Homo sapiens
aagccaggttccatggaggagc

SEQ ID NO: 7416361 - DNA, 22 bp, Homo sapiens
aagccaggttccatggaggagc

SEQ ID NO: 7416362 - DNA, 19 bp, Homo sapiens
aagcagtttatatatttgt

SEQ ID NO: 7416363 - DNA, 22 bp, Homo sapiens
aagcagtttagataggcaaagg

SEQ ID NO: 7416364 - DNA, 22 bp, Homo sapiens
aagcagtttttcaactgtttag

SEQ ID NO: 7416365 - DNA, 22 bp, Homo sapiens
aagcataaaacgttacaacatg

SEQ ID NO: 7416366 - DNA, 22 bp, Homo sapiens
aagcataaaacgttacaacatg

SEQ ID NO: 7416367 - DNA, 22 bp, Homo sapiens
aagcataaaacgttacaacatg

SEQ ID NO: 7416368 - DNA, 22 bp, Homo sapiens
aagcataaaacgttacaacatg

SEQ ID NO: 7416369 - DNA, 22 bp, Homo sapiens
aagcataacttgctgcacatag

SEQ ID NO: 7416370 - DNA, 22 bp, Homo sapiens
aagcataacttgctgcacatag

SEQ ID NO: 7416371 - DNA, 22 bp, Homo sapiens
aagcataaaacgttacaacatg

SEQ ID NO: 7416372 - DNA, 22 bp, Homo sapiens
acagcaggaagctggagggaaa

SEQ ID NO: 7416373 - DNA, 22 bp, Homo sapiens
acagcaggaagctggagggaaa

SEQ ID NO: 7416374 - DNA, 22 bp, Homo sapiens
aagcagttaatgttttgtcaat

SEQ ID NO: 7416375 - DNA, 22 bp, Homo sapiens
aagcagttactatttactatta

SEQ ID NO: 7416376 - DNA, 22 bp, Homo sapiens
aagcagtgttcccagctggccc

SEQ ID NO: 7416377 - DNA, 22 bp, Homo sapiens
aagcagtgttcccagctggccc

SEQ ID NO: 7416378 - DNA, 22 bp, Homo sapiens
aagcagtgttcccagctggccc

SEQ ID NO: 7416379 - DNA, 22 bp, Homo sapiens
aagcagtgttcccagctggccc

SEQ ID NO: 7416380 - DNA, 22 bp, Homo sapiens
aagcagtgatgcatacagctgt

SEQ ID NO: 7416381 - DNA, 22 bp, Homo sapiens
aagcagtgatgcatacagctgt

SEQ ID NO: 7416382 - DNA, 22 bp, Homo sapiens
aagcagtgcgctcatctaaggg

SEQ ID NO: 7416383 - DNA, 22 bp, Homo sapiens
aagcagtgataagagctaccat

SEQ ID NO: 7416384 - DNA, 22 bp, Homo sapiens
aagcagtgatgcatacagctgt

SEQ ID NO: 7416385 - DNA, 22 bp, Homo sapiens
aagcagtgatgcatacagctgt

SEQ ID NO: 7416386 - DNA, 22 bp, Homo sapiens
aagcagtgataagagctaccat

SEQ ID NO: 7416387 - DNA, 22 bp, Homo sapiens
aagcagtgataagagctaccat

SEQ ID NO: 7416388 - DNA, 22 bp, Homo sapiens
aagcagtgataagagctaccat

SEQ ID NO: 7416389 - DNA, 22 bp, Homo sapiens
aagcagtgactctcagaggcag

SEQ ID NO: 7416390 - DNA, 22 bp, Homo sapiens
aagcagtgactctcagaggcag

SEQ ID NO: 7416391 - DNA, 22 bp, Homo sapiens
aagcagtcttggctgggttcag

SEQ ID NO: 7416392 - DNA, 22 bp, Homo sapiens
acagcagggtcacattccctct

SEQ ID NO: 7416393 - DNA, 22 bp, Homo sapiens
acagcaggtagctttgtgcctc

SEQ ID NO: 7416394 - DNA, 22 bp, Homo sapiens
acagcaggtagctttgtgcctc

SEQ ID NO: 7416395 - DNA, 22 bp, Homo sapiens
acagcaggtagctttgtgcctc

SEQ ID NO: 7416396 - DNA, 19 bp, Homo sapiens
acagcaggtgtggggataa

SEQ ID NO: 7416397 - DNA, 19 bp, Homo sapiens
acagcaggtgtggggataa

SEQ ID NO: 7416398 - DNA, 19 bp, Homo sapiens
acagcaggtgtggggataa

SEQ ID NO: 7416399 - DNA, 19 bp, Homo sapiens
acagcaggtgtggggataa

SEQ ID NO: 7416400 - DNA, 19 bp, Homo sapiens
acagcaggtgtggggataa

SEQ ID NO: 7416401 - DNA, 22 bp, Homo sapiens
acagcagggtcacattccctct

SEQ ID NO: 7416402 - DNA, 22 bp, Homo sapiens
acagcaggggtggaataaacgt

SEQ ID NO: 7416403 - DNA, 22 bp, Homo sapiens
acagcaggggtggaataaacgt

SEQ ID NO: 7416404 - DNA, 22 bp, Homo sapiens
acagcaggggtggaataaacgt

SEQ ID NO: 7416405 - DNA, 22 bp, Homo sapiens
acagcagggtcacattccctct

SEQ ID NO: 7416406 - DNA, 22 bp, Homo sapiens
acagcagggtcacattccctct

SEQ ID NO: 7416407 - DNA, 22 bp, Homo sapiens
acagcagggtcacattccctct

SEQ ID NO: 7416408 - DNA, 22 bp, Homo sapiens
acagcagggggagctgttggac

SEQ ID NO: 7416409 - DNA, 22 bp, Homo sapiens
acagcagggggagctgttggac

SEQ ID NO: 7416410 - DNA, 22 bp, Homo sapiens
acagcagggggagctgttggac

SEQ ID NO: 7416411 - DNA, 22 bp, Homo sapiens
acagcagggggagctgttggac

SEQ ID NO: 7416412 - DNA, 21 bp, Homo sapiens
acagcagggctggcatgacag

SEQ ID NO: 7416413 - DNA, 22 bp, Homo sapiens
acagcaggaagctggagggaaa

SEQ ID NO: 7416414 - DNA, 21 bp, Homo sapiens
acagcagggctggcatgacag

SEQ ID NO: 7416415 - DNA, 21 bp, Homo sapiens
acagcagggctggcatgacag

SEQ ID NO: 7416416 - DNA, 21 bp, Homo sapiens
acagcagggctggcatgacag

SEQ ID NO: 7416417 - DNA, 22 bp, Homo sapiens
acagcaggggtggaataaacgt

SEQ ID NO: 7416418 - DNA, 22 bp, Homo sapiens
acagcagggggagctgttggac

SEQ ID NO: 7416419 - DNA, 22 bp, Homo sapiens
acagcagggggagctgttggac

SEQ ID NO: 7416420 - DNA, 22 bp, Homo sapiens
acagcagggggagctgttggac

SEQ ID NO: 7416421 - DNA, 22 bp, Homo sapiens
acagcagggggagctgttggac

SEQ ID NO: 7416422 - DNA, 22 bp, Homo sapiens
acagcagggggagctgttggac

SEQ ID NO: 7416423 - DNA, 22 bp, Homo sapiens
acagagcacagtcgggatggga

SEQ ID NO: 7416424 - DNA, 22 bp, Homo sapiens
acagagcacagtcgggatggga

SEQ ID NO: 7416425 - DNA, 22 bp, Homo sapiens
acagagcaattcttgggtgttt

SEQ ID NO: 7416426 - DNA, 22 bp, Homo sapiens
acagagcacagtcgggatggga

SEQ ID NO: 7416427 - DNA, 22 bp, Homo sapiens
acagagcacagtcgggatggga

SEQ ID NO: 7416428 - DNA, 22 bp, Homo sapiens
acagagcacagtcgggatggga

SEQ ID NO: 7416429 - DNA, 22 bp, Homo sapiens
aagcaggaaggagcccagggca

SEQ ID NO: 7416430 - DNA, 21 bp, Homo sapiens
aagcaggacatatgatgccct

SEQ ID NO: 7416431 - DNA, 21 bp, Homo sapiens
aagcaggacatatgatgccct

SEQ ID NO: 7416432 - DNA, 22 bp, Homo sapiens
aagcaggctagattgaagggct

SEQ ID NO: 7416433 - DNA, 22 bp, Homo sapiens
aagcaggctagattgaagggct

SEQ ID NO: 7416434 - DNA, 22 bp, Homo sapiens
aagcaggctcacgccaggcagt

SEQ ID NO: 7416435 - DNA, 22 bp, Homo sapiens
aagcaggcgagggcctggagca

SEQ ID NO: 7416436 - DNA, 22 bp, Homo sapiens
aagcaggacgtatttctatcct

SEQ ID NO: 7416437 - DNA, 22 bp, Homo sapiens
aagcaggagagcctgggcgagc

SEQ ID NO: 7416438 - DNA, 22 bp, Homo sapiens
aagcaggagagcctgggcgagc

SEQ ID NO: 7416439 - DNA, 21 bp, Homo sapiens
aagcaggacatatgatgccct

SEQ ID NO: 7416440 - DNA, 22 bp, Homo sapiens
aagcaggcttggtgtggccgct

SEQ ID NO: 7416441 - DNA, 22 bp, Homo sapiens
aagcaggcttggtgtggccgct

SEQ ID NO: 7416442 - DNA, 22 bp, Homo sapiens
aagcaggctcacgccaggcagt

SEQ ID NO: 7416443 - DNA, 22 bp, Homo sapiens
aagcaggctcacgccaggcagt

SEQ ID NO: 7416444 - DNA, 21 bp, Homo sapiens
aagcaggctgtaatcatgtgg

SEQ ID NO: 7416445 - DNA, 22 bp, Homo sapiens
aagcaggcttggtgtggccgct

SEQ ID NO: 7416446 - DNA, 22 bp, Homo sapiens
aagcagggagaaatttttcttc

SEQ ID NO: 7416447 - DNA, 21 bp, Homo sapiens
aagcagggactgcccaggtcc

SEQ ID NO: 7416448 - DNA, 21 bp, Homo sapiens
aagcagggactgcccaggtcc

SEQ ID NO: 7416449 - DNA, 21 bp, Homo sapiens
aagcagggactgcccaggtcc

SEQ ID NO: 7416450 - DNA, 21 bp, Homo sapiens
aagcagggactgcccaggtcc

SEQ ID NO: 7416451 - DNA, 23 bp, Homo sapiens
aagcagggagattcttagctgag

SEQ ID NO: 7416452 - DNA, 23 bp, Homo sapiens
aagcagggagattcttagctgag

SEQ ID NO: 7416453 - DNA, 21 bp, Homo sapiens
aagcagggactgcccaggtcc

SEQ ID NO: 7416454 - DNA, 22 bp, Homo sapiens
aagcagggtgtcttgacccatg

SEQ ID NO: 7416455 - DNA, 22 bp, Homo sapiens
aagcagggtgtcttgacccatg

SEQ ID NO: 7416456 - DNA, 22 bp, Homo sapiens
aagcaggtaaatatgtttccct

SEQ ID NO: 7416457 - DNA, 22 bp, Homo sapiens
aagcagggtttttccaccgcag

SEQ ID NO: 7416458 - DNA, 22 bp, Homo sapiens
aagcagtaatgaggtactattt

SEQ ID NO: 7416459 - DNA, 22 bp, Homo sapiens
aagcagtaatgaggtactattt

SEQ ID NO: 7416460 - DNA, 22 bp, Homo sapiens
aagcagtagaatgcattgcttt

SEQ ID NO: 7416461 - DNA, 22 bp, Homo sapiens
aagcaggtgtgagccagtgggc

SEQ ID NO: 7416462 - DNA, 22 bp, Homo sapiens
aagcagggtttttccaccgcag

SEQ ID NO: 7416463 - DNA, 22 bp, Homo sapiens
aagcaggttacatacattatct

SEQ ID NO: 7416464 - DNA, 22 bp, Homo sapiens
aagcaggttacatacattatct

SEQ ID NO: 7416465 - DNA, 22 bp, Homo sapiens
aagcaggttatgaaatatagaa

SEQ ID NO: 7416466 - DNA, 22 bp, Homo sapiens
aagcaggttatgaaatatagaa

SEQ ID NO: 7416467 - DNA, 22 bp, Homo sapiens
aagcagggctccctggggactc

SEQ ID NO: 7416468 - DNA, 22 bp, Homo sapiens
aagcagggctccctggggactc

SEQ ID NO: 7416469 - DNA, 22 bp, Homo sapiens
aagcagggctagaccaagaaga

SEQ ID NO: 7416470 - DNA, 22 bp, Homo sapiens
aagcagggctccctggggactc

SEQ ID NO: 7416471 - DNA, 22 bp, Homo sapiens
aagcagggtcttcctcagttgg

SEQ ID NO: 7416472 - DNA, 18 bp, Homo sapiens
aagcagggtccattgtgc

SEQ ID NO: 7416473 - DNA, 18 bp, Homo sapiens
aagcagggtccattgtgc

SEQ ID NO: 7416474 - DNA, 18 bp, Homo sapiens
aagcagggtccattgtgc

SEQ ID NO: 7416475 - DNA, 22 bp, Homo sapiens
aagcagggctccctggggactc

SEQ ID NO: 7416476 - DNA, 22 bp, Homo sapiens
aagttacagttggaactgtgaa

SEQ ID NO: 7416477 - DNA, 22 bp, Homo sapiens
aagttacagttggaactgtgaa

SEQ ID NO: 7416478 - DNA, 22 bp, Homo sapiens
aagttacagttattatttaaaa

SEQ ID NO: 7416479 - DNA, 22 bp, Homo sapiens
aagttacagttggaactgtgaa

SEQ ID NO: 7416480 - DNA, 22 bp, Homo sapiens
aagttacagttattatttaaaa

SEQ ID NO: 7416481 - DNA, 22 bp, Homo sapiens
aagttacagttattatttaaaa

SEQ ID NO: 7416482 - DNA, 22 bp, Homo sapiens
aataagaattgccagatttgaa

SEQ ID NO: 7416483 - DNA, 22 bp, Homo sapiens
aataagaattgccagatttgaa

SEQ ID NO: 7416484 - DNA, 22 bp, Homo sapiens
aataagaattgccagatttgaa

SEQ ID NO: 7416485 - DNA, 22 bp, Homo sapiens
aataagaattgccagatttgaa

SEQ ID NO: 7416486 - DNA, 22 bp, Homo sapiens
aataagaacttgtctctggcag

SEQ ID NO: 7416487 - DNA, 22 bp, Homo sapiens
aataagaacttgtctctggcag

SEQ ID NO: 7416488 - DNA, 22 bp, Homo sapiens
aataagaacttgtctctggcag

SEQ ID NO: 7416489 - DNA, 20 bp, Homo sapiens
aagttacattgtattgtacc

SEQ ID NO: 7416490 - DNA, 20 bp, Homo sapiens
aagttacattgtattgtacc

SEQ ID NO: 7416491 - DNA, 22 bp, Homo sapiens
aagttacataaatgtcctctag

SEQ ID NO: 7416492 - DNA, 22 bp, Homo sapiens
aagttacataaatgtcctctag

SEQ ID NO: 7416493 - DNA, 22 bp, Homo sapiens
aagttacataaatgtcctctag

SEQ ID NO: 7416494 - DNA, 22 bp, Homo sapiens
aagttacagttatgaaactcac

SEQ ID NO: 7416495 - DNA, 22 bp, Homo sapiens
aagttacagttacagaatggag

SEQ ID NO: 7416496 - DNA, 22 bp, Homo sapiens
aagttacagttacagaatggag

SEQ ID NO: 7416497 - DNA, 22 bp, Homo sapiens
aagttacagttattatttaaaa

SEQ ID NO: 7416498 - DNA, 22 bp, Homo sapiens
aagttacagttattatttaaaa

SEQ ID NO: 7416499 - DNA, 22 bp, Homo sapiens
aagttacagttattatttaaaa

SEQ ID NO: 7416500 - DNA, 22 bp, Homo sapiens
aagttacagttatgaaactcac

SEQ ID NO: 7416501 - DNA, 22 bp, Homo sapiens
aagttacagttatgaaactcac

SEQ ID NO: 7416502 - DNA, 22 bp, Homo sapiens
aagttacagttacagaatggag

SEQ ID NO: 7416503 - DNA, 22 bp, Homo sapiens
aagttacagttacagaatggag

SEQ ID NO: 7416504 - DNA, 22 bp, Homo sapiens
aagttacagtcagaggttaaca

SEQ ID NO: 7416505 - DNA, 22 bp, Homo sapiens
aagttacagtcagaggttaaca

SEQ ID NO: 7416506 - DNA, 22 bp, Homo sapiens
aagttacagtcagaggttaaca

SEQ ID NO: 7416507 - DNA, 22 bp, Homo sapiens
aagttacaggagaaagagatca

SEQ ID NO: 7416508 - DNA, 22 bp, Homo sapiens
aagttacaagactaaatggaag

SEQ ID NO: 7416509 - DNA, 22 bp, Homo sapiens
aagttacaagactaaatggaag

SEQ ID NO: 7416510 - DNA, 22 bp, Homo sapiens
aagttacaagactaaatggaag

SEQ ID NO: 7416511 - DNA, 22 bp, Homo sapiens
aagttacaagactaaatggaag

SEQ ID NO: 7416512 - DNA, 22 bp, Homo sapiens
aagttaattaacctctccatca

SEQ ID NO: 7416513 - DNA, 22 bp, Homo sapiens
aagttaaggcacatgctttgga

SEQ ID NO: 7416514 - DNA, 22 bp, Homo sapiens
aagttaaggcacatgctttgga

SEQ ID NO: 7416515 - DNA, 22 bp, Homo sapiens
aagttaaggcacatgctttgga

SEQ ID NO: 7416516 - DNA, 22 bp, Homo sapiens
aagttaaggatcttgagatgat

SEQ ID NO: 7416517 - DNA, 22 bp, Homo sapiens
aagttaacccagtatttctttt

SEQ ID NO: 7416518 - DNA, 22 bp, Homo sapiens
aagttaacccagtatttctttt

SEQ ID NO: 7416519 - DNA, 22 bp, Homo sapiens
aagttacaggagaaagagatca

SEQ ID NO: 7416520 - DNA, 22 bp, Homo sapiens
aagttacagattgggagcagag

SEQ ID NO: 7416521 - DNA, 22 bp, Homo sapiens
aagttacacattttcattgtaa

SEQ ID NO: 7416522 - DNA, 22 bp, Homo sapiens
aagttacacattttcattgtaa

SEQ ID NO: 7416523 - DNA, 22 bp, Homo sapiens
aagttacacattttcattgtaa

SEQ ID NO: 7416524 - DNA, 22 bp, Homo sapiens
aagttacacattttcattgtaa

SEQ ID NO: 7416525 - DNA, 22 bp, Homo sapiens
aagttacacagagttggaggct

SEQ ID NO: 7416526 - DNA, 22 bp, Homo sapiens
aagttacacagagttggaggct

SEQ ID NO: 7416527 - DNA, 22 bp, Homo sapiens
aacagttattatcacattagtg

SEQ ID NO: 7416528 - DNA, 21 bp, Homo sapiens
aacagttctctttgaaggtgt

SEQ ID NO: 7416529 - DNA, 21 bp, Homo sapiens
aacagttctctttgaaggtgt

SEQ ID NO: 7416530 - DNA, 22 bp, Homo sapiens
aacagttgatgtagctttggag

SEQ ID NO: 7416531 - DNA, 22 bp, Homo sapiens
aacagttgatgtagctttggag

SEQ ID NO: 7416532 - DNA, 22 bp, Homo sapiens
aacagtttatcaagtttttaca

SEQ ID NO: 7416533 - DNA, 22 bp, Homo sapiens
aacagtttatcaagtttttaca

SEQ ID NO: 7416534 - DNA, 22 bp, Homo sapiens
aacagtttatcaagtttttaca

SEQ ID NO: 7416535 - DNA, 22 bp, Homo sapiens
aacagtttatcaagtttttaca

SEQ ID NO: 7416536 - DNA, 22 bp, Homo sapiens
aacagtttatgataaattctta

SEQ ID NO: 7416537 - DNA, 22 bp, Homo sapiens
aacagtttatgataaattctta

SEQ ID NO: 7416538 - DNA, 22 bp, Homo sapiens
aacagtttatgagatatgctat

SEQ ID NO: 7416539 - DNA, 22 bp, Homo sapiens
aacagtttatgagatatgctat

SEQ ID NO: 7416540 - DNA, 22 bp, Homo sapiens
aacagtttatgagatatgctat

SEQ ID NO: 7416541 - DNA, 22 bp, Homo sapiens
aataatgtctttggcttgacca

SEQ ID NO: 7416542 - DNA, 22 bp, Homo sapiens
aataatgtctgctattttaaaa

SEQ ID NO: 7416543 - DNA, 22 bp, Homo sapiens
aataatgtacatacatatttcg

SEQ ID NO: 7416544 - DNA, 22 bp, Homo sapiens
aataatgtacatacatatttcg

SEQ ID NO: 7416545 - DNA, 22 bp, Homo sapiens
aataatgtacatacatatttcg

SEQ ID NO: 7416546 - DNA, 22 bp, Homo sapiens
aataatgtaggatgataaatga

SEQ ID NO: 7416547 - DNA, 22 bp, Homo sapiens
aataatgtaggatgataaatga

SEQ ID NO: 7416548 - DNA, 22 bp, Homo sapiens
aataatgtaggatgataaatga

SEQ ID NO: 7416549 - DNA, 22 bp, Homo sapiens
aataatgtaggatgataaatga

SEQ ID NO: 7416550 - DNA, 22 bp, Homo sapiens
aataatgtaggatgataaatga

SEQ ID NO: 7416551 - DNA, 22 bp, Homo sapiens
aatacagatattcagtggtact

SEQ ID NO: 7416552 - DNA, 22 bp, Homo sapiens
aatacagatattcagtggtact

SEQ ID NO: 7416553 - DNA, 22 bp, Homo sapiens
aatacagatgagcttctgcctc

SEQ ID NO: 7416554 - DNA, 22 bp, Homo sapiens
aatacagatgagcttctgcctc

SEQ ID NO: 7416555 - DNA, 22 bp, Homo sapiens
aatacagatgagcttctgcctc

SEQ ID NO: 7416556 - DNA, 22 bp, Homo sapiens
aatacagatggcatgtgaagat

SEQ ID NO: 7416557 - DNA, 22 bp, Homo sapiens
aatacagatggcatgtgaagat

SEQ ID NO: 7416558 - DNA, 22 bp, Homo sapiens
aatacagatggcatgtgaagat

SEQ ID NO: 7416559 - DNA, 22 bp, Homo sapiens
aatacagatggcatgtgaagat

SEQ ID NO: 7416560 - DNA, 22 bp, Homo sapiens
aatacagcagatggagacaaat

SEQ ID NO: 7416561 - DNA, 22 bp, Homo sapiens
aatacagatggcatgtgaagat

SEQ ID NO: 7416562 - DNA, 22 bp, Homo sapiens
aatacagatggcatgtgaagat

SEQ ID NO: 7416563 - DNA, 22 bp, Homo sapiens
aatacagaggggtcacaattca

SEQ ID NO: 7416564 - DNA, 22 bp, Homo sapiens
aatacagaggggtcacaattca

SEQ ID NO: 7416565 - DNA, 22 bp, Homo sapiens
aatacagaggggtcacaattca

SEQ ID NO: 7416566 - DNA, 22 bp, Homo sapiens
aatacagaggggtcacaattca

SEQ ID NO: 7416567 - DNA, 22 bp, Homo sapiens
aatacagatattcagtggtact

SEQ ID NO: 7416568 - DNA, 22 bp, Homo sapiens
aatacagaggggtcacaattca

SEQ ID NO: 7416569 - DNA, 22 bp, Homo sapiens
aatacagaggggtcacaattca

SEQ ID NO: 7416570 - DNA, 22 bp, Homo sapiens
aatacagaggggtcacaattca

SEQ ID NO: 7416571 - DNA, 22 bp, Homo sapiens
aataatatttgaagcttcaaag

SEQ ID NO: 7416572 - DNA, 22 bp, Homo sapiens
aataatatttgaagcttcaaag

SEQ ID NO: 7416573 - DNA, 22 bp, Homo sapiens
aataatatttgaagcttcaaag

SEQ ID NO: 7416574 - DNA, 22 bp, Homo sapiens
aataatatttgaagcttcaaag

SEQ ID NO: 7416575 - DNA, 22 bp, Homo sapiens
aataatatttgaagcttcaaag

SEQ ID NO: 7416576 - DNA, 22 bp, Homo sapiens
aataatatttgaagcttcaaag

SEQ ID NO: 7416577 - DNA, 22 bp, Homo sapiens
aataatattcctctgtgtgcgt

SEQ ID NO: 7416578 - DNA, 22 bp, Homo sapiens
aataagaattgccagatttgaa

SEQ ID NO: 7416579 - DNA, 22 bp, Homo sapiens
aataagaattgccagatttgaa

SEQ ID NO: 7416580 - DNA, 22 bp, Homo sapiens
aataagaattgccagatttgaa

SEQ ID NO: 7416581 - DNA, 22 bp, Homo sapiens
aataagaattgccagatttgaa

SEQ ID NO: 7416582 - DNA, 22 bp, Homo sapiens
aataatctccctttttgtatgt

SEQ ID NO: 7416583 - DNA, 22 bp, Homo sapiens
aataatatttgaagcttcaaag

SEQ ID NO: 7416584 - DNA, 22 bp, Homo sapiens
aataatatttgaagcttcaaag

SEQ ID NO: 7416585 - DNA, 22 bp, Homo sapiens
aataatctccctttttgtatgt

SEQ ID NO: 7416586 - DNA, 22 bp, Homo sapiens
aataatcttgactactgaatca

SEQ ID NO: 7416587 - DNA, 19 bp, Homo sapiens
aataatgccagatgtctgt

SEQ ID NO: 7416588 - DNA, 22 bp, Homo sapiens
aataatgtacatacatatttcg

SEQ ID NO: 7416589 - DNA, 22 bp, Homo sapiens
aataatgtacatacatatttcg

SEQ ID NO: 7416590 - DNA, 19 bp, Homo sapiens
aataatgccagatgtctgt

SEQ ID NO: 7416591 - DNA, 18 bp, Homo sapiens
aataatgctgctgtgaac

SEQ ID NO: 7416592 - DNA, 22 bp, Homo sapiens
aataatgataatggttatagct

SEQ ID NO: 7416593 - DNA, 22 bp, Homo sapiens
aataatgataatggttatagct

SEQ ID NO: 7416594 - DNA, 22 bp, Homo sapiens
aataatgataatggttatagct

SEQ ID NO: 7416595 - DNA, 22 bp, Homo sapiens
aataatgagcttgtctaattgt

SEQ ID NO: 7416596 - DNA, 22 bp, Homo sapiens
aataatgagcttgtctaattgt

SEQ ID NO: 7416597 - DNA, 22 bp, Homo sapiens
aataatgagacagcttatttaa

SEQ ID NO: 7416598 - DNA, 22 bp, Homo sapiens
aataatgagacagcttatttaa

SEQ ID NO: 7416599 - DNA, 22 bp, Homo sapiens
aataatgagacagcttatttaa

SEQ ID NO: 7416600 - DNA, 22 bp, Homo sapiens
aataatgagacagcttatttaa

SEQ ID NO: 7416601 - DNA, 22 bp, Homo sapiens
aataatgagacagcttatttaa

SEQ ID NO: 7416602 - DNA, 22 bp, Homo sapiens
aataatgagacagcttatttaa

SEQ ID NO: 7416603 - DNA, 22 bp, Homo sapiens
aataatgaacatttaaaacctg

SEQ ID NO: 7416604 - DNA, 22 bp, Homo sapiens
aataatgagcttgtctaattgt

SEQ ID NO: 7416605 - DNA, 22 bp, Homo sapiens
aataatgagcttgtctaattgt

SEQ ID NO: 7416606 - DNA, 22 bp, Homo sapiens
aataatgagcttgtctaattgt

SEQ ID NO: 7416607 - DNA, 22 bp, Homo sapiens
aataatgagcttgtctaattgt

SEQ ID NO: 7416608 - DNA, 22 bp, Homo sapiens
aataatgagcttgtctaattgt

SEQ ID NO: 7416609 - DNA, 22 bp, Homo sapiens
aataatgagcttgtctaattgt

SEQ ID NO: 7416610 - DNA, 22 bp, Homo sapiens
aataatgagacagcttatttaa

SEQ ID NO: 7416611 - DNA, 22 bp, Homo sapiens
aatatctagcctttagcagctt

SEQ ID NO: 7416612 - DNA, 22 bp, Homo sapiens
aatatctagcctttagcagctt

SEQ ID NO: 7416613 - DNA, 22 bp, Homo sapiens
aatatccattgggagcaaatgg

SEQ ID NO: 7416614 - DNA, 22 bp, Homo sapiens
aatatcctttccagagtacagt

SEQ ID NO: 7416615 - DNA, 22 bp, Homo sapiens
aatatcctgaccagtaaactaa

SEQ ID NO: 7416616 - DNA, 22 bp, Homo sapiens
aatatcctgaccagtaaactaa

SEQ ID NO: 7416617 - DNA, 22 bp, Homo sapiens
aatatcctttccagagtacagt

SEQ ID NO: 7416618 - DNA, 22 bp, Homo sapiens
aatatctggagatgctttttgt

SEQ ID NO: 7416619 - DNA, 22 bp, Homo sapiens
aatatctggagatgctttttgt

SEQ ID NO: 7416620 - DNA, 22 bp, Homo sapiens
aatatctcaccatgacaaagca

SEQ ID NO: 7416621 - DNA, 22 bp, Homo sapiens
aatatcctttccagagtacagt

SEQ ID NO: 7416622 - DNA, 22 bp, Homo sapiens
aatatctcaccatgacaaagca

SEQ ID NO: 7416623 - DNA, 22 bp, Homo sapiens
aatatccattgggagcaaatgg

SEQ ID NO: 7416624 - DNA, 22 bp, Homo sapiens
aatatccaggtagatgtcttct

SEQ ID NO: 7416625 - DNA, 22 bp, Homo sapiens
aatatccaggtagatgtcttct

SEQ ID NO: 7416626 - DNA, 22 bp, Homo sapiens
aatatccaggtagatgtcttct

SEQ ID NO: 7416627 - DNA, 22 bp, Homo sapiens
aatatccaggtagatgtcttct

SEQ ID NO: 7416628 - DNA, 22 bp, Homo sapiens
aatatccaggtagatgtcttct

SEQ ID NO: 7416629 - DNA, 22 bp, Homo sapiens
aatatccaggtagatgtcttct

SEQ ID NO: 7416630 - DNA, 22 bp, Homo sapiens
aatatccacttcaatacaggca

SEQ ID NO: 7416631 - DNA, 22 bp, Homo sapiens
aatatccattgggagcaaatgg

SEQ ID NO: 7416632 - DNA, 22 bp, Homo sapiens
aatatcccttgaagtggtgctg

SEQ ID NO: 7416633 - DNA, 22 bp, Homo sapiens
aatatccattgggagcaaatgg

SEQ ID NO: 7416634 - DNA, 22 bp, Homo sapiens
aatatccattgggagcaaatgg

SEQ ID NO: 7416635 - DNA, 22 bp, Homo sapiens
aatatccattgggagcaaatgg

SEQ ID NO: 7416636 - DNA, 22 bp, Homo sapiens
aatatccattgggagcaaatgg

SEQ ID NO: 7416637 - DNA, 20 bp, Homo sapiens
aatataattctctgaattta

SEQ ID NO: 7416638 - DNA, 22 bp, Homo sapiens
aatacatatggaattccatgtt

SEQ ID NO: 7416639 - DNA, 22 bp, Homo sapiens
aatacatatggaattccatgtt

SEQ ID NO: 7416640 - DNA, 22 bp, Homo sapiens
aatataattttattcctagagt

SEQ ID NO: 7416641 - DNA, 22 bp, Homo sapiens
aatataattttattcctagagt

SEQ ID NO: 7416642 - DNA, 20 bp, Homo sapiens
aatataattctctgaattta

SEQ ID NO: 7416643 - DNA, 22 bp, Homo sapiens
aatataattttattcctagagt

SEQ ID NO: 7416644 - DNA, 22 bp, Homo sapiens
aatatccacttcaatacaggca

SEQ ID NO: 7416645 - DNA, 22 bp, Homo sapiens
aatatccacttcaatacaggca

SEQ ID NO: 7416646 - DNA, 22 bp, Homo sapiens
aatatccacactgtgtccctgc

SEQ ID NO: 7416647 - DNA, 21 bp, Homo sapiens
aatatccaaatgattagatct

SEQ ID NO: 7416648 - DNA, 22 bp, Homo sapiens
aatatcagtatattgtatcagt

SEQ ID NO: 7416649 - DNA, 22 bp, Homo sapiens
aatatcagtatattgtatcagt

SEQ ID NO: 7416650 - DNA, 21 bp, Homo sapiens
aatatccaaatgattagatct

SEQ ID NO: 7416651 - DNA, 21 bp, Homo sapiens
aatatccaaatgattagatct

SEQ ID NO: 7416652 - DNA, 22 bp, Homo sapiens
aatatcatctctcttttctgca

SEQ ID NO: 7416653 - DNA, 21 bp, Homo sapiens
aatatccaaatgattagatct

SEQ ID NO: 7416654 - DNA, 21 bp, Homo sapiens
aatatccaaatgattagatct

SEQ ID NO: 7416655 - DNA, 22 bp, Homo sapiens
aatacagtaggtaatagttcat

SEQ ID NO: 7416656 - DNA, 22 bp, Homo sapiens
aatacagtcttactagaaaatc

SEQ ID NO: 7416657 - DNA, 22 bp, Homo sapiens
aatacagtcttactagaaaatc

SEQ ID NO: 7416658 - DNA, 22 bp, Homo sapiens
aatacagtcttactagaaaatc

SEQ ID NO: 7416659 - DNA, 22 bp, Homo sapiens
aatacagtcttactagaaaatc

SEQ ID NO: 7416660 - DNA, 22 bp, Homo sapiens
aatacagtcttactagaaaatc

SEQ ID NO: 7416661 - DNA, 22 bp, Homo sapiens
aatacagtgaaagtgagcaagg

SEQ ID NO: 7416662 - DNA, 22 bp, Homo sapiens
aatacagtgaaagtgagcaagg

SEQ ID NO: 7416663 - DNA, 22 bp, Homo sapiens
aatacagtgaaagtgagcaagg

SEQ ID NO: 7416664 - DNA, 22 bp, Homo sapiens
aatacagtaggtaatagttcat

SEQ ID NO: 7416665 - DNA, 22 bp, Homo sapiens
aatacagtaggtaatagttcat

SEQ ID NO: 7416666 - DNA, 22 bp, Homo sapiens
aatacagtaggtaatagttcat

SEQ ID NO: 7416667 - DNA, 22 bp, Homo sapiens
aatacagtaattttgatgagtt

SEQ ID NO: 7416668 - DNA, 22 bp, Homo sapiens
aatacagtaattttgatgagtt

SEQ ID NO: 7416669 - DNA, 22 bp, Homo sapiens
aatacagcagatggagacaaat

SEQ ID NO: 7416670 - DNA, 22 bp, Homo sapiens
aatacagcagatggagacaaat

SEQ ID NO: 7416671 - DNA, 22 bp, Homo sapiens
aatacatatggaattccatgtt

SEQ ID NO: 7416672 - DNA, 22 bp, Homo sapiens
aatacataataagttttgtctg

SEQ ID NO: 7416673 - DNA, 22 bp, Homo sapiens
aatacatatggaattccatgtt

SEQ ID NO: 7416674 - DNA, 22 bp, Homo sapiens
aatacatatggaattccatgtt

SEQ ID NO: 7416675 - DNA, 22 bp, Homo sapiens
aatacatatggaattccatgtt

SEQ ID NO: 7416676 - DNA, 22 bp, Homo sapiens
aatacataataagttttgtctg

SEQ ID NO: 7416677 - DNA, 22 bp, Homo sapiens
aatacataataagttttgtctg

SEQ ID NO: 7416678 - DNA, 19 bp, Homo sapiens
aatacagtgttatagaatt

SEQ ID NO: 7416679 - DNA, 19 bp, Homo sapiens
aatacagtgttatagaatt

SEQ ID NO: 7416680 - DNA, 22 bp, Homo sapiens
aatacataataagttttgtctg

SEQ ID NO: 7416681 - DNA, 19 bp, Homo sapiens
aatacagtgttatagaatt

SEQ ID NO: 7416682 - DNA, 22 bp, Homo sapiens
aatacataataagttttgtctg

SEQ ID NO: 7416683 - DNA, 19 bp, Homo sapiens
aatacagtgttatagaatt

SEQ ID NO: 7416684 - DNA, 19 bp, Homo sapiens
aatacagtgttatagaatt

SEQ ID NO: 7416685 - DNA, 21 bp, Homo sapiens
aatacagtgaagaatttcttt

SEQ ID NO: 7416686 - DNA, 21 bp, Homo sapiens
aatacagtgaagaatttcttt

SEQ ID NO: 7416687 - DNA, 19 bp, Homo sapiens
aatacagtgttatagaatt

SEQ ID NO: 7416688 - DNA, 21 bp, Homo sapiens
aatacagtgaagaatttcttt

SEQ ID NO: 7416689 - DNA, 22 bp, Homo sapiens
aatatttctgtagctatgttct

SEQ ID NO: 7416690 - DNA, 22 bp, Homo sapiens
aatatttctgtagctatgttct

SEQ ID NO: 7416691 - DNA, 22 bp, Homo sapiens
aatatttctgtagctatgttct

SEQ ID NO: 7416692 - DNA, 22 bp, Homo sapiens
aatatttctgtagctatgttct

SEQ ID NO: 7416693 - DNA, 22 bp, Homo sapiens
aatatttctgtagctatgttct

SEQ ID NO: 7416694 - DNA, 22 bp, Homo sapiens
aatatttctggtgcttctcact

SEQ ID NO: 7416695 - DNA, 22 bp, Homo sapiens
aatccagatgagcaatcatact

SEQ ID NO: 7416696 - DNA, 22 bp, Homo sapiens
aatccagatgagcaatcatact

SEQ ID NO: 7416697 - DNA, 22 bp, Homo sapiens
aatccagatgagcaatcatact

SEQ ID NO: 7416698 - DNA, 22 bp, Homo sapiens
aatccagatgagcaatcatact

SEQ ID NO: 7416699 - DNA, 22 bp, Homo sapiens
aatccagatgagcaatcatact

SEQ ID NO: 7416700 - DNA, 22 bp, Homo sapiens
aatccagcacatggacacagtc

SEQ ID NO: 7416701 - DNA, 22 bp, Homo sapiens
aatccagatgagcaatcatact

SEQ ID NO: 7416702 - DNA, 22 bp, Homo sapiens
aatccagattccagaaaatcgc

SEQ ID NO: 7416703 - DNA, 22 bp, Homo sapiens
aatccagattccagaaaatcgc

SEQ ID NO: 7416704 - DNA, 22 bp, Homo sapiens
aatctcacatagctaggagtag

SEQ ID NO: 7416705 - DNA, 22 bp, Homo sapiens
aatctcacaagccggtatgggt

SEQ ID NO: 7416706 - DNA, 22 bp, Homo sapiens
aatatttctgcagaatggtttt

SEQ ID NO: 7416707 - DNA, 22 bp, Homo sapiens
aatatttctgcagaatggtttt

SEQ ID NO: 7416708 - DNA, 22 bp, Homo sapiens
aatatttctgcagaatggtttt

SEQ ID NO: 7416709 - DNA, 22 bp, Homo sapiens
aatatttctccttcgttatagc

SEQ ID NO: 7416710 - DNA, 22 bp, Homo sapiens
aatatttctggtgcttctcact

SEQ ID NO: 7416711 - DNA, 22 bp, Homo sapiens
aatatttctggtgcttctcact

SEQ ID NO: 7416712 - DNA, 22 bp, Homo sapiens
aatatttctggtgcttctcact

SEQ ID NO: 7416713 - DNA, 22 bp, Homo sapiens
aatatttctgcagaatggtttt

SEQ ID NO: 7416714 - DNA, 22 bp, Homo sapiens
aatatttctccttcgttatagc

SEQ ID NO: 7416715 - DNA, 22 bp, Homo sapiens
aatatttctccttcgttatagc

SEQ ID NO: 7416716 - DNA, 22 bp, Homo sapiens
aatatttctccttcgttatagc

SEQ ID NO: 7416717 - DNA, 22 bp, Homo sapiens
aatatttcaaaaggaaacacag

SEQ ID NO: 7416718 - DNA, 22 bp, Homo sapiens
aatatttcaaaaggaaacacag

SEQ ID NO: 7416719 - DNA, 22 bp, Homo sapiens
aatatttcaaaaggaaacacag

SEQ ID NO: 7416720 - DNA, 22 bp, Homo sapiens
aatatttccaaggcctgtcagg

SEQ ID NO: 7416721 - DNA, 22 bp, Homo sapiens
aatatttccaaggcctgtcagg

SEQ ID NO: 7416722 - DNA, 22 bp, Homo sapiens
aatattgagaaccagcatgttt

SEQ ID NO: 7416723 - DNA, 22 bp, Homo sapiens
aatatcttctaaggatagaact

SEQ ID NO: 7416724 - DNA, 22 bp, Homo sapiens
aatatctgttgttctaagccac

SEQ ID NO: 7416725 - DNA, 22 bp, Homo sapiens
aatatctgttgttctaagccac

SEQ ID NO: 7416726 - DNA, 22 bp, Homo sapiens
aatatctgtggccatacaattt

SEQ ID NO: 7416727 - DNA, 22 bp, Homo sapiens
aatatctgtggccatacaattt

SEQ ID NO: 7416728 - DNA, 22 bp, Homo sapiens
aatatctgtggccatacaattt

SEQ ID NO: 7416729 - DNA, 22 bp, Homo sapiens
aatatctgtctctaatgcatat

SEQ ID NO: 7416730 - DNA, 22 bp, Homo sapiens
aatatctgtctctaatgcatat

SEQ ID NO: 7416731 - DNA, 22 bp, Homo sapiens
aatatctggagatgctttttgt

SEQ ID NO: 7416732 - DNA, 22 bp, Homo sapiens
aatatctgtctctaatgcatat

SEQ ID NO: 7416733 - DNA, 22 bp, Homo sapiens
aatatctgtggccatacaattt

SEQ ID NO: 7416734 - DNA, 22 bp, Homo sapiens
aatatctgtctctaatgcatat

SEQ ID NO: 7416735 - DNA, 22 bp, Homo sapiens
aatatctgtggccatacaattt

SEQ ID NO: 7416736 - DNA, 22 bp, Homo sapiens
aatatttatgacaggaagtagc

SEQ ID NO: 7416737 - DNA, 22 bp, Homo sapiens
aatatttatgacaggaagtagc

SEQ ID NO: 7416738 - DNA, 22 bp, Homo sapiens
aatatttatgacaggaagtagc

SEQ ID NO: 7416739 - DNA, 22 bp, Homo sapiens
aatatttatatttctcttccct

SEQ ID NO: 7416740 - DNA, 22 bp, Homo sapiens
aatatttatatttctcttccct

SEQ ID NO: 7416741 - DNA, 22 bp, Homo sapiens
aatatttatgacaggaagtagc

SEQ ID NO: 7416742 - DNA, 22 bp, Homo sapiens
aatatttatgacaggaagtagc

SEQ ID NO: 7416743 - DNA, 22 bp, Homo sapiens
aatatttatgacaggaagtagc

SEQ ID NO: 7416744 - DNA, 22 bp, Homo sapiens
aatatttatgacaggaagtagc

SEQ ID NO: 7416745 - DNA, 22 bp, Homo sapiens
aatatttatgacaggaagtagc

SEQ ID NO: 7416746 - DNA, 22 bp, Homo sapiens
aatattgtttcaagatcacaga

SEQ ID NO: 7416747 - DNA, 22 bp, Homo sapiens
aatatcttctaaggatagaact

SEQ ID NO: 7416748 - DNA, 22 bp, Homo sapiens
aatattgagaaccagcatgttt

SEQ ID NO: 7416749 - DNA, 22 bp, Homo sapiens
aatattgtttcaagatcacaga

SEQ ID NO: 7416750 - DNA, 22 bp, Homo sapiens
aatattgtttcaagatcacaga

SEQ ID NO: 7416751 - DNA, 22 bp, Homo sapiens
aatatttatatttctcttccct

SEQ ID NO: 7416752 - DNA, 22 bp, Homo sapiens
aatatttatatttctcttccct

SEQ ID NO: 7416753 - DNA, 22 bp, Homo sapiens
aatatttatatttctcttccct

SEQ ID NO: 7416754 - DNA, 22 bp, Homo sapiens
aatatttatatttctcttccct

SEQ ID NO: 7416755 - DNA, 22 bp, Homo sapiens
aatatttatatttctcttccct

SEQ ID NO: 7416756 - DNA, 22 bp, Homo sapiens
aatgctttagcagtgattagtg

SEQ ID NO: 7416757 - DNA, 22 bp, Homo sapiens
aatgctttagcagtgattagtg

SEQ ID NO: 7416758 - DNA, 22 bp, Homo sapiens
aatgctttcaaaaatgtgcagt

SEQ ID NO: 7416759 - DNA, 22 bp, Homo sapiens
aatgctttcaaaaatgtgcagt

SEQ ID NO: 7416760 - DNA, 22 bp, Homo sapiens
aacttcatttataatgtcatta

SEQ ID NO: 7416761 - DNA, 22 bp, Homo sapiens
aacttcattcctttttatgact

SEQ ID NO: 7416762 - DNA, 22 bp, Homo sapiens
aacttccaacccagaagcctaa

SEQ ID NO: 7416763 - DNA, 22 bp, Homo sapiens
aacttcatttataatgtcatta

SEQ ID NO: 7416764 - DNA, 22 bp, Homo sapiens
aacttggctttgccatttatcg

SEQ ID NO: 7416765 - DNA, 22 bp, Homo sapiens
aacttggtaaattgtgtcagat

SEQ ID NO: 7416766 - DNA, 22 bp, Homo sapiens
aacttggtaaattgtgtcagat

SEQ ID NO: 7416767 - DNA, 22 bp, Homo sapiens
aacttccaacccagaagcctaa

SEQ ID NO: 7416768 - DNA, 22 bp, Homo sapiens
aacttggtaccaccttctgaag

SEQ ID NO: 7416769 - DNA, 22 bp, Homo sapiens
aacttggtaccaccttctgaag

SEQ ID NO: 7416770 - DNA, 22 bp, Homo sapiens
aacttgtaaaatagagtgtaca

SEQ ID NO: 7416771 - DNA, 22 bp, Homo sapiens
aacttgtaaaatagagtgtaca

SEQ ID NO: 7416772 - DNA, 22 bp, Homo sapiens
aacttgtaatgaaaggcaatag

SEQ ID NO: 7416773 - DNA, 22 bp, Homo sapiens
aatgctttaattgcatgtagtg

SEQ ID NO: 7416774 - DNA, 22 bp, Homo sapiens
aatgctttaattgcatgtagtg

SEQ ID NO: 7416775 - DNA, 22 bp, Homo sapiens
aatgctttaattgcatgtagtg

SEQ ID NO: 7416776 - DNA, 22 bp, Homo sapiens
aatgctttaaatcctagtgtaa

SEQ ID NO: 7416777 - DNA, 22 bp, Homo sapiens
aatgctttagaaaaccagcttt

SEQ ID NO: 7416778 - DNA, 22 bp, Homo sapiens
aatgctttagcagtgattagtg

SEQ ID NO: 7416779 - DNA, 22 bp, Homo sapiens
aatgctttagaaaaccagcttt

SEQ ID NO: 7416780 - DNA, 22 bp, Homo sapiens
aatgctttaattgcatgtagtg

SEQ ID NO: 7416781 - DNA, 22 bp, Homo sapiens
aatgcttattattaatagaatg

SEQ ID NO: 7416782 - DNA, 22 bp, Homo sapiens
aatgcttattattaatagaatg

SEQ ID NO: 7416783 - DNA, 22 bp, Homo sapiens
aatgcttattattaatagaatg

SEQ ID NO: 7416784 - DNA, 22 bp, Homo sapiens
aatgcttattattaatagaatg

SEQ ID NO: 7416785 - DNA, 22 bp, Homo sapiens
aatgcttcctcctcacctcagg

SEQ ID NO: 7416786 - DNA, 22 bp, Homo sapiens
aatgcttccaaaataccaagcc

SEQ ID NO: 7416787 - DNA, 22 bp, Homo sapiens
aatgcataatggtttgtgacaa

SEQ ID NO: 7416788 - DNA, 22 bp, Homo sapiens
aatgcagtttcatttgtagaat

SEQ ID NO: 7416789 - DNA, 22 bp, Homo sapiens
aatgcataatggtttgtgacaa

SEQ ID NO: 7416790 - DNA, 22 bp, Homo sapiens
aatgcataatggtttgtgacaa

SEQ ID NO: 7416791 - DNA, 22 bp, Homo sapiens
aatgctgtccaataggaacata

SEQ ID NO: 7416792 - DNA, 22 bp, Homo sapiens
aatgctgtccaataggaacata

SEQ ID NO: 7416793 - DNA, 22 bp, Homo sapiens
aatgcataatggtttgtgacaa

SEQ ID NO: 7416794 - DNA, 22 bp, Homo sapiens
aatgctgtccaataggaacata

SEQ ID NO: 7416795 - DNA, 22 bp, Homo sapiens
aatgcagtgagccattaaatgg

SEQ ID NO: 7416796 - DNA, 22 bp, Homo sapiens
aatgcagtgagccattaaatgg

SEQ ID NO: 7416797 - DNA, 22 bp, Homo sapiens
aatgcagtgagccattaaatgg

SEQ ID NO: 7416798 - DNA, 22 bp, Homo sapiens
aatgcagttgaatttgggtatg

SEQ ID NO: 7416799 - DNA, 22 bp, Homo sapiens
aatgcagtttcatttgtagaat

SEQ ID NO: 7416800 - DNA, 22 bp, Homo sapiens
aatgcagtttcatttgtagaat

SEQ ID NO: 7416801 - DNA, 22 bp, Homo sapiens
aatgcagttgaatttgggtatg

SEQ ID NO: 7416802 - DNA, 22 bp, Homo sapiens
aatgcagttgaatttgggtatg

SEQ ID NO: 7416803 - DNA, 22 bp, Homo sapiens
aatgcagtgagccattaaatgg

SEQ ID NO: 7416804 - DNA, 22 bp, Homo sapiens
aatgcttatacctaatgatctt

SEQ ID NO: 7416805 - DNA, 22 bp, Homo sapiens
aatgcttatacctaatgatctt

SEQ ID NO: 7416806 - DNA, 22 bp, Homo sapiens
aatgcttatgggttccataata

SEQ ID NO: 7416807 - DNA, 22 bp, Homo sapiens
aatgcttatgggttccataata

SEQ ID NO: 7416808 - DNA, 19 bp, Homo sapiens
aatgcttaggacagtgcct

SEQ ID NO: 7416809 - DNA, 22 bp, Homo sapiens
aatgcttataacgttagaatgt

SEQ ID NO: 7416810 - DNA, 22 bp, Homo sapiens
aatgcttataacgttagaatgt

SEQ ID NO: 7416811 - DNA, 22 bp, Homo sapiens
aatgcttataacgttagaatgt

SEQ ID NO: 7416812 - DNA, 22 bp, Homo sapiens
aatgcttaattcaatactgtgt

SEQ ID NO: 7416813 - DNA, 22 bp, Homo sapiens
aatgctgttgagttgttcctgt

SEQ ID NO: 7416814 - DNA, 22 bp, Homo sapiens
aatgctgttctgagtctgcagg

SEQ ID NO: 7416815 - DNA, 22 bp, Homo sapiens
aatgctgttctgagtctgcagg

SEQ ID NO: 7416816 - DNA, 22 bp, Homo sapiens
aatgctgtcttttctacttcat

SEQ ID NO: 7416817 - DNA, 22 bp, Homo sapiens
aatgctgtgatttattaagtat

SEQ ID NO: 7416818 - DNA, 22 bp, Homo sapiens
aatgctgtggagccgtggacag

SEQ ID NO: 7416819 - DNA, 22 bp, Homo sapiens
aatgctgtggagccgtggacag

SEQ ID NO: 7416820 - DNA, 22 bp, Homo sapiens
aatgctgttctgagtctgcagg

SEQ ID NO: 7416821 - DNA, 22 bp, Homo sapiens
aatgctgtcttttctacttcat

SEQ ID NO: 7416822 - DNA, 22 bp, Homo sapiens
aatgctgtcttagcatgaaagc

SEQ ID NO: 7416823 - DNA, 22 bp, Homo sapiens
aatgctgtcttttctacttcat

SEQ ID NO: 7416824 - DNA, 22 bp, Homo sapiens
aatgctgtcttttctacttcat

SEQ ID NO: 7416825 - DNA, 22 bp, Homo sapiens
aactttaaggctataaattatg

SEQ ID NO: 7416826 - DNA, 22 bp, Homo sapiens
aactttaaggctataaattatg

SEQ ID NO: 7416827 - DNA, 22 bp, Homo sapiens
aactttaaggctataaattatg

SEQ ID NO: 7416828 - DNA, 22 bp, Homo sapiens
aactttacactgctttacatga

SEQ ID NO: 7416829 - DNA, 22 bp, Homo sapiens
aactttacactgctttacatga

SEQ ID NO: 7416830 - DNA, 22 bp, Homo sapiens
aactttacactgctttacatga

SEQ ID NO: 7416831 - DNA, 23 bp, Homo sapiens
aactttactattttgaataatgc

SEQ ID NO: 7416832 - DNA, 23 bp, Homo sapiens
aactttactattttgaataatgc

SEQ ID NO: 7416833 - DNA, 23 bp, Homo sapiens
aactttactattttgaataatgc

SEQ ID NO: 7416834 - DNA, 22 bp, Homo sapiens
aactttacactgctttacatga

SEQ ID NO: 7416835 - DNA, 22 bp, Homo sapiens
aactttacactgctttacatga

SEQ ID NO: 7416836 - DNA, 22 bp, Homo sapiens
aactttaaagaggaggcttggg

SEQ ID NO: 7416837 - DNA, 22 bp, Homo sapiens
aactttaaagaggaggcttggg

SEQ ID NO: 7416838 - DNA, 22 bp, Homo sapiens
aactttaaagaggaggcttggg

SEQ ID NO: 7416839 - DNA, 22 bp, Homo sapiens
aactttaaagaggaggcttggg

SEQ ID NO: 7416840 - DNA, 22 bp, Homo sapiens
aactttaaggctataaattatg

SEQ ID NO: 7416841 - DNA, 22 bp, Homo sapiens
aactttaaggctataaattatg

SEQ ID NO: 7416842 - DNA, 22 bp, Homo sapiens
aactttaaggctataaattatg

SEQ ID NO: 7416843 - DNA, 22 bp, Homo sapiens
aacttgttagaaatgcagaatc

SEQ ID NO: 7416844 - DNA, 21 bp, Homo sapiens
aacttgtatttctccttattc

SEQ ID NO: 7416845 - DNA, 21 bp, Homo sapiens
aacttgtatttctccttattc

SEQ ID NO: 7416846 - DNA, 22 bp, Homo sapiens
aacttgtaatgaaaggcaatag

SEQ ID NO: 7416847 - DNA, 22 bp, Homo sapiens
aacttgtaggactgcactgtag

SEQ ID NO: 7416848 - DNA, 22 bp, Homo sapiens
aacttgtatatgttattcagag

SEQ ID NO: 7416849 - DNA, 22 bp, Homo sapiens
aacttgtattgaaaatgggtaa

SEQ ID NO: 7416850 - DNA, 21 bp, Homo sapiens
aacttgtatttctccttattc

SEQ ID NO: 7416851 - DNA, 22 bp, Homo sapiens
aacttgtatatgttattcagag

SEQ ID NO: 7416852 - DNA, 22 bp, Homo sapiens
aactttaaaaaatatgtctgtt

SEQ ID NO: 7416853 - DNA, 22 bp, Homo sapiens
aactttaaaaaatatgtctgtt

SEQ ID NO: 7416854 - DNA, 22 bp, Homo sapiens
aactttaaaaaatatgtctgtt

SEQ ID NO: 7416855 - DNA, 22 bp, Homo sapiens
aactttaaaaaatatgtctgtt

SEQ ID NO: 7416856 - DNA, 22 bp, Homo sapiens
aacttgtttcttccattcaaca

SEQ ID NO: 7416857 - DNA, 20 bp, Homo sapiens
aacttgttttgttttctaat

SEQ ID NO: 7416858 - DNA, 20 bp, Homo sapiens
aacttgttttgttttctaat

SEQ ID NO: 7416859 - DNA, 22 bp, Homo sapiens
aacttgtttcttccattcaaca

SEQ ID NO: 7416860 - DNA, 22 bp, Homo sapiens
aatgtacaaaccttctttgtag

SEQ ID NO: 7416861 - DNA, 22 bp, Homo sapiens
aatgtacaaaccttctttgtag

SEQ ID NO: 7416862 - DNA, 22 bp, Homo sapiens
aatgtacaaaccttctttgtag

SEQ ID NO: 7416863 - DNA, 22 bp, Homo sapiens
aatgtacaaaccttctttgtag

SEQ ID NO: 7416864 - DNA, 22 bp, Homo sapiens
aatgtacaaaccttctttgtag

SEQ ID NO: 7416865 - DNA, 22 bp, Homo sapiens
aatgtacaaaccttctttgtag

SEQ ID NO: 7416866 - DNA, 22 bp, Homo sapiens
aatgtacaaaccttctttgtag

SEQ ID NO: 7416867 - DNA, 22 bp, Homo sapiens
aatgtacaaaccttctttgtag

SEQ ID NO: 7416868 - DNA, 22 bp, Homo sapiens
aatgtacaaaccttctttgtag

SEQ ID NO: 7416869 - DNA, 22 bp, Homo sapiens
aatgtacaaaccttctttgtag

SEQ ID NO: 7416870 - DNA, 22 bp, Homo sapiens
aatgtacaaaccttctttgtag

SEQ ID NO: 7416871 - DNA, 22 bp, Homo sapiens
aatgtacaaaccttctttgtag

SEQ ID NO: 7416872 - DNA, 22 bp, Homo sapiens
aatgtacaaaagtcagccaact

SEQ ID NO: 7416873 - DNA, 22 bp, Homo sapiens
aatgtacaaaagtcagccaact

SEQ ID NO: 7416874 - DNA, 22 bp, Homo sapiens
aatgtaaagttgggcacaaatg

SEQ ID NO: 7416875 - DNA, 22 bp, Homo sapiens
aatgtaaagttgggcacaaatg

SEQ ID NO: 7416876 - DNA, 22 bp, Homo sapiens
aatgtaacagcaacaacaatgg

SEQ ID NO: 7416877 - DNA, 22 bp, Homo sapiens
aatgtacaaaagtcagccaact

SEQ ID NO: 7416878 - DNA, 22 bp, Homo sapiens
aatgtacaaaagtcagccaact

SEQ ID NO: 7416879 - DNA, 22 bp, Homo sapiens
aatgtacaaaagtcagccaact

SEQ ID NO: 7416880 - DNA, 22 bp, Homo sapiens
aatgtacaaaagtcagccaact

SEQ ID NO: 7416881 - DNA, 22 bp, Homo sapiens
aatgtaaagttgggcacaaatg

SEQ ID NO: 7416882 - DNA, 22 bp, Homo sapiens
aatgtaaagttgggcacaaatg

SEQ ID NO: 7416883 - DNA, 22 bp, Homo sapiens
aatgtaaagttgggcacaaatg

SEQ ID NO: 7416884 - DNA, 22 bp, Homo sapiens
aatgtaaagttgggcacaaatg

SEQ ID NO: 7416885 - DNA, 22 bp, Homo sapiens
aatgtaaagttgggcacaaatg

SEQ ID NO: 7416886 - DNA, 22 bp, Homo sapiens
aatgtaaagttgggcacaaatg

SEQ ID NO: 7416887 - DNA, 22 bp, Homo sapiens
aatgtaaagttgggcacaaatg

SEQ ID NO: 7416888 - DNA, 22 bp, Homo sapiens
aatgtaaagctcaggtcaggag

SEQ ID NO: 7416889 - DNA, 22 bp, Homo sapiens
aatgtaaagctcaggtcaggag

SEQ ID NO: 7416890 - DNA, 22 bp, Homo sapiens
aactttacttgaaagaacatgt

SEQ ID NO: 7416891 - DNA, 22 bp, Homo sapiens
aactttacttgaaagaacatgt

SEQ ID NO: 7416892 - DNA, 22 bp, Homo sapiens
aatgtaaacagcaagagaaggg

SEQ ID NO: 7416893 - DNA, 22 bp, Homo sapiens
aactttacttgaaagaacatgt

SEQ ID NO: 7416894 - DNA, 22 bp, Homo sapiens
aactttacttgaaagaacatgt

SEQ ID NO: 7416895 - DNA, 22 bp, Homo sapiens
aatgtaaacagcaagagaaggg

SEQ ID NO: 7416896 - DNA, 22 bp, Homo sapiens
aatgtaaacagcaagagaaggg

SEQ ID NO: 7416897 - DNA, 22 bp, Homo sapiens
aatgtaaacagcaagagaaggg

SEQ ID NO: 7416898 - DNA, 22 bp, Homo sapiens
aatgtaaacagcaagagaaggg

SEQ ID NO: 7416899 - DNA, 22 bp, Homo sapiens
aatgaaagaatgaaacagccca

SEQ ID NO: 7416900 - DNA, 22 bp, Homo sapiens
aatgaaactgtatatagactgt

SEQ ID NO: 7416901 - DNA, 22 bp, Homo sapiens
aatgaaactgtatatagactgt

SEQ ID NO: 7416902 - DNA, 22 bp, Homo sapiens
aatgaaactgtatatagactgt

SEQ ID NO: 7416903 - DNA, 22 bp, Homo sapiens
aatgaaactgtatatagactgt

SEQ ID NO: 7416904 - DNA, 22 bp, Homo sapiens
aatgaaactgtatatagactgt

SEQ ID NO: 7416905 - DNA, 22 bp, Homo sapiens
aatctgtagggaacaactgtac

SEQ ID NO: 7416906 - DNA, 22 bp, Homo sapiens
aatctgtattgctcatacttga

SEQ ID NO: 7416907 - DNA, 22 bp, Homo sapiens
aatctgtattgctcatacttga

SEQ ID NO: 7416908 - DNA, 22 bp, Homo sapiens
aatgaaatctgctgggtaaaga

SEQ ID NO: 7416909 - DNA, 22 bp, Homo sapiens
aatgaaatctgctgggtaaaga

SEQ ID NO: 7416910 - DNA, 22 bp, Homo sapiens
aatgaaatagttggctgtagag

SEQ ID NO: 7416911 - DNA, 22 bp, Homo sapiens
aatgaaatagttggctgtagag

SEQ ID NO: 7416912 - DNA, 22 bp, Homo sapiens
aatgaaatagttggctgtagag

SEQ ID NO: 7416913 - DNA, 22 bp, Homo sapiens
aatgaaatagttggctgtagag

SEQ ID NO: 7416914 - DNA, 22 bp, Homo sapiens
aatgaaatagttggctgtagag

SEQ ID NO: 7416915 - DNA, 22 bp, Homo sapiens
aatctggagagtcatctctgac

SEQ ID NO: 7416916 - DNA, 22 bp, Homo sapiens
aatctggagttaatgttttcgc

SEQ ID NO: 7416917 - DNA, 22 bp, Homo sapiens
aatctggcatgtaagcttagag

SEQ ID NO: 7416918 - DNA, 22 bp, Homo sapiens
aatctggacacagttctcatgc

SEQ ID NO: 7416919 - DNA, 22 bp, Homo sapiens
aatctggacttgtctgtgaaga

SEQ ID NO: 7416920 - DNA, 22 bp, Homo sapiens
aatctggacacagttctcatgc

SEQ ID NO: 7416921 - DNA, 22 bp, Homo sapiens
aatctggacacagttctcatgc

SEQ ID NO: 7416922 - DNA, 22 bp, Homo sapiens
aatctggacacagttctcatgc

SEQ ID NO: 7416923 - DNA, 22 bp, Homo sapiens
aatctgcttttgtcatttatga

SEQ ID NO: 7416924 - DNA, 22 bp, Homo sapiens
aatctgcttttgtcatttatga

SEQ ID NO: 7416925 - DNA, 22 bp, Homo sapiens
aatctgtaacattcaataaaga

SEQ ID NO: 7416926 - DNA, 22 bp, Homo sapiens
aatctgtagggaacaactgtac

SEQ ID NO: 7416927 - DNA, 23 bp, Homo sapiens
aatctggctgatgttttttctct

SEQ ID NO: 7416928 - DNA, 22 bp, Homo sapiens
aatctggtttgacaacttttgt

SEQ ID NO: 7416929 - DNA, 15 bp, Homo sapiens
aatctggcggcaagt

SEQ ID NO: 7416930 - DNA, 22 bp, Homo sapiens
aatctggcatttgagagtagga

SEQ ID NO: 7416931 - DNA, 22 bp, Homo sapiens
aatctggctcagaagaagatga

SEQ ID NO: 7416932 - DNA, 22 bp, Homo sapiens
aatctgcttagagctttgagga

SEQ ID NO: 7416933 - DNA, 21 bp, Homo sapiens
aatctgcttccctgtgacttg

SEQ ID NO: 7416934 - DNA, 22 bp, Homo sapiens
aatctgcacccactgaaaatgc

SEQ ID NO: 7416935 - DNA, 22 bp, Homo sapiens
aatctgcacaattcagtttcag

SEQ ID NO: 7416936 - DNA, 22 bp, Homo sapiens
aatctgcacaattcagtttcag

SEQ ID NO: 7416937 - DNA, 22 bp, Homo sapiens
aatctgagggaacttgaactcc

SEQ ID NO: 7416938 - DNA, 22 bp, Homo sapiens
aatctgaatatttatgtgtatt

SEQ ID NO: 7416939 - DNA, 22 bp, Homo sapiens
aatctgaatatttatgtgtatt

SEQ ID NO: 7416940 - DNA, 22 bp, Homo sapiens
aatctgaatatttatgtgtatt

SEQ ID NO: 7416941 - DNA, 22 bp, Homo sapiens
aatctgaagggagatacatgta

SEQ ID NO: 7416942 - DNA, 20 bp, Homo sapiens
aatctgaatcccagtcctag

SEQ ID NO: 7416943 - DNA, 20 bp, Homo sapiens
aatctgaatcccagtcctag

SEQ ID NO: 7416944 - DNA, 20 bp, Homo sapiens
aatctgaatcccagtcctag

SEQ ID NO: 7416945 - DNA, 22 bp, Homo sapiens
aatctgacagctaggcaggcac

SEQ ID NO: 7416946 - DNA, 22 bp, Homo sapiens
aatctctttggctcaaggatcc

SEQ ID NO: 7416947 - DNA, 22 bp, Homo sapiens
aatctctttggctcaaggatcc

SEQ ID NO: 7416948 - DNA, 22 bp, Homo sapiens
aatctctttggctcaaggatcc

SEQ ID NO: 7416949 - DNA, 22 bp, Homo sapiens
aatctctttggctcaaggatcc

SEQ ID NO: 7416950 - DNA, 22 bp, Homo sapiens
aatctctttggctcaaggatcc

SEQ ID NO: 7416951 - DNA, 22 bp, Homo sapiens
aatctgaaagtatggagcagta

SEQ ID NO: 7416952 - DNA, 22 bp, Homo sapiens
aatctcatgagcttcttgtccc

SEQ ID NO: 7416953 - DNA, 22 bp, Homo sapiens
aatctcatgagcttcttgtccc

SEQ ID NO: 7416954 - DNA, 22 bp, Homo sapiens
aatctcatttacaacatgagga

SEQ ID NO: 7416955 - DNA, 22 bp, Homo sapiens
aatctcatttacaacatgagga

SEQ ID NO: 7416956 - DNA, 17 bp, Homo sapiens
aatctcagtggcttaag

SEQ ID NO: 7416957 - DNA, 17 bp, Homo sapiens
aatctcagtggcttaag

SEQ ID NO: 7416958 - DNA, 22 bp, Homo sapiens
aatctcatgagcttcttgtccc

SEQ ID NO: 7416959 - DNA, 22 bp, Homo sapiens
aatctcagagatatctgtgtcc

SEQ ID NO: 7416960 - DNA, 22 bp, Homo sapiens
aatctcagagatatctgtgtcc

SEQ ID NO: 7416961 - DNA, 22 bp, Homo sapiens
aatctcagctcatgcaattcca

SEQ ID NO: 7416962 - DNA, 22 bp, Homo sapiens
aatctcagaaactggtggattt

SEQ ID NO: 7416963 - DNA, 22 bp, Homo sapiens
aatctcagaaactggtggattt

SEQ ID NO: 7416964 - DNA, 22 bp, Homo sapiens
aatctcactcaaagaattctct

SEQ ID NO: 7416965 - DNA, 22 bp, Homo sapiens
aatctcagaaactggtggattt

SEQ ID NO: 7416966 - DNA, 22 bp, Homo sapiens
aatctcacctcccgctcctggt

SEQ ID NO: 7416967 - DNA, 22 bp, Homo sapiens
aatctcactcaaagaattctct

SEQ ID NO: 7416968 - DNA, 22 bp, Homo sapiens
aatctcttggttcagaagcctc

SEQ ID NO: 7416969 - DNA, 22 bp, Homo sapiens
aatctcttgggaggaatgaatt

SEQ ID NO: 7416970 - DNA, 22 bp, Homo sapiens
aatctcttgggaggaatgaatt

SEQ ID NO: 7416971 - DNA, 22 bp, Homo sapiens
aatctcttcccagtaaaaatgg

SEQ ID NO: 7416972 - DNA, 22 bp, Homo sapiens
aatctcttgggaggaatgaatt

SEQ ID NO: 7416973 - DNA, 22 bp, Homo sapiens
aatctcttggttcagaagcctc

SEQ ID NO: 7416974 - DNA, 22 bp, Homo sapiens
aatctcttgtatttcctttgac

SEQ ID NO: 7416975 - DNA, 22 bp, Homo sapiens
aatctcatttttagtttaggtg

SEQ ID NO: 7416976 - DNA, 22 bp, Homo sapiens
aatctcatttttagtttaggtg

SEQ ID NO: 7416977 - DNA, 22 bp, Homo sapiens
aatctccatttaccctgcatct

SEQ ID NO: 7416978 - DNA, 22 bp, Homo sapiens
aatctccatttaccctgcatct

SEQ ID NO: 7416979 - DNA, 22 bp, Homo sapiens
aatctcttcccagtaaaaatgg

SEQ ID NO: 7416980 - DNA, 22 bp, Homo sapiens
aatgcacatgttgtaataaata

SEQ ID NO: 7416981 - DNA, 22 bp, Homo sapiens
aatgcacatgtcttggcctcac

SEQ ID NO: 7416982 - DNA, 22 bp, Homo sapiens
aatgcacatgttgtaataaata

SEQ ID NO: 7416983 - DNA, 22 bp, Homo sapiens
aatgcacatgttgtaataaata

SEQ ID NO: 7416984 - DNA, 22 bp, Homo sapiens
aatgcacatgccacatgtggta

SEQ ID NO: 7416985 - DNA, 22 bp, Homo sapiens
aatgcacatgtcttggcctcac

SEQ ID NO: 7416986 - DNA, 22 bp, Homo sapiens
aatgcacatgtcttggcctcac

SEQ ID NO: 7416987 - DNA, 22 bp, Homo sapiens
aatgcacatgttgtaataaata

SEQ ID NO: 7416988 - DNA, 22 bp, Homo sapiens
aatgcacctaccttgattctgc

SEQ ID NO: 7416989 - DNA, 22 bp, Homo sapiens
aatgcacatgttgtaataaata

SEQ ID NO: 7416990 - DNA, 22 bp, Homo sapiens
aatgcaccaagcctgctggggt

SEQ ID NO: 7416991 - DNA, 22 bp, Homo sapiens
aatgcaccttggcagggattca

SEQ ID NO: 7416992 - DNA, 22 bp, Homo sapiens
aatgcactgtcagtattgttga

SEQ ID NO: 7416993 - DNA, 22 bp, Homo sapiens
aatgcacctaccttgattctgc

SEQ ID NO: 7416994 - DNA, 22 bp, Homo sapiens
aatgcagaccagtatgaaaaac

SEQ ID NO: 7416995 - DNA, 22 bp, Homo sapiens
aatgcactgtcagtattgttga

SEQ ID NO: 7416996 - DNA, 22 bp, Homo sapiens
aatgcacttaataactgtcctt

SEQ ID NO: 7416997 - DNA, 22 bp, Homo sapiens
aatgcacttagtatgaatgcct

SEQ ID NO: 7416998 - DNA, 22 bp, Homo sapiens
aatgcagagtaaatatttaatt

SEQ ID NO: 7416999 - DNA, 22 bp, Homo sapiens
aatgcagaccagtatgaaaaac

SEQ ID NO: 7417000 - DNA, 22 bp, Homo sapiens
aatgcagattcttattctgtag

SEQ ID NO: 7417001 - DNA, 22 bp, Homo sapiens
aatgcagattcttattctgtag

SEQ ID NO: 7417002 - DNA, 22 bp, Homo sapiens
aatgcagattcttattctgtag

SEQ ID NO: 7417003 - DNA, 19 bp, Homo sapiens
aatgcagagtgtggtcttt

SEQ ID NO: 7417004 - DNA, 22 bp, Homo sapiens
aatgcagagtaaatatttaatt

SEQ ID NO: 7417005 - DNA, 22 bp, Homo sapiens
aatgcagagtaaatatttaatt

SEQ ID NO: 7417006 - DNA, 22 bp, Homo sapiens
aatgcacacatttggtactgaa

SEQ ID NO: 7417007 - DNA, 18 bp, Homo sapiens
aatgcacacatttactcc

SEQ ID NO: 7417008 - DNA, 22 bp, Homo sapiens
aatgcacacatttggtactgaa

SEQ ID NO: 7417009 - DNA, 22 bp, Homo sapiens
aatgcacacatttggtactgaa

SEQ ID NO: 7417010 - DNA, 18 bp, Homo sapiens
aatgcacacatttactcc

SEQ ID NO: 7417011 - DNA, 18 bp, Homo sapiens
aatgcacacatttactcc

SEQ ID NO: 7417012 - DNA, 22 bp, Homo sapiens
aatgcacataaatatggtctta

SEQ ID NO: 7417013 - DNA, 22 bp, Homo sapiens
aatgcacataaatatggtctta

SEQ ID NO: 7417014 - DNA, 22 bp, Homo sapiens
aatgcacagctaaagtggttcc

SEQ ID NO: 7417015 - DNA, 22 bp, Homo sapiens
aatgcacagctaaagtggttcc

SEQ ID NO: 7417016 - DNA, 22 bp, Homo sapiens
aatgcacagctaaagtggttcc

SEQ ID NO: 7417017 - DNA, 22 bp, Homo sapiens
aatgcacacatttggtactgaa

SEQ ID NO: 7417018 - DNA, 22 bp, Homo sapiens
aatgcacagcgttccatgcttg

SEQ ID NO: 7417019 - DNA, 22 bp, Homo sapiens
aatgcacagcgttccatgcttg

SEQ ID NO: 7417020 - DNA, 22 bp, Homo sapiens
aatgcacagcgttccatgcttg

SEQ ID NO: 7417021 - DNA, 22 bp, Homo sapiens
aatgcacatatatttccttatt

SEQ ID NO: 7417022 - DNA, 22 bp, Homo sapiens
aatgcacatatatgtgtataca

SEQ ID NO: 7417023 - DNA, 22 bp, Homo sapiens
aatgcacatatatgtgtataca

SEQ ID NO: 7417024 - DNA, 22 bp, Homo sapiens
aatgcacataaatatggtctta

SEQ ID NO: 7417025 - DNA, 22 bp, Homo sapiens
aatgcacataaatatggtctta

SEQ ID NO: 7417026 - DNA, 22 bp, Homo sapiens
aatgcacataaatatggtctta

SEQ ID NO: 7417027 - DNA, 22 bp, Homo sapiens
aatgcacatatatgtgtataca

SEQ ID NO: 7417028 - DNA, 22 bp, Homo sapiens
aatgcacatatatgtgtataca

SEQ ID NO: 7417029 - DNA, 22 bp, Homo sapiens
aatgcacatatatttccttatt

SEQ ID NO: 7417030 - DNA, 22 bp, Homo sapiens
aatgcacatatatttccttatt

SEQ ID NO: 7417031 - DNA, 22 bp, Homo sapiens
aatgcacatgccacatgtggta

SEQ ID NO: 7417032 - DNA, 22 bp, Homo sapiens
aatgcacatgccacatgtggta

SEQ ID NO: 7417033 - DNA, 22 bp, Homo sapiens
aatgcacatgccacatgtggta

SEQ ID NO: 7417034 - DNA, 22 bp, Homo sapiens
aatgcacatgccacatgtggta

SEQ ID NO: 7417035 - DNA, 22 bp, Homo sapiens
aatgcacatgccacatgtggta

SEQ ID NO: 7417036 - DNA, 18 bp, Homo sapiens
aatgaaatgtacaccttt

SEQ ID NO: 7417037 - DNA, 18 bp, Homo sapiens
aatgaaatgtacaccttt

SEQ ID NO: 7417038 - DNA, 18 bp, Homo sapiens
aatgaaatgtacaccttt

SEQ ID NO: 7417039 - DNA, 18 bp, Homo sapiens
aatgaaatgtacaccttt

SEQ ID NO: 7417040 - DNA, 18 bp, Homo sapiens
aatgaaatgtacaccttt

SEQ ID NO: 7417041 - DNA, 18 bp, Homo sapiens
aatgaaatgtacaccttt

SEQ ID NO: 7417042 - DNA, 22 bp, Homo sapiens
aatgaaatgtagcttatccata

SEQ ID NO: 7417043 - DNA, 22 bp, Homo sapiens
aatgaaatgtagcttatccata

SEQ ID NO: 7417044 - DNA, 22 bp, Homo sapiens
aatgaaatgtagcttatccata

SEQ ID NO: 7417045 - DNA, 22 bp, Homo sapiens
aatgaaatgtagcttatccata

SEQ ID NO: 7417046 - DNA, 22 bp, Homo sapiens
aatgaaatgtagcttatccata

SEQ ID NO: 7417047 - DNA, 18 bp, Homo sapiens
aatgaaatgtacaccttt

SEQ ID NO: 7417048 - DNA, 22 bp, Homo sapiens
aatgaaatgaagatatgatcag

SEQ ID NO: 7417049 - DNA, 22 bp, Homo sapiens
aatgaaatgaagatatgatcag

SEQ ID NO: 7417050 - DNA, 22 bp, Homo sapiens
aatgaaatgaagatatgatcag

SEQ ID NO: 7417051 - DNA, 22 bp, Homo sapiens
aatgaaatgaagatatgatcag

SEQ ID NO: 7417052 - DNA, 22 bp, Homo sapiens
aatgaaatgaagatatgatcag

SEQ ID NO: 7417053 - DNA, 22 bp, Homo sapiens
aatgaaatgaagatatgatcag

SEQ ID NO: 7417054 - DNA, 22 bp, Homo sapiens
aatgaaatgaagatatgatcag

SEQ ID NO: 7417055 - DNA, 22 bp, Homo sapiens
aatgaaatgaagatatgatcag

SEQ ID NO: 7417056 - DNA, 18 bp, Homo sapiens
aatgaaatgtacaccttt

SEQ ID NO: 7417057 - DNA, 18 bp, Homo sapiens
aatgaaatgtacaccttt

SEQ ID NO: 7417058 - DNA, 18 bp, Homo sapiens
aatgaaatgtacaccttt

SEQ ID NO: 7417059 - DNA, 18 bp, Homo sapiens
aatgaaatgtacaccttt

SEQ ID NO: 7417060 - DNA, 18 bp, Homo sapiens
aatgaaatgtacaccttt

SEQ ID NO: 7417061 - DNA, 22 bp, Homo sapiens
aatgaaatgaagatatgatcag

SEQ ID NO: 7417062 - DNA, 22 bp, Homo sapiens
aatgaaatgaagatatgatcag

SEQ ID NO: 7417063 - DNA, 22 bp, Homo sapiens
aatgaaatgtagcttatccata

SEQ ID NO: 7417064 - DNA, 22 bp, Homo sapiens
aatgaaatgtagcttatccata

SEQ ID NO: 7417065 - DNA, 22 bp, Homo sapiens
aatgaacaaaatatgctttgca

SEQ ID NO: 7417066 - DNA, 22 bp, Homo sapiens
aatgaacaaaatatgctttgca

SEQ ID NO: 7417067 - DNA, 22 bp, Homo sapiens
aatgaaatgtagcttatccata

SEQ ID NO: 7417068 - DNA, 22 bp, Homo sapiens
aatgaaatgtagcttatccata

SEQ ID NO: 7417069 - DNA, 22 bp, Homo sapiens
aatgaaatgtagcttatccata

SEQ ID NO: 7417070 - DNA, 22 bp, Homo sapiens
aatgaaatgtagcttatccata

SEQ ID NO: 7417071 - DNA, 21 bp, Homo sapiens
aatgatgaaagatgacagagt

SEQ ID NO: 7417072 - DNA, 22 bp, Homo sapiens
aatgaacaaatggtgctgcttg

SEQ ID NO: 7417073 - DNA, 22 bp, Homo sapiens
aatgaacaaatggtgctgcttg

SEQ ID NO: 7417074 - DNA, 22 bp, Homo sapiens
aatgaacaaatggtgctgcttg

SEQ ID NO: 7417075 - DNA, 21 bp, Homo sapiens
aatgatgaaagatgacagagt

SEQ ID NO: 7417076 - DNA, 22 bp, Homo sapiens
aatgcacaaaggtgtctattgc

SEQ ID NO: 7417077 - DNA, 18 bp, Homo sapiens
aatgcacacatttactcc

SEQ ID NO: 7417078 - DNA, 18 bp, Homo sapiens
aatgcacacatttactcc

SEQ ID NO: 7417079 - DNA, 22 bp, Homo sapiens
aatgcacaaaggtgtctattgc

SEQ ID NO: 7417080 - DNA, 22 bp, Homo sapiens
aatgatgacaggataaagaaca

SEQ ID NO: 7417081 - DNA, 22 bp, Homo sapiens
aatgatgaactcagagggaacc

SEQ ID NO: 7417082 - DNA, 22 bp, Homo sapiens
aagggcaggcagagatcatata

SEQ ID NO: 7417083 - DNA, 22 bp, Homo sapiens
aagggcaggcagagatcatata

SEQ ID NO: 7417084 - DNA, 22 bp, Homo sapiens
aagggcaggcagagatcatata

SEQ ID NO: 7417085 - DNA, 22 bp, Homo sapiens
aagggcaggcagagatcatata

SEQ ID NO: 7417086 - DNA, 22 bp, Homo sapiens
aagggcaggcagagatcatata

SEQ ID NO: 7417087 - DNA, 22 bp, Homo sapiens
aagggcaggcagagatcatata

SEQ ID NO: 7417088 - DNA, 22 bp, Homo sapiens
aagggcaggcacccaccctcac

SEQ ID NO: 7417089 - DNA, 22 bp, Homo sapiens
aagggcaggagaagacggatat

SEQ ID NO: 7417090 - DNA, 22 bp, Homo sapiens
aagggcaggagaagacggatat

SEQ ID NO: 7417091 - DNA, 22 bp, Homo sapiens
aagggcaggcacccaccctcac

SEQ ID NO: 7417092 - DNA, 22 bp, Homo sapiens
aagggcaggcacccaccctcac

SEQ ID NO: 7417093 - DNA, 22 bp, Homo sapiens
aagggcaggcacccaccctcac

SEQ ID NO: 7417094 - DNA, 22 bp, Homo sapiens
aagggcaggagaagacggatat

SEQ ID NO: 7417095 - DNA, 22 bp, Homo sapiens
aagggcaggcacccaccctcac

SEQ ID NO: 7417096 - DNA, 22 bp, Homo sapiens
aagggcaggcacccaccctcac

SEQ ID NO: 7417097 - DNA, 22 bp, Homo sapiens
aagggcaggcacccaccctcac

SEQ ID NO: 7417098 - DNA, 22 bp, Homo sapiens
aagggcaggcacccaccctcac

SEQ ID NO: 7417099 - DNA, 22 bp, Homo sapiens
aagggcaggcacccaccctcac

SEQ ID NO: 7417100 - DNA, 22 bp, Homo sapiens
aagggcaggagaagacggatat

SEQ ID NO: 7417101 - DNA, 22 bp, Homo sapiens
aagggcaggagaagacggatat

SEQ ID NO: 7417102 - DNA, 22 bp, Homo sapiens
aagggcaggagaagacggatat

SEQ ID NO: 7417103 - DNA, 22 bp, Homo sapiens
aagggcaggagaagacggatat

SEQ ID NO: 7417104 - DNA, 22 bp, Homo sapiens
aagggcaggagaagacggatat

SEQ ID NO: 7417105 - DNA, 22 bp, Homo sapiens
aagggcaggagaagacggatat

SEQ ID NO: 7417106 - DNA, 22 bp, Homo sapiens
aagggcaggagaagacggatat

SEQ ID NO: 7417107 - DNA, 22 bp, Homo sapiens
aagggcaggagaagacggatat

SEQ ID NO: 7417108 - DNA, 22 bp, Homo sapiens
aagggcaggagaagacggatat

SEQ ID NO: 7417109 - DNA, 22 bp, Homo sapiens
aagggcaggaaaagatggatgt

SEQ ID NO: 7417110 - DNA, 22 bp, Homo sapiens
aagggcaggaaaagatggatgt

SEQ ID NO: 7417111 - DNA, 22 bp, Homo sapiens
aagggcaggaaaagatggatgt

SEQ ID NO: 7417112 - DNA, 22 bp, Homo sapiens
aagggcaggaaaagatggatgt

SEQ ID NO: 7417113 - DNA, 22 bp, Homo sapiens
aagggcaggaaaagatggatgt

SEQ ID NO: 7417114 - DNA, 22 bp, Homo sapiens
aagggcaggaaaagatggatgt

SEQ ID NO: 7417115 - DNA, 22 bp, Homo sapiens
aagggcaggaaaagatggatgt

SEQ ID NO: 7417116 - DNA, 22 bp, Homo sapiens
aagggaggggatgtaagcctgg

SEQ ID NO: 7417117 - DNA, 22 bp, Homo sapiens
aagggaggggatgtaagcctgg

SEQ ID NO: 7417118 - DNA, 22 bp, Homo sapiens
aagggcaggaaaagatggatgt

SEQ ID NO: 7417119 - DNA, 22 bp, Homo sapiens
aagggcaggaaaagatggatgt

SEQ ID NO: 7417120 - DNA, 22 bp, Homo sapiens
aagggcaggaaaagatggatgt

SEQ ID NO: 7417121 - DNA, 22 bp, Homo sapiens
aagggaggggatgtaagcctgg

SEQ ID NO: 7417122 - DNA, 22 bp, Homo sapiens
aagggaggggatgtaagcctgg

SEQ ID NO: 7417123 - DNA, 22 bp, Homo sapiens
aagggaggggatgtaagcctgg

SEQ ID NO: 7417124 - DNA, 22 bp, Homo sapiens
aagggaggccagaggttttgca

SEQ ID NO: 7417125 - DNA, 22 bp, Homo sapiens
aagggaggccagaggttttgca

SEQ ID NO: 7417126 - DNA, 22 bp, Homo sapiens
aaggctgagacagcacaggtcc

SEQ ID NO: 7417127 - DNA, 22 bp, Homo sapiens
aaggctgagacagcacaggtcc

SEQ ID NO: 7417128 - DNA, 21 bp, Homo sapiens
aaggctgagacaactcaggag

SEQ ID NO: 7417129 - DNA, 22 bp, Homo sapiens
aaggctgagagtcacagtccta

SEQ ID NO: 7417130 - DNA, 22 bp, Homo sapiens
aaggctgagagtcacagtccta

SEQ ID NO: 7417131 - DNA, 21 bp, Homo sapiens
aaggctgagacaactcaggag

SEQ ID NO: 7417132 - DNA, 22 bp, Homo sapiens
aaggctgagacagcacaggtcc

SEQ ID NO: 7417133 - DNA, 22 bp, Homo sapiens
aaggctgagacagcacaggtcc

SEQ ID NO: 7417134 - DNA, 22 bp, Homo sapiens
aaggctgacgtttgtgtttatt

SEQ ID NO: 7417135 - DNA, 22 bp, Homo sapiens
aaggctgacgtttgtgtttatt

SEQ ID NO: 7417136 - DNA, 22 bp, Homo sapiens
aaggctgacgtttgtgtttatt

SEQ ID NO: 7417137 - DNA, 22 bp, Homo sapiens
aaggctgaccagtttacacttt

SEQ ID NO: 7417138 - DNA, 22 bp, Homo sapiens
aaggctgacgtttgtgtttatt

SEQ ID NO: 7417139 - DNA, 22 bp, Homo sapiens
aaggctgactcaacagggggcc

SEQ ID NO: 7417140 - DNA, 22 bp, Homo sapiens
aaggctgactcaacagggggcc

SEQ ID NO: 7417141 - DNA, 22 bp, Homo sapiens
aaggctgactcaacagggggcc

SEQ ID NO: 7417142 - DNA, 22 bp, Homo sapiens
aaggctgaccagtttacacttt

SEQ ID NO: 7417143 - DNA, 22 bp, Homo sapiens
aaggctgacgtttgtgtttatt

SEQ ID NO: 7417144 - DNA, 22 bp, Homo sapiens
aaggctgaccagtttacacttt

SEQ ID NO: 7417145 - DNA, 22 bp, Homo sapiens
aaggctgaattcaagggtaggc

SEQ ID NO: 7417146 - DNA, 22 bp, Homo sapiens
aaggctgaccagtttacacttt

SEQ ID NO: 7417147 - DNA, 22 bp, Homo sapiens
aaggctgaattcaagggtaggc

SEQ ID NO: 7417148 - DNA, 22 bp, Homo sapiens
aaggctgaccagtttacacttt

SEQ ID NO: 7417149 - DNA, 22 bp, Homo sapiens
aaggctgaccagtttacacttt

SEQ ID NO: 7417150 - DNA, 22 bp, Homo sapiens
aaggccctggatggttttgaga

SEQ ID NO: 7417151 - DNA, 22 bp, Homo sapiens
aaggccctcatgcgtcagagcc

SEQ ID NO: 7417152 - DNA, 22 bp, Homo sapiens
aaggccctggcaggaagcagga

SEQ ID NO: 7417153 - DNA, 22 bp, Homo sapiens
aaggccctggagtttctggaca

SEQ ID NO: 7417154 - DNA, 22 bp, Homo sapiens
aaggccctggccccagcttctt

SEQ ID NO: 7417155 - DNA, 22 bp, Homo sapiens
aaggcccttccaccagtcctcg

SEQ ID NO: 7417156 - DNA, 22 bp, Homo sapiens
aaggccctgtctccaaatacag

SEQ ID NO: 7417157 - DNA, 22 bp, Homo sapiens
aaggccctggccccagcttctt

SEQ ID NO: 7417158 - DNA, 22 bp, Homo sapiens
aaggcccttccaccagtcctcg

SEQ ID NO: 7417159 - DNA, 22 bp, Homo sapiens
aaggcccttcggcttcctcagc

SEQ ID NO: 7417160 - DNA, 22 bp, Homo sapiens
aaggcccttccaccagtcctcg

SEQ ID NO: 7417161 - DNA, 22 bp, Homo sapiens
aaggcccttccaccagtcctcg

SEQ ID NO: 7417162 - DNA, 22 bp, Homo sapiens
aaggctgaaagaccttgaacct

SEQ ID NO: 7417163 - DNA, 22 bp, Homo sapiens
aaggctgaattcaagggtaggc

SEQ ID NO: 7417164 - DNA, 22 bp, Homo sapiens
aaggctgaaagaccttgaacct

SEQ ID NO: 7417165 - DNA, 22 bp, Homo sapiens
aaggctgaattcaagggtaggc

SEQ ID NO: 7417166 - DNA, 22 bp, Homo sapiens
aaggctgaattcaagggtaggc

SEQ ID NO: 7417167 - DNA, 22 bp, Homo sapiens
aaggcccagcgtgacctcagtg

SEQ ID NO: 7417168 - DNA, 22 bp, Homo sapiens
aaggcccagcctggagcttgtt

SEQ ID NO: 7417169 - DNA, 22 bp, Homo sapiens
aaggcccagcctggagcttgtt

SEQ ID NO: 7417170 - DNA, 22 bp, Homo sapiens
aaggcccagcgtgacctcagtg

SEQ ID NO: 7417171 - DNA, 22 bp, Homo sapiens
aaggcccagcgtgacctcagtg

SEQ ID NO: 7417172 - DNA, 22 bp, Homo sapiens
aaggcccagccaatgggggcag

SEQ ID NO: 7417173 - DNA, 22 bp, Homo sapiens
aaggcccagcgtgacctcagtg

SEQ ID NO: 7417174 - DNA, 22 bp, Homo sapiens
aaggcccagcgtgacctcagtg

SEQ ID NO: 7417175 - DNA, 22 bp, Homo sapiens
aaggcccagggattggaggtca

SEQ ID NO: 7417176 - DNA, 22 bp, Homo sapiens
aaggcccagggattggaggtca

SEQ ID NO: 7417177 - DNA, 22 bp, Homo sapiens
aaggcccaggctgccctgggca

SEQ ID NO: 7417178 - DNA, 22 bp, Homo sapiens
aaggcccaggctgccctgggca

SEQ ID NO: 7417179 - DNA, 22 bp, Homo sapiens
aaggcccaggctgccctgggca

SEQ ID NO: 7417180 - DNA, 22 bp, Homo sapiens
aaggcccaggctgccctgggca

SEQ ID NO: 7417181 - DNA, 22 bp, Homo sapiens
aaggcccagcgtgacctcagtg

SEQ ID NO: 7417182 - DNA, 22 bp, Homo sapiens
aaggccctcatgcgtcagagcc

SEQ ID NO: 7417183 - DNA, 22 bp, Homo sapiens
aaggccctcatgcgtcagagcc

SEQ ID NO: 7417184 - DNA, 22 bp, Homo sapiens
aaggccctcatgcgtcagagcc

SEQ ID NO: 7417185 - DNA, 22 bp, Homo sapiens
aaggccctagaatctatattgc

SEQ ID NO: 7417186 - DNA, 22 bp, Homo sapiens
aaggccctaatagagcacatat

SEQ ID NO: 7417187 - DNA, 22 bp, Homo sapiens
aaggcccagggattggaggtca

SEQ ID NO: 7417188 - DNA, 22 bp, Homo sapiens
aaggcccaggggctctagggca

SEQ ID NO: 7417189 - DNA, 22 bp, Homo sapiens
aaggcccaggggctctagggca

SEQ ID NO: 7417190 - DNA, 22 bp, Homo sapiens
aaggcccagggattggaggtca

SEQ ID NO: 7417191 - DNA, 22 bp, Homo sapiens
aaggcccagggattggaggtca

SEQ ID NO: 7417192 - DNA, 22 bp, Homo sapiens
aaggcccagggattggaggtca

SEQ ID NO: 7417193 - DNA, 22 bp, Homo sapiens
aaggccaggtccctgcagtgca

SEQ ID NO: 7417194 - DNA, 22 bp, Homo sapiens
aaggccaggtccctgcagtgca

SEQ ID NO: 7417195 - DNA, 22 bp, Homo sapiens
aaggccaggtccctgcagtgca

SEQ ID NO: 7417196 - DNA, 22 bp, Homo sapiens
aaggccaggtccctgcagtgca

SEQ ID NO: 7417197 - DNA, 22 bp, Homo sapiens
aaggccaggtccctgcagtgca

SEQ ID NO: 7417198 - DNA, 22 bp, Homo sapiens
aaggccaggtccctgcagtgca

SEQ ID NO: 7417199 - DNA, 23 bp, Homo sapiens
aaggccagagagaggctagtgtc

SEQ ID NO: 7417200 - DNA, 23 bp, Homo sapiens
aaggccagagagaggctagtgtc

SEQ ID NO: 7417201 - DNA, 22 bp, Homo sapiens
aaggcactgtactagttagtta

SEQ ID NO: 7417202 - DNA, 23 bp, Homo sapiens
aaggccagagagaggctagtgtc

SEQ ID NO: 7417203 - DNA, 23 bp, Homo sapiens
aaggccagagagaggctagtgtc

SEQ ID NO: 7417204 - DNA, 22 bp, Homo sapiens
aaggccagactctggaatgaca

SEQ ID NO: 7417205 - DNA, 22 bp, Homo sapiens
aaggccagactctggaatgaca

SEQ ID NO: 7417206 - DNA, 22 bp, Homo sapiens
aaggcactgctttgctgcgccc

SEQ ID NO: 7417207 - DNA, 22 bp, Homo sapiens
aaggcactgagccagccgtctc

SEQ ID NO: 7417208 - DNA, 22 bp, Homo sapiens
aaggcactgtactagttagtta

SEQ ID NO: 7417209 - DNA, 22 bp, Homo sapiens
aaggcactgctttgctgcgccc

SEQ ID NO: 7417210 - DNA, 22 bp, Homo sapiens
aaggccattgtaatgtaaatat

SEQ ID NO: 7417211 - DNA, 22 bp, Homo sapiens
aaggcccacagaactgtctcca

SEQ ID NO: 7417212 - DNA, 22 bp, Homo sapiens
aaggccatgtaggaggcatgcg

SEQ ID NO: 7417213 - DNA, 22 bp, Homo sapiens
aaggccattattctgatatatt

SEQ ID NO: 7417214 - DNA, 22 bp, Homo sapiens
aaggcccagcctggagcttgtt

SEQ ID NO: 7417215 - DNA, 22 bp, Homo sapiens
aaggcccagcctggagcttgtt

SEQ ID NO: 7417216 - DNA, 22 bp, Homo sapiens
aaggcccagcctggagcttgtt

SEQ ID NO: 7417217 - DNA, 22 bp, Homo sapiens
aaggcccagccaatgggggcag

SEQ ID NO: 7417218 - DNA, 22 bp, Homo sapiens
aaggcccagccaatgggggcag

SEQ ID NO: 7417219 - DNA, 22 bp, Homo sapiens
aaggcccacagaactgtctcca

SEQ ID NO: 7417220 - DNA, 17 bp, Homo sapiens
aaggccatttccaccca

SEQ ID NO: 7417221 - DNA, 22 bp, Homo sapiens
aaggcccacagaactgtctcca

SEQ ID NO: 7417222 - DNA, 22 bp, Homo sapiens
aaggcccacagaactgtctcca

SEQ ID NO: 7417223 - DNA, 22 bp, Homo sapiens
aaggcccacagaactgtctcca

SEQ ID NO: 7417224 - DNA, 22 bp, Homo sapiens
aaggccaggtccctgcagtgca

SEQ ID NO: 7417225 - DNA, 22 bp, Homo sapiens
aaggccaggtccctgcagtgca

SEQ ID NO: 7417226 - DNA, 22 bp, Homo sapiens
aaggccagtggataaaacctct

SEQ ID NO: 7417227 - DNA, 22 bp, Homo sapiens
aaggccatacaatgaaaggggc

SEQ ID NO: 7417228 - DNA, 22 bp, Homo sapiens
aaggccatctacttacggaatt

SEQ ID NO: 7417229 - DNA, 22 bp, Homo sapiens
aaggccatgaccacttgctgtg

SEQ ID NO: 7417230 - DNA, 22 bp, Homo sapiens
aaggccatgaccacttgctgtg

SEQ ID NO: 7417231 - DNA, 22 bp, Homo sapiens
aaggccatgcacatcctaggca

SEQ ID NO: 7417232 - DNA, 22 bp, Homo sapiens
aaggccatgcacatcctaggca

SEQ ID NO: 7417233 - DNA, 22 bp, Homo sapiens
aaggccatgcacatcctaggca

SEQ ID NO: 7417234 - DNA, 22 bp, Homo sapiens
aaatggatggaattgacattta

SEQ ID NO: 7417235 - DNA, 22 bp, Homo sapiens
aaatggatggaattgacattta

SEQ ID NO: 7417236 - DNA, 22 bp, Homo sapiens
aaatggatgttgagttaaatgt

SEQ ID NO: 7417237 - DNA, 22 bp, Homo sapiens
aaatggatgttgagttaaatgt

SEQ ID NO: 7417238 - DNA, 22 bp, Homo sapiens
aaatggcaacagaagggagttc

SEQ ID NO: 7417239 - DNA, 22 bp, Homo sapiens
aaatggatgttgagttaaatgt

SEQ ID NO: 7417240 - DNA, 22 bp, Homo sapiens
aaatggcaacagaagggagttc

SEQ ID NO: 7417241 - DNA, 22 bp, Homo sapiens
aaatggcaacagaagggagttc

SEQ ID NO: 7417242 - DNA, 22 bp, Homo sapiens
aaatggcaatcagcagaagcta

SEQ ID NO: 7417243 - DNA, 22 bp, Homo sapiens
aaatggcaatcagcagaagcta

SEQ ID NO: 7417244 - DNA, 22 bp, Homo sapiens
aaatggcaatcagcagaagcta

SEQ ID NO: 7417245 - DNA, 22 bp, Homo sapiens
aaggagaagggtaatcaacaca

SEQ ID NO: 7417246 - DNA, 22 bp, Homo sapiens
aaggagaagggtaatcaacaca

SEQ ID NO: 7417247 - DNA, 22 bp, Homo sapiens
aaggagaagggtaatcaacaca

SEQ ID NO: 7417248 - DNA, 22 bp, Homo sapiens
aaggagaagggtaatcaacaca

SEQ ID NO: 7417249 - DNA, 18 bp, Homo sapiens
aaatggcagaatggatag

SEQ ID NO: 7417250 - DNA, 22 bp, Homo sapiens
aaatggcactttgacagcctgc

SEQ ID NO: 7417251 - DNA, 22 bp, Homo sapiens
aaatggcactttgacagcctgc

SEQ ID NO: 7417252 - DNA, 22 bp, Homo sapiens
aaatggcactttgacagcctgc

SEQ ID NO: 7417253 - DNA, 22 bp, Homo sapiens
aaatggcaatttagtttattta

SEQ ID NO: 7417254 - DNA, 22 bp, Homo sapiens
aaatggcaatttagtttattta

SEQ ID NO: 7417255 - DNA, 18 bp, Homo sapiens
aaatggcacacagacctg

SEQ ID NO: 7417256 - DNA, 18 bp, Homo sapiens
aaatggcacacagacctg

SEQ ID NO: 7417257 - DNA, 20 bp, Homo sapiens
aaatggcacatgggaagtcc

SEQ ID NO: 7417258 - DNA, 20 bp, Homo sapiens
aaatggcacatgggaagtcc

SEQ ID NO: 7417259 - DNA, 22 bp, Homo sapiens
aaggagaagggtaatcaacaca

SEQ ID NO: 7417260 - DNA, 22 bp, Homo sapiens
aaggagaagggtaatcaacaca

SEQ ID NO: 7417261 - DNA, 22 bp, Homo sapiens
aaggagaagggtaatcaacaca

SEQ ID NO: 7417262 - DNA, 22 bp, Homo sapiens
aaggagaagggtaatcaacaca

SEQ ID NO: 7417263 - DNA, 22 bp, Homo sapiens
aaggagaagtctgttgagattg

SEQ ID NO: 7417264 - DNA, 22 bp, Homo sapiens
aaggagaagtctgttgagattg

SEQ ID NO: 7417265 - DNA, 22 bp, Homo sapiens
aaggagggaaagcagtgcttct

SEQ ID NO: 7417266 - DNA, 22 bp, Homo sapiens
aaggagggaaagcagtgcttct

SEQ ID NO: 7417267 - DNA, 22 bp, Homo sapiens
aaggagggaaagcagtgcttct

SEQ ID NO: 7417268 - DNA, 16 bp, Homo sapiens
aaggagggaagagaat

SEQ ID NO: 7417269 - DNA, 22 bp, Homo sapiens
aaggagggttcccaggtcctgg

SEQ ID NO: 7417270 - DNA, 22 bp, Homo sapiens
aaggagggttcccaggtcctgg

SEQ ID NO: 7417271 - DNA, 22 bp, Homo sapiens
aaggagggttcccaggtcctgg

SEQ ID NO: 7417272 - DNA, 22 bp, Homo sapiens
aaggagggttcccaggtcctgg

SEQ ID NO: 7417273 - DNA, 22 bp, Homo sapiens
aaggagggaaagcagtgcttct

SEQ ID NO: 7417274 - DNA, 16 bp, Homo sapiens
aaggagggaagagaat

SEQ ID NO: 7417275 - DNA, 16 bp, Homo sapiens
aaggagggaagagaat

SEQ ID NO: 7417276 - DNA, 16 bp, Homo sapiens
aaggagggaagagaat

SEQ ID NO: 7417277 - DNA, 16 bp, Homo sapiens
aaggagggaagagaat

SEQ ID NO: 7417278 - DNA, 22 bp, Homo sapiens
aaatggagatgataagagggtt

SEQ ID NO: 7417279 - DNA, 22 bp, Homo sapiens
aaatggaggcaaaattggtttc

SEQ ID NO: 7417280 - DNA, 22 bp, Homo sapiens
aaatggaggcaaaattggtttc

SEQ ID NO: 7417281 - DNA, 19 bp, Homo sapiens
aaatggagctaatcttgtc

SEQ ID NO: 7417282 - DNA, 22 bp, Homo sapiens
aaatggaggcacgcagtggtta

SEQ ID NO: 7417283 - DNA, 22 bp, Homo sapiens
aaatggaggcacgcagtggtta

SEQ ID NO: 7417284 - DNA, 21 bp, Homo sapiens
aaatggatagggcaatggaag

SEQ ID NO: 7417285 - DNA, 21 bp, Homo sapiens
aaatggatagggcaatggaag

SEQ ID NO: 7417286 - DNA, 22 bp, Homo sapiens
aaatggagttctaagtatagta

SEQ ID NO: 7417287 - DNA, 22 bp, Homo sapiens
aaatggatggaattgacattta

SEQ ID NO: 7417288 - DNA, 22 bp, Homo sapiens
aaatggatggaaagcaattttt

SEQ ID NO: 7417289 - DNA, 22 bp, Homo sapiens
aaatggatgcctgataacgtca

SEQ ID NO: 7417290 - DNA, 22 bp, Homo sapiens
aaatggatctttttataatgca

SEQ ID NO: 7417291 - DNA, 18 bp, Homo sapiens
aaatggatgacagtacca

SEQ ID NO: 7417292 - DNA, 18 bp, Homo sapiens
aaatggatgacagtacca

SEQ ID NO: 7417293 - DNA, 18 bp, Homo sapiens
aaatggatgacagtacca

SEQ ID NO: 7417294 - DNA, 22 bp, Homo sapiens
aaatggatctgtggaatacatt

SEQ ID NO: 7417295 - DNA, 22 bp, Homo sapiens
aaatggatctgtggaatacatt

SEQ ID NO: 7417296 - DNA, 22 bp, Homo sapiens
aaatggatctgtggaatacatt

SEQ ID NO: 7417297 - DNA, 22 bp, Homo sapiens
aaatggatctttttataatgca

SEQ ID NO: 7417298 - DNA, 22 bp, Homo sapiens
aaatggatctttttataatgca

SEQ ID NO: 7417299 - DNA, 22 bp, Homo sapiens
aaatggactgtgatatttacat

SEQ ID NO: 7417300 - DNA, 23 bp, Homo sapiens
aaatggactattcggcatggaga

SEQ ID NO: 7417301 - DNA, 22 bp, Homo sapiens
aaatggaatgtgtttataattc

SEQ ID NO: 7417302 - DNA, 22 bp, Homo sapiens
aaatggacattgggtgagctct

SEQ ID NO: 7417303 - DNA, 22 bp, Homo sapiens
aaatggaatgtgtttataattc

SEQ ID NO: 7417304 - DNA, 22 bp, Homo sapiens
aaatggaatgtgtttataattc

SEQ ID NO: 7417305 - DNA, 22 bp, Homo sapiens
aaatggaatgtgtttataattc

SEQ ID NO: 7417306 - DNA, 22 bp, Homo sapiens
aaatggaatgtgtttataattc

SEQ ID NO: 7417307 - DNA, 22 bp, Homo sapiens
aaatggaatgtgtttataattc

SEQ ID NO: 7417308 - DNA, 22 bp, Homo sapiens
aaatggaatgtgtttataattc

SEQ ID NO: 7417309 - DNA, 22 bp, Homo sapiens
aaatggaagtgtatttagtgtt

SEQ ID NO: 7417310 - DNA, 22 bp, Homo sapiens
aaatggaagaagtgcaatactg

SEQ ID NO: 7417311 - DNA, 22 bp, Homo sapiens
aaatggaagaagtgcaatactg

SEQ ID NO: 7417312 - DNA, 22 bp, Homo sapiens
aaatggaagaagtgcaatactg

SEQ ID NO: 7417313 - DNA, 22 bp, Homo sapiens
aaatggaagaagtgcaatactg

SEQ ID NO: 7417314 - DNA, 22 bp, Homo sapiens
aaatggaactgttgtgcatttg

SEQ ID NO: 7417315 - DNA, 22 bp, Homo sapiens
aaatggaactgttgtgcatttg

SEQ ID NO: 7417316 - DNA, 22 bp, Homo sapiens
aaatggaagctatttatgattc

SEQ ID NO: 7417317 - DNA, 22 bp, Homo sapiens
aaatggaagctatttatgattc

SEQ ID NO: 7417318 - DNA, 22 bp, Homo sapiens
aaatggaagctatttatgattc

SEQ ID NO: 7417319 - DNA, 22 bp, Homo sapiens
aaatggaagctatttatgattc

SEQ ID NO: 7417320 - DNA, 22 bp, Homo sapiens
aaatggaagaagtgcaatactg

SEQ ID NO: 7417321 - DNA, 22 bp, Homo sapiens
aaggagggttcccaggtcctgg

SEQ ID NO: 7417322 - DNA, 22 bp, Homo sapiens
aaggagggttcccaggtcctgg

SEQ ID NO: 7417323 - DNA, 22 bp, Homo sapiens
aaggagggttcccaggtcctgg

SEQ ID NO: 7417324 - DNA, 22 bp, Homo sapiens
aaggagggttcccaggtcctgg

SEQ ID NO: 7417325 - DNA, 22 bp, Homo sapiens
aaggagtctcagctgggcctga

SEQ ID NO: 7417326 - DNA, 22 bp, Homo sapiens
aaggaggttatcccagtggact

SEQ ID NO: 7417327 - DNA, 22 bp, Homo sapiens
aaggagtctcagctgggcctga

SEQ ID NO: 7417328 - DNA, 22 bp, Homo sapiens
aaggagtctgggccattcagag

SEQ ID NO: 7417329 - DNA, 22 bp, Homo sapiens
aaggagtctgggccattcagag

SEQ ID NO: 7417330 - DNA, 22 bp, Homo sapiens
aaggagtctgggccattcagag

SEQ ID NO: 7417331 - DNA, 22 bp, Homo sapiens
aaggagtctgggccattcagag

SEQ ID NO: 7417332 - DNA, 22 bp, Homo sapiens
aaggagtctgggccattcagag

SEQ ID NO: 7417333 - DNA, 22 bp, Homo sapiens
aaggagtctgggccattcagag

SEQ ID NO: 7417334 - DNA, 22 bp, Homo sapiens
aaggagtctgggccattcagag

SEQ ID NO: 7417335 - DNA, 22 bp, Homo sapiens
aaggagtctgggccattcagag

SEQ ID NO: 7417336 - DNA, 22 bp, Homo sapiens
aaggagtctgggccattcagag

SEQ ID NO: 7417337 - DNA, 22 bp, Homo sapiens
aaggataagaatggaaggaaca

SEQ ID NO: 7417338 - DNA, 22 bp, Homo sapiens
aaggatacttttagagcctgag

SEQ ID NO: 7417339 - DNA, 22 bp, Homo sapiens
aaggatacttttagagcctgag

SEQ ID NO: 7417340 - DNA, 22 bp, Homo sapiens
aaggatacttttagagcctgag

SEQ ID NO: 7417341 - DNA, 22 bp, Homo sapiens
aaggatacttttagagcctgag

SEQ ID NO: 7417342 - DNA, 22 bp, Homo sapiens
aaggatatgggtagtatgatgt

SEQ ID NO: 7417343 - DNA, 22 bp, Homo sapiens
aaggatacttttagagcctgag

SEQ ID NO: 7417344 - DNA, 22 bp, Homo sapiens
aaggataaaaaccacttctaat

SEQ ID NO: 7417345 - DNA, 22 bp, Homo sapiens
aaggagtttgggtagtcataca

SEQ ID NO: 7417346 - DNA, 22 bp, Homo sapiens
aaggataaaaaccacttctaat

SEQ ID NO: 7417347 - DNA, 22 bp, Homo sapiens
aaggataaaaaccacttctaat

SEQ ID NO: 7417348 - DNA, 22 bp, Homo sapiens
aaggataaaaaccacttctaat

SEQ ID NO: 7417349 - DNA, 22 bp, Homo sapiens
aaggagtgatatatgggtgcta

SEQ ID NO: 7417350 - DNA, 22 bp, Homo sapiens
aaggagtgcatgactcagagta

SEQ ID NO: 7417351 - DNA, 22 bp, Homo sapiens
aaggagtgcatgactcagagta

SEQ ID NO: 7417352 - DNA, 22 bp, Homo sapiens
aaggagtgatatatgggtgcta

SEQ ID NO: 7417353 - DNA, 22 bp, Homo sapiens
aaggagtgtgaccttccagctc

SEQ ID NO: 7417354 - DNA, 22 bp, Homo sapiens
aaggagtggggcatatcacaga

SEQ ID NO: 7417355 - DNA, 22 bp, Homo sapiens
aaggagtgctgaaaggaagcgg

SEQ ID NO: 7417356 - DNA, 22 bp, Homo sapiens
aaggagtgcatgactcagagta

SEQ ID NO: 7417357 - DNA, 22 bp, Homo sapiens
aaggagtgcatgactcagagta

SEQ ID NO: 7417358 - DNA, 22 bp, Homo sapiens
aaggagtgctgaaaggaagcgg

SEQ ID NO: 7417359 - DNA, 22 bp, Homo sapiens
aaggcactgaaaaattgtgtgt

SEQ ID NO: 7417360 - DNA, 22 bp, Homo sapiens
aaggcactcattcaaggagata

SEQ ID NO: 7417361 - DNA, 22 bp, Homo sapiens
aaggcactcattcaaggagata

SEQ ID NO: 7417362 - DNA, 22 bp, Homo sapiens
aaggcactgaaaaattgtgtgt

SEQ ID NO: 7417363 - DNA, 22 bp, Homo sapiens
aaggcactgaaaaattgtgtgt

SEQ ID NO: 7417364 - DNA, 22 bp, Homo sapiens
aaggcactgaacttaaattctg

SEQ ID NO: 7417365 - DNA, 22 bp, Homo sapiens
aaggcactgaaaaattgtgtgt

SEQ ID NO: 7417366 - DNA, 22 bp, Homo sapiens
aaggcactgactgtgcagggga

SEQ ID NO: 7417367 - DNA, 22 bp, Homo sapiens
aaggcactgactgtgcagggga

SEQ ID NO: 7417368 - DNA, 22 bp, Homo sapiens
aaggcactgagccagccgtctc

SEQ ID NO: 7417369 - DNA, 22 bp, Homo sapiens
aaggcactgactgtgcagggga

SEQ ID NO: 7417370 - DNA, 22 bp, Homo sapiens
aaggcactgaacttaaattctg

SEQ ID NO: 7417371 - DNA, 22 bp, Homo sapiens
aaggcactgaacttaaattctg

SEQ ID NO: 7417372 - DNA, 22 bp, Homo sapiens
aaggcactgaacttaaattctg

SEQ ID NO: 7417373 - DNA, 22 bp, Homo sapiens
aaggcactagcaagctgcctgg

SEQ ID NO: 7417374 - DNA, 22 bp, Homo sapiens
aaggatcaagtggattttctta

SEQ ID NO: 7417375 - DNA, 22 bp, Homo sapiens
aaggatcaagtggattttctta

SEQ ID NO: 7417376 - DNA, 22 bp, Homo sapiens
aaggcactagcaagctgcctgg

SEQ ID NO: 7417377 - DNA, 22 bp, Homo sapiens
aaggcactagcaagctgcctgg

SEQ ID NO: 7417378 - DNA, 22 bp, Homo sapiens
aaggatcaagtggattttctta

SEQ ID NO: 7417379 - DNA, 17 bp, Homo sapiens
aaggatattatagttct

SEQ ID NO: 7417380 - DNA, 22 bp, Homo sapiens
aaggatatttggctacagaagc

SEQ ID NO: 7417381 - DNA, 22 bp, Homo sapiens
aaggatatttggctacagaagc

SEQ ID NO: 7417382 - DNA, 22 bp, Homo sapiens
aaggatagaataactcttgact

SEQ ID NO: 7417383 - DNA, 22 bp, Homo sapiens
aaggatagtcacatttttatgt

SEQ ID NO: 7417384 - DNA, 22 bp, Homo sapiens
aaggatatttggctacagaagc

SEQ ID NO: 7417385 - DNA, 22 bp, Homo sapiens
aaggcactagcagaattagtga

SEQ ID NO: 7417386 - DNA, 22 bp, Homo sapiens
aaggcactagcagaattagtga

SEQ ID NO: 7417387 - DNA, 20 bp, Homo sapiens
aaggcactatgtctgctagc

SEQ ID NO: 7417388 - DNA, 22 bp, Homo sapiens
aaggcactagcagaattagtga

SEQ ID NO: 7417389 - DNA, 20 bp, Homo sapiens
aaggcactatgtctgctagc

SEQ ID NO: 7417390 - DNA, 22 bp, Homo sapiens
aaggcactcagccttgggacag

SEQ ID NO: 7417391 - DNA, 22 bp, Homo sapiens
aaggcactcattcaaggagata

SEQ ID NO: 7417392 - DNA, 22 bp, Homo sapiens
aaggcactcattcaaggagata

SEQ ID NO: 7417393 - DNA, 22 bp, Homo sapiens
aaggatcatagtaaacattgat

SEQ ID NO: 7417394 - DNA, 22 bp, Homo sapiens
aacagttaatgaagaggaagcc

SEQ ID NO: 7417395 - DNA, 22 bp, Homo sapiens
aacagttacccttaagatcttt

SEQ ID NO: 7417396 - DNA, 22 bp, Homo sapiens
aacagttacccttaagatcttt

SEQ ID NO: 7417397 - DNA, 22 bp, Homo sapiens
aacagttaacattttgggagct

SEQ ID NO: 7417398 - DNA, 22 bp, Homo sapiens
aacagtgttctagggtgtggct

SEQ ID NO: 7417399 - DNA, 22 bp, Homo sapiens
aacagttaagcagtcctgatat

SEQ ID NO: 7417400 - DNA, 22 bp, Homo sapiens
aacagttaagcagtcctgatat

SEQ ID NO: 7417401 - DNA, 22 bp, Homo sapiens
aacagtgttttgctctttgccc

SEQ ID NO: 7417402 - DNA, 22 bp, Homo sapiens
aacagtgtttttcttcagcact

SEQ ID NO: 7417403 - DNA, 22 bp, Homo sapiens
aacagttatctcacatatggaa

SEQ ID NO: 7417404 - DNA, 22 bp, Homo sapiens
aacagttattatcacattagtg

SEQ ID NO: 7417405 - DNA, 22 bp, Homo sapiens
aacagttatctcacatatggaa

SEQ ID NO: 7417406 - DNA, 22 bp, Homo sapiens
aacagttatctcacatatggaa

SEQ ID NO: 7417407 - DNA, 22 bp, Homo sapiens
aacagttacccttaagatcttt

SEQ ID NO: 7417408 - DNA, 22 bp, Homo sapiens
aacagttacccttaagatcttt

SEQ ID NO: 7417409 - DNA, 17 bp, Homo sapiens
aacagttaatgggggaa

SEQ ID NO: 7417410 - DNA, 22 bp, Homo sapiens
aacagtggggaaaagagttggt

SEQ ID NO: 7417411 - DNA, 21 bp, Homo sapiens
aacagtgcttagtagatgttc

SEQ ID NO: 7417412 - DNA, 22 bp, Homo sapiens
aacagtgcttcattcacacatt

SEQ ID NO: 7417413 - DNA, 22 bp, Homo sapiens
aacagtgcttcattcacacatt

SEQ ID NO: 7417414 - DNA, 22 bp, Homo sapiens
aacagtgctgttataaatgtac

SEQ ID NO: 7417415 - DNA, 22 bp, Homo sapiens
aacagtgctgttataaatgtac

SEQ ID NO: 7417416 - DNA, 22 bp, Homo sapiens
aacagtgctgttataaatgtac

SEQ ID NO: 7417417 - DNA, 21 bp, Homo sapiens
aacagtgcttagtagatgttc

SEQ ID NO: 7417418 - DNA, 21 bp, Homo sapiens
aacagtgcttagtagatgttc

SEQ ID NO: 7417419 - DNA, 22 bp, Homo sapiens
aacagtggtctggggagtggag

SEQ ID NO: 7417420 - DNA, 22 bp, Homo sapiens
aacagtggtctggggagtggag

SEQ ID NO: 7417421 - DNA, 22 bp, Homo sapiens
aacagtggtctggggagtggag

SEQ ID NO: 7417422 - DNA, 22 bp, Homo sapiens
aacagtggggaaaagagttggt

SEQ ID NO: 7417423 - DNA, 22 bp, Homo sapiens
aacagtgtcaggattacagata

SEQ ID NO: 7417424 - DNA, 22 bp, Homo sapiens
aacagtgtcaggattacagata

SEQ ID NO: 7417425 - DNA, 22 bp, Homo sapiens
aacagtggtctggggagtggag

SEQ ID NO: 7417426 - DNA, 22 bp, Homo sapiens
aacagtgttttgctctttgccc

SEQ ID NO: 7417427 - DNA, 22 bp, Homo sapiens
aacagtgtgttttgttattaag

SEQ ID NO: 7417428 - DNA, 22 bp, Homo sapiens
aacagtgtgttttgttattaag

SEQ ID NO: 7417429 - DNA, 22 bp, Homo sapiens
aacagtgtctgtggttaaaggt

SEQ ID NO: 7417430 - DNA, 22 bp, Homo sapiens
aacagtgtgtacacatcatagg

SEQ ID NO: 7417431 - DNA, 22 bp, Homo sapiens
aacagtgtcaggattacagata

SEQ ID NO: 7417432 - DNA, 22 bp, Homo sapiens
aacagtgtctgtggttaaaggt

SEQ ID NO: 7417433 - DNA, 22 bp, Homo sapiens
aacagtgtctgtggttaaaggt

SEQ ID NO: 7417434 - DNA, 22 bp, Homo sapiens
aagtgcttaaaagggtggtcta

SEQ ID NO: 7417435 - DNA, 22 bp, Homo sapiens
aagtgcttaaaagggtggtcta

SEQ ID NO: 7417436 - DNA, 22 bp, Homo sapiens
aagtgcttagaagttgcattag

SEQ ID NO: 7417437 - DNA, 22 bp, Homo sapiens
aagtgcttccatgtttgagtgt

SEQ ID NO: 7417438 - DNA, 22 bp, Homo sapiens
aagtgcttcaactagtgtggtc

SEQ ID NO: 7417439 - DNA, 22 bp, Homo sapiens
aagtgcttccatgtttgagtgt

SEQ ID NO: 7417440 - DNA, 22 bp, Homo sapiens
aacagtaaagacagaatttatc

SEQ ID NO: 7417441 - DNA, 22 bp, Homo sapiens
aagtgcttcaactagtgtggtc

SEQ ID NO: 7417442 - DNA, 22 bp, Homo sapiens
aagtgcttcaactagtgtggtc

SEQ ID NO: 7417443 - DNA, 22 bp, Homo sapiens
aacagtaaagacagaatttatc

SEQ ID NO: 7417444 - DNA, 22 bp, Homo sapiens
aagtgcttccatgtttgagtgt

SEQ ID NO: 7417445 - DNA, 22 bp, Homo sapiens
aacagtaaagacagaatttatc

SEQ ID NO: 7417446 - DNA, 22 bp, Homo sapiens
aacagtaaagacagaatttatc

SEQ ID NO: 7417447 - DNA, 22 bp, Homo sapiens
aacagtgctgcattcattgagc

SEQ ID NO: 7417448 - DNA, 22 bp, Homo sapiens
aacagtgctgattattttacct

SEQ ID NO: 7417449 - DNA, 22 bp, Homo sapiens
aacagtgctgattattttacct

SEQ ID NO: 7417450 - DNA, 22 bp, Homo sapiens
aacagtgatatcaagacagaca

SEQ ID NO: 7417451 - DNA, 17 bp, Homo sapiens
aacagtaagccctgttt

SEQ ID NO: 7417452 - DNA, 22 bp, Homo sapiens
aacagtaacgagatgtcctaac

SEQ ID NO: 7417453 - DNA, 22 bp, Homo sapiens
aacagtaagagatgttttatct

SEQ ID NO: 7417454 - DNA, 22 bp, Homo sapiens
aacagtaacgagatgtcctaac

SEQ ID NO: 7417455 - DNA, 22 bp, Homo sapiens
aagtgctgggattataggcatg

SEQ ID NO: 7417456 - DNA, 22 bp, Homo sapiens
aagtgctgtttctgatgaatgc

SEQ ID NO: 7417457 - DNA, 22 bp, Homo sapiens
aagtgctgtacagtgtgtaaat

SEQ ID NO: 7417458 - DNA, 22 bp, Homo sapiens
aagtgctgggattacaggtgtc

SEQ ID NO: 7417459 - DNA, 22 bp, Homo sapiens
aagtgctgggattacaggtgtg

SEQ ID NO: 7417460 - DNA, 23 bp, Homo sapiens
aagtgctatgtttataagagctg

SEQ ID NO: 7417461 - DNA, 22 bp, Homo sapiens
aagtgctgaatgaagacacaaa

SEQ ID NO: 7417462 - DNA, 22 bp, Homo sapiens
aagtgctgagactacaggcatg

SEQ ID NO: 7417463 - DNA, 22 bp, Homo sapiens
aagtgctgagactacaggcatg

SEQ ID NO: 7417464 - DNA, 22 bp, Homo sapiens
aagtgctgggattacaggcatg

SEQ ID NO: 7417465 - DNA, 22 bp, Homo sapiens
aagtgctgggattacaggcatg

SEQ ID NO: 7417466 - DNA, 22 bp, Homo sapiens
aagtcttttgctaagagtaatg

SEQ ID NO: 7417467 - DNA, 22 bp, Homo sapiens
aagtcttttgctaagagtaatg

SEQ ID NO: 7417468 - DNA, 22 bp, Homo sapiens
aagtcttttgctaagagtaatg

SEQ ID NO: 7417469 - DNA, 22 bp, Homo sapiens
aagtcttttgctaagagtaatg

SEQ ID NO: 7417470 - DNA, 22 bp, Homo sapiens
aagtcttttgctgtcataggtg

SEQ ID NO: 7417471 - DNA, 22 bp, Homo sapiens
aagtcttttgctgtcataggtg

SEQ ID NO: 7417472 - DNA, 22 bp, Homo sapiens
aagtcttttgttcaggctggca

SEQ ID NO: 7417473 - DNA, 22 bp, Homo sapiens
aagtcttttgttcaggctggca

SEQ ID NO: 7417474 - DNA, 22 bp, Homo sapiens
aagtctttcataagtctcttat

SEQ ID NO: 7417475 - DNA, 22 bp, Homo sapiens
aagtcttgtctaaggtctctaa

SEQ ID NO: 7417476 - DNA, 22 bp, Homo sapiens
aagtctttcataagtctcttat

SEQ ID NO: 7417477 - DNA, 22 bp, Homo sapiens
aagtctttcataagtctcttat

SEQ ID NO: 7417478 - DNA, 18 bp, Homo sapiens
aagtcttggaatttccac

SEQ ID NO: 7417479 - DNA, 18 bp, Homo sapiens
aagtcttggaatttccac

SEQ ID NO: 7417480 - DNA, 22 bp, Homo sapiens
aagtcttggtagagaaggactt

SEQ ID NO: 7417481 - DNA, 22 bp, Homo sapiens
aagtcttaggcattttatttct

SEQ ID NO: 7417482 - DNA, 22 bp, Homo sapiens
aagtcttaggaaatagcaaaga

SEQ ID NO: 7417483 - DNA, 22 bp, Homo sapiens
aagtcttatttgtcatgtatgt

SEQ ID NO: 7417484 - DNA, 22 bp, Homo sapiens
aagtcttaggcattttatttct

SEQ ID NO: 7417485 - DNA, 22 bp, Homo sapiens
aagtcttgatgatctcctcctt

SEQ ID NO: 7417486 - DNA, 22 bp, Homo sapiens
aagtcttacataatagtttgga

SEQ ID NO: 7417487 - DNA, 22 bp, Homo sapiens
aagtcttagcaactatcgcttt

SEQ ID NO: 7417488 - DNA, 22 bp, Homo sapiens
aagtcttacagacaagctgaag

SEQ ID NO: 7417489 - DNA, 22 bp, Homo sapiens
aagtcttacataaacaggaaat

SEQ ID NO: 7417490 - DNA, 22 bp, Homo sapiens
aagtcttacataaacaggaaat

SEQ ID NO: 7417491 - DNA, 22 bp, Homo sapiens
aagtcttacataatagtttgga

SEQ ID NO: 7417492 - DNA, 22 bp, Homo sapiens
aagtcttacataatagtttgga

SEQ ID NO: 7417493 - DNA, 22 bp, Homo sapiens
aagtctggtgctgtcctcaccc

SEQ ID NO: 7417494 - DNA, 22 bp, Homo sapiens
aagtctggtgctgtcctcaccc

SEQ ID NO: 7417495 - DNA, 22 bp, Homo sapiens
aagtctggtgctgtcctcaccc

SEQ ID NO: 7417496 - DNA, 21 bp, Homo sapiens
aagtctggttgattcctttgc

SEQ ID NO: 7417497 - DNA, 21 bp, Homo sapiens
aagtctggttgattcctttgc

SEQ ID NO: 7417498 - DNA, 21 bp, Homo sapiens
aagtctggttgattcctttgc

SEQ ID NO: 7417499 - DNA, 22 bp, Homo sapiens
aagtctgtagaaaaacagttta

SEQ ID NO: 7417500 - DNA, 22 bp, Homo sapiens
aagtcttaaccaaataaatgtt

SEQ ID NO: 7417501 - DNA, 22 bp, Homo sapiens
aagtctgtttgagtgtcacact

SEQ ID NO: 7417502 - DNA, 22 bp, Homo sapiens
aagtctgtagaaaaacagttta

SEQ ID NO: 7417503 - DNA, 22 bp, Homo sapiens
aagtctgtagaaaaacagttta

SEQ ID NO: 7417504 - DNA, 22 bp, Homo sapiens
aagtcttaaccaaataaatgtt

SEQ ID NO: 7417505 - DNA, 22 bp, Homo sapiens
aagtcttaaccaaataaatgtt

SEQ ID NO: 7417506 - DNA, 22 bp, Homo sapiens
aagtctgggcctccttcccaga

SEQ ID NO: 7417507 - DNA, 22 bp, Homo sapiens
aagtctgggcctccttcccaga

SEQ ID NO: 7417508 - DNA, 22 bp, Homo sapiens
aagtctgggccagggcacagcc

SEQ ID NO: 7417509 - DNA, 22 bp, Homo sapiens
aagtctgggcctccttcccaga

SEQ ID NO: 7417510 - DNA, 22 bp, Homo sapiens
aagtctgggccagggcacagcc

SEQ ID NO: 7417511 - DNA, 22 bp, Homo sapiens
aagtctgggccagggcacagcc

SEQ ID NO: 7417512 - DNA, 22 bp, Homo sapiens
aagtctggaacctcatgctggc

SEQ ID NO: 7417513 - DNA, 22 bp, Homo sapiens
aagtctggaacctcatgctggc

SEQ ID NO: 7417514 - DNA, 22 bp, Homo sapiens
aagtctgatcatttcttctata

SEQ ID NO: 7417515 - DNA, 22 bp, Homo sapiens
aagtctgcctaaccttcatgtt

SEQ ID NO: 7417516 - DNA, 22 bp, Homo sapiens
aagtctggaagtctcagttttc

SEQ ID NO: 7417517 - DNA, 18 bp, Homo sapiens
aagtctggcagctttccc

SEQ ID NO: 7417518 - DNA, 18 bp, Homo sapiens
aagtctggcagctttccc

SEQ ID NO: 7417519 - DNA, 22 bp, Homo sapiens
aagtgcatcactactcattaca

SEQ ID NO: 7417520 - DNA, 22 bp, Homo sapiens
aagtgcatcactactcattaca

SEQ ID NO: 7417521 - DNA, 22 bp, Homo sapiens
aagtgcatatttttgttgtaga

SEQ ID NO: 7417522 - DNA, 22 bp, Homo sapiens
aagtgaaacatgtatctcttta

SEQ ID NO: 7417523 - DNA, 22 bp, Homo sapiens
aagtgcattagatagaatgatg

SEQ ID NO: 7417524 - DNA, 22 bp, Homo sapiens
aagtgcattagatagaatgatg

SEQ ID NO: 7417525 - DNA, 22 bp, Homo sapiens
aagtgcatggtatggtctccat

SEQ ID NO: 7417526 - DNA, 22 bp, Homo sapiens
aagtgaaacatgtatctcttta

SEQ ID NO: 7417527 - DNA, 22 bp, Homo sapiens
aagtgaaacatgtatctcttta

SEQ ID NO: 7417528 - DNA, 22 bp, Homo sapiens
aagtctttttgaatctataact

SEQ ID NO: 7417529 - DNA, 22 bp, Homo sapiens
aagtctttttgaatctataact

SEQ ID NO: 7417530 - DNA, 22 bp, Homo sapiens
aagtctttttgaatctataact

SEQ ID NO: 7417531 - DNA, 22 bp, Homo sapiens
aagtctttttgaatctataact

SEQ ID NO: 7417532 - DNA, 22 bp, Homo sapiens
aagtctttttgaatctataact

SEQ ID NO: 7417533 - DNA, 22 bp, Homo sapiens
aagtgccatcatagcatggctg

SEQ ID NO: 7417534 - DNA, 22 bp, Homo sapiens
aagtgcccagtgaagcagtggt

SEQ ID NO: 7417535 - DNA, 22 bp, Homo sapiens
aagtgccagtttctggcttcct

SEQ ID NO: 7417536 - DNA, 22 bp, Homo sapiens
aagtgcattagatagaatgatg

SEQ ID NO: 7417537 - DNA, 22 bp, Homo sapiens
aagtgcattagatagaatgatg

SEQ ID NO: 7417538 - DNA, 21 bp, Homo sapiens
aagtgccacccacagatgcat

SEQ ID NO: 7417539 - DNA, 21 bp, Homo sapiens
aagtgccacccacagatgcat

SEQ ID NO: 7417540 - DNA, 22 bp, Homo sapiens
aagtgccagggacacttcttgt

SEQ ID NO: 7417541 - DNA, 22 bp, Homo sapiens
aagtgctaggattacaggtgtg

SEQ ID NO: 7417542 - DNA, 22 bp, Homo sapiens
aagtgctagaaccccagcaaca

SEQ ID NO: 7417543 - DNA, 22 bp, Homo sapiens
aagtgctaggattacaggtgtg

SEQ ID NO: 7417544 - DNA, 22 bp, Homo sapiens
aagtgctaggattacaggtgtg

SEQ ID NO: 7417545 - DNA, 23 bp, Homo sapiens
aagtgctaagtactgtaatcatc

SEQ ID NO: 7417546 - DNA, 21 bp, Homo sapiens
aagtgctaatggttgcaacag

SEQ ID NO: 7417547 - DNA, 23 bp, Homo sapiens
aagtgctaccaaaagaattcctc

SEQ ID NO: 7417548 - DNA, 22 bp, Homo sapiens
aagtgctaaatgttttagttaa

SEQ ID NO: 7417549 - DNA, 22 bp, Homo sapiens
aagtgctaaatgttttagttaa

SEQ ID NO: 7417550 - DNA, 22 bp, Homo sapiens
aagtgctaaccacaatccacag

SEQ ID NO: 7417551 - DNA, 22 bp, Homo sapiens
aagtgcctgacctagcctggag

SEQ ID NO: 7417552 - DNA, 22 bp, Homo sapiens
aagtgcctgggcaacatagcaa

SEQ ID NO: 7417553 - DNA, 22 bp, Homo sapiens
aagtgcctgggcaacatagcaa

SEQ ID NO: 7417554 - DNA, 22 bp, Homo sapiens
aagtgcctgggcaacatagcaa

SEQ ID NO: 7417555 - DNA, 22 bp, Homo sapiens
aagggcagggagtttgtgtcta

SEQ ID NO: 7417556 - DNA, 22 bp, Homo sapiens
aagggcagggagtttgtgtcta

SEQ ID NO: 7417557 - DNA, 22 bp, Homo sapiens
aagggcagggagtttgtgtcta

SEQ ID NO: 7417558 - DNA, 22 bp, Homo sapiens
aagggcaggcagagatcatata

SEQ ID NO: 7417559 - DNA, 22 bp, Homo sapiens
aagggcaggtgggcatttctgg

SEQ ID NO: 7417560 - DNA, 22 bp, Homo sapiens
aagggcagggagtttgtgtcta

SEQ ID NO: 7417561 - DNA, 22 bp, Homo sapiens
aagggcaggtgggcatttctgg

SEQ ID NO: 7417562 - DNA, 22 bp, Homo sapiens
aagggcaggtgggcatttctgg

SEQ ID NO: 7417563 - DNA, 22 bp, Homo sapiens
aagggcagggagtttgtgtcta

SEQ ID NO: 7417564 - DNA, 22 bp, Homo sapiens
aagggcagggagtttgtgtcta

SEQ ID NO: 7417565 - DNA, 22 bp, Homo sapiens
aagggctgcatttgatgtgtca

SEQ ID NO: 7417566 - DNA, 22 bp, Homo sapiens
aagggctgcatttgatgtgtca

SEQ ID NO: 7417567 - DNA, 22 bp, Homo sapiens
aagggctgcatttgatgtgtca

SEQ ID NO: 7417568 - DNA, 22 bp, Homo sapiens
aagggcaggtgggcatttctgg

SEQ ID NO: 7417569 - DNA, 22 bp, Homo sapiens
aagggctgcatttgatgtgtca

SEQ ID NO: 7417570 - DNA, 22 bp, Homo sapiens
aagggctgcatttgatgtgtca

SEQ ID NO: 7417571 - DNA, 22 bp, Homo sapiens
aagggctgcaatccaaaacact

SEQ ID NO: 7417572 - DNA, 22 bp, Homo sapiens
aagggctgcaatccaaaacact

SEQ ID NO: 7417573 - DNA, 22 bp, Homo sapiens
aagggctgcaatccaaaacact

SEQ ID NO: 7417574 - DNA, 22 bp, Homo sapiens
aagggctggaatatctcttaga

SEQ ID NO: 7417575 - DNA, 22 bp, Homo sapiens
aagggctgctgtagaagcagag

SEQ ID NO: 7417576 - DNA, 22 bp, Homo sapiens
aagggctgctgtagaagcagag

SEQ ID NO: 7417577 - DNA, 22 bp, Homo sapiens
aagggctgctgtagaagcagag

SEQ ID NO: 7417578 - DNA, 22 bp, Homo sapiens
aagggctgctgtagaagcagag

SEQ ID NO: 7417579 - DNA, 22 bp, Homo sapiens
aagggctgctgtagaagcagag

SEQ ID NO: 7417580 - DNA, 22 bp, Homo sapiens
aagggctgctgtagaagcagag

SEQ ID NO: 7417581 - DNA, 22 bp, Homo sapiens
aagggctgctgtagaagcagag

SEQ ID NO: 7417582 - DNA, 22 bp, Homo sapiens
aagggctgctgtagaagcagag

SEQ ID NO: 7417583 - DNA, 22 bp, Homo sapiens
aagggctgctgtagaagcagag

SEQ ID NO: 7417584 - DNA, 22 bp, Homo sapiens
aagggctgccagggggtgccag

SEQ ID NO: 7417585 - DNA, 22 bp, Homo sapiens
aagggctgcatttgatgtgtca

SEQ ID NO: 7417586 - DNA, 22 bp, Homo sapiens
aagggctgccagggggtgccag

SEQ ID NO: 7417587 - DNA, 22 bp, Homo sapiens
aagggctgccagggggtgccag

SEQ ID NO: 7417588 - DNA, 22 bp, Homo sapiens
aagggctgccagggggtgccag

SEQ ID NO: 7417589 - DNA, 22 bp, Homo sapiens
aagggctgccagggggtgccag

SEQ ID NO: 7417590 - DNA, 22 bp, Homo sapiens
aagggctgccagggggtgccag

SEQ ID NO: 7417591 - DNA, 22 bp, Homo sapiens
aagggctgccagggggtgccag

SEQ ID NO: 7417592 - DNA, 22 bp, Homo sapiens
aagggctggaatatctcttaga

SEQ ID NO: 7417593 - DNA, 22 bp, Homo sapiens
aagggctggaatatctcttaga

SEQ ID NO: 7417594 - DNA, 22 bp, Homo sapiens
aagggctggaatatctcttaga

SEQ ID NO: 7417595 - DNA, 22 bp, Homo sapiens
aagggctggaatatctcttaga

SEQ ID NO: 7417596 - DNA, 22 bp, Homo sapiens
aagggctgctgtagaagcagag

SEQ ID NO: 7417597 - DNA, 22 bp, Homo sapiens
aagggctggaatatctcttaga

SEQ ID NO: 7417598 - DNA, 21 bp, Homo sapiens
aaggtctgtaaagtgacagga

SEQ ID NO: 7417599 - DNA, 22 bp, Homo sapiens
aaggtgtcggcagagccgcttc

SEQ ID NO: 7417600 - DNA, 22 bp, Homo sapiens
aaggtgtcgggttagctcagcc

SEQ ID NO: 7417601 - DNA, 22 bp, Homo sapiens
aaggtgtcggcagagccgcttc

SEQ ID NO: 7417602 - DNA, 22 bp, Homo sapiens
aaggtgtcgggttagctcagcc

SEQ ID NO: 7417603 - DNA, 22 bp, Homo sapiens
aaggtgtgaagagatgggaaga

SEQ ID NO: 7417604 - DNA, 22 bp, Homo sapiens
aaggtgtgaactgattcattgg

SEQ ID NO: 7417605 - DNA, 22 bp, Homo sapiens
aaggtgtgagacatcctgccat

SEQ ID NO: 7417606 - DNA, 22 bp, Homo sapiens
aaggtgttcaggttttcccatt

SEQ ID NO: 7417607 - DNA, 22 bp, Homo sapiens
aaggtgttatagctgaggaata

SEQ ID NO: 7417608 - DNA, 22 bp, Homo sapiens
aaggttactcagaataacttcc

SEQ ID NO: 7417609 - DNA, 22 bp, Homo sapiens
aaggttactcagaataacttcc

SEQ ID NO: 7417610 - DNA, 23 bp, Homo sapiens
aaggtgtttgttttcagaaagca

SEQ ID NO: 7417611 - DNA, 22 bp, Homo sapiens
aaggttaaataggtattttcca

SEQ ID NO: 7417612 - DNA, 22 bp, Homo sapiens
aaggttaaataggtattttcca

SEQ ID NO: 7417613 - DNA, 22 bp, Homo sapiens
aaggtgttcaggttttcccatt

SEQ ID NO: 7417614 - DNA, 22 bp, Homo sapiens
aaggtgttcttcagtagaggtc

SEQ ID NO: 7417615 - DNA, 22 bp, Homo sapiens
aagtaacatctgaacatgatgt

SEQ ID NO: 7417616 - DNA, 22 bp, Homo sapiens
aagtaacatctgaacatgatgt

SEQ ID NO: 7417617 - DNA, 22 bp, Homo sapiens
aagtaacatctgaacatgatgt

SEQ ID NO: 7417618 - DNA, 22 bp, Homo sapiens
aagtaacatctgaacatgatgt

SEQ ID NO: 7417619 - DNA, 22 bp, Homo sapiens
aagtaacaggtgcttagtttat

SEQ ID NO: 7417620 - DNA, 22 bp, Homo sapiens
aagtaacaggtgcttagtttat

SEQ ID NO: 7417621 - DNA, 22 bp, Homo sapiens
aagtaacaggtgcttagtttat

SEQ ID NO: 7417622 - DNA, 23 bp, Homo sapiens
aagtaacagggataatagcagtt

SEQ ID NO: 7417623 - DNA, 22 bp, Homo sapiens
aagtaacaggtgcttagtttat

SEQ ID NO: 7417624 - DNA, 22 bp, Homo sapiens
aagtaacatctgaacatgatgt

SEQ ID NO: 7417625 - DNA, 22 bp, Homo sapiens
aagtaacatctgaacatgatgt

SEQ ID NO: 7417626 - DNA, 22 bp, Homo sapiens
aagtaacatctgaacatgatgt

SEQ ID NO: 7417627 - DNA, 22 bp, Homo sapiens
aagtaacatctgaacatgatgt

SEQ ID NO: 7417628 - DNA, 22 bp, Homo sapiens
aagtaaggcagtgaatgagatt

SEQ ID NO: 7417629 - DNA, 22 bp, Homo sapiens
aagtaacttatttgcaaacagg

SEQ ID NO: 7417630 - DNA, 22 bp, Homo sapiens
aagtaacttatttgcaaacagg

SEQ ID NO: 7417631 - DNA, 22 bp, Homo sapiens
aagtaaggccttcttgagcatg

SEQ ID NO: 7417632 - DNA, 22 bp, Homo sapiens
aagtaagtgccttttattctta

SEQ ID NO: 7417633 - DNA, 22 bp, Homo sapiens
aagtaagtggctattagctgtg

SEQ ID NO: 7417634 - DNA, 22 bp, Homo sapiens
aagtaagtcttacattcacatt

SEQ ID NO: 7417635 - DNA, 22 bp, Homo sapiens
aagtaagtcttacattcacatt

SEQ ID NO: 7417636 - DNA, 22 bp, Homo sapiens
aagtaacatgggaacatctgaa

SEQ ID NO: 7417637 - DNA, 22 bp, Homo sapiens
aagtaacatctgaacatgatgt

SEQ ID NO: 7417638 - DNA, 22 bp, Homo sapiens
aagtaacatgggaacatctgaa

SEQ ID NO: 7417639 - DNA, 22 bp, Homo sapiens
aagtaacatctgaacatgatgt

SEQ ID NO: 7417640 - DNA, 22 bp, Homo sapiens
aagtaacatctgaacatgatgt

SEQ ID NO: 7417641 - DNA, 22 bp, Homo sapiens
aagtaacatgggaacatctgaa

SEQ ID NO: 7417642 - DNA, 22 bp, Homo sapiens
aagtaacatgggaacatctgaa

SEQ ID NO: 7417643 - DNA, 22 bp, Homo sapiens
aagtaacatgggaacatctgaa

SEQ ID NO: 7417644 - DNA, 22 bp, Homo sapiens
aagtaactaaagatatccattt

SEQ ID NO: 7417645 - DNA, 22 bp, Homo sapiens
aagtccagtgatactggcagga

SEQ ID NO: 7417646 - DNA, 22 bp, Homo sapiens
aagtctgagtgtcagtgcaagt

SEQ ID NO: 7417647 - DNA, 22 bp, Homo sapiens
aagtctgatcatttcttctata

SEQ ID NO: 7417648 - DNA, 22 bp, Homo sapiens
aagtctgatcatttcttctata

SEQ ID NO: 7417649 - DNA, 22 bp, Homo sapiens
aagtctgagtgtcagtgcaagt

SEQ ID NO: 7417650 - DNA, 22 bp, Homo sapiens
aagtctgagagaaactctctca

SEQ ID NO: 7417651 - DNA, 22 bp, Homo sapiens
aagtctgagtgtcagtgcaagt

SEQ ID NO: 7417652 - DNA, 22 bp, Homo sapiens
aagtctgagtgtcagtgcaagt

SEQ ID NO: 7417653 - DNA, 22 bp, Homo sapiens
aagtacaacgcatacagagaaa

SEQ ID NO: 7417654 - DNA, 22 bp, Homo sapiens
aagtacaacgcatacagagaaa

SEQ ID NO: 7417655 - DNA, 22 bp, Homo sapiens
aagtacaatctttctgtaaagg

SEQ ID NO: 7417656 - DNA, 22 bp, Homo sapiens
aagtacaatctttctgtaaagg

SEQ ID NO: 7417657 - DNA, 22 bp, Homo sapiens
aagtacaatctttctgtaaagg

SEQ ID NO: 7417658 - DNA, 22 bp, Homo sapiens
aagtccagtatgagaaacctgc

SEQ ID NO: 7417659 - DNA, 22 bp, Homo sapiens
aagtccagtatttctagatctt

SEQ ID NO: 7417660 - DNA, 22 bp, Homo sapiens
aagtccagtatttctagatctt

SEQ ID NO: 7417661 - DNA, 22 bp, Homo sapiens
aagtacaacgcatacagagaaa

SEQ ID NO: 7417662 - DNA, 22 bp, Homo sapiens
aagtacaacgcatacagagaaa

SEQ ID NO: 7417663 - DNA, 22 bp, Homo sapiens
aagtacaacgcatacagagaaa

SEQ ID NO: 7417664 - DNA, 22 bp, Homo sapiens
aagtacaacgcatacagagaaa

SEQ ID NO: 7417665 - DNA, 22 bp, Homo sapiens
aagtacaacgcatacagagaaa

SEQ ID NO: 7417666 - DNA, 22 bp, Homo sapiens
aagtacaacgcatacagagaaa

SEQ ID NO: 7417667 - DNA, 22 bp, Homo sapiens
aagtacaacgcatacagagaaa

SEQ ID NO: 7417668 - DNA, 22 bp, Homo sapiens
aagtacaaattttgaagagctt

SEQ ID NO: 7417669 - DNA, 22 bp, Homo sapiens
aagtacaaattttgaagagctt

SEQ ID NO: 7417670 - DNA, 20 bp, Homo sapiens
aagtaatatttgtgtaactg

SEQ ID NO: 7417671 - DNA, 20 bp, Homo sapiens
aagtaatatttgtgtaactg

SEQ ID NO: 7417672 - DNA, 22 bp, Homo sapiens
aagtaatataattgttgttgtt

SEQ ID NO: 7417673 - DNA, 22 bp, Homo sapiens
aagtaatataattgttgttgtt

SEQ ID NO: 7417674 - DNA, 22 bp, Homo sapiens
aagtaatatctggcaccaggaa

SEQ ID NO: 7417675 - DNA, 22 bp, Homo sapiens
aagtaatatctggcaccaggaa

SEQ ID NO: 7417676 - DNA, 22 bp, Homo sapiens
aagtaatggttaaataattcta

SEQ ID NO: 7417677 - DNA, 22 bp, Homo sapiens
aagtaatgatgtcatcacagag

SEQ ID NO: 7417678 - DNA, 22 bp, Homo sapiens
aagtaatctggaatttggtttt

SEQ ID NO: 7417679 - DNA, 22 bp, Homo sapiens
aagtaatggttaaataattcta

SEQ ID NO: 7417680 - DNA, 21 bp, Homo sapiens
aagtaatgtgtctcttctacc

SEQ ID NO: 7417681 - DNA, 22 bp, Homo sapiens
aaaagcaagttgcctaggttga

SEQ ID NO: 7417682 - DNA, 22 bp, Homo sapiens
aaaagcaagttgcctaggttga

SEQ ID NO: 7417683 - DNA, 22 bp, Homo sapiens
aaaagcaagttgcctaggttga

SEQ ID NO: 7417684 - DNA, 22 bp, Homo sapiens
aaaagcaagttgcctaggttga

SEQ ID NO: 7417685 - DNA, 22 bp, Homo sapiens
aaaagcaagttgcctaggttga

SEQ ID NO: 7417686 - DNA, 22 bp, Homo sapiens
aaaagcaaggcagtctgtctga

SEQ ID NO: 7417687 - DNA, 22 bp, Homo sapiens
aaaagcaaggcagtctgtctga

SEQ ID NO: 7417688 - DNA, 22 bp, Homo sapiens
aaaagcaaggcagtctgtctga

SEQ ID NO: 7417689 - DNA, 22 bp, Homo sapiens
aaaagcaaggcagtctgtctga

SEQ ID NO: 7417690 - DNA, 22 bp, Homo sapiens
aaaagcaaggcagtctgtctga

SEQ ID NO: 7417691 - DNA, 22 bp, Homo sapiens
aaaagcaaggcagtctgtctga

SEQ ID NO: 7417692 - DNA, 22 bp, Homo sapiens
aaaagcaaggcagtctgtctga

SEQ ID NO: 7417693 - DNA, 22 bp, Homo sapiens
aaaagcaaggcagtctgtctga

SEQ ID NO: 7417694 - DNA, 22 bp, Homo sapiens
aaaagcaaggcagtctgtctga

SEQ ID NO: 7417695 - DNA, 22 bp, Homo sapiens
aaaagcaaggcagtctgtctga

SEQ ID NO: 7417696 - DNA, 22 bp, Homo sapiens
aaaagcaagaggctggattaaa

SEQ ID NO: 7417697 - DNA, 22 bp, Homo sapiens
aaaagcaagaggctggattaaa

SEQ ID NO: 7417698 - DNA, 22 bp, Homo sapiens
aaaagcaagaggctggattaaa

SEQ ID NO: 7417699 - DNA, 20 bp, Homo sapiens
aaaagagtgcttcaactgct

SEQ ID NO: 7417700 - DNA, 22 bp, Homo sapiens
aaaagagtgtttcaactttggc

SEQ ID NO: 7417701 - DNA, 22 bp, Homo sapiens
aaaagagtgtttcaactttggc

SEQ ID NO: 7417702 - DNA, 22 bp, Homo sapiens
aaaagagtgtttcaactttggc

SEQ ID NO: 7417703 - DNA, 22 bp, Homo sapiens
aaaagagtgactgataagtata

SEQ ID NO: 7417704 - DNA, 20 bp, Homo sapiens
aaaagagtgcttcaactgct

SEQ ID NO: 7417705 - DNA, 20 bp, Homo sapiens
aaaagagtgcttcaactgct

SEQ ID NO: 7417706 - DNA, 22 bp, Homo sapiens
aaaagatgaaatggtgtcttgg

SEQ ID NO: 7417707 - DNA, 22 bp, Homo sapiens
aaaagagtgtttcaactttggc

SEQ ID NO: 7417708 - DNA, 22 bp, Homo sapiens
aaaagagtgtttcaactttggc

SEQ ID NO: 7417709 - DNA, 22 bp, Homo sapiens
aaaagcaagaggctggattaaa

SEQ ID NO: 7417710 - DNA, 22 bp, Homo sapiens
aaaagcaagaggctggattaaa

SEQ ID NO: 7417711 - DNA, 22 bp, Homo sapiens
aaaagcaagaggctggattaaa

SEQ ID NO: 7417712 - DNA, 22 bp, Homo sapiens
aaaagcaagaggctggattaaa

SEQ ID NO: 7417713 - DNA, 22 bp, Homo sapiens
aaaagcaagaggctggattaaa

SEQ ID NO: 7417714 - DNA, 22 bp, Homo sapiens
aaaagattgttagggagaatgt

SEQ ID NO: 7417715 - DNA, 22 bp, Homo sapiens
aaaagcaagaggctggattaaa

SEQ ID NO: 7417716 - DNA, 22 bp, Homo sapiens
aaaagcaagaggctggattaaa

SEQ ID NO: 7417717 - DNA, 22 bp, Homo sapiens
aaaagattgttagggagaatgt

SEQ ID NO: 7417718 - DNA, 22 bp, Homo sapiens
aaaagattgttagggagaatgt

SEQ ID NO: 7417719 - DNA, 22 bp, Homo sapiens
aaaaatgttatctactgtccga

SEQ ID NO: 7417720 - DNA, 22 bp, Homo sapiens
aaaaatgttatctactgtccga

SEQ ID NO: 7417721 - DNA, 22 bp, Homo sapiens
aaaaatgttatctactgtccga

SEQ ID NO: 7417722 - DNA, 22 bp, Homo sapiens
aaaaatgttatctactgtccga

SEQ ID NO: 7417723 - DNA, 22 bp, Homo sapiens
aaaaatgttatctactgtccga

SEQ ID NO: 7417724 - DNA, 22 bp, Homo sapiens
aaaaatgttatctactgtccga

SEQ ID NO: 7417725 - DNA, 22 bp, Homo sapiens
aaaaatgttatctactgtccga

SEQ ID NO: 7417726 - DNA, 22 bp, Homo sapiens
aaaaatgttatctactgtccga

SEQ ID NO: 7417727 - DNA, 22 bp, Homo sapiens
aaaaatgtgaccacagggtgtt

SEQ ID NO: 7417728 - DNA, 22 bp, Homo sapiens
aaaaatgtgaccacagggtgtt

SEQ ID NO: 7417729 - DNA, 22 bp, Homo sapiens
aaaaatgaaacggctggttggc

SEQ ID NO: 7417730 - DNA, 22 bp, Homo sapiens
aaaaatgtgaccacagggtgtt

SEQ ID NO: 7417731 - DNA, 22 bp, Homo sapiens
aaaaatgtgaccacagggtgtt

SEQ ID NO: 7417732 - DNA, 22 bp, Homo sapiens
aaaaatgaaacggctggttggc

SEQ ID NO: 7417733 - DNA, 22 bp, Homo sapiens
aaaaatgaaacggctggttggc

SEQ ID NO: 7417734 - DNA, 22 bp, Homo sapiens
aaaaatctatgactgcttctcc

SEQ ID NO: 7417735 - DNA, 22 bp, Homo sapiens
aaaaatgaaacggctggttggc

SEQ ID NO: 7417736 - DNA, 22 bp, Homo sapiens
aaaaatgaaacggctggttggc

SEQ ID NO: 7417737 - DNA, 22 bp, Homo sapiens
aaaacacaagaagcagggtaca

SEQ ID NO: 7417738 - DNA, 22 bp, Homo sapiens
aaaacacaagaagcagggtaca

SEQ ID NO: 7417739 - DNA, 22 bp, Homo sapiens
aaaacacaagaagcagggtaca

SEQ ID NO: 7417740 - DNA, 22 bp, Homo sapiens
aaaacacaagaagcagggtaca

SEQ ID NO: 7417741 - DNA, 22 bp, Homo sapiens
aaaacacaagaagcagggtaca

SEQ ID NO: 7417742 - DNA, 22 bp, Homo sapiens
aaaacacaagaagcagggtaca

SEQ ID NO: 7417743 - DNA, 22 bp, Homo sapiens
aaaacacaagaagcagggtaca

SEQ ID NO: 7417744 - DNA, 22 bp, Homo sapiens
aaaaatttatggttcttctctg

SEQ ID NO: 7417745 - DNA, 22 bp, Homo sapiens
aaaaatttatggttcttctctg

SEQ ID NO: 7417746 - DNA, 22 bp, Homo sapiens
aaaaatttatggttcttctctg

SEQ ID NO: 7417747 - DNA, 22 bp, Homo sapiens
aaaaatttatggttcttctctg

SEQ ID NO: 7417748 - DNA, 22 bp, Homo sapiens
aaaaatttatggttcttctctg

SEQ ID NO: 7417749 - DNA, 22 bp, Homo sapiens
aaaaatttatggttcttctctg

SEQ ID NO: 7417750 - DNA, 22 bp, Homo sapiens
aaaaattgctgagaacggaatt

SEQ ID NO: 7417751 - DNA, 22 bp, Homo sapiens
aaaaattgctgagaacggaatt

SEQ ID NO: 7417752 - DNA, 22 bp, Homo sapiens
aaaaattgctgagaacggaatt

SEQ ID NO: 7417753 - DNA, 22 bp, Homo sapiens
aaaaattgctgagaacggaatt

SEQ ID NO: 7417754 - DNA, 20 bp, Homo sapiens
aaaaattgatatcgcttcct

SEQ ID NO: 7417755 - DNA, 20 bp, Homo sapiens
aaaaattgatatcgcttcct

SEQ ID NO: 7417756 - DNA, 22 bp, Homo sapiens
aaaacattttactgccatctca

SEQ ID NO: 7417757 - DNA, 22 bp, Homo sapiens
aaaacattttactgccatctca

SEQ ID NO: 7417758 - DNA, 22 bp, Homo sapiens
aaaacattttactgccatctca

SEQ ID NO: 7417759 - DNA, 22 bp, Homo sapiens
aaaaccaagttttccttagtct

SEQ ID NO: 7417760 - DNA, 22 bp, Homo sapiens
aaaaccaagttttccttagtct

SEQ ID NO: 7417761 - DNA, 22 bp, Homo sapiens
aaaacattttactgccatctca

SEQ ID NO: 7417762 - DNA, 22 bp, Homo sapiens
aaaacattgaattgcacactat

SEQ ID NO: 7417763 - DNA, 22 bp, Homo sapiens
aaaacattgaattgcacactat

SEQ ID NO: 7417764 - DNA, 22 bp, Homo sapiens
aaaacattgaattgcacactat

SEQ ID NO: 7417765 - DNA, 22 bp, Homo sapiens
aaaacattgaattgcacactat

SEQ ID NO: 7417766 - DNA, 22 bp, Homo sapiens
aaaacattgaattgcacactat

SEQ ID NO: 7417767 - DNA, 22 bp, Homo sapiens
aaaacattgaattgcacactat

SEQ ID NO: 7417768 - DNA, 22 bp, Homo sapiens
aaaacattgaattgcacactat

SEQ ID NO: 7417769 - DNA, 22 bp, Homo sapiens
aaaacattgaattgcacactat

SEQ ID NO: 7417770 - DNA, 22 bp, Homo sapiens
aaaacattctgtgaactctcaa

SEQ ID NO: 7417771 - DNA, 22 bp, Homo sapiens
aaaacattctgtgaactctcaa

SEQ ID NO: 7417772 - DNA, 22 bp, Homo sapiens
aaaacatgtccatacagaaact

SEQ ID NO: 7417773 - DNA, 22 bp, Homo sapiens
aaaacatgtccatacagaaact

SEQ ID NO: 7417774 - DNA, 22 bp, Homo sapiens
aaaacatgtccatacagaaact

SEQ ID NO: 7417775 - DNA, 22 bp, Homo sapiens
aaaacatgtccatacagaaact

SEQ ID NO: 7417776 - DNA, 22 bp, Homo sapiens
aaaacatgtccatacagaaact

SEQ ID NO: 7417777 - DNA, 22 bp, Homo sapiens
aaaacatgtccatacagaaact

SEQ ID NO: 7417778 - DNA, 22 bp, Homo sapiens
aaaacatgtccatacagaaact

SEQ ID NO: 7417779 - DNA, 22 bp, Homo sapiens
aaaacatgtccatacagaaact

SEQ ID NO: 7417780 - DNA, 22 bp, Homo sapiens
aaaacatgtccatacagaaact

SEQ ID NO: 7417781 - DNA, 22 bp, Homo sapiens
aaaacatgtccatacagaaact

SEQ ID NO: 7417782 - DNA, 22 bp, Homo sapiens
aaaacattctgtgaactctcaa

SEQ ID NO: 7417783 - DNA, 22 bp, Homo sapiens
aaaacattctgtgaactctcaa

SEQ ID NO: 7417784 - DNA, 22 bp, Homo sapiens
aaaacattctgtgaactctcaa

SEQ ID NO: 7417785 - DNA, 22 bp, Homo sapiens
aaaacattctgtgaactctcaa

SEQ ID NO: 7417786 - DNA, 22 bp, Homo sapiens
aaaacatgtccatacagaaact

SEQ ID NO: 7417787 - DNA, 22 bp, Homo sapiens
aaaacatgtccatacagaaact

SEQ ID NO: 7417788 - DNA, 22 bp, Homo sapiens
aaaacatgtccatacagaaact

SEQ ID NO: 7417789 - DNA, 22 bp, Homo sapiens
aaaacatgtccatacagaaact

SEQ ID NO: 7417790 - DNA, 22 bp, Homo sapiens
aaaacattctgtgaactctcaa

SEQ ID NO: 7417791 - DNA, 22 bp, Homo sapiens
aaaacattctgtgaactctcaa

SEQ ID NO: 7417792 - DNA, 22 bp, Homo sapiens
aaaacattctgtgaactctcaa

SEQ ID NO: 7417793 - DNA, 22 bp, Homo sapiens
aaaacattctgtgaactctcaa

SEQ ID NO: 7417794 - DNA, 22 bp, Homo sapiens
aaaacattctgtgaactctcaa

SEQ ID NO: 7417795 - DNA, 22 bp, Homo sapiens
aaaagagtgactgataagtata

SEQ ID NO: 7417796 - DNA, 22 bp, Homo sapiens
aaaagagtgactgataagtata

SEQ ID NO: 7417797 - DNA, 22 bp, Homo sapiens
aaaagagtgactgataagtata

SEQ ID NO: 7417798 - DNA, 22 bp, Homo sapiens
aaaagagtgactgataagtata

SEQ ID NO: 7417799 - DNA, 22 bp, Homo sapiens
aaaagagtgactgataagtata

SEQ ID NO: 7417800 - DNA, 22 bp, Homo sapiens
aaaagagtcttaggcagtcata

SEQ ID NO: 7417801 - DNA, 22 bp, Homo sapiens
aaaagaggttaaccaggtgtgt

SEQ ID NO: 7417802 - DNA, 22 bp, Homo sapiens
aaaagagtcttaggcagtcata

SEQ ID NO: 7417803 - DNA, 22 bp, Homo sapiens
aaaagagtcttaggcagtcata

SEQ ID NO: 7417804 - DNA, 22 bp, Homo sapiens
aaaagagtcttaggcagtcata

SEQ ID NO: 7417805 - DNA, 22 bp, Homo sapiens
aaaaccaggcgtttcctattat

SEQ ID NO: 7417806 - DNA, 22 bp, Homo sapiens
aaaaccagacactgtttctggg

SEQ ID NO: 7417807 - DNA, 22 bp, Homo sapiens
aaaaccaggcgtttcctattat

SEQ ID NO: 7417808 - DNA, 22 bp, Homo sapiens
aaaagaggttaaccaggtgtgt

SEQ ID NO: 7417809 - DNA, 22 bp, Homo sapiens
aaaagaggttaaccaggtgtgt

SEQ ID NO: 7417810 - DNA, 22 bp, Homo sapiens
aaaagaggagtggtttatgaca

SEQ ID NO: 7417811 - DNA, 22 bp, Homo sapiens
aaaaccaggcttgctgtgctcg

SEQ ID NO: 7417812 - DNA, 22 bp, Homo sapiens
aaaaccacttccttgctattgg

SEQ ID NO: 7417813 - DNA, 22 bp, Homo sapiens
aaaaccacttccttgctattgg

SEQ ID NO: 7417814 - DNA, 22 bp, Homo sapiens
aaaaccacttccttgctattgg

SEQ ID NO: 7417815 - DNA, 22 bp, Homo sapiens
aaaaccagacactgtttctggg

SEQ ID NO: 7417816 - DNA, 22 bp, Homo sapiens
aaaaccacttccttgctattgg

SEQ ID NO: 7417817 - DNA, 22 bp, Homo sapiens
aaaaccacagttacttttgcac

SEQ ID NO: 7417818 - DNA, 22 bp, Homo sapiens
aaaaccacagttacttttgcac

SEQ ID NO: 7417819 - DNA, 22 bp, Homo sapiens
aaaaccacagttacttttgcac

SEQ ID NO: 7417820 - DNA, 22 bp, Homo sapiens
aaaaccacagttacttttgcac

SEQ ID NO: 7417821 - DNA, 22 bp, Homo sapiens
aaaaccacaattatttttgcac

SEQ ID NO: 7417822 - DNA, 22 bp, Homo sapiens
aaaaccacaattacttttgcac

SEQ ID NO: 7417823 - DNA, 22 bp, Homo sapiens
aaaaccacaattacttttgcac

SEQ ID NO: 7417824 - DNA, 22 bp, Homo sapiens
aaaaccacaattatttttgcac

SEQ ID NO: 7417825 - DNA, 22 bp, Homo sapiens
aaaaccacaattatttttgcac

SEQ ID NO: 7417826 - DNA, 22 bp, Homo sapiens
aaaaccacaatgacttttgcag

SEQ ID NO: 7417827 - DNA, 22 bp, Homo sapiens
aaaaccacaatgacttttgcag

SEQ ID NO: 7417828 - DNA, 22 bp, Homo sapiens
aaaaccacaattacttttgcac

SEQ ID NO: 7417829 - DNA, 22 bp, Homo sapiens
aaaaccacaattacttttgcac

SEQ ID NO: 7417830 - DNA, 22 bp, Homo sapiens
aaaaccacaatgacttttgcac

SEQ ID NO: 7417831 - DNA, 22 bp, Homo sapiens
aaaaccacaatgacttttgcac

SEQ ID NO: 7417832 - DNA, 22 bp, Homo sapiens
aaaaccacaatgacttttgcag

SEQ ID NO: 7417833 - DNA, 22 bp, Homo sapiens
aaaaccacaatgacttttgcag

SEQ ID NO: 7417834 - DNA, 22 bp, Homo sapiens
aaaaccacaatgacttttgcac

SEQ ID NO: 7417835 - DNA, 22 bp, Homo sapiens
aaaaccacaatgacttttgcac

SEQ ID NO: 7417836 - DNA, 22 bp, Homo sapiens
aaaaccacaaaagtggcttggt

SEQ ID NO: 7417837 - DNA, 22 bp, Homo sapiens
aaaaccacaaaagtggcttggt

SEQ ID NO: 7417838 - DNA, 22 bp, Homo sapiens
aaaaccaagttttccttagtct

SEQ ID NO: 7417839 - DNA, 22 bp, Homo sapiens
aaaaccacaaaagtggcttggt

SEQ ID NO: 7417840 - DNA, 22 bp, Homo sapiens
aaaacagtttaggcatcacagt

SEQ ID NO: 7417841 - DNA, 22 bp, Homo sapiens
aaaacagtttaggcatcacagt

SEQ ID NO: 7417842 - DNA, 22 bp, Homo sapiens
aaaacagtttttgctaactgct

SEQ ID NO: 7417843 - DNA, 22 bp, Homo sapiens
aaaacagtttttgctaactgct

SEQ ID NO: 7417844 - DNA, 22 bp, Homo sapiens
aaaacagtttttgctaactgct

SEQ ID NO: 7417845 - DNA, 22 bp, Homo sapiens
aaaacagtttaggcatcacagt

SEQ ID NO: 7417846 - DNA, 22 bp, Homo sapiens
aaaacagtttaggcatcacagt

SEQ ID NO: 7417847 - DNA, 22 bp, Homo sapiens
aaaacagtttaggcatcacagt

SEQ ID NO: 7417848 - DNA, 22 bp, Homo sapiens
aaaagaggagtggtttatgaca

SEQ ID NO: 7417849 - DNA, 22 bp, Homo sapiens
aaaagcaagttgcctaggttga

SEQ ID NO: 7417850 - DNA, 22 bp, Homo sapiens
aaaagagccacttatgacctca

SEQ ID NO: 7417851 - DNA, 22 bp, Homo sapiens
aaaagagccacttatgacctca

SEQ ID NO: 7417852 - DNA, 22 bp, Homo sapiens
aaaagaggaactcttatatact

SEQ ID NO: 7417853 - DNA, 22 bp, Homo sapiens
aaaagaggaactcttatatact

SEQ ID NO: 7417854 - DNA, 22 bp, Homo sapiens
aaaagagcttggttgattttgc

SEQ ID NO: 7417855 - DNA, 22 bp, Homo sapiens
aaaagagcttggttgattttgc

SEQ ID NO: 7417856 - DNA, 22 bp, Homo sapiens
aaaacagtttttgctaactgct

SEQ ID NO: 7417857 - DNA, 22 bp, Homo sapiens
aaaagagccacttatgacctca

SEQ ID NO: 7417858 - DNA, 22 bp, Homo sapiens
aaaacaggagttttggtaggct

SEQ ID NO: 7417859 - DNA, 22 bp, Homo sapiens
aaaacaggtgtcagcaaactat

SEQ ID NO: 7417860 - DNA, 22 bp, Homo sapiens
aaaacaggagttttggtaggct

SEQ ID NO: 7417861 - DNA, 22 bp, Homo sapiens
aaaacagttataaacagagtca

SEQ ID NO: 7417862 - DNA, 22 bp, Homo sapiens
aaaacagttataaacagagtca

SEQ ID NO: 7417863 - DNA, 22 bp, Homo sapiens
aaaacagttataaacagagtca

SEQ ID NO: 7417864 - DNA, 22 bp, Homo sapiens
aaaacagttataaacagagtca

SEQ ID NO: 7417865 - DNA, 22 bp, Homo sapiens
aaaacaggtgtcagcaaactat

SEQ ID NO: 7417866 - DNA, 22 bp, Homo sapiens
aaaacagtttaggcatcacagt

SEQ ID NO: 7417867 - DNA, 22 bp, Homo sapiens
aaaacagtttaggcatcacagt

SEQ ID NO: 7417868 - DNA, 22 bp, Homo sapiens
aaaacagtttaggcatcacagt

SEQ ID NO: 7417869 - DNA, 22 bp, Homo sapiens
aaaacagtttaggcatcacagt

SEQ ID NO: 7417870 - DNA, 22 bp, Homo sapiens
aaaacagtttaggcatcacagt

SEQ ID NO: 7417871 - DNA, 22 bp, Homo sapiens
aaaacagtttaggcatcacagt

SEQ ID NO: 7417872 - DNA, 22 bp, Homo sapiens
aaaacagttataaacagagtca

SEQ ID NO: 7417873 - DNA, 22 bp, Homo sapiens
aaaacagttataaacagagtca

SEQ ID NO: 7417874 - DNA, 22 bp, Homo sapiens
aaaacagttataaacagagtca

SEQ ID NO: 7417875 - DNA, 22 bp, Homo sapiens
aaaacagttataaacagagtca

SEQ ID NO: 7417876 - DNA, 22 bp, Homo sapiens
aaaacagttataaacagagtca

SEQ ID NO: 7417877 - DNA, 23 bp, Homo sapiens
aaaacagcttcctccagtggctc

SEQ ID NO: 7417878 - DNA, 22 bp, Homo sapiens
aaaacagaggtgcctgggccca

SEQ ID NO: 7417879 - DNA, 22 bp, Homo sapiens
aaaacagaggtgcctgggccca

SEQ ID NO: 7417880 - DNA, 23 bp, Homo sapiens
aaaacagcttcctccagtggctc

SEQ ID NO: 7417881 - DNA, 23 bp, Homo sapiens
aaaacagcttcctccagtggctc

SEQ ID NO: 7417882 - DNA, 23 bp, Homo sapiens
aaaacagcttcctccagtggctc

SEQ ID NO: 7417883 - DNA, 22 bp, Homo sapiens
aaaacagaggtgcctgggccca

SEQ ID NO: 7417884 - DNA, 22 bp, Homo sapiens
aaaacagaggtgcctgggccca

SEQ ID NO: 7417885 - DNA, 22 bp, Homo sapiens
aaaacagacagccagtgtagag

SEQ ID NO: 7417886 - DNA, 22 bp, Homo sapiens
aaaacagacagccagtgtagag

SEQ ID NO: 7417887 - DNA, 22 bp, Homo sapiens
aaaacagacagccagtgtagag

SEQ ID NO: 7417888 - DNA, 22 bp, Homo sapiens
aaaacagacagccagtgtagag

SEQ ID NO: 7417889 - DNA, 22 bp, Homo sapiens
aaaacagacagccagtgtagag

SEQ ID NO: 7417890 - DNA, 22 bp, Homo sapiens
aaaacagacagccagtgtagag

SEQ ID NO: 7417891 - DNA, 22 bp, Homo sapiens
aaaacagacagccagtgtagag

SEQ ID NO: 7417892 - DNA, 22 bp, Homo sapiens
aaaacagacagccagtgtagag

SEQ ID NO: 7417893 - DNA, 22 bp, Homo sapiens
aaaacactgcctgcttgactga

SEQ ID NO: 7417894 - DNA, 22 bp, Homo sapiens
aaaacactgcctgcttgactga

SEQ ID NO: 7417895 - DNA, 22 bp, Homo sapiens
aaaacactgcctgcttgactga

SEQ ID NO: 7417896 - DNA, 22 bp, Homo sapiens
aaaacactgcctgcttgactga

SEQ ID NO: 7417897 - DNA, 22 bp, Homo sapiens
aaaacacactggaccaatttaa

SEQ ID NO: 7417898 - DNA, 22 bp, Homo sapiens
aaaacacactggaccaatttaa

SEQ ID NO: 7417899 - DNA, 22 bp, Homo sapiens
aaaacacactggaccaatttaa

SEQ ID NO: 7417900 - DNA, 22 bp, Homo sapiens
aaaacacactggaccaatttaa

SEQ ID NO: 7417901 - DNA, 22 bp, Homo sapiens
aaaacacactggaccaatttaa

SEQ ID NO: 7417902 - DNA, 22 bp, Homo sapiens
aaaacacactggaccaatttaa

SEQ ID NO: 7417903 - DNA, 22 bp, Homo sapiens
aaaacacactggaccaatttaa

SEQ ID NO: 7417904 - DNA, 22 bp, Homo sapiens
aaaacacaagaagcagggtaca

SEQ ID NO: 7417905 - DNA, 22 bp, Homo sapiens
aaaacacaagaagcagggtaca

SEQ ID NO: 7417906 - DNA, 22 bp, Homo sapiens
aaaacacaagaagcagggtaca

SEQ ID NO: 7417907 - DNA, 22 bp, Homo sapiens
aaaacacaagaagcagggtaca

SEQ ID NO: 7417908 - DNA, 22 bp, Homo sapiens
aaaacacactggaccaatttaa

SEQ ID NO: 7417909 - DNA, 22 bp, Homo sapiens
aaaacacactggaccaatttaa

SEQ ID NO: 7417910 - DNA, 22 bp, Homo sapiens
aaaacacactggaccaatttaa

SEQ ID NO: 7417911 - DNA, 22 bp, Homo sapiens
aaaacactgcaaagctgattgg

SEQ ID NO: 7417912 - DNA, 22 bp, Homo sapiens
aaaacactgcaaagctgattgg

SEQ ID NO: 7417913 - DNA, 22 bp, Homo sapiens
aaaacacactggaccaatttaa

SEQ ID NO: 7417914 - DNA, 22 bp, Homo sapiens
aaaacactgcctgcttgactga

SEQ ID NO: 7417915 - DNA, 22 bp, Homo sapiens
aaaacactgcaaagctgattgg

SEQ ID NO: 7417916 - DNA, 22 bp, Homo sapiens
aaaacactgcaaagctgattgg

SEQ ID NO: 7417917 - DNA, 22 bp, Homo sapiens
aaaagcattacatggtacgtat

SEQ ID NO: 7417918 - DNA, 22 bp, Homo sapiens
aaaagccatgcatacctaagag

SEQ ID NO: 7417919 - DNA, 22 bp, Homo sapiens
aaaagctagtcaatgatgtatt

SEQ ID NO: 7417920 - DNA, 22 bp, Homo sapiens
aaaagctagtcaatgatgtatt

SEQ ID NO: 7417921 - DNA, 22 bp, Homo sapiens
aaaagccatgcatacctaagag

SEQ ID NO: 7417922 - DNA, 22 bp, Homo sapiens
aaaagccatgcatacctaagag

SEQ ID NO: 7417923 - DNA, 22 bp, Homo sapiens
aaaagcagtttatagtcagttg

SEQ ID NO: 7417924 - DNA, 22 bp, Homo sapiens
aaaagcagtttatagtcagttg

SEQ ID NO: 7417925 - DNA, 22 bp, Homo sapiens
aaaagcatctcaaaggagcttc

SEQ ID NO: 7417926 - DNA, 22 bp, Homo sapiens
aaaagcatctcaaaggagcttc

SEQ ID NO: 7417927 - DNA, 22 bp, Homo sapiens
aaaagcatctcaaaggagcttc

SEQ ID NO: 7417928 - DNA, 22 bp, Homo sapiens
aaaagcatctcaaaggagcttc

SEQ ID NO: 7417929 - DNA, 22 bp, Homo sapiens
aaaagccaaggtcctcttcaga

SEQ ID NO: 7417930 - DNA, 22 bp, Homo sapiens
aaaagccaaggtcctcttcaga

SEQ ID NO: 7417931 - DNA, 22 bp, Homo sapiens
aaaagccaaggtcctcttcaga

SEQ ID NO: 7417932 - DNA, 22 bp, Homo sapiens
aaaagcattacatggtacgtat

SEQ ID NO: 7417933 - DNA, 22 bp, Homo sapiens
aaaagcatctcaaaggagcttc

SEQ ID NO: 7417934 - DNA, 22 bp, Homo sapiens
aaaagcagtttatagtcagttg

SEQ ID NO: 7417935 - DNA, 22 bp, Homo sapiens
aaaagcagtttatagtcagttg

SEQ ID NO: 7417936 - DNA, 22 bp, Homo sapiens
aaaagcagtttatagtcagttg

SEQ ID NO: 7417937 - DNA, 22 bp, Homo sapiens
aaaagcagttatctgggaggaa

SEQ ID NO: 7417938 - DNA, 22 bp, Homo sapiens
aaaagcagttatctgggaggaa

SEQ ID NO: 7417939 - DNA, 22 bp, Homo sapiens
aaaagcagttatctgggaggaa

SEQ ID NO: 7417940 - DNA, 22 bp, Homo sapiens
aaaagcagttatctgggaggaa

SEQ ID NO: 7417941 - DNA, 22 bp, Homo sapiens
aaaagcagtaaatgtatgacct

SEQ ID NO: 7417942 - DNA, 22 bp, Homo sapiens
aaaagcaggtactcagcttggg

SEQ ID NO: 7417943 - DNA, 22 bp, Homo sapiens
aaaagcagtaaatgtatgacct

SEQ ID NO: 7417944 - DNA, 22 bp, Homo sapiens
aaaagcagtaaatgtatgacct

SEQ ID NO: 7417945 - DNA, 22 bp, Homo sapiens
aaaagcaggtactcagcttggg

SEQ ID NO: 7417946 - DNA, 22 bp, Homo sapiens
aaaagcaggtactcagcttggg

SEQ ID NO: 7417947 - DNA, 20 bp, Homo sapiens
aaaagcagccagagatggta

SEQ ID NO: 7417948 - DNA, 20 bp, Homo sapiens
aaaagcagccagagatggta

SEQ ID NO: 7417949 - DNA, 20 bp, Homo sapiens
aaaagcagccagagatggta

SEQ ID NO: 7417950 - DNA, 22 bp, Homo sapiens
aaaagcaggtactcagcttggg

SEQ ID NO: 7417951 - DNA, 20 bp, Homo sapiens
aaaagcagccagagatggta

SEQ ID NO: 7417952 - DNA, 22 bp, Homo sapiens
aaaagcaattgcagttcttgcc

SEQ ID NO: 7417953 - DNA, 22 bp, Homo sapiens
aaaagcaattgcagttcttgcc

SEQ ID NO: 7417954 - DNA, 22 bp, Homo sapiens
aaaagcaagttgcctaggttga

SEQ ID NO: 7417955 - DNA, 22 bp, Homo sapiens
aaaagcaagttgcctaggttga

SEQ ID NO: 7417956 - DNA, 22 bp, Homo sapiens
aaaagcaagttgcctaggttga

SEQ ID NO: 7417957 - DNA, 22 bp, Homo sapiens
aaaagcaagttgcctaggttga

SEQ ID NO: 7417958 - DNA, 22 bp, Homo sapiens
aaaagcaagttgcctaggttga

SEQ ID NO: 7417959 - DNA, 22 bp, Homo sapiens
aaaagcaagttgcctaggttga

SEQ ID NO: 7417960 - DNA, 22 bp, Homo sapiens
aaaagcaattgcagttcttgcc

SEQ ID NO: 7417961 - DNA, 22 bp, Homo sapiens
aaaagcaattgcagttcttgcc

SEQ ID NO: 7417962 - DNA, 22 bp, Homo sapiens
aaaagcaattgcagttcttgcc

SEQ ID NO: 7417963 - DNA, 22 bp, Homo sapiens
aaaagcaattgcgggttttgcc

SEQ ID NO: 7417964 - DNA, 22 bp, Homo sapiens
aaaagcaattgcgggttttgcc

SEQ ID NO: 7417965 - DNA, 22 bp, Homo sapiens
aaaagcaattgcgggttttgcc

SEQ ID NO: 7417966 - DNA, 22 bp, Homo sapiens
aaaagcaattgcgggttttgcc

SEQ ID NO: 7417967 - DNA, 22 bp, Homo sapiens
aaaagcaattgcgggttttgcc

SEQ ID NO: 7417968 - DNA, 22 bp, Homo sapiens
aaaagcagagactctggagcta

SEQ ID NO: 7417969 - DNA, 22 bp, Homo sapiens
aaaagcagagactctggagcta

SEQ ID NO: 7417970 - DNA, 22 bp, Homo sapiens
aaaagcagatctccaaagtcta

SEQ ID NO: 7417971 - DNA, 20 bp, Homo sapiens
aaaagcagccagagatggta

SEQ ID NO: 7417972 - DNA, 22 bp, Homo sapiens
aaaagcagatctccaaagtcta

SEQ ID NO: 7417973 - DNA, 22 bp, Homo sapiens
aaaagcagatctccaaagtcta

SEQ ID NO: 7417974 - DNA, 22 bp, Homo sapiens
aaaagcagatctccaaagtcta

SEQ ID NO: 7417975 - DNA, 22 bp, Homo sapiens
aaaagcactacaatttcgcttc

SEQ ID NO: 7417976 - DNA, 22 bp, Homo sapiens
aaaagcactacaatttcgcttc

SEQ ID NO: 7417977 - DNA, 22 bp, Homo sapiens
aaaagcaattgcgggttttgcc

SEQ ID NO: 7417978 - DNA, 22 bp, Homo sapiens
aaaagcactacaatttcgcttc

SEQ ID NO: 7417979 - DNA, 22 bp, Homo sapiens
aaaagcagaccacgctttgtgg

SEQ ID NO: 7417980 - DNA, 22 bp, Homo sapiens
aaaagcactacaatttcgcttc

SEQ ID NO: 7417981 - DNA, 22 bp, Homo sapiens
aaaagcagagactctggagcta

SEQ ID NO: 7417982 - DNA, 22 bp, Homo sapiens
aaaagcagagactctggagcta

SEQ ID NO: 7417983 - DNA, 22 bp, Homo sapiens
aaaagcagagactctggagcta

SEQ ID NO: 7417984 - DNA, 22 bp, Homo sapiens
aaagcaatggatgagaatctgt

SEQ ID NO: 7417985 - DNA, 21 bp, Homo sapiens
aaaatgtgagcgtgatgctta

SEQ ID NO: 7417986 - DNA, 22 bp, Homo sapiens
aaaatgtctgctgttggtttat

SEQ ID NO: 7417987 - DNA, 22 bp, Homo sapiens
aaagcaatggatgagaatctgt

SEQ ID NO: 7417988 - DNA, 22 bp, Homo sapiens
aaagcagcagaatctctcaggg

SEQ ID NO: 7417989 - DNA, 22 bp, Homo sapiens
aaagcagcagaatctctcaggg

SEQ ID NO: 7417990 - DNA, 22 bp, Homo sapiens
aaagcagcagaatctctcaggg

SEQ ID NO: 7417991 - DNA, 22 bp, Homo sapiens
aaagcaatggcacatgatggta

SEQ ID NO: 7417992 - DNA, 22 bp, Homo sapiens
aaagcagcagaaagctggcccc

SEQ ID NO: 7417993 - DNA, 22 bp, Homo sapiens
aaagcaatggcacatgatggta

SEQ ID NO: 7417994 - DNA, 22 bp, Homo sapiens
aaagcaatggcacatgatggta

SEQ ID NO: 7417995 - DNA, 22 bp, Homo sapiens
aaagcaatggatgagaatctgt

SEQ ID NO: 7417996 - DNA, 22 bp, Homo sapiens
aaagcaatggatgagaatctgt

SEQ ID NO: 7417997 - DNA, 22 bp, Homo sapiens
aaaatgtctgctgttggtttat

SEQ ID NO: 7417998 - DNA, 22 bp, Homo sapiens
aaaatgtatgatggaggtgcta

SEQ ID NO: 7417999 - DNA, 21 bp, Homo sapiens
aaaatgtagacttttccctga

SEQ ID NO: 7418000 - DNA, 21 bp, Homo sapiens
aaaatgtagacttttccctga

SEQ ID NO: 7418001 - DNA, 22 bp, Homo sapiens
aaaatgtatgatggaggtgcta

SEQ ID NO: 7418002 - DNA, 21 bp, Homo sapiens
aaaatgtagacttttccctga

SEQ ID NO: 7418003 - DNA, 21 bp, Homo sapiens
aaaatgtagacttttccctga

SEQ ID NO: 7418004 - DNA, 21 bp, Homo sapiens
aaaatgtagacttttccctga

SEQ ID NO: 7418005 - DNA, 22 bp, Homo sapiens
aaagcagcagaatctctcaggg

SEQ ID NO: 7418006 - DNA, 22 bp, Homo sapiens
aaagcagcagcacctgcatttc

SEQ ID NO: 7418007 - DNA, 22 bp, Homo sapiens
aaagcagcagcacctgcatttc

SEQ ID NO: 7418008 - DNA, 22 bp, Homo sapiens
aaagcagcagcacgtggaagag

SEQ ID NO: 7418009 - DNA, 22 bp, Homo sapiens
aaagcagcagcacgtggaagag

SEQ ID NO: 7418010 - DNA, 22 bp, Homo sapiens
aaagcagccacagagagagcgt

SEQ ID NO: 7418011 - DNA, 22 bp, Homo sapiens
aaagcagccacagagagagcgt

SEQ ID NO: 7418012 - DNA, 22 bp, Homo sapiens
aaagcagcagttccatcacctg

SEQ ID NO: 7418013 - DNA, 22 bp, Homo sapiens
aaagcagcagttccatcacctg

SEQ ID NO: 7418014 - DNA, 22 bp, Homo sapiens
aaagcagccactctctctgcct

SEQ ID NO: 7418015 - DNA, 22 bp, Homo sapiens
aaagcagccactctctctgcct

SEQ ID NO: 7418016 - DNA, 22 bp, Homo sapiens
aaagcagccacagagagagcgt

SEQ ID NO: 7418017 - DNA, 22 bp, Homo sapiens
aaagcagccacagagagagcgt

SEQ ID NO: 7418018 - DNA, 21 bp, Homo sapiens
aaagcagcccatggcacagtc

SEQ ID NO: 7418019 - DNA, 22 bp, Homo sapiens
aaagcagccggttccctggtct

SEQ ID NO: 7418020 - DNA, 22 bp, Homo sapiens
aaagcagccggttccctggtct

SEQ ID NO: 7418021 - DNA, 22 bp, Homo sapiens
aaagcagcctgctcatcctgga

SEQ ID NO: 7418022 - DNA, 22 bp, Homo sapiens
aaagcagcctgctcatcctgga

SEQ ID NO: 7418023 - DNA, 22 bp, Homo sapiens
aaagcagctgatagtctcatct

SEQ ID NO: 7418024 - DNA, 22 bp, Homo sapiens
aaagcagctgatagtctcatct

SEQ ID NO: 7418025 - DNA, 22 bp, Homo sapiens
aaagcagctgatagtctcatct

SEQ ID NO: 7418026 - DNA, 22 bp, Homo sapiens
aaagcagctgctctggccttga

SEQ ID NO: 7418027 - DNA, 22 bp, Homo sapiens
aaagcagctgatctcagagcct

SEQ ID NO: 7418028 - DNA, 22 bp, Homo sapiens
aaagcagctgatctcagagcct

SEQ ID NO: 7418029 - DNA, 22 bp, Homo sapiens
aaagcagcctgctcatcctgga

SEQ ID NO: 7418030 - DNA, 22 bp, Homo sapiens
aaagcagcggtgtctttactgc

SEQ ID NO: 7418031 - DNA, 22 bp, Homo sapiens
aaagcaggcagcaggctggatt

SEQ ID NO: 7418032 - DNA, 22 bp, Homo sapiens
aaagcaggcagcaggctggatt

SEQ ID NO: 7418033 - DNA, 22 bp, Homo sapiens
aaagcaggcagcaggctggatt

SEQ ID NO: 7418034 - DNA, 22 bp, Homo sapiens
aaagcagctgctctggccttga

SEQ ID NO: 7418035 - DNA, 22 bp, Homo sapiens
aaagcagctgctctggccttga

SEQ ID NO: 7418036 - DNA, 22 bp, Homo sapiens
aaagcagctgtttgactttcca

SEQ ID NO: 7418037 - DNA, 22 bp, Homo sapiens
aaagcagctgtttgactttcca

SEQ ID NO: 7418038 - DNA, 22 bp, Homo sapiens
aaaattgtaggaactgaatcaa

SEQ ID NO: 7418039 - DNA, 22 bp, Homo sapiens
aaagcagggtccaaggagatgt

SEQ ID NO: 7418040 - DNA, 22 bp, Homo sapiens
aaagcagggtccaaggagatgt

SEQ ID NO: 7418041 - DNA, 22 bp, Homo sapiens
aaagcagggtccaaggagatgt

SEQ ID NO: 7418042 - DNA, 22 bp, Homo sapiens
aaagcagggtccaaggagatgt

SEQ ID NO: 7418043 - DNA, 22 bp, Homo sapiens
aaagcagggtccaaggagatgt

SEQ ID NO: 7418044 - DNA, 22 bp, Homo sapiens
aaagcagggtccaaggagatgt

SEQ ID NO: 7418045 - DNA, 22 bp, Homo sapiens
aaagcagggtccaaggagatgt

SEQ ID NO: 7418046 - DNA, 22 bp, Homo sapiens
aaagcagggtccaaggagatgt

SEQ ID NO: 7418047 - DNA, 22 bp, Homo sapiens
aaagcaggcagcaggctggatt

SEQ ID NO: 7418048 - DNA, 22 bp, Homo sapiens
aaagcagggtccaaggagatgt

SEQ ID NO: 7418049 - DNA, 22 bp, Homo sapiens
aaagcagggatgaggctagagg

SEQ ID NO: 7418050 - DNA, 22 bp, Homo sapiens
aaagcagggatgaggctagagg

SEQ ID NO: 7418051 - DNA, 22 bp, Homo sapiens
aaagcagggatgaggctagagg

SEQ ID NO: 7418052 - DNA, 22 bp, Homo sapiens
aaagcagggcgatgtcctcctc

SEQ ID NO: 7418053 - DNA, 22 bp, Homo sapiens
aaagcagggcgatgtcctcctc

SEQ ID NO: 7418054 - DNA, 22 bp, Homo sapiens
aaagcagggatgaggctagagg

SEQ ID NO: 7418055 - DNA, 22 bp, Homo sapiens
aaagcagggatgaggctagagg

SEQ ID NO: 7418056 - DNA, 22 bp, Homo sapiens
aaagcagggatgaggctagagg

SEQ ID NO: 7418057 - DNA, 22 bp, Homo sapiens
aaagcagggatgaggctagagg

SEQ ID NO: 7418058 - DNA, 22 bp, Homo sapiens
aaaatgtaaagcttgagtgtag

SEQ ID NO: 7418059 - DNA, 22 bp, Homo sapiens
aaaatgtaaagcttgagtgtag

SEQ ID NO: 7418060 - DNA, 22 bp, Homo sapiens
aaaatggtctcagctggcacca

SEQ ID NO: 7418061 - DNA, 22 bp, Homo sapiens
aaaatgtaaagcttgagtgtag

SEQ ID NO: 7418062 - DNA, 22 bp, Homo sapiens
aaaatgtaaagcttgagtgtag

SEQ ID NO: 7418063 - DNA, 22 bp, Homo sapiens
aaaatgtaaagcttgagtgtag

SEQ ID NO: 7418064 - DNA, 22 bp, Homo sapiens
aaaatgtaaagcttgagtgtag

SEQ ID NO: 7418065 - DNA, 22 bp, Homo sapiens
aaaatgtaaagcttgagtgtag

SEQ ID NO: 7418066 - DNA, 22 bp, Homo sapiens
aaaatggatagtgcgtcttctc

SEQ ID NO: 7418067 - DNA, 22 bp, Homo sapiens
aaaatgctgggaaagttggaat

SEQ ID NO: 7418068 - DNA, 22 bp, Homo sapiens
aaaatgctcatcagcgatggct

SEQ ID NO: 7418069 - DNA, 22 bp, Homo sapiens
aaaatgctcatcagcgatggct

SEQ ID NO: 7418070 - DNA, 22 bp, Homo sapiens
aaaatgctgggaaagttggaat

SEQ ID NO: 7418071 - DNA, 22 bp, Homo sapiens
aaaatgctgggaaagttggaat

SEQ ID NO: 7418072 - DNA, 18 bp, Homo sapiens
aaaatgcaggcgacatgg

SEQ ID NO: 7418073 - DNA, 18 bp, Homo sapiens
aaaatgcaggcgacatgg

SEQ ID NO: 7418074 - DNA, 18 bp, Homo sapiens
aaaatgcaggcgacatgg

SEQ ID NO: 7418075 - DNA, 18 bp, Homo sapiens
aaaatgcaggcgacatgg

SEQ ID NO: 7418076 - DNA, 18 bp, Homo sapiens
aaaatgcaggcgacatgg

SEQ ID NO: 7418077 - DNA, 18 bp, Homo sapiens
aaaatgcaggcgacatgg

SEQ ID NO: 7418078 - DNA, 18 bp, Homo sapiens
aaaatgcaggcgacatgg

SEQ ID NO: 7418079 - DNA, 18 bp, Homo sapiens
aaaatgcaggcgacatgg

SEQ ID NO: 7418080 - DNA, 18 bp, Homo sapiens
aaaatgcaggcgacatgg

SEQ ID NO: 7418081 - DNA, 22 bp, Homo sapiens
aaaatgcatgagaatgtgctcg

SEQ ID NO: 7418082 - DNA, 22 bp, Homo sapiens
aaaatgcatgagaatgtgctcg

SEQ ID NO: 7418083 - DNA, 22 bp, Homo sapiens
aaaatgcatgagaatgtgctcg

SEQ ID NO: 7418084 - DNA, 22 bp, Homo sapiens
aaaatgcatgagaatgtgctcg

SEQ ID NO: 7418085 - DNA, 22 bp, Homo sapiens
aaaatgcatgagaatgtgctcg

SEQ ID NO: 7418086 - DNA, 22 bp, Homo sapiens
aaaatgcatgagaatgtgctcg

SEQ ID NO: 7418087 - DNA, 22 bp, Homo sapiens
aaaatgcatgagaatgtgctcg

SEQ ID NO: 7418088 - DNA, 22 bp, Homo sapiens
aaaatgcatgagaatgtgctcg

SEQ ID NO: 7418089 - DNA, 22 bp, Homo sapiens
aaaatgcatgagaatgtgctcg

SEQ ID NO: 7418090 - DNA, 22 bp, Homo sapiens
aaaatgcatgagaatgtgctcg

SEQ ID NO: 7418091 - DNA, 22 bp, Homo sapiens
aaaatgcatgagaatgtgctcg

SEQ ID NO: 7418092 - DNA, 22 bp, Homo sapiens
aaaatgctatttcatggaggag

SEQ ID NO: 7418093 - DNA, 22 bp, Homo sapiens
aaaatgctatttcatggaggag

SEQ ID NO: 7418094 - DNA, 22 bp, Homo sapiens
aaaatgatatcctgacttttat

SEQ ID NO: 7418095 - DNA, 22 bp, Homo sapiens
aaaatgatatcctgacttttat

SEQ ID NO: 7418096 - DNA, 22 bp, Homo sapiens
aaaatgatatcctgacttttat

SEQ ID NO: 7418097 - DNA, 22 bp, Homo sapiens
aaaatgatatcctgacttttat

SEQ ID NO: 7418098 - DNA, 22 bp, Homo sapiens
aaaatgaggtcaatatcctttt

SEQ ID NO: 7418099 - DNA, 22 bp, Homo sapiens
aaaatgaggtcaatatcctttt

SEQ ID NO: 7418100 - DNA, 22 bp, Homo sapiens
aaaatgatatcctgacttttat

SEQ ID NO: 7418101 - DNA, 22 bp, Homo sapiens
aaaatgatatcctgacttttat

SEQ ID NO: 7418102 - DNA, 22 bp, Homo sapiens
aaaatgaggaacggatcatggc

SEQ ID NO: 7418103 - DNA, 22 bp, Homo sapiens
aaaatgaggaacggatcatggc

SEQ ID NO: 7418104 - DNA, 22 bp, Homo sapiens
aaaatgagccatgaaccaacca

SEQ ID NO: 7418105 - DNA, 22 bp, Homo sapiens
aaaatgaggtcaatatcctttt

SEQ ID NO: 7418106 - DNA, 22 bp, Homo sapiens
aaaatgaggtcaatatcctttt

SEQ ID NO: 7418107 - DNA, 22 bp, Homo sapiens
aaaatgaggtcaatatcctttt

SEQ ID NO: 7418108 - DNA, 22 bp, Homo sapiens
aaaatgaggaacggatcatggc

SEQ ID NO: 7418109 - DNA, 22 bp, Homo sapiens
aaaatgaggaacggatcatggc

SEQ ID NO: 7418110 - DNA, 22 bp, Homo sapiens
aaaatgcaaacctacctacata

SEQ ID NO: 7418111 - DNA, 22 bp, Homo sapiens
aaaatgcaaacctacctacata

SEQ ID NO: 7418112 - DNA, 22 bp, Homo sapiens
aaaatgcaaacctacctacata

SEQ ID NO: 7418113 - DNA, 22 bp, Homo sapiens
aaaatgcaaacctacctacata

SEQ ID NO: 7418114 - DNA, 22 bp, Homo sapiens
aaaatgcaaacctacctacata

SEQ ID NO: 7418115 - DNA, 22 bp, Homo sapiens
aaaatgcaaacctacctacata

SEQ ID NO: 7418116 - DNA, 22 bp, Homo sapiens
aaaatgcaaacctacctacata

SEQ ID NO: 7418117 - DNA, 20 bp, Homo sapiens
aaaatgatgggcagggcagg

SEQ ID NO: 7418118 - DNA, 20 bp, Homo sapiens
aaaatgatgggcagggcagg

SEQ ID NO: 7418119 - DNA, 20 bp, Homo sapiens
aaaatgatgggcagggcagg

SEQ ID NO: 7418120 - DNA, 22 bp, Homo sapiens
aaaatgatgctgtaatttggca

SEQ ID NO: 7418121 - DNA, 22 bp, Homo sapiens
aaaatgatgctgtaatttggca

SEQ ID NO: 7418122 - DNA, 22 bp, Homo sapiens
aaaatgatgctgtaatttggca

SEQ ID NO: 7418123 - DNA, 22 bp, Homo sapiens
aaaatgatgctgtaatttggca

SEQ ID NO: 7418124 - DNA, 22 bp, Homo sapiens
aaaatgatgctgtaatttggca

SEQ ID NO: 7418125 - DNA, 22 bp, Homo sapiens
aaaatgatgctgtaatttggca

SEQ ID NO: 7418126 - DNA, 22 bp, Homo sapiens
aaaagtatttatggctatgtaa

SEQ ID NO: 7418127 - DNA, 22 bp, Homo sapiens
aaaagtatttatggctatgtaa

SEQ ID NO: 7418128 - DNA, 22 bp, Homo sapiens
aaaagtattttgagcactttat

SEQ ID NO: 7418129 - DNA, 22 bp, Homo sapiens
aaaagtattttgagcactttat

SEQ ID NO: 7418130 - DNA, 22 bp, Homo sapiens
aaaagtattttgagcactttat

SEQ ID NO: 7418131 - DNA, 22 bp, Homo sapiens
aaaagtattttgagcactttat

SEQ ID NO: 7418132 - DNA, 19 bp, Homo sapiens
aaaaggaatattctttggg

SEQ ID NO: 7418133 - DNA, 19 bp, Homo sapiens
aaaaggaatattctttggg

SEQ ID NO: 7418134 - DNA, 19 bp, Homo sapiens
aaaaggaatattctttggg

SEQ ID NO: 7418135 - DNA, 19 bp, Homo sapiens
aaaaggaatattctttggg

SEQ ID NO: 7418136 - DNA, 19 bp, Homo sapiens
aaaaggaatattctttggg

SEQ ID NO: 7418137 - DNA, 22 bp, Homo sapiens
aaaagtattttgagcactttat

SEQ ID NO: 7418138 - DNA, 22 bp, Homo sapiens
aaaagtattttgagcactttat

SEQ ID NO: 7418139 - DNA, 22 bp, Homo sapiens
aaaagtattttgagcactttat

SEQ ID NO: 7418140 - DNA, 22 bp, Homo sapiens
aaaagtgttcaggaagaataat

SEQ ID NO: 7418141 - DNA, 22 bp, Homo sapiens
aaaagtgttcaggaagaataat

SEQ ID NO: 7418142 - DNA, 22 bp, Homo sapiens
aaaagtgttcaggaagaataat

SEQ ID NO: 7418143 - DNA, 22 bp, Homo sapiens
aaaagtgttcaggaagaataat

SEQ ID NO: 7418144 - DNA, 22 bp, Homo sapiens
aaaagtgttcaggaagaataat

SEQ ID NO: 7418145 - DNA, 21 bp, Homo sapiens
aaaaggaaggtctgtttgggg

SEQ ID NO: 7418146 - DNA, 21 bp, Homo sapiens
aaaaggaaggtctgtttgggg

SEQ ID NO: 7418147 - DNA, 21 bp, Homo sapiens
aaaaggaaggtctgtttgggg

SEQ ID NO: 7418148 - DNA, 21 bp, Homo sapiens
aaaaggaaggtctgtttgggg

SEQ ID NO: 7418149 - DNA, 21 bp, Homo sapiens
aaaaggaaggtctgtttgggg

SEQ ID NO: 7418150 - DNA, 21 bp, Homo sapiens
aaaaggaaggtctgtttgggg

SEQ ID NO: 7418151 - DNA, 19 bp, Homo sapiens
aaaaggaatattctttggg

SEQ ID NO: 7418152 - DNA, 19 bp, Homo sapiens
aaaaggaatattctttggg

SEQ ID NO: 7418153 - DNA, 19 bp, Homo sapiens
aaaaggaatattctttggg

SEQ ID NO: 7418154 - DNA, 19 bp, Homo sapiens
aaaaggaatattctttggg

SEQ ID NO: 7418155 - DNA, 19 bp, Homo sapiens
aaaaggaatattctttggg

SEQ ID NO: 7418156 - DNA, 22 bp, Homo sapiens
aaaagctttgttaataggtttg

SEQ ID NO: 7418157 - DNA, 22 bp, Homo sapiens
aaaagctttgttaataggtttg

SEQ ID NO: 7418158 - DNA, 22 bp, Homo sapiens
aaaagctttgttaataggtttg

SEQ ID NO: 7418159 - DNA, 22 bp, Homo sapiens
aaaagctctttctgctgtagat

SEQ ID NO: 7418160 - DNA, 22 bp, Homo sapiens
aaaagctctttctgctgtagat

SEQ ID NO: 7418161 - DNA, 22 bp, Homo sapiens
aaaagctcattgataaaaagtc

SEQ ID NO: 7418162 - DNA, 22 bp, Homo sapiens
aaaagctctttctgctgtagat

SEQ ID NO: 7418163 - DNA, 22 bp, Homo sapiens
aaaagctcattgataaaaagtc

SEQ ID NO: 7418164 - DNA, 22 bp, Homo sapiens
aaaagctagtcaatgatgtatt

SEQ ID NO: 7418165 - DNA, 22 bp, Homo sapiens
aaaagctagtcaatgatgtatt

SEQ ID NO: 7418166 - DNA, 22 bp, Homo sapiens
aaaagctagtcaatgatgtatt

SEQ ID NO: 7418167 - DNA, 22 bp, Homo sapiens
aaaagttaactgtgttcatgca

SEQ ID NO: 7418168 - DNA, 22 bp, Homo sapiens
aaaagttaactgtgttcatgca

SEQ ID NO: 7418169 - DNA, 22 bp, Homo sapiens
aaaagttacctctgtaatataa

SEQ ID NO: 7418170 - DNA, 22 bp, Homo sapiens
aaaagttaactgtgttcatgca

SEQ ID NO: 7418171 - DNA, 22 bp, Homo sapiens
aaaagttacctctgtaatataa

SEQ ID NO: 7418172 - DNA, 22 bp, Homo sapiens
aaaagttacctctgtaatataa

SEQ ID NO: 7418173 - DNA, 22 bp, Homo sapiens
aaaagttacctctgtaatataa

SEQ ID NO: 7418174 - DNA, 22 bp, Homo sapiens
aaaagttacctctgtaatataa

SEQ ID NO: 7418175 - DNA, 22 bp, Homo sapiens
aaaagttacctctgtaatataa

SEQ ID NO: 7418176 - DNA, 22 bp, Homo sapiens
aaaagttacctctgtaatataa

SEQ ID NO: 7418177 - DNA, 22 bp, Homo sapiens
aaaagttcattagtgagcttct

SEQ ID NO: 7418178 - DNA, 22 bp, Homo sapiens
aaaagttcattagtgagcttct

SEQ ID NO: 7418179 - DNA, 22 bp, Homo sapiens
aaaagttcattagtgagcttct

SEQ ID NO: 7418180 - DNA, 22 bp, Homo sapiens
aaaagttattgatgcaggacaa

SEQ ID NO: 7418181 - DNA, 22 bp, Homo sapiens
aaaagttattgatgcaggacaa

SEQ ID NO: 7418182 - DNA, 22 bp, Homo sapiens
aaaagttagctattagtaggtg

SEQ ID NO: 7418183 - DNA, 22 bp, Homo sapiens
aaaagttagctattagtaggtg

SEQ ID NO: 7418184 - DNA, 22 bp, Homo sapiens
aaaagttacctctgtaatataa

SEQ ID NO: 7418185 - DNA, 22 bp, Homo sapiens
aaaagttacctctgtaatataa

SEQ ID NO: 7418186 - DNA, 22 bp, Homo sapiens
aaaagttacctctgtaatataa

SEQ ID NO: 7418187 - DNA, 22 bp, Homo sapiens
aaaagttacctctgtaatataa

SEQ ID NO: 7418188 - DNA, 22 bp, Homo sapiens
aaaagtttaagactcattctag

SEQ ID NO: 7418189 - DNA, 22 bp, Homo sapiens
aaaagtttaagactcattctag

SEQ ID NO: 7418190 - DNA, 22 bp, Homo sapiens
aaaagtttaagactcattctag

SEQ ID NO: 7418191 - DNA, 22 bp, Homo sapiens
aaaagtttaagactcattctag

SEQ ID NO: 7418192 - DNA, 22 bp, Homo sapiens
aaaagtttaagactcattctag

SEQ ID NO: 7418193 - DNA, 21 bp, Homo sapiens
aaaagtttgacaggaaaggga

SEQ ID NO: 7418194 - DNA, 21 bp, Homo sapiens
aaaagtttgacaggaaaggga

SEQ ID NO: 7418195 - DNA, 21 bp, Homo sapiens
aaaagtttgacaggaaaggga

SEQ ID NO: 7418196 - DNA, 22 bp, Homo sapiens
aaaagtttaagactcattctag

SEQ ID NO: 7418197 - DNA, 22 bp, Homo sapiens
aaaagtttaagactcattctag

SEQ ID NO: 7418198 - DNA, 22 bp, Homo sapiens
aaaagtttaagactcattctag

SEQ ID NO: 7418199 - DNA, 22 bp, Homo sapiens
aaaagtttaagactcattctag

SEQ ID NO: 7418200 - DNA, 22 bp, Homo sapiens
aaaagtttaagactcattctag

SEQ ID NO: 7418201 - DNA, 22 bp, Homo sapiens
aaaagtttaagactcattctag

SEQ ID NO: 7418202 - DNA, 22 bp, Homo sapiens
aaaagttccctggttagaaaag

SEQ ID NO: 7418203 - DNA, 22 bp, Homo sapiens
aaaagttccctggttagaaaag

SEQ ID NO: 7418204 - DNA, 22 bp, Homo sapiens
aaaagttccctggttagaaaag

SEQ ID NO: 7418205 - DNA, 22 bp, Homo sapiens
aaaagttccctggttagaaaag

SEQ ID NO: 7418206 - DNA, 22 bp, Homo sapiens
aaaagttccctggttagaaaag

SEQ ID NO: 7418207 - DNA, 22 bp, Homo sapiens
aaaagttccctggttagaaaag

SEQ ID NO: 7418208 - DNA, 22 bp, Homo sapiens
aaaagttccctggttagaaaag

SEQ ID NO: 7418209 - DNA, 22 bp, Homo sapiens
aaaatactactgtcttcttccc

SEQ ID NO: 7418210 - DNA, 22 bp, Homo sapiens
aaaatactactgtcttcttccc

SEQ ID NO: 7418211 - DNA, 22 bp, Homo sapiens
aaaatactactgtcttcttccc

SEQ ID NO: 7418212 - DNA, 22 bp, Homo sapiens
aaaatactactgtcttcttccc

SEQ ID NO: 7418213 - DNA, 22 bp, Homo sapiens
aaaatactactgtcttcttccc

SEQ ID NO: 7418214 - DNA, 22 bp, Homo sapiens
aaaatactactgtcttcttccc

SEQ ID NO: 7418215 - DNA, 22 bp, Homo sapiens
aaaatactactgtcttcttccc

SEQ ID NO: 7418216 - DNA, 22 bp, Homo sapiens
aaaatactactgtcttcttccc

SEQ ID NO: 7418217 - DNA, 22 bp, Homo sapiens
aaaatactactgtcttcttccc

SEQ ID NO: 7418218 - DNA, 22 bp, Homo sapiens
aaaatactactgtcttcttccc

SEQ ID NO: 7418219 - DNA, 22 bp, Homo sapiens
aaaatacacatactaggggaaa

SEQ ID NO: 7418220 - DNA, 22 bp, Homo sapiens
aaaatacacatactaggggaaa

SEQ ID NO: 7418221 - DNA, 22 bp, Homo sapiens
aaaatactactgtcttcttccc

SEQ ID NO: 7418222 - DNA, 22 bp, Homo sapiens
aaaatactactgtcttcttccc

SEQ ID NO: 7418223 - DNA, 22 bp, Homo sapiens
aaaatactactgtcttcttccc

SEQ ID NO: 7418224 - DNA, 22 bp, Homo sapiens
aaaatactgtggagtgttgaaa

SEQ ID NO: 7418225 - DNA, 22 bp, Homo sapiens
aaaatactgtggagtgttgaaa

SEQ ID NO: 7418226 - DNA, 22 bp, Homo sapiens
aaaatactgtggagtgttgaaa

SEQ ID NO: 7418227 - DNA, 22 bp, Homo sapiens
aaaatactactgtcttcttccc

SEQ ID NO: 7418228 - DNA, 22 bp, Homo sapiens
aaaatactgtggagtgttgaaa

SEQ ID NO: 7418229 - DNA, 22 bp, Homo sapiens
aaaatactgtggagtgttgaaa

SEQ ID NO: 7418230 - DNA, 22 bp, Homo sapiens
aaaatactgtggagtgttgaaa

SEQ ID NO: 7418231 - DNA, 22 bp, Homo sapiens
aaaatctggcaacactaagttt

SEQ ID NO: 7418232 - DNA, 22 bp, Homo sapiens
aaaatctggcaacactaagttt

SEQ ID NO: 7418233 - DNA, 22 bp, Homo sapiens
aaaatctggcaacactaagttt

SEQ ID NO: 7418234 - DNA, 22 bp, Homo sapiens
aaaatctggcaacactaagttt

SEQ ID NO: 7418235 - DNA, 22 bp, Homo sapiens
aaaatgagacacatgtgactcc

SEQ ID NO: 7418236 - DNA, 22 bp, Homo sapiens
aaaatgagacacatgtgactcc

SEQ ID NO: 7418237 - DNA, 22 bp, Homo sapiens
aaaatctgcttccttttacaga

SEQ ID NO: 7418238 - DNA, 22 bp, Homo sapiens
aaaatgagatacagtttgaaag

SEQ ID NO: 7418239 - DNA, 22 bp, Homo sapiens
aaaatgagacacatgtgactcc

SEQ ID NO: 7418240 - DNA, 22 bp, Homo sapiens
aaaatgacattccagtgatatt

SEQ ID NO: 7418241 - DNA, 22 bp, Homo sapiens
aaaatgagacacatgtgactcc

SEQ ID NO: 7418242 - DNA, 22 bp, Homo sapiens
aaaatgagcatattgatccttt

SEQ ID NO: 7418243 - DNA, 22 bp, Homo sapiens
aaaatgagcatattgatccttt

SEQ ID NO: 7418244 - DNA, 22 bp, Homo sapiens
aaaatgagcatattgatccttt

SEQ ID NO: 7418245 - DNA, 21 bp, Homo sapiens
aaaagtttgacaggaaaggga

SEQ ID NO: 7418246 - DNA, 22 bp, Homo sapiens
aaaagtttgtgcaaacactcag

SEQ ID NO: 7418247 - DNA, 22 bp, Homo sapiens
aaaagtttgtgcaaacactcag

SEQ ID NO: 7418248 - DNA, 22 bp, Homo sapiens
aaaagtttgtgcaaacactcag

SEQ ID NO: 7418249 - DNA, 22 bp, Homo sapiens
aaaagtttgtgcaaacactcag

SEQ ID NO: 7418250 - DNA, 22 bp, Homo sapiens
aaaagtttgtgcaaacactcag

SEQ ID NO: 7418251 - DNA, 21 bp, Homo sapiens
aaaagtttgacaggaaaggga

SEQ ID NO: 7418252 - DNA, 21 bp, Homo sapiens
aaaagtttgacaggaaaggga

SEQ ID NO: 7418253 - DNA, 21 bp, Homo sapiens
aaaagtttgacaggaaaggga

SEQ ID NO: 7418254 - DNA, 22 bp, Homo sapiens
aaaagtttgtgcaaacactcag

SEQ ID NO: 7418255 - DNA, 22 bp, Homo sapiens
aaaagtttgtgcaaacactcag

SEQ ID NO: 7418256 - DNA, 22 bp, Homo sapiens
aaaagtttgtgcaaacactcag

SEQ ID NO: 7418257 - DNA, 22 bp, Homo sapiens
aaaataacttctactatttgca

SEQ ID NO: 7418258 - DNA, 22 bp, Homo sapiens
aaaataacttctactatttgca

SEQ ID NO: 7418259 - DNA, 22 bp, Homo sapiens
aaaataacttctactatttgca

SEQ ID NO: 7418260 - DNA, 22 bp, Homo sapiens
aaaataacttctactatttgca

SEQ ID NO: 7418261 - DNA, 18 bp, Homo sapiens
aaaataacaaagttggct

SEQ ID NO: 7418262 - DNA, 18 bp, Homo sapiens
aaaataacaaagttggct

SEQ ID NO: 7418263 - DNA, 18 bp, Homo sapiens
aaaataacaaagttggct

SEQ ID NO: 7418264 - DNA, 18 bp, Homo sapiens
aaaataacaaagttggct

SEQ ID NO: 7418265 - DNA, 18 bp, Homo sapiens
aaaataacaaagttggct

SEQ ID NO: 7418266 - DNA, 18 bp, Homo sapiens
aaaataacaaagttggct

SEQ ID NO: 7418267 - DNA, 22 bp, Homo sapiens
aaaataacttctactatttgca

SEQ ID NO: 7418268 - DNA, 22 bp, Homo sapiens
aaaataacttctactatttgca

SEQ ID NO: 7418269 - DNA, 22 bp, Homo sapiens
aaaataacttctactatttgca

SEQ ID NO: 7418270 - DNA, 22 bp, Homo sapiens
aaaataacttctactatttgca

SEQ ID NO: 7418271 - DNA, 22 bp, Homo sapiens
aaaataacttctactatttgca

SEQ ID NO: 7418272 - DNA, 22 bp, Homo sapiens
aaaataacttctactatttgca

SEQ ID NO: 7418273 - DNA, 22 bp, Homo sapiens
aaaataacttctactatttgca

SEQ ID NO: 7418274 - DNA, 22 bp, Homo sapiens
aaaatacacatactaggggaaa

SEQ ID NO: 7418275 - DNA, 22 bp, Homo sapiens
aaaataagttggtcctgtcctt

SEQ ID NO: 7418276 - DNA, 22 bp, Homo sapiens
aaaataagttggtcctgtcctt

SEQ ID NO: 7418277 - DNA, 22 bp, Homo sapiens
aaaatacacatactaggggaaa

SEQ ID NO: 7418278 - DNA, 22 bp, Homo sapiens
aaaatacacatactaggggaaa

SEQ ID NO: 7418279 - DNA, 22 bp, Homo sapiens
aaaatacacatactaggggaaa

SEQ ID NO: 7418280 - DNA, 22 bp, Homo sapiens
aaaatacacatactaggggaaa

SEQ ID NO: 7418281 - DNA, 22 bp, Homo sapiens
aaaatacacatactaggggaaa

SEQ ID NO: 7418282 - DNA, 22 bp, Homo sapiens
aaaatacacatactaggggaaa

SEQ ID NO: 7418283 - DNA, 22 bp, Homo sapiens
aaatgaactcttcctgcatccc

SEQ ID NO: 7418284 - DNA, 22 bp, Homo sapiens
aaatgaactcttcctgcatccc

SEQ ID NO: 7418285 - DNA, 22 bp, Homo sapiens
aaatgaactcaatgatctccca

SEQ ID NO: 7418286 - DNA, 22 bp, Homo sapiens
aaatccagtttgtcatttccca

SEQ ID NO: 7418287 - DNA, 22 bp, Homo sapiens
aaatccagtgttcaaagtttga

SEQ ID NO: 7418288 - DNA, 22 bp, Homo sapiens
aaatccagtgttcaaagtttga

SEQ ID NO: 7418289 - DNA, 21 bp, Homo sapiens
aaatgaatgtggtagtgcaag

SEQ ID NO: 7418290 - DNA, 21 bp, Homo sapiens
aaatgaatgtggtagtgcaag

SEQ ID NO: 7418291 - DNA, 21 bp, Homo sapiens
aaatgaatgtggtagtgcaag

SEQ ID NO: 7418292 - DNA, 21 bp, Homo sapiens
aaatgaatgtggtagtgcaag

SEQ ID NO: 7418293 - DNA, 21 bp, Homo sapiens
aaatgaatgtggtagtgcaag

SEQ ID NO: 7418294 - DNA, 21 bp, Homo sapiens
aaatgaatgtggtagtgcaag

SEQ ID NO: 7418295 - DNA, 21 bp, Homo sapiens
aaatgaatgtggtagtgcaag

SEQ ID NO: 7418296 - DNA, 22 bp, Homo sapiens
aaatgaactcttcctgcatccc

SEQ ID NO: 7418297 - DNA, 21 bp, Homo sapiens
aaatgaatgtggtagtgcaag

SEQ ID NO: 7418298 - DNA, 21 bp, Homo sapiens
aaatgaatgtggtagtgcaag

SEQ ID NO: 7418299 - DNA, 21 bp, Homo sapiens
aaatgaatgtggtagtgcaag

SEQ ID NO: 7418300 - DNA, 22 bp, Homo sapiens
aaatgacactaggctttttgca

SEQ ID NO: 7418301 - DNA, 22 bp, Homo sapiens
aaatgacactaggctttttgca

SEQ ID NO: 7418302 - DNA, 22 bp, Homo sapiens
aaatgacactaggctttttgca

SEQ ID NO: 7418303 - DNA, 22 bp, Homo sapiens
aaatgacaataaaagtccatgc

SEQ ID NO: 7418304 - DNA, 22 bp, Homo sapiens
aaatgacaataaaagtccatgc

SEQ ID NO: 7418305 - DNA, 22 bp, Homo sapiens
aaatgacactcattcagtgtca

SEQ ID NO: 7418306 - DNA, 22 bp, Homo sapiens
aaatgacactcattcagtgtca

SEQ ID NO: 7418307 - DNA, 22 bp, Homo sapiens
aaatgacactaggctttttgca

SEQ ID NO: 7418308 - DNA, 22 bp, Homo sapiens
aaatgacactaggctttttgca

SEQ ID NO: 7418309 - DNA, 22 bp, Homo sapiens
aaatgacaataaaagtccatgc

SEQ ID NO: 7418310 - DNA, 22 bp, Homo sapiens
aaatgacaataaaagtccatgc

SEQ ID NO: 7418311 - DNA, 22 bp, Homo sapiens
aaatgacaataaaagtccatgc

SEQ ID NO: 7418312 - DNA, 22 bp, Homo sapiens
aaatgacaataaaagtccatgc

SEQ ID NO: 7418313 - DNA, 22 bp, Homo sapiens
aaatgacaataaaagtccatgc

SEQ ID NO: 7418314 - DNA, 22 bp, Homo sapiens
aaatgacaataaaagtccatgc

SEQ ID NO: 7418315 - DNA, 22 bp, Homo sapiens
aaatgacaataaaagtccatgc

SEQ ID NO: 7418316 - DNA, 22 bp, Homo sapiens
aaacttagatgtttttagagtt

SEQ ID NO: 7418317 - DNA, 22 bp, Homo sapiens
aaactgttgtggtttatcatta

SEQ ID NO: 7418318 - DNA, 22 bp, Homo sapiens
aaactgtttccctccataacct

SEQ ID NO: 7418319 - DNA, 23 bp, Homo sapiens
aaactgttgcttcaatgtatcct

SEQ ID NO: 7418320 - DNA, 22 bp, Homo sapiens
aaactgttgtggtttatcatta

SEQ ID NO: 7418321 - DNA, 23 bp, Homo sapiens
aaatgacatatggtttctgaagg

SEQ ID NO: 7418322 - DNA, 23 bp, Homo sapiens
aaatgacatatggtttctgaagg

SEQ ID NO: 7418323 - DNA, 23 bp, Homo sapiens
aaatgacatatggtttctgaagg

SEQ ID NO: 7418324 - DNA, 23 bp, Homo sapiens
aaatgacatatggtttctgaagg

SEQ ID NO: 7418325 - DNA, 23 bp, Homo sapiens
aaatgacatatggtttctgaagg

SEQ ID NO: 7418326 - DNA, 23 bp, Homo sapiens
aaatgacatatggtttctgaagg

SEQ ID NO: 7418327 - DNA, 23 bp, Homo sapiens
aaatgacatatggtttctgaagg

SEQ ID NO: 7418328 - DNA, 22 bp, Homo sapiens
aaactgtgtatgcagagagcat

SEQ ID NO: 7418329 - DNA, 22 bp, Homo sapiens
aaactgttatagcagaaaggac

SEQ ID NO: 7418330 - DNA, 22 bp, Homo sapiens
aaactgttatagcagaaaggac

SEQ ID NO: 7418331 - DNA, 23 bp, Homo sapiens
aaatgacatatggtttctgaagg

SEQ ID NO: 7418332 - DNA, 22 bp, Homo sapiens
aaactgtgagctagtaaatagg

SEQ ID NO: 7418333 - DNA, 22 bp, Homo sapiens
aaactgtgcttcccaaatgccc

SEQ ID NO: 7418334 - DNA, 22 bp, Homo sapiens
aaatgacactcattcagtgtca

SEQ ID NO: 7418335 - DNA, 22 bp, Homo sapiens
aaatgacactcattcagtgtca

SEQ ID NO: 7418336 - DNA, 22 bp, Homo sapiens
aaatgacactcattcagtgtca

SEQ ID NO: 7418337 - DNA, 22 bp, Homo sapiens
aaatgacactcattcagtgtca

SEQ ID NO: 7418338 - DNA, 22 bp, Homo sapiens
aaatgacactcattcagtgtca

SEQ ID NO: 7418339 - DNA, 22 bp, Homo sapiens
aaatgacagagctgggactagt

SEQ ID NO: 7418340 - DNA, 22 bp, Homo sapiens
aaatgacagagctgggactagt

SEQ ID NO: 7418341 - DNA, 22 bp, Homo sapiens
aaatgacagagctgggactagt

SEQ ID NO: 7418342 - DNA, 22 bp, Homo sapiens
aaatgacactcattcagtgtca

SEQ ID NO: 7418343 - DNA, 22 bp, Homo sapiens
aaatgacactcattcagtgtca

SEQ ID NO: 7418344 - DNA, 22 bp, Homo sapiens
aaatgacagagctgggactagt

SEQ ID NO: 7418345 - DNA, 22 bp, Homo sapiens
aaatgacagttctctctgagta

SEQ ID NO: 7418346 - DNA, 22 bp, Homo sapiens
aaatgacagagtaagctgttta

SEQ ID NO: 7418347 - DNA, 22 bp, Homo sapiens
aaatgacagttctctctgagta

SEQ ID NO: 7418348 - DNA, 22 bp, Homo sapiens
aaatgacagttctctctgagta

SEQ ID NO: 7418349 - DNA, 22 bp, Homo sapiens
aaatgacagttctctctgagta

SEQ ID NO: 7418350 - DNA, 22 bp, Homo sapiens
aaatgacagagtaagctgttta

SEQ ID NO: 7418351 - DNA, 22 bp, Homo sapiens
aaatgacagagtaagctgttta

SEQ ID NO: 7418352 - DNA, 22 bp, Homo sapiens
aaatgacagagtaagctgttta

SEQ ID NO: 7418353 - DNA, 22 bp, Homo sapiens
aaatgacagagtaagctgttta

SEQ ID NO: 7418354 - DNA, 22 bp, Homo sapiens
aaatgacagagtaagctgttta

SEQ ID NO: 7418355 - DNA, 22 bp, Homo sapiens
aaatgacagagtaagctgttta

SEQ ID NO: 7418356 - DNA, 22 bp, Homo sapiens
aaatgacagagtaagctgttta

SEQ ID NO: 7418357 - DNA, 22 bp, Homo sapiens
aaataacagtcagggacaacat

SEQ ID NO: 7418358 - DNA, 22 bp, Homo sapiens
aaataacagtcagggacaacat

SEQ ID NO: 7418359 - DNA, 22 bp, Homo sapiens
aaataacagtcagggacaacat

SEQ ID NO: 7418360 - DNA, 22 bp, Homo sapiens
aaataacagtcagggacaacat

SEQ ID NO: 7418361 - DNA, 22 bp, Homo sapiens
aaataacagtcagggacaacat

SEQ ID NO: 7418362 - DNA, 22 bp, Homo sapiens
aaataacagtcagggacaacat

SEQ ID NO: 7418363 - DNA, 22 bp, Homo sapiens
aaataacagtcagggacaacat

SEQ ID NO: 7418364 - DNA, 22 bp, Homo sapiens
aaataaaggtccactttagggc

SEQ ID NO: 7418365 - DNA, 22 bp, Homo sapiens
aaataaaggtccactttagggc

SEQ ID NO: 7418366 - DNA, 22 bp, Homo sapiens
aaataaaggtccactttagggc

SEQ ID NO: 7418367 - DNA, 22 bp, Homo sapiens
aaataaaggtccactttagggc

SEQ ID NO: 7418368 - DNA, 22 bp, Homo sapiens
aaataaaggtccactttagggc

SEQ ID NO: 7418369 - DNA, 22 bp, Homo sapiens
aaataaaggtccactttagggc

SEQ ID NO: 7418370 - DNA, 22 bp, Homo sapiens
aaataaaggaactgttttccca

SEQ ID NO: 7418371 - DNA, 22 bp, Homo sapiens
aaataaactgaagcacagagag

SEQ ID NO: 7418372 - DNA, 22 bp, Homo sapiens
aaataaaggaactgttttccca

SEQ ID NO: 7418373 - DNA, 22 bp, Homo sapiens
aaataaaggaactgttttccca

SEQ ID NO: 7418374 - DNA, 22 bp, Homo sapiens
aaatacaatttcaggctgtaat

SEQ ID NO: 7418375 - DNA, 22 bp, Homo sapiens
aaatacaatttcaggctgtaat

SEQ ID NO: 7418376 - DNA, 22 bp, Homo sapiens
aaatacacgtacatgtgtaaaa

SEQ ID NO: 7418377 - DNA, 22 bp, Homo sapiens
aaatacacgtacatgtgtaaaa

SEQ ID NO: 7418378 - DNA, 22 bp, Homo sapiens
aaatacacgtacatgtgtaaaa

SEQ ID NO: 7418379 - DNA, 22 bp, Homo sapiens
aaatacacgtacatgtgtaaaa

SEQ ID NO: 7418380 - DNA, 22 bp, Homo sapiens
aaatacaatttcaggctgtaat

SEQ ID NO: 7418381 - DNA, 22 bp, Homo sapiens
aaatacaatttcaggctgtaat

SEQ ID NO: 7418382 - DNA, 22 bp, Homo sapiens
aaatacaatttcaggctgtaat

SEQ ID NO: 7418383 - DNA, 22 bp, Homo sapiens
aaatacaatttcaggctgtaat

SEQ ID NO: 7418384 - DNA, 22 bp, Homo sapiens
aaatacaatttcaggctgtaat

SEQ ID NO: 7418385 - DNA, 22 bp, Homo sapiens
aaatacaatttcaggctgtaat

SEQ ID NO: 7418386 - DNA, 22 bp, Homo sapiens
aaatacaatttcaggctgtaat

SEQ ID NO: 7418387 - DNA, 22 bp, Homo sapiens
aaatacaatttcaggctgtaat

SEQ ID NO: 7418388 - DNA, 22 bp, Homo sapiens
aaataacagtcagggacaacat

SEQ ID NO: 7418389 - DNA, 22 bp, Homo sapiens
aaatacaatttcaggctgtaat

SEQ ID NO: 7418390 - DNA, 22 bp, Homo sapiens
aaatacaatttcaggctgtaat

SEQ ID NO: 7418391 - DNA, 21 bp, Homo sapiens
aaatacagatgcaaatctgtt

SEQ ID NO: 7418392 - DNA, 21 bp, Homo sapiens
aaatacagatgcaaatctgtt

SEQ ID NO: 7418393 - DNA, 20 bp, Homo sapiens
aaatccagtgtgtattttac

SEQ ID NO: 7418394 - DNA, 21 bp, Homo sapiens
aaatacagatgcaaatctgtt

SEQ ID NO: 7418395 - DNA, 22 bp, Homo sapiens
aaatacagattccagggtctta

SEQ ID NO: 7418396 - DNA, 22 bp, Homo sapiens
aaatacagatagatttaaccca

SEQ ID NO: 7418397 - DNA, 22 bp, Homo sapiens
aaatacagatagatttaaccca

SEQ ID NO: 7418398 - DNA, 22 bp, Homo sapiens
aaatacagatagatttaaccca

SEQ ID NO: 7418399 - DNA, 21 bp, Homo sapiens
aaatacagatgcaaatctgtt

SEQ ID NO: 7418400 - DNA, 21 bp, Homo sapiens
aaatacagatgcaaatctgtt

SEQ ID NO: 7418401 - DNA, 21 bp, Homo sapiens
aaatacagatgcaaatctgtt

SEQ ID NO: 7418402 - DNA, 21 bp, Homo sapiens
aaatacagatgcaaatctgtt

SEQ ID NO: 7418403 - DNA, 21 bp, Homo sapiens
aaatacagatgcaaatctgtt

SEQ ID NO: 7418404 - DNA, 21 bp, Homo sapiens
aaatacagatgcaaatctgtt

SEQ ID NO: 7418405 - DNA, 21 bp, Homo sapiens
aaatacagatgcaaatctgtt

SEQ ID NO: 7418406 - DNA, 22 bp, Homo sapiens
aaatacagagttgcttaaaagc

SEQ ID NO: 7418407 - DNA, 22 bp, Homo sapiens
aaatacagagttgcttaaaagc

SEQ ID NO: 7418408 - DNA, 22 bp, Homo sapiens
aaatacagagttgcttaaaagc

SEQ ID NO: 7418409 - DNA, 22 bp, Homo sapiens
aaatacagagttgcttaaaagc

SEQ ID NO: 7418410 - DNA, 22 bp, Homo sapiens
aaatacagagttgcttaaaagc

SEQ ID NO: 7418411 - DNA, 22 bp, Homo sapiens
aaatacagagttgcttaaaagc

SEQ ID NO: 7418412 - DNA, 22 bp, Homo sapiens
aaatacagagttgcttaaaagc

SEQ ID NO: 7418413 - DNA, 22 bp, Homo sapiens
aaatacagagttgcttaaaagc

SEQ ID NO: 7418414 - DNA, 22 bp, Homo sapiens
aaatacagagttgcttaaaagc

SEQ ID NO: 7418415 - DNA, 22 bp, Homo sapiens
aaatacagagttatggacctca

SEQ ID NO: 7418416 - DNA, 22 bp, Homo sapiens
aaatacagagttatggacctca

SEQ ID NO: 7418417 - DNA, 22 bp, Homo sapiens
aaatacagagttatggacctca

SEQ ID NO: 7418418 - DNA, 22 bp, Homo sapiens
aaatacagagttgcttaaaagc

SEQ ID NO: 7418419 - DNA, 22 bp, Homo sapiens
aaatacagagttgcttaaaagc

SEQ ID NO: 7418420 - DNA, 21 bp, Homo sapiens
aaatacagaaacttgttttca

SEQ ID NO: 7418421 - DNA, 21 bp, Homo sapiens
aaatacagaaacttgttttca

SEQ ID NO: 7418422 - DNA, 21 bp, Homo sapiens
aaatacagaaacttgttttca

SEQ ID NO: 7418423 - DNA, 22 bp, Homo sapiens
aaatgtctttgagtatttctgc

SEQ ID NO: 7418424 - DNA, 22 bp, Homo sapiens
aaatgtctttgagtatttctgc

SEQ ID NO: 7418425 - DNA, 22 bp, Homo sapiens
aaatgtctttgagtatttctgc

SEQ ID NO: 7418426 - DNA, 22 bp, Homo sapiens
aaatgtctttcttctgctacgt

SEQ ID NO: 7418427 - DNA, 22 bp, Homo sapiens
aaatgtctttgagtttttataa

SEQ ID NO: 7418428 - DNA, 22 bp, Homo sapiens
aaatgtctttgagtttttataa

SEQ ID NO: 7418429 - DNA, 22 bp, Homo sapiens
aaatgtctttgagtatttctgc

SEQ ID NO: 7418430 - DNA, 22 bp, Homo sapiens
aaatgtgacagatgcagtacag

SEQ ID NO: 7418431 - DNA, 22 bp, Homo sapiens
aaatgtctttgagtttttataa

SEQ ID NO: 7418432 - DNA, 22 bp, Homo sapiens
aaatgtgacagatgcagtacag

SEQ ID NO: 7418433 - DNA, 22 bp, Homo sapiens
aaatgtctttcttctgctacgt

SEQ ID NO: 7418434 - DNA, 22 bp, Homo sapiens
aaatgtctttcttctgctacgt

SEQ ID NO: 7418435 - DNA, 22 bp, Homo sapiens
aaatgtctttcaatagagaaat

SEQ ID NO: 7418436 - DNA, 22 bp, Homo sapiens
aaatgtctttcaatagagaaat

SEQ ID NO: 7418437 - DNA, 22 bp, Homo sapiens
aaatgtctttcaatagagaaat

SEQ ID NO: 7418438 - DNA, 22 bp, Homo sapiens
aaatgtctttcaatagagaaat

SEQ ID NO: 7418439 - DNA, 22 bp, Homo sapiens
aaagacacacagtgcttcagtt

SEQ ID NO: 7418440 - DNA, 22 bp, Homo sapiens
aaagacacacagtgcttcagtt

SEQ ID NO: 7418441 - DNA, 22 bp, Homo sapiens
aaagacacacagtgcttcagtt

SEQ ID NO: 7418442 - DNA, 22 bp, Homo sapiens
aaagacacacagtgcttcagtt

SEQ ID NO: 7418443 - DNA, 22 bp, Homo sapiens
aaatgtgagttatagcaataga

SEQ ID NO: 7418444 - DNA, 22 bp, Homo sapiens
aaatgtgagttatagcaataga

SEQ ID NO: 7418445 - DNA, 22 bp, Homo sapiens
aaagacacacagccagcaagtg

SEQ ID NO: 7418446 - DNA, 22 bp, Homo sapiens
aaagacacacagccagcaagtg

SEQ ID NO: 7418447 - DNA, 22 bp, Homo sapiens
aaagacacacagccagcaagtg

SEQ ID NO: 7418448 - DNA, 22 bp, Homo sapiens
aaatgtgagttatagcaataga

SEQ ID NO: 7418449 - DNA, 23 bp, Homo sapiens
aaatgtgagggaaaatctttctg

SEQ ID NO: 7418450 - DNA, 23 bp, Homo sapiens
aaatgtgagggaaaatctttctg

SEQ ID NO: 7418451 - DNA, 23 bp, Homo sapiens
aaatgtgagggaaaatctttctg

SEQ ID NO: 7418452 - DNA, 23 bp, Homo sapiens
aaatgtgagggaaaatctttctg

SEQ ID NO: 7418453 - DNA, 22 bp, Homo sapiens
aaatgtgagactgagttttcct

SEQ ID NO: 7418454 - DNA, 22 bp, Homo sapiens
aaatgtgacagatgcagtacag

SEQ ID NO: 7418455 - DNA, 22 bp, Homo sapiens
aaatgtgagactgagttttcct

SEQ ID NO: 7418456 - DNA, 22 bp, Homo sapiens
aaatgtgagactgagttttcct

SEQ ID NO: 7418457 - DNA, 22 bp, Homo sapiens
aaagacagatggcaaggatgat

SEQ ID NO: 7418458 - DNA, 22 bp, Homo sapiens
aaagacagatggcaaggatgat

SEQ ID NO: 7418459 - DNA, 22 bp, Homo sapiens
aaagacagatggcaaggatgat

SEQ ID NO: 7418460 - DNA, 22 bp, Homo sapiens
aaagacagagctgtaggggaaa

SEQ ID NO: 7418461 - DNA, 22 bp, Homo sapiens
aaagacagatggcaaggatgat

SEQ ID NO: 7418462 - DNA, 22 bp, Homo sapiens
aaagacagatggcaaggatgat

SEQ ID NO: 7418463 - DNA, 22 bp, Homo sapiens
aaagacacatgtctcttagatt

SEQ ID NO: 7418464 - DNA, 22 bp, Homo sapiens
aaagacacatatgcttaaccca

SEQ ID NO: 7418465 - DNA, 22 bp, Homo sapiens
aaagacacatgtctcttagatt

SEQ ID NO: 7418466 - DNA, 22 bp, Homo sapiens
aaagacagagctgtaggggaaa

SEQ ID NO: 7418467 - DNA, 22 bp, Homo sapiens
aaagacagagctgtaggggaaa

SEQ ID NO: 7418468 - DNA, 22 bp, Homo sapiens
aaagacagagctgtaggggaaa

SEQ ID NO: 7418469 - DNA, 22 bp, Homo sapiens
aaagacagacggaaacctgagg

SEQ ID NO: 7418470 - DNA, 22 bp, Homo sapiens
aaagacagacggaaacctgagg

SEQ ID NO: 7418471 - DNA, 22 bp, Homo sapiens
aaagacacatgtctcttagatt

SEQ ID NO: 7418472 - DNA, 22 bp, Homo sapiens
aaagacagtggattcaaaatcc

SEQ ID NO: 7418473 - DNA, 22 bp, Homo sapiens
aaagacagtggattcaaaatcc

SEQ ID NO: 7418474 - DNA, 22 bp, Homo sapiens
aaagacagtggattcaaaatcc

SEQ ID NO: 7418475 - DNA, 22 bp, Homo sapiens
aaagacagatggcaaggatgat

SEQ ID NO: 7418476 - DNA, 22 bp, Homo sapiens
aaagacagatggcaaggatgat

SEQ ID NO: 7418477 - DNA, 22 bp, Homo sapiens
aaagacagatggcaaggatgat

SEQ ID NO: 7418478 - DNA, 22 bp, Homo sapiens
aaagacagatggcaaggatgat

SEQ ID NO: 7418479 - DNA, 22 bp, Homo sapiens
aaagacagtggattcaaaatcc

SEQ ID NO: 7418480 - DNA, 22 bp, Homo sapiens
aaagacagtggattcaaaatcc

SEQ ID NO: 7418481 - DNA, 22 bp, Homo sapiens
aaagacatatttctaagtttat

SEQ ID NO: 7418482 - DNA, 22 bp, Homo sapiens
aaagacatatttctaagtttat

SEQ ID NO: 7418483 - DNA, 22 bp, Homo sapiens
aaagacatcagaaccagctgag

SEQ ID NO: 7418484 - DNA, 22 bp, Homo sapiens
aaagacatcagaaccagctgag

SEQ ID NO: 7418485 - DNA, 22 bp, Homo sapiens
aaagacatatttctaagtttat

SEQ ID NO: 7418486 - DNA, 22 bp, Homo sapiens
aaagacatatttctaagtttat

SEQ ID NO: 7418487 - DNA, 22 bp, Homo sapiens
aaagacagtggattcaaaatcc

SEQ ID NO: 7418488 - DNA, 22 bp, Homo sapiens
aaagacatatttctaagtttat

SEQ ID NO: 7418489 - DNA, 22 bp, Homo sapiens
aaagacagtggattcaaaatcc

SEQ ID NO: 7418490 - DNA, 22 bp, Homo sapiens
aaagacatatttctaagtttat

SEQ ID NO: 7418491 - DNA, 22 bp, Homo sapiens
aaagacatatttctaagtttat

SEQ ID NO: 7418492 - DNA, 22 bp, Homo sapiens
aaagacatatttctaagtttat

SEQ ID NO: 7418493 - DNA, 22 bp, Homo sapiens
aaagacatatttctaagtttat

SEQ ID NO: 7418494 - DNA, 22 bp, Homo sapiens
aaagacatatttctaagtttat

SEQ ID NO: 7418495 - DNA, 22 bp, Homo sapiens
aaatgtctgagacttctgaact

SEQ ID NO: 7418496 - DNA, 22 bp, Homo sapiens
aaatgtctgagacttctgaact

SEQ ID NO: 7418497 - DNA, 22 bp, Homo sapiens
aaatgtctgagacttctgaact

SEQ ID NO: 7418498 - DNA, 22 bp, Homo sapiens
aaatgtctgagacttctgaact

SEQ ID NO: 7418499 - DNA, 22 bp, Homo sapiens
aaatgtctgtatgagaaagaga

SEQ ID NO: 7418500 - DNA, 22 bp, Homo sapiens
aaatgtctgtatgagaaagaga

SEQ ID NO: 7418501 - DNA, 22 bp, Homo sapiens
aaatgtctgtatgagaaagaga

SEQ ID NO: 7418502 - DNA, 22 bp, Homo sapiens
aaatgtctgtaggggctgcagg

SEQ ID NO: 7418503 - DNA, 22 bp, Homo sapiens
aaatgtctgtaggggctgcagg

SEQ ID NO: 7418504 - DNA, 22 bp, Homo sapiens
aaatgtctgtatgagaaagaga

SEQ ID NO: 7418505 - DNA, 22 bp, Homo sapiens
aaatgtctgtatgagaaagaga

SEQ ID NO: 7418506 - DNA, 22 bp, Homo sapiens
aaatggtgtttctaatgctaga

SEQ ID NO: 7418507 - DNA, 22 bp, Homo sapiens
aaatggtttaattatgtttaat

SEQ ID NO: 7418508 - DNA, 22 bp, Homo sapiens
aaatgtctctattgcctctggt

SEQ ID NO: 7418509 - DNA, 22 bp, Homo sapiens
aaatggtttaattatgtttaat

SEQ ID NO: 7418510 - DNA, 22 bp, Homo sapiens
aaatgtctctattgcctctggt

SEQ ID NO: 7418511 - DNA, 22 bp, Homo sapiens
aaatgtctgagacttctgaact

SEQ ID NO: 7418512 - DNA, 22 bp, Homo sapiens
aaatgtctgagacttctgaact

SEQ ID NO: 7418513 - DNA, 22 bp, Homo sapiens
aaatggtgtttctaatgctaga

SEQ ID NO: 7418514 - DNA, 22 bp, Homo sapiens
aaatgtctgttagtcatatcat

SEQ ID NO: 7418515 - DNA, 22 bp, Homo sapiens
aaatgtctgttagtcatatcat

SEQ ID NO: 7418516 - DNA, 22 bp, Homo sapiens
aaatgtctgttagtcatatcat

SEQ ID NO: 7418517 - DNA, 22 bp, Homo sapiens
aaatgtctgttagtcatatcat

SEQ ID NO: 7418518 - DNA, 22 bp, Homo sapiens
aaatgtctgttagtcatatcat

SEQ ID NO: 7418519 - DNA, 22 bp, Homo sapiens
aaatgtctgtatgagaaagaga

SEQ ID NO: 7418520 - DNA, 22 bp, Homo sapiens
aaatgtctgtctcatgaggaaa

SEQ ID NO: 7418521 - DNA, 22 bp, Homo sapiens
aaatgtctgtctcatgaggaaa

SEQ ID NO: 7418522 - DNA, 23 bp, Homo sapiens
aaatgtcttctagctcttgagaa

SEQ ID NO: 7418523 - DNA, 23 bp, Homo sapiens
aaatgtcttctagctcttgagaa

SEQ ID NO: 7418524 - DNA, 22 bp, Homo sapiens
aaatgtctgttagtcatatcat

SEQ ID NO: 7418525 - DNA, 23 bp, Homo sapiens
aaatgtcttctagctcttgagaa

SEQ ID NO: 7418526 - DNA, 22 bp, Homo sapiens
aaatgtctttatctcatgtaac

SEQ ID NO: 7418527 - DNA, 22 bp, Homo sapiens
aaatgtctttatctcatgtaac

SEQ ID NO: 7418528 - DNA, 22 bp, Homo sapiens
aaatgtctttatctcatgtaac

SEQ ID NO: 7418529 - DNA, 22 bp, Homo sapiens
aaatgtctttatctcatgtaac

SEQ ID NO: 7418530 - DNA, 22 bp, Homo sapiens
aaatgtctttatctcatgtaac

SEQ ID NO: 7418531 - DNA, 22 bp, Homo sapiens
aaacttcatggataatataaag

SEQ ID NO: 7418532 - DNA, 22 bp, Homo sapiens
aaacttcatggataatataaag

SEQ ID NO: 7418533 - DNA, 22 bp, Homo sapiens
aaacttcatggataatataaag

SEQ ID NO: 7418534 - DNA, 22 bp, Homo sapiens
aaacttcatggataatataaag

SEQ ID NO: 7418535 - DNA, 22 bp, Homo sapiens
aaacttcagtgaatgacttatg

SEQ ID NO: 7418536 - DNA, 22 bp, Homo sapiens
aaacttcagtgaatgacttatg

SEQ ID NO: 7418537 - DNA, 22 bp, Homo sapiens
aaacttcatggataatataaag

SEQ ID NO: 7418538 - DNA, 22 bp, Homo sapiens
aaacttcatggataatataaag

SEQ ID NO: 7418539 - DNA, 17 bp, Homo sapiens
aaacttcattctcagga

SEQ ID NO: 7418540 - DNA, 17 bp, Homo sapiens
aaacttcattctcagga

SEQ ID NO: 7418541 - DNA, 22 bp, Homo sapiens
aaatggtgctactaggagtcag

SEQ ID NO: 7418542 - DNA, 22 bp, Homo sapiens
aaacttcatggataatataaag

SEQ ID NO: 7418543 - DNA, 22 bp, Homo sapiens
aaacttcagtgaatgacttatg

SEQ ID NO: 7418544 - DNA, 23 bp, Homo sapiens
aaacttcagtagtgtcatcagcc

SEQ ID NO: 7418545 - DNA, 22 bp, Homo sapiens
aaacttcagtaggagccaacct

SEQ ID NO: 7418546 - DNA, 22 bp, Homo sapiens
aaacttcagtaggagccaacct

SEQ ID NO: 7418547 - DNA, 22 bp, Homo sapiens
aaacttcagggaataaaagagt

SEQ ID NO: 7418548 - DNA, 22 bp, Homo sapiens
aaacttcagtaggagccaacct

SEQ ID NO: 7418549 - DNA, 22 bp, Homo sapiens
aaacttcagggaataaaagagt

SEQ ID NO: 7418550 - DNA, 22 bp, Homo sapiens
aaacttattttatcacagttca

SEQ ID NO: 7418551 - DNA, 22 bp, Homo sapiens
aaacttattttatcacagttca

SEQ ID NO: 7418552 - DNA, 22 bp, Homo sapiens
aaacttagttaagcatattatt

SEQ ID NO: 7418553 - DNA, 22 bp, Homo sapiens
aaacttcaagattcaagcctgg

SEQ ID NO: 7418554 - DNA, 22 bp, Homo sapiens
aaacttcaaggatttgcaaatc

SEQ ID NO: 7418555 - DNA, 22 bp, Homo sapiens
aaacttcaaggatttgcaaatc

SEQ ID NO: 7418556 - DNA, 22 bp, Homo sapiens
aaacttcaagattcaagcctgg

SEQ ID NO: 7418557 - DNA, 22 bp, Homo sapiens
aaacttcaactggaatgggcta

SEQ ID NO: 7418558 - DNA, 22 bp, Homo sapiens
aaacttcaactggaatgggcta

SEQ ID NO: 7418559 - DNA, 22 bp, Homo sapiens
aaacttcaagattcaagcctgg

SEQ ID NO: 7418560 - DNA, 22 bp, Homo sapiens
aaacttcaagattcaagcctgg

SEQ ID NO: 7418561 - DNA, 22 bp, Homo sapiens
aaacttcaaggatttgcaaatc

SEQ ID NO: 7418562 - DNA, 22 bp, Homo sapiens
aaacttcaaggatttgcaaatc

SEQ ID NO: 7418563 - DNA, 22 bp, Homo sapiens
aaacttcaaggatttgcaaatc

SEQ ID NO: 7418564 - DNA, 22 bp, Homo sapiens
aaacttcaaggatttgcaaatc

SEQ ID NO: 7418565 - DNA, 22 bp, Homo sapiens
aaacttcagactccccacttct

SEQ ID NO: 7418566 - DNA, 22 bp, Homo sapiens
aaacttcaaggatttgcaaatc

SEQ ID NO: 7418567 - DNA, 22 bp, Homo sapiens
aaacttcagggaataaaagagt

SEQ ID NO: 7418568 - DNA, 22 bp, Homo sapiens
aaacttcagggaataaaagagt

SEQ ID NO: 7418569 - DNA, 22 bp, Homo sapiens
aaacttcagggaataaaagagt

SEQ ID NO: 7418570 - DNA, 22 bp, Homo sapiens
aaacttcagggaataaaagagt

SEQ ID NO: 7418571 - DNA, 17 bp, Homo sapiens
aaacttcacggtcagcc

SEQ ID NO: 7418572 - DNA, 22 bp, Homo sapiens
aaaggacacacaggaggtgtct

SEQ ID NO: 7418573 - DNA, 22 bp, Homo sapiens
aaaggacatgtcaatatcaggc

SEQ ID NO: 7418574 - DNA, 22 bp, Homo sapiens
aaaggacacacaggaggtgtct

SEQ ID NO: 7418575 - DNA, 22 bp, Homo sapiens
aaaggacacacaggaggtgtct

SEQ ID NO: 7418576 - DNA, 22 bp, Homo sapiens
aaaggacatgtcaatatcaggc

SEQ ID NO: 7418577 - DNA, 22 bp, Homo sapiens
aaaggacatgtcaatatcaggc

SEQ ID NO: 7418578 - DNA, 22 bp, Homo sapiens
aaaggacatgtcaatatcaggc

SEQ ID NO: 7418579 - DNA, 22 bp, Homo sapiens
aaaggacatgtcaatatcaggc

SEQ ID NO: 7418580 - DNA, 22 bp, Homo sapiens
aaaggacatgtcaatatcaggc

SEQ ID NO: 7418581 - DNA, 22 bp, Homo sapiens
aaaggactaggtgttgccaaaa

SEQ ID NO: 7418582 - DNA, 22 bp, Homo sapiens
aaaggacatgtcaatatcaggc

SEQ ID NO: 7418583 - DNA, 22 bp, Homo sapiens
aaagctcttactgtactagtga

SEQ ID NO: 7418584 - DNA, 22 bp, Homo sapiens
aaagctcttactgtactagtga

SEQ ID NO: 7418585 - DNA, 22 bp, Homo sapiens
aaaggaatgagcttctgttagg

SEQ ID NO: 7418586 - DNA, 22 bp, Homo sapiens
aaaggaatgagcttctgttagg

SEQ ID NO: 7418587 - DNA, 22 bp, Homo sapiens
aaagctcttactgtactagtga

SEQ ID NO: 7418588 - DNA, 22 bp, Homo sapiens
aaagctcttaatgagattatcc

SEQ ID NO: 7418589 - DNA, 22 bp, Homo sapiens
aaagctcttaatgagattatcc

SEQ ID NO: 7418590 - DNA, 22 bp, Homo sapiens
aaagctcttaaattgacctgct

SEQ ID NO: 7418591 - DNA, 22 bp, Homo sapiens
aaagctcttaaattgacctgct

SEQ ID NO: 7418592 - DNA, 22 bp, Homo sapiens
aaagctcttaatgagattatcc

SEQ ID NO: 7418593 - DNA, 22 bp, Homo sapiens
aaagctcttaatgagattatcc

SEQ ID NO: 7418594 - DNA, 22 bp, Homo sapiens
aaagctcttaatgagattatcc

SEQ ID NO: 7418595 - DNA, 22 bp, Homo sapiens
aaagctcttaatgagattatcc

SEQ ID NO: 7418596 - DNA, 22 bp, Homo sapiens
aaagctctcccactgtatgaag

SEQ ID NO: 7418597 - DNA, 22 bp, Homo sapiens
aaagctctcccactgtatgaag

SEQ ID NO: 7418598 - DNA, 22 bp, Homo sapiens
aaagctctctgaacaccagacc

SEQ ID NO: 7418599 - DNA, 22 bp, Homo sapiens
aaagctctctgaacaccagacc

SEQ ID NO: 7418600 - DNA, 22 bp, Homo sapiens
aaagctcatcattaggaggcta

SEQ ID NO: 7418601 - DNA, 22 bp, Homo sapiens
aaagctctaagagaggtaggta

SEQ ID NO: 7418602 - DNA, 22 bp, Homo sapiens
aaagctctaagagaggtaggta

SEQ ID NO: 7418603 - DNA, 22 bp, Homo sapiens
aaagctctcccactgtatgaag

SEQ ID NO: 7418604 - DNA, 22 bp, Homo sapiens
aaagctcagtcagtggtgtatg

SEQ ID NO: 7418605 - DNA, 22 bp, Homo sapiens
aaagctcatcattaggaggcta

SEQ ID NO: 7418606 - DNA, 22 bp, Homo sapiens
aaagctcagtcagtggtgtatg

SEQ ID NO: 7418607 - DNA, 22 bp, Homo sapiens
aaagctcacagtaatacaaggc

SEQ ID NO: 7418608 - DNA, 22 bp, Homo sapiens
aaagctcacagtaatacaaggc

SEQ ID NO: 7418609 - DNA, 22 bp, Homo sapiens
aaagctcacagtaatacaaggc

SEQ ID NO: 7418610 - DNA, 22 bp, Homo sapiens
aaagctcacagtaatacaaggc

SEQ ID NO: 7418611 - DNA, 22 bp, Homo sapiens
aaagctcacagtaatacaaggc

SEQ ID NO: 7418612 - DNA, 22 bp, Homo sapiens
aaagctctgggaatgcttatct

SEQ ID NO: 7418613 - DNA, 22 bp, Homo sapiens
aaagctctggtttggagcattt

SEQ ID NO: 7418614 - DNA, 22 bp, Homo sapiens
aaagctctggtttggagcattt

SEQ ID NO: 7418615 - DNA, 22 bp, Homo sapiens
aaagctctggaagattaggtaa

SEQ ID NO: 7418616 - DNA, 23 bp, Homo sapiens
aaagctctgctgcatgtagaata

SEQ ID NO: 7418617 - DNA, 22 bp, Homo sapiens
aaagctctggaagattaggtaa

SEQ ID NO: 7418618 - DNA, 22 bp, Homo sapiens
aaagctctgggaatgcttatct

SEQ ID NO: 7418619 - DNA, 22 bp, Homo sapiens
aaagctctgagaagcactgcaa

SEQ ID NO: 7418620 - DNA, 22 bp, Homo sapiens
aaagctctgagaagcactgcaa

SEQ ID NO: 7418621 - DNA, 23 bp, Homo sapiens
aaagctctgctgcatgtagaata

SEQ ID NO: 7418622 - DNA, 22 bp, Homo sapiens
aaagctctgagaagcactgcaa

SEQ ID NO: 7418623 - DNA, 22 bp, Homo sapiens
aaagctctctgaacaccagacc

SEQ ID NO: 7418624 - DNA, 22 bp, Homo sapiens
aaagctctgagaagcactgcaa

SEQ ID NO: 7418625 - DNA, 22 bp, Homo sapiens
aaagctctgagaagcactgcaa

SEQ ID NO: 7418626 - DNA, 22 bp, Homo sapiens
aaaggagataaagggcccttca

SEQ ID NO: 7418627 - DNA, 22 bp, Homo sapiens
aaaggaggaatggagagatgct

SEQ ID NO: 7418628 - DNA, 22 bp, Homo sapiens
aaaggaggaatggagagatgct

SEQ ID NO: 7418629 - DNA, 22 bp, Homo sapiens
aaaggaggaatggagagatgct

SEQ ID NO: 7418630 - DNA, 22 bp, Homo sapiens
aaaggaggaatggagagatgct

SEQ ID NO: 7418631 - DNA, 22 bp, Homo sapiens
aaaggaggaatggagagatgct

SEQ ID NO: 7418632 - DNA, 22 bp, Homo sapiens
aaaggaggaatggagagatgct

SEQ ID NO: 7418633 - DNA, 22 bp, Homo sapiens
aaaggttaaggtgttcaagaaa

SEQ ID NO: 7418634 - DNA, 22 bp, Homo sapiens
aaaggagagtaggttactccat

SEQ ID NO: 7418635 - DNA, 22 bp, Homo sapiens
aaaggagagtgagtcagatgcc

SEQ ID NO: 7418636 - DNA, 22 bp, Homo sapiens
aaaggagagtgagtcagatgcc

SEQ ID NO: 7418637 - DNA, 22 bp, Homo sapiens
aaaggagagtgagtcagatgcc

SEQ ID NO: 7418638 - DNA, 22 bp, Homo sapiens
aaaggagacagtcttacctgga

SEQ ID NO: 7418639 - DNA, 22 bp, Homo sapiens
aaaggagacagtcttacctgga

SEQ ID NO: 7418640 - DNA, 22 bp, Homo sapiens
aaaggagacagtcttacctgga

SEQ ID NO: 7418641 - DNA, 22 bp, Homo sapiens
aaaggagaaaacatacaggact

SEQ ID NO: 7418642 - DNA, 22 bp, Homo sapiens
aaaggagaaaacatacaggact

SEQ ID NO: 7418643 - DNA, 22 bp, Homo sapiens
aaaggagaaaacatacaggact

SEQ ID NO: 7418644 - DNA, 22 bp, Homo sapiens
aaaggagaaaacatacaggact

SEQ ID NO: 7418645 - DNA, 22 bp, Homo sapiens
aaaggagaaaacatacaggact

SEQ ID NO: 7418646 - DNA, 22 bp, Homo sapiens
aaaggactggatattaaagagt

SEQ ID NO: 7418647 - DNA, 22 bp, Homo sapiens
aaaggactagtctttctaccat

SEQ ID NO: 7418648 - DNA, 22 bp, Homo sapiens
aaaggactagtctttctaccat

SEQ ID NO: 7418649 - DNA, 22 bp, Homo sapiens
aaagctatttattacagagaat

SEQ ID NO: 7418650 - DNA, 22 bp, Homo sapiens
aaagctatttattacagagaat

SEQ ID NO: 7418651 - DNA, 22 bp, Homo sapiens
aaagctatttattacagagaat

SEQ ID NO: 7418652 - DNA, 22 bp, Homo sapiens
aaagctatttgtgagttataga

SEQ ID NO: 7418653 - DNA, 22 bp, Homo sapiens
aaagctatttgtgagttataga

SEQ ID NO: 7418654 - DNA, 22 bp, Homo sapiens
aaagctatttgtgagttataga

SEQ ID NO: 7418655 - DNA, 22 bp, Homo sapiens
aaagctatttgttatgagagaa

SEQ ID NO: 7418656 - DNA, 22 bp, Homo sapiens
aaagctattttattgcagctct

SEQ ID NO: 7418657 - DNA, 22 bp, Homo sapiens
aaagctattcaacacgaacatg

SEQ ID NO: 7418658 - DNA, 22 bp, Homo sapiens
aaagctattcaacacgaacatg

SEQ ID NO: 7418659 - DNA, 22 bp, Homo sapiens
aaagctattcaacacgaacatg

SEQ ID NO: 7418660 - DNA, 22 bp, Homo sapiens
aaagctatttattacagagaat

SEQ ID NO: 7418661 - DNA, 22 bp, Homo sapiens
aaagctatgaggcatgcatttc

SEQ ID NO: 7418662 - DNA, 22 bp, Homo sapiens
aaagctatgaggcatgcatttc

SEQ ID NO: 7418663 - DNA, 22 bp, Homo sapiens
aaagctatgaggcatgcatttc

SEQ ID NO: 7418664 - DNA, 22 bp, Homo sapiens
aaagctatagggtcaagcattt

SEQ ID NO: 7418665 - DNA, 22 bp, Homo sapiens
aaagctagtaatattttaatcc

SEQ ID NO: 7418666 - DNA, 22 bp, Homo sapiens
aaagctagtaatattttaatcc

SEQ ID NO: 7418667 - DNA, 22 bp, Homo sapiens
aaagctagtaatattttaatcc

SEQ ID NO: 7418668 - DNA, 22 bp, Homo sapiens
aaagctagagaagctgctgtca

SEQ ID NO: 7418669 - DNA, 22 bp, Homo sapiens
aaagctatagggtcaagcattt

SEQ ID NO: 7418670 - DNA, 22 bp, Homo sapiens
aaagctatagggtcaagcattt

SEQ ID NO: 7418671 - DNA, 22 bp, Homo sapiens
aaagctatagggtcaagcattt

SEQ ID NO: 7418672 - DNA, 22 bp, Homo sapiens
aaagctatagggtcaagcattt

SEQ ID NO: 7418673 - DNA, 22 bp, Homo sapiens
aaagctatcatcaatgcaactt

SEQ ID NO: 7418674 - DNA, 22 bp, Homo sapiens
aaaattttgccctatccttcat

SEQ ID NO: 7418675 - DNA, 22 bp, Homo sapiens
aaaattttgccctatccttcat

SEQ ID NO: 7418676 - DNA, 22 bp, Homo sapiens
aaagccagggacagtgtgcatg

SEQ ID NO: 7418677 - DNA, 22 bp, Homo sapiens
aaagccaggggagggattccca

SEQ ID NO: 7418678 - DNA, 22 bp, Homo sapiens
aaagccagggacagtgtgcatg

SEQ ID NO: 7418679 - DNA, 22 bp, Homo sapiens
aaagccagggacagtgtgcatg

SEQ ID NO: 7418680 - DNA, 22 bp, Homo sapiens
aaagccagggacagtgtgcatg

SEQ ID NO: 7418681 - DNA, 22 bp, Homo sapiens
aaagctagaaggaaattttatg

SEQ ID NO: 7418682 - DNA, 22 bp, Homo sapiens
aaaattttcagcttgacttgat

SEQ ID NO: 7418683 - DNA, 22 bp, Homo sapiens
aaaattttgccctatccttcat

SEQ ID NO: 7418684 - DNA, 22 bp, Homo sapiens
aaaattttgccctatccttcat

SEQ ID NO: 7418685 - DNA, 22 bp, Homo sapiens
aaaattttgccctatccttcat

SEQ ID NO: 7418686 - DNA, 22 bp, Homo sapiens
aaaattttcagcttgacttgat

SEQ ID NO: 7418687 - DNA, 22 bp, Homo sapiens
aaaattttcagcttgacttgat

SEQ ID NO: 7418688 - DNA, 22 bp, Homo sapiens
aaaattttactggtgtttcctt

SEQ ID NO: 7418689 - DNA, 22 bp, Homo sapiens
aaaattttcagcttgacttgat

SEQ ID NO: 7418690 - DNA, 22 bp, Homo sapiens
aaaattttcagcttgacttgat

SEQ ID NO: 7418691 - DNA, 22 bp, Homo sapiens
aaaattttcagcttgacttgat

SEQ ID NO: 7418692 - DNA, 22 bp, Homo sapiens
aaaattttcagcttgacttgat

SEQ ID NO: 7418693 - DNA, 22 bp, Homo sapiens
aaaattttactggtgtttcctt

SEQ ID NO: 7418694 - DNA, 22 bp, Homo sapiens
aaaattttactggtgtttcctt

SEQ ID NO: 7418695 - DNA, 22 bp, Homo sapiens
aaaattttactggtgtttcctt

SEQ ID NO: 7418696 - DNA, 22 bp, Homo sapiens
aaaattttcagcttgacttgat

SEQ ID NO: 7418697 - DNA, 22 bp, Homo sapiens
aaaattttcagcttgacttgat

SEQ ID NO: 7418698 - DNA, 22 bp, Homo sapiens
aaaattgtgaaggtttctgaaa

SEQ ID NO: 7418699 - DNA, 22 bp, Homo sapiens
aaaatttccaccatctttgtgt

SEQ ID NO: 7418700 - DNA, 22 bp, Homo sapiens
aaaattttactggtgtttcctt

SEQ ID NO: 7418701 - DNA, 22 bp, Homo sapiens
aaaattttactggtgtttcctt

SEQ ID NO: 7418702 - DNA, 22 bp, Homo sapiens
aaaattttactggtgtttcctt

SEQ ID NO: 7418703 - DNA, 22 bp, Homo sapiens
aaaattgtcgaacagtagtaac

SEQ ID NO: 7418704 - DNA, 22 bp, Homo sapiens
aaaattgtcagaagttgatctt

SEQ ID NO: 7418705 - DNA, 22 bp, Homo sapiens
aaaattgtcgaacagtagtaac

SEQ ID NO: 7418706 - DNA, 22 bp, Homo sapiens
aaaattgtcgaacagtagtaac

SEQ ID NO: 7418707 - DNA, 22 bp, Homo sapiens
aaaattgtcgaacagtagtaac

SEQ ID NO: 7418708 - DNA, 22 bp, Homo sapiens
aaaattgtcgaacagtagtaac

SEQ ID NO: 7418709 - DNA, 22 bp, Homo sapiens
aaaattgtcgaacagtagtaac

SEQ ID NO: 7418710 - DNA, 22 bp, Homo sapiens
aaaattgtgaaggtttctgaaa

SEQ ID NO: 7418711 - DNA, 22 bp, Homo sapiens
aaaattgtgaaggtttctgaaa

SEQ ID NO: 7418712 - DNA, 22 bp, Homo sapiens
aaaattgtgaaggtttctgaaa

SEQ ID NO: 7418713 - DNA, 22 bp, Homo sapiens
aaaattgtgaaggtttctgaaa

SEQ ID NO: 7418714 - DNA, 22 bp, Homo sapiens
aaaattgtgaaggtttctgaaa

SEQ ID NO: 7418715 - DNA, 22 bp, Homo sapiens
aaaatttccaccatctttgtgt

SEQ ID NO: 7418716 - DNA, 22 bp, Homo sapiens
aaaatttccaccatctttgtgt

SEQ ID NO: 7418717 - DNA, 22 bp, Homo sapiens
aaaatttccaccatctttgtgt

SEQ ID NO: 7418718 - DNA, 22 bp, Homo sapiens
aaagtcaggctgtgtacctaac

SEQ ID NO: 7418719 - DNA, 22 bp, Homo sapiens
aaagtcagttggccagatcact

SEQ ID NO: 7418720 - DNA, 22 bp, Homo sapiens
aaagtcagttggccagatcact

SEQ ID NO: 7418721 - DNA, 22 bp, Homo sapiens
aaagtcagttggccagatcact

SEQ ID NO: 7418722 - DNA, 22 bp, Homo sapiens
aaagtcagttggccagatcact

SEQ ID NO: 7418723 - DNA, 22 bp, Homo sapiens
aaagtcaggctgtgtacctaac

SEQ ID NO: 7418724 - DNA, 22 bp, Homo sapiens
aaagtcaggctgtgtacctaac

SEQ ID NO: 7418725 - DNA, 22 bp, Homo sapiens
aaagtcacttccttctgtcagc

SEQ ID NO: 7418726 - DNA, 22 bp, Homo sapiens
aaagtcacttccttctgtcagc

SEQ ID NO: 7418727 - DNA, 22 bp, Homo sapiens
aaagtcacttacagctcttttg

SEQ ID NO: 7418728 - DNA, 22 bp, Homo sapiens
aaagtcacttacagctcttttg

SEQ ID NO: 7418729 - DNA, 22 bp, Homo sapiens
aaagtacatgtttggccatttg

SEQ ID NO: 7418730 - DNA, 22 bp, Homo sapiens
aaagtcacttacagctcttttg

SEQ ID NO: 7418731 - DNA, 22 bp, Homo sapiens
aaagtcacttccttctgtcagc

SEQ ID NO: 7418732 - DNA, 22 bp, Homo sapiens
aaagtcacttccttctgtcagc

SEQ ID NO: 7418733 - DNA, 22 bp, Homo sapiens
aaagtcacttccttctgtcagc

SEQ ID NO: 7418734 - DNA, 22 bp, Homo sapiens
aaagtcatacatggtgcttact

SEQ ID NO: 7418735 - DNA, 22 bp, Homo sapiens
aaagtcagttggccagatcact

SEQ ID NO: 7418736 - DNA, 22 bp, Homo sapiens
aaagtcagttggccagatcact

SEQ ID NO: 7418737 - DNA, 22 bp, Homo sapiens
aaagtcagttggccagatcact

SEQ ID NO: 7418738 - DNA, 22 bp, Homo sapiens
aaagtcagttggccagatcact

SEQ ID NO: 7418739 - DNA, 22 bp, Homo sapiens
aaagtcatcagaaccttccaga

SEQ ID NO: 7418740 - DNA, 22 bp, Homo sapiens
aaagtcatcatttcttttcaaa

SEQ ID NO: 7418741 - DNA, 22 bp, Homo sapiens
aaagtcatcatttcttttcaaa

SEQ ID NO: 7418742 - DNA, 22 bp, Homo sapiens
aaagtacatgtttggccatttg

SEQ ID NO: 7418743 - DNA, 22 bp, Homo sapiens
aaagtacatgtttggccatttg

SEQ ID NO: 7418744 - DNA, 22 bp, Homo sapiens
aaagtacatgcaattcttctga

SEQ ID NO: 7418745 - DNA, 22 bp, Homo sapiens
aaagtacatgcaattcttctga

SEQ ID NO: 7418746 - DNA, 22 bp, Homo sapiens
aaagtacatgcaattcttctga

SEQ ID NO: 7418747 - DNA, 22 bp, Homo sapiens
aaagtacatgcaattcttctga

SEQ ID NO: 7418748 - DNA, 22 bp, Homo sapiens
aaagtacatgcaattcttctga

SEQ ID NO: 7418749 - DNA, 22 bp, Homo sapiens
aaagtacatgcaattcttctga

SEQ ID NO: 7418750 - DNA, 22 bp, Homo sapiens
aaagtacatgcaattcttctga

SEQ ID NO: 7418751 - DNA, 22 bp, Homo sapiens
aaagtacatgcaattcttctga

SEQ ID NO: 7418752 - DNA, 22 bp, Homo sapiens
aaagtacatgcaattcttctga

SEQ ID NO: 7418753 - DNA, 22 bp, Homo sapiens
aaagtacatagcatattccaac

SEQ ID NO: 7418754 - DNA, 22 bp, Homo sapiens
aaagtacatagcatattccaac

SEQ ID NO: 7418755 - DNA, 22 bp, Homo sapiens
aaagtacatagcatattccaac

SEQ ID NO: 7418756 - DNA, 22 bp, Homo sapiens
aaagtacatagcatattccaac

SEQ ID NO: 7418757 - DNA, 22 bp, Homo sapiens
aaagtacatagcatattccaac

SEQ ID NO: 7418758 - DNA, 22 bp, Homo sapiens
aaagtacatagcatattccaac

SEQ ID NO: 7418759 - DNA, 22 bp, Homo sapiens
aaagtacatgagattcaagggg

SEQ ID NO: 7418760 - DNA, 22 bp, Homo sapiens
aaagtacatgagattcaagggg

SEQ ID NO: 7418761 - DNA, 22 bp, Homo sapiens
aaagtacatagcatattccaac

SEQ ID NO: 7418762 - DNA, 22 bp, Homo sapiens
aaagtacatgagattcaagggg

SEQ ID NO: 7418763 - DNA, 22 bp, Homo sapiens
aaagtacatgagattcaagggg

SEQ ID NO: 7418764 - DNA, 22 bp, Homo sapiens
aaagtacatgagattcaagggg

SEQ ID NO: 7418765 - DNA, 22 bp, Homo sapiens
aaagtacagccacatccaagta

SEQ ID NO: 7418766 - DNA, 22 bp, Homo sapiens
aaagtacagccacatccaagta

SEQ ID NO: 7418767 - DNA, 22 bp, Homo sapiens
aaagtacagccacatccaagta

SEQ ID NO: 7418768 - DNA, 22 bp, Homo sapiens
aaagtacagccacatccaagta

SEQ ID NO: 7418769 - DNA, 22 bp, Homo sapiens
aaagtacagccacatccaagta

SEQ ID NO: 7418770 - DNA, 22 bp, Homo sapiens
aaagtacatagcatattccaac

SEQ ID NO: 7418771 - DNA, 22 bp, Homo sapiens
aaagtacatagcatattccaac

SEQ ID NO: 7418772 - DNA, 22 bp, Homo sapiens
aaagtacagggttgtggggtga

SEQ ID NO: 7418773 - DNA, 22 bp, Homo sapiens
aaagtacagggttgtggggtga

SEQ ID NO: 7418774 - DNA, 22 bp, Homo sapiens
aaagtacaggaaagcctagcca

SEQ ID NO: 7418775 - DNA, 22 bp, Homo sapiens
aaagtacaggaaagcctagcca

SEQ ID NO: 7418776 - DNA, 22 bp, Homo sapiens
aaagtacagccacatccaagta

SEQ ID NO: 7418777 - DNA, 22 bp, Homo sapiens
aaagtacaggaaagcctagcca

SEQ ID NO: 7418778 - DNA, 22 bp, Homo sapiens
aaagtacaggaaagcctagcca

SEQ ID NO: 7418779 - DNA, 22 bp, Homo sapiens
aaagtacagatggtgaggttgg

SEQ ID NO: 7418780 - DNA, 22 bp, Homo sapiens
aaagtacagatggtgaggttgg

SEQ ID NO: 7418781 - DNA, 22 bp, Homo sapiens
aaagtacagatggtgaggttgg

SEQ ID NO: 7418782 - DNA, 22 bp, Homo sapiens
aaagtacagatggtgaggttgg

SEQ ID NO: 7418783 - DNA, 22 bp, Homo sapiens
aaagtacagatggtgaggttgg

SEQ ID NO: 7418784 - DNA, 22 bp, Homo sapiens
aaagtacacatttatcccttat

SEQ ID NO: 7418785 - DNA, 22 bp, Homo sapiens
aaagtacacatttatcccttat

SEQ ID NO: 7418786 - DNA, 22 bp, Homo sapiens
aaagtacagccacatccaagta

SEQ ID NO: 7418787 - DNA, 22 bp, Homo sapiens
aaagtacagccacatccaagta

SEQ ID NO: 7418788 - DNA, 22 bp, Homo sapiens
aaagtacagccacatccaagta

SEQ ID NO: 7418789 - DNA, 22 bp, Homo sapiens
aaagtacagccacatccaagta

SEQ ID NO: 7418790 - DNA, 22 bp, Homo sapiens
aaagtacagatggtgaggttgg

SEQ ID NO: 7418791 - DNA, 22 bp, Homo sapiens
aaagtacagatggtgaggttgg

SEQ ID NO: 7418792 - DNA, 22 bp, Homo sapiens
aaagtacaaggaaaggatctga

SEQ ID NO: 7418793 - DNA, 22 bp, Homo sapiens
aaagtacaaggaaaggatctga

SEQ ID NO: 7418794 - DNA, 22 bp, Homo sapiens
aaagtacaatattgagattgat

SEQ ID NO: 7418795 - DNA, 22 bp, Homo sapiens
aaaggttagacagctctgcata

SEQ ID NO: 7418796 - DNA, 22 bp, Homo sapiens
aaaggttaatgttgtcatgtta

SEQ ID NO: 7418797 - DNA, 22 bp, Homo sapiens
aaaggttaatgttgtcatgtta

SEQ ID NO: 7418798 - DNA, 22 bp, Homo sapiens
aaaggttagacagctctgcata

SEQ ID NO: 7418799 - DNA, 22 bp, Homo sapiens
aaaggttagacagctctgcata

SEQ ID NO: 7418800 - DNA, 22 bp, Homo sapiens
aaaggttagttcttagaagtgc

SEQ ID NO: 7418801 - DNA, 22 bp, Homo sapiens
aaagtacaatattgagattgat

SEQ ID NO: 7418802 - DNA, 22 bp, Homo sapiens
aaagtacaatattgagattgat

SEQ ID NO: 7418803 - DNA, 22 bp, Homo sapiens
aaagtacaatattgagattgat

SEQ ID NO: 7418804 - DNA, 22 bp, Homo sapiens
aaagtacaatattgagattgat

SEQ ID NO: 7418805 - DNA, 22 bp, Homo sapiens
aaagtacacacagagccaagaa

SEQ ID NO: 7418806 - DNA, 22 bp, Homo sapiens
aaagtacacatttatcccttat

SEQ ID NO: 7418807 - DNA, 22 bp, Homo sapiens
aaagtacacacagagccaagaa

SEQ ID NO: 7418808 - DNA, 22 bp, Homo sapiens
aaagtacacacagagccaagaa

SEQ ID NO: 7418809 - DNA, 22 bp, Homo sapiens
aaagtacacacagagccaagaa

SEQ ID NO: 7418810 - DNA, 22 bp, Homo sapiens
aaagtacacacagagccaagaa

SEQ ID NO: 7418811 - DNA, 22 bp, Homo sapiens
aaagtacacacagagccaagaa

SEQ ID NO: 7418812 - DNA, 22 bp, Homo sapiens
aaagtcatgcagttgaactttt

SEQ ID NO: 7418813 - DNA, 22 bp, Homo sapiens
aaagtcatgcagttgaactttt

SEQ ID NO: 7418814 - DNA, 22 bp, Homo sapiens
aaagtcatgatgaaccaccgta

SEQ ID NO: 7418815 - DNA, 22 bp, Homo sapiens
aaagtcatctgtcctaggctct

SEQ ID NO: 7418816 - DNA, 22 bp, Homo sapiens
aaagtcatggaaaatcttggaa

SEQ ID NO: 7418817 - DNA, 22 bp, Homo sapiens
aaagtcatctgtcctaggctct

SEQ ID NO: 7418818 - DNA, 22 bp, Homo sapiens
aaagtcatgtaatgatatgatt

SEQ ID NO: 7418819 - DNA, 22 bp, Homo sapiens
aaagtcatctgtcctaggctct

SEQ ID NO: 7418820 - DNA, 22 bp, Homo sapiens
aaagtcatctaggagcagattt

SEQ ID NO: 7418821 - DNA, 22 bp, Homo sapiens
aaagtcatctaggagcagattt

SEQ ID NO: 7418822 - DNA, 22 bp, Homo sapiens
aaagtcatccaaatttttatgt

SEQ ID NO: 7418823 - DNA, 22 bp, Homo sapiens
aaagtcatccaaatttttatgt

SEQ ID NO: 7418824 - DNA, 22 bp, Homo sapiens
aaagtcatccaaatttttatgt

SEQ ID NO: 7418825 - DNA, 22 bp, Homo sapiens
aaagtcatctaggagcagattt

SEQ ID NO: 7418826 - DNA, 22 bp, Homo sapiens
aaagtcattgtaatatatgcta

SEQ ID NO: 7418827 - DNA, 22 bp, Homo sapiens
aaagtcattggaatattaatga

SEQ ID NO: 7418828 - DNA, 22 bp, Homo sapiens
aaagtcattgtaatatatgcta

SEQ ID NO: 7418829 - DNA, 22 bp, Homo sapiens
aaagtcattgctgttatcaatg

SEQ ID NO: 7418830 - DNA, 22 bp, Homo sapiens
aaagtcattggaatattaatga

SEQ ID NO: 7418831 - DNA, 22 bp, Homo sapiens
aaagtcatttagccttatctcc

SEQ ID NO: 7418832 - DNA, 22 bp, Homo sapiens
aaagtcattgtaatatatgcta

SEQ ID NO: 7418833 - DNA, 22 bp, Homo sapiens
aaagttctaaaactctttgtga

SEQ ID NO: 7418834 - DNA, 22 bp, Homo sapiens
aaagttccttttatagacatga

SEQ ID NO: 7418835 - DNA, 22 bp, Homo sapiens
aaagttcattgatgactgaggt

SEQ ID NO: 7418836 - DNA, 22 bp, Homo sapiens
aaagttccttttatagacatga

SEQ ID NO: 7418837 - DNA, 22 bp, Homo sapiens
aaagtcattggaatattaatga

SEQ ID NO: 7418838 - DNA, 22 bp, Homo sapiens
aaagtcattggaatattaatga

SEQ ID NO: 7418839 - DNA, 22 bp, Homo sapiens
aaagtcattggaatattaatga

SEQ ID NO: 7418840 - DNA, 22 bp, Homo sapiens
aaagtcattggaatattaatga

SEQ ID NO: 7418841 - DNA, 22 bp, Homo sapiens
aaagtcatgtttttgtttagca

SEQ ID NO: 7418842 - DNA, 22 bp, Homo sapiens
aaagtcatgtaatgatatgatt

SEQ ID NO: 7418843 - DNA, 22 bp, Homo sapiens
aaagtcatgtttttgtttagca

SEQ ID NO: 7418844 - DNA, 22 bp, Homo sapiens
aaagtcattgctgttatcaatg

SEQ ID NO: 7418845 - DNA, 22 bp, Homo sapiens
aaagtcatgtttttgtttagca

SEQ ID NO: 7418846 - DNA, 22 bp, Homo sapiens
aaagtcattgctgttatcaatg

SEQ ID NO: 7418847 - DNA, 22 bp, Homo sapiens
aaataaactgaagcacagagag

SEQ ID NO: 7418848 - DNA, 22 bp, Homo sapiens
aaataaactgaagcacagagag

SEQ ID NO: 7418849 - DNA, 22 bp, Homo sapiens
aaataaactgaagcacagagag

SEQ ID NO: 7418850 - DNA, 22 bp, Homo sapiens
aaataaactgaagcacagagag

SEQ ID NO: 7418851 - DNA, 22 bp, Homo sapiens
aaataaactgaagcacagagag

SEQ ID NO: 7418852 - DNA, 22 bp, Homo sapiens
aaagtttttaagcaagaccctt

SEQ ID NO: 7418853 - DNA, 22 bp, Homo sapiens
aaagttttgttgattgtggaat

SEQ ID NO: 7418854 - DNA, 22 bp, Homo sapiens
aaagtttttaagcaagaccctt

SEQ ID NO: 7418855 - DNA, 22 bp, Homo sapiens
aaataaactgaagcacagagag

SEQ ID NO: 7418856 - DNA, 22 bp, Homo sapiens
aaagtttttaagcaagaccctt

SEQ ID NO: 7418857 - DNA, 22 bp, Homo sapiens
aaagtttttaagcaagaccctt

SEQ ID NO: 7418858 - DNA, 22 bp, Homo sapiens
aaagtttttaagcaagaccctt

SEQ ID NO: 7418859 - DNA, 22 bp, Homo sapiens
aaagttttctgccttcattaga

SEQ ID NO: 7418860 - DNA, 22 bp, Homo sapiens
aaagttttctgccttcattaga

SEQ ID NO: 7418861 - DNA, 22 bp, Homo sapiens
aaagttttctgccttcattaga

SEQ ID NO: 7418862 - DNA, 22 bp, Homo sapiens
aaagttttgttgattgtggaat

SEQ ID NO: 7418863 - DNA, 22 bp, Homo sapiens
aaagttttgttgattgtggaat

SEQ ID NO: 7418864 - DNA, 22 bp, Homo sapiens
aaagttttgttgattgtggaat

SEQ ID NO: 7418865 - DNA, 22 bp, Homo sapiens
aaagttttgttgattgtggaat

SEQ ID NO: 7418866 - DNA, 22 bp, Homo sapiens
aaagttttctgccttcattaga

SEQ ID NO: 7418867 - DNA, 19 bp, Homo sapiens
aaagttttattctcatttg

SEQ ID NO: 7418868 - DNA, 22 bp, Homo sapiens
aaagttttctgccttcattaga

SEQ ID NO: 7418869 - DNA, 22 bp, Homo sapiens
aaagttttctgccttcattaga

SEQ ID NO: 7418870 - DNA, 22 bp, Homo sapiens
aaagttttctgccttcattaga

SEQ ID NO: 7418871 - DNA, 19 bp, Homo sapiens
aaagttttattctcatttg

SEQ ID NO: 7418872 - DNA, 19 bp, Homo sapiens
aaagttttattctcatttg

SEQ ID NO: 7418873 - DNA, 19 bp, Homo sapiens
aaagttttattctcatttg

SEQ ID NO: 7418874 - DNA, 22 bp, Homo sapiens
aaagttttattcaagcattagt

SEQ ID NO: 7418875 - DNA, 22 bp, Homo sapiens
aaagttttattcaagcattagt

SEQ ID NO: 7418876 - DNA, 19 bp, Homo sapiens
aaagttttattctcatttg

SEQ ID NO: 7418877 - DNA, 19 bp, Homo sapiens
aaagttttattctcatttg

SEQ ID NO: 7418878 - DNA, 22 bp, Homo sapiens
aaagttttattcaagcattagt

SEQ ID NO: 7418879 - DNA, 22 bp, Homo sapiens
aaagttttattcaagcattagt

SEQ ID NO: 7418880 - DNA, 22 bp, Homo sapiens
aaagttttattcaagcattagt

SEQ ID NO: 7418881 - DNA, 22 bp, Homo sapiens
aaagttctagagttgcaagaga

SEQ ID NO: 7418882 - DNA, 22 bp, Homo sapiens
aaagttttattcaagcattagt

SEQ ID NO: 7418883 - DNA, 22 bp, Homo sapiens
aaagttctaaaactctttgtga

SEQ ID NO: 7418884 - DNA, 22 bp, Homo sapiens
aaagttctaaaactctttgtga

SEQ ID NO: 7418885 - DNA, 22 bp, Homo sapiens
aacatgaaagttgctaagtgca

SEQ ID NO: 7418886 - DNA, 22 bp, Homo sapiens
aaaggcagagtgctcagctggc

SEQ ID NO: 7418887 - DNA, 22 bp, Homo sapiens
aaaggcagagtgctcagctggc

SEQ ID NO: 7418888 - DNA, 22 bp, Homo sapiens
aaaggcagagtgctcagctggc

SEQ ID NO: 7418889 - DNA, 22 bp, Homo sapiens
aacatgaaacccaaacagaata

SEQ ID NO: 7418890 - DNA, 22 bp, Homo sapiens
aacatgaaacccaaacagaata

SEQ ID NO: 7418891 - DNA, 22 bp, Homo sapiens
aacatgaaacccaaacagaata

SEQ ID NO: 7418892 - DNA, 22 bp, Homo sapiens
aacatgaaagttgctaagtgca

SEQ ID NO: 7418893 - DNA, 22 bp, Homo sapiens
aacatgaaagttgctaagtgca

SEQ ID NO: 7418894 - DNA, 22 bp, Homo sapiens
aacatgaaagttgctaagtgca

SEQ ID NO: 7418895 - DNA, 22 bp, Homo sapiens
aacatgaaggtaggatggtttt

SEQ ID NO: 7418896 - DNA, 22 bp, Homo sapiens
aacatgaaggtaggatggtttt

SEQ ID NO: 7418897 - DNA, 22 bp, Homo sapiens
aacatgaagttttctatagtga

SEQ ID NO: 7418898 - DNA, 22 bp, Homo sapiens
aacatgaagttttctatagtga

SEQ ID NO: 7418899 - DNA, 22 bp, Homo sapiens
aacatgaaggtaggatggtttt

SEQ ID NO: 7418900 - DNA, 22 bp, Homo sapiens
aacatgaaggtaggatggtttt

SEQ ID NO: 7418901 - DNA, 22 bp, Homo sapiens
aacatgaaggtaggatggtttt

SEQ ID NO: 7418902 - DNA, 22 bp, Homo sapiens
aaaggcactgatcttatccagt

SEQ ID NO: 7418903 - DNA, 22 bp, Homo sapiens
aaaggcactgatcttatccagt

SEQ ID NO: 7418904 - DNA, 22 bp, Homo sapiens
aaaggcactggatagctgggga

SEQ ID NO: 7418905 - DNA, 22 bp, Homo sapiens
aaaggcactgatcttatccagt

SEQ ID NO: 7418906 - DNA, 22 bp, Homo sapiens
aaaggcactgatcttatccagt

SEQ ID NO: 7418907 - DNA, 22 bp, Homo sapiens
aaaggcactgatcttatccagt

SEQ ID NO: 7418908 - DNA, 22 bp, Homo sapiens
aaaggcactggatagctgggga

SEQ ID NO: 7418909 - DNA, 22 bp, Homo sapiens
aaaggcagagtgctcagctggc

SEQ ID NO: 7418910 - DNA, 22 bp, Homo sapiens
aaaggcagagtgctcagctggc

SEQ ID NO: 7418911 - DNA, 22 bp, Homo sapiens
aaaggcagagtgctcagctggc

SEQ ID NO: 7418912 - DNA, 23 bp, Homo sapiens
aaaggcacagcattgtctagcag

SEQ ID NO: 7418913 - DNA, 23 bp, Homo sapiens
aaaggcacagcattgtctagcag

SEQ ID NO: 7418914 - DNA, 22 bp, Homo sapiens
aaaggcactagaagttaccttt

SEQ ID NO: 7418915 - DNA, 22 bp, Homo sapiens
aaaggcactagaagttaccttt

SEQ ID NO: 7418916 - DNA, 23 bp, Homo sapiens
aaaggcacagcattgtctagcag

SEQ ID NO: 7418917 - DNA, 20 bp, Homo sapiens
aaaggcacagcaacagagct

SEQ ID NO: 7418918 - DNA, 23 bp, Homo sapiens
aaaggcacagcattgtctagcag

SEQ ID NO: 7418919 - DNA, 20 bp, Homo sapiens
aaaggcacagcaacagagct

SEQ ID NO: 7418920 - DNA, 20 bp, Homo sapiens
aaaggcacagcaacagagct

SEQ ID NO: 7418921 - DNA, 22 bp, Homo sapiens
aaaggcacacactccttgttat

SEQ ID NO: 7418922 - DNA, 22 bp, Homo sapiens
aaaggcacagaagggaaaccaa

SEQ ID NO: 7418923 - DNA, 22 bp, Homo sapiens
aaaggcacacactccttgttat

SEQ ID NO: 7418924 - DNA, 22 bp, Homo sapiens
aaaggcacaaattcagcatttt

SEQ ID NO: 7418925 - DNA, 22 bp, Homo sapiens
aaaggcacaaattcagcatttt

SEQ ID NO: 7418926 - DNA, 22 bp, Homo sapiens
aaaggcaatttcttcttcctga

SEQ ID NO: 7418927 - DNA, 22 bp, Homo sapiens
aaaggcaatttcttcttcctga

SEQ ID NO: 7418928 - DNA, 22 bp, Homo sapiens
aaaggcaagcatttatatagga

SEQ ID NO: 7418929 - DNA, 22 bp, Homo sapiens
aaaggcaagcatttatatagga

SEQ ID NO: 7418930 - DNA, 22 bp, Homo sapiens
aaaggcaaaggctggtatggct

SEQ ID NO: 7418931 - DNA, 22 bp, Homo sapiens
aaaggcaaaggctggtatggct

SEQ ID NO: 7418932 - DNA, 22 bp, Homo sapiens
aaaggcaagcatttatatagga

SEQ ID NO: 7418933 - DNA, 22 bp, Homo sapiens
aaaggcaagcatttatatagga

SEQ ID NO: 7418934 - DNA, 22 bp, Homo sapiens
aaaggcaagcatttatatagga

SEQ ID NO: 7418935 - DNA, 22 bp, Homo sapiens
aaaggcaaaattcttagcagga

SEQ ID NO: 7418936 - DNA, 22 bp, Homo sapiens
aaaggcaaaattcttagcagga

SEQ ID NO: 7418937 - DNA, 22 bp, Homo sapiens
aaaggattagagataccatgcc

SEQ ID NO: 7418938 - DNA, 22 bp, Homo sapiens
aaaggattagagataccatgcc

SEQ ID NO: 7418939 - DNA, 22 bp, Homo sapiens
aaaggagttactcataaagctt

SEQ ID NO: 7418940 - DNA, 22 bp, Homo sapiens
aaaggataaggttatcaatttt

SEQ ID NO: 7418941 - DNA, 22 bp, Homo sapiens
aaaggataaggttatcaatttt

SEQ ID NO: 7418942 - DNA, 22 bp, Homo sapiens
aaaggataaggttatcaatttt

SEQ ID NO: 7418943 - DNA, 22 bp, Homo sapiens
aaaggataaggttatcaatttt

SEQ ID NO: 7418944 - DNA, 22 bp, Homo sapiens
aaaggattaaataaatgtgctg

SEQ ID NO: 7418945 - DNA, 22 bp, Homo sapiens
aaaggataaggttatcaatttt

SEQ ID NO: 7418946 - DNA, 22 bp, Homo sapiens
aaaggaggccacatggctagga

SEQ ID NO: 7418947 - DNA, 22 bp, Homo sapiens
aaaggaggccacatggctagga

SEQ ID NO: 7418948 - DNA, 22 bp, Homo sapiens
aaaggaggccacatggctagga

SEQ ID NO: 7418949 - DNA, 22 bp, Homo sapiens
aaaggaggccacatggctagga

SEQ ID NO: 7418950 - DNA, 22 bp, Homo sapiens
aaaggaggccacatggctagga

SEQ ID NO: 7418951 - DNA, 22 bp, Homo sapiens
aaaggaatattcaaaacagtca

SEQ ID NO: 7418952 - DNA, 22 bp, Homo sapiens
aaaggaatattcaaaacagtca

SEQ ID NO: 7418953 - DNA, 22 bp, Homo sapiens
aaaggaatattcaaaacagtca

SEQ ID NO: 7418954 - DNA, 20 bp, Homo sapiens
aaagcatttacttgtgattg

SEQ ID NO: 7418955 - DNA, 22 bp, Homo sapiens
aaagcatttcatgtctagaaag

SEQ ID NO: 7418956 - DNA, 20 bp, Homo sapiens
aaagcatttacttgtgattg

SEQ ID NO: 7418957 - DNA, 22 bp, Homo sapiens
aaagcatttcatgtctagaaag

SEQ ID NO: 7418958 - DNA, 22 bp, Homo sapiens
aaagcatttcatgtctagaaag

SEQ ID NO: 7418959 - DNA, 22 bp, Homo sapiens
aaagcatttcatgtctagaaag

SEQ ID NO: 7418960 - DNA, 22 bp, Homo sapiens
aaagcatttcatgtctagaaag

SEQ ID NO: 7418961 - DNA, 22 bp, Homo sapiens
aaagcatttcatgtctagaaag

SEQ ID NO: 7418962 - DNA, 20 bp, Homo sapiens
aaagcatttacttgtgattg

SEQ ID NO: 7418963 - DNA, 22 bp, Homo sapiens
aaagcattgtttcaagattaac

SEQ ID NO: 7418964 - DNA, 22 bp, Homo sapiens
aaagcattgtttcaagattaac

SEQ ID NO: 7418965 - DNA, 22 bp, Homo sapiens
aaagcattgtttcaagattaac

SEQ ID NO: 7418966 - DNA, 22 bp, Homo sapiens
aaagcattactagactggattt

SEQ ID NO: 7418967 - DNA, 22 bp, Homo sapiens
aaagcattactagactggattt

SEQ ID NO: 7418968 - DNA, 22 bp, Homo sapiens
aaagcattattctgtggaaaaa

SEQ ID NO: 7418969 - DNA, 22 bp, Homo sapiens
aaagcattgtttcaagattaac

SEQ ID NO: 7418970 - DNA, 22 bp, Homo sapiens
aaagcattgtttcaagattaac

SEQ ID NO: 7418971 - DNA, 22 bp, Homo sapiens
aaaggaagtgccactcttcttc

SEQ ID NO: 7418972 - DNA, 22 bp, Homo sapiens
aaaggaagtgccactcttcttc

SEQ ID NO: 7418973 - DNA, 22 bp, Homo sapiens
aaaggaagtgccactcttcttc

SEQ ID NO: 7418974 - DNA, 22 bp, Homo sapiens
aaaggaagtgccactcttcttc

SEQ ID NO: 7418975 - DNA, 20 bp, Homo sapiens
aaaggaatatatgaagtata

SEQ ID NO: 7418976 - DNA, 20 bp, Homo sapiens
aaaggaatatatgaagtata

SEQ ID NO: 7418977 - DNA, 20 bp, Homo sapiens
aaaggaatatatgaagtata

SEQ ID NO: 7418978 - DNA, 23 bp, Homo sapiens
aaagccaagtcagtctactggaa

SEQ ID NO: 7418979 - DNA, 22 bp, Homo sapiens
aaagccacagttctatgtctgc

SEQ ID NO: 7418980 - DNA, 23 bp, Homo sapiens
aaagccaagtcagtctactggaa

SEQ ID NO: 7418981 - DNA, 22 bp, Homo sapiens
aaagccaaatgaaagatggttc

SEQ ID NO: 7418982 - DNA, 22 bp, Homo sapiens
aaagccaaatgaaagatggttc

SEQ ID NO: 7418983 - DNA, 22 bp, Homo sapiens
aaagccaaatgaaagatggttc

SEQ ID NO: 7418984 - DNA, 22 bp, Homo sapiens
aaagccaaatgaaagatggttc

SEQ ID NO: 7418985 - DNA, 22 bp, Homo sapiens
aaagcatttcatgtctagaaag

SEQ ID NO: 7418986 - DNA, 22 bp, Homo sapiens
aaagccaaatgaaagatggttc

SEQ ID NO: 7418987 - DNA, 22 bp, Homo sapiens
aaagccaaatgaaagatggttc

SEQ ID NO: 7418988 - DNA, 22 bp, Homo sapiens
aaagccaagctgggaaggcagg

SEQ ID NO: 7418989 - DNA, 22 bp, Homo sapiens
aaagccaagctgggaaggcagg

SEQ ID NO: 7418990 - DNA, 22 bp, Homo sapiens
aaagccaaatgaaagatggttc

SEQ ID NO: 7418991 - DNA, 22 bp, Homo sapiens
aaagccaagctgggaaggcagg

SEQ ID NO: 7418992 - DNA, 22 bp, Homo sapiens
aaagcatagaattagagttagg

SEQ ID NO: 7418993 - DNA, 22 bp, Homo sapiens
aaagcatagaattagagttagg

SEQ ID NO: 7418994 - DNA, 22 bp, Homo sapiens
aaagcatagaattagagttagg

SEQ ID NO: 7418995 - DNA, 22 bp, Homo sapiens
aaagcatattaggactgaatta

SEQ ID NO: 7418996 - DNA, 22 bp, Homo sapiens
aaagcatagttcatctgtccat

SEQ ID NO: 7418997 - DNA, 22 bp, Homo sapiens
aaagcagtgctgtgagaacact

SEQ ID NO: 7418998 - DNA, 22 bp, Homo sapiens
aaagcagtgctgtgagaacact

SEQ ID NO: 7418999 - DNA, 21 bp, Homo sapiens
aaagcagttcttcctgcctct

SEQ ID NO: 7419000 - DNA, 22 bp, Homo sapiens
aaagcatattaggactgaatta

SEQ ID NO: 7419001 - DNA, 21 bp, Homo sapiens
aaagcatcacgaacatttggg

SEQ ID NO: 7419002 - DNA, 21 bp, Homo sapiens
aaagcatcacgaacatttggg

SEQ ID NO: 7419003 - DNA, 21 bp, Homo sapiens
aaagcatcacgaacatttggg

SEQ ID NO: 7419004 - DNA, 22 bp, Homo sapiens
aaagcatattaggactgaatta

SEQ ID NO: 7419005 - DNA, 22 bp, Homo sapiens
aaagcatcagatctgacacttc

SEQ ID NO: 7419006 - DNA, 22 bp, Homo sapiens
aaagcatgactcaagaattact

SEQ ID NO: 7419007 - DNA, 22 bp, Homo sapiens
aaagcatgactcaagaattact

SEQ ID NO: 7419008 - DNA, 22 bp, Homo sapiens
aaagcatcagatctgacacttc

SEQ ID NO: 7419009 - DNA, 22 bp, Homo sapiens
aaagcatgactcaagaattact

SEQ ID NO: 7419010 - DNA, 22 bp, Homo sapiens
aaagcatgactcaagaattact

SEQ ID NO: 7419011 - DNA, 22 bp, Homo sapiens
aaagcattactagactggattt

SEQ ID NO: 7419012 - DNA, 22 bp, Homo sapiens
aaagcatgttgggtccctcttt

SEQ ID NO: 7419013 - DNA, 22 bp, Homo sapiens
aaagcatgttctgggaatagta

SEQ ID NO: 7419014 - DNA, 22 bp, Homo sapiens
aaagcatgtgaatagaatatgg

SEQ ID NO: 7419015 - DNA, 22 bp, Homo sapiens
aaagcatgtgaatagaatatgg

SEQ ID NO: 7419016 - DNA, 22 bp, Homo sapiens
aaagcatgtgaatagaatatgg

SEQ ID NO: 7419017 - DNA, 22 bp, Homo sapiens
aaagcatgtgaatagaatatgg

SEQ ID NO: 7419018 - DNA, 22 bp, Homo sapiens
aaagcatggttaaagacagtgg

SEQ ID NO: 7419019 - DNA, 22 bp, Homo sapiens
aaagcatggttaaagacagtgg

SEQ ID NO: 7419020 - DNA, 22 bp, Homo sapiens
aaagcatggttaaagacagtgg

SEQ ID NO: 7419021 - DNA, 22 bp, Homo sapiens
aaagcatgctactttatatagg

SEQ ID NO: 7419022 - DNA, 22 bp, Homo sapiens
aaagcatggcatgaagaacatg

SEQ ID NO: 7419023 - DNA, 22 bp, Homo sapiens
aaagcatgctactttatatagg

SEQ ID NO: 7419024 - DNA, 22 bp, Homo sapiens
aaagcatggcatgaagaacatg

SEQ ID NO: 7419025 - DNA, 22 bp, Homo sapiens
aaagcatggcatgaagaacatg

SEQ ID NO: 7419026 - DNA, 22 bp, Homo sapiens
aaagcatgattagatagatgat

SEQ ID NO: 7419027 - DNA, 22 bp, Homo sapiens
aaagcatgattagatagatgat

SEQ ID NO: 7419028 - DNA, 22 bp, Homo sapiens
aaagcatgactcaagaattact

SEQ ID NO: 7419029 - DNA, 22 bp, Homo sapiens
aaagcatgctactttatatagg

SEQ ID NO: 7419030 - DNA, 22 bp, Homo sapiens
aaagcatgctactttatatagg

SEQ ID NO: 7419031 - DNA, 22 bp, Homo sapiens
aaagcatgattagatagatgat

SEQ ID NO: 7419032 - DNA, 22 bp, Homo sapiens
aaagcatgctactttatatagg

SEQ ID NO: 7419033 - DNA, 22 bp, Homo sapiens
aaattcatttttcttagtgtgc

SEQ ID NO: 7419034 - DNA, 22 bp, Homo sapiens
aaattcatatgttgaaatgcta

SEQ ID NO: 7419035 - DNA, 22 bp, Homo sapiens
aaattcatatgttgaaatgcta

SEQ ID NO: 7419036 - DNA, 22 bp, Homo sapiens
aaattcatatgttgaaatgcta

SEQ ID NO: 7419037 - DNA, 22 bp, Homo sapiens
aaattcatatgttgaaatgcta

SEQ ID NO: 7419038 - DNA, 22 bp, Homo sapiens
aaattcatatgttgaaatgcta

SEQ ID NO: 7419039 - DNA, 22 bp, Homo sapiens
aaattcatatgttgaaatgcta

SEQ ID NO: 7419040 - DNA, 22 bp, Homo sapiens
aaattcatatgttgaaatgcta

SEQ ID NO: 7419041 - DNA, 22 bp, Homo sapiens
aaattcagttttaataatcact

SEQ ID NO: 7419042 - DNA, 22 bp, Homo sapiens
aaattcagttttaataatcact

SEQ ID NO: 7419043 - DNA, 22 bp, Homo sapiens
aaattcagttttaataatcact

SEQ ID NO: 7419044 - DNA, 22 bp, Homo sapiens
aaattcatttttcttagtgtgc

SEQ ID NO: 7419045 - DNA, 22 bp, Homo sapiens
aaattcatttttcttagtgtgc

SEQ ID NO: 7419046 - DNA, 22 bp, Homo sapiens
aaattcatttttcttagtgtgc

SEQ ID NO: 7419047 - DNA, 22 bp, Homo sapiens
aaattcatttttcttagtgtgc

SEQ ID NO: 7419048 - DNA, 22 bp, Homo sapiens
aaattcagcagtgaaatgcccc

SEQ ID NO: 7419049 - DNA, 22 bp, Homo sapiens
aaattcatttttcttagtgtgc

SEQ ID NO: 7419050 - DNA, 22 bp, Homo sapiens
aaattccaccagaatcagtaat

SEQ ID NO: 7419051 - DNA, 22 bp, Homo sapiens
aaattccaccagaatcagtaat

SEQ ID NO: 7419052 - DNA, 22 bp, Homo sapiens
aaattccaccagaatcagtaat

SEQ ID NO: 7419053 - DNA, 22 bp, Homo sapiens
aaattcatttttcttagtgtgc

SEQ ID NO: 7419054 - DNA, 22 bp, Homo sapiens
aaattccaccagaatcagtaat

SEQ ID NO: 7419055 - DNA, 22 bp, Homo sapiens
aaattagatcagtggattttct

SEQ ID NO: 7419056 - DNA, 22 bp, Homo sapiens
aaattagatcagtggattttct

SEQ ID NO: 7419057 - DNA, 22 bp, Homo sapiens
aaattcagatggctttcttttc

SEQ ID NO: 7419058 - DNA, 22 bp, Homo sapiens
aaagacatgacacattggagag

SEQ ID NO: 7419059 - DNA, 22 bp, Homo sapiens
aaattagaccagttcaggtcca

SEQ ID NO: 7419060 - DNA, 22 bp, Homo sapiens
aaattagatatgtgtgagactc

SEQ ID NO: 7419061 - DNA, 23 bp, Homo sapiens
aaattcagtccttcaactctgag

SEQ ID NO: 7419062 - DNA, 22 bp, Homo sapiens
aaattcagttttaataatcact

SEQ ID NO: 7419063 - DNA, 22 bp, Homo sapiens
aaattcagttttaataatcact

SEQ ID NO: 7419064 - DNA, 22 bp, Homo sapiens
aaattcagtttctgtcctggga

SEQ ID NO: 7419065 - DNA, 22 bp, Homo sapiens
aaattcagttcctcagccacat

SEQ ID NO: 7419066 - DNA, 22 bp, Homo sapiens
aaattcagatggctttcttttc

SEQ ID NO: 7419067 - DNA, 22 bp, Homo sapiens
aaattcagcagtgaaatgcccc

SEQ ID NO: 7419068 - DNA, 23 bp, Homo sapiens
aaattcagtccttcaactctgag

SEQ ID NO: 7419069 - DNA, 22 bp, Homo sapiens
aaattcagcatcctgcactgga

SEQ ID NO: 7419070 - DNA, 22 bp, Homo sapiens
aaattcagcatcctgcactgga

SEQ ID NO: 7419071 - DNA, 22 bp, Homo sapiens
aaattccattttgtgactattc

SEQ ID NO: 7419072 - DNA, 22 bp, Homo sapiens
aaattccattttgtgactattc

SEQ ID NO: 7419073 - DNA, 22 bp, Homo sapiens
aaattccattttgtgactattc

SEQ ID NO: 7419074 - DNA, 22 bp, Homo sapiens
aaattgctatatgtgaatgtga

SEQ ID NO: 7419075 - DNA, 22 bp, Homo sapiens
aaattgctatatgtgaatgtga

SEQ ID NO: 7419076 - DNA, 22 bp, Homo sapiens
aaattccattttgtgactattc

SEQ ID NO: 7419077 - DNA, 22 bp, Homo sapiens
aaattgctctttaaaagtactg

SEQ ID NO: 7419078 - DNA, 22 bp, Homo sapiens
aaattgctgacacttgaccatt

SEQ ID NO: 7419079 - DNA, 22 bp, Homo sapiens
aaattgctggcagcctttattc

SEQ ID NO: 7419080 - DNA, 22 bp, Homo sapiens
aaattgctgaccaagtatattc

SEQ ID NO: 7419081 - DNA, 22 bp, Homo sapiens
aaattgctgaccaagtatattc

SEQ ID NO: 7419082 - DNA, 22 bp, Homo sapiens
aaattgctgaccaagtatattc

SEQ ID NO: 7419083 - DNA, 22 bp, Homo sapiens
aaattccattatgataatttcg

SEQ ID NO: 7419084 - DNA, 22 bp, Homo sapiens
aaattccattatgataatttcg

SEQ ID NO: 7419085 - DNA, 22 bp, Homo sapiens
aaattccattatgataatttcg

SEQ ID NO: 7419086 - DNA, 22 bp, Homo sapiens
aaattccattaggaaacttcca

SEQ ID NO: 7419087 - DNA, 22 bp, Homo sapiens
aaattccattaggaaacttcca

SEQ ID NO: 7419088 - DNA, 22 bp, Homo sapiens
aaattccattaggaaacttcca

SEQ ID NO: 7419089 - DNA, 22 bp, Homo sapiens
aaattccattaggaaacttcca

SEQ ID NO: 7419090 - DNA, 22 bp, Homo sapiens
aaattccattatgataatttcg

SEQ ID NO: 7419091 - DNA, 22 bp, Homo sapiens
aaattccattatgataatttcg

SEQ ID NO: 7419092 - DNA, 22 bp, Homo sapiens
aaattccattatgataatttcg

SEQ ID NO: 7419093 - DNA, 22 bp, Homo sapiens
aaattccattatgataatttcg

SEQ ID NO: 7419094 - DNA, 22 bp, Homo sapiens
aaattccagttcttttacctgc

SEQ ID NO: 7419095 - DNA, 22 bp, Homo sapiens
aaattccagttcttttacctgc

SEQ ID NO: 7419096 - DNA, 22 bp, Homo sapiens
aaattccagttcttttacctgc

SEQ ID NO: 7419097 - DNA, 22 bp, Homo sapiens
aaattccagttcttttacctgc

SEQ ID NO: 7419098 - DNA, 22 bp, Homo sapiens
aaattccagcaacaccttttta

SEQ ID NO: 7419099 - DNA, 22 bp, Homo sapiens
aaattccagcaacaccttttta

SEQ ID NO: 7419100 - DNA, 22 bp, Homo sapiens
aaattccagaaactcagtatat

SEQ ID NO: 7419101 - DNA, 22 bp, Homo sapiens
aaattccagaaactcagtatat

SEQ ID NO: 7419102 - DNA, 22 bp, Homo sapiens
aaattccagaaactcagtatat

SEQ ID NO: 7419103 - DNA, 22 bp, Homo sapiens
aaattccagaaactcagtatat

SEQ ID NO: 7419104 - DNA, 22 bp, Homo sapiens
aaattgtctctattttgattcg

SEQ ID NO: 7419105 - DNA, 22 bp, Homo sapiens
aaattgtctctattttgattcg

SEQ ID NO: 7419106 - DNA, 22 bp, Homo sapiens
aaattgtccttttaagaaacag

SEQ ID NO: 7419107 - DNA, 23 bp, Homo sapiens
aaattgtcgtaaggtggagatgt

SEQ ID NO: 7419108 - DNA, 22 bp, Homo sapiens
aaagcagcaagtatttgttact

SEQ ID NO: 7419109 - DNA, 22 bp, Homo sapiens
aaagcagcacatggatatcagt

SEQ ID NO: 7419110 - DNA, 22 bp, Homo sapiens
aaagcagcacatggatatcagt

SEQ ID NO: 7419111 - DNA, 22 bp, Homo sapiens
aaagcagcaagtatttgttact

SEQ ID NO: 7419112 - DNA, 22 bp, Homo sapiens
aaattgtccttttaagaaacag

SEQ ID NO: 7419113 - DNA, 22 bp, Homo sapiens
aaattgtcagaattcagaaagt

SEQ ID NO: 7419114 - DNA, 22 bp, Homo sapiens
aaattgtatattccatttgtat

SEQ ID NO: 7419115 - DNA, 22 bp, Homo sapiens
aaattgtatattccatttgtat

SEQ ID NO: 7419116 - DNA, 22 bp, Homo sapiens
aaattgtataatgttccagctg

SEQ ID NO: 7419117 - DNA, 22 bp, Homo sapiens
aaattgtataatgttccagctg

SEQ ID NO: 7419118 - DNA, 22 bp, Homo sapiens
aaattgtatattccatttgtat

SEQ ID NO: 7419119 - DNA, 22 bp, Homo sapiens
aaattgtatattccatttgtat

SEQ ID NO: 7419120 - DNA, 22 bp, Homo sapiens
aaattggattttaaactgttgg

SEQ ID NO: 7419121 - DNA, 22 bp, Homo sapiens
aaattggattttaaactgttgg

SEQ ID NO: 7419122 - DNA, 22 bp, Homo sapiens
aaattggattgggagaatgtga

SEQ ID NO: 7419123 - DNA, 22 bp, Homo sapiens
aaattgcttgagattagtctcc

SEQ ID NO: 7419124 - DNA, 22 bp, Homo sapiens
aaattggagtctgaggagtaag

SEQ ID NO: 7419125 - DNA, 22 bp, Homo sapiens
aaattgtaatgacttcacttga

SEQ ID NO: 7419126 - DNA, 22 bp, Homo sapiens
aaattgtaatgacttcacttga

SEQ ID NO: 7419127 - DNA, 22 bp, Homo sapiens
aaattgtaatgacttcacttga

SEQ ID NO: 7419128 - DNA, 22 bp, Homo sapiens
aaattgtaatgacttcacttga

SEQ ID NO: 7419129 - DNA, 22 bp, Homo sapiens
aaattgtaatgacttcacttga

SEQ ID NO: 7419130 - DNA, 22 bp, Homo sapiens
aaattgtaatgacttcacttga

SEQ ID NO: 7419131 - DNA, 22 bp, Homo sapiens
aaattgtaggatcacatgacct

SEQ ID NO: 7419132 - DNA, 22 bp, Homo sapiens
aaattgtaggatcacatgacct

SEQ ID NO: 7419133 - DNA, 22 bp, Homo sapiens
aaattgtaggatcacatgacct

SEQ ID NO: 7419134 - DNA, 22 bp, Homo sapiens
aaattgtaggatcacatgacct

SEQ ID NO: 7419135 - DNA, 22 bp, Homo sapiens
aaattgtaatgacttcacttga

SEQ ID NO: 7419136 - DNA, 22 bp, Homo sapiens
aaattgtagagatcgctttgtg

SEQ ID NO: 7419137 - DNA, 22 bp, Homo sapiens
aaattgtagagatcgctttgtg

SEQ ID NO: 7419138 - DNA, 22 bp, Homo sapiens
aaattgtaggatcacatgacct

SEQ ID NO: 7419139 - DNA, 22 bp, Homo sapiens
aaagcagcacatggatatcagt

SEQ ID NO: 7419140 - DNA, 22 bp, Homo sapiens
aaagcagcacatggatatcagt

SEQ ID NO: 7419141 - DNA, 22 bp, Homo sapiens
aaagcaggttatgaccatggcc

SEQ ID NO: 7419142 - DNA, 22 bp, Homo sapiens
aaagcagcagaaagctggcccc

SEQ ID NO: 7419143 - DNA, 22 bp, Homo sapiens
aaagcaggttatgaccatggcc

SEQ ID NO: 7419144 - DNA, 22 bp, Homo sapiens
aaagcaggttatgaccatggcc

SEQ ID NO: 7419145 - DNA, 22 bp, Homo sapiens
aaagcaggttatgaccatggcc

SEQ ID NO: 7419146 - DNA, 22 bp, Homo sapiens
aaagcaggttgcaattacagtg

SEQ ID NO: 7419147 - DNA, 22 bp, Homo sapiens
aaagcaggttatgaccatggcc

SEQ ID NO: 7419148 - DNA, 22 bp, Homo sapiens
aaagcaggttgcaattacagtg

SEQ ID NO: 7419149 - DNA, 22 bp, Homo sapiens
aaagcagtatagtggaagggct

SEQ ID NO: 7419150 - DNA, 22 bp, Homo sapiens
aaagcagtatattggtagttgt

SEQ ID NO: 7419151 - DNA, 22 bp, Homo sapiens
aaagcagtatattggtagttgt

SEQ ID NO: 7419152 - DNA, 22 bp, Homo sapiens
aaagcagtatagtggaagggct

SEQ ID NO: 7419153 - DNA, 22 bp, Homo sapiens
aaagcagtataagtaacggaag

SEQ ID NO: 7419154 - DNA, 22 bp, Homo sapiens
aaagcagtataagtaacggaag

SEQ ID NO: 7419155 - DNA, 22 bp, Homo sapiens
aaagcagtataagtaacggaag

SEQ ID NO: 7419156 - DNA, 22 bp, Homo sapiens
aaagcagtataagtaacggaag

SEQ ID NO: 7419157 - DNA, 22 bp, Homo sapiens
aaagcagtagttttcaaatagt

SEQ ID NO: 7419158 - DNA, 22 bp, Homo sapiens
aaagcagtagttttcaaatagt

SEQ ID NO: 7419159 - DNA, 22 bp, Homo sapiens
aaagcagtagttttcaaatagt

SEQ ID NO: 7419160 - DNA, 22 bp, Homo sapiens
aaagcaggttgcaattacagtg

SEQ ID NO: 7419161 - DNA, 22 bp, Homo sapiens
aaagcagtagttttcaaatagt

SEQ ID NO: 7419162 - DNA, 22 bp, Homo sapiens
aaagcagtagttttcaaatagt

SEQ ID NO: 7419163 - DNA, 22 bp, Homo sapiens
aaagcagtagttttcaaatagt

SEQ ID NO: 7419164 - DNA, 22 bp, Homo sapiens
aaagcagtgcaccttaattgat

SEQ ID NO: 7419165 - DNA, 19 bp, Homo sapiens
aaagcagtgcatcctcttt

SEQ ID NO: 7419166 - DNA, 22 bp, Homo sapiens
aaagcagtgcaccttaattgat

SEQ ID NO: 7419167 - DNA, 22 bp, Homo sapiens
aaagcagtctgttttaacctga

SEQ ID NO: 7419168 - DNA, 22 bp, Homo sapiens
aaagcagtctgttttaacctga

SEQ ID NO: 7419169 - DNA, 22 bp, Homo sapiens
aaagcagtctgttttaacctga

SEQ ID NO: 7419170 - DNA, 22 bp, Homo sapiens
aaagcagtctgttttaacctga

SEQ ID NO: 7419171 - DNA, 22 bp, Homo sapiens
aaagcagtctcagacttaagca

SEQ ID NO: 7419172 - DNA, 22 bp, Homo sapiens
aaagcagtctcagacttaagca

SEQ ID NO: 7419173 - DNA, 22 bp, Homo sapiens
aaagcagtctcagacttaagca

SEQ ID NO: 7419174 - DNA, 22 bp, Homo sapiens
aaagcagtctcagacttaagca

SEQ ID NO: 7419175 - DNA, 22 bp, Homo sapiens
aaagcagtctcagacttaagca

SEQ ID NO: 7419176 - DNA, 22 bp, Homo sapiens
aaagcagtctcagacttaagca

SEQ ID NO: 7419177 - DNA, 22 bp, Homo sapiens
aaagcagtccttcccttaaggt

SEQ ID NO: 7419178 - DNA, 22 bp, Homo sapiens
aaagcagtccttcccttaaggt

SEQ ID NO: 7419179 - DNA, 22 bp, Homo sapiens
aaagcagtccttcccttaaggt

SEQ ID NO: 7419180 - DNA, 22 bp, Homo sapiens
aaagcagtcactccagtgtgat

SEQ ID NO: 7419181 - DNA, 20 bp, Homo sapiens
aaagcagtatgcaagtagag

SEQ ID NO: 7419182 - DNA, 20 bp, Homo sapiens
aaagcagtatgcaagtagag

SEQ ID NO: 7419183 - DNA, 20 bp, Homo sapiens
aaagcagtatgcaagtagag

SEQ ID NO: 7419184 - DNA, 22 bp, Homo sapiens
aaagcagtatgaaaggcaataa

SEQ ID NO: 7419185 - DNA, 22 bp, Homo sapiens
aaagttctgggggagaagaacg

SEQ ID NO: 7419186 - DNA, 22 bp, Homo sapiens
aaagttctgggggagaagaacg

SEQ ID NO: 7419187 - DNA, 22 bp, Homo sapiens
aaagttctggagaaaataatga

SEQ ID NO: 7419188 - DNA, 22 bp, Homo sapiens
aaagttctggcattttctgtct

SEQ ID NO: 7419189 - DNA, 22 bp, Homo sapiens
aaagttctggagaaaataatga

SEQ ID NO: 7419190 - DNA, 22 bp, Homo sapiens
aaagttctggagaaaataatga

SEQ ID NO: 7419191 - DNA, 22 bp, Homo sapiens
aaagttctgatgctgatcaaag

SEQ ID NO: 7419192 - DNA, 22 bp, Homo sapiens
aaagttctggagaaaataatga

SEQ ID NO: 7419193 - DNA, 22 bp, Homo sapiens
aaagttctgatgctgatcaaag

SEQ ID NO: 7419194 - DNA, 22 bp, Homo sapiens
aaagttctgatgctgatcaaag

SEQ ID NO: 7419195 - DNA, 22 bp, Homo sapiens
aaagttcttcatttttattgga

SEQ ID NO: 7419196 - DNA, 22 bp, Homo sapiens
aaagttcttcatttttattgga

SEQ ID NO: 7419197 - DNA, 22 bp, Homo sapiens
aaagttctttctcttatttggt

SEQ ID NO: 7419198 - DNA, 22 bp, Homo sapiens
aaagttctttctcttatttggt

SEQ ID NO: 7419199 - DNA, 22 bp, Homo sapiens
aaagttctttctcttatttggt

SEQ ID NO: 7419200 - DNA, 22 bp, Homo sapiens
aaagttctgggggtgtttctgg

SEQ ID NO: 7419201 - DNA, 22 bp, Homo sapiens
aaagttctgggggtgtttctgg

SEQ ID NO: 7419202 - DNA, 22 bp, Homo sapiens
aaagttctgggggtgtttctgg

SEQ ID NO: 7419203 - DNA, 22 bp, Homo sapiens
aaagttctgggggagaagaacg

SEQ ID NO: 7419204 - DNA, 22 bp, Homo sapiens
aaagttctgggggagaagaacg

SEQ ID NO: 7419205 - DNA, 22 bp, Homo sapiens
aaagttctcctggattgtgctg

SEQ ID NO: 7419206 - DNA, 22 bp, Homo sapiens
aaagttctcctggattgtgctg

SEQ ID NO: 7419207 - DNA, 22 bp, Homo sapiens
aaagttctctatggtgtaaaaa

SEQ ID NO: 7419208 - DNA, 22 bp, Homo sapiens
aaagttctctatggtgtaaaaa

SEQ ID NO: 7419209 - DNA, 22 bp, Homo sapiens
aaagttctctatggtgtaaaaa

SEQ ID NO: 7419210 - DNA, 23 bp, Homo sapiens
aaagttctcttgcgtgtgggaaa

SEQ ID NO: 7419211 - DNA, 19 bp, Homo sapiens
aaagttctgactgtagagc

SEQ ID NO: 7419212 - DNA, 19 bp, Homo sapiens
aaagttctgactgtagagc

SEQ ID NO: 7419213 - DNA, 19 bp, Homo sapiens
aaagttctgactgtagagc

SEQ ID NO: 7419214 - DNA, 22 bp, Homo sapiens
aaagttctgagaagcagtttac

SEQ ID NO: 7419215 - DNA, 22 bp, Homo sapiens
aaagttctgagactgatggcta

SEQ ID NO: 7419216 - DNA, 22 bp, Homo sapiens
aaagttctgagactgatggcta

SEQ ID NO: 7419217 - DNA, 22 bp, Homo sapiens
aaagttctattggatagtgctg

SEQ ID NO: 7419218 - DNA, 22 bp, Homo sapiens
aaagttctattggatagtgctg

SEQ ID NO: 7419219 - DNA, 22 bp, Homo sapiens
aaagttctattggatagtgctg

SEQ ID NO: 7419220 - DNA, 22 bp, Homo sapiens
aaagttctatgtaatgtttttt

SEQ ID NO: 7419221 - DNA, 22 bp, Homo sapiens
aaagttctatgtaatgtttttt

SEQ ID NO: 7419222 - DNA, 22 bp, Homo sapiens
aaagttctatgtaatgtttttt

SEQ ID NO: 7419223 - DNA, 22 bp, Homo sapiens
aaagttacacgactatttatgt

SEQ ID NO: 7419224 - DNA, 22 bp, Homo sapiens
aaagttacacgactatttatgt

SEQ ID NO: 7419225 - DNA, 22 bp, Homo sapiens
aaagttacacatctagtaagtg

SEQ ID NO: 7419226 - DNA, 22 bp, Homo sapiens
aaagttacacatctagtaagtg

SEQ ID NO: 7419227 - DNA, 22 bp, Homo sapiens
aacttgaatgagaacttttgcc

SEQ ID NO: 7419228 - DNA, 22 bp, Homo sapiens
aacttgaagttgcagaaagtac

SEQ ID NO: 7419229 - DNA, 22 bp, Homo sapiens
aacttgaagttgcagaaagtac

SEQ ID NO: 7419230 - DNA, 22 bp, Homo sapiens
aaagttacacatctagtaagtg

SEQ ID NO: 7419231 - DNA, 22 bp, Homo sapiens
aaagttacacatctagtaagtg

SEQ ID NO: 7419232 - DNA, 22 bp, Homo sapiens
aaagttacacatctagtaagtg

SEQ ID NO: 7419233 - DNA, 22 bp, Homo sapiens
aacttgaagttgcagaaagtac

SEQ ID NO: 7419234 - DNA, 22 bp, Homo sapiens
aacttgaagttgcagaaagtac

SEQ ID NO: 7419235 - DNA, 22 bp, Homo sapiens
aacttgaagaggctttttggca

SEQ ID NO: 7419236 - DNA, 22 bp, Homo sapiens
aacttgaaccacagaagctgcc

SEQ ID NO: 7419237 - DNA, 22 bp, Homo sapiens
aacttgaactgatgagtgttag

SEQ ID NO: 7419238 - DNA, 22 bp, Homo sapiens
aacttgaaactgttccagaaaa

SEQ ID NO: 7419239 - DNA, 22 bp, Homo sapiens
aacttgaaactgttccagaaaa

SEQ ID NO: 7419240 - DNA, 22 bp, Homo sapiens
aacttgaaaacctcatgaattg

SEQ ID NO: 7419241 - DNA, 22 bp, Homo sapiens
aacttgaaaacctcatgaattg

SEQ ID NO: 7419242 - DNA, 22 bp, Homo sapiens
aacttgaaactgttccagaaaa

SEQ ID NO: 7419243 - DNA, 22 bp, Homo sapiens
aacttctttgagctccagtttt

SEQ ID NO: 7419244 - DNA, 22 bp, Homo sapiens
aacttctttgagctccagtttt

SEQ ID NO: 7419245 - DNA, 22 bp, Homo sapiens
aacttcttggtcctgagctgtt

SEQ ID NO: 7419246 - DNA, 22 bp, Homo sapiens
aacttctgggctgtccaaaact

SEQ ID NO: 7419247 - DNA, 22 bp, Homo sapiens
aacttctgggctgtccaaaact

SEQ ID NO: 7419248 - DNA, 22 bp, Homo sapiens
aacttctggatgtttcaaatgt

SEQ ID NO: 7419249 - DNA, 22 bp, Homo sapiens
aacttctgccaaacagctgtta

SEQ ID NO: 7419250 - DNA, 22 bp, Homo sapiens
aacttctgcagaaaagtgcatg

SEQ ID NO: 7419251 - DNA, 22 bp, Homo sapiens
aacttctgccaaacagctgtta

SEQ ID NO: 7419252 - DNA, 22 bp, Homo sapiens
aacttctgacctcaagaactgt

SEQ ID NO: 7419253 - DNA, 22 bp, Homo sapiens
aacttctgcagaaaagtgcatg

SEQ ID NO: 7419254 - DNA, 22 bp, Homo sapiens
aacttctaatctgtacagtttt

SEQ ID NO: 7419255 - DNA, 22 bp, Homo sapiens
aaagtcacgctgatgggaaatg

SEQ ID NO: 7419256 - DNA, 22 bp, Homo sapiens
aaagtcacgctgatgggaaatg

SEQ ID NO: 7419257 - DNA, 22 bp, Homo sapiens
aaagtcacgctgatgggaaatg

SEQ ID NO: 7419258 - DNA, 22 bp, Homo sapiens
aaagtcacgctgatgggaaatg

SEQ ID NO: 7419259 - DNA, 22 bp, Homo sapiens
aaagtcacatataacaagggca

SEQ ID NO: 7419260 - DNA, 22 bp, Homo sapiens
aaagtcacatataacaagggca

SEQ ID NO: 7419261 - DNA, 22 bp, Homo sapiens
aaagtccagggaaagagcgtct

SEQ ID NO: 7419262 - DNA, 22 bp, Homo sapiens
aaagtccagggaaagagcgtct

SEQ ID NO: 7419263 - DNA, 22 bp, Homo sapiens
aaagtccagggaaagagcgtct

SEQ ID NO: 7419264 - DNA, 22 bp, Homo sapiens
aaagtcctagcgatccacagaa

SEQ ID NO: 7419265 - DNA, 22 bp, Homo sapiens
aaagtcctagcgatccacagaa

SEQ ID NO: 7419266 - DNA, 22 bp, Homo sapiens
aaagtcctagcgatccacagaa

SEQ ID NO: 7419267 - DNA, 22 bp, Homo sapiens
aaagtcctgactgcaggggatg

SEQ ID NO: 7419268 - DNA, 22 bp, Homo sapiens
aaagtcctagcgatccacagaa

SEQ ID NO: 7419269 - DNA, 22 bp, Homo sapiens
aaagtcctagcgatccacagaa

SEQ ID NO: 7419270 - DNA, 22 bp, Homo sapiens
aaagtcctgttaactgttaaca

SEQ ID NO: 7419271 - DNA, 22 bp, Homo sapiens
aaagtcctgttaactgttaaca

SEQ ID NO: 7419272 - DNA, 22 bp, Homo sapiens
aaagtccttgcagtttcctctt

SEQ ID NO: 7419273 - DNA, 22 bp, Homo sapiens
aaagtcctttttgccatgcaag

SEQ ID NO: 7419274 - DNA, 22 bp, Homo sapiens
aaagtccttgcagtttcctctt

SEQ ID NO: 7419275 - DNA, 22 bp, Homo sapiens
aaagtccttgcagtttcctctt

SEQ ID NO: 7419276 - DNA, 22 bp, Homo sapiens
aaagtcctgtttgaaggacctg

SEQ ID NO: 7419277 - DNA, 22 bp, Homo sapiens
aaagtctatcagttactaatca

SEQ ID NO: 7419278 - DNA, 22 bp, Homo sapiens
aaagtctaaattattcaataag

SEQ ID NO: 7419279 - DNA, 22 bp, Homo sapiens
aaagtctaaattattcaataag

SEQ ID NO: 7419280 - DNA, 22 bp, Homo sapiens
aaagtcctttttgccatgcaag

SEQ ID NO: 7419281 - DNA, 22 bp, Homo sapiens
aaagtcctttttgccatgcaag

SEQ ID NO: 7419282 - DNA, 22 bp, Homo sapiens
aaagtctttctcatagtcacgc

SEQ ID NO: 7419283 - DNA, 22 bp, Homo sapiens
aaagtctttctcattggccatg

SEQ ID NO: 7419284 - DNA, 22 bp, Homo sapiens
aaagtctttctcattggccatg

SEQ ID NO: 7419285 - DNA, 22 bp, Homo sapiens
aaagtctttctcattggccatg

SEQ ID NO: 7419286 - DNA, 22 bp, Homo sapiens
aaagtctttctcatagtcacgc

SEQ ID NO: 7419287 - DNA, 22 bp, Homo sapiens
aaagtctttctcatagtcacgc

SEQ ID NO: 7419288 - DNA, 22 bp, Homo sapiens
aaagtctttctcatagtcacgc

SEQ ID NO: 7419289 - DNA, 22 bp, Homo sapiens
aaagtctttattttgtatcttt

SEQ ID NO: 7419290 - DNA, 22 bp, Homo sapiens
aaagtctttattttgtatcttt

SEQ ID NO: 7419291 - DNA, 22 bp, Homo sapiens
aaagtctttattttgtatcttt

SEQ ID NO: 7419292 - DNA, 22 bp, Homo sapiens
aaagtctttattttgtatcttt

SEQ ID NO: 7419293 - DNA, 22 bp, Homo sapiens
aaagtcttgcattgatcttgaa

SEQ ID NO: 7419294 - DNA, 22 bp, Homo sapiens
aaagtctttattttgtatcttt

SEQ ID NO: 7419295 - DNA, 22 bp, Homo sapiens
aaagtctttattttgtatcttt

SEQ ID NO: 7419296 - DNA, 22 bp, Homo sapiens
aacttccttctagttcatatgt

SEQ ID NO: 7419297 - DNA, 22 bp, Homo sapiens
aacttcctgacttctaatgagt

SEQ ID NO: 7419298 - DNA, 22 bp, Homo sapiens
aacttccttctagttcatatgt

SEQ ID NO: 7419299 - DNA, 22 bp, Homo sapiens
aacttccttctagttcatatgt

SEQ ID NO: 7419300 - DNA, 22 bp, Homo sapiens
aacttccttctagttcatatgt

SEQ ID NO: 7419301 - DNA, 22 bp, Homo sapiens
aacttccaggccttgaattatt

SEQ ID NO: 7419302 - DNA, 22 bp, Homo sapiens
aacttccaggccttgaattatt

SEQ ID NO: 7419303 - DNA, 22 bp, Homo sapiens
aacttccaccaaatagtatata

SEQ ID NO: 7419304 - DNA, 22 bp, Homo sapiens
aacttccaccaaatagtatata

SEQ ID NO: 7419305 - DNA, 22 bp, Homo sapiens
aacttccaccaaatagtatata

SEQ ID NO: 7419306 - DNA, 22 bp, Homo sapiens
aacttccagctttctgtctaat

SEQ ID NO: 7419307 - DNA, 22 bp, Homo sapiens
aacttccagctttctgtctaat

SEQ ID NO: 7419308 - DNA, 22 bp, Homo sapiens
aacttccagctttctgtctaat

SEQ ID NO: 7419309 - DNA, 22 bp, Homo sapiens
aaagtcttcacggcactagtgt

SEQ ID NO: 7419310 - DNA, 22 bp, Homo sapiens
aaagtcttcacggcactagtgt

SEQ ID NO: 7419311 - DNA, 22 bp, Homo sapiens
aaagtcttgcattgatcttgaa

SEQ ID NO: 7419312 - DNA, 22 bp, Homo sapiens
aaagtcttgcattgatcttgaa

SEQ ID NO: 7419313 - DNA, 22 bp, Homo sapiens
aaagtcttgcattgatcttgaa

SEQ ID NO: 7419314 - DNA, 22 bp, Homo sapiens
aaagtcttgttacgttccattg

SEQ ID NO: 7419315 - DNA, 22 bp, Homo sapiens
aaagtcttgttacgttccattg

SEQ ID NO: 7419316 - DNA, 22 bp, Homo sapiens
aaagtcttgttacgttccattg

SEQ ID NO: 7419317 - DNA, 22 bp, Homo sapiens
aaagtcttgttacgttccattg

SEQ ID NO: 7419318 - DNA, 20 bp, Homo sapiens
aaagtcttatggttaatttt

SEQ ID NO: 7419319 - DNA, 20 bp, Homo sapiens
aaagtcttatggttaatttt

SEQ ID NO: 7419320 - DNA, 22 bp, Homo sapiens
aaagtcttcacggcactagtgt

SEQ ID NO: 7419321 - DNA, 22 bp, Homo sapiens
aaagtcttcacggcactagtgt

SEQ ID NO: 7419322 - DNA, 22 bp, Homo sapiens
aaagtcttcacggcactagtgt

SEQ ID NO: 7419323 - DNA, 22 bp, Homo sapiens
aaagtcttcacggcactagtgt

SEQ ID NO: 7419324 - DNA, 20 bp, Homo sapiens
aaagtcttatggttaatttt

SEQ ID NO: 7419325 - DNA, 20 bp, Homo sapiens
aaagtcttatggttaatttt

SEQ ID NO: 7419326 - DNA, 20 bp, Homo sapiens
aaagtcttatggttaatttt

SEQ ID NO: 7419327 - DNA, 20 bp, Homo sapiens
aaagtcttatggttaatttt

SEQ ID NO: 7419328 - DNA, 22 bp, Homo sapiens
aaagtctgaaagatgctaacat

SEQ ID NO: 7419329 - DNA, 22 bp, Homo sapiens
aaagtctgagcagaatttctca

SEQ ID NO: 7419330 - DNA, 22 bp, Homo sapiens
aaagtctgaaagataagagtga

SEQ ID NO: 7419331 - DNA, 22 bp, Homo sapiens
aaagtctgaaagataagagtga

SEQ ID NO: 7419332 - DNA, 22 bp, Homo sapiens
aaagtctgaaagataagagtga

SEQ ID NO: 7419333 - DNA, 20 bp, Homo sapiens
aaagtctgtttatctctgga

SEQ ID NO: 7419334 - DNA, 22 bp, Homo sapiens
aaagtcttaatgtaagtttagt

SEQ ID NO: 7419335 - DNA, 22 bp, Homo sapiens
aaagtcttaatgtaagtttagt

SEQ ID NO: 7419336 - DNA, 22 bp, Homo sapiens
aaagtcttaatgtaagtttagt

SEQ ID NO: 7419337 - DNA, 22 bp, Homo sapiens
aaagtcttaatgtaagtttagt

SEQ ID NO: 7419338 - DNA, 22 bp, Homo sapiens
aaaggctatgagatagaagata

SEQ ID NO: 7419339 - DNA, 22 bp, Homo sapiens
aaaggctatgagatagaagata

SEQ ID NO: 7419340 - DNA, 22 bp, Homo sapiens
aaaggctatgagatagaagata

SEQ ID NO: 7419341 - DNA, 22 bp, Homo sapiens
aaaggctatgagatagaagata

SEQ ID NO: 7419342 - DNA, 22 bp, Homo sapiens
aaaggctatgagatagaagata

SEQ ID NO: 7419343 - DNA, 22 bp, Homo sapiens
aaaggctattcagggacttgcc

SEQ ID NO: 7419344 - DNA, 22 bp, Homo sapiens
aaaggctatgatagtccagtgg

SEQ ID NO: 7419345 - DNA, 22 bp, Homo sapiens
aaaggctattcagggacttgcc

SEQ ID NO: 7419346 - DNA, 22 bp, Homo sapiens
aaaggctattcagggacttgcc

SEQ ID NO: 7419347 - DNA, 22 bp, Homo sapiens
aaaggctattcagggacttgcc

SEQ ID NO: 7419348 - DNA, 22 bp, Homo sapiens
aaaggctatgatagtccagtgg

SEQ ID NO: 7419349 - DNA, 22 bp, Homo sapiens
aaaggctatgatagtccagtgg

SEQ ID NO: 7419350 - DNA, 22 bp, Homo sapiens
aaaggctcacgcagttagtgat

SEQ ID NO: 7419351 - DNA, 22 bp, Homo sapiens
aaaggctcatgaaccaggctcg

SEQ ID NO: 7419352 - DNA, 22 bp, Homo sapiens
aaaggctcatgaaccaggctcg

SEQ ID NO: 7419353 - DNA, 22 bp, Homo sapiens
aaaggctatttttagatgtttg

SEQ ID NO: 7419354 - DNA, 22 bp, Homo sapiens
aaaggctattgctgataatgtt

SEQ ID NO: 7419355 - DNA, 22 bp, Homo sapiens
aaaggctattgctgataatgtt

SEQ ID NO: 7419356 - DNA, 22 bp, Homo sapiens
aaaggctatttcagggtcagta

SEQ ID NO: 7419357 - DNA, 22 bp, Homo sapiens
aaaggctatttcagggtcagta

SEQ ID NO: 7419358 - DNA, 22 bp, Homo sapiens
aaaggctatttttagatgtttg

SEQ ID NO: 7419359 - DNA, 22 bp, Homo sapiens
aaaggctatttttagatgtttg

SEQ ID NO: 7419360 - DNA, 22 bp, Homo sapiens
aaaggctctaacaaggagagag

SEQ ID NO: 7419361 - DNA, 22 bp, Homo sapiens
aaaggctctattgttttcatat

SEQ ID NO: 7419362 - DNA, 22 bp, Homo sapiens
aaaggctgaaggagttgtcata

SEQ ID NO: 7419363 - DNA, 22 bp, Homo sapiens
aaaggctccttctcccatgacc

SEQ ID NO: 7419364 - DNA, 18 bp, Homo sapiens
aaaggctgaatatagaag

SEQ ID NO: 7419365 - DNA, 18 bp, Homo sapiens
aaaggctgaatatagaag

SEQ ID NO: 7419366 - DNA, 22 bp, Homo sapiens
aaaggctctaacaaggagagag

SEQ ID NO: 7419367 - DNA, 22 bp, Homo sapiens
aaaggctcatgaaccaggctcg

SEQ ID NO: 7419368 - DNA, 22 bp, Homo sapiens
aaaggctccttctcccatgacc

SEQ ID NO: 7419369 - DNA, 22 bp, Homo sapiens
aaaggctgccaggtaaaatatt

SEQ ID NO: 7419370 - DNA, 22 bp, Homo sapiens
aaaggctgccaggtaaaatatt

SEQ ID NO: 7419371 - DNA, 22 bp, Homo sapiens
aaaggctgccaggtaaaatatt

SEQ ID NO: 7419372 - DNA, 22 bp, Homo sapiens
aaaggctggaaactgaagataa

SEQ ID NO: 7419373 - DNA, 22 bp, Homo sapiens
aaaggctgcctcagtgccatga

SEQ ID NO: 7419374 - DNA, 22 bp, Homo sapiens
aaaggctgcctcagtgccatga

SEQ ID NO: 7419375 - DNA, 18 bp, Homo sapiens
aaaggctgaatatagaag

SEQ ID NO: 7419376 - DNA, 18 bp, Homo sapiens
aaaggctgaatatagaag

SEQ ID NO: 7419377 - DNA, 22 bp, Homo sapiens
aaaggctgcaaagctgtaagtg

SEQ ID NO: 7419378 - DNA, 22 bp, Homo sapiens
aaaggctgcaaagctgtaagtg

SEQ ID NO: 7419379 - DNA, 22 bp, Homo sapiens
aaaggctgcaaagctgtaagtg

SEQ ID NO: 7419380 - DNA, 22 bp, Homo sapiens
aaaggctgacagggtcctaagt

SEQ ID NO: 7419381 - DNA, 22 bp, Homo sapiens
aaaggctgacagggtcctaagt

SEQ ID NO: 7419382 - DNA, 22 bp, Homo sapiens
aaaggcatgcatggtctgctcc

SEQ ID NO: 7419383 - DNA, 22 bp, Homo sapiens
aacatgcaaagctatgatgtat

SEQ ID NO: 7419384 - DNA, 22 bp, Homo sapiens
aaaggcatgattaattctgtgt

SEQ ID NO: 7419385 - DNA, 22 bp, Homo sapiens
aaaggcatgattaattctgtgt

SEQ ID NO: 7419386 - DNA, 22 bp, Homo sapiens
aaaggctatgagatagaagata

SEQ ID NO: 7419387 - DNA, 22 bp, Homo sapiens
aaaggcatgcatggtctgctcc

SEQ ID NO: 7419388 - DNA, 22 bp, Homo sapiens
aaaggcatgctgctgaatgatg

SEQ ID NO: 7419389 - DNA, 22 bp, Homo sapiens
aaaggcatgcctccatttctat

SEQ ID NO: 7419390 - DNA, 22 bp, Homo sapiens
aaaggcatgcctccatttctat

SEQ ID NO: 7419391 - DNA, 22 bp, Homo sapiens
aaaggcatgcctccatttctat

SEQ ID NO: 7419392 - DNA, 22 bp, Homo sapiens
aacatgatttcatgcatttaga

SEQ ID NO: 7419393 - DNA, 22 bp, Homo sapiens
aacatgatttagtataatgcag

SEQ ID NO: 7419394 - DNA, 22 bp, Homo sapiens
aacatgatttagtataatgcag

SEQ ID NO: 7419395 - DNA, 22 bp, Homo sapiens
aacatgattggaaaatgctgtc

SEQ ID NO: 7419396 - DNA, 22 bp, Homo sapiens
aacatgatgacaaaggtatatt

SEQ ID NO: 7419397 - DNA, 22 bp, Homo sapiens
aacatgatggggaagaacaaga

SEQ ID NO: 7419398 - DNA, 22 bp, Homo sapiens
aacatgatgacattgtaagctt

SEQ ID NO: 7419399 - DNA, 22 bp, Homo sapiens
aacatgatgtgaagcatgaact

SEQ ID NO: 7419400 - DNA, 22 bp, Homo sapiens
aacatgattggaaaatgctgtc

SEQ ID NO: 7419401 - DNA, 22 bp, Homo sapiens
aacatgatggggaagaacaaga

SEQ ID NO: 7419402 - DNA, 22 bp, Homo sapiens
aacatgatgtattttcttgtct

SEQ ID NO: 7419403 - DNA, 22 bp, Homo sapiens
aacatgatgtattttcttgtct

SEQ ID NO: 7419404 - DNA, 22 bp, Homo sapiens
aacatgatgtgaagcatgaact

SEQ ID NO: 7419405 - DNA, 22 bp, Homo sapiens
aacatgaagttttctatagtga

SEQ ID NO: 7419406 - DNA, 22 bp, Homo sapiens
aacatgagcattcttgtgcttg

SEQ ID NO: 7419407 - DNA, 22 bp, Homo sapiens
aacatgaagttttctatagtga

SEQ ID NO: 7419408 - DNA, 22 bp, Homo sapiens
aacatgaagttttctatagtga

SEQ ID NO: 7419409 - DNA, 21 bp, Homo sapiens
aacatgatatgtgtatggatt

SEQ ID NO: 7419410 - DNA, 22 bp, Homo sapiens
aacatgatagtattttgaggtg

SEQ ID NO: 7419411 - DNA, 22 bp, Homo sapiens
aacatgaggcactgagtttcat

SEQ ID NO: 7419412 - DNA, 22 bp, Homo sapiens
aacatgagtgataaaattacct

SEQ ID NO: 7419413 - DNA, 22 bp, Homo sapiens
aacatgagtgataaaattacct

SEQ ID NO: 7419414 - DNA, 22 bp, Homo sapiens
aaaggcttctcagaaaggcctt

SEQ ID NO: 7419415 - DNA, 22 bp, Homo sapiens
aaaggcttcagtgagtgggtat

SEQ ID NO: 7419416 - DNA, 22 bp, Homo sapiens
aaaggcttcggatcagaaggta

SEQ ID NO: 7419417 - DNA, 22 bp, Homo sapiens
aaaggcttctattggacgttgc

SEQ ID NO: 7419418 - DNA, 22 bp, Homo sapiens
aaaggcttctattggacgttgc

SEQ ID NO: 7419419 - DNA, 22 bp, Homo sapiens
aaaggcttcggatcagaaggta

SEQ ID NO: 7419420 - DNA, 22 bp, Homo sapiens
aaaggcttcagtgagtgggtat

SEQ ID NO: 7419421 - DNA, 22 bp, Homo sapiens
aaaggcttcagtgagtgggtat

SEQ ID NO: 7419422 - DNA, 22 bp, Homo sapiens
aaaggcttagacacagaactgt

SEQ ID NO: 7419423 - DNA, 22 bp, Homo sapiens
aaaggcttcacttatttatttt

SEQ ID NO: 7419424 - DNA, 22 bp, Homo sapiens
aaaggcttcacttatttatttt

SEQ ID NO: 7419425 - DNA, 22 bp, Homo sapiens
aaaggcttagacacagaactgt

SEQ ID NO: 7419426 - DNA, 22 bp, Homo sapiens
aaaggcttaacagaagaccttt

SEQ ID NO: 7419427 - DNA, 22 bp, Homo sapiens
aaaggcttaatgttgttgtaat

SEQ ID NO: 7419428 - DNA, 22 bp, Homo sapiens
aaaggcttaatgttgttgtaat

SEQ ID NO: 7419429 - DNA, 22 bp, Homo sapiens
aaaggctggattcagagaggtg

SEQ ID NO: 7419430 - DNA, 22 bp, Homo sapiens
aaaggctggattcagagaggtg

SEQ ID NO: 7419431 - DNA, 22 bp, Homo sapiens
aaaggctggattcagagaggtg

SEQ ID NO: 7419432 - DNA, 22 bp, Homo sapiens
aaaggctggaaactgaagataa

SEQ ID NO: 7419433 - DNA, 22 bp, Homo sapiens
aaaggctggggactgaggaagg

SEQ ID NO: 7419434 - DNA, 22 bp, Homo sapiens
aaaggctggggactgaggaagg

SEQ ID NO: 7419435 - DNA, 22 bp, Homo sapiens
aaaggctggattcagagaggtg

SEQ ID NO: 7419436 - DNA, 22 bp, Homo sapiens
aaaggcttaacagaagaccttt

SEQ ID NO: 7419437 - DNA, 22 bp, Homo sapiens
aaaggctggggactgaggaagg

SEQ ID NO: 7419438 - DNA, 22 bp, Homo sapiens
aaaggctggggactgaggaagg

SEQ ID NO: 7419439 - DNA, 22 bp, Homo sapiens
aaaggctggattcagagaggtg

SEQ ID NO: 7419440 - DNA, 22 bp, Homo sapiens
aaaggcttggtattttggagtt

SEQ ID NO: 7419441 - DNA, 22 bp, Homo sapiens
aaaggcttgcgattccttgtaa

SEQ ID NO: 7419442 - DNA, 22 bp, Homo sapiens
aaaggcttggtattttggagtt

SEQ ID NO: 7419443 - DNA, 22 bp, Homo sapiens
aaaggcttgcgattccttgtaa

SEQ ID NO: 7419444 - DNA, 22 bp, Homo sapiens
aaaggcttgagcatttgttgaa

SEQ ID NO: 7419445 - DNA, 22 bp, Homo sapiens
aaaggcttgactagaagggaga

SEQ ID NO: 7419446 - DNA, 22 bp, Homo sapiens
aaaggcttgagcatttgttgaa

SEQ ID NO: 7419447 - DNA, 22 bp, Homo sapiens
aaaggcttgactagaagggaga

SEQ ID NO: 7419448 - DNA, 22 bp, Homo sapiens
aaaggcttgactagaagggaga

SEQ ID NO: 7419449 - DNA, 22 bp, Homo sapiens
aaaggcttgactagaagggaga

SEQ ID NO: 7419450 - DNA, 22 bp, Homo sapiens
aaaggcttctattggacgttgc

SEQ ID NO: 7419451 - DNA, 22 bp, Homo sapiens
aaaggcttctcagaaaggcctt

SEQ ID NO: 7419452 - DNA, 22 bp, Homo sapiens
aaaggcttctttgctccatgtc

SEQ ID NO: 7419453 - DNA, 22 bp, Homo sapiens
aaaggcttctttgctccatgtc

SEQ ID NO: 7419454 - DNA, 22 bp, Homo sapiens
aaaggcttctttgctccatgtc

SEQ ID NO: 7419455 - DNA, 22 bp, Homo sapiens
aaaggcttgtttgaggactggt

SEQ ID NO: 7419456 - DNA, 22 bp, Homo sapiens
aaaggcttgtacagcagccttc

SEQ ID NO: 7419457 - DNA, 22 bp, Homo sapiens
aaaggctttaaaatgtacatat

SEQ ID NO: 7419458 - DNA, 22 bp, Homo sapiens
aaaggctttaaaatgtacatat

SEQ ID NO: 7419459 - DNA, 22 bp, Homo sapiens
aaaggctttaaaatgtacatat

SEQ ID NO: 7419460 - DNA, 22 bp, Homo sapiens
aaaggctttaaaatgtacatat

SEQ ID NO: 7419461 - DNA, 22 bp, Homo sapiens
aaaggctttaaagaaccagaac

SEQ ID NO: 7419462 - DNA, 22 bp, Homo sapiens
aaaggcttgtccagtaagggga

SEQ ID NO: 7419463 - DNA, 22 bp, Homo sapiens
aaaggcttgtccagtaagggga

SEQ ID NO: 7419464 - DNA, 22 bp, Homo sapiens
aaaggcttgtttgaggactggt

SEQ ID NO: 7419465 - DNA, 22 bp, Homo sapiens
aaaggcttgtttgaggactggt

SEQ ID NO: 7419466 - DNA, 22 bp, Homo sapiens
aaaggcttgtttgaggactggt

SEQ ID NO: 7419467 - DNA, 22 bp, Homo sapiens
aaaggcttgtacagcagccttc

SEQ ID NO: 7419468 - DNA, 22 bp, Homo sapiens
aaaggcttggttctttgatgac

SEQ ID NO: 7419469 - DNA, 22 bp, Homo sapiens
aaaggcttggttctttgatgac

SEQ ID NO: 7419470 - DNA, 22 bp, Homo sapiens
aaagtcacatataacaagggca

SEQ ID NO: 7419471 - DNA, 22 bp, Homo sapiens
aaagtcacatagcatcacttct

SEQ ID NO: 7419472 - DNA, 22 bp, Homo sapiens
aaagggaggggcgataagccgg

SEQ ID NO: 7419473 - DNA, 22 bp, Homo sapiens
aaagtcacatataacaagggca

SEQ ID NO: 7419474 - DNA, 22 bp, Homo sapiens
aaagggcagagttcactagaaa

SEQ ID NO: 7419475 - DNA, 22 bp, Homo sapiens
aaagggcagagttcactagaaa

SEQ ID NO: 7419476 - DNA, 22 bp, Homo sapiens
aaagggaggggcgataagccgg

SEQ ID NO: 7419477 - DNA, 22 bp, Homo sapiens
aaagggaggggcgataagccgg

SEQ ID NO: 7419478 - DNA, 22 bp, Homo sapiens
aaagggagcatggctgcaggga

SEQ ID NO: 7419479 - DNA, 22 bp, Homo sapiens
aaagggaggggcgataagccgg

SEQ ID NO: 7419480 - DNA, 22 bp, Homo sapiens
aaagggaatgtgtaggacatgt

SEQ ID NO: 7419481 - DNA, 22 bp, Homo sapiens
aaagggagcatggctgcaggga

SEQ ID NO: 7419482 - DNA, 22 bp, Homo sapiens
aaagggagcatggctgcaggga

SEQ ID NO: 7419483 - DNA, 22 bp, Homo sapiens
aaagggaatgtgtaggacatgt

SEQ ID NO: 7419484 - DNA, 22 bp, Homo sapiens
aaagggagcatggctgcaggga

SEQ ID NO: 7419485 - DNA, 22 bp, Homo sapiens
aaagggagcatggctgcaggga

SEQ ID NO: 7419486 - DNA, 22 bp, Homo sapiens
aaagggagcatggctgcaggga

SEQ ID NO: 7419487 - DNA, 22 bp, Homo sapiens
aaagggagcatggctgcaggga

SEQ ID NO: 7419488 - DNA, 22 bp, Homo sapiens
aaaggctttgagaagtcctgca

SEQ ID NO: 7419489 - DNA, 22 bp, Homo sapiens
aaaggctttgagaagtcctgca

SEQ ID NO: 7419490 - DNA, 22 bp, Homo sapiens
aaaggctttgagaagtcctgca

SEQ ID NO: 7419491 - DNA, 22 bp, Homo sapiens
aaaggcttttggtatataggag

SEQ ID NO: 7419492 - DNA, 22 bp, Homo sapiens
aaaggcttttggtatataggag

SEQ ID NO: 7419493 - DNA, 22 bp, Homo sapiens
aaaggctttaaagaaccagaac

SEQ ID NO: 7419494 - DNA, 22 bp, Homo sapiens
aaaggctttccagcgcgcggac

SEQ ID NO: 7419495 - DNA, 22 bp, Homo sapiens
aaaggctttaaagaaccagaac

SEQ ID NO: 7419496 - DNA, 22 bp, Homo sapiens
aaaggctttccagcgcgcggac

SEQ ID NO: 7419497 - DNA, 22 bp, Homo sapiens
aaagggaactctaattatcttc

SEQ ID NO: 7419498 - DNA, 22 bp, Homo sapiens
aaagggaactctaattatcttc

SEQ ID NO: 7419499 - DNA, 22 bp, Homo sapiens
aaagggaactctaattatcttc

SEQ ID NO: 7419500 - DNA, 22 bp, Homo sapiens
aaagggaactctaattatcttc

SEQ ID NO: 7419501 - DNA, 22 bp, Homo sapiens
aaagggaactctaattatcttc

SEQ ID NO: 7419502 - DNA, 22 bp, Homo sapiens
aaaggcttttggtatataggag

SEQ ID NO: 7419503 - DNA, 22 bp, Homo sapiens
aaagggaaaatatttagacata

SEQ ID NO: 7419504 - DNA, 22 bp, Homo sapiens
aaagggaaaatatttagacata

SEQ ID NO: 7419505 - DNA, 22 bp, Homo sapiens
aaagggaaaatatttagacata

SEQ ID NO: 7419506 - DNA, 22 bp, Homo sapiens
aaagggaaaatatttagacata

SEQ ID NO: 7419507 - DNA, 22 bp, Homo sapiens
aaagggaagttgcacatgttcc

SEQ ID NO: 7419508 - DNA, 22 bp, Homo sapiens
aaagggaagttgcacatgttcc

SEQ ID NO: 7419509 - DNA, 22 bp, Homo sapiens
aaagggaatgtgtaggacatgt

SEQ ID NO: 7419510 - DNA, 22 bp, Homo sapiens
aaagggaatgtgtaggacatgt

SEQ ID NO: 7419511 - DNA, 22 bp, Homo sapiens
aaagggaatgtgtaggacatgt

SEQ ID NO: 7419512 - DNA, 22 bp, Homo sapiens
aaagggaactctaattatcttc

SEQ ID NO: 7419513 - DNA, 22 bp, Homo sapiens
aaagggaactctaattatcttc

SEQ ID NO: 7419514 - DNA, 22 bp, Homo sapiens
aaagggaagttgcacatgttcc

SEQ ID NO: 7419515 - DNA, 22 bp, Homo sapiens
aaagggaagttgcacatgttcc

SEQ ID NO: 7419516 - DNA, 22 bp, Homo sapiens
aaagggaagttgcacatgttcc

SEQ ID NO: 7419517 - DNA, 22 bp, Homo sapiens
aaagggaagttgcacatgttcc

SEQ ID NO: 7419518 - DNA, 22 bp, Homo sapiens
aaagggaagttgcacatgttcc

SEQ ID NO: 7419519 - DNA, 22 bp, Homo sapiens
aaagttctttttctataaatcc

SEQ ID NO: 7419520 - DNA, 22 bp, Homo sapiens
aaagttctttttctataaatcc

SEQ ID NO: 7419521 - DNA, 22 bp, Homo sapiens
aaagttctttctcttatttggt

SEQ ID NO: 7419522 - DNA, 22 bp, Homo sapiens
aaagttctttctcttatttggt

SEQ ID NO: 7419523 - DNA, 22 bp, Homo sapiens
aaagttctttgcatctttgctc

SEQ ID NO: 7419524 - DNA, 22 bp, Homo sapiens
aaagttctttgcatctttgctc

SEQ ID NO: 7419525 - DNA, 22 bp, Homo sapiens
aaagttctttgcatctttgctc

SEQ ID NO: 7419526 - DNA, 22 bp, Homo sapiens
aaagttgactactaaggaatgt

SEQ ID NO: 7419527 - DNA, 22 bp, Homo sapiens
aaagttgactactaaggaatgt

SEQ ID NO: 7419528 - DNA, 22 bp, Homo sapiens
aaagttgaccgaaagattttga

SEQ ID NO: 7419529 - DNA, 22 bp, Homo sapiens
aaagttgaccgaaagattttga

SEQ ID NO: 7419530 - DNA, 22 bp, Homo sapiens
aaagttctttttctataaatcc

SEQ ID NO: 7419531 - DNA, 19 bp, Homo sapiens
aaagttgagaaacaatgga

SEQ ID NO: 7419532 - DNA, 19 bp, Homo sapiens
aaagttgagaaacaatgga

SEQ ID NO: 7419533 - DNA, 19 bp, Homo sapiens
aaagttgagaaacaatgga

SEQ ID NO: 7419534 - DNA, 22 bp, Homo sapiens
aaagttgagtgctgatctgatt

SEQ ID NO: 7419535 - DNA, 22 bp, Homo sapiens
aaagttgagttttatgtgttac

SEQ ID NO: 7419536 - DNA, 21 bp, Homo sapiens
aaagttgatttagattggtga

SEQ ID NO: 7419537 - DNA, 22 bp, Homo sapiens
aaagttgagttttatgtgttac

SEQ ID NO: 7419538 - DNA, 22 bp, Homo sapiens
aaagttgtaatggaagaaatgc

SEQ ID NO: 7419539 - DNA, 22 bp, Homo sapiens
aaagttgttcagtaagaaactc

SEQ ID NO: 7419540 - DNA, 22 bp, Homo sapiens
aaagttgttcagtaagaaactc

SEQ ID NO: 7419541 - DNA, 22 bp, Homo sapiens
aagaagcagctgccaggccagt

SEQ ID NO: 7419542 - DNA, 22 bp, Homo sapiens
aagaagcagctgccaggccagt

SEQ ID NO: 7419543 - DNA, 22 bp, Homo sapiens
aagaagcagctgccaggccagt

SEQ ID NO: 7419544 - DNA, 22 bp, Homo sapiens
aagaagcagctgccaggccagt

SEQ ID NO: 7419545 - DNA, 22 bp, Homo sapiens
aagaagcagagctgtgggtgtt

SEQ ID NO: 7419546 - DNA, 22 bp, Homo sapiens
aaagttggattagttgcaatag

SEQ ID NO: 7419547 - DNA, 22 bp, Homo sapiens
aaagttggctcttatgcttgtg

SEQ ID NO: 7419548 - DNA, 22 bp, Homo sapiens
aaagttgctgtcctagctggct

SEQ ID NO: 7419549 - DNA, 22 bp, Homo sapiens
aaagttgcaggtggtgagaggt

SEQ ID NO: 7419550 - DNA, 22 bp, Homo sapiens
aaagttgatttggagggatatt

SEQ ID NO: 7419551 - DNA, 22 bp, Homo sapiens
aaagttgatttggagggatatt

SEQ ID NO: 7419552 - DNA, 23 bp, Homo sapiens
aaagttgatttgcagtttaagag

SEQ ID NO: 7419553 - DNA, 23 bp, Homo sapiens
aaagttgatttgcagtttaagag

SEQ ID NO: 7419554 - DNA, 22 bp, Homo sapiens
aagaaggcttcagagcccagga

SEQ ID NO: 7419555 - DNA, 22 bp, Homo sapiens
aagaaggcggaccagaagggag

SEQ ID NO: 7419556 - DNA, 22 bp, Homo sapiens
aagaaggcggaccagaagggag

SEQ ID NO: 7419557 - DNA, 22 bp, Homo sapiens
aagaaggcggaccagaagggag

SEQ ID NO: 7419558 - DNA, 22 bp, Homo sapiens
aagaaggcggaccagaagggag

SEQ ID NO: 7419559 - DNA, 22 bp, Homo sapiens
aagaaggcggaccagaagggag

SEQ ID NO: 7419560 - DNA, 22 bp, Homo sapiens
aagaaggcctggtagacgtctt

SEQ ID NO: 7419561 - DNA, 22 bp, Homo sapiens
aagaaggcctggtagacgtctt

SEQ ID NO: 7419562 - DNA, 22 bp, Homo sapiens
aagaaggcctggtagacgtctt

SEQ ID NO: 7419563 - DNA, 22 bp, Homo sapiens
aagaaggcctggtagacgtctt

SEQ ID NO: 7419564 - DNA, 20 bp, Homo sapiens
aagaaggcctgcccagacac

SEQ ID NO: 7419565 - DNA, 22 bp, Homo sapiens
aagaaggcctctgccctggctt

SEQ ID NO: 7419566 - DNA, 22 bp, Homo sapiens
aagaaggcctctgccctggctt

SEQ ID NO: 7419567 - DNA, 20 bp, Homo sapiens
aagaaggcctgcccagacac

SEQ ID NO: 7419568 - DNA, 22 bp, Homo sapiens
aagaagctgtagggattaactc

SEQ ID NO: 7419569 - DNA, 22 bp, Homo sapiens
aagaaggaagtgtggacatcac

SEQ ID NO: 7419570 - DNA, 22 bp, Homo sapiens
aagaagctgcgtggtatgtgaa

SEQ ID NO: 7419571 - DNA, 22 bp, Homo sapiens
aagaagctgcgtggtatgtgaa

SEQ ID NO: 7419572 - DNA, 22 bp, Homo sapiens
aagaagctgtagggattaactc

SEQ ID NO: 7419573 - DNA, 22 bp, Homo sapiens
aagaagctatacataatttggg

SEQ ID NO: 7419574 - DNA, 22 bp, Homo sapiens
aagaagctatacataatttggg

SEQ ID NO: 7419575 - DNA, 22 bp, Homo sapiens
aagaagctgatgcagagggttc

SEQ ID NO: 7419576 - DNA, 22 bp, Homo sapiens
aagaagctgatgcagagggttc

SEQ ID NO: 7419577 - DNA, 22 bp, Homo sapiens
aagaagcatggctgtagattcc

SEQ ID NO: 7419578 - DNA, 22 bp, Homo sapiens
aagaagcatggctgtagattcc

SEQ ID NO: 7419579 - DNA, 22 bp, Homo sapiens
aagaagcatggctgtagattcc

SEQ ID NO: 7419580 - DNA, 22 bp, Homo sapiens
aagaagcatggctgtagattcc

SEQ ID NO: 7419581 - DNA, 22 bp, Homo sapiens
aagaagcatggctgtagattcc

SEQ ID NO: 7419582 - DNA, 22 bp, Homo sapiens
aagaagcatggctgtagattcc

SEQ ID NO: 7419583 - DNA, 22 bp, Homo sapiens
aagaagcatggctgtagattcc

SEQ ID NO: 7419584 - DNA, 20 bp, Homo sapiens
aagaagccgggaaggcaggc

SEQ ID NO: 7419585 - DNA, 20 bp, Homo sapiens
aagaagccgggaaggcaggc

SEQ ID NO: 7419586 - DNA, 22 bp, Homo sapiens
aagaagcattctttcattggtt

SEQ ID NO: 7419587 - DNA, 22 bp, Homo sapiens
aagaagcattctttcattggtt

SEQ ID NO: 7419588 - DNA, 22 bp, Homo sapiens
aagaagcattctttcattggtt

SEQ ID NO: 7419589 - DNA, 22 bp, Homo sapiens
aagaagcaggtcacagacaggg

SEQ ID NO: 7419590 - DNA, 22 bp, Homo sapiens
aagaagcagctgccaggccagt

SEQ ID NO: 7419591 - DNA, 22 bp, Homo sapiens
aagaagcaggtcacagacaggg

SEQ ID NO: 7419592 - DNA, 22 bp, Homo sapiens
aagaagcatggctgtagattcc

SEQ ID NO: 7419593 - DNA, 22 bp, Homo sapiens
aagaagcatgagaagattttat

SEQ ID NO: 7419594 - DNA, 22 bp, Homo sapiens
aagaagcatgagaagattttat

SEQ ID NO: 7419595 - DNA, 22 bp, Homo sapiens
aagaagcatgagaagattttat

SEQ ID NO: 7419596 - DNA, 22 bp, Homo sapiens
aagaagcatgagaagattttat

SEQ ID NO: 7419597 - DNA, 22 bp, Homo sapiens
aagaagcaggtcacagacaggg

SEQ ID NO: 7419598 - DNA, 22 bp, Homo sapiens
aagaagcaggtcacagacaggg

SEQ ID NO: 7419599 - DNA, 22 bp, Homo sapiens
aaatacagattctgactcagag

SEQ ID NO: 7419600 - DNA, 22 bp, Homo sapiens
aaatacagattctgactcagag

SEQ ID NO: 7419601 - DNA, 22 bp, Homo sapiens
aaatacagattcttgtgtctat

SEQ ID NO: 7419602 - DNA, 22 bp, Homo sapiens
aaatacagcagactcctgttgt

SEQ ID NO: 7419603 - DNA, 22 bp, Homo sapiens
aaatacagattcttgtgtctat

SEQ ID NO: 7419604 - DNA, 22 bp, Homo sapiens
aaatacaggagtttggacttct

SEQ ID NO: 7419605 - DNA, 19 bp, Homo sapiens
aaatacagcagctgtttcc

SEQ ID NO: 7419606 - DNA, 22 bp, Homo sapiens
aaatacaggagtttggacttct

SEQ ID NO: 7419607 - DNA, 22 bp, Homo sapiens
aaatacaggagtttggacttct

SEQ ID NO: 7419608 - DNA, 22 bp, Homo sapiens
aaatacagcagactcctgttgt

SEQ ID NO: 7419609 - DNA, 19 bp, Homo sapiens
aaatacagcagctgtttcc

SEQ ID NO: 7419610 - DNA, 22 bp, Homo sapiens
aagaagtggttggaagaagcat

SEQ ID NO: 7419611 - DNA, 22 bp, Homo sapiens
aagaagtggttggaagaagcat

SEQ ID NO: 7419612 - DNA, 22 bp, Homo sapiens
aagaagtggtccttttctttct

SEQ ID NO: 7419613 - DNA, 22 bp, Homo sapiens
aagaagtctggagcaatgcaat

SEQ ID NO: 7419614 - DNA, 22 bp, Homo sapiens
aagaaggtgtggaaagatgctc

SEQ ID NO: 7419615 - DNA, 22 bp, Homo sapiens
aagaaggtgtggaaagatgctc

SEQ ID NO: 7419616 - DNA, 22 bp, Homo sapiens
aagaaggttgaatgactacttt

SEQ ID NO: 7419617 - DNA, 22 bp, Homo sapiens
aagaaggtgtggaaagatgctc

SEQ ID NO: 7419618 - DNA, 22 bp, Homo sapiens
aagaaggcttcagagcccagga

SEQ ID NO: 7419619 - DNA, 22 bp, Homo sapiens
aaatacaaaaattagccaggca

SEQ ID NO: 7419620 - DNA, 22 bp, Homo sapiens
aaatacaaaaattagccaggca

SEQ ID NO: 7419621 - DNA, 22 bp, Homo sapiens
aaatacaaaaattagccaggca

SEQ ID NO: 7419622 - DNA, 22 bp, Homo sapiens
aagaagttaaataaatggacca

SEQ ID NO: 7419623 - DNA, 22 bp, Homo sapiens
aagaagttaaataaatggacca

SEQ ID NO: 7419624 - DNA, 22 bp, Homo sapiens
aagaagttaaataaatggacca

SEQ ID NO: 7419625 - DNA, 22 bp, Homo sapiens
aaatacaaaaattagccaggca

SEQ ID NO: 7419626 - DNA, 22 bp, Homo sapiens
aaatacaaaaattagccaggca

SEQ ID NO: 7419627 - DNA, 22 bp, Homo sapiens
aaatacaaaaattagccaggca

SEQ ID NO: 7419628 - DNA, 22 bp, Homo sapiens
aaatacaaaaattagccaggca

SEQ ID NO: 7419629 - DNA, 22 bp, Homo sapiens
aaatacagtggcagcagataat

SEQ ID NO: 7419630 - DNA, 22 bp, Homo sapiens
aaatacagtggcagcagataat

SEQ ID NO: 7419631 - DNA, 22 bp, Homo sapiens
aaatacagtggcagcagataat

SEQ ID NO: 7419632 - DNA, 22 bp, Homo sapiens
aaatacaggagtttggacttct

SEQ ID NO: 7419633 - DNA, 22 bp, Homo sapiens
aaatacagtggcagcagataat

SEQ ID NO: 7419634 - DNA, 22 bp, Homo sapiens
aaatacagtgtgtgttctttga

SEQ ID NO: 7419635 - DNA, 22 bp, Homo sapiens
aaatacagtgtgtgttctttga

SEQ ID NO: 7419636 - DNA, 22 bp, Homo sapiens
aaatacagtggcagcagataat

SEQ ID NO: 7419637 - DNA, 22 bp, Homo sapiens
aaatacataaaggttgtaccag

SEQ ID NO: 7419638 - DNA, 22 bp, Homo sapiens
aaatacataaaggttgtaccag

SEQ ID NO: 7419639 - DNA, 22 bp, Homo sapiens
aaatacataaaggttgtaccag

SEQ ID NO: 7419640 - DNA, 22 bp, Homo sapiens
aaatacataaaggttgtaccag

SEQ ID NO: 7419641 - DNA, 22 bp, Homo sapiens
aaatacataaaggttgtaccag

SEQ ID NO: 7419642 - DNA, 22 bp, Homo sapiens
aaatacataaaggttgtaccag

SEQ ID NO: 7419643 - DNA, 22 bp, Homo sapiens
aaatacataaaggttgtaccag

SEQ ID NO: 7419644 - DNA, 22 bp, Homo sapiens
aaatacagtgtgtgttctttga

SEQ ID NO: 7419645 - DNA, 22 bp, Homo sapiens
aaatacagtgtgtgttctttga

SEQ ID NO: 7419646 - DNA, 22 bp, Homo sapiens
aaatacagtgtgtgttctttga

SEQ ID NO: 7419647 - DNA, 22 bp, Homo sapiens
aagagagaactcccttcgccag

SEQ ID NO: 7419648 - DNA, 22 bp, Homo sapiens
aagagagaagtctctctggttc

SEQ ID NO: 7419649 - DNA, 22 bp, Homo sapiens
aagagagaactcccttcgccag

SEQ ID NO: 7419650 - DNA, 22 bp, Homo sapiens
aaatacattagacggagagtta

SEQ ID NO: 7419651 - DNA, 22 bp, Homo sapiens
aaatacattagacggagagtta

SEQ ID NO: 7419652 - DNA, 22 bp, Homo sapiens
aaatacattagacggagagtta

SEQ ID NO: 7419653 - DNA, 22 bp, Homo sapiens
aaatacattagacggagagtta

SEQ ID NO: 7419654 - DNA, 22 bp, Homo sapiens
aaatacattagacggagagtta

SEQ ID NO: 7419655 - DNA, 22 bp, Homo sapiens
aaatacatacactgtacgtggc

SEQ ID NO: 7419656 - DNA, 22 bp, Homo sapiens
aaatacatacactgtacgtggc

SEQ ID NO: 7419657 - DNA, 22 bp, Homo sapiens
aaatacataaaggttgtaccag

SEQ ID NO: 7419658 - DNA, 22 bp, Homo sapiens
aaatacataaaggttgtaccag

SEQ ID NO: 7419659 - DNA, 22 bp, Homo sapiens
aaatacatacactgtacgtggc

SEQ ID NO: 7419660 - DNA, 22 bp, Homo sapiens
aaatacatacactgtacgtggc

SEQ ID NO: 7419661 - DNA, 22 bp, Homo sapiens
aaatacatacactgtacgtggc

SEQ ID NO: 7419662 - DNA, 22 bp, Homo sapiens
aagagttttagacaaactgatt

SEQ ID NO: 7419663 - DNA, 22 bp, Homo sapiens
aagagttttctataatcttggc

SEQ ID NO: 7419664 - DNA, 22 bp, Homo sapiens
aagagttttctataatcttggc

SEQ ID NO: 7419665 - DNA, 22 bp, Homo sapiens
aagagttttagacaaactgatt

SEQ ID NO: 7419666 - DNA, 22 bp, Homo sapiens
aagagttttagacaaactgatt

SEQ ID NO: 7419667 - DNA, 22 bp, Homo sapiens
aagagttttagacaaactgatt

SEQ ID NO: 7419668 - DNA, 22 bp, Homo sapiens
aagagtttgtcagatctgcacg

SEQ ID NO: 7419669 - DNA, 22 bp, Homo sapiens
aagagtttgggcaagtcataaa

SEQ ID NO: 7419670 - DNA, 22 bp, Homo sapiens
aagagtttgtcagatctgcacg

SEQ ID NO: 7419671 - DNA, 22 bp, Homo sapiens
aagagtttgggcaagtcataaa

SEQ ID NO: 7419672 - DNA, 22 bp, Homo sapiens
aagagtttgggcaagtcataaa

SEQ ID NO: 7419673 - DNA, 22 bp, Homo sapiens
aagagtttctttattaaccttt

SEQ ID NO: 7419674 - DNA, 22 bp, Homo sapiens
aagagtttgacctgtgccatcc

SEQ ID NO: 7419675 - DNA, 22 bp, Homo sapiens
aagagttttctctgatggcatt

SEQ ID NO: 7419676 - DNA, 22 bp, Homo sapiens
aagagttttctataatcttggc

SEQ ID NO: 7419677 - DNA, 22 bp, Homo sapiens
aagagttttctataatcttggc

SEQ ID NO: 7419678 - DNA, 22 bp, Homo sapiens
aagataaactcttgatttctga

SEQ ID NO: 7419679 - DNA, 22 bp, Homo sapiens
aagagtttttggagtgtgagtt

SEQ ID NO: 7419680 - DNA, 22 bp, Homo sapiens
aaatattattgcttaaggggag

SEQ ID NO: 7419681 - DNA, 22 bp, Homo sapiens
aaatatgagatgttctctttcg

SEQ ID NO: 7419682 - DNA, 22 bp, Homo sapiens
aaatatgagatgttctctttcg

SEQ ID NO: 7419683 - DNA, 22 bp, Homo sapiens
aaatatgagatgttctctttcg

SEQ ID NO: 7419684 - DNA, 22 bp, Homo sapiens
aaatatgagatgttctctttcg

SEQ ID NO: 7419685 - DNA, 22 bp, Homo sapiens
aaatatgagagtaggagtttgg

SEQ ID NO: 7419686 - DNA, 22 bp, Homo sapiens
aaatatgactagaatgccaggt

SEQ ID NO: 7419687 - DNA, 22 bp, Homo sapiens
aaatatgagagtaggagtttgg

SEQ ID NO: 7419688 - DNA, 22 bp, Homo sapiens
aagagtttccatgctctgtgct

SEQ ID NO: 7419689 - DNA, 22 bp, Homo sapiens
aaatatagtgacacttatagtc

SEQ ID NO: 7419690 - DNA, 19 bp, Homo sapiens
aaatatcagagagatgata

SEQ ID NO: 7419691 - DNA, 19 bp, Homo sapiens
aaatatcagagagatgata

SEQ ID NO: 7419692 - DNA, 19 bp, Homo sapiens
aaatatcagagagatgata

SEQ ID NO: 7419693 - DNA, 19 bp, Homo sapiens
aaatatcagagagatgata

SEQ ID NO: 7419694 - DNA, 22 bp, Homo sapiens
aagagtttctgattcagtaggt

SEQ ID NO: 7419695 - DNA, 22 bp, Homo sapiens
aagagtttctgggtcaaggatt

SEQ ID NO: 7419696 - DNA, 22 bp, Homo sapiens
aagagtttctgggtcaaggatt

SEQ ID NO: 7419697 - DNA, 22 bp, Homo sapiens
aagagtttctttattaaccttt

SEQ ID NO: 7419698 - DNA, 22 bp, Homo sapiens
aagagtttctttattaaccttt

SEQ ID NO: 7419699 - DNA, 22 bp, Homo sapiens
aagagtttctttattaaccttt

SEQ ID NO: 7419700 - DNA, 22 bp, Homo sapiens
aaatatagtgacacttatagtc

SEQ ID NO: 7419701 - DNA, 22 bp, Homo sapiens
aaatatagtgacacttatagtc

SEQ ID NO: 7419702 - DNA, 19 bp, Homo sapiens
aaatatcagagagatgata

SEQ ID NO: 7419703 - DNA, 22 bp, Homo sapiens
aaatatagtgacacttatagtc

SEQ ID NO: 7419704 - DNA, 22 bp, Homo sapiens
aaatatagtgacacttatagtc

SEQ ID NO: 7419705 - DNA, 22 bp, Homo sapiens
aaatatagtgacacttatagtc

SEQ ID NO: 7419706 - DNA, 22 bp, Homo sapiens
aaatatagtaaatgcatagttc

SEQ ID NO: 7419707 - DNA, 22 bp, Homo sapiens
aaatatagtaaatgcatagttc

SEQ ID NO: 7419708 - DNA, 22 bp, Homo sapiens
aaatatagtgacacttatagtc

SEQ ID NO: 7419709 - DNA, 22 bp, Homo sapiens
aaatatagtgacacttatagtc

SEQ ID NO: 7419710 - DNA, 22 bp, Homo sapiens
aaatatagtgacacttatagtc

SEQ ID NO: 7419711 - DNA, 22 bp, Homo sapiens
aaatatagtaaatgcatagttc

SEQ ID NO: 7419712 - DNA, 22 bp, Homo sapiens
aaatatagtgacacttatagtc

SEQ ID NO: 7419713 - DNA, 22 bp, Homo sapiens
aaatatagtgacacttatagtc

SEQ ID NO: 7419714 - DNA, 22 bp, Homo sapiens
aaatatactagatgatgaccca

SEQ ID NO: 7419715 - DNA, 22 bp, Homo sapiens
aaatatactagatgatgaccca

SEQ ID NO: 7419716 - DNA, 22 bp, Homo sapiens
aaatatactagatgatgaccca

SEQ ID NO: 7419717 - DNA, 22 bp, Homo sapiens
aaatatactagatgatgaccca

SEQ ID NO: 7419718 - DNA, 22 bp, Homo sapiens
aaatatacggtccctaacagtc

SEQ ID NO: 7419719 - DNA, 22 bp, Homo sapiens
aaatatacggtccctaacagtc

SEQ ID NO: 7419720 - DNA, 22 bp, Homo sapiens
aaatatacggtccctaacagtc

SEQ ID NO: 7419721 - DNA, 22 bp, Homo sapiens
aaatatacggtccctaacagtc

SEQ ID NO: 7419722 - DNA, 22 bp, Homo sapiens
aaatatacggtccctaacagtc

SEQ ID NO: 7419723 - DNA, 22 bp, Homo sapiens
aaatatagcaattatgcctact

SEQ ID NO: 7419724 - DNA, 22 bp, Homo sapiens
aaatatagcaattatgcctact

SEQ ID NO: 7419725 - DNA, 22 bp, Homo sapiens
aaatatagcaattatgcctact

SEQ ID NO: 7419726 - DNA, 22 bp, Homo sapiens
aaatatagcaattatgcctact

SEQ ID NO: 7419727 - DNA, 22 bp, Homo sapiens
aaatatactagatgatgaccca

SEQ ID NO: 7419728 - DNA, 22 bp, Homo sapiens
aaatatagtaaatgcatagttc

SEQ ID NO: 7419729 - DNA, 22 bp, Homo sapiens
aaatatagtaaatgcatagttc

SEQ ID NO: 7419730 - DNA, 22 bp, Homo sapiens
aaatatagtaaatgcatagttc

SEQ ID NO: 7419731 - DNA, 22 bp, Homo sapiens
aaatatagtaaatgcatagttc

SEQ ID NO: 7419732 - DNA, 22 bp, Homo sapiens
aaatatagtaaatgcatagttc

SEQ ID NO: 7419733 - DNA, 22 bp, Homo sapiens
aaatatagcaattatgcctact

SEQ ID NO: 7419734 - DNA, 22 bp, Homo sapiens
aaatagtcctgggaatagtact

SEQ ID NO: 7419735 - DNA, 22 bp, Homo sapiens
aaatagtcctgggaatagtact

SEQ ID NO: 7419736 - DNA, 22 bp, Homo sapiens
aaatagtcctgggaatagtact

SEQ ID NO: 7419737 - DNA, 22 bp, Homo sapiens
aaatagtcctgggaatagtact

SEQ ID NO: 7419738 - DNA, 22 bp, Homo sapiens
aaatagtaaagtggtagccatc

SEQ ID NO: 7419739 - DNA, 22 bp, Homo sapiens
aaatagtaaagtggtagccatc

SEQ ID NO: 7419740 - DNA, 22 bp, Homo sapiens
aaataggggaccaggaaaggag

SEQ ID NO: 7419741 - DNA, 22 bp, Homo sapiens
aaatagtcctgggaatagtact

SEQ ID NO: 7419742 - DNA, 22 bp, Homo sapiens
aaatatacggtccctaacagtc

SEQ ID NO: 7419743 - DNA, 22 bp, Homo sapiens
aaatatacggtccctaacagtc

SEQ ID NO: 7419744 - DNA, 22 bp, Homo sapiens
aaatatacggtccctaacagtc

SEQ ID NO: 7419745 - DNA, 22 bp, Homo sapiens
aaatatacggtccctaacagtc

SEQ ID NO: 7419746 - DNA, 22 bp, Homo sapiens
aaatataccagttgcctgcatc

SEQ ID NO: 7419747 - DNA, 22 bp, Homo sapiens
aaatataccagttgcctgcatc

SEQ ID NO: 7419748 - DNA, 22 bp, Homo sapiens
aaatataatttctgcctcaata

SEQ ID NO: 7419749 - DNA, 22 bp, Homo sapiens
aaatataccagttgcctgcatc

SEQ ID NO: 7419750 - DNA, 22 bp, Homo sapiens
aaatataatttctgcctcaata

SEQ ID NO: 7419751 - DNA, 22 bp, Homo sapiens
aaatataccagttgcctgcatc

SEQ ID NO: 7419752 - DNA, 22 bp, Homo sapiens
aaatataccagttgcctgcatc

SEQ ID NO: 7419753 - DNA, 22 bp, Homo sapiens
aagagagacaataggtagcatt

SEQ ID NO: 7419754 - DNA, 22 bp, Homo sapiens
aagagagacaataggtagcatt

SEQ ID NO: 7419755 - DNA, 22 bp, Homo sapiens
aagagagacaataggtagcatt

SEQ ID NO: 7419756 - DNA, 22 bp, Homo sapiens
aagagagacaataggtagcatt

SEQ ID NO: 7419757 - DNA, 22 bp, Homo sapiens
aagagagaagtctctctggttc

SEQ ID NO: 7419758 - DNA, 22 bp, Homo sapiens
aagagagacaataggtagcatt

SEQ ID NO: 7419759 - DNA, 22 bp, Homo sapiens
aagagagaagtctctctggttc

SEQ ID NO: 7419760 - DNA, 22 bp, Homo sapiens
aagagagacaataggtagcatt

SEQ ID NO: 7419761 - DNA, 22 bp, Homo sapiens
aagagagacaataggtagcatt

SEQ ID NO: 7419762 - DNA, 22 bp, Homo sapiens
aagagagacaataggtagcatt

SEQ ID NO: 7419763 - DNA, 22 bp, Homo sapiens
aagagagaccatgggggacagg

SEQ ID NO: 7419764 - DNA, 22 bp, Homo sapiens
aagagagaccatgggggacagg

SEQ ID NO: 7419765 - DNA, 22 bp, Homo sapiens
aagagagagtgcgctcacagaa

SEQ ID NO: 7419766 - DNA, 22 bp, Homo sapiens
aagagagagtgcgctcacagaa

SEQ ID NO: 7419767 - DNA, 22 bp, Homo sapiens
aagagagagtgcgctcacagaa

SEQ ID NO: 7419768 - DNA, 22 bp, Homo sapiens
aagagagagtgcgctcacagaa

SEQ ID NO: 7419769 - DNA, 22 bp, Homo sapiens
aagagagaccatgggggacagg

SEQ ID NO: 7419770 - DNA, 22 bp, Homo sapiens
aagagagagcattcttctgtta

SEQ ID NO: 7419771 - DNA, 22 bp, Homo sapiens
aagagagagcattcttctgtta

SEQ ID NO: 7419772 - DNA, 22 bp, Homo sapiens
aagagagagttcctaggcaaaa

SEQ ID NO: 7419773 - DNA, 22 bp, Homo sapiens
aagagagagttcctaggcaaaa

SEQ ID NO: 7419774 - DNA, 22 bp, Homo sapiens
aaataggggaccaggaaaggag

SEQ ID NO: 7419775 - DNA, 22 bp, Homo sapiens
aaataggggaccaggaaaggag

SEQ ID NO: 7419776 - DNA, 22 bp, Homo sapiens
aagagagagttcctaggcaaaa

SEQ ID NO: 7419777 - DNA, 22 bp, Homo sapiens
aagagagagttcctaggcaaaa

SEQ ID NO: 7419778 - DNA, 22 bp, Homo sapiens
aagagagagttcctaggcaaaa

SEQ ID NO: 7419779 - DNA, 22 bp, Homo sapiens
aagagagagtgcgctcacagaa

SEQ ID NO: 7419780 - DNA, 22 bp, Homo sapiens
aaatgcaaggccatgtgaagga

SEQ ID NO: 7419781 - DNA, 22 bp, Homo sapiens
aaatgcaaggccatgtgaagga

SEQ ID NO: 7419782 - DNA, 22 bp, Homo sapiens
aaatgcaaggccatgtgaagga

SEQ ID NO: 7419783 - DNA, 22 bp, Homo sapiens
aaatgcaaggccatgtgaagga

SEQ ID NO: 7419784 - DNA, 22 bp, Homo sapiens
aaatgcaaggcacattcctttt

SEQ ID NO: 7419785 - DNA, 22 bp, Homo sapiens
aaatgcaaggcacattcctttt

SEQ ID NO: 7419786 - DNA, 22 bp, Homo sapiens
aaatgcaaggattttgttaggc

SEQ ID NO: 7419787 - DNA, 22 bp, Homo sapiens
aaatgattgtcaaagttctgtt

SEQ ID NO: 7419788 - DNA, 22 bp, Homo sapiens
aaatgattgtcaaagttctgtt

SEQ ID NO: 7419789 - DNA, 22 bp, Homo sapiens
aaatgattgtcaaagttctgtt

SEQ ID NO: 7419790 - DNA, 22 bp, Homo sapiens
aaatgattgtcaaagttctgtt

SEQ ID NO: 7419791 - DNA, 22 bp, Homo sapiens
aaatgcaacgggctttccttat

SEQ ID NO: 7419792 - DNA, 22 bp, Homo sapiens
aaatgcaacgggctttccttat

SEQ ID NO: 7419793 - DNA, 22 bp, Homo sapiens
aaatgatgtggagtgaaattgt

SEQ ID NO: 7419794 - DNA, 22 bp, Homo sapiens
aaatgatggtactcatgtttag

SEQ ID NO: 7419795 - DNA, 22 bp, Homo sapiens
aaatgatggtactcatgtttag

SEQ ID NO: 7419796 - DNA, 22 bp, Homo sapiens
aaatgatgttataagaccagga

SEQ ID NO: 7419797 - DNA, 22 bp, Homo sapiens
aaatgatgtggagtgaaattgt

SEQ ID NO: 7419798 - DNA, 23 bp, Homo sapiens
aaatgatgtgtgttgtcccattc

SEQ ID NO: 7419799 - DNA, 22 bp, Homo sapiens
aaatgatgctcacagattagtg

SEQ ID NO: 7419800 - DNA, 22 bp, Homo sapiens
aaatgatgctacagttttccca

SEQ ID NO: 7419801 - DNA, 22 bp, Homo sapiens
aaatgatggaaatgaggctgaa

SEQ ID NO: 7419802 - DNA, 20 bp, Homo sapiens
aaatgatgggaataatctat

SEQ ID NO: 7419803 - DNA, 22 bp, Homo sapiens
aaatgatggaaatgaggctgaa

SEQ ID NO: 7419804 - DNA, 20 bp, Homo sapiens
aaatgatgggaataatctat

SEQ ID NO: 7419805 - DNA, 20 bp, Homo sapiens
aaatgatgggaataatctat

SEQ ID NO: 7419806 - DNA, 20 bp, Homo sapiens
aaatgatgggaataatctat

SEQ ID NO: 7419807 - DNA, 22 bp, Homo sapiens
aaatgatggtactcatgtttag

SEQ ID NO: 7419808 - DNA, 22 bp, Homo sapiens
aaatgatggtactcatgtttag

SEQ ID NO: 7419809 - DNA, 22 bp, Homo sapiens
aaatgcacaataaagtaaaggc

SEQ ID NO: 7419810 - DNA, 22 bp, Homo sapiens
aaatgcacaataaagtaaaggc

SEQ ID NO: 7419811 - DNA, 22 bp, Homo sapiens
aaatgcacaaagtaagtgtaat

SEQ ID NO: 7419812 - DNA, 22 bp, Homo sapiens
aaatgcacaaagattttgcact

SEQ ID NO: 7419813 - DNA, 22 bp, Homo sapiens
aaatgcacaaagattttgcact

SEQ ID NO: 7419814 - DNA, 22 bp, Homo sapiens
aaatgcacaaagattttgcact

SEQ ID NO: 7419815 - DNA, 22 bp, Homo sapiens
aaatgcacaaagtaagtgtaat

SEQ ID NO: 7419816 - DNA, 22 bp, Homo sapiens
aaatgcacaaagtaagtgtaat

SEQ ID NO: 7419817 - DNA, 22 bp, Homo sapiens
aaatgcacaaagtaagtgtaat

SEQ ID NO: 7419818 - DNA, 22 bp, Homo sapiens
aaatgcacaaagattttgcact

SEQ ID NO: 7419819 - DNA, 22 bp, Homo sapiens
aaatgcacaaagattttgcact

SEQ ID NO: 7419820 - DNA, 22 bp, Homo sapiens
aaatgcaattgtatgtactcca

SEQ ID NO: 7419821 - DNA, 22 bp, Homo sapiens
aaatgcaattgtatgtactcca

SEQ ID NO: 7419822 - DNA, 22 bp, Homo sapiens
aaatgcaattgtatgtactcca

SEQ ID NO: 7419823 - DNA, 22 bp, Homo sapiens
aaatgcaattgtatgtactcca

SEQ ID NO: 7419824 - DNA, 22 bp, Homo sapiens
aaatgcaattcaggaagacaag

SEQ ID NO: 7419825 - DNA, 22 bp, Homo sapiens
aaatgcaattcaggaagacaag

SEQ ID NO: 7419826 - DNA, 22 bp, Homo sapiens
aaatgcaattcaggaagacaag

SEQ ID NO: 7419827 - DNA, 22 bp, Homo sapiens
aaatgcaattcaggaagacaag

SEQ ID NO: 7419828 - DNA, 22 bp, Homo sapiens
aaatgcaattcaggaagacaag

SEQ ID NO: 7419829 - DNA, 22 bp, Homo sapiens
aaatgcaattcaggaagacaag

SEQ ID NO: 7419830 - DNA, 22 bp, Homo sapiens
aaatgcaagttcatattttgtt

SEQ ID NO: 7419831 - DNA, 22 bp, Homo sapiens
aaatgcacaataaagtaaaggc

SEQ ID NO: 7419832 - DNA, 22 bp, Homo sapiens
aaatgcacaataaagtaaaggc

SEQ ID NO: 7419833 - DNA, 22 bp, Homo sapiens
aaatgcacaataaagtaaaggc

SEQ ID NO: 7419834 - DNA, 22 bp, Homo sapiens
aaatgcacaataaagtaaaggc

SEQ ID NO: 7419835 - DNA, 22 bp, Homo sapiens
aaatgcacaataaagtaaaggc

SEQ ID NO: 7419836 - DNA, 22 bp, Homo sapiens
aaatgcacacaccaggaaacta

SEQ ID NO: 7419837 - DNA, 22 bp, Homo sapiens
aaatgcacacaccaggaaacta

SEQ ID NO: 7419838 - DNA, 22 bp, Homo sapiens
aaatgcacagaggccagagagg

SEQ ID NO: 7419839 - DNA, 22 bp, Homo sapiens
aaatgcacagagccttagagat

SEQ ID NO: 7419840 - DNA, 22 bp, Homo sapiens
aaatgcacagagccttagagat

SEQ ID NO: 7419841 - DNA, 22 bp, Homo sapiens
aaatgcacagagccttagagat

SEQ ID NO: 7419842 - DNA, 22 bp, Homo sapiens
aaatgcacagaaaggatgtgga

SEQ ID NO: 7419843 - DNA, 22 bp, Homo sapiens
aaatgcacagaaaggatgtgga

SEQ ID NO: 7419844 - DNA, 22 bp, Homo sapiens
aaatgccaggattattagaggc

SEQ ID NO: 7419845 - DNA, 22 bp, Homo sapiens
aaatgccaaggagagactgtta

SEQ ID NO: 7419846 - DNA, 22 bp, Homo sapiens
aaatgccaaggagagactgtta

SEQ ID NO: 7419847 - DNA, 22 bp, Homo sapiens
aaatgcatttttaattagaccc

SEQ ID NO: 7419848 - DNA, 22 bp, Homo sapiens
aaatgccaaggagagactgtta

SEQ ID NO: 7419849 - DNA, 22 bp, Homo sapiens
aaatgccaaggagagactgtta

SEQ ID NO: 7419850 - DNA, 22 bp, Homo sapiens
aaatgcacaggagaaccaattc

SEQ ID NO: 7419851 - DNA, 22 bp, Homo sapiens
aaatgcacaggagaaccaattc

SEQ ID NO: 7419852 - DNA, 22 bp, Homo sapiens
aaatgcacaggttttaaatcct

SEQ ID NO: 7419853 - DNA, 22 bp, Homo sapiens
aaatgcatttttaattagaccc

SEQ ID NO: 7419854 - DNA, 22 bp, Homo sapiens
aaatgcacagaggccagagagg

SEQ ID NO: 7419855 - DNA, 22 bp, Homo sapiens
aaatgcacagaggccagagagg

SEQ ID NO: 7419856 - DNA, 22 bp, Homo sapiens
aaatgcacagaggccagagagg

SEQ ID NO: 7419857 - DNA, 22 bp, Homo sapiens
aaatgcacaggagaaccaattc

SEQ ID NO: 7419858 - DNA, 22 bp, Homo sapiens
aaatgcacaggagaaccaattc

SEQ ID NO: 7419859 - DNA, 22 bp, Homo sapiens
aaatgcttagaggtgttcaaat

SEQ ID NO: 7419860 - DNA, 22 bp, Homo sapiens
aaatgcttagaggtgttcaaat

SEQ ID NO: 7419861 - DNA, 22 bp, Homo sapiens
aaatgctgttcttttaggtaga

SEQ ID NO: 7419862 - DNA, 22 bp, Homo sapiens
aaatgctgtgttttaacataga

SEQ ID NO: 7419863 - DNA, 22 bp, Homo sapiens
aaatgctgtgttttaacataga

SEQ ID NO: 7419864 - DNA, 22 bp, Homo sapiens
aaatgctgtgttttaacataga

SEQ ID NO: 7419865 - DNA, 22 bp, Homo sapiens
aaatgctgtgttttaacataga

SEQ ID NO: 7419866 - DNA, 19 bp, Homo sapiens
aaatgctgtggagggctcc

SEQ ID NO: 7419867 - DNA, 22 bp, Homo sapiens
aaatgctgtcagtgttattgga

SEQ ID NO: 7419868 - DNA, 22 bp, Homo sapiens
aaatgcttattagtgtcacaaa

SEQ ID NO: 7419869 - DNA, 22 bp, Homo sapiens
aaatgcttattagtgtcacaaa

SEQ ID NO: 7419870 - DNA, 22 bp, Homo sapiens
aaatgcttattagtgtcacaaa

SEQ ID NO: 7419871 - DNA, 22 bp, Homo sapiens
aaatgcttattagtgtcacaaa

SEQ ID NO: 7419872 - DNA, 22 bp, Homo sapiens
aaatgcttcacctcattaaact

SEQ ID NO: 7419873 - DNA, 22 bp, Homo sapiens
aaatgcttcacctcattaaact

SEQ ID NO: 7419874 - DNA, 22 bp, Homo sapiens
aaatgctgtcagtgttattgga

SEQ ID NO: 7419875 - DNA, 22 bp, Homo sapiens
aaatgctgtagatcagtgagtt

SEQ ID NO: 7419876 - DNA, 22 bp, Homo sapiens
aaatgctgtagatcagtgagtt

SEQ ID NO: 7419877 - DNA, 22 bp, Homo sapiens
aaatgctgtagatcagtgagtt

SEQ ID NO: 7419878 - DNA, 20 bp, Homo sapiens
aaatgctgtaatgtttggga

SEQ ID NO: 7419879 - DNA, 20 bp, Homo sapiens
aaatgctgtaatgtttggga

SEQ ID NO: 7419880 - DNA, 20 bp, Homo sapiens
aaatgctgtaatgtttggga

SEQ ID NO: 7419881 - DNA, 22 bp, Homo sapiens
aaatgctgtaactgatattctg

SEQ ID NO: 7419882 - DNA, 22 bp, Homo sapiens
aaatgctgggaaccattggatc

SEQ ID NO: 7419883 - DNA, 22 bp, Homo sapiens
aaatgctgtaactgatattctg

SEQ ID NO: 7419884 - DNA, 22 bp, Homo sapiens
aaatgctgcagctagtgtgttt

SEQ ID NO: 7419885 - DNA, 22 bp, Homo sapiens
aaatgctgcagctagtgtgttt

SEQ ID NO: 7419886 - DNA, 22 bp, Homo sapiens
aaatgctgcagctagtgtgttt

SEQ ID NO: 7419887 - DNA, 18 bp, Homo sapiens
aaatgctgctcaaattcc

SEQ ID NO: 7419888 - DNA, 22 bp, Homo sapiens
aaatgctgagtgtttagagatc

SEQ ID NO: 7419889 - DNA, 22 bp, Homo sapiens
aaatgctgagtgtttagagatc

SEQ ID NO: 7419890 - DNA, 23 bp, Homo sapiens
aaatgccagggagacaggaacca

SEQ ID NO: 7419891 - DNA, 22 bp, Homo sapiens
aaatgccaggattattagaggc

SEQ ID NO: 7419892 - DNA, 22 bp, Homo sapiens
aaatgccaggattattagaggc

SEQ ID NO: 7419893 - DNA, 22 bp, Homo sapiens
aaatgcttgctcttgattattt

SEQ ID NO: 7419894 - DNA, 22 bp, Homo sapiens
aaatgcttgctcttgattattt

SEQ ID NO: 7419895 - DNA, 22 bp, Homo sapiens
aaatgcttgcaacatcccaggt

SEQ ID NO: 7419896 - DNA, 22 bp, Homo sapiens
aaatgcttgctcttgattattt

SEQ ID NO: 7419897 - DNA, 22 bp, Homo sapiens
aaatgcttgcaacatcccaggt

SEQ ID NO: 7419898 - DNA, 22 bp, Homo sapiens
aaatgcttgctcttgattattt

SEQ ID NO: 7419899 - DNA, 22 bp, Homo sapiens
aaatgcttgctcttgattattt

SEQ ID NO: 7419900 - DNA, 22 bp, Homo sapiens
aaatgcttcacctcattaaact

SEQ ID NO: 7419901 - DNA, 22 bp, Homo sapiens
aaatgcttcacctcattaaact

SEQ ID NO: 7419902 - DNA, 22 bp, Homo sapiens
aaatgcttcacctcattaaact

SEQ ID NO: 7419903 - DNA, 22 bp, Homo sapiens
aaatgcttgcaacatcccaggt

SEQ ID NO: 7419904 - DNA, 22 bp, Homo sapiens
aaatgcttcacctcattaaact

SEQ ID NO: 7419905 - DNA, 21 bp, Homo sapiens
aaatgctttgtatatatctgt

SEQ ID NO: 7419906 - DNA, 21 bp, Homo sapiens
aaatgctttgtatatatctgt

SEQ ID NO: 7419907 - DNA, 22 bp, Homo sapiens
aaatgctttggtgctggtacag

SEQ ID NO: 7419908 - DNA, 22 bp, Homo sapiens
aaatgctttggtgctggtacag

SEQ ID NO: 7419909 - DNA, 22 bp, Homo sapiens
aaatgcttgtatatttcttggt

SEQ ID NO: 7419910 - DNA, 22 bp, Homo sapiens
aaatgctttggtgctggtacag

SEQ ID NO: 7419911 - DNA, 22 bp, Homo sapiens
aaatgctttggtgctggtacag

SEQ ID NO: 7419912 - DNA, 22 bp, Homo sapiens
aaatgcttgtaaattttccatg

SEQ ID NO: 7419913 - DNA, 22 bp, Homo sapiens
aaatgcttgtaaattttccatg

SEQ ID NO: 7419914 - DNA, 22 bp, Homo sapiens
aaatgcttgtaaattttccatg

SEQ ID NO: 7419915 - DNA, 22 bp, Homo sapiens
aaatgcttgtatatttcttggt

SEQ ID NO: 7419916 - DNA, 20 bp, Homo sapiens
aaatgcttttgacacatatt

SEQ ID NO: 7419917 - DNA, 20 bp, Homo sapiens
aaatgcttttgacacatatt

SEQ ID NO: 7419918 - DNA, 21 bp, Homo sapiens
aaatgctttgtatatatctgt

SEQ ID NO: 7419919 - DNA, 21 bp, Homo sapiens
aaatgctttgtatatatctgt

SEQ ID NO: 7419920 - DNA, 21 bp, Homo sapiens
aaatgctttgtatatatctgt

SEQ ID NO: 7419921 - DNA, 20 bp, Homo sapiens
aaatgcttttgacacatatt

SEQ ID NO: 7419922 - DNA, 20 bp, Homo sapiens
aaatgcttttgacacatatt

SEQ ID NO: 7419923 - DNA, 20 bp, Homo sapiens
aaatgcttttgacacatatt

SEQ ID NO: 7419924 - DNA, 20 bp, Homo sapiens
aaatgcttttgacacatatt

SEQ ID NO: 7419925 - DNA, 22 bp, Homo sapiens
aaatggaactgttgtgcatttg

SEQ ID NO: 7419926 - DNA, 22 bp, Homo sapiens
aaatggaaaatgctgttttggt

SEQ ID NO: 7419927 - DNA, 22 bp, Homo sapiens
aaatggaaaatgctgttttggt

SEQ ID NO: 7419928 - DNA, 22 bp, Homo sapiens
aaatggaactgggctactaggt

SEQ ID NO: 7419929 - DNA, 22 bp, Homo sapiens
aaatgaggccagatcatgcaga

SEQ ID NO: 7419930 - DNA, 22 bp, Homo sapiens
aaatgaggccagatcatgcaga

SEQ ID NO: 7419931 - DNA, 22 bp, Homo sapiens
aaatgaggccagatcatgcaga

SEQ ID NO: 7419932 - DNA, 22 bp, Homo sapiens
aaatgaggccagatcatgcaga

SEQ ID NO: 7419933 - DNA, 22 bp, Homo sapiens
aaatgactaatgatcctgggca

SEQ ID NO: 7419934 - DNA, 23 bp, Homo sapiens
aaatgactaaatgttcttataga

SEQ ID NO: 7419935 - DNA, 22 bp, Homo sapiens
aaatgacattaggatcctgcat

SEQ ID NO: 7419936 - DNA, 22 bp, Homo sapiens
aaatgacattaggatcctgcat

SEQ ID NO: 7419937 - DNA, 23 bp, Homo sapiens
aaatgacatatggtttctgaagg

SEQ ID NO: 7419938 - DNA, 22 bp, Homo sapiens
aaatgaccagaatacaggcttc

SEQ ID NO: 7419939 - DNA, 22 bp, Homo sapiens
aaatgaccagaatacaggcttc

SEQ ID NO: 7419940 - DNA, 23 bp, Homo sapiens
aaatgactaaatgttcttataga

SEQ ID NO: 7419941 - DNA, 23 bp, Homo sapiens
aaatgacatatggtttctgaagg

SEQ ID NO: 7419942 - DNA, 23 bp, Homo sapiens
aaatgacatatggtttctgaagg

SEQ ID NO: 7419943 - DNA, 23 bp, Homo sapiens
aaatgacatatggtttctgaagg

SEQ ID NO: 7419944 - DNA, 23 bp, Homo sapiens
aaatgacatatggtttctgaagg

SEQ ID NO: 7419945 - DNA, 22 bp, Homo sapiens
aaatgagtagcgatgcacatta

SEQ ID NO: 7419946 - DNA, 22 bp, Homo sapiens
aaatgagtagcgatgcacatta

SEQ ID NO: 7419947 - DNA, 22 bp, Homo sapiens
aaatgagtttcctcaatgtcct

SEQ ID NO: 7419948 - DNA, 22 bp, Homo sapiens
aaatgagtttcctcaatgtcct

SEQ ID NO: 7419949 - DNA, 22 bp, Homo sapiens
aaatgagtttgcctctagatag

SEQ ID NO: 7419950 - DNA, 22 bp, Homo sapiens
aaatgagtttgcctctagatag

SEQ ID NO: 7419951 - DNA, 22 bp, Homo sapiens
aaatgagtttgcctctagatag

SEQ ID NO: 7419952 - DNA, 22 bp, Homo sapiens
aaatgatagtatggaactagga

SEQ ID NO: 7419953 - DNA, 22 bp, Homo sapiens
aaatgagtttgcctctagatag

SEQ ID NO: 7419954 - DNA, 22 bp, Homo sapiens
aaatgatagtatggaactagga

SEQ ID NO: 7419955 - DNA, 22 bp, Homo sapiens
aaatgatcatgtaatttcagaa

SEQ ID NO: 7419956 - DNA, 22 bp, Homo sapiens
aaatgatgattaaaatgaggta

SEQ ID NO: 7419957 - DNA, 22 bp, Homo sapiens
aaatgatagtatggaactagga

SEQ ID NO: 7419958 - DNA, 22 bp, Homo sapiens
aaatgatcatgtaatttcagaa

SEQ ID NO: 7419959 - DNA, 22 bp, Homo sapiens
aaatgatagtatggaactagga

SEQ ID NO: 7419960 - DNA, 22 bp, Homo sapiens
aaatgatagtatggaactagga

SEQ ID NO: 7419961 - DNA, 22 bp, Homo sapiens
aaatgatagtatggaactagga

SEQ ID NO: 7419962 - DNA, 22 bp, Homo sapiens
aaatcagacacagtgaaagtta

SEQ ID NO: 7419963 - DNA, 22 bp, Homo sapiens
aaatcagacttgaattttcatc

SEQ ID NO: 7419964 - DNA, 22 bp, Homo sapiens
aaatcagacttgaattttcatc

SEQ ID NO: 7419965 - DNA, 22 bp, Homo sapiens
aaatcagacacagtgaaagtta

SEQ ID NO: 7419966 - DNA, 22 bp, Homo sapiens
aaatcagacacagtgaaagtta

SEQ ID NO: 7419967 - DNA, 22 bp, Homo sapiens
aaatcagacacagtgaaagtta

SEQ ID NO: 7419968 - DNA, 22 bp, Homo sapiens
aaatcagacacagtgaaagtta

SEQ ID NO: 7419969 - DNA, 22 bp, Homo sapiens
aaatcagacacagtgaaagtta

SEQ ID NO: 7419970 - DNA, 19 bp, Homo sapiens
aaatcagaatctgcatttt

SEQ ID NO: 7419971 - DNA, 19 bp, Homo sapiens
aaatcagaatctgcatttt

SEQ ID NO: 7419972 - DNA, 19 bp, Homo sapiens
aaatcagaatctgcatttt

SEQ ID NO: 7419973 - DNA, 22 bp, Homo sapiens
aaatcagaggcaacaactactt

SEQ ID NO: 7419974 - DNA, 22 bp, Homo sapiens
aaatcagaggcaacaactactt

SEQ ID NO: 7419975 - DNA, 22 bp, Homo sapiens
aaatcagaggcaacaactactt

SEQ ID NO: 7419976 - DNA, 22 bp, Homo sapiens
aaatcagaggtcagctgtacca

SEQ ID NO: 7419977 - DNA, 22 bp, Homo sapiens
aaatcagagtagaattgagcca

SEQ ID NO: 7419978 - DNA, 22 bp, Homo sapiens
aaatcagagtagaattgagcca

SEQ ID NO: 7419979 - DNA, 22 bp, Homo sapiens
aaatcagacttgaattttcatc

SEQ ID NO: 7419980 - DNA, 22 bp, Homo sapiens
aaatcagacttgaattttcatc

SEQ ID NO: 7419981 - DNA, 22 bp, Homo sapiens
aaatcagagtctgattttaagg

SEQ ID NO: 7419982 - DNA, 22 bp, Homo sapiens
aaatcagagtctgattttaagg

SEQ ID NO: 7419983 - DNA, 22 bp, Homo sapiens
aaatcagaggtcagctgtacca

SEQ ID NO: 7419984 - DNA, 22 bp, Homo sapiens
aaatcagagtagaattgagcca

SEQ ID NO: 7419985 - DNA, 22 bp, Homo sapiens
aaatcagagtagaattgagcca

SEQ ID NO: 7419986 - DNA, 22 bp, Homo sapiens
aaatcagagtagaattgagcca

SEQ ID NO: 7419987 - DNA, 22 bp, Homo sapiens
aaatcagagtctgattttaagg

SEQ ID NO: 7419988 - DNA, 22 bp, Homo sapiens
aaatcagagtctgattttaagg

SEQ ID NO: 7419989 - DNA, 22 bp, Homo sapiens
aaatcagagtctgattttaagg

SEQ ID NO: 7419990 - DNA, 22 bp, Homo sapiens
aaatcagagtctgattttaagg

SEQ ID NO: 7419991 - DNA, 22 bp, Homo sapiens
aaatcagagtctgattttaagg

SEQ ID NO: 7419992 - DNA, 22 bp, Homo sapiens
aaatgaaatgagtgcctggagg

SEQ ID NO: 7419993 - DNA, 22 bp, Homo sapiens
aaatgaaatgagtgcctggagg

SEQ ID NO: 7419994 - DNA, 22 bp, Homo sapiens
aaatgaaatgagtgcctggagg

SEQ ID NO: 7419995 - DNA, 22 bp, Homo sapiens
aaatgaaatgagtgcctggagg

SEQ ID NO: 7419996 - DNA, 22 bp, Homo sapiens
aaatgaacagttgcattctctg

SEQ ID NO: 7419997 - DNA, 22 bp, Homo sapiens
aaatgaacagttgcattctctg

SEQ ID NO: 7419998 - DNA, 22 bp, Homo sapiens
aaatgaacatcaagaatagcct

SEQ ID NO: 7419999 - DNA, 22 bp, Homo sapiens
aaatgaacatcaagaatagcct

SEQ ID NO: 7420000 - DNA, 22 bp, Homo sapiens
aaatgaacagttgcattctctg

SEQ ID NO: 7420001 - DNA, 23 bp, Homo sapiens
aaatgacatatggtttctgaagg

SEQ ID NO: 7420002 - DNA, 23 bp, Homo sapiens
aaatgacatatggtttctgaagg

SEQ ID NO: 7420003 - DNA, 22 bp, Homo sapiens
aaatcagaaaatatggagagga

SEQ ID NO: 7420004 - DNA, 22 bp, Homo sapiens
aaatcagaaaatatggagagga

SEQ ID NO: 7420005 - DNA, 22 bp, Homo sapiens
aaatcactgttattgatcttaa

SEQ ID NO: 7420006 - DNA, 22 bp, Homo sapiens
aaatcactgttattgatcttaa

SEQ ID NO: 7420007 - DNA, 22 bp, Homo sapiens
aaatcactgttattgatcttaa

SEQ ID NO: 7420008 - DNA, 22 bp, Homo sapiens
aaatcagaaaatatggagagga

SEQ ID NO: 7420009 - DNA, 22 bp, Homo sapiens
aaatcacttaaatggcttattt

SEQ ID NO: 7420010 - DNA, 22 bp, Homo sapiens
aaatcactgttattgatcttaa

SEQ ID NO: 7420011 - DNA, 22 bp, Homo sapiens
aaatcactgttattgatcttaa

SEQ ID NO: 7420012 - DNA, 21 bp, Homo sapiens
aaatcactgtccaatcttggt

SEQ ID NO: 7420013 - DNA, 21 bp, Homo sapiens
aaatcactgtccaatcttggt

SEQ ID NO: 7420014 - DNA, 21 bp, Homo sapiens
aaatcactgtccaatcttggt

SEQ ID NO: 7420015 - DNA, 22 bp, Homo sapiens
aaatcactgattaaagttagaa

SEQ ID NO: 7420016 - DNA, 22 bp, Homo sapiens
aaatcactaagttatagtgtgg

SEQ ID NO: 7420017 - DNA, 22 bp, Homo sapiens
aaatcactgattaaagttagaa

SEQ ID NO: 7420018 - DNA, 22 bp, Homo sapiens
aaatcactgattaaagttagaa

SEQ ID NO: 7420019 - DNA, 17 bp, Homo sapiens
aaatcactgtcagttca

SEQ ID NO: 7420020 - DNA, 22 bp, Homo sapiens
aaatcactgattaaagttagaa

SEQ ID NO: 7420021 - DNA, 22 bp, Homo sapiens
aaatcacagggtctctaagtat

SEQ ID NO: 7420022 - DNA, 22 bp, Homo sapiens
aaatcacagggtctctaagtat

SEQ ID NO: 7420023 - DNA, 22 bp, Homo sapiens
aaatcacagggtctctaagtat

SEQ ID NO: 7420024 - DNA, 22 bp, Homo sapiens
aaatcactaagttatagtgtgg

SEQ ID NO: 7420025 - DNA, 22 bp, Homo sapiens
aaatcacagggtctctaagtat

SEQ ID NO: 7420026 - DNA, 22 bp, Homo sapiens
aaatcactaagttatagtgtgg

SEQ ID NO: 7420027 - DNA, 22 bp, Homo sapiens
aaatcactaagttatagtgtgg

SEQ ID NO: 7420028 - DNA, 22 bp, Homo sapiens
aaatcactaagttatagtgtgg

SEQ ID NO: 7420029 - DNA, 22 bp, Homo sapiens
aaatcaaggagggattatattt

SEQ ID NO: 7420030 - DNA, 22 bp, Homo sapiens
aaatcaaggagggattatattt

SEQ ID NO: 7420031 - DNA, 22 bp, Homo sapiens
aaatcaaggagggattatattt

SEQ ID NO: 7420032 - DNA, 22 bp, Homo sapiens
aaatcaaggagggattatattt

SEQ ID NO: 7420033 - DNA, 22 bp, Homo sapiens
aaatcaaggagggattatattt

SEQ ID NO: 7420034 - DNA, 22 bp, Homo sapiens
aaatcacagggtctctaagtat

SEQ ID NO: 7420035 - DNA, 22 bp, Homo sapiens
aaatcacagggtctctaagtat

SEQ ID NO: 7420036 - DNA, 22 bp, Homo sapiens
aaatcacagggtctctaagtat

SEQ ID NO: 7420037 - DNA, 22 bp, Homo sapiens
aaatcacagggtctctaagtat

SEQ ID NO: 7420038 - DNA, 22 bp, Homo sapiens
aaatcacagggtctctaagtat

SEQ ID NO: 7420039 - DNA, 22 bp, Homo sapiens
aaatcacagggtctctaagtat

SEQ ID NO: 7420040 - DNA, 22 bp, Homo sapiens
aaatcaaggagggattatattt

SEQ ID NO: 7420041 - DNA, 22 bp, Homo sapiens
aaatcaaggagggattatattt

SEQ ID NO: 7420042 - DNA, 22 bp, Homo sapiens
aaatcaaggagggattatattt

SEQ ID NO: 7420043 - DNA, 22 bp, Homo sapiens
aaatattggtaggatgcttgtt

SEQ ID NO: 7420044 - DNA, 22 bp, Homo sapiens
aaatattggtaggatgcttgtt

SEQ ID NO: 7420045 - DNA, 22 bp, Homo sapiens
aaatattggtaggatgcttgtt

SEQ ID NO: 7420046 - DNA, 22 bp, Homo sapiens
aaatattggtaggatgcttgtt

SEQ ID NO: 7420047 - DNA, 22 bp, Homo sapiens
aaatattggtaggatgcttgtt

SEQ ID NO: 7420048 - DNA, 22 bp, Homo sapiens
aaatattgttttggtaagcttc

SEQ ID NO: 7420049 - DNA, 22 bp, Homo sapiens
aaatattgttttggtaagcttc

SEQ ID NO: 7420050 - DNA, 22 bp, Homo sapiens
aaatattggtaggatgcttgtt

SEQ ID NO: 7420051 - DNA, 22 bp, Homo sapiens
aaatattggtaggatgcttgtt

SEQ ID NO: 7420052 - DNA, 22 bp, Homo sapiens
aaatattgttttggtaagcttc

SEQ ID NO: 7420053 - DNA, 23 bp, Homo sapiens
aaatattcttttttagtaagtgc

SEQ ID NO: 7420054 - DNA, 23 bp, Homo sapiens
aaatattcttttttagtaagtgc

SEQ ID NO: 7420055 - DNA, 23 bp, Homo sapiens
aaatattcttttttagtaagtgc

SEQ ID NO: 7420056 - DNA, 23 bp, Homo sapiens
aaatattcttttttagtaagtgc

SEQ ID NO: 7420057 - DNA, 23 bp, Homo sapiens
aaatattcttttttagtaagtgc

SEQ ID NO: 7420058 - DNA, 23 bp, Homo sapiens
aaatattcttttttagtaagtgc

SEQ ID NO: 7420059 - DNA, 23 bp, Homo sapiens
aaatattcttttttagtaagtgc

SEQ ID NO: 7420060 - DNA, 23 bp, Homo sapiens
aaatattcttttttagtaagtgc

SEQ ID NO: 7420061 - DNA, 23 bp, Homo sapiens
aaatattcttttttagtaagtgc

SEQ ID NO: 7420062 - DNA, 23 bp, Homo sapiens
aaatattcttttttagtaagtgc

SEQ ID NO: 7420063 - DNA, 23 bp, Homo sapiens
aaatattcttttttagtaagtgc

SEQ ID NO: 7420064 - DNA, 23 bp, Homo sapiens
aaatattcttttttagtaagtgc

SEQ ID NO: 7420065 - DNA, 22 bp, Homo sapiens
aaatcaaaagacatgtgtttta

SEQ ID NO: 7420066 - DNA, 22 bp, Homo sapiens
aaatcaaaagacatgtgtttta

SEQ ID NO: 7420067 - DNA, 22 bp, Homo sapiens
aaatcaaaagacatgtgtttta

SEQ ID NO: 7420068 - DNA, 22 bp, Homo sapiens
aaatatttgtctgaggcggttg

SEQ ID NO: 7420069 - DNA, 22 bp, Homo sapiens
aaatatttgtctgaggcggttg

SEQ ID NO: 7420070 - DNA, 22 bp, Homo sapiens
aaatatttgtctgaggcggttg

SEQ ID NO: 7420071 - DNA, 22 bp, Homo sapiens
aaatatttgtctgaggcggttg

SEQ ID NO: 7420072 - DNA, 22 bp, Homo sapiens
aaatatttgtctgaggcggttg

SEQ ID NO: 7420073 - DNA, 22 bp, Homo sapiens
aaatattgttttggtaagcttc

SEQ ID NO: 7420074 - DNA, 22 bp, Homo sapiens
aaatatttgtctgaggcggttg

SEQ ID NO: 7420075 - DNA, 22 bp, Homo sapiens
aaatatttgtctgaggcggttg

SEQ ID NO: 7420076 - DNA, 22 bp, Homo sapiens
aaatatttgtctgaggcggttg

SEQ ID NO: 7420077 - DNA, 22 bp, Homo sapiens
aaatatttgtctgaggcggttg

SEQ ID NO: 7420078 - DNA, 22 bp, Homo sapiens
aaatcaaaagacatgtgtttta

SEQ ID NO: 7420079 - DNA, 22 bp, Homo sapiens
aaatcaaaagacatgtgtttta

SEQ ID NO: 7420080 - DNA, 22 bp, Homo sapiens
aaatcaaaagacatgtgtttta

SEQ ID NO: 7420081 - DNA, 22 bp, Homo sapiens
aaatcaaaagacatgtgtttta

SEQ ID NO: 7420082 - DNA, 22 bp, Homo sapiens
aaatcaaaagacatgtgtttta

SEQ ID NO: 7420083 - DNA, 22 bp, Homo sapiens
aaatcaacttgtgacgttaggt

SEQ ID NO: 7420084 - DNA, 22 bp, Homo sapiens
aaatcaaaagacatgtgtttta

SEQ ID NO: 7420085 - DNA, 22 bp, Homo sapiens
aaatcaaaagacatgtgtttta

SEQ ID NO: 7420086 - DNA, 22 bp, Homo sapiens
aaatcaaaagacatgtgtttta

SEQ ID NO: 7420087 - DNA, 22 bp, Homo sapiens
aaatcaaaagacatgtgtttta

SEQ ID NO: 7420088 - DNA, 22 bp, Homo sapiens
agatgcctaaatctgggcaagg

SEQ ID NO: 7420089 - DNA, 22 bp, Homo sapiens
agatgcctgccagttatttagc

SEQ ID NO: 7420090 - DNA, 22 bp, Homo sapiens
agatgccaggttgggaagtgat

SEQ ID NO: 7420091 - DNA, 22 bp, Homo sapiens
agatgccagcttacactgggaa

SEQ ID NO: 7420092 - DNA, 22 bp, Homo sapiens
agatgccttttatttattgtca

SEQ ID NO: 7420093 - DNA, 22 bp, Homo sapiens
agatgcctgccagttatttagc

SEQ ID NO: 7420094 - DNA, 22 bp, Homo sapiens
agatgctatacattgtaagaca

SEQ ID NO: 7420095 - DNA, 22 bp, Homo sapiens
agatgctatacattgtaagaca

SEQ ID NO: 7420096 - DNA, 21 bp, Homo sapiens
agatgcagtttgcaggtgggt

SEQ ID NO: 7420097 - DNA, 22 bp, Homo sapiens
agatgcatgcttaattagcaca

SEQ ID NO: 7420098 - DNA, 22 bp, Homo sapiens
agatgcatggaaatctcattac

SEQ ID NO: 7420099 - DNA, 21 bp, Homo sapiens
agatgcagtttgcaggtgggt

SEQ ID NO: 7420100 - DNA, 21 bp, Homo sapiens
agatgcagtttgcaggtgggt

SEQ ID NO: 7420101 - DNA, 21 bp, Homo sapiens
agatgcagtttgcaggtgggt

SEQ ID NO: 7420102 - DNA, 21 bp, Homo sapiens
agatgcagtgacccactgggg

SEQ ID NO: 7420103 - DNA, 22 bp, Homo sapiens
agatgcagagtttgctgtggac

SEQ ID NO: 7420104 - DNA, 22 bp, Homo sapiens
agatgcagatttggattcagga

SEQ ID NO: 7420105 - DNA, 22 bp, Homo sapiens
agatgcagatttggattcagga

SEQ ID NO: 7420106 - DNA, 21 bp, Homo sapiens
agatgcagttatgagatgcag

SEQ ID NO: 7420107 - DNA, 21 bp, Homo sapiens
agatgcagttatgagatgcag

SEQ ID NO: 7420108 - DNA, 21 bp, Homo sapiens
agatgcagttatgagatgcag

SEQ ID NO: 7420109 - DNA, 22 bp, Homo sapiens
agatgcagtggttaacaataca

SEQ ID NO: 7420110 - DNA, 22 bp, Homo sapiens
agatgcagtggttaacaataca

SEQ ID NO: 7420111 - DNA, 21 bp, Homo sapiens
agatgcagtgacccactgggg

SEQ ID NO: 7420112 - DNA, 22 bp, Homo sapiens
agatgcagtggttaacaataca

SEQ ID NO: 7420113 - DNA, 22 bp, Homo sapiens
agatgcagacttggttcaggca

SEQ ID NO: 7420114 - DNA, 22 bp, Homo sapiens
agatgcagacttggttcaggca

SEQ ID NO: 7420115 - DNA, 20 bp, Homo sapiens
agatcttttctatagaagtg

SEQ ID NO: 7420116 - DNA, 22 bp, Homo sapiens
agatgcagacttggttcaggca

SEQ ID NO: 7420117 - DNA, 22 bp, Homo sapiens
agatgcagacttggttcaggca

SEQ ID NO: 7420118 - DNA, 22 bp, Homo sapiens
agatgcagacttggttcaggca

SEQ ID NO: 7420119 - DNA, 22 bp, Homo sapiens
agatgcagagtttgctgtggac

SEQ ID NO: 7420120 - DNA, 22 bp, Homo sapiens
agatgcagacttggttcaggca

SEQ ID NO: 7420121 - DNA, 22 bp, Homo sapiens
agatgcagagttgcttaagcat

SEQ ID NO: 7420122 - DNA, 22 bp, Homo sapiens
agatgcagagtttgctgtggac

SEQ ID NO: 7420123 - DNA, 22 bp, Homo sapiens
agatgcagagtttgctgtggac

SEQ ID NO: 7420124 - DNA, 22 bp, Homo sapiens
agatgctgctccacaggccagg

SEQ ID NO: 7420125 - DNA, 22 bp, Homo sapiens
agatgctgctccacaggccagg

SEQ ID NO: 7420126 - DNA, 22 bp, Homo sapiens
agatgctgccaggcccctcagt

SEQ ID NO: 7420127 - DNA, 22 bp, Homo sapiens
agatgctgaattattgtgcttt

SEQ ID NO: 7420128 - DNA, 22 bp, Homo sapiens
agatgctgaattattgtgcttt

SEQ ID NO: 7420129 - DNA, 22 bp, Homo sapiens
agatgctgcagcctggactgga

SEQ ID NO: 7420130 - DNA, 22 bp, Homo sapiens
acaacagtaggaaaacatgtct

SEQ ID NO: 7420131 - DNA, 22 bp, Homo sapiens
acaacagtaggaaaacatgtct

SEQ ID NO: 7420132 - DNA, 22 bp, Homo sapiens
acaacagtaggaaaacatgtct

SEQ ID NO: 7420133 - DNA, 22 bp, Homo sapiens
acaacagtaggaaaacatgtct

SEQ ID NO: 7420134 - DNA, 22 bp, Homo sapiens
acaacagtagcctttacaaggc

SEQ ID NO: 7420135 - DNA, 22 bp, Homo sapiens
acaacagtagcctttacaaggc

SEQ ID NO: 7420136 - DNA, 22 bp, Homo sapiens
acaacagtagcctttacaaggc

SEQ ID NO: 7420137 - DNA, 22 bp, Homo sapiens
acaacagtagcctttacaaggc

SEQ ID NO: 7420138 - DNA, 22 bp, Homo sapiens
acaacagggtaaggcaggccat

SEQ ID NO: 7420139 - DNA, 22 bp, Homo sapiens
agatgctgctccacaggccagg

SEQ ID NO: 7420140 - DNA, 22 bp, Homo sapiens
agatgctggatggaaaatgatc

SEQ ID NO: 7420141 - DNA, 22 bp, Homo sapiens
agatgctggatggaaaatgatc

SEQ ID NO: 7420142 - DNA, 23 bp, Homo sapiens
acaacaggaaatcagacctgaac

SEQ ID NO: 7420143 - DNA, 22 bp, Homo sapiens
acaacagctgttcacaggggtc

SEQ ID NO: 7420144 - DNA, 22 bp, Homo sapiens
acaacagggtaaggcaggccat

SEQ ID NO: 7420145 - DNA, 22 bp, Homo sapiens
acaacagggtaaggcaggccat

SEQ ID NO: 7420146 - DNA, 22 bp, Homo sapiens
acaaataggtagatttgcaaca

SEQ ID NO: 7420147 - DNA, 22 bp, Homo sapiens
acaaataggtagatttgcaaca

SEQ ID NO: 7420148 - DNA, 22 bp, Homo sapiens
acaaataggtagatttgcaaca

SEQ ID NO: 7420149 - DNA, 22 bp, Homo sapiens
acaaatagagattcaaataaag

SEQ ID NO: 7420150 - DNA, 22 bp, Homo sapiens
acaaatagagattcaaataaag

SEQ ID NO: 7420151 - DNA, 22 bp, Homo sapiens
acaaatagagattcaaataaag

SEQ ID NO: 7420152 - DNA, 22 bp, Homo sapiens
acaaatagagattcaaataaag

SEQ ID NO: 7420153 - DNA, 16 bp, Homo sapiens
acaaatacaactgctg

SEQ ID NO: 7420154 - DNA, 22 bp, Homo sapiens
acaaatagaaaatctggattgg

SEQ ID NO: 7420155 - DNA, 22 bp, Homo sapiens
acaaatagaaaatctggattgg

SEQ ID NO: 7420156 - DNA, 22 bp, Homo sapiens
agatctttagtgaagctaaatc

SEQ ID NO: 7420157 - DNA, 22 bp, Homo sapiens
agatctttagtgaagctaaatc

SEQ ID NO: 7420158 - DNA, 22 bp, Homo sapiens
agatctttagtgaagctaaatc

SEQ ID NO: 7420159 - DNA, 22 bp, Homo sapiens
acaaatagagattcaaataaag

SEQ ID NO: 7420160 - DNA, 22 bp, Homo sapiens
agatctttagaagatagaatca

SEQ ID NO: 7420161 - DNA, 22 bp, Homo sapiens
agatctttagaagatagaatca

SEQ ID NO: 7420162 - DNA, 20 bp, Homo sapiens
agatctttgggttgtcatat

SEQ ID NO: 7420163 - DNA, 20 bp, Homo sapiens
agatctttgggttgtcatat

SEQ ID NO: 7420164 - DNA, 22 bp, Homo sapiens
agatctttagtgaagctaaatc

SEQ ID NO: 7420165 - DNA, 20 bp, Homo sapiens
agatcttttctatagaagtg

SEQ ID NO: 7420166 - DNA, 22 bp, Homo sapiens
agatcttttggttattataaga

SEQ ID NO: 7420167 - DNA, 22 bp, Homo sapiens
acaaagtttgtggtattccaag

SEQ ID NO: 7420168 - DNA, 22 bp, Homo sapiens
acaaagtttgtggtattccaag

SEQ ID NO: 7420169 - DNA, 22 bp, Homo sapiens
acaaagtttgtggtattccaag

SEQ ID NO: 7420170 - DNA, 22 bp, Homo sapiens
acaaagtttgtggtattccaag

SEQ ID NO: 7420171 - DNA, 22 bp, Homo sapiens
acaaagtttcttctaacatctg

SEQ ID NO: 7420172 - DNA, 22 bp, Homo sapiens
acaaagtttgtggtattccaag

SEQ ID NO: 7420173 - DNA, 22 bp, Homo sapiens
acaaagtttgtggtattccaag

SEQ ID NO: 7420174 - DNA, 22 bp, Homo sapiens
acaaagttaacagttggatagt

SEQ ID NO: 7420175 - DNA, 22 bp, Homo sapiens
acaaagttattctttcagagga

SEQ ID NO: 7420176 - DNA, 22 bp, Homo sapiens
acaaagttattctttcagagga

SEQ ID NO: 7420177 - DNA, 22 bp, Homo sapiens
acaaagtttcttctaacatctg

SEQ ID NO: 7420178 - DNA, 22 bp, Homo sapiens
acaaagtttcttctaacatctg

SEQ ID NO: 7420179 - DNA, 22 bp, Homo sapiens
acaaagttattctttcagagga

SEQ ID NO: 7420180 - DNA, 22 bp, Homo sapiens
acaaagttattctttcagagga

SEQ ID NO: 7420181 - DNA, 22 bp, Homo sapiens
acaaagttaacagttggatagt

SEQ ID NO: 7420182 - DNA, 22 bp, Homo sapiens
acaaagtgttttctgaaggcct

SEQ ID NO: 7420183 - DNA, 22 bp, Homo sapiens
acaaagtgttttctgaaggcct

SEQ ID NO: 7420184 - DNA, 22 bp, Homo sapiens
acaaagtgtgcggagcccaggg

SEQ ID NO: 7420185 - DNA, 22 bp, Homo sapiens
acaaagtgctgacattacaggc

SEQ ID NO: 7420186 - DNA, 22 bp, Homo sapiens
acaaagtgtgcggagcccaggg

SEQ ID NO: 7420187 - DNA, 22 bp, Homo sapiens
acaaagtgtgcggagcccaggg

SEQ ID NO: 7420188 - DNA, 22 bp, Homo sapiens
acaaagtgtgcggagcccaggg

SEQ ID NO: 7420189 - DNA, 22 bp, Homo sapiens
agagttcagctactgcaaatgt

SEQ ID NO: 7420190 - DNA, 22 bp, Homo sapiens
agagttcagaaagtgcaggttt

SEQ ID NO: 7420191 - DNA, 22 bp, Homo sapiens
agagttcagaaagtgcaggttt

SEQ ID NO: 7420192 - DNA, 22 bp, Homo sapiens
agagttcacactcagtgcaccc

SEQ ID NO: 7420193 - DNA, 22 bp, Homo sapiens
agagttcacactcagtgcaccc

SEQ ID NO: 7420194 - DNA, 22 bp, Homo sapiens
agagttcagttgtagccatatt

SEQ ID NO: 7420195 - DNA, 22 bp, Homo sapiens
agagttccacgtacagcttttg

SEQ ID NO: 7420196 - DNA, 22 bp, Homo sapiens
acaaagtatttttaggtttgta

SEQ ID NO: 7420197 - DNA, 22 bp, Homo sapiens
acaaagtatttttaggtttgta

SEQ ID NO: 7420198 - DNA, 22 bp, Homo sapiens
acaaagtcctggtgtatggcca

SEQ ID NO: 7420199 - DNA, 22 bp, Homo sapiens
agagttctctctcatttgagct

SEQ ID NO: 7420200 - DNA, 22 bp, Homo sapiens
agagttctctctcatttgagct

SEQ ID NO: 7420201 - DNA, 22 bp, Homo sapiens
acaaagtatttttaggtttgta

SEQ ID NO: 7420202 - DNA, 20 bp, Homo sapiens
acaaagtattgaggacaagt

SEQ ID NO: 7420203 - DNA, 22 bp, Homo sapiens
acaaagtctctaataatcttct

SEQ ID NO: 7420204 - DNA, 22 bp, Homo sapiens
acaaagtgaaaagcatcgaatt

SEQ ID NO: 7420205 - DNA, 22 bp, Homo sapiens
acaaagtgaaaagcatcgaatt

SEQ ID NO: 7420206 - DNA, 22 bp, Homo sapiens
acaaagtgaattgcatcgagtt

SEQ ID NO: 7420207 - DNA, 22 bp, Homo sapiens
acaaagtgaattgcatcgagtt

SEQ ID NO: 7420208 - DNA, 22 bp, Homo sapiens
acaaagtgctgacattacaggc

SEQ ID NO: 7420209 - DNA, 22 bp, Homo sapiens
acaaagtgctgacattacaggc

SEQ ID NO: 7420210 - DNA, 22 bp, Homo sapiens
acaaagtgctgacattacaggc

SEQ ID NO: 7420211 - DNA, 22 bp, Homo sapiens
acaaagtgctgacattacaggc

SEQ ID NO: 7420212 - DNA, 22 bp, Homo sapiens
acaaagtgcacaagatgagaac

SEQ ID NO: 7420213 - DNA, 22 bp, Homo sapiens
acaaagtgcacaagatgagaac

SEQ ID NO: 7420214 - DNA, 19 bp, Homo sapiens
acaaagtgcgtgctctttt

SEQ ID NO: 7420215 - DNA, 22 bp, Homo sapiens
acaaagtgaattgcatcgagtt

SEQ ID NO: 7420216 - DNA, 22 bp, Homo sapiens
acaaagtgcacaagatgagaac

SEQ ID NO: 7420217 - DNA, 22 bp, Homo sapiens
acaaagtgcacaagatgagaac

SEQ ID NO: 7420218 - DNA, 22 bp, Homo sapiens
acaaagtgcacaagatgagaac

SEQ ID NO: 7420219 - DNA, 22 bp, Homo sapiens
agagttaaatgaaatggtatgt

SEQ ID NO: 7420220 - DNA, 22 bp, Homo sapiens
agagttaaatgaaatggtatgt

SEQ ID NO: 7420221 - DNA, 22 bp, Homo sapiens
agagttaagacgtacatgagtg

SEQ ID NO: 7420222 - DNA, 22 bp, Homo sapiens
agagttaagtgaaatgtaataa

SEQ ID NO: 7420223 - DNA, 22 bp, Homo sapiens
agagttaaggccactgtcagta

SEQ ID NO: 7420224 - DNA, 21 bp, Homo sapiens
agagttactgtcatcctaggt

SEQ ID NO: 7420225 - DNA, 22 bp, Homo sapiens
agagttagtggcctcagcaggg

SEQ ID NO: 7420226 - DNA, 19 bp, Homo sapiens
agagttagctggctatctc

SEQ ID NO: 7420227 - DNA, 22 bp, Homo sapiens
agagttaagtgaaatgtaataa

SEQ ID NO: 7420228 - DNA, 22 bp, Homo sapiens
agagttatggacttaatgcagg

SEQ ID NO: 7420229 - DNA, 22 bp, Homo sapiens
agagttatggacttaatgcagg

SEQ ID NO: 7420230 - DNA, 21 bp, Homo sapiens
agagttatgtggcttgcctga

SEQ ID NO: 7420231 - DNA, 22 bp, Homo sapiens
agagttcacactcagtgcaccc

SEQ ID NO: 7420232 - DNA, 22 bp, Homo sapiens
agagttatcactccatgcagct

SEQ ID NO: 7420233 - DNA, 22 bp, Homo sapiens
agagttatcctgtcctagggga

SEQ ID NO: 7420234 - DNA, 22 bp, Homo sapiens
agagttatcactccatgcagct

SEQ ID NO: 7420235 - DNA, 22 bp, Homo sapiens
agagttatcactccatgcagct

SEQ ID NO: 7420236 - DNA, 22 bp, Homo sapiens
agagttatattggttgagaatt

SEQ ID NO: 7420237 - DNA, 22 bp, Homo sapiens
agagtgtttcagtcttcctaga

SEQ ID NO: 7420238 - DNA, 22 bp, Homo sapiens
agagtgtttcagtcttcctaga

SEQ ID NO: 7420239 - DNA, 22 bp, Homo sapiens
agagtgttatttgctctgtatt

SEQ ID NO: 7420240 - DNA, 22 bp, Homo sapiens
agagtgtgttccccaagaaaga

SEQ ID NO: 7420241 - DNA, 22 bp, Homo sapiens
agagtgtgtggggctgaggtca

SEQ ID NO: 7420242 - DNA, 22 bp, Homo sapiens
agagtgtgtggggctgaggtca

SEQ ID NO: 7420243 - DNA, 22 bp, Homo sapiens
agagtgtgtgctgagaaacgag

SEQ ID NO: 7420244 - DNA, 22 bp, Homo sapiens
agagtgtgtctatggaaggggt

SEQ ID NO: 7420245 - DNA, 22 bp, Homo sapiens
agagtgtggttcttgcccgcat

SEQ ID NO: 7420246 - DNA, 22 bp, Homo sapiens
agagtgtgtctatggaaggggt

SEQ ID NO: 7420247 - DNA, 22 bp, Homo sapiens
agagtgtggaaatgttcagagt

SEQ ID NO: 7420248 - DNA, 22 bp, Homo sapiens
agagtgtggaaatgttcagagt

SEQ ID NO: 7420249 - DNA, 22 bp, Homo sapiens
agagtgtggaaatgttcagagt

SEQ ID NO: 7420250 - DNA, 22 bp, Homo sapiens
agagtgtggaacttgaggagct

SEQ ID NO: 7420251 - DNA, 22 bp, Homo sapiens
agagtgtggaacttgaggagct

SEQ ID NO: 7420252 - DNA, 22 bp, Homo sapiens
agagtgtaccaaatatcctaca

SEQ ID NO: 7420253 - DNA, 22 bp, Homo sapiens
agagtgtaccaaatatcctaca

SEQ ID NO: 7420254 - DNA, 22 bp, Homo sapiens
agagtgtaccaaatatcctaca

SEQ ID NO: 7420255 - DNA, 22 bp, Homo sapiens
agagtgtaccaaatatcctaca

SEQ ID NO: 7420256 - DNA, 22 bp, Homo sapiens
agagtgtgaagaaagtgcaatg

SEQ ID NO: 7420257 - DNA, 22 bp, Homo sapiens
agagtgtcagccccagagtatg

SEQ ID NO: 7420258 - DNA, 22 bp, Homo sapiens
agagtgtctggtagctgctctg

SEQ ID NO: 7420259 - DNA, 22 bp, Homo sapiens
aatttgtacaaaatgtttataa

SEQ ID NO: 7420260 - DNA, 22 bp, Homo sapiens
aatttgtacaaaatgtttataa

SEQ ID NO: 7420261 - DNA, 22 bp, Homo sapiens
aatttgtacaaaatgtttataa

SEQ ID NO: 7420262 - DNA, 22 bp, Homo sapiens
aatttggttttaagagcatcag

SEQ ID NO: 7420263 - DNA, 22 bp, Homo sapiens
aatttgtacaaaatgtttataa

SEQ ID NO: 7420264 - DNA, 22 bp, Homo sapiens
aatttgtacaaaatgtttataa

SEQ ID NO: 7420265 - DNA, 22 bp, Homo sapiens
aatttggcagtgtcttgaagta

SEQ ID NO: 7420266 - DNA, 22 bp, Homo sapiens
aatttggcagtgtcttgaagta

SEQ ID NO: 7420267 - DNA, 22 bp, Homo sapiens
aatttgggcgaggagggaggca

SEQ ID NO: 7420268 - DNA, 23 bp, Homo sapiens
aatttggtatatctgaaccactg

SEQ ID NO: 7420269 - DNA, 22 bp, Homo sapiens
aatttggtgtgttccaggaact

SEQ ID NO: 7420270 - DNA, 22 bp, Homo sapiens
aatttggtgtcttagtttccct

SEQ ID NO: 7420271 - DNA, 22 bp, Homo sapiens
agagtgaagtttttgaaagtga

SEQ ID NO: 7420272 - DNA, 22 bp, Homo sapiens
agagtgaagtaattgttaggat

SEQ ID NO: 7420273 - DNA, 22 bp, Homo sapiens
agagtgaagtaattgttaggat

SEQ ID NO: 7420274 - DNA, 22 bp, Homo sapiens
agagtgaagttcatcgtgcagc

SEQ ID NO: 7420275 - DNA, 22 bp, Homo sapiens
aatttgtatacatgttacattt

SEQ ID NO: 7420276 - DNA, 22 bp, Homo sapiens
aatttgtatacatgttacattt

SEQ ID NO: 7420277 - DNA, 22 bp, Homo sapiens
aatttgtatacatgttacattt

SEQ ID NO: 7420278 - DNA, 22 bp, Homo sapiens
aatttgtatacatgttacattt

SEQ ID NO: 7420279 - DNA, 22 bp, Homo sapiens
agagtgaagtttttgaaagtga

SEQ ID NO: 7420280 - DNA, 22 bp, Homo sapiens
agagtgacagccactgcagtaa

SEQ ID NO: 7420281 - DNA, 20 bp, Homo sapiens
agagtgggtgtcacaggctg

SEQ ID NO: 7420282 - DNA, 20 bp, Homo sapiens
agagtgggtgtcacaggctg

SEQ ID NO: 7420283 - DNA, 20 bp, Homo sapiens
agagtgggtgtcacaggctg

SEQ ID NO: 7420284 - DNA, 20 bp, Homo sapiens
agagtgggtgtcacaggctg

SEQ ID NO: 7420285 - DNA, 22 bp, Homo sapiens
agagtggtggccgtggtgtcac

SEQ ID NO: 7420286 - DNA, 22 bp, Homo sapiens
agagtgtaccaaatatcctaca

SEQ ID NO: 7420287 - DNA, 22 bp, Homo sapiens
agagtgtaccaaatatcctaca

SEQ ID NO: 7420288 - DNA, 22 bp, Homo sapiens
agagtgtaccaaatatcctaca

SEQ ID NO: 7420289 - DNA, 22 bp, Homo sapiens
agagtgtaccaaatatcctaca

SEQ ID NO: 7420290 - DNA, 22 bp, Homo sapiens
agagtggtcatttgtccaggat

SEQ ID NO: 7420291 - DNA, 22 bp, Homo sapiens
agagtgggttataggcagactt

SEQ ID NO: 7420292 - DNA, 22 bp, Homo sapiens
agagtgggttataggcagactt

SEQ ID NO: 7420293 - DNA, 22 bp, Homo sapiens
agagtgggttataggcagactt

SEQ ID NO: 7420294 - DNA, 22 bp, Homo sapiens
agagtgggttataggcagactt

SEQ ID NO: 7420295 - DNA, 18 bp, Homo sapiens
aatttctttgacaactta

SEQ ID NO: 7420296 - DNA, 18 bp, Homo sapiens
aatttctttgacaactta

SEQ ID NO: 7420297 - DNA, 22 bp, Homo sapiens
aatttcttgggagctcagagaa

SEQ ID NO: 7420298 - DNA, 18 bp, Homo sapiens
aatttctttgacaactta

SEQ ID NO: 7420299 - DNA, 18 bp, Homo sapiens
aatttctttgacaactta

SEQ ID NO: 7420300 - DNA, 18 bp, Homo sapiens
aatttctttgacaactta

SEQ ID NO: 7420301 - DNA, 18 bp, Homo sapiens
aatttctttgacaactta

SEQ ID NO: 7420302 - DNA, 18 bp, Homo sapiens
aatttctttgacaactta

SEQ ID NO: 7420303 - DNA, 18 bp, Homo sapiens
aatttctttgacaactta

SEQ ID NO: 7420304 - DNA, 18 bp, Homo sapiens
aatttctttgacaactta

SEQ ID NO: 7420305 - DNA, 18 bp, Homo sapiens
aatttctttgacaactta

SEQ ID NO: 7420306 - DNA, 22 bp, Homo sapiens
aatttgacccatcttggaattt

SEQ ID NO: 7420307 - DNA, 22 bp, Homo sapiens
aatttgaaacatagtcaccact

SEQ ID NO: 7420308 - DNA, 22 bp, Homo sapiens
aatttgaaacatagtcaccact

SEQ ID NO: 7420309 - DNA, 22 bp, Homo sapiens
aatttgattcagcaaatgttca

SEQ ID NO: 7420310 - DNA, 22 bp, Homo sapiens
aatttgattcagcaaatgttca

SEQ ID NO: 7420311 - DNA, 22 bp, Homo sapiens
aatttgattcagcaaatgttca

SEQ ID NO: 7420312 - DNA, 22 bp, Homo sapiens
aatttgattcagcaaatgttca

SEQ ID NO: 7420313 - DNA, 22 bp, Homo sapiens
aatttggagctttgtttctaga

SEQ ID NO: 7420314 - DNA, 22 bp, Homo sapiens
aatttggagagagattaatgtt

SEQ ID NO: 7420315 - DNA, 22 bp, Homo sapiens
aatttggagctttgtttctaga

SEQ ID NO: 7420316 - DNA, 22 bp, Homo sapiens
aatttggaggtatttagctgtc

SEQ ID NO: 7420317 - DNA, 22 bp, Homo sapiens
aatttggagctttgtttctaga

SEQ ID NO: 7420318 - DNA, 22 bp, Homo sapiens
aatttggcagtgtcttgaagta

SEQ ID NO: 7420319 - DNA, 22 bp, Homo sapiens
aatttggagagaaacaagtagg

SEQ ID NO: 7420320 - DNA, 22 bp, Homo sapiens
aatttggagagaaacaagtagg

SEQ ID NO: 7420321 - DNA, 22 bp, Homo sapiens
aatttggagagaaacaagtagg

SEQ ID NO: 7420322 - DNA, 22 bp, Homo sapiens
aatttggagagagattaatgtt

SEQ ID NO: 7420323 - DNA, 22 bp, Homo sapiens
aatttggagagaaacaagtagg

SEQ ID NO: 7420324 - DNA, 22 bp, Homo sapiens
aatttggacttgggtgctagag

SEQ ID NO: 7420325 - DNA, 22 bp, Homo sapiens
aatttggaagatgttgtttatc

SEQ ID NO: 7420326 - DNA, 23 bp, Homo sapiens
aatttggaaatgaggctaccaag

SEQ ID NO: 7420327 - DNA, 21 bp, Homo sapiens
aatttgctaagcaaaggagca

SEQ ID NO: 7420328 - DNA, 23 bp, Homo sapiens
aatttggaaatgaggctaccaag

SEQ ID NO: 7420329 - DNA, 22 bp, Homo sapiens
aatttgcatgatgagaacaata

SEQ ID NO: 7420330 - DNA, 22 bp, Homo sapiens
aatttgccttaccttcttccaa

SEQ ID NO: 7420331 - DNA, 22 bp, Homo sapiens
aatttgattccctgcacctgtt

SEQ ID NO: 7420332 - DNA, 22 bp, Homo sapiens
aatttgattccctgcacctgtt

SEQ ID NO: 7420333 - DNA, 22 bp, Homo sapiens
aatttgcatgatgagaacaata

SEQ ID NO: 7420334 - DNA, 22 bp, Homo sapiens
aatttctcggttttgatattgt

SEQ ID NO: 7420335 - DNA, 22 bp, Homo sapiens
aatttctccagacagctgtgca

SEQ ID NO: 7420336 - DNA, 22 bp, Homo sapiens
aatttctcaattgttacaggtg

SEQ ID NO: 7420337 - DNA, 22 bp, Homo sapiens
aatttctaattgaatctctctt

SEQ ID NO: 7420338 - DNA, 22 bp, Homo sapiens
aatttctaattgaatctctctt

SEQ ID NO: 7420339 - DNA, 22 bp, Homo sapiens
aatttctaattgaatctctctt

SEQ ID NO: 7420340 - DNA, 22 bp, Homo sapiens
aatttctaattgaatctctctt

SEQ ID NO: 7420341 - DNA, 22 bp, Homo sapiens
aatttctcatggattcagttat

SEQ ID NO: 7420342 - DNA, 22 bp, Homo sapiens
aatttctccaagaatgcttaga

SEQ ID NO: 7420343 - DNA, 22 bp, Homo sapiens
aatttcttcagctctaaaatgg

SEQ ID NO: 7420344 - DNA, 22 bp, Homo sapiens
aatttcttcagctctaaaatgg

SEQ ID NO: 7420345 - DNA, 22 bp, Homo sapiens
aatttcttcagctctaaaatgg

SEQ ID NO: 7420346 - DNA, 22 bp, Homo sapiens
aatttcttcagctctaaaatgg

SEQ ID NO: 7420347 - DNA, 22 bp, Homo sapiens
aatttcttgggagctcagagaa

SEQ ID NO: 7420348 - DNA, 22 bp, Homo sapiens
aatttcttgggagctcagagaa

SEQ ID NO: 7420349 - DNA, 22 bp, Homo sapiens
aatttcttgggagctcagagaa

SEQ ID NO: 7420350 - DNA, 22 bp, Homo sapiens
aatttctgtatgaatagagaaa

SEQ ID NO: 7420351 - DNA, 22 bp, Homo sapiens
aatttctgtatgaatagagaaa

SEQ ID NO: 7420352 - DNA, 22 bp, Homo sapiens
aatttcttcagctctaaaatgg

SEQ ID NO: 7420353 - DNA, 22 bp, Homo sapiens
aatttcttcagctctaaaatgg

SEQ ID NO: 7420354 - DNA, 22 bp, Homo sapiens
aatttctgtatgaatagagaaa

SEQ ID NO: 7420355 - DNA, 22 bp, Homo sapiens
aatttcttcagctctaaaatgg

SEQ ID NO: 7420356 - DNA, 22 bp, Homo sapiens
aatttcttcagctctaaaatgg

SEQ ID NO: 7420357 - DNA, 22 bp, Homo sapiens
aatttcttcagctctaaaatgg

SEQ ID NO: 7420358 - DNA, 22 bp, Homo sapiens
aatttcttcagctctaaaatgg

SEQ ID NO: 7420359 - DNA, 22 bp, Homo sapiens
aatttcttcagctctaaaatgg

SEQ ID NO: 7420360 - DNA, 22 bp, Homo sapiens
aatttcttcagctctaaaatgg

SEQ ID NO: 7420361 - DNA, 22 bp, Homo sapiens
agcacaatatgggttttatagt

SEQ ID NO: 7420362 - DNA, 22 bp, Homo sapiens
agcacacaggacttgattcatg

SEQ ID NO: 7420363 - DNA, 22 bp, Homo sapiens
agcacacaggacttgattcatg

SEQ ID NO: 7420364 - DNA, 22 bp, Homo sapiens
agcacacaggacttgattcatg

SEQ ID NO: 7420365 - DNA, 22 bp, Homo sapiens
agcacacaggacttgattcatg

SEQ ID NO: 7420366 - DNA, 22 bp, Homo sapiens
agcacacaggacttgattcatg

SEQ ID NO: 7420367 - DNA, 22 bp, Homo sapiens
agcacacaggacttgattcatg

SEQ ID NO: 7420368 - DNA, 22 bp, Homo sapiens
agcacacaggacttgattcatg

SEQ ID NO: 7420369 - DNA, 22 bp, Homo sapiens
agcacacaggacttgattcatg

SEQ ID NO: 7420370 - DNA, 22 bp, Homo sapiens
agcacacaggccacctccactt

SEQ ID NO: 7420371 - DNA, 22 bp, Homo sapiens
agcacacaggccacctccactt

SEQ ID NO: 7420372 - DNA, 22 bp, Homo sapiens
agcacacaggccacctccactt

SEQ ID NO: 7420373 - DNA, 22 bp, Homo sapiens
agcacacagtattagccattgt

SEQ ID NO: 7420374 - DNA, 22 bp, Homo sapiens
agcacacagtattagccattgt

SEQ ID NO: 7420375 - DNA, 22 bp, Homo sapiens
agcacacagtattagccattgt

SEQ ID NO: 7420376 - DNA, 22 bp, Homo sapiens
agcacacagtattagccattgt

SEQ ID NO: 7420377 - DNA, 22 bp, Homo sapiens
agcacaatataaagtgaacgca

SEQ ID NO: 7420378 - DNA, 22 bp, Homo sapiens
agcacaatagagcagttaaaaa

SEQ ID NO: 7420379 - DNA, 22 bp, Homo sapiens
agcacaatagagcagttaaaaa

SEQ ID NO: 7420380 - DNA, 22 bp, Homo sapiens
agcacaagtttctggcagacag

SEQ ID NO: 7420381 - DNA, 22 bp, Homo sapiens
agcacaagtttctggcagacag

SEQ ID NO: 7420382 - DNA, 22 bp, Homo sapiens
agcacaaatataaaaatgtctg

SEQ ID NO: 7420383 - DNA, 22 bp, Homo sapiens
agcacaaatataaaaatgtctg

SEQ ID NO: 7420384 - DNA, 22 bp, Homo sapiens
agcacaaatataaaaatgtctg

SEQ ID NO: 7420385 - DNA, 22 bp, Homo sapiens
agcacaaatataaaaatgtctg

SEQ ID NO: 7420386 - DNA, 22 bp, Homo sapiens
agcacaaaagcagccacagatg

SEQ ID NO: 7420387 - DNA, 22 bp, Homo sapiens
agcacaaaagcagccacagatg

SEQ ID NO: 7420388 - DNA, 22 bp, Homo sapiens
agcacaaaagcagccacagatg

SEQ ID NO: 7420389 - DNA, 23 bp, Homo sapiens
agcacaaagtgttttccttgtag

SEQ ID NO: 7420390 - DNA, 22 bp, Homo sapiens
agcaaggccgagaggatgctat

SEQ ID NO: 7420391 - DNA, 22 bp, Homo sapiens
agcaaggccgagaggatgctat

SEQ ID NO: 7420392 - DNA, 22 bp, Homo sapiens
agcaaggccgagaggatgctat

SEQ ID NO: 7420393 - DNA, 22 bp, Homo sapiens
agcacagaatgaggtggaagtg

SEQ ID NO: 7420394 - DNA, 22 bp, Homo sapiens
agcacagaatggcttggaagcc

SEQ ID NO: 7420395 - DNA, 22 bp, Homo sapiens
agcacagaatgaggtggaagtg

SEQ ID NO: 7420396 - DNA, 22 bp, Homo sapiens
agcacagaatggcttggaagcc

SEQ ID NO: 7420397 - DNA, 22 bp, Homo sapiens
agcacagaatggcttggaagcc

SEQ ID NO: 7420398 - DNA, 19 bp, Homo sapiens
agcacagacaagaccagca

SEQ ID NO: 7420399 - DNA, 19 bp, Homo sapiens
agcacagacaagaccagca

SEQ ID NO: 7420400 - DNA, 19 bp, Homo sapiens
agcacagacaagaccagca

SEQ ID NO: 7420401 - DNA, 19 bp, Homo sapiens
agcacagacaagaccagca

SEQ ID NO: 7420402 - DNA, 21 bp, Homo sapiens
agcacagctttaagccatgtg

SEQ ID NO: 7420403 - DNA, 19 bp, Homo sapiens
agcacagacaagaccagca

SEQ ID NO: 7420404 - DNA, 22 bp, Homo sapiens
agcacagaatggcttggaagcc

SEQ ID NO: 7420405 - DNA, 22 bp, Homo sapiens
agcacaggaacatggagatggg

SEQ ID NO: 7420406 - DNA, 22 bp, Homo sapiens
agcacaggaacatggagatggg

SEQ ID NO: 7420407 - DNA, 22 bp, Homo sapiens
agcacaggaccaaggaagctgt

SEQ ID NO: 7420408 - DNA, 22 bp, Homo sapiens
agcacaggaccaaggaagctgt

SEQ ID NO: 7420409 - DNA, 22 bp, Homo sapiens
agcacaggaacatggagatggg

SEQ ID NO: 7420410 - DNA, 22 bp, Homo sapiens
agcacaggaacatggagatggg

SEQ ID NO: 7420411 - DNA, 22 bp, Homo sapiens
agcacaggaacatggagatggg

SEQ ID NO: 7420412 - DNA, 21 bp, Homo sapiens
agcacagctttaagccatgtg

SEQ ID NO: 7420413 - DNA, 22 bp, Homo sapiens
agcacaggaacatggagatggg

SEQ ID NO: 7420414 - DNA, 22 bp, Homo sapiens
agcacaggaacatggagatggg

SEQ ID NO: 7420415 - DNA, 22 bp, Homo sapiens
agcacaggaacatggagatggg

SEQ ID NO: 7420416 - DNA, 22 bp, Homo sapiens
agcacacagtcttccttcctcc

SEQ ID NO: 7420417 - DNA, 22 bp, Homo sapiens
agcacacatcacttctgctcat

SEQ ID NO: 7420418 - DNA, 22 bp, Homo sapiens
agcacacatcacttctgctcat

SEQ ID NO: 7420419 - DNA, 22 bp, Homo sapiens
agcacacagtcttccttcctcc

SEQ ID NO: 7420420 - DNA, 22 bp, Homo sapiens
agcacacatcacttctgctcat

SEQ ID NO: 7420421 - DNA, 22 bp, Homo sapiens
agcacacatcacttctgctcat

SEQ ID NO: 7420422 - DNA, 22 bp, Homo sapiens
agcacactgacctgaagccttg

SEQ ID NO: 7420423 - DNA, 22 bp, Homo sapiens
agcacacatcacttctgctcat

SEQ ID NO: 7420424 - DNA, 22 bp, Homo sapiens
agcacacatcacttctgctcat

SEQ ID NO: 7420425 - DNA, 22 bp, Homo sapiens
agcacactggcattgggaagct

SEQ ID NO: 7420426 - DNA, 21 bp, Homo sapiens
agcacacttacctgttctaag

SEQ ID NO: 7420427 - DNA, 23 bp, Homo sapiens
agcacacttgtacaatgccctag

SEQ ID NO: 7420428 - DNA, 23 bp, Homo sapiens
agcacacttgtacaatgccctag

SEQ ID NO: 7420429 - DNA, 22 bp, Homo sapiens
agcacagaaagcacatttgaaa

SEQ ID NO: 7420430 - DNA, 22 bp, Homo sapiens
agcacagaaagcacatttgaaa

SEQ ID NO: 7420431 - DNA, 22 bp, Homo sapiens
agcacagaatgaggtggaagtg

SEQ ID NO: 7420432 - DNA, 22 bp, Homo sapiens
agcacagaaagtattgactgaa

SEQ ID NO: 7420433 - DNA, 22 bp, Homo sapiens
agcacagaaagtattgactgaa

SEQ ID NO: 7420434 - DNA, 22 bp, Homo sapiens
agcacagaatgaggtggaagtg

SEQ ID NO: 7420435 - DNA, 22 bp, Homo sapiens
agcacagaatgaggtggaagtg

SEQ ID NO: 7420436 - DNA, 22 bp, Homo sapiens
agcacagaatgaggtggaagtg

SEQ ID NO: 7420437 - DNA, 22 bp, Homo sapiens
agcacagaatgaggtggaagtg

SEQ ID NO: 7420438 - DNA, 22 bp, Homo sapiens
acacaaattgtaggataattgc

SEQ ID NO: 7420439 - DNA, 22 bp, Homo sapiens
acacaaattgtaggataattgc

SEQ ID NO: 7420440 - DNA, 22 bp, Homo sapiens
acacaaattgtaggataattgc

SEQ ID NO: 7420441 - DNA, 21 bp, Homo sapiens
acacaacaggcagtcattttc

SEQ ID NO: 7420442 - DNA, 21 bp, Homo sapiens
acacaacaggcagtcattttc

SEQ ID NO: 7420443 - DNA, 22 bp, Homo sapiens
acacaacagaagagcaattgca

SEQ ID NO: 7420444 - DNA, 22 bp, Homo sapiens
acacaacagaagagcaattgca

SEQ ID NO: 7420445 - DNA, 22 bp, Homo sapiens
acacaacagaagagcaattgca

SEQ ID NO: 7420446 - DNA, 22 bp, Homo sapiens
acacaacagaagagcaattgca

SEQ ID NO: 7420447 - DNA, 21 bp, Homo sapiens
acacaacaggcagtcattttc

SEQ ID NO: 7420448 - DNA, 21 bp, Homo sapiens
acacaacaggcagtcattttc

SEQ ID NO: 7420449 - DNA, 21 bp, Homo sapiens
acacaacaggcagtcattttc

SEQ ID NO: 7420450 - DNA, 21 bp, Homo sapiens
acacaacaggcagtcattttc

SEQ ID NO: 7420451 - DNA, 22 bp, Homo sapiens
acacaagaagttaatgggcaaa

SEQ ID NO: 7420452 - DNA, 22 bp, Homo sapiens
acacaagaagttaatgggcaaa

SEQ ID NO: 7420453 - DNA, 22 bp, Homo sapiens
acacaagaagttaatgggcaaa

SEQ ID NO: 7420454 - DNA, 22 bp, Homo sapiens
acacaagaataatgatgaaggt

SEQ ID NO: 7420455 - DNA, 22 bp, Homo sapiens
acacaagaataatgatgaaggt

SEQ ID NO: 7420456 - DNA, 22 bp, Homo sapiens
acacaagaagttaatgggcaaa

SEQ ID NO: 7420457 - DNA, 22 bp, Homo sapiens
acacaagaagttaatgggcaaa

SEQ ID NO: 7420458 - DNA, 22 bp, Homo sapiens
acacaaattgtaggataattgc

SEQ ID NO: 7420459 - DNA, 22 bp, Homo sapiens
acacaaattgtaggataattgc

SEQ ID NO: 7420460 - DNA, 22 bp, Homo sapiens
acacaaattgtaggataattgc

SEQ ID NO: 7420461 - DNA, 22 bp, Homo sapiens
acacaaattgtaggataattgc

SEQ ID NO: 7420462 - DNA, 22 bp, Homo sapiens
acacaaaatcaaagtcctaggc

SEQ ID NO: 7420463 - DNA, 22 bp, Homo sapiens
acacaaaatcaaagtcctaggc

SEQ ID NO: 7420464 - DNA, 22 bp, Homo sapiens
acacaaattgtaggataattgc

SEQ ID NO: 7420465 - DNA, 22 bp, Homo sapiens
acaatttttcaaagaagcttat

SEQ ID NO: 7420466 - DNA, 22 bp, Homo sapiens
acaattttccccataggttatc

SEQ ID NO: 7420467 - DNA, 22 bp, Homo sapiens
acaattttccccataggttatc

SEQ ID NO: 7420468 - DNA, 22 bp, Homo sapiens
agcacaggtaatacagagtaac

SEQ ID NO: 7420469 - DNA, 22 bp, Homo sapiens
agcacagggcccagcctaggcc

SEQ ID NO: 7420470 - DNA, 22 bp, Homo sapiens
agcacagggcccagcctaggcc

SEQ ID NO: 7420471 - DNA, 22 bp, Homo sapiens
agcacaggtaatacagagtaac

SEQ ID NO: 7420472 - DNA, 22 bp, Homo sapiens
agcacaggtaatacagagtaac

SEQ ID NO: 7420473 - DNA, 22 bp, Homo sapiens
agcacaggtaatacagagtaac

SEQ ID NO: 7420474 - DNA, 22 bp, Homo sapiens
agcacaggtaatacagagtaac

SEQ ID NO: 7420475 - DNA, 22 bp, Homo sapiens
agcacaggtaatacagagtaac

SEQ ID NO: 7420476 - DNA, 22 bp, Homo sapiens
agcacagggcccagcctaggcc

SEQ ID NO: 7420477 - DNA, 22 bp, Homo sapiens
agcacagggcccagcctaggcc

SEQ ID NO: 7420478 - DNA, 22 bp, Homo sapiens
agcacagggcccagcctaggcc

SEQ ID NO: 7420479 - DNA, 22 bp, Homo sapiens
agcacagggcccagcctaggcc

SEQ ID NO: 7420480 - DNA, 22 bp, Homo sapiens
agcacagggcccagcctaggcc

SEQ ID NO: 7420481 - DNA, 22 bp, Homo sapiens
agcacagggcccagcctaggcc

SEQ ID NO: 7420482 - DNA, 22 bp, Homo sapiens
agcacagggcccagcctaggcc

SEQ ID NO: 7420483 - DNA, 22 bp, Homo sapiens
agcacagggcccagcctaggcc

SEQ ID NO: 7420484 - DNA, 22 bp, Homo sapiens
agcacagggcccagcctaggcc

SEQ ID NO: 7420485 - DNA, 22 bp, Homo sapiens
agcacagggcccagcctaggcc

SEQ ID NO: 7420486 - DNA, 22 bp, Homo sapiens
agcacagggacaatgccaggtg

SEQ ID NO: 7420487 - DNA, 22 bp, Homo sapiens
agcacagggacaatgccaggtg

SEQ ID NO: 7420488 - DNA, 22 bp, Homo sapiens
agcacagggacaatgccaggtg

SEQ ID NO: 7420489 - DNA, 22 bp, Homo sapiens
agcacagggacaatgccaggtg

SEQ ID NO: 7420490 - DNA, 22 bp, Homo sapiens
agcacaggctttggtgtgaggg

SEQ ID NO: 7420491 - DNA, 22 bp, Homo sapiens
agcacagggacaatgccaggtg

SEQ ID NO: 7420492 - DNA, 22 bp, Homo sapiens
agcacagggacaatgccaggtg

SEQ ID NO: 7420493 - DNA, 22 bp, Homo sapiens
agcacagggacaatgccaggtg

SEQ ID NO: 7420494 - DNA, 22 bp, Homo sapiens
agcacaggacgtagagcttgga

SEQ ID NO: 7420495 - DNA, 22 bp, Homo sapiens
agcacaggacgtagagcttgga

SEQ ID NO: 7420496 - DNA, 22 bp, Homo sapiens
agcacaggacgtagagcttgga

SEQ ID NO: 7420497 - DNA, 22 bp, Homo sapiens
agcacaggctttggtgtgaggg

SEQ ID NO: 7420498 - DNA, 22 bp, Homo sapiens
agcacaggctttggtgtgaggg

SEQ ID NO: 7420499 - DNA, 22 bp, Homo sapiens
agcacaggctttggtgtgaggg

SEQ ID NO: 7420500 - DNA, 22 bp, Homo sapiens
agcacaggctttggtgtgaggg

SEQ ID NO: 7420501 - DNA, 22 bp, Homo sapiens
agcacaggctttggtgtgaggg

SEQ ID NO: 7420502 - DNA, 22 bp, Homo sapiens
agcacaggctttggtgtgaggg

SEQ ID NO: 7420503 - DNA, 22 bp, Homo sapiens
agcacaggctttggtgtgaggg

SEQ ID NO: 7420504 - DNA, 22 bp, Homo sapiens
agcacaggctttggtgtgaggg

SEQ ID NO: 7420505 - DNA, 22 bp, Homo sapiens
agcacaggacgtagagcttgga

SEQ ID NO: 7420506 - DNA, 22 bp, Homo sapiens
agcacaggacgtagagcttgga

SEQ ID NO: 7420507 - DNA, 22 bp, Homo sapiens
agcacaggacgtagagcttgga

SEQ ID NO: 7420508 - DNA, 22 bp, Homo sapiens
agcacaggacgtagagcttgga

SEQ ID NO: 7420509 - DNA, 22 bp, Homo sapiens
agcacaggacgtagagcttgga

SEQ ID NO: 7420510 - DNA, 22 bp, Homo sapiens
agcacaggaccaaggaagctgt

SEQ ID NO: 7420511 - DNA, 22 bp, Homo sapiens
agcacaggaccaaggaagctgt

SEQ ID NO: 7420512 - DNA, 22 bp, Homo sapiens
agcacaggaccaaggaagctgt

SEQ ID NO: 7420513 - DNA, 22 bp, Homo sapiens
agcacaggaccaaggaagctgt

SEQ ID NO: 7420514 - DNA, 18 bp, Homo sapiens
agattttgagaaatacaa

SEQ ID NO: 7420515 - DNA, 22 bp, Homo sapiens
acaacatttccatttccttggt

SEQ ID NO: 7420516 - DNA, 22 bp, Homo sapiens
agattttggctggctggagaga

SEQ ID NO: 7420517 - DNA, 22 bp, Homo sapiens
acaacatttccatttccttggt

SEQ ID NO: 7420518 - DNA, 18 bp, Homo sapiens
agattttgagaaatacaa

SEQ ID NO: 7420519 - DNA, 22 bp, Homo sapiens
agcaaaagatagattaacaaga

SEQ ID NO: 7420520 - DNA, 22 bp, Homo sapiens
agcaaaagatagattaacaaga

SEQ ID NO: 7420521 - DNA, 22 bp, Homo sapiens
agcaaaagatagattaacaaga

SEQ ID NO: 7420522 - DNA, 22 bp, Homo sapiens
agcaaaagatagattaacaaga

SEQ ID NO: 7420523 - DNA, 22 bp, Homo sapiens
agcaaaagatagattaacaaga

SEQ ID NO: 7420524 - DNA, 22 bp, Homo sapiens
agcaaaagatagattaacaaga

SEQ ID NO: 7420525 - DNA, 22 bp, Homo sapiens
acaacattcttaaatacactga

SEQ ID NO: 7420526 - DNA, 22 bp, Homo sapiens
acaacattcttaaatacactga

SEQ ID NO: 7420527 - DNA, 22 bp, Homo sapiens
acaacattcttaaatacactga

SEQ ID NO: 7420528 - DNA, 22 bp, Homo sapiens
acaacattcttaaatacactga

SEQ ID NO: 7420529 - DNA, 22 bp, Homo sapiens
acaacattatacatagaaagct

SEQ ID NO: 7420530 - DNA, 22 bp, Homo sapiens
acaacattcttaaatacactga

SEQ ID NO: 7420531 - DNA, 22 bp, Homo sapiens
acaacattcttaaatacactga

SEQ ID NO: 7420532 - DNA, 22 bp, Homo sapiens
acaacattcttaaatacactga

SEQ ID NO: 7420533 - DNA, 22 bp, Homo sapiens
acaacatttaaggaggcactga

SEQ ID NO: 7420534 - DNA, 22 bp, Homo sapiens
acaacattatacatagaaagct

SEQ ID NO: 7420535 - DNA, 22 bp, Homo sapiens
acaacattatacatagaaagct

SEQ ID NO: 7420536 - DNA, 22 bp, Homo sapiens
acaacattatacatagaaagct

SEQ ID NO: 7420537 - DNA, 22 bp, Homo sapiens
acaacattatacatagaaagct

SEQ ID NO: 7420538 - DNA, 22 bp, Homo sapiens
acaacatcagctgagaccttca

SEQ ID NO: 7420539 - DNA, 22 bp, Homo sapiens
acaacatcagctgagaccttca

SEQ ID NO: 7420540 - DNA, 22 bp, Homo sapiens
acaacattatacatagaaagct

SEQ ID NO: 7420541 - DNA, 22 bp, Homo sapiens
acaacattatacatagaaagct

SEQ ID NO: 7420542 - DNA, 22 bp, Homo sapiens
acaacattatacatagaaagct

SEQ ID NO: 7420543 - DNA, 22 bp, Homo sapiens
acaacattatacatagaaagct

SEQ ID NO: 7420544 - DNA, 22 bp, Homo sapiens
acaacattatacatagaaagct

SEQ ID NO: 7420545 - DNA, 22 bp, Homo sapiens
acaacagtccagtatagactgt

SEQ ID NO: 7420546 - DNA, 22 bp, Homo sapiens
acaacagtttaggtatttgtag

SEQ ID NO: 7420547 - DNA, 22 bp, Homo sapiens
acaacagtttaggtatttgtag

SEQ ID NO: 7420548 - DNA, 22 bp, Homo sapiens
acaacagtgtggtggaaggagc

SEQ ID NO: 7420549 - DNA, 22 bp, Homo sapiens
acaacagtccagtatagactgt

SEQ ID NO: 7420550 - DNA, 22 bp, Homo sapiens
acaacagtaggaaaacatgtct

SEQ ID NO: 7420551 - DNA, 22 bp, Homo sapiens
acaacagtccagtatagactgt

SEQ ID NO: 7420552 - DNA, 22 bp, Homo sapiens
acaacagtccagtatagactgt

SEQ ID NO: 7420553 - DNA, 22 bp, Homo sapiens
agcaaagtagctgctgttctta

SEQ ID NO: 7420554 - DNA, 22 bp, Homo sapiens
agcaaagcttccataaagcagc

SEQ ID NO: 7420555 - DNA, 21 bp, Homo sapiens
agcaaaggcaggagaggtttc

SEQ ID NO: 7420556 - DNA, 21 bp, Homo sapiens
agcaaaggcaggagaggtttc

SEQ ID NO: 7420557 - DNA, 22 bp, Homo sapiens
agcaaagctgattaagagcaca

SEQ ID NO: 7420558 - DNA, 22 bp, Homo sapiens
agcaaagcttccataaagcagc

SEQ ID NO: 7420559 - DNA, 22 bp, Homo sapiens
agcaaagctgctcccttttgtc

SEQ ID NO: 7420560 - DNA, 22 bp, Homo sapiens
agcaaagctgctcccttttgtc

SEQ ID NO: 7420561 - DNA, 22 bp, Homo sapiens
agcaaagtccagtctgtgtaca

SEQ ID NO: 7420562 - DNA, 22 bp, Homo sapiens
agcaaagtccagtctgtgtaca

SEQ ID NO: 7420563 - DNA, 22 bp, Homo sapiens
agcaaagtggctttccaaacca

SEQ ID NO: 7420564 - DNA, 22 bp, Homo sapiens
agcaaagtggctttccaaacca

SEQ ID NO: 7420565 - DNA, 22 bp, Homo sapiens
agcaaagtggctttccaaacca

SEQ ID NO: 7420566 - DNA, 22 bp, Homo sapiens
agcaaagtggctttccaaacca

SEQ ID NO: 7420567 - DNA, 22 bp, Homo sapiens
agcaaagttaaggtttctcttt

SEQ ID NO: 7420568 - DNA, 22 bp, Homo sapiens
agcaaagtcagtggaaccatcc

SEQ ID NO: 7420569 - DNA, 22 bp, Homo sapiens
agcaaagtatgtgctgggagct

SEQ ID NO: 7420570 - DNA, 22 bp, Homo sapiens
agcaaagtcagtggaaccatcc

SEQ ID NO: 7420571 - DNA, 22 bp, Homo sapiens
agcaaataattgtctttgaggg

SEQ ID NO: 7420572 - DNA, 22 bp, Homo sapiens
agcaaataattgtctttgaggg

SEQ ID NO: 7420573 - DNA, 19 bp, Homo sapiens
agcaaatacatcaaaattg

SEQ ID NO: 7420574 - DNA, 19 bp, Homo sapiens
agcaaatacatcaaaattg

SEQ ID NO: 7420575 - DNA, 19 bp, Homo sapiens
agcaaatacatcaaaattg

SEQ ID NO: 7420576 - DNA, 19 bp, Homo sapiens
agcaaatacatcaaaattg

SEQ ID NO: 7420577 - DNA, 19 bp, Homo sapiens
agcaaatacatcaaaattg

SEQ ID NO: 7420578 - DNA, 19 bp, Homo sapiens
agcaaatacatcaaaattg

SEQ ID NO: 7420579 - DNA, 22 bp, Homo sapiens
agcaaatacatttttagcataa

SEQ ID NO: 7420580 - DNA, 22 bp, Homo sapiens
agcaaatacatttttagcataa

SEQ ID NO: 7420581 - DNA, 22 bp, Homo sapiens
agcaaatacatttttagcataa

SEQ ID NO: 7420582 - DNA, 22 bp, Homo sapiens
agcaaatacatttttagcataa

SEQ ID NO: 7420583 - DNA, 22 bp, Homo sapiens
agcaaataaagacaattatgtc

SEQ ID NO: 7420584 - DNA, 22 bp, Homo sapiens
agcaaataaagacaattatgtc

SEQ ID NO: 7420585 - DNA, 22 bp, Homo sapiens
agcaaataaagacaattatgtc

SEQ ID NO: 7420586 - DNA, 22 bp, Homo sapiens
agcaaataaagacaattatgtc

SEQ ID NO: 7420587 - DNA, 22 bp, Homo sapiens
agcaaataaagacaattatgtc

SEQ ID NO: 7420588 - DNA, 22 bp, Homo sapiens
agcaaataaagacaattatgtc

SEQ ID NO: 7420589 - DNA, 22 bp, Homo sapiens
agcaaataaagacaattatgtc

SEQ ID NO: 7420590 - DNA, 22 bp, Homo sapiens
agcaaataaagacaattatgtc

SEQ ID NO: 7420591 - DNA, 22 bp, Homo sapiens
agcaaataattgtctttgaggg

SEQ ID NO: 7420592 - DNA, 22 bp, Homo sapiens
agcaaataattgtctttgaggg

SEQ ID NO: 7420593 - DNA, 23 bp, Homo sapiens
agcaaataatctgcttgcttttt

SEQ ID NO: 7420594 - DNA, 19 bp, Homo sapiens
agcaaatataatagtgttc

SEQ ID NO: 7420595 - DNA, 18 bp, Homo sapiens
agcaaatattaagtgcat

SEQ ID NO: 7420596 - DNA, 18 bp, Homo sapiens
agcaaatattaagtgcat

SEQ ID NO: 7420597 - DNA, 22 bp, Homo sapiens
agcaaatattttgttgaagtgc

SEQ ID NO: 7420598 - DNA, 22 bp, Homo sapiens
acaagtttcattgtttagaacc

SEQ ID NO: 7420599 - DNA, 19 bp, Homo sapiens
acaataactcattgattgc

SEQ ID NO: 7420600 - DNA, 19 bp, Homo sapiens
acaataactcattgattgc

SEQ ID NO: 7420601 - DNA, 19 bp, Homo sapiens
acaataactcattgattgc

SEQ ID NO: 7420602 - DNA, 22 bp, Homo sapiens
acaataacttctgtttccttgc

SEQ ID NO: 7420603 - DNA, 22 bp, Homo sapiens
acaagtttttgatagactagaa

SEQ ID NO: 7420604 - DNA, 22 bp, Homo sapiens
acaataacttctgtttccttgc

SEQ ID NO: 7420605 - DNA, 22 bp, Homo sapiens
acaataacttctgtttccttgc

SEQ ID NO: 7420606 - DNA, 22 bp, Homo sapiens
acaagttttggaagtcttaagg

SEQ ID NO: 7420607 - DNA, 22 bp, Homo sapiens
acaagtttttgatagactagaa

SEQ ID NO: 7420608 - DNA, 22 bp, Homo sapiens
acaagtttttgatagactagaa

SEQ ID NO: 7420609 - DNA, 22 bp, Homo sapiens
acaagttttggaagtcttaagg

SEQ ID NO: 7420610 - DNA, 22 bp, Homo sapiens
acaagtttcattgtttagaacc

SEQ ID NO: 7420611 - DNA, 22 bp, Homo sapiens
acaagttttggaagtcttaagg

SEQ ID NO: 7420612 - DNA, 22 bp, Homo sapiens
acaagttttggaagtcttaagg

SEQ ID NO: 7420613 - DNA, 22 bp, Homo sapiens
agcaaatacatttttagcataa

SEQ ID NO: 7420614 - DNA, 22 bp, Homo sapiens
agcaaataccaaaggctgatgt

SEQ ID NO: 7420615 - DNA, 22 bp, Homo sapiens
agcaaatacatttttagcataa

SEQ ID NO: 7420616 - DNA, 22 bp, Homo sapiens
agcaaatacttgaataaaaaga

SEQ ID NO: 7420617 - DNA, 22 bp, Homo sapiens
agcaaatacttgaataaaaaga

SEQ ID NO: 7420618 - DNA, 22 bp, Homo sapiens
agcaaatacttgaataaaaaga

SEQ ID NO: 7420619 - DNA, 22 bp, Homo sapiens
agcaaatacttgaataaaaaga

SEQ ID NO: 7420620 - DNA, 22 bp, Homo sapiens
agcaaatacttgaataaaaaga

SEQ ID NO: 7420621 - DNA, 19 bp, Homo sapiens
agcaaatataatagtgttc

SEQ ID NO: 7420622 - DNA, 19 bp, Homo sapiens
agcaaatataatagtgttc

SEQ ID NO: 7420623 - DNA, 22 bp, Homo sapiens
agcaaatacttttcactgagcc

SEQ ID NO: 7420624 - DNA, 22 bp, Homo sapiens
agcaaatacttttcactgagcc

SEQ ID NO: 7420625 - DNA, 22 bp, Homo sapiens
agcaaatacttgaataaaaaga

SEQ ID NO: 7420626 - DNA, 22 bp, Homo sapiens
agcaaatacttgaataaaaaga

SEQ ID NO: 7420627 - DNA, 22 bp, Homo sapiens
agcaaatacttgaataaaaaga

SEQ ID NO: 7420628 - DNA, 22 bp, Homo sapiens
agcaaggcagtcagctggctgg

SEQ ID NO: 7420629 - DNA, 22 bp, Homo sapiens
acaatagaaggaaactgacata

SEQ ID NO: 7420630 - DNA, 22 bp, Homo sapiens
acaatagaaggaaactgacata

SEQ ID NO: 7420631 - DNA, 22 bp, Homo sapiens
acaatagaaggaaactgacata

SEQ ID NO: 7420632 - DNA, 22 bp, Homo sapiens
acaatagaaataattaagcaca

SEQ ID NO: 7420633 - DNA, 22 bp, Homo sapiens
acaatagaaataattaagcaca

SEQ ID NO: 7420634 - DNA, 22 bp, Homo sapiens
acaatagaaataattaagcaca

SEQ ID NO: 7420635 - DNA, 22 bp, Homo sapiens
acaatagaaataattaagcaca

SEQ ID NO: 7420636 - DNA, 22 bp, Homo sapiens
acaatacttaccaatgtttttg

SEQ ID NO: 7420637 - DNA, 22 bp, Homo sapiens
acaatacttaccaatgtttttg

SEQ ID NO: 7420638 - DNA, 22 bp, Homo sapiens
acaatacttaccaatgtttttg

SEQ ID NO: 7420639 - DNA, 22 bp, Homo sapiens
acaatactcatgctctttttct

SEQ ID NO: 7420640 - DNA, 22 bp, Homo sapiens
acaatactcatgctctttttct

SEQ ID NO: 7420641 - DNA, 22 bp, Homo sapiens
acaatacttaccaatgtttttg

SEQ ID NO: 7420642 - DNA, 19 bp, Homo sapiens
acaatagaaaagtcttttg

SEQ ID NO: 7420643 - DNA, 22 bp, Homo sapiens
acaatagaaataattaagcaca

SEQ ID NO: 7420644 - DNA, 22 bp, Homo sapiens
acaatagaaataattaagcaca

SEQ ID NO: 7420645 - DNA, 22 bp, Homo sapiens
acaatagaaataattaagcaca

SEQ ID NO: 7420646 - DNA, 20 bp, Homo sapiens
acaatacaggttgtgtctga

SEQ ID NO: 7420647 - DNA, 22 bp, Homo sapiens
acaatactagccaaggttatta

SEQ ID NO: 7420648 - DNA, 20 bp, Homo sapiens
acaatacaggttgtgtctga

SEQ ID NO: 7420649 - DNA, 20 bp, Homo sapiens
acaatacaggttgtgtctga

SEQ ID NO: 7420650 - DNA, 22 bp, Homo sapiens
acaatactattttcagtatcct

SEQ ID NO: 7420651 - DNA, 22 bp, Homo sapiens
acaatactattttcagtatcct

SEQ ID NO: 7420652 - DNA, 22 bp, Homo sapiens
acaatacaggcttctggactta

SEQ ID NO: 7420653 - DNA, 22 bp, Homo sapiens
acaatacaggcttctggactta

SEQ ID NO: 7420654 - DNA, 20 bp, Homo sapiens
acaatacaggttgtgtctga

SEQ ID NO: 7420655 - DNA, 20 bp, Homo sapiens
acaatacaggttgtgtctga

SEQ ID NO: 7420656 - DNA, 22 bp, Homo sapiens
acaatacaggcttctggactta

SEQ ID NO: 7420657 - DNA, 22 bp, Homo sapiens
acaataatgtattgccaaaagt

SEQ ID NO: 7420658 - DNA, 22 bp, Homo sapiens
acaataatgtattgccaaaagt

SEQ ID NO: 7420659 - DNA, 22 bp, Homo sapiens
acaataatgtattgccaaaagt

SEQ ID NO: 7420660 - DNA, 22 bp, Homo sapiens
acaataagtattgggcttttga

SEQ ID NO: 7420661 - DNA, 22 bp, Homo sapiens
acaataaggatttttaggggca

SEQ ID NO: 7420662 - DNA, 22 bp, Homo sapiens
acaataagtattgggcttttga

SEQ ID NO: 7420663 - DNA, 22 bp, Homo sapiens
agagaaggcatagaacttgagt

SEQ ID NO: 7420664 - DNA, 22 bp, Homo sapiens
agagaaggcatagaacttgagt

SEQ ID NO: 7420665 - DNA, 22 bp, Homo sapiens
agagaaggcatagaacttgagt

SEQ ID NO: 7420666 - DNA, 22 bp, Homo sapiens
agagaaggcatagaacttgagt

SEQ ID NO: 7420667 - DNA, 19 bp, Homo sapiens
agagaaggatcctatggtt

SEQ ID NO: 7420668 - DNA, 22 bp, Homo sapiens
agagaaattctcagtggaagat

SEQ ID NO: 7420669 - DNA, 22 bp, Homo sapiens
agagaaatttccctgccttctg

SEQ ID NO: 7420670 - DNA, 22 bp, Homo sapiens
agagaaatttccctgccttctg

SEQ ID NO: 7420671 - DNA, 22 bp, Homo sapiens
agagaaatttccctgccttctg

SEQ ID NO: 7420672 - DNA, 22 bp, Homo sapiens
agagaaatttccctgccttctg

SEQ ID NO: 7420673 - DNA, 22 bp, Homo sapiens
agagaaggcatagaacttgagt

SEQ ID NO: 7420674 - DNA, 19 bp, Homo sapiens
agagaaggatcctatggtt

SEQ ID NO: 7420675 - DNA, 22 bp, Homo sapiens
aatgtattcctcatgcaagagt

SEQ ID NO: 7420676 - DNA, 22 bp, Homo sapiens
aatgtattcctcatgcaagagt

SEQ ID NO: 7420677 - DNA, 22 bp, Homo sapiens
aatgtattcctcatgcaagagt

SEQ ID NO: 7420678 - DNA, 22 bp, Homo sapiens
agagaaatgattcctgggcaga

SEQ ID NO: 7420679 - DNA, 22 bp, Homo sapiens
agagaaatggggtaatctttca

SEQ ID NO: 7420680 - DNA, 22 bp, Homo sapiens
agagaaatgattcctgggcaga

SEQ ID NO: 7420681 - DNA, 22 bp, Homo sapiens
agagaaatggggtaatctttca

SEQ ID NO: 7420682 - DNA, 22 bp, Homo sapiens
agagaaattctcagtggaagat

SEQ ID NO: 7420683 - DNA, 22 bp, Homo sapiens
agagaaattctcagtggaagat

SEQ ID NO: 7420684 - DNA, 22 bp, Homo sapiens
agagaaattctcagtggaagat

SEQ ID NO: 7420685 - DNA, 22 bp, Homo sapiens
agagaaattctcagtggaagat

SEQ ID NO: 7420686 - DNA, 21 bp, Homo sapiens
agagaagggactcttccagtc

SEQ ID NO: 7420687 - DNA, 22 bp, Homo sapiens
agagaagggaagggattcaccc

SEQ ID NO: 7420688 - DNA, 22 bp, Homo sapiens
agagaagggaagggattcaccc

SEQ ID NO: 7420689 - DNA, 21 bp, Homo sapiens
agagaagggactcttccagtc

SEQ ID NO: 7420690 - DNA, 21 bp, Homo sapiens
agagaagggactcttccagtc

SEQ ID NO: 7420691 - DNA, 21 bp, Homo sapiens
agagaagggactcttccagtc

SEQ ID NO: 7420692 - DNA, 21 bp, Homo sapiens
agagaagggactcttccagtc

SEQ ID NO: 7420693 - DNA, 21 bp, Homo sapiens
agagaagggactcttccagtc

SEQ ID NO: 7420694 - DNA, 21 bp, Homo sapiens
agagaagggattccaggccct

SEQ ID NO: 7420695 - DNA, 21 bp, Homo sapiens
agagaagggattccaggccct

SEQ ID NO: 7420696 - DNA, 21 bp, Homo sapiens
agagaagggattccaggccct

SEQ ID NO: 7420697 - DNA, 21 bp, Homo sapiens
agagaagggattccaggccct

SEQ ID NO: 7420698 - DNA, 21 bp, Homo sapiens
agagaagggattccaggccct

SEQ ID NO: 7420699 - DNA, 21 bp, Homo sapiens
agagaagggattccaggccct

SEQ ID NO: 7420700 - DNA, 22 bp, Homo sapiens
agagaagggcctgtatgtaatc

SEQ ID NO: 7420701 - DNA, 22 bp, Homo sapiens
agagaagggcctgtatgtaatc

SEQ ID NO: 7420702 - DNA, 21 bp, Homo sapiens
agagaagggattccaggccct

SEQ ID NO: 7420703 - DNA, 21 bp, Homo sapiens
agagaagggattccaggccct

SEQ ID NO: 7420704 - DNA, 22 bp, Homo sapiens
aatgtgtactttttcatgctca

SEQ ID NO: 7420705 - DNA, 22 bp, Homo sapiens
aatgtgtagatgttgcattcct

SEQ ID NO: 7420706 - DNA, 22 bp, Homo sapiens
aatgtgtactttttcatgctca

SEQ ID NO: 7420707 - DNA, 22 bp, Homo sapiens
aatgtgtacatgacagatagaa

SEQ ID NO: 7420708 - DNA, 22 bp, Homo sapiens
aatgtgtacatgacagatagaa

SEQ ID NO: 7420709 - DNA, 22 bp, Homo sapiens
agagaaggggtaaagagtcctg

SEQ ID NO: 7420710 - DNA, 22 bp, Homo sapiens
agagaaggggtaaagagtcctg

SEQ ID NO: 7420711 - DNA, 22 bp, Homo sapiens
agagaaggggtaaagagtcctg

SEQ ID NO: 7420712 - DNA, 22 bp, Homo sapiens
agagaaggggtaaagagtcctg

SEQ ID NO: 7420713 - DNA, 22 bp, Homo sapiens
agagaaggggtaaagagtcctg

SEQ ID NO: 7420714 - DNA, 22 bp, Homo sapiens
aatgtgtagcatttaatgcagt

SEQ ID NO: 7420715 - DNA, 22 bp, Homo sapiens
aatgtgtagcatttaatgcagt

SEQ ID NO: 7420716 - DNA, 22 bp, Homo sapiens
aatgtgtagatgttgcattcct

SEQ ID NO: 7420717 - DNA, 22 bp, Homo sapiens
aatgtgtagcagaaccaggatt

SEQ ID NO: 7420718 - DNA, 22 bp, Homo sapiens
aatgtgtagcatttaatgcagt

SEQ ID NO: 7420719 - DNA, 22 bp, Homo sapiens
aatgtgtagtcattgatcaaga

SEQ ID NO: 7420720 - DNA, 22 bp, Homo sapiens
aatgtgtagtcattgatcaaga

SEQ ID NO: 7420721 - DNA, 22 bp, Homo sapiens
aatgtgtagggtgcctgttttt

SEQ ID NO: 7420722 - DNA, 22 bp, Homo sapiens
aatgtgtagcatttaatgcagt

SEQ ID NO: 7420723 - DNA, 22 bp, Homo sapiens
agagaagggggaaagatctcac

SEQ ID NO: 7420724 - DNA, 22 bp, Homo sapiens
agagaagggggaaagatctcac

SEQ ID NO: 7420725 - DNA, 22 bp, Homo sapiens
agagaagggggaaagatctcac

SEQ ID NO: 7420726 - DNA, 22 bp, Homo sapiens
agagaagggggaaagatctcac

SEQ ID NO: 7420727 - DNA, 22 bp, Homo sapiens
agagaagggcctgtatgtaatc

SEQ ID NO: 7420728 - DNA, 22 bp, Homo sapiens
agagaagggcctgtatgtaatc

SEQ ID NO: 7420729 - DNA, 22 bp, Homo sapiens
agagaagggcctgtatgtaatc

SEQ ID NO: 7420730 - DNA, 22 bp, Homo sapiens
agagaaggggtaaagagtcctg

SEQ ID NO: 7420731 - DNA, 22 bp, Homo sapiens
agagaaggggtaaagagtcctg

SEQ ID NO: 7420732 - DNA, 22 bp, Homo sapiens
agagaaggggtaaagagtcctg

SEQ ID NO: 7420733 - DNA, 22 bp, Homo sapiens
agagaaggggtaaagagtcctg

SEQ ID NO: 7420734 - DNA, 22 bp, Homo sapiens
agagaaggggtaaagagtcctg

SEQ ID NO: 7420735 - DNA, 22 bp, Homo sapiens
agagaaggggtaaagagtcctg

SEQ ID NO: 7420736 - DNA, 22 bp, Homo sapiens
agagaagggggaaagatctcac

SEQ ID NO: 7420737 - DNA, 22 bp, Homo sapiens
agagaagggggaaagatctcac

SEQ ID NO: 7420738 - DNA, 22 bp, Homo sapiens
agagcaaagggacatggaagag

SEQ ID NO: 7420739 - DNA, 22 bp, Homo sapiens
agagcaaagggacatggaagag

SEQ ID NO: 7420740 - DNA, 22 bp, Homo sapiens
agagatttgtcaatgatttcca

SEQ ID NO: 7420741 - DNA, 22 bp, Homo sapiens
agagatttgtcaatgatttcca

SEQ ID NO: 7420742 - DNA, 22 bp, Homo sapiens
agagatttctactgcactcttt

SEQ ID NO: 7420743 - DNA, 22 bp, Homo sapiens
agagatgaaaagtggagactgg

SEQ ID NO: 7420744 - DNA, 22 bp, Homo sapiens
agagatttgtcaatgatttcca

SEQ ID NO: 7420745 - DNA, 22 bp, Homo sapiens
agagatttgtcaatgatttcca

SEQ ID NO: 7420746 - DNA, 22 bp, Homo sapiens
agagcaaatagagaagccagct

SEQ ID NO: 7420747 - DNA, 22 bp, Homo sapiens
agagcaaatagagaagccagct

SEQ ID NO: 7420748 - DNA, 22 bp, Homo sapiens
agagcaaatagagaagccagct

SEQ ID NO: 7420749 - DNA, 22 bp, Homo sapiens
agagcaaagggacatggaagag

SEQ ID NO: 7420750 - DNA, 22 bp, Homo sapiens
agagcaaagggacatggaagag

SEQ ID NO: 7420751 - DNA, 22 bp, Homo sapiens
agagcaaatagagaagccagct

SEQ ID NO: 7420752 - DNA, 22 bp, Homo sapiens
agagcaaatagagaagccagct

SEQ ID NO: 7420753 - DNA, 22 bp, Homo sapiens
agagcaaagggacatggaagag

SEQ ID NO: 7420754 - DNA, 22 bp, Homo sapiens
agagcaaatagagaagccagct

SEQ ID NO: 7420755 - DNA, 22 bp, Homo sapiens
agagcaacagagaaatttaggt

SEQ ID NO: 7420756 - DNA, 23 bp, Homo sapiens
agagcaaggaaatgaggtgtgat

SEQ ID NO: 7420757 - DNA, 23 bp, Homo sapiens
agagcaaggaaatgaggtgtgat

SEQ ID NO: 7420758 - DNA, 22 bp, Homo sapiens
agagcaatggcatccagctgat

SEQ ID NO: 7420759 - DNA, 22 bp, Homo sapiens
agagcaattagcttaggtaaaa

SEQ ID NO: 7420760 - DNA, 21 bp, Homo sapiens
agagcaagttaaggcattaat

SEQ ID NO: 7420761 - DNA, 22 bp, Homo sapiens
agagcaagtgacagaaacaggg

SEQ ID NO: 7420762 - DNA, 21 bp, Homo sapiens
agagcaagttaaggcattaat

SEQ ID NO: 7420763 - DNA, 22 bp, Homo sapiens
agagcaatggcatccagctgat

SEQ ID NO: 7420764 - DNA, 22 bp, Homo sapiens
agagcaatttcttctccaagtt

SEQ ID NO: 7420765 - DNA, 22 bp, Homo sapiens
agagcaattagcttaggtaaaa

SEQ ID NO: 7420766 - DNA, 22 bp, Homo sapiens
agagcacaaattagttggtctt

SEQ ID NO: 7420767 - DNA, 23 bp, Homo sapiens
agagcaaggaaatgaggtgtgat

SEQ ID NO: 7420768 - DNA, 22 bp, Homo sapiens
agagcaagtgacagaaacaggg

SEQ ID NO: 7420769 - DNA, 22 bp, Homo sapiens
agagcaagtgacagaaacaggg

SEQ ID NO: 7420770 - DNA, 23 bp, Homo sapiens
agagcaaggaaatgaggtgtgat

SEQ ID NO: 7420771 - DNA, 23 bp, Homo sapiens
agagcaaggaaatgaggtgtgat

SEQ ID NO: 7420772 - DNA, 22 bp, Homo sapiens
agagcaagtgacagaaacaggg

SEQ ID NO: 7420773 - DNA, 22 bp, Homo sapiens
agagcaagtgacagaaacaggg

SEQ ID NO: 7420774 - DNA, 22 bp, Homo sapiens
agagcaagtgacagaaacaggg

SEQ ID NO: 7420775 - DNA, 22 bp, Homo sapiens
agagcaagtgacagaaacaggg

SEQ ID NO: 7420776 - DNA, 22 bp, Homo sapiens
agagcaagtgacagaaacaggg

SEQ ID NO: 7420777 - DNA, 22 bp, Homo sapiens
aatgtgtataagggagagctaa

SEQ ID NO: 7420778 - DNA, 22 bp, Homo sapiens
aatgtgtatactggcaattaag

SEQ ID NO: 7420779 - DNA, 22 bp, Homo sapiens
aatgtgtatatgaacatacagg

SEQ ID NO: 7420780 - DNA, 22 bp, Homo sapiens
aatgtgtatatgaacatacagg

SEQ ID NO: 7420781 - DNA, 22 bp, Homo sapiens
aatgtgtatactggcaattaag

SEQ ID NO: 7420782 - DNA, 22 bp, Homo sapiens
aatgtgtatactggcaattaag

SEQ ID NO: 7420783 - DNA, 22 bp, Homo sapiens
aatgtgtatgaggaagagagaa

SEQ ID NO: 7420784 - DNA, 22 bp, Homo sapiens
aatgtgtatgaggaagagagaa

SEQ ID NO: 7420785 - DNA, 22 bp, Homo sapiens
aatgtgtatatgaacatacagg

SEQ ID NO: 7420786 - DNA, 22 bp, Homo sapiens
aatgtgtatgaggaagagagaa

SEQ ID NO: 7420787 - DNA, 22 bp, Homo sapiens
aatgtgtcatttcccacaggtg

SEQ ID NO: 7420788 - DNA, 22 bp, Homo sapiens
agagatgaaaagtggagactgg

SEQ ID NO: 7420789 - DNA, 22 bp, Homo sapiens
agagatgaaaagggtactgagg

SEQ ID NO: 7420790 - DNA, 22 bp, Homo sapiens
aatgtgttactgtgtaagagca

SEQ ID NO: 7420791 - DNA, 22 bp, Homo sapiens
agagatctgtggattcattgtc

SEQ ID NO: 7420792 - DNA, 21 bp, Homo sapiens
aatgtgtgctatttatctttt

SEQ ID NO: 7420793 - DNA, 22 bp, Homo sapiens
aatgtgtgtatttctaggcgag

SEQ ID NO: 7420794 - DNA, 22 bp, Homo sapiens
aatgtgtgttcggggcccagag

SEQ ID NO: 7420795 - DNA, 22 bp, Homo sapiens
aatgtgtcccttatttcacagg

SEQ ID NO: 7420796 - DNA, 22 bp, Homo sapiens
aatgtgtgaacactaatgcaac

SEQ ID NO: 7420797 - DNA, 22 bp, Homo sapiens
aatgtgtgaattgagagaagag

SEQ ID NO: 7420798 - DNA, 22 bp, Homo sapiens
aatgtgtgaattgagagaagag

SEQ ID NO: 7420799 - DNA, 22 bp, Homo sapiens
aatgtattatacataatttgtg

SEQ ID NO: 7420800 - DNA, 22 bp, Homo sapiens
aatgtattatacataatttgtg

SEQ ID NO: 7420801 - DNA, 21 bp, Homo sapiens
aatgtatgtttatctcacagt

SEQ ID NO: 7420802 - DNA, 22 bp, Homo sapiens
aatgtattatacataatttgtg

SEQ ID NO: 7420803 - DNA, 22 bp, Homo sapiens
aatgtattatacataatttgtg

SEQ ID NO: 7420804 - DNA, 22 bp, Homo sapiens
aatgtattatacataatttgtg

SEQ ID NO: 7420805 - DNA, 22 bp, Homo sapiens
aatgtattatacataatttgtg

SEQ ID NO: 7420806 - DNA, 21 bp, Homo sapiens
aatgtatgtttatctcacagt

SEQ ID NO: 7420807 - DNA, 21 bp, Homo sapiens
aatgtatgtttatctcacagt

SEQ ID NO: 7420808 - DNA, 21 bp, Homo sapiens
aatgtatgtttatctcacagt

SEQ ID NO: 7420809 - DNA, 23 bp, Homo sapiens
aatgtatgttagtatcttagaga

SEQ ID NO: 7420810 - DNA, 22 bp, Homo sapiens
aatgtatgtgtatatcaaatca

SEQ ID NO: 7420811 - DNA, 22 bp, Homo sapiens
aatgtatgtgcatcatttacat

SEQ ID NO: 7420812 - DNA, 22 bp, Homo sapiens
aatgtatgtgattattcctcta

SEQ ID NO: 7420813 - DNA, 22 bp, Homo sapiens
aatgtatgtgattattcctcta

SEQ ID NO: 7420814 - DNA, 22 bp, Homo sapiens
aatgtatgtgcatcatttacat

SEQ ID NO: 7420815 - DNA, 22 bp, Homo sapiens
aatgtatgtgtatatcaaatca

SEQ ID NO: 7420816 - DNA, 23 bp, Homo sapiens
aatgtatgttagtatcttagaga

SEQ ID NO: 7420817 - DNA, 23 bp, Homo sapiens
aatgtatgttagtatcttagaga

SEQ ID NO: 7420818 - DNA, 22 bp, Homo sapiens
aatgtatgaaggttccagtttc

SEQ ID NO: 7420819 - DNA, 22 bp, Homo sapiens
aatgtatgaaggttccagtttc

SEQ ID NO: 7420820 - DNA, 22 bp, Homo sapiens
aatgtatgacagttctagtggt

SEQ ID NO: 7420821 - DNA, 22 bp, Homo sapiens
aatgtatgacagttctagtggt

SEQ ID NO: 7420822 - DNA, 22 bp, Homo sapiens
aatgtatgagcgtgaaagcact

SEQ ID NO: 7420823 - DNA, 22 bp, Homo sapiens
aatgtatgagcgtgaaagcact

SEQ ID NO: 7420824 - DNA, 22 bp, Homo sapiens
aatgtatgagcgtgaaagcact

SEQ ID NO: 7420825 - DNA, 22 bp, Homo sapiens
aatgtatggattcatgtctgtg

SEQ ID NO: 7420826 - DNA, 22 bp, Homo sapiens
aatgtatggattcatgtctgtg

SEQ ID NO: 7420827 - DNA, 22 bp, Homo sapiens
aatgtatgctgtggtatcttct

SEQ ID NO: 7420828 - DNA, 22 bp, Homo sapiens
aatgtatgctgtggtatcttct

SEQ ID NO: 7420829 - DNA, 20 bp, Homo sapiens
aatgtatattttatgccagg

SEQ ID NO: 7420830 - DNA, 20 bp, Homo sapiens
aatgtatattttatgccagg

SEQ ID NO: 7420831 - DNA, 20 bp, Homo sapiens
aatgtatatgtgaccccaaa

SEQ ID NO: 7420832 - DNA, 22 bp, Homo sapiens
aatgtataatatttaatgcttt

SEQ ID NO: 7420833 - DNA, 20 bp, Homo sapiens
aatgtatattttatgccagg

SEQ ID NO: 7420834 - DNA, 20 bp, Homo sapiens
aatgtatattttatgccagg

SEQ ID NO: 7420835 - DNA, 20 bp, Homo sapiens
aatgtatattttatgccagg

SEQ ID NO: 7420836 - DNA, 20 bp, Homo sapiens
aatgtatattttatgccagg

SEQ ID NO: 7420837 - DNA, 20 bp, Homo sapiens
aatgtatattttatgccagg

SEQ ID NO: 7420838 - DNA, 22 bp, Homo sapiens
aatgtatgaaggttccagtttc

SEQ ID NO: 7420839 - DNA, 22 bp, Homo sapiens
agacatttatgtttctctagga

SEQ ID NO: 7420840 - DNA, 22 bp, Homo sapiens
agacatttagacccctgtagtt

SEQ ID NO: 7420841 - DNA, 22 bp, Homo sapiens
agacattggctaaaagtagtgt

SEQ ID NO: 7420842 - DNA, 22 bp, Homo sapiens
agacatttattcacacatttat

SEQ ID NO: 7420843 - DNA, 22 bp, Homo sapiens
agacatttattcacacatttat

SEQ ID NO: 7420844 - DNA, 22 bp, Homo sapiens
agacatttattcacacatttat

SEQ ID NO: 7420845 - DNA, 22 bp, Homo sapiens
agacatttattcacacatttat

SEQ ID NO: 7420846 - DNA, 22 bp, Homo sapiens
agacatttatgtttctctagga

SEQ ID NO: 7420847 - DNA, 22 bp, Homo sapiens
aatgtataatatttaatgcttt

SEQ ID NO: 7420848 - DNA, 22 bp, Homo sapiens
aatgtataaccataggaaattt

SEQ ID NO: 7420849 - DNA, 22 bp, Homo sapiens
aatgtataaccataggaaattt

SEQ ID NO: 7420850 - DNA, 22 bp, Homo sapiens
aatgtataatatttaatgcttt

SEQ ID NO: 7420851 - DNA, 22 bp, Homo sapiens
aatgtataatatttaatgcttt

SEQ ID NO: 7420852 - DNA, 22 bp, Homo sapiens
aatgtataatatttaatgcttt

SEQ ID NO: 7420853 - DNA, 22 bp, Homo sapiens
agacatggtttattttaatggt

SEQ ID NO: 7420854 - DNA, 22 bp, Homo sapiens
agacatggtttattttaatggt

SEQ ID NO: 7420855 - DNA, 20 bp, Homo sapiens
agacatggtagtgattcagg

SEQ ID NO: 7420856 - DNA, 22 bp, Homo sapiens
agacatggttgagaataaagtg

SEQ ID NO: 7420857 - DNA, 23 bp, Homo sapiens
agacatggcaggaatacagcttc

SEQ ID NO: 7420858 - DNA, 22 bp, Homo sapiens
agacatggatttcttacataaa

SEQ ID NO: 7420859 - DNA, 22 bp, Homo sapiens
agacatggagaaggagccagtg

SEQ ID NO: 7420860 - DNA, 22 bp, Homo sapiens
agacatggagaaggagccagtg

SEQ ID NO: 7420861 - DNA, 22 bp, Homo sapiens
agacatggagaaggagccagtg

SEQ ID NO: 7420862 - DNA, 22 bp, Homo sapiens
agacatggagaaggagccagtg

SEQ ID NO: 7420863 - DNA, 22 bp, Homo sapiens
agacatgcaataatgtgcactc

SEQ ID NO: 7420864 - DNA, 22 bp, Homo sapiens
agacatggagaaggagccagtg

SEQ ID NO: 7420865 - DNA, 22 bp, Homo sapiens
agacatgtccacaaagcattca

SEQ ID NO: 7420866 - DNA, 22 bp, Homo sapiens
agacatgtccacaaagcattca

SEQ ID NO: 7420867 - DNA, 21 bp, Homo sapiens
agacatgtgaactaaaggtga

SEQ ID NO: 7420868 - DNA, 23 bp, Homo sapiens
agacatggcaggaatacagcttc

SEQ ID NO: 7420869 - DNA, 22 bp, Homo sapiens
agacattatgctgagtgaaaga

SEQ ID NO: 7420870 - DNA, 22 bp, Homo sapiens
agacattatgctgagtgaaaga

SEQ ID NO: 7420871 - DNA, 22 bp, Homo sapiens
agacattatgctgagtgaaaga

SEQ ID NO: 7420872 - DNA, 22 bp, Homo sapiens
agacatgtggtataatcagggg

SEQ ID NO: 7420873 - DNA, 22 bp, Homo sapiens
aatgctctttaacctattctga

SEQ ID NO: 7420874 - DNA, 22 bp, Homo sapiens
aatgctctttgaatttgtcaga

SEQ ID NO: 7420875 - DNA, 22 bp, Homo sapiens
aatgctctttgaatttgtcaga

SEQ ID NO: 7420876 - DNA, 22 bp, Homo sapiens
aatgctctttaacctattctga

SEQ ID NO: 7420877 - DNA, 22 bp, Homo sapiens
aatgctctgtctctgacagtgg

SEQ ID NO: 7420878 - DNA, 22 bp, Homo sapiens
aatgctctctgccatagctaac

SEQ ID NO: 7420879 - DNA, 22 bp, Homo sapiens
aatgctctctgccatagctaac

SEQ ID NO: 7420880 - DNA, 22 bp, Homo sapiens
aatgctcaaaatgtttcatcta

SEQ ID NO: 7420881 - DNA, 22 bp, Homo sapiens
aatgctcaaaatgtttcatcta

SEQ ID NO: 7420882 - DNA, 22 bp, Homo sapiens
aatgctctctgccatagctaac

SEQ ID NO: 7420883 - DNA, 17 bp, Homo sapiens
aatgctccaacctgaag

SEQ ID NO: 7420884 - DNA, 22 bp, Homo sapiens
aatgctattcattaagcctact

SEQ ID NO: 7420885 - DNA, 18 bp, Homo sapiens
aatgctattgttataggg

SEQ ID NO: 7420886 - DNA, 22 bp, Homo sapiens
aatgctatcggctctaagcatg

SEQ ID NO: 7420887 - DNA, 22 bp, Homo sapiens
aatgctagtgtgatatgtaagg

SEQ ID NO: 7420888 - DNA, 22 bp, Homo sapiens
aatgctagtgtgatatgtaagg

SEQ ID NO: 7420889 - DNA, 22 bp, Homo sapiens
aatgctacagaagtgatcttgg

SEQ ID NO: 7420890 - DNA, 22 bp, Homo sapiens
aatgctaaaatggcactaaagt

SEQ ID NO: 7420891 - DNA, 22 bp, Homo sapiens
aatgctaacattggtttatatc

SEQ ID NO: 7420892 - DNA, 22 bp, Homo sapiens
aatgctaacattggtttatatc

SEQ ID NO: 7420893 - DNA, 22 bp, Homo sapiens
aatgccttggagagcctagagg

SEQ ID NO: 7420894 - DNA, 22 bp, Homo sapiens
aatgccttggagagcctagagg

SEQ ID NO: 7420895 - DNA, 22 bp, Homo sapiens
aatgccttggagagcctagagg

SEQ ID NO: 7420896 - DNA, 22 bp, Homo sapiens
aatgccttgcctgctacaactt

SEQ ID NO: 7420897 - DNA, 22 bp, Homo sapiens
aatgccttgcctgctacaactt

SEQ ID NO: 7420898 - DNA, 22 bp, Homo sapiens
aatgccttggagagcctagagg

SEQ ID NO: 7420899 - DNA, 22 bp, Homo sapiens
aatgccttggagagcctagagg

SEQ ID NO: 7420900 - DNA, 22 bp, Homo sapiens
aatgccttggagagcctagagg

SEQ ID NO: 7420901 - DNA, 22 bp, Homo sapiens
aatgccttggagagcctagagg

SEQ ID NO: 7420902 - DNA, 22 bp, Homo sapiens
aatgctaaatgtgttatgttaa

SEQ ID NO: 7420903 - DNA, 22 bp, Homo sapiens
aatgctaaatgtgttatgttaa

SEQ ID NO: 7420904 - DNA, 22 bp, Homo sapiens
aatgctaacattggtttatatc

SEQ ID NO: 7420905 - DNA, 22 bp, Homo sapiens
aatgctaaaatggcactaaagt

SEQ ID NO: 7420906 - DNA, 22 bp, Homo sapiens
aatgcgtattgagcatctacta

SEQ ID NO: 7420907 - DNA, 22 bp, Homo sapiens
aatgctaaaacacagatttttg

SEQ ID NO: 7420908 - DNA, 22 bp, Homo sapiens
aatgcctttccactgggtatca

SEQ ID NO: 7420909 - DNA, 22 bp, Homo sapiens
aatgccttggagagcctagagg

SEQ ID NO: 7420910 - DNA, 22 bp, Homo sapiens
aatgccttggagagcctagagg

SEQ ID NO: 7420911 - DNA, 22 bp, Homo sapiens
aatgccttggagagcctagagg

SEQ ID NO: 7420912 - DNA, 22 bp, Homo sapiens
aatgccttggagagcctagagg

SEQ ID NO: 7420913 - DNA, 22 bp, Homo sapiens
agacatgacagatagttgctag

SEQ ID NO: 7420914 - DNA, 22 bp, Homo sapiens
agacatcttgcacacatatact

SEQ ID NO: 7420915 - DNA, 22 bp, Homo sapiens
agacatcttgcacacatatact

SEQ ID NO: 7420916 - DNA, 22 bp, Homo sapiens
agacatctcccatgcattttta

SEQ ID NO: 7420917 - DNA, 22 bp, Homo sapiens
agacatctctatgcaggatctc

SEQ ID NO: 7420918 - DNA, 22 bp, Homo sapiens
agacatctctatgcaggatctc

SEQ ID NO: 7420919 - DNA, 22 bp, Homo sapiens
agacatctgtcaggggttctta

SEQ ID NO: 7420920 - DNA, 22 bp, Homo sapiens
agacatcttgcacacatatact

SEQ ID NO: 7420921 - DNA, 22 bp, Homo sapiens
agacatgcattgcaatatccat

SEQ ID NO: 7420922 - DNA, 22 bp, Homo sapiens
agacatgccaagaaacccagtg

SEQ ID NO: 7420923 - DNA, 22 bp, Homo sapiens
agacatgccaagaaacccagtg

SEQ ID NO: 7420924 - DNA, 19 bp, Homo sapiens
agacatgagacacaggatg

SEQ ID NO: 7420925 - DNA, 22 bp, Homo sapiens
agacatggagaaggagccagtg

SEQ ID NO: 7420926 - DNA, 22 bp, Homo sapiens
agacatgcttggaggagaagga

SEQ ID NO: 7420927 - DNA, 22 bp, Homo sapiens
agacatgagaaacccaccagag

SEQ ID NO: 7420928 - DNA, 19 bp, Homo sapiens
agacatgagacacaggatg

SEQ ID NO: 7420929 - DNA, 22 bp, Homo sapiens
agacatgagaaacccaccagag

SEQ ID NO: 7420930 - DNA, 20 bp, Homo sapiens
aatgctgcttctttttgcat

SEQ ID NO: 7420931 - DNA, 22 bp, Homo sapiens
aatgctgagggatgagagaggc

SEQ ID NO: 7420932 - DNA, 22 bp, Homo sapiens
aatgctgagtcctgtgagtctt

SEQ ID NO: 7420933 - DNA, 22 bp, Homo sapiens
aatgctgcaagaggtgaaaaga

SEQ ID NO: 7420934 - DNA, 22 bp, Homo sapiens
aatgctgctctcataattatag

SEQ ID NO: 7420935 - DNA, 22 bp, Homo sapiens
agacaggtaaatagagatgctg

SEQ ID NO: 7420936 - DNA, 22 bp, Homo sapiens
agacatcagcttgtgtgcaggg

SEQ ID NO: 7420937 - DNA, 22 bp, Homo sapiens
agacatcctgtgtgcgtgagta

SEQ ID NO: 7420938 - DNA, 22 bp, Homo sapiens
agacatctacctttcattcaaa

SEQ ID NO: 7420939 - DNA, 22 bp, Homo sapiens
agacatctacctttcattcaaa

SEQ ID NO: 7420940 - DNA, 22 bp, Homo sapiens
agacatcatgttacagattaag

SEQ ID NO: 7420941 - DNA, 23 bp, Homo sapiens
agacatcaggatggtggctggga

SEQ ID NO: 7420942 - DNA, 22 bp, Homo sapiens
agaggatgattttaaggacact

SEQ ID NO: 7420943 - DNA, 22 bp, Homo sapiens
agaggatgattttaaggacact

SEQ ID NO: 7420944 - DNA, 22 bp, Homo sapiens
agaggatgattttaaggacact

SEQ ID NO: 7420945 - DNA, 22 bp, Homo sapiens
agaggatgattttaaggacact

SEQ ID NO: 7420946 - DNA, 22 bp, Homo sapiens
agaggatgattttaaggacact

SEQ ID NO: 7420947 - DNA, 22 bp, Homo sapiens
agaggatggttgaggaagacct

SEQ ID NO: 7420948 - DNA, 22 bp, Homo sapiens
agaggagtgggaagcagtgcaa

SEQ ID NO: 7420949 - DNA, 22 bp, Homo sapiens
agaggagtgggaagcagtgcaa

SEQ ID NO: 7420950 - DNA, 22 bp, Homo sapiens
agaggagtattttctaagggaa

SEQ ID NO: 7420951 - DNA, 22 bp, Homo sapiens
agaggagtgggaagcagtgcaa

SEQ ID NO: 7420952 - DNA, 22 bp, Homo sapiens
agaggagtgggaagcagtgcaa

SEQ ID NO: 7420953 - DNA, 22 bp, Homo sapiens
agaggatgattttaaggacact

SEQ ID NO: 7420954 - DNA, 22 bp, Homo sapiens
agaggatgattttaaggacact

SEQ ID NO: 7420955 - DNA, 22 bp, Homo sapiens
agaggatcctaagaagatatga

SEQ ID NO: 7420956 - DNA, 22 bp, Homo sapiens
agaggatcctaagaagatatga

SEQ ID NO: 7420957 - DNA, 22 bp, Homo sapiens
agaggatctaagtgagtcctca

SEQ ID NO: 7420958 - DNA, 22 bp, Homo sapiens
agaggatcatctagtttgactc

SEQ ID NO: 7420959 - DNA, 22 bp, Homo sapiens
agaggatcatctagtttgactc

SEQ ID NO: 7420960 - DNA, 22 bp, Homo sapiens
agaggagtttgctggtgtgtgc

SEQ ID NO: 7420961 - DNA, 22 bp, Homo sapiens
agaggagtttgctggtgtgtgc

SEQ ID NO: 7420962 - DNA, 22 bp, Homo sapiens
agaggaggtggtgatgctttaa

SEQ ID NO: 7420963 - DNA, 22 bp, Homo sapiens
agaggaggtggtgatgctttaa

SEQ ID NO: 7420964 - DNA, 22 bp, Homo sapiens
agaggaggtggtgatgctttaa

SEQ ID NO: 7420965 - DNA, 22 bp, Homo sapiens
agaggaggtggtgatgctttaa

SEQ ID NO: 7420966 - DNA, 22 bp, Homo sapiens
agaggaggtggtgatgctttaa

SEQ ID NO: 7420967 - DNA, 22 bp, Homo sapiens
agaggaggtggtgatgctttaa

SEQ ID NO: 7420968 - DNA, 22 bp, Homo sapiens
agaggaggtccttttctgatgt

SEQ ID NO: 7420969 - DNA, 22 bp, Homo sapiens
agaggaggtccttttctgatgt

SEQ ID NO: 7420970 - DNA, 22 bp, Homo sapiens
agaggaggtccttttctgatgt

SEQ ID NO: 7420971 - DNA, 22 bp, Homo sapiens
agaggacaaaatgagaagtgct

SEQ ID NO: 7420972 - DNA, 22 bp, Homo sapiens
agaggacaaaatgagaagtgct

SEQ ID NO: 7420973 - DNA, 22 bp, Homo sapiens
agaggacaaaatgagaagtgct

SEQ ID NO: 7420974 - DNA, 22 bp, Homo sapiens
agaggaatttctggaaggaggc

SEQ ID NO: 7420975 - DNA, 22 bp, Homo sapiens
agaggatggttgaggaagacct

SEQ ID NO: 7420976 - DNA, 22 bp, Homo sapiens
agaggatggttgaggaagacct

SEQ ID NO: 7420977 - DNA, 22 bp, Homo sapiens
agaggatgttctaggcactcat

SEQ ID NO: 7420978 - DNA, 22 bp, Homo sapiens
agaggattatattttcaacaag

SEQ ID NO: 7420979 - DNA, 22 bp, Homo sapiens
agaggatgttctaggcactcat

SEQ ID NO: 7420980 - DNA, 22 bp, Homo sapiens
agaggattgttactgattagct

SEQ ID NO: 7420981 - DNA, 22 bp, Homo sapiens
agaggattgatcaaacactgca

SEQ ID NO: 7420982 - DNA, 22 bp, Homo sapiens
agaggattgaaggatttgttga

SEQ ID NO: 7420983 - DNA, 22 bp, Homo sapiens
agaggattgaaggatttgttga

SEQ ID NO: 7420984 - DNA, 22 bp, Homo sapiens
agaggattcttagaattctgag

SEQ ID NO: 7420985 - DNA, 22 bp, Homo sapiens
agaggattcactgcagaagaca

SEQ ID NO: 7420986 - DNA, 22 bp, Homo sapiens
agaggcaacatggggaacagat

SEQ ID NO: 7420987 - DNA, 22 bp, Homo sapiens
agaggcaacatggggaacagat

SEQ ID NO: 7420988 - DNA, 22 bp, Homo sapiens
aatttcaattacttttgcacca

SEQ ID NO: 7420989 - DNA, 22 bp, Homo sapiens
aatttcaattacttttgcacca

SEQ ID NO: 7420990 - DNA, 22 bp, Homo sapiens
aatttcaattacttttgcacca

SEQ ID NO: 7420991 - DNA, 22 bp, Homo sapiens
aatttcaattacttttgcacca

SEQ ID NO: 7420992 - DNA, 22 bp, Homo sapiens
agaggattttaacttatgcaac

SEQ ID NO: 7420993 - DNA, 22 bp, Homo sapiens
agaggcaaaaatctatggcaac

SEQ ID NO: 7420994 - DNA, 22 bp, Homo sapiens
agaggattttaaaagcatatgt

SEQ ID NO: 7420995 - DNA, 22 bp, Homo sapiens
agaggattttaaaagcatatgt

SEQ ID NO: 7420996 - DNA, 22 bp, Homo sapiens
agaggattgttactgattagct

SEQ ID NO: 7420997 - DNA, 18 bp, Homo sapiens
aatttccatatgaattgc

SEQ ID NO: 7420998 - DNA, 18 bp, Homo sapiens
aatttccatatgaattgc

SEQ ID NO: 7420999 - DNA, 18 bp, Homo sapiens
aatttccatatgaattgc

SEQ ID NO: 7421000 - DNA, 22 bp, Homo sapiens
aatttcacagtgaactttgagg

SEQ ID NO: 7421001 - DNA, 22 bp, Homo sapiens
aatttcacagtgaactttgagg

SEQ ID NO: 7421002 - DNA, 22 bp, Homo sapiens
aatttcacagctggtctatggg

SEQ ID NO: 7421003 - DNA, 22 bp, Homo sapiens
aatttcctgggataaaaagcca

SEQ ID NO: 7421004 - DNA, 23 bp, Homo sapiens
aatttcccctgtctctgatttgg

SEQ ID NO: 7421005 - DNA, 22 bp, Homo sapiens
aatttcggttcaaggcccagtt

SEQ ID NO: 7421006 - DNA, 18 bp, Homo sapiens
aatttccatatgaattgc

SEQ ID NO: 7421007 - DNA, 22 bp, Homo sapiens
aatttcctgggataaaaagcca

SEQ ID NO: 7421008 - DNA, 22 bp, Homo sapiens
agaggaatatgggtgcactaga

SEQ ID NO: 7421009 - DNA, 22 bp, Homo sapiens
agaggaataaatttctgtagtg

SEQ ID NO: 7421010 - DNA, 21 bp, Homo sapiens
agaggaagtgattggtctggc

SEQ ID NO: 7421011 - DNA, 21 bp, Homo sapiens
agaggaagtgattggtctggc

SEQ ID NO: 7421012 - DNA, 21 bp, Homo sapiens
agaggaagtgattggtctggc

SEQ ID NO: 7421013 - DNA, 21 bp, Homo sapiens
agaggaagtgattggtctggc

SEQ ID NO: 7421014 - DNA, 21 bp, Homo sapiens
agaggaagtgattggtctggc

SEQ ID NO: 7421015 - DNA, 22 bp, Homo sapiens
agaggaatttctggaaggaggc

SEQ ID NO: 7421016 - DNA, 22 bp, Homo sapiens
agaggaatggagactaaacgct

SEQ ID NO: 7421017 - DNA, 22 bp, Homo sapiens
agaggaatttctggaaggaggc

SEQ ID NO: 7421018 - DNA, 22 bp, Homo sapiens
agaggaataaatttctgtagtg

SEQ ID NO: 7421019 - DNA, 22 bp, Homo sapiens
agaggaatctgtctagacacaa

SEQ ID NO: 7421020 - DNA, 22 bp, Homo sapiens
agaggaatctgtctagacacaa

SEQ ID NO: 7421021 - DNA, 22 bp, Homo sapiens
agaggaatgtatttccctgcaa

SEQ ID NO: 7421022 - DNA, 22 bp, Homo sapiens
agaggaatgtatttccctgcaa

SEQ ID NO: 7421023 - DNA, 22 bp, Homo sapiens
agaggaagtaatcaggacctgc

SEQ ID NO: 7421024 - DNA, 22 bp, Homo sapiens
agaggaagtaatcaggacctgc

SEQ ID NO: 7421025 - DNA, 22 bp, Homo sapiens
agaggaagtaatcaggacctgc

SEQ ID NO: 7421026 - DNA, 21 bp, Homo sapiens
agaggaagtgattggtctggc

SEQ ID NO: 7421027 - DNA, 21 bp, Homo sapiens
agaggaagtgattggtctggc

SEQ ID NO: 7421028 - DNA, 21 bp, Homo sapiens
agaggaagtgattggtctggc

SEQ ID NO: 7421029 - DNA, 21 bp, Homo sapiens
agaggaagtgattggtctggc

SEQ ID NO: 7421030 - DNA, 21 bp, Homo sapiens
agaggaagtgattggtctggc

SEQ ID NO: 7421031 - DNA, 22 bp, Homo sapiens
agaggaagtaatcaggacctgc

SEQ ID NO: 7421032 - DNA, 22 bp, Homo sapiens
agaggaagtaatcaggacctgc

SEQ ID NO: 7421033 - DNA, 22 bp, Homo sapiens
agaggaagtaatcaggacctgc

SEQ ID NO: 7421034 - DNA, 22 bp, Homo sapiens
agaggaagtaatcaggacctgc

SEQ ID NO: 7421035 - DNA, 22 bp, Homo sapiens
agaggaagtaatcaggacctgc

SEQ ID NO: 7421036 - DNA, 22 bp, Homo sapiens
agaggaagtaatcaggacctgc

SEQ ID NO: 7421037 - DNA, 22 bp, Homo sapiens
agaggaagtaatcaggacctgc

SEQ ID NO: 7421038 - DNA, 22 bp, Homo sapiens
agaggaagtaatcaggacctgc

SEQ ID NO: 7421039 - DNA, 22 bp, Homo sapiens
agaggaagtaatcaggacctgc

SEQ ID NO: 7421040 - DNA, 22 bp, Homo sapiens
agaggaagtaatcaggacctgc

SEQ ID NO: 7421041 - DNA, 22 bp, Homo sapiens
agaggaagtaatcaggacctgc

SEQ ID NO: 7421042 - DNA, 22 bp, Homo sapiens
agaggaagtaatcaggacctgc

SEQ ID NO: 7421043 - DNA, 22 bp, Homo sapiens
agaggaagtaatcaggacctgc

SEQ ID NO: 7421044 - DNA, 22 bp, Homo sapiens
agaggaagtaatcaggacctgc

SEQ ID NO: 7421045 - DNA, 22 bp, Homo sapiens
agaggaagtaatcaggacctgc

SEQ ID NO: 7421046 - DNA, 22 bp, Homo sapiens
agaggaagtaatcaggacctgc

SEQ ID NO: 7421047 - DNA, 22 bp, Homo sapiens
agaggaagtaatcaggacctgc

SEQ ID NO: 7421048 - DNA, 22 bp, Homo sapiens
aattccagaggaggacagtcct

SEQ ID NO: 7421049 - DNA, 22 bp, Homo sapiens
aattccagaggaggacagtcct

SEQ ID NO: 7421050 - DNA, 22 bp, Homo sapiens
aattccagaccacaagtgattt

SEQ ID NO: 7421051 - DNA, 20 bp, Homo sapiens
aattccagcatgatatttat

SEQ ID NO: 7421052 - DNA, 22 bp, Homo sapiens
aattccagaggaggacagtcct

SEQ ID NO: 7421053 - DNA, 20 bp, Homo sapiens
aattccagcatgatatttat

SEQ ID NO: 7421054 - DNA, 22 bp, Homo sapiens
aattccagcctcagttctatta

SEQ ID NO: 7421055 - DNA, 22 bp, Homo sapiens
aattccagctacttggaaggtt

SEQ ID NO: 7421056 - DNA, 22 bp, Homo sapiens
aattccagctacttggaaggtt

SEQ ID NO: 7421057 - DNA, 22 bp, Homo sapiens
aattccagaccacaagtgattt

SEQ ID NO: 7421058 - DNA, 22 bp, Homo sapiens
aattccacagctgcacagaggt

SEQ ID NO: 7421059 - DNA, 22 bp, Homo sapiens
aattccacagatgtctatctgt

SEQ ID NO: 7421060 - DNA, 22 bp, Homo sapiens
aattccaacagacaaagttaga

SEQ ID NO: 7421061 - DNA, 22 bp, Homo sapiens
aattccaacagacaaagttaga

SEQ ID NO: 7421062 - DNA, 22 bp, Homo sapiens
aattccaacagacaaagttaga

SEQ ID NO: 7421063 - DNA, 22 bp, Homo sapiens
aattccaagagcttcctaagtg

SEQ ID NO: 7421064 - DNA, 22 bp, Homo sapiens
aattccaagagcttcctaagtg

SEQ ID NO: 7421065 - DNA, 22 bp, Homo sapiens
aattccaagagcttcctaagtg

SEQ ID NO: 7421066 - DNA, 22 bp, Homo sapiens
aattccacaaaaggttctcttc

SEQ ID NO: 7421067 - DNA, 22 bp, Homo sapiens
aattccaagtagcatcccatca

SEQ ID NO: 7421068 - DNA, 18 bp, Homo sapiens
aattccaagccataggag

SEQ ID NO: 7421069 - DNA, 22 bp, Homo sapiens
aattccaagtagcatcccatca

SEQ ID NO: 7421070 - DNA, 22 bp, Homo sapiens
aattccaagtagcatcccatca

SEQ ID NO: 7421071 - DNA, 18 bp, Homo sapiens
aattccaagccataggag

SEQ ID NO: 7421072 - DNA, 22 bp, Homo sapiens
aattccaagagcttcctaagtg

SEQ ID NO: 7421073 - DNA, 22 bp, Homo sapiens
agagctgggtggtggtgactca

SEQ ID NO: 7421074 - DNA, 22 bp, Homo sapiens
agagctgggtggtggtgactca

SEQ ID NO: 7421075 - DNA, 22 bp, Homo sapiens
agagctgggtggtggtgactca

SEQ ID NO: 7421076 - DNA, 22 bp, Homo sapiens
agagctgggtggtggtgactca

SEQ ID NO: 7421077 - DNA, 22 bp, Homo sapiens
aattccaggatgcaggaggtgc

SEQ ID NO: 7421078 - DNA, 22 bp, Homo sapiens
aattccaggatgcaggaggtgc

SEQ ID NO: 7421079 - DNA, 22 bp, Homo sapiens
aattccagctgattgactttcc

SEQ ID NO: 7421080 - DNA, 22 bp, Homo sapiens
aattccagctaggaaaagcttc

SEQ ID NO: 7421081 - DNA, 22 bp, Homo sapiens
aattccagctgattgactttcc

SEQ ID NO: 7421082 - DNA, 22 bp, Homo sapiens
agaggaaggatgcatatccaaa

SEQ ID NO: 7421083 - DNA, 22 bp, Homo sapiens
agaggaaggatgcatatccaaa

SEQ ID NO: 7421084 - DNA, 22 bp, Homo sapiens
agaggaaggatgcatatccaaa

SEQ ID NO: 7421085 - DNA, 21 bp, Homo sapiens
agagctggtaggtaggtaggt

SEQ ID NO: 7421086 - DNA, 21 bp, Homo sapiens
agagctggtaggtaggtaggt

SEQ ID NO: 7421087 - DNA, 21 bp, Homo sapiens
agagctggtaggtaggtaggt

SEQ ID NO: 7421088 - DNA, 22 bp, Homo sapiens
agaggaagtaatcaggacctgc

SEQ ID NO: 7421089 - DNA, 22 bp, Homo sapiens
agaggaaggatgcatatccaaa

SEQ ID NO: 7421090 - DNA, 22 bp, Homo sapiens
agaggaaggatgcatatccaaa

SEQ ID NO: 7421091 - DNA, 22 bp, Homo sapiens
agaggaaggatgcatatccaaa

SEQ ID NO: 7421092 - DNA, 22 bp, Homo sapiens
agaggaaggatgcatatccaaa

SEQ ID NO: 7421093 - DNA, 22 bp, Homo sapiens
aattcattgccagaatctatga

SEQ ID NO: 7421094 - DNA, 22 bp, Homo sapiens
aattcattgccagaatctatga

SEQ ID NO: 7421095 - DNA, 22 bp, Homo sapiens
aattcattgccagaatctatga

SEQ ID NO: 7421096 - DNA, 22 bp, Homo sapiens
aattcattgccagaatctatga

SEQ ID NO: 7421097 - DNA, 22 bp, Homo sapiens
aattccaaatcaactagtctag

SEQ ID NO: 7421098 - DNA, 22 bp, Homo sapiens
aattcattgccagaatctatga

SEQ ID NO: 7421099 - DNA, 22 bp, Homo sapiens
aattccaaatcaactagtctag

SEQ ID NO: 7421100 - DNA, 22 bp, Homo sapiens
aattccaacagacaaagttaga

SEQ ID NO: 7421101 - DNA, 22 bp, Homo sapiens
aattccaaatgttttcaatcca

SEQ ID NO: 7421102 - DNA, 22 bp, Homo sapiens
aattccaaatcaactagtctag

SEQ ID NO: 7421103 - DNA, 22 bp, Homo sapiens
aattcatgagtagaatctatat

SEQ ID NO: 7421104 - DNA, 22 bp, Homo sapiens
aattcattgccagaatctatga

SEQ ID NO: 7421105 - DNA, 22 bp, Homo sapiens
aattcattaagaaagagctaaa

SEQ ID NO: 7421106 - DNA, 22 bp, Homo sapiens
aattcatccatgaacaattcca

SEQ ID NO: 7421107 - DNA, 22 bp, Homo sapiens
aattcatccatgaacaattcca

SEQ ID NO: 7421108 - DNA, 22 bp, Homo sapiens
aattcatgagtagaatctatat

SEQ ID NO: 7421109 - DNA, 22 bp, Homo sapiens
aattcatccatgaacaattcca

SEQ ID NO: 7421110 - DNA, 22 bp, Homo sapiens
aattcatcattttatagctagt

SEQ ID NO: 7421111 - DNA, 22 bp, Homo sapiens
aattcatcattttatagctagt

SEQ ID NO: 7421112 - DNA, 22 bp, Homo sapiens
agagctggaaaagttgttttaa

SEQ ID NO: 7421113 - DNA, 22 bp, Homo sapiens
agagctgctcagatgtcactgc

SEQ ID NO: 7421114 - DNA, 22 bp, Homo sapiens
agagctgctcagatgtcactgc

SEQ ID NO: 7421115 - DNA, 22 bp, Homo sapiens
agagctgctcagatgtcactgc

SEQ ID NO: 7421116 - DNA, 22 bp, Homo sapiens
agagctggaagctgctcttaga

SEQ ID NO: 7421117 - DNA, 22 bp, Homo sapiens
agagctggaaaagttgttttaa

SEQ ID NO: 7421118 - DNA, 22 bp, Homo sapiens
agagctggaagctgctcttaga

SEQ ID NO: 7421119 - DNA, 22 bp, Homo sapiens
agagctggaatcagacctcagg

SEQ ID NO: 7421120 - DNA, 22 bp, Homo sapiens
agagctggaatcagacctcagg

SEQ ID NO: 7421121 - DNA, 22 bp, Homo sapiens
agagctggaatcagacctcagg

SEQ ID NO: 7421122 - DNA, 22 bp, Homo sapiens
agagctggaatcagacctcagg

SEQ ID NO: 7421123 - DNA, 22 bp, Homo sapiens
agagctggaagctgctcttaga

SEQ ID NO: 7421124 - DNA, 22 bp, Homo sapiens
agagctggaagctgctcttaga

SEQ ID NO: 7421125 - DNA, 22 bp, Homo sapiens
agagctggaagctgctcttaga

SEQ ID NO: 7421126 - DNA, 22 bp, Homo sapiens
aattcatagcaacaaagaccca

SEQ ID NO: 7421127 - DNA, 22 bp, Homo sapiens
aattcatagcaacaaagaccca

SEQ ID NO: 7421128 - DNA, 22 bp, Homo sapiens
aattcatatggatatgctagta

SEQ ID NO: 7421129 - DNA, 22 bp, Homo sapiens
aattcatatggatatgctagta

SEQ ID NO: 7421130 - DNA, 22 bp, Homo sapiens
aattcatagcaacaaagaccca

SEQ ID NO: 7421131 - DNA, 22 bp, Homo sapiens
aattcatagcaacaaagaccca

SEQ ID NO: 7421132 - DNA, 22 bp, Homo sapiens
aattcatatggatatgctagta

SEQ ID NO: 7421133 - DNA, 22 bp, Homo sapiens
aattcatatggatatgctagta

SEQ ID NO: 7421134 - DNA, 22 bp, Homo sapiens
agagctgcccacacagcagatt

SEQ ID NO: 7421135 - DNA, 22 bp, Homo sapiens
agagctgccctgccagttctaa

SEQ ID NO: 7421136 - DNA, 22 bp, Homo sapiens
agagctgccctgccagttctaa

SEQ ID NO: 7421137 - DNA, 22 bp, Homo sapiens
agagctgcccacacagcagatt

SEQ ID NO: 7421138 - DNA, 22 bp, Homo sapiens
agagctgccgagctggggccat

SEQ ID NO: 7421139 - DNA, 22 bp, Homo sapiens
agagctgcacctatgcagacct

SEQ ID NO: 7421140 - DNA, 22 bp, Homo sapiens
agagctgcaatttcatgtggtg

SEQ ID NO: 7421141 - DNA, 22 bp, Homo sapiens
agagctgcagggtggacccagg

SEQ ID NO: 7421142 - DNA, 22 bp, Homo sapiens
agagctgagcaccaagcatggt

SEQ ID NO: 7421143 - DNA, 22 bp, Homo sapiens
agagctgaggatccagctgagc

SEQ ID NO: 7421144 - DNA, 22 bp, Homo sapiens
agagctgaggatccagctgagc

SEQ ID NO: 7421145 - DNA, 22 bp, Homo sapiens
agagctgagcaccaagcatggt

SEQ ID NO: 7421146 - DNA, 22 bp, Homo sapiens
agagctgaggatccagctgagc

SEQ ID NO: 7421147 - DNA, 22 bp, Homo sapiens
agagctgaggatccagctgagc

SEQ ID NO: 7421148 - DNA, 22 bp, Homo sapiens
agagctgagcaccaagcatggt

SEQ ID NO: 7421149 - DNA, 22 bp, Homo sapiens
agagctgaggatccagctgagc

SEQ ID NO: 7421150 - DNA, 22 bp, Homo sapiens
agagctgcaatttcatgtggtg

SEQ ID NO: 7421151 - DNA, 22 bp, Homo sapiens
agagctgcaacttcataggcct

SEQ ID NO: 7421152 - DNA, 22 bp, Homo sapiens
agagctgcaatttcatgtggtg

SEQ ID NO: 7421153 - DNA, 22 bp, Homo sapiens
agagctgcaacttcataggcct

SEQ ID NO: 7421154 - DNA, 22 bp, Homo sapiens
agagctgcaacttcataggcct

SEQ ID NO: 7421155 - DNA, 22 bp, Homo sapiens
agagctgaggatccagctgagc

SEQ ID NO: 7421156 - DNA, 22 bp, Homo sapiens
agagctgatttgattacagtgc

SEQ ID NO: 7421157 - DNA, 22 bp, Homo sapiens
aattaacagagggcttattact

SEQ ID NO: 7421158 - DNA, 22 bp, Homo sapiens
agagcacagaagaataggtgct

SEQ ID NO: 7421159 - DNA, 22 bp, Homo sapiens
aattaactaaaattcactttat

SEQ ID NO: 7421160 - DNA, 22 bp, Homo sapiens
aattaactaatttggtacaaga

SEQ ID NO: 7421161 - DNA, 22 bp, Homo sapiens
aattaactaaaattcactttat

SEQ ID NO: 7421162 - DNA, 22 bp, Homo sapiens
aattaactaatttggtacaaga

SEQ ID NO: 7421163 - DNA, 22 bp, Homo sapiens
agagcacagcagatctctgatg

SEQ ID NO: 7421164 - DNA, 22 bp, Homo sapiens
agagcacagcagatctctgatg

SEQ ID NO: 7421165 - DNA, 22 bp, Homo sapiens
agagcacagccaccatttacaa

SEQ ID NO: 7421166 - DNA, 22 bp, Homo sapiens
agagcacagaagttatatgtta

SEQ ID NO: 7421167 - DNA, 22 bp, Homo sapiens
agagcaatttcttctccaagtt

SEQ ID NO: 7421168 - DNA, 22 bp, Homo sapiens
agagcacagaagaataggtgct

SEQ ID NO: 7421169 - DNA, 22 bp, Homo sapiens
agagcacactgacgtcagtctg

SEQ ID NO: 7421170 - DNA, 22 bp, Homo sapiens
agagcacactgacgtcagtctg

SEQ ID NO: 7421171 - DNA, 22 bp, Homo sapiens
agagcacactgacgtcagtctg

SEQ ID NO: 7421172 - DNA, 22 bp, Homo sapiens
agagcacaaattttaaggaggc

SEQ ID NO: 7421173 - DNA, 22 bp, Homo sapiens
agagcacaaattttaaggaggc

SEQ ID NO: 7421174 - DNA, 22 bp, Homo sapiens
agagcacaaattagttggtctt

SEQ ID NO: 7421175 - DNA, 22 bp, Homo sapiens
aattaatatttgtggaattaat

SEQ ID NO: 7421176 - DNA, 22 bp, Homo sapiens
aattaatatttgtggaattaat

SEQ ID NO: 7421177 - DNA, 22 bp, Homo sapiens
aattaatatttgtggaattaat

SEQ ID NO: 7421178 - DNA, 22 bp, Homo sapiens
aattaatatttgtggaattaat

SEQ ID NO: 7421179 - DNA, 22 bp, Homo sapiens
aattaatatttgtggaattaat

SEQ ID NO: 7421180 - DNA, 22 bp, Homo sapiens
aattaatggaaagtaaggaagg

SEQ ID NO: 7421181 - DNA, 22 bp, Homo sapiens
aattaatggaaagtaaggaagg

SEQ ID NO: 7421182 - DNA, 22 bp, Homo sapiens
aattaatggaaagtaaggaagg

SEQ ID NO: 7421183 - DNA, 22 bp, Homo sapiens
aattaattcagtttttaaggga

SEQ ID NO: 7421184 - DNA, 22 bp, Homo sapiens
aattaattcagtttttaaggga

SEQ ID NO: 7421185 - DNA, 22 bp, Homo sapiens
aattaagtcacacacctaaacc

SEQ ID NO: 7421186 - DNA, 22 bp, Homo sapiens
aattaagtcacacacctaaacc

SEQ ID NO: 7421187 - DNA, 22 bp, Homo sapiens
aattaagtcacacacctaaacc

SEQ ID NO: 7421188 - DNA, 22 bp, Homo sapiens
aattaagagagagttgaagcaa

SEQ ID NO: 7421189 - DNA, 22 bp, Homo sapiens
aattaagaaaatgttttatgat

SEQ ID NO: 7421190 - DNA, 22 bp, Homo sapiens
aattaagaaaatgttttatgat

SEQ ID NO: 7421191 - DNA, 22 bp, Homo sapiens
aattaactaatttggtacaaga

SEQ ID NO: 7421192 - DNA, 22 bp, Homo sapiens
aattaactaatttggtacaaga

SEQ ID NO: 7421193 - DNA, 22 bp, Homo sapiens
aattaactaatttggtacaaga

SEQ ID NO: 7421194 - DNA, 23 bp, Homo sapiens
aattacaaccaagaactggaagg

SEQ ID NO: 7421195 - DNA, 23 bp, Homo sapiens
aattacaaccaagaactggaagg

SEQ ID NO: 7421196 - DNA, 23 bp, Homo sapiens
aattacaaccaagaactggaagg

SEQ ID NO: 7421197 - DNA, 23 bp, Homo sapiens
aattacaaccaagaactggaagg

SEQ ID NO: 7421198 - DNA, 21 bp, Homo sapiens
aattacagatggaattacaga

SEQ ID NO: 7421199 - DNA, 21 bp, Homo sapiens
aattacagatggaattacaga

SEQ ID NO: 7421200 - DNA, 21 bp, Homo sapiens
aattacagatggaattacaga

SEQ ID NO: 7421201 - DNA, 21 bp, Homo sapiens
aattacagatggaattacaga

SEQ ID NO: 7421202 - DNA, 22 bp, Homo sapiens
aattacacagggatcacttttt

SEQ ID NO: 7421203 - DNA, 22 bp, Homo sapiens
aattacacagggatcacttttt

SEQ ID NO: 7421204 - DNA, 22 bp, Homo sapiens
aattaattttgttcattcagtc

SEQ ID NO: 7421205 - DNA, 22 bp, Homo sapiens
aattaattttgttcattcagtc

SEQ ID NO: 7421206 - DNA, 22 bp, Homo sapiens
aattaattttgttcattcagtc

SEQ ID NO: 7421207 - DNA, 22 bp, Homo sapiens
aattaattttgttcattcagtc

SEQ ID NO: 7421208 - DNA, 22 bp, Homo sapiens
aattaattttgttcattcagtc

SEQ ID NO: 7421209 - DNA, 22 bp, Homo sapiens
aattaattttgttcattcagtc

SEQ ID NO: 7421210 - DNA, 22 bp, Homo sapiens
aattaattcagtttttaaggga

SEQ ID NO: 7421211 - DNA, 23 bp, Homo sapiens
aattacaaccaagaactggaagg

SEQ ID NO: 7421212 - DNA, 23 bp, Homo sapiens
aattacaaccaagaactggaagg

SEQ ID NO: 7421213 - DNA, 23 bp, Homo sapiens
aattacaaccaagaactggaagg

SEQ ID NO: 7421214 - DNA, 22 bp, Homo sapiens
aattacaaatgtagactctcat

SEQ ID NO: 7421215 - DNA, 22 bp, Homo sapiens
aattacaaatgtagactctcat

SEQ ID NO: 7421216 - DNA, 22 bp, Homo sapiens
aattacaaatgtagactctcat

SEQ ID NO: 7421217 - DNA, 22 bp, Homo sapiens
aattacagtcggagcagcactg

SEQ ID NO: 7421218 - DNA, 22 bp, Homo sapiens
aattacagtcggagcagcactg

SEQ ID NO: 7421219 - DNA, 21 bp, Homo sapiens
aattacagatggaattacaga

SEQ ID NO: 7421220 - DNA, 21 bp, Homo sapiens
aattacagatggaattacaga

SEQ ID NO: 7421221 - DNA, 21 bp, Homo sapiens
aattacagatggaattacaga

SEQ ID NO: 7421222 - DNA, 21 bp, Homo sapiens
aattacagatggaattacaga

SEQ ID NO: 7421223 - DNA, 21 bp, Homo sapiens
aattacagatggaattacaga

SEQ ID NO: 7421224 - DNA, 22 bp, Homo sapiens
agagctgaattcaagtgctggc

SEQ ID NO: 7421225 - DNA, 22 bp, Homo sapiens
agagctgaattcaagtgctggc

SEQ ID NO: 7421226 - DNA, 22 bp, Homo sapiens
agagctgaattcaagtgctggc

SEQ ID NO: 7421227 - DNA, 22 bp, Homo sapiens
agagcctggctcccagctaccg

SEQ ID NO: 7421228 - DNA, 22 bp, Homo sapiens
agagcctggctcccagctaccg

SEQ ID NO: 7421229 - DNA, 17 bp, Homo sapiens
acagaggcaggagtgga

SEQ ID NO: 7421230 - DNA, 22 bp, Homo sapiens
acagagctgtacatgtgccatg

SEQ ID NO: 7421231 - DNA, 22 bp, Homo sapiens
acagaattaacatttgatgaat

SEQ ID NO: 7421232 - DNA, 22 bp, Homo sapiens
acagagctgtacatgtgccatg

SEQ ID NO: 7421233 - DNA, 22 bp, Homo sapiens
acagaatgggatttgaatattt

SEQ ID NO: 7421234 - DNA, 22 bp, Homo sapiens
acagaatgggatttgaatattt

SEQ ID NO: 7421235 - DNA, 22 bp, Homo sapiens
acagaatgggatttgaatattt

SEQ ID NO: 7421236 - DNA, 22 bp, Homo sapiens
acagaatgggatttgaatattt

SEQ ID NO: 7421237 - DNA, 22 bp, Homo sapiens
acagaatgggatttgaatattt

SEQ ID NO: 7421238 - DNA, 22 bp, Homo sapiens
acagaatgggatttgaatattt

SEQ ID NO: 7421239 - DNA, 22 bp, Homo sapiens
acagaattaaagtgtttgtgga

SEQ ID NO: 7421240 - DNA, 22 bp, Homo sapiens
acagaattaaagtgtttgtgga

SEQ ID NO: 7421241 - DNA, 22 bp, Homo sapiens
acagaattaaagtgtttgtgga

SEQ ID NO: 7421242 - DNA, 22 bp, Homo sapiens
acagaattaacatttgatgaat

SEQ ID NO: 7421243 - DNA, 22 bp, Homo sapiens
acagaattaacatttgatgaat

SEQ ID NO: 7421244 - DNA, 22 bp, Homo sapiens
acagaattaacatttgatgaat

SEQ ID NO: 7421245 - DNA, 22 bp, Homo sapiens
acagaattaacatttgatgaat

SEQ ID NO: 7421246 - DNA, 22 bp, Homo sapiens
acagaattaacatttgatgaat

SEQ ID NO: 7421247 - DNA, 22 bp, Homo sapiens
acagaggccatgagctgccacc

SEQ ID NO: 7421248 - DNA, 22 bp, Homo sapiens
acagaggccatgagctgccacc

SEQ ID NO: 7421249 - DNA, 22 bp, Homo sapiens
acagaggccatgagctgccacc

SEQ ID NO: 7421250 - DNA, 22 bp, Homo sapiens
acagaggccatgagctgccacc

SEQ ID NO: 7421251 - DNA, 22 bp, Homo sapiens
acagaggccatgagctgccacc

SEQ ID NO: 7421252 - DNA, 22 bp, Homo sapiens
acagaggccatgagctgccacc

SEQ ID NO: 7421253 - DNA, 21 bp, Homo sapiens
acagaggcatacagcttaagg

SEQ ID NO: 7421254 - DNA, 22 bp, Homo sapiens
acagaggccatgagctgccacc

SEQ ID NO: 7421255 - DNA, 22 bp, Homo sapiens
acagaggccatgagctgccacc

SEQ ID NO: 7421256 - DNA, 22 bp, Homo sapiens
acagaggcagtgtgagatactg

SEQ ID NO: 7421257 - DNA, 21 bp, Homo sapiens
acagaggcatacagcttaagg

SEQ ID NO: 7421258 - DNA, 22 bp, Homo sapiens
acagaggcagtgtgagatactg

SEQ ID NO: 7421259 - DNA, 22 bp, Homo sapiens
acagaggcagtgtgagatactg

SEQ ID NO: 7421260 - DNA, 22 bp, Homo sapiens
acagaggcagtgtgagatactg

SEQ ID NO: 7421261 - DNA, 17 bp, Homo sapiens
acagaggcaggagtgga

SEQ ID NO: 7421262 - DNA, 17 bp, Homo sapiens
acagaggcaggagtgga

SEQ ID NO: 7421263 - DNA, 17 bp, Homo sapiens
acagaggcaggagtgga

SEQ ID NO: 7421264 - DNA, 22 bp, Homo sapiens
acagaatattggttactgttgc

SEQ ID NO: 7421265 - DNA, 22 bp, Homo sapiens
acagaatattggttactgttgc

SEQ ID NO: 7421266 - DNA, 22 bp, Homo sapiens
acagaatattggttactgttgc

SEQ ID NO: 7421267 - DNA, 22 bp, Homo sapiens
acagaatattggttactgttgc

SEQ ID NO: 7421268 - DNA, 22 bp, Homo sapiens
acagaatattggttactgttgc

SEQ ID NO: 7421269 - DNA, 22 bp, Homo sapiens
acagaatattggttactgttgc

SEQ ID NO: 7421270 - DNA, 22 bp, Homo sapiens
acagaatattggttactgttgc

SEQ ID NO: 7421271 - DNA, 22 bp, Homo sapiens
acagaatattggttactgttgc

SEQ ID NO: 7421272 - DNA, 22 bp, Homo sapiens
acagaatattgtaagtgccact

SEQ ID NO: 7421273 - DNA, 22 bp, Homo sapiens
acagaatattgtaagtgccact

SEQ ID NO: 7421274 - DNA, 22 bp, Homo sapiens
acagaatattgtaagtgccact

SEQ ID NO: 7421275 - DNA, 22 bp, Homo sapiens
acagaatattgtaagtgccact

SEQ ID NO: 7421276 - DNA, 22 bp, Homo sapiens
acagaatattgtaagtgccact

SEQ ID NO: 7421277 - DNA, 22 bp, Homo sapiens
acagaatattggttactgttgc

SEQ ID NO: 7421278 - DNA, 22 bp, Homo sapiens
acagaatattttatttagatca

SEQ ID NO: 7421279 - DNA, 22 bp, Homo sapiens
acagaatattttatttagatca

SEQ ID NO: 7421280 - DNA, 22 bp, Homo sapiens
acagaatattttatttagatca

SEQ ID NO: 7421281 - DNA, 22 bp, Homo sapiens
acagaatgcgtagtgcatgttg

SEQ ID NO: 7421282 - DNA, 22 bp, Homo sapiens
acagaatgcgtagtgcatgttg

SEQ ID NO: 7421283 - DNA, 22 bp, Homo sapiens
acagaatgcgtagtgcatgttg

SEQ ID NO: 7421284 - DNA, 22 bp, Homo sapiens
acagaatgcattgacgtacgat

SEQ ID NO: 7421285 - DNA, 22 bp, Homo sapiens
acagaatgcagagatgcccaga

SEQ ID NO: 7421286 - DNA, 22 bp, Homo sapiens
acagaatgcagagatgcccaga

SEQ ID NO: 7421287 - DNA, 22 bp, Homo sapiens
acagaatagtagcttaaagtca

SEQ ID NO: 7421288 - DNA, 22 bp, Homo sapiens
acagaatagtagcttaaagtca

SEQ ID NO: 7421289 - DNA, 22 bp, Homo sapiens
acagaatagtagcttaaagtca

SEQ ID NO: 7421290 - DNA, 22 bp, Homo sapiens
acagaataggtacagtcagtca

SEQ ID NO: 7421291 - DNA, 22 bp, Homo sapiens
acagaataggtacagtcagtca

SEQ ID NO: 7421292 - DNA, 22 bp, Homo sapiens
acagaataggtacagtcagtca

SEQ ID NO: 7421293 - DNA, 22 bp, Homo sapiens
acagaatagagactgcctgctc

SEQ ID NO: 7421294 - DNA, 22 bp, Homo sapiens
acagaatagagactgcctgctc

SEQ ID NO: 7421295 - DNA, 22 bp, Homo sapiens
acagaatactcataagaagggg

SEQ ID NO: 7421296 - DNA, 22 bp, Homo sapiens
acagaatactcataagaagggg

SEQ ID NO: 7421297 - DNA, 22 bp, Homo sapiens
acagaatactcataagaagggg

SEQ ID NO: 7421298 - DNA, 22 bp, Homo sapiens
acagaatagtcagctgtaggcc

SEQ ID NO: 7421299 - DNA, 22 bp, Homo sapiens
acagaatagttggccctgctat

SEQ ID NO: 7421300 - DNA, 22 bp, Homo sapiens
acagaatagtagcttaaagtca

SEQ ID NO: 7421301 - DNA, 22 bp, Homo sapiens
acagaatagtagcttaaagtca

SEQ ID NO: 7421302 - DNA, 22 bp, Homo sapiens
acagaatagtagcttaaagtca

SEQ ID NO: 7421303 - DNA, 22 bp, Homo sapiens
acagaatattggttactgttgc

SEQ ID NO: 7421304 - DNA, 20 bp, Homo sapiens
acagaatatgctggttgtgg

SEQ ID NO: 7421305 - DNA, 20 bp, Homo sapiens
acagaatatgctggttgtgg

SEQ ID NO: 7421306 - DNA, 20 bp, Homo sapiens
acagaatatgctggttgtgg

SEQ ID NO: 7421307 - DNA, 20 bp, Homo sapiens
acagaatatgctggttgtgg

SEQ ID NO: 7421308 - DNA, 22 bp, Homo sapiens
acagaagctcaagagagcagtg

SEQ ID NO: 7421309 - DNA, 22 bp, Homo sapiens
acagaagctcaagagagcagtg

SEQ ID NO: 7421310 - DNA, 22 bp, Homo sapiens
acagaagctcaagagagcagtg

SEQ ID NO: 7421311 - DNA, 22 bp, Homo sapiens
acagaagctcaagagagcagtg

SEQ ID NO: 7421312 - DNA, 22 bp, Homo sapiens
acagaaggacttgagaaagaca

SEQ ID NO: 7421313 - DNA, 22 bp, Homo sapiens
acagaaggcggggacaaggcgg

SEQ ID NO: 7421314 - DNA, 22 bp, Homo sapiens
acagaaggacttgagaaagaca

SEQ ID NO: 7421315 - DNA, 22 bp, Homo sapiens
acagaaggacttgagaaagaca

SEQ ID NO: 7421316 - DNA, 22 bp, Homo sapiens
acagaaggacttgagaaagaca

SEQ ID NO: 7421317 - DNA, 22 bp, Homo sapiens
acagaaggcggggacaaggcgg

SEQ ID NO: 7421318 - DNA, 22 bp, Homo sapiens
acagaagtccccatgaagaagc

SEQ ID NO: 7421319 - DNA, 22 bp, Homo sapiens
acagaagtccccatgaagaagc

SEQ ID NO: 7421320 - DNA, 22 bp, Homo sapiens
acagaagtccccatgaagaagc

SEQ ID NO: 7421321 - DNA, 22 bp, Homo sapiens
acagaagtccccatgaagaagc

SEQ ID NO: 7421322 - DNA, 22 bp, Homo sapiens
acagaagtgacaatttcttggg

SEQ ID NO: 7421323 - DNA, 22 bp, Homo sapiens
acagaagtgacaatttcttggg

SEQ ID NO: 7421324 - DNA, 22 bp, Homo sapiens
acagaagtgacaatttcttggg

SEQ ID NO: 7421325 - DNA, 22 bp, Homo sapiens
acagaagtgacaatttcttggg

SEQ ID NO: 7421326 - DNA, 21 bp, Homo sapiens
acagaagcggcgagtggcccc

SEQ ID NO: 7421327 - DNA, 21 bp, Homo sapiens
acagaagcggcgagtggcccc

SEQ ID NO: 7421328 - DNA, 23 bp, Homo sapiens
acagaagccaggagccgctgggc

SEQ ID NO: 7421329 - DNA, 22 bp, Homo sapiens
acagaagcctttggccatttga

SEQ ID NO: 7421330 - DNA, 23 bp, Homo sapiens
acagaagccaggagccgctgggc

SEQ ID NO: 7421331 - DNA, 19 bp, Homo sapiens
acagaagcatagaaaagga

SEQ ID NO: 7421332 - DNA, 19 bp, Homo sapiens
acagaagcatagaaaagga

SEQ ID NO: 7421333 - DNA, 23 bp, Homo sapiens
acagaagccaggagccgctgggc

SEQ ID NO: 7421334 - DNA, 22 bp, Homo sapiens
agccaggaatgcatgctctgct

SEQ ID NO: 7421335 - DNA, 22 bp, Homo sapiens
acagaacttccagggaacatac

SEQ ID NO: 7421336 - DNA, 22 bp, Homo sapiens
acagaacttccagggaacatac

SEQ ID NO: 7421337 - DNA, 22 bp, Homo sapiens
acagaacttccagggaacatac

SEQ ID NO: 7421338 - DNA, 22 bp, Homo sapiens
acagaacttcctgctggagtgg

SEQ ID NO: 7421339 - DNA, 22 bp, Homo sapiens
acagaacttcctgctggagtgg

SEQ ID NO: 7421340 - DNA, 22 bp, Homo sapiens
acagaacttggaacttttcaca

SEQ ID NO: 7421341 - DNA, 22 bp, Homo sapiens
acagaactttctgatcctgagc

SEQ ID NO: 7421342 - DNA, 19 bp, Homo sapiens
acagaagcatagaaaagga

SEQ ID NO: 7421343 - DNA, 22 bp, Homo sapiens
acagaagtggcttcaaagagca

SEQ ID NO: 7421344 - DNA, 22 bp, Homo sapiens
acagaagtggcttcaaagagca

SEQ ID NO: 7421345 - DNA, 22 bp, Homo sapiens
acagaagtggcttcaaagagca

SEQ ID NO: 7421346 - DNA, 22 bp, Homo sapiens
acagaagtgagtggcaagaact

SEQ ID NO: 7421347 - DNA, 22 bp, Homo sapiens
acagaagtgagtggcaagaact

SEQ ID NO: 7421348 - DNA, 22 bp, Homo sapiens
acagaagtgagtggcaagaact

SEQ ID NO: 7421349 - DNA, 22 bp, Homo sapiens
acagaagtgtctttttcattca

SEQ ID NO: 7421350 - DNA, 21 bp, Homo sapiens
acagaagtggcttggtctcag

SEQ ID NO: 7421351 - DNA, 21 bp, Homo sapiens
acagaagtggcttggtctcag

SEQ ID NO: 7421352 - DNA, 21 bp, Homo sapiens
acagaagtggcttggtctcag

SEQ ID NO: 7421353 - DNA, 22 bp, Homo sapiens
acagaagttggaattagatact

SEQ ID NO: 7421354 - DNA, 22 bp, Homo sapiens
acagaagttggaattagatact

SEQ ID NO: 7421355 - DNA, 22 bp, Homo sapiens
acagaagtgttgaagttttcat

SEQ ID NO: 7421356 - DNA, 22 bp, Homo sapiens
acagaagtgtgtgtgtaggaat

SEQ ID NO: 7421357 - DNA, 22 bp, Homo sapiens
acagaagtgtgtgtgtaggaat

SEQ ID NO: 7421358 - DNA, 22 bp, Homo sapiens
acagaagtgtctttttcattca

SEQ ID NO: 7421359 - DNA, 22 bp, Homo sapiens
acagaagtgtctttttcattca

SEQ ID NO: 7421360 - DNA, 22 bp, Homo sapiens
acagaagtgtgtgtgtaggaat

SEQ ID NO: 7421361 - DNA, 22 bp, Homo sapiens
acagaagtgttgaagttttcat

SEQ ID NO: 7421362 - DNA, 22 bp, Homo sapiens
acagaagtgttgaagttttcat

SEQ ID NO: 7421363 - DNA, 22 bp, Homo sapiens
acagaagtgttgaagttttcat

SEQ ID NO: 7421364 - DNA, 22 bp, Homo sapiens
acagaataaggtttatctctcc

SEQ ID NO: 7421365 - DNA, 22 bp, Homo sapiens
acagaataaggtttatctctcc

SEQ ID NO: 7421366 - DNA, 23 bp, Homo sapiens
acagaataccattgactaggtgt

SEQ ID NO: 7421367 - DNA, 23 bp, Homo sapiens
acagaataccattgactaggtgt

SEQ ID NO: 7421368 - DNA, 22 bp, Homo sapiens
acagaatactacagactggtta

SEQ ID NO: 7421369 - DNA, 23 bp, Homo sapiens
acagaataccattgactaggtgt

SEQ ID NO: 7421370 - DNA, 22 bp, Homo sapiens
acagaatactacagactggtta

SEQ ID NO: 7421371 - DNA, 22 bp, Homo sapiens
acagaatactcataagaagggg

SEQ ID NO: 7421372 - DNA, 22 bp, Homo sapiens
acagaatactacagactggtta

SEQ ID NO: 7421373 - DNA, 22 bp, Homo sapiens
acagaataactcttgcttgagt

SEQ ID NO: 7421374 - DNA, 22 bp, Homo sapiens
acagaataaggtttatctctcc

SEQ ID NO: 7421375 - DNA, 22 bp, Homo sapiens
acagaataaggtttatctctcc

SEQ ID NO: 7421376 - DNA, 22 bp, Homo sapiens
acagaataaggtttatctctcc

SEQ ID NO: 7421377 - DNA, 22 bp, Homo sapiens
acagaataactcttgcttgagt

SEQ ID NO: 7421378 - DNA, 22 bp, Homo sapiens
acagaataactcttgcttgagt

SEQ ID NO: 7421379 - DNA, 22 bp, Homo sapiens
acagaataactcttgcttgagt

SEQ ID NO: 7421380 - DNA, 22 bp, Homo sapiens
acagaagtttcaagtaagaagt

SEQ ID NO: 7421381 - DNA, 22 bp, Homo sapiens
acagaagtttcaagtaagaagt

SEQ ID NO: 7421382 - DNA, 22 bp, Homo sapiens
acagaagtttcaagtaagaagt

SEQ ID NO: 7421383 - DNA, 22 bp, Homo sapiens
acagaagtttcaagtaagaagt

SEQ ID NO: 7421384 - DNA, 20 bp, Homo sapiens
agcggcagcttcctgcttcg

SEQ ID NO: 7421385 - DNA, 22 bp, Homo sapiens
agcggcgccgagcttggccagg

SEQ ID NO: 7421386 - DNA, 22 bp, Homo sapiens
agccttcagcagttcaggtgcc

SEQ ID NO: 7421387 - DNA, 22 bp, Homo sapiens
agccttcagcagttcaggtgcc

SEQ ID NO: 7421388 - DNA, 22 bp, Homo sapiens
agcggctgctccgcaggctggc

SEQ ID NO: 7421389 - DNA, 22 bp, Homo sapiens
agcggctgctccgcaggctggc

SEQ ID NO: 7421390 - DNA, 22 bp, Homo sapiens
agcggctgctccgcaggctggc

SEQ ID NO: 7421391 - DNA, 22 bp, Homo sapiens
agcggctgctccgcaggctggc

SEQ ID NO: 7421392 - DNA, 22 bp, Homo sapiens
agcggctgctcttttcagatcc

SEQ ID NO: 7421393 - DNA, 22 bp, Homo sapiens
agcggctggaccagcgttcaag

SEQ ID NO: 7421394 - DNA, 22 bp, Homo sapiens
agccttcactgggaccttggat

SEQ ID NO: 7421395 - DNA, 22 bp, Homo sapiens
agccttcactgggaccttggat

SEQ ID NO: 7421396 - DNA, 22 bp, Homo sapiens
agccttcaacctagctagagca

SEQ ID NO: 7421397 - DNA, 22 bp, Homo sapiens
agccttcaacctagctagagca

SEQ ID NO: 7421398 - DNA, 22 bp, Homo sapiens
agccttcaacctagctagagca

SEQ ID NO: 7421399 - DNA, 22 bp, Homo sapiens
acagaggtcatggagagttctc

SEQ ID NO: 7421400 - DNA, 22 bp, Homo sapiens
acagaggtcatggagagttctc

SEQ ID NO: 7421401 - DNA, 23 bp, Homo sapiens
acagaggtccaaacagtataagc

SEQ ID NO: 7421402 - DNA, 23 bp, Homo sapiens
acagaggtccaaacagtataagc

SEQ ID NO: 7421403 - DNA, 22 bp, Homo sapiens
agcggctgtcggccagccggag

SEQ ID NO: 7421404 - DNA, 20 bp, Homo sapiens
agcggctggcggaggacacg

SEQ ID NO: 7421405 - DNA, 20 bp, Homo sapiens
agcggctggcggaggacacg

SEQ ID NO: 7421406 - DNA, 20 bp, Homo sapiens
agcggctggcggaggacacg

SEQ ID NO: 7421407 - DNA, 22 bp, Homo sapiens
agcgggcaccctttgagggttt

SEQ ID NO: 7421408 - DNA, 19 bp, Homo sapiens
agcggttctcaaagtcagg

SEQ ID NO: 7421409 - DNA, 22 bp, Homo sapiens
agcggtggtgtcggcagcggct

SEQ ID NO: 7421410 - DNA, 22 bp, Homo sapiens
agcgggctcacccggttgttgt

SEQ ID NO: 7421411 - DNA, 22 bp, Homo sapiens
agcgggctcaagtggccagcag

SEQ ID NO: 7421412 - DNA, 22 bp, Homo sapiens
agcgggtctgcaagccttccct

SEQ ID NO: 7421413 - DNA, 22 bp, Homo sapiens
agcgggtctgcaagccttccct

SEQ ID NO: 7421414 - DNA, 22 bp, Homo sapiens
agcgggtctgcaagccttccct

SEQ ID NO: 7421415 - DNA, 22 bp, Homo sapiens
agcgggtctgcaagccttccct

SEQ ID NO: 7421416 - DNA, 22 bp, Homo sapiens
agctaaatgcatttcaagactg

SEQ ID NO: 7421417 - DNA, 22 bp, Homo sapiens
agctaaatcctacttttgtatt

SEQ ID NO: 7421418 - DNA, 22 bp, Homo sapiens
agctaaactaggtaaacagcag

SEQ ID NO: 7421419 - DNA, 22 bp, Homo sapiens
agctaaatgttgcttaaaattt

SEQ ID NO: 7421420 - DNA, 22 bp, Homo sapiens
agctaaatgttgcttaaaattt

SEQ ID NO: 7421421 - DNA, 22 bp, Homo sapiens
agctaaatgttgcttaaaattt

SEQ ID NO: 7421422 - DNA, 22 bp, Homo sapiens
agctaacacattccagctattt

SEQ ID NO: 7421423 - DNA, 22 bp, Homo sapiens
agctaaatgtgaaatgtcaacc

SEQ ID NO: 7421424 - DNA, 22 bp, Homo sapiens
agctaaatgtgaaatgtcaacc

SEQ ID NO: 7421425 - DNA, 22 bp, Homo sapiens
acagataattagcataaatgct

SEQ ID NO: 7421426 - DNA, 22 bp, Homo sapiens
acagataattagcataaatgct

SEQ ID NO: 7421427 - DNA, 22 bp, Homo sapiens
acagataattagcataaatgct

SEQ ID NO: 7421428 - DNA, 23 bp, Homo sapiens
agctaacagatcgacaaagtata

SEQ ID NO: 7421429 - DNA, 22 bp, Homo sapiens
acagataattagcataaatgct

SEQ ID NO: 7421430 - DNA, 22 bp, Homo sapiens
acagataattagcataaatgct

SEQ ID NO: 7421431 - DNA, 22 bp, Homo sapiens
agcgtggatgtggggcgcggct

SEQ ID NO: 7421432 - DNA, 22 bp, Homo sapiens
agcgtgggtccaaggctctggt

SEQ ID NO: 7421433 - DNA, 22 bp, Homo sapiens
agcgtggatgtggggcgcggct

SEQ ID NO: 7421434 - DNA, 22 bp, Homo sapiens
agcgtgggtccaaggctctggt

SEQ ID NO: 7421435 - DNA, 22 bp, Homo sapiens
agcgtgtgcctcggggtacacg

SEQ ID NO: 7421436 - DNA, 22 bp, Homo sapiens
agcgtgtggagaactaagcaga

SEQ ID NO: 7421437 - DNA, 22 bp, Homo sapiens
agcgtgtgtgcgggtcttcttt

SEQ ID NO: 7421438 - DNA, 22 bp, Homo sapiens
agcgttattcttagcctggaga

SEQ ID NO: 7421439 - DNA, 22 bp, Homo sapiens
agcgtgtgcctcggggtacacg

SEQ ID NO: 7421440 - DNA, 22 bp, Homo sapiens
agcgtgtgtgcgggtcttcttt

SEQ ID NO: 7421441 - DNA, 22 bp, Homo sapiens
agcggtggtgtcggcagcggct

SEQ ID NO: 7421442 - DNA, 22 bp, Homo sapiens
agcgtgaattagttggtacaca

SEQ ID NO: 7421443 - DNA, 22 bp, Homo sapiens
agcgtggactgctgggcaaggt

SEQ ID NO: 7421444 - DNA, 22 bp, Homo sapiens
agcgtgaattagttggtacaca

SEQ ID NO: 7421445 - DNA, 22 bp, Homo sapiens
agcgtgaattagttggtacaca

SEQ ID NO: 7421446 - DNA, 21 bp, Homo sapiens
agcgtcaatatcgtcaacagg

SEQ ID NO: 7421447 - DNA, 22 bp, Homo sapiens
agcgtgaattagttggtacaca

SEQ ID NO: 7421448 - DNA, 22 bp, Homo sapiens
agcgtgaattagttggtacaca

SEQ ID NO: 7421449 - DNA, 22 bp, Homo sapiens
agcgtagatgaaaggcacttac

SEQ ID NO: 7421450 - DNA, 21 bp, Homo sapiens
agcgtcaatatcgtcaacagg

SEQ ID NO: 7421451 - DNA, 22 bp, Homo sapiens
acagaggccccgtgggagagcc

SEQ ID NO: 7421452 - DNA, 22 bp, Homo sapiens
acagaggccccgtgggagagcc

SEQ ID NO: 7421453 - DNA, 22 bp, Homo sapiens
acagaggccccgtgggagagcc

SEQ ID NO: 7421454 - DNA, 22 bp, Homo sapiens
acagaggccccgtgggagagcc

SEQ ID NO: 7421455 - DNA, 22 bp, Homo sapiens
acagaggccgcctctctcacgg

SEQ ID NO: 7421456 - DNA, 22 bp, Homo sapiens
acagaggccgcctctctcacgg

SEQ ID NO: 7421457 - DNA, 22 bp, Homo sapiens
acagaggccgcctctctcacgg

SEQ ID NO: 7421458 - DNA, 22 bp, Homo sapiens
acagaggccgcctctctcacgg

SEQ ID NO: 7421459 - DNA, 22 bp, Homo sapiens
acagaggccccgtgggagagcc

SEQ ID NO: 7421460 - DNA, 22 bp, Homo sapiens
acagaggcctcggcctgcccag

SEQ ID NO: 7421461 - DNA, 22 bp, Homo sapiens
acagaggcctcggcctgcccag

SEQ ID NO: 7421462 - DNA, 22 bp, Homo sapiens
acagaggcctcggcctgcccag

SEQ ID NO: 7421463 - DNA, 22 bp, Homo sapiens
acagaggcctcgtaggtacaac

SEQ ID NO: 7421464 - DNA, 22 bp, Homo sapiens
acagaggcctcgtaggtacaac

SEQ ID NO: 7421465 - DNA, 22 bp, Homo sapiens
acagaggcctcgtaggtacaac

SEQ ID NO: 7421466 - DNA, 22 bp, Homo sapiens
acagaggcctcgtaggtacaac

SEQ ID NO: 7421467 - DNA, 22 bp, Homo sapiens
acagaggcctcgtaggtacaac

SEQ ID NO: 7421468 - DNA, 23 bp, Homo sapiens
acagaggcttaaatgagtggcag

SEQ ID NO: 7421469 - DNA, 23 bp, Homo sapiens
acagaggcttaaatgagtggcag

SEQ ID NO: 7421470 - DNA, 23 bp, Homo sapiens
acagaggcttaaatgagtggcag

SEQ ID NO: 7421471 - DNA, 23 bp, Homo sapiens
acagaggcttaaatgagtggcag

SEQ ID NO: 7421472 - DNA, 23 bp, Homo sapiens
acagaggcttaaatgagtggcag

SEQ ID NO: 7421473 - DNA, 23 bp, Homo sapiens
acagaggcttaaatgagtggcag

SEQ ID NO: 7421474 - DNA, 19 bp, Homo sapiens
acagagggcaactgagaaa

SEQ ID NO: 7421475 - DNA, 19 bp, Homo sapiens
acagagggcaactgagaaa

SEQ ID NO: 7421476 - DNA, 23 bp, Homo sapiens
acagaggcttaaatgagtggcag

SEQ ID NO: 7421477 - DNA, 22 bp, Homo sapiens
acagaggctgatcttcaagccc

SEQ ID NO: 7421478 - DNA, 22 bp, Homo sapiens
acagaggctgatcttcaagccc

SEQ ID NO: 7421479 - DNA, 22 bp, Homo sapiens
acagaggcctcgtaggtacaac

SEQ ID NO: 7421480 - DNA, 22 bp, Homo sapiens
acagaggctgcgcttgggaacg

SEQ ID NO: 7421481 - DNA, 22 bp, Homo sapiens
acagaggctgatcttcaagccc

SEQ ID NO: 7421482 - DNA, 22 bp, Homo sapiens
acagaggctgcgcttgggaacg

SEQ ID NO: 7421483 - DNA, 22 bp, Homo sapiens
acagaggctgcgcttgggaacg

SEQ ID NO: 7421484 - DNA, 22 bp, Homo sapiens
acagagggggccttggagtgca

SEQ ID NO: 7421485 - DNA, 22 bp, Homo sapiens
acagagggggccttggagtgca

SEQ ID NO: 7421486 - DNA, 19 bp, Homo sapiens
acagagggcaactgagaaa

SEQ ID NO: 7421487 - DNA, 19 bp, Homo sapiens
acagagggcaactgagaaa

SEQ ID NO: 7421488 - DNA, 19 bp, Homo sapiens
acagagggcaactgagaaa

SEQ ID NO: 7421489 - DNA, 22 bp, Homo sapiens
acagagggggccttggagtgca

SEQ ID NO: 7421490 - DNA, 22 bp, Homo sapiens
acagagggggccttggagtgca

SEQ ID NO: 7421491 - DNA, 22 bp, Homo sapiens
acagagggggccttggagtgca

SEQ ID NO: 7421492 - DNA, 19 bp, Homo sapiens
acagagggcaactgagaaa

SEQ ID NO: 7421493 - DNA, 22 bp, Homo sapiens
acagagggggccttggagtgca

SEQ ID NO: 7421494 - DNA, 22 bp, Homo sapiens
acagagggggccttggagtgca

SEQ ID NO: 7421495 - DNA, 22 bp, Homo sapiens
acagagggggccttggagtgca

SEQ ID NO: 7421496 - DNA, 22 bp, Homo sapiens
acagagggtctgggcacaggac

SEQ ID NO: 7421497 - DNA, 22 bp, Homo sapiens
acagagggtctgggcacaggac

SEQ ID NO: 7421498 - DNA, 22 bp, Homo sapiens
acagagggtctgggcacaggac

SEQ ID NO: 7421499 - DNA, 22 bp, Homo sapiens
acagagggtctgggcacaggac

SEQ ID NO: 7421500 - DNA, 22 bp, Homo sapiens
acagagggtctgggcacaggac

SEQ ID NO: 7421501 - DNA, 22 bp, Homo sapiens
acagagggtctgggcacaggac

SEQ ID NO: 7421502 - DNA, 22 bp, Homo sapiens
acagagggtctgggcacaggac

SEQ ID NO: 7421503 - DNA, 22 bp, Homo sapiens
acagaggggtcacagcctgaag

SEQ ID NO: 7421504 - DNA, 22 bp, Homo sapiens
acagaggggtcacagcctgaag

SEQ ID NO: 7421505 - DNA, 22 bp, Homo sapiens
acagaggggtcacagcctgaag

SEQ ID NO: 7421506 - DNA, 22 bp, Homo sapiens
acagagggggccttggagtgca

SEQ ID NO: 7421507 - DNA, 22 bp, Homo sapiens
acagaggggtcacagcctgaag

SEQ ID NO: 7421508 - DNA, 22 bp, Homo sapiens
acagaggggtcacagcctgaag

SEQ ID NO: 7421509 - DNA, 22 bp, Homo sapiens
acagaggggtcacagcctgaag

SEQ ID NO: 7421510 - DNA, 22 bp, Homo sapiens
acagagggtttctaaggatttg

SEQ ID NO: 7421511 - DNA, 22 bp, Homo sapiens
acagagggtttctaaggatttg

SEQ ID NO: 7421512 - DNA, 22 bp, Homo sapiens
acagagggtttctaaggatttg

SEQ ID NO: 7421513 - DNA, 22 bp, Homo sapiens
acagagggtgtggaggaagacg

SEQ ID NO: 7421514 - DNA, 22 bp, Homo sapiens
acagagggtctgggcacaggac

SEQ ID NO: 7421515 - DNA, 22 bp, Homo sapiens
acagagggtgtggaggaagacg

SEQ ID NO: 7421516 - DNA, 22 bp, Homo sapiens
acagagggtgtggaggaagacg

SEQ ID NO: 7421517 - DNA, 22 bp, Homo sapiens
acagagggtgtggaggaagacg

SEQ ID NO: 7421518 - DNA, 22 bp, Homo sapiens
acagagggtgtggaggaagacg

SEQ ID NO: 7421519 - DNA, 22 bp, Homo sapiens
acagagggtgtggaggaagacg

SEQ ID NO: 7421520 - DNA, 22 bp, Homo sapiens
acagagggtttctaaggatttg

SEQ ID NO: 7421521 - DNA, 22 bp, Homo sapiens
acagaggtaggacatgagatat

SEQ ID NO: 7421522 - DNA, 22 bp, Homo sapiens
acagaggtcacctttgtatctt

SEQ ID NO: 7421523 - DNA, 22 bp, Homo sapiens
acagaggtcacctttgtatctt

SEQ ID NO: 7421524 - DNA, 22 bp, Homo sapiens
acagaggtcatggagagttctc

SEQ ID NO: 7421525 - DNA, 22 bp, Homo sapiens
acagagggtttctaaggatttg

SEQ ID NO: 7421526 - DNA, 22 bp, Homo sapiens
acagaggtaggacatgagatat

SEQ ID NO: 7421527 - DNA, 22 bp, Homo sapiens
acagaggtaggacatgagatat

SEQ ID NO: 7421528 - DNA, 22 bp, Homo sapiens
agctgagggttcggtgtccaca

SEQ ID NO: 7421529 - DNA, 18 bp, Homo sapiens
agctgaggggactgaaga

SEQ ID NO: 7421530 - DNA, 18 bp, Homo sapiens
agctgaggggactgaaga

SEQ ID NO: 7421531 - DNA, 22 bp, Homo sapiens
agctgagggcaggatggggtga

SEQ ID NO: 7421532 - DNA, 22 bp, Homo sapiens
agctgagggcaggatggggtga

SEQ ID NO: 7421533 - DNA, 21 bp, Homo sapiens
agctgaggtaaggcaagagag

SEQ ID NO: 7421534 - DNA, 22 bp, Homo sapiens
agctgagggttcggtgtccaca

SEQ ID NO: 7421535 - DNA, 21 bp, Homo sapiens
agctgaggtaaggcaagagag

SEQ ID NO: 7421536 - DNA, 22 bp, Homo sapiens
agctgagggttcggtgtccaca

SEQ ID NO: 7421537 - DNA, 22 bp, Homo sapiens
agctgagggttcggtgtccaca

SEQ ID NO: 7421538 - DNA, 22 bp, Homo sapiens
agctgagggttcggtgtccaca

SEQ ID NO: 7421539 - DNA, 22 bp, Homo sapiens
agctgagggttcggtgtccaca

SEQ ID NO: 7421540 - DNA, 22 bp, Homo sapiens
agctgagggttcggtgtccaca

SEQ ID NO: 7421541 - DNA, 22 bp, Homo sapiens
acagcagccttgttggtttcga

SEQ ID NO: 7421542 - DNA, 22 bp, Homo sapiens
acagcagcgtcaacttaaaatt

SEQ ID NO: 7421543 - DNA, 22 bp, Homo sapiens
acagcagccttgttggtttcga

SEQ ID NO: 7421544 - DNA, 22 bp, Homo sapiens
acagcagcgtcaacttaaaatt

SEQ ID NO: 7421545 - DNA, 22 bp, Homo sapiens
acagcagcgtcaacttaaaatt

SEQ ID NO: 7421546 - DNA, 22 bp, Homo sapiens
acagcagcgtgaagtgtgttat

SEQ ID NO: 7421547 - DNA, 22 bp, Homo sapiens
acagcagcgtgaagtgtgttat

SEQ ID NO: 7421548 - DNA, 22 bp, Homo sapiens
agctgagaggtggcaagctgta

SEQ ID NO: 7421549 - DNA, 22 bp, Homo sapiens
agctgagattatgctcttctca

SEQ ID NO: 7421550 - DNA, 22 bp, Homo sapiens
agctgagattgtttccatttct

SEQ ID NO: 7421551 - DNA, 22 bp, Homo sapiens
acagcagcgtgaagtgtgttat

SEQ ID NO: 7421552 - DNA, 22 bp, Homo sapiens
acagcagcgtgaagtgtgttat

SEQ ID NO: 7421553 - DNA, 22 bp, Homo sapiens
agctgagcatttgatccacctc

SEQ ID NO: 7421554 - DNA, 22 bp, Homo sapiens
agctgagcatttgatccacctc

SEQ ID NO: 7421555 - DNA, 22 bp, Homo sapiens
agctgagcacattcaaacaggt

SEQ ID NO: 7421556 - DNA, 22 bp, Homo sapiens
agctgatgtgtccggagcagct

SEQ ID NO: 7421557 - DNA, 22 bp, Homo sapiens
agctgatgtgtccggagcagct

SEQ ID NO: 7421558 - DNA, 22 bp, Homo sapiens
agctgatgtgtccggagcagct

SEQ ID NO: 7421559 - DNA, 22 bp, Homo sapiens
acagcaggcatgaatgacactg

SEQ ID NO: 7421560 - DNA, 22 bp, Homo sapiens
acagcaggcatgaatgacactg

SEQ ID NO: 7421561 - DNA, 22 bp, Homo sapiens
agctgataggtgtaggatacac

SEQ ID NO: 7421562 - DNA, 22 bp, Homo sapiens
agctgatgccatgtggaacagt

SEQ ID NO: 7421563 - DNA, 22 bp, Homo sapiens
agctgatgccatgtggaacagt

SEQ ID NO: 7421564 - DNA, 22 bp, Homo sapiens
agctgatgccatgtggaacagt

SEQ ID NO: 7421565 - DNA, 22 bp, Homo sapiens
agctgatgtgacaaaacatagg

SEQ ID NO: 7421566 - DNA, 22 bp, Homo sapiens
agctgaggttgaagagtgaacg

SEQ ID NO: 7421567 - DNA, 22 bp, Homo sapiens
agctgaggttgaagagtgaacg

SEQ ID NO: 7421568 - DNA, 22 bp, Homo sapiens
agctgaggttgaagagtgaacg

SEQ ID NO: 7421569 - DNA, 22 bp, Homo sapiens
agctgagttaattcatcactta

SEQ ID NO: 7421570 - DNA, 22 bp, Homo sapiens
agctgagttaattcatcactta

SEQ ID NO: 7421571 - DNA, 22 bp, Homo sapiens
agctgaggttgaagagtgaacg

SEQ ID NO: 7421572 - DNA, 22 bp, Homo sapiens
agctgagttaattcatcactta

SEQ ID NO: 7421573 - DNA, 23 bp, Homo sapiens
agctgaggtgcagatccaaagaa

SEQ ID NO: 7421574 - DNA, 21 bp, Homo sapiens
agctgaggtaaggcaagagag

SEQ ID NO: 7421575 - DNA, 21 bp, Homo sapiens
agctgaggtaaggcaagagag

SEQ ID NO: 7421576 - DNA, 21 bp, Homo sapiens
agctgaggtaaggcaagagag

SEQ ID NO: 7421577 - DNA, 21 bp, Homo sapiens
agctgaggtaaggcaagagag

SEQ ID NO: 7421578 - DNA, 21 bp, Homo sapiens
agctgaggtaaggcaagagag

SEQ ID NO: 7421579 - DNA, 23 bp, Homo sapiens
agctgaggtgcagatccaaagaa

SEQ ID NO: 7421580 - DNA, 23 bp, Homo sapiens
agctgaggtgcagatccaaagaa

SEQ ID NO: 7421581 - DNA, 23 bp, Homo sapiens
agctgaggtgcagatccaaagaa

SEQ ID NO: 7421582 - DNA, 23 bp, Homo sapiens
agctgaggtgcagatccaaagaa

SEQ ID NO: 7421583 - DNA, 22 bp, Homo sapiens
agctgaggttagtataaatgtg

SEQ ID NO: 7421584 - DNA, 23 bp, Homo sapiens
agctgaggtgcagatccaaagaa

SEQ ID NO: 7421585 - DNA, 22 bp, Homo sapiens
agctgaggttagtataaatgtg

SEQ ID NO: 7421586 - DNA, 22 bp, Homo sapiens
acagcagtgcacagagaaccct

SEQ ID NO: 7421587 - DNA, 22 bp, Homo sapiens
acagcagtcttaacacattgca

SEQ ID NO: 7421588 - DNA, 22 bp, Homo sapiens
acagcagtcagtgaatatttaa

SEQ ID NO: 7421589 - DNA, 22 bp, Homo sapiens
acagcaggttttaactttgaag

SEQ ID NO: 7421590 - DNA, 22 bp, Homo sapiens
acagcaggttttaactttgaag

SEQ ID NO: 7421591 - DNA, 22 bp, Homo sapiens
acagcaggttttaactttgaag

SEQ ID NO: 7421592 - DNA, 18 bp, Homo sapiens
acagcaggtttcattctt

SEQ ID NO: 7421593 - DNA, 22 bp, Homo sapiens
acagcaggttttaactttgaag

SEQ ID NO: 7421594 - DNA, 22 bp, Homo sapiens
acagcaggttttaactttgaag

SEQ ID NO: 7421595 - DNA, 22 bp, Homo sapiens
acagcaggttttaactttgaag

SEQ ID NO: 7421596 - DNA, 22 bp, Homo sapiens
acagcaggttattgttatggca

SEQ ID NO: 7421597 - DNA, 22 bp, Homo sapiens
acagcaggttacagtggcacag

SEQ ID NO: 7421598 - DNA, 22 bp, Homo sapiens
acagcaggttattgttatggca

SEQ ID NO: 7421599 - DNA, 21 bp, Homo sapiens
acagcagggctggcatgacag

SEQ ID NO: 7421600 - DNA, 21 bp, Homo sapiens
acagcagggctggcatgacag

SEQ ID NO: 7421601 - DNA, 21 bp, Homo sapiens
acagcagggctggcatgacag

SEQ ID NO: 7421602 - DNA, 21 bp, Homo sapiens
acagcagggctggcatgacag

SEQ ID NO: 7421603 - DNA, 19 bp, Homo sapiens
acagcagggatttttggag

SEQ ID NO: 7421604 - DNA, 21 bp, Homo sapiens
acagcagggctggcatgacag

SEQ ID NO: 7421605 - DNA, 22 bp, Homo sapiens
acagcaggttattgttatggca

SEQ ID NO: 7421606 - DNA, 18 bp, Homo sapiens
acagcaggtttcattctt

SEQ ID NO: 7421607 - DNA, 18 bp, Homo sapiens
acagcaggtttcattctt

SEQ ID NO: 7421608 - DNA, 22 bp, Homo sapiens
acagcagggaatatgggaattg

SEQ ID NO: 7421609 - DNA, 17 bp, Homo sapiens
acagcagggaagtgttg

SEQ ID NO: 7421610 - DNA, 17 bp, Homo sapiens
acagcagggaagtgttg

SEQ ID NO: 7421611 - DNA, 17 bp, Homo sapiens
acagcagggaagtgttg

SEQ ID NO: 7421612 - DNA, 17 bp, Homo sapiens
acagcagggaagtgttg

SEQ ID NO: 7421613 - DNA, 22 bp, Homo sapiens
acagcagggaatatgggaattg

SEQ ID NO: 7421614 - DNA, 22 bp, Homo sapiens
acagcagggaatatgggaattg

SEQ ID NO: 7421615 - DNA, 22 bp, Homo sapiens
acagcagggaatatgggaattg

SEQ ID NO: 7421616 - DNA, 22 bp, Homo sapiens
acagcagggaatatgggaattg

SEQ ID NO: 7421617 - DNA, 19 bp, Homo sapiens
acagcagggatttttggag

SEQ ID NO: 7421618 - DNA, 22 bp, Homo sapiens
acagcagggaatatgggaattg

SEQ ID NO: 7421619 - DNA, 22 bp, Homo sapiens
acagcaggcccatactggaagg

SEQ ID NO: 7421620 - DNA, 22 bp, Homo sapiens
acagcaggcccatactggaagg

SEQ ID NO: 7421621 - DNA, 22 bp, Homo sapiens
acagcaggcccatactggaagg

SEQ ID NO: 7421622 - DNA, 22 bp, Homo sapiens
acagcaggcatgaatgacactg

SEQ ID NO: 7421623 - DNA, 22 bp, Homo sapiens
acagcaggcccatactggaagg

SEQ ID NO: 7421624 - DNA, 22 bp, Homo sapiens
acagcaggcccatactggaagg

SEQ ID NO: 7421625 - DNA, 22 bp, Homo sapiens
acagcaggcccatactggaagg

SEQ ID NO: 7421626 - DNA, 22 bp, Homo sapiens
acagcaggcccatactggaagg

SEQ ID NO: 7421627 - DNA, 22 bp, Homo sapiens
acagcaggcatgaatgacactg

SEQ ID NO: 7421628 - DNA, 17 bp, Homo sapiens
acagcaggcccggaggg

SEQ ID NO: 7421629 - DNA, 17 bp, Homo sapiens
acagcaggcccggaggg

SEQ ID NO: 7421630 - DNA, 17 bp, Homo sapiens
acagcaggcccggaggg

SEQ ID NO: 7421631 - DNA, 17 bp, Homo sapiens
acagcaggcccggaggg

SEQ ID NO: 7421632 - DNA, 17 bp, Homo sapiens
acagcaggcccggaggg

SEQ ID NO: 7421633 - DNA, 17 bp, Homo sapiens
acagcaggcccggaggg

SEQ ID NO: 7421634 - DNA, 22 bp, Homo sapiens
acagatactcagctctatgctt

SEQ ID NO: 7421635 - DNA, 22 bp, Homo sapiens
acagatactataatgtaaagtg

SEQ ID NO: 7421636 - DNA, 22 bp, Homo sapiens
acagatactcagctctatgctt

SEQ ID NO: 7421637 - DNA, 22 bp, Homo sapiens
acagatactcagctctatgctt

SEQ ID NO: 7421638 - DNA, 22 bp, Homo sapiens
acagatactataatgtaaagtg

SEQ ID NO: 7421639 - DNA, 22 bp, Homo sapiens
acagatactataatgtaaagtg

SEQ ID NO: 7421640 - DNA, 23 bp, Homo sapiens
acagatagggaaggcagagtttc

SEQ ID NO: 7421641 - DNA, 23 bp, Homo sapiens
acagatagggaaggcagagtttc

SEQ ID NO: 7421642 - DNA, 22 bp, Homo sapiens
acagatactataatgtaaagtg

SEQ ID NO: 7421643 - DNA, 20 bp, Homo sapiens
acagataccagggacatggg

SEQ ID NO: 7421644 - DNA, 22 bp, Homo sapiens
acagatacaaatatacaaatac

SEQ ID NO: 7421645 - DNA, 22 bp, Homo sapiens
acagataatttaattaatgcat

SEQ ID NO: 7421646 - DNA, 22 bp, Homo sapiens
acagataattagcataaatgct

SEQ ID NO: 7421647 - DNA, 22 bp, Homo sapiens
acagataatttaattaatgcat

SEQ ID NO: 7421648 - DNA, 22 bp, Homo sapiens
acagatacaaatatacaaatac

SEQ ID NO: 7421649 - DNA, 22 bp, Homo sapiens
acagatacaaatatacaaatac

SEQ ID NO: 7421650 - DNA, 22 bp, Homo sapiens
acagatacaaatatacaaatac

SEQ ID NO: 7421651 - DNA, 22 bp, Homo sapiens
acagatacaaatatacaaatac

SEQ ID NO: 7421652 - DNA, 22 bp, Homo sapiens
acagatataaactatagtagtg

SEQ ID NO: 7421653 - DNA, 22 bp, Homo sapiens
acagatataaactatagtagtg

SEQ ID NO: 7421654 - DNA, 22 bp, Homo sapiens
acagatagtatgtaaattaagc

SEQ ID NO: 7421655 - DNA, 22 bp, Homo sapiens
acagatataaactatagtagtg

SEQ ID NO: 7421656 - DNA, 22 bp, Homo sapiens
acagatataaactatagtagtg

SEQ ID NO: 7421657 - DNA, 22 bp, Homo sapiens
acagatataaactatagtagtg

SEQ ID NO: 7421658 - DNA, 22 bp, Homo sapiens
acagatataaactatagtagtg

SEQ ID NO: 7421659 - DNA, 22 bp, Homo sapiens
acagatatatgattgtgtaaat

SEQ ID NO: 7421660 - DNA, 22 bp, Homo sapiens
acagatatatgattgtgtaaat

SEQ ID NO: 7421661 - DNA, 22 bp, Homo sapiens
acagatatatgattgtgtaaat

SEQ ID NO: 7421662 - DNA, 22 bp, Homo sapiens
acagatatatgattgtgtaaat

SEQ ID NO: 7421663 - DNA, 22 bp, Homo sapiens
acagatatatgattgtgtaaat

SEQ ID NO: 7421664 - DNA, 22 bp, Homo sapiens
acagatatgcaaagcaaatgga

SEQ ID NO: 7421665 - DNA, 22 bp, Homo sapiens
acagatattatggtttctcctt

SEQ ID NO: 7421666 - DNA, 22 bp, Homo sapiens
acagatatttaagagcttttgt

SEQ ID NO: 7421667 - DNA, 22 bp, Homo sapiens
acagcagaccactactagtagg

SEQ ID NO: 7421668 - DNA, 22 bp, Homo sapiens
acagcagaccactactagtagg

SEQ ID NO: 7421669 - DNA, 22 bp, Homo sapiens
acagcagaccccagtgccatgg

SEQ ID NO: 7421670 - DNA, 22 bp, Homo sapiens
acagcagaccccagtgccatgg

SEQ ID NO: 7421671 - DNA, 22 bp, Homo sapiens
acagcagaccccagtgccatgg

SEQ ID NO: 7421672 - DNA, 21 bp, Homo sapiens
acagatatttcattgaacatt

SEQ ID NO: 7421673 - DNA, 22 bp, Homo sapiens
acagcagaccactactagtagg

SEQ ID NO: 7421674 - DNA, 22 bp, Homo sapiens
acagcagaccactactagtagg

SEQ ID NO: 7421675 - DNA, 21 bp, Homo sapiens
acagatatttcattgaacatt

SEQ ID NO: 7421676 - DNA, 21 bp, Homo sapiens
acagatatttcattgaacatt

SEQ ID NO: 7421677 - DNA, 22 bp, Homo sapiens
acagcagagtggagatgagcac

SEQ ID NO: 7421678 - DNA, 22 bp, Homo sapiens
acagcagagtggagatgagcac

SEQ ID NO: 7421679 - DNA, 22 bp, Homo sapiens
acagcagagtggagatgagcac

SEQ ID NO: 7421680 - DNA, 22 bp, Homo sapiens
acagcagagtgtgagatagcca

SEQ ID NO: 7421681 - DNA, 22 bp, Homo sapiens
acagcagagtgtgagatagcca

SEQ ID NO: 7421682 - DNA, 22 bp, Homo sapiens
acagcagagtgtgagatagcca

SEQ ID NO: 7421683 - DNA, 22 bp, Homo sapiens
acagcagagtgtgagatagcca

SEQ ID NO: 7421684 - DNA, 22 bp, Homo sapiens
acagcagagtgtgagatagcca

SEQ ID NO: 7421685 - DNA, 22 bp, Homo sapiens
acagcagagtgtgagatagcca

SEQ ID NO: 7421686 - DNA, 22 bp, Homo sapiens
acagcagagtgtgagatagcca

SEQ ID NO: 7421687 - DNA, 22 bp, Homo sapiens
acagcagagtgtgagatagcca

SEQ ID NO: 7421688 - DNA, 20 bp, Homo sapiens
acagcagataccacaactat

SEQ ID NO: 7421689 - DNA, 20 bp, Homo sapiens
acagcagataccacaactat

SEQ ID NO: 7421690 - DNA, 22 bp, Homo sapiens
acagcagatctggctacaggtt

SEQ ID NO: 7421691 - DNA, 22 bp, Homo sapiens
acagcagatctggctacaggtt

SEQ ID NO: 7421692 - DNA, 22 bp, Homo sapiens
acagcagatctggctacaggtt

SEQ ID NO: 7421693 - DNA, 22 bp, Homo sapiens
acagcagatctggctacaggtt

SEQ ID NO: 7421694 - DNA, 22 bp, Homo sapiens
acagcagatctggctacaggtt

SEQ ID NO: 7421695 - DNA, 22 bp, Homo sapiens
acagcagagtgtgagatagcca

SEQ ID NO: 7421696 - DNA, 22 bp, Homo sapiens
acagcagagtgtgagatagcca

SEQ ID NO: 7421697 - DNA, 22 bp, Homo sapiens
acagcagagtgtgagatagcca

SEQ ID NO: 7421698 - DNA, 20 bp, Homo sapiens
acagcagataccacaactat

SEQ ID NO: 7421699 - DNA, 22 bp, Homo sapiens
acagcagagttgagtagttgca

SEQ ID NO: 7421700 - DNA, 22 bp, Homo sapiens
acagcagagttgagtagttgca

SEQ ID NO: 7421701 - DNA, 22 bp, Homo sapiens
acagcagattacattctgctat

SEQ ID NO: 7421702 - DNA, 22 bp, Homo sapiens
acagcagattacattctgctat

SEQ ID NO: 7421703 - DNA, 22 bp, Homo sapiens
acagcagatttccctgggctcc

SEQ ID NO: 7421704 - DNA, 22 bp, Homo sapiens
acagcagatttccctgggctcc

SEQ ID NO: 7421705 - DNA, 22 bp, Homo sapiens
acagcagatttccctgggctcc

SEQ ID NO: 7421706 - DNA, 22 bp, Homo sapiens
acagcagatttccctgggctcc

SEQ ID NO: 7421707 - DNA, 22 bp, Homo sapiens
acagcagatttccctgggctcc

SEQ ID NO: 7421708 - DNA, 22 bp, Homo sapiens
acagcagatgacaactatttat

SEQ ID NO: 7421709 - DNA, 22 bp, Homo sapiens
acagcagatgacaactatttat

SEQ ID NO: 7421710 - DNA, 22 bp, Homo sapiens
acagcagattacattctgctat

SEQ ID NO: 7421711 - DNA, 22 bp, Homo sapiens
acagcagattacattctgctat

SEQ ID NO: 7421712 - DNA, 22 bp, Homo sapiens
acagcagatgacaactatttat

SEQ ID NO: 7421713 - DNA, 22 bp, Homo sapiens
acagcagatgacaactatttat

SEQ ID NO: 7421714 - DNA, 22 bp, Homo sapiens
acagcagatctgtggagcttat

SEQ ID NO: 7421715 - DNA, 22 bp, Homo sapiens
acagcagatctggctacaggtt

SEQ ID NO: 7421716 - DNA, 22 bp, Homo sapiens
acagcagatctgtggagcttat

SEQ ID NO: 7421717 - DNA, 22 bp, Homo sapiens
acagcagatctgtggagcttat

SEQ ID NO: 7421718 - DNA, 22 bp, Homo sapiens
acagcagatctggctacaggtt

SEQ ID NO: 7421719 - DNA, 22 bp, Homo sapiens
acagcagatctggctacaggtt

SEQ ID NO: 7421720 - DNA, 22 bp, Homo sapiens
acagcagatctggctacaggtt

SEQ ID NO: 7421721 - DNA, 22 bp, Homo sapiens
acagcagatctggctacaggtt

SEQ ID NO: 7421722 - DNA, 21 bp, Homo sapiens
acagcagcaatctgtctttcc

SEQ ID NO: 7421723 - DNA, 22 bp, Homo sapiens
acagcagcaatagcagtgacat

SEQ ID NO: 7421724 - DNA, 22 bp, Homo sapiens
acagcagcaatagcagtgacat

SEQ ID NO: 7421725 - DNA, 21 bp, Homo sapiens
acagcagcaatctgtctttcc

SEQ ID NO: 7421726 - DNA, 21 bp, Homo sapiens
acagcagcaatctgtctttcc

SEQ ID NO: 7421727 - DNA, 22 bp, Homo sapiens
acagcagcactattgacatttt

SEQ ID NO: 7421728 - DNA, 22 bp, Homo sapiens
acagcagcactattgacatttt

SEQ ID NO: 7421729 - DNA, 21 bp, Homo sapiens
acagcagcaatctgtctttcc

SEQ ID NO: 7421730 - DNA, 21 bp, Homo sapiens
acagcagcaatctgtctttcc

SEQ ID NO: 7421731 - DNA, 21 bp, Homo sapiens
acagcagcaatctgtctttcc

SEQ ID NO: 7421732 - DNA, 22 bp, Homo sapiens
acagcagatttccctgggctcc

SEQ ID NO: 7421733 - DNA, 22 bp, Homo sapiens
acagcagcaatagcagtgacat

SEQ ID NO: 7421734 - DNA, 22 bp, Homo sapiens
acagcagcaatagcagtgacat

SEQ ID NO: 7421735 - DNA, 22 bp, Homo sapiens
acagcagcaatagcagtgacat

SEQ ID NO: 7421736 - DNA, 22 bp, Homo sapiens
acagcagatttccctgggctcc

SEQ ID NO: 7421737 - DNA, 22 bp, Homo sapiens
acagcagatttccctgggctcc

SEQ ID NO: 7421738 - DNA, 22 bp, Homo sapiens
acagcagatttccctgggctcc

SEQ ID NO: 7421739 - DNA, 22 bp, Homo sapiens
acagcagcaatagcagtgacat

SEQ ID NO: 7421740 - DNA, 22 bp, Homo sapiens
acagcagcactattgacatttt

SEQ ID NO: 7421741 - DNA, 22 bp, Homo sapiens
acagcagcagaccagcatatgt

SEQ ID NO: 7421742 - DNA, 22 bp, Homo sapiens
acagcagcactattgacatttt

SEQ ID NO: 7421743 - DNA, 22 bp, Homo sapiens
acagcagcagaccagcatatgt

SEQ ID NO: 7421744 - DNA, 22 bp, Homo sapiens
acagcagcagaccagcatatgt

SEQ ID NO: 7421745 - DNA, 22 bp, Homo sapiens
acagcagcagaccagcatatgt

SEQ ID NO: 7421746 - DNA, 22 bp, Homo sapiens
acagcagcagaccagcatatgt

SEQ ID NO: 7421747 - DNA, 22 bp, Homo sapiens
acagcagcataaactgactaag

SEQ ID NO: 7421748 - DNA, 22 bp, Homo sapiens
acagcagcataaactgactaag

SEQ ID NO: 7421749 - DNA, 22 bp, Homo sapiens
acagcagcagaccagcatatgt

SEQ ID NO: 7421750 - DNA, 22 bp, Homo sapiens
acagcagcatcctatttcactc

SEQ ID NO: 7421751 - DNA, 22 bp, Homo sapiens
acagcagcataaactgactaag

SEQ ID NO: 7421752 - DNA, 22 bp, Homo sapiens
acagcagcataaactgactaag

SEQ ID NO: 7421753 - DNA, 22 bp, Homo sapiens
acagcagccagccactgtgagc

SEQ ID NO: 7421754 - DNA, 22 bp, Homo sapiens
acagcagccagccactgtgagc

SEQ ID NO: 7421755 - DNA, 22 bp, Homo sapiens
acagcagcatcctatttcactc

SEQ ID NO: 7421756 - DNA, 22 bp, Homo sapiens
acagcagcatcctatttcactc

SEQ ID NO: 7421757 - DNA, 22 bp, Homo sapiens
acagcagcatcctatttcactc

SEQ ID NO: 7421758 - DNA, 22 bp, Homo sapiens
acagcagcatcctatttcactc

SEQ ID NO: 7421759 - DNA, 22 bp, Homo sapiens
acagcagcatcctatttcactc

SEQ ID NO: 7421760 - DNA, 22 bp, Homo sapiens
acagcagcctgcagccctgtgt

SEQ ID NO: 7421761 - DNA, 22 bp, Homo sapiens
acagcagcctgcagccctgtgt

SEQ ID NO: 7421762 - DNA, 22 bp, Homo sapiens
acagcagcctgcagccctgtgt

SEQ ID NO: 7421763 - DNA, 22 bp, Homo sapiens
acagcagccagccactgtgagc

SEQ ID NO: 7421764 - DNA, 22 bp, Homo sapiens
acagcagccagccactgtgagc

SEQ ID NO: 7421765 - DNA, 22 bp, Homo sapiens
acagcagccagccactgtgagc

SEQ ID NO: 7421766 - DNA, 22 bp, Homo sapiens
acagcagccagccactgtgagc

SEQ ID NO: 7421767 - DNA, 22 bp, Homo sapiens
acagcagccagccactgtgagc

SEQ ID NO: 7421768 - DNA, 22 bp, Homo sapiens
acagcagccagccactgtgagc

SEQ ID NO: 7421769 - DNA, 20 bp, Homo sapiens
acagcagccttgctagaaac

SEQ ID NO: 7421770 - DNA, 20 bp, Homo sapiens
acagcagccttgctagaaac

SEQ ID NO: 7421771 - DNA, 22 bp, Homo sapiens
acagcagcctgcagccctgtgt

SEQ ID NO: 7421772 - DNA, 20 bp, Homo sapiens
acagcagccttgctagaaac

SEQ ID NO: 7421773 - DNA, 22 bp, Homo sapiens
acagcagccttgttggtttcga

SEQ ID NO: 7421774 - DNA, 22 bp, Homo sapiens
acagcagccttgttggtttcga

SEQ ID NO: 7421775 - DNA, 20 bp, Homo sapiens
acagcagccttgctagaaac

SEQ ID NO: 7421776 - DNA, 22 bp, Homo sapiens
acagcagccttgttggtttcga

SEQ ID NO: 7421777 - DNA, 22 bp, Homo sapiens
acagcagccttgttggtttcga

SEQ ID NO: 7421778 - DNA, 22 bp, Homo sapiens
acagcagccttgttggtttcga

SEQ ID NO: 7421779 - DNA, 22 bp, Homo sapiens
acacccagattatgcacacaaa

SEQ ID NO: 7421780 - DNA, 22 bp, Homo sapiens
acacccagagcgccagtgccga

SEQ ID NO: 7421781 - DNA, 22 bp, Homo sapiens
acacccagattatgcacacaaa

SEQ ID NO: 7421782 - DNA, 22 bp, Homo sapiens
acacccagattatgcacacaaa

SEQ ID NO: 7421783 - DNA, 22 bp, Homo sapiens
acacccagattatgcacacaaa

SEQ ID NO: 7421784 - DNA, 22 bp, Homo sapiens
acacccagagcgccagtgccga

SEQ ID NO: 7421785 - DNA, 22 bp, Homo sapiens
acacccagagcgccagtgccga

SEQ ID NO: 7421786 - DNA, 22 bp, Homo sapiens
acacccagagcgccagtgccga

SEQ ID NO: 7421787 - DNA, 21 bp, Homo sapiens
acacccacttatgcccgcttg

SEQ ID NO: 7421788 - DNA, 22 bp, Homo sapiens
acacccacctctttaggccatg

SEQ ID NO: 7421789 - DNA, 22 bp, Homo sapiens
acacccagagcgccagtgccga

SEQ ID NO: 7421790 - DNA, 22 bp, Homo sapiens
acacccagagcgccagtgccga

SEQ ID NO: 7421791 - DNA, 21 bp, Homo sapiens
acacccacttatgcccgcttg

SEQ ID NO: 7421792 - DNA, 22 bp, Homo sapiens
acaccatggttcccaaactgtg

SEQ ID NO: 7421793 - DNA, 22 bp, Homo sapiens
acaccatggttcccaaactgtg

SEQ ID NO: 7421794 - DNA, 22 bp, Homo sapiens
acaccatggttcccaaactgtg

SEQ ID NO: 7421795 - DNA, 22 bp, Homo sapiens
acaccagtcatttattcagtca

SEQ ID NO: 7421796 - DNA, 22 bp, Homo sapiens
acaccagggcctagccagggcg

SEQ ID NO: 7421797 - DNA, 22 bp, Homo sapiens
acaccatactcatgttggttcc

SEQ ID NO: 7421798 - DNA, 22 bp, Homo sapiens
acaccatgatgagtgatgtagc

SEQ ID NO: 7421799 - DNA, 22 bp, Homo sapiens
acaccatactcatgttggttcc

SEQ ID NO: 7421800 - DNA, 22 bp, Homo sapiens
acaccatactcatgttggttcc

SEQ ID NO: 7421801 - DNA, 22 bp, Homo sapiens
acaccatactcatgttggttcc

SEQ ID NO: 7421802 - DNA, 22 bp, Homo sapiens
acaccagtttcttaagaatatt

SEQ ID NO: 7421803 - DNA, 22 bp, Homo sapiens
acaccagtttcttaagaatatt

SEQ ID NO: 7421804 - DNA, 22 bp, Homo sapiens
acaccagtccttactcattttt

SEQ ID NO: 7421805 - DNA, 22 bp, Homo sapiens
agcaggtgtcactttcactcca

SEQ ID NO: 7421806 - DNA, 22 bp, Homo sapiens
agcaggtgtcactttcactcca

SEQ ID NO: 7421807 - DNA, 22 bp, Homo sapiens
agcaggtgtatcggtcacctac

SEQ ID NO: 7421808 - DNA, 22 bp, Homo sapiens
acaccagggcctagccagggcg

SEQ ID NO: 7421809 - DNA, 22 bp, Homo sapiens
agcaggtgtcggcgagggtctt

SEQ ID NO: 7421810 - DNA, 22 bp, Homo sapiens
acaccagggcctagccagggcg

SEQ ID NO: 7421811 - DNA, 22 bp, Homo sapiens
agcaggtgagcacagccaggct

SEQ ID NO: 7421812 - DNA, 22 bp, Homo sapiens
agcaggtgagcacagccaggct

SEQ ID NO: 7421813 - DNA, 22 bp, Homo sapiens
agcaggtggtaggcagtcagca

SEQ ID NO: 7421814 - DNA, 22 bp, Homo sapiens
agcaggtggtaggcagtcagca

SEQ ID NO: 7421815 - DNA, 22 bp, Homo sapiens
agcaggtggtaggcagtcagca

SEQ ID NO: 7421816 - DNA, 22 bp, Homo sapiens
agcaggtggtaggcagtcagca

SEQ ID NO: 7421817 - DNA, 22 bp, Homo sapiens
agcaggtggtaggcagtcagca

SEQ ID NO: 7421818 - DNA, 22 bp, Homo sapiens
agcaggtggtaggcagtcagca

SEQ ID NO: 7421819 - DNA, 22 bp, Homo sapiens
agcaggtgtagggctctttgta

SEQ ID NO: 7421820 - DNA, 22 bp, Homo sapiens
agcaggtgtagggctctttgta

SEQ ID NO: 7421821 - DNA, 21 bp, Homo sapiens
agcaggtgtaaaggaggaaat

SEQ ID NO: 7421822 - DNA, 21 bp, Homo sapiens
agcaggtgtaaaggaggaaat

SEQ ID NO: 7421823 - DNA, 21 bp, Homo sapiens
agcaggtgtaaaggaggaaat

SEQ ID NO: 7421824 - DNA, 21 bp, Homo sapiens
agcaggtgtaaaggaggaaat

SEQ ID NO: 7421825 - DNA, 21 bp, Homo sapiens
agcaggtgtaaaggaggaaat

SEQ ID NO: 7421826 - DNA, 22 bp, Homo sapiens
agcaggtgtatataaggctgag

SEQ ID NO: 7421827 - DNA, 22 bp, Homo sapiens
agcaggtgtatataaggctgag

SEQ ID NO: 7421828 - DNA, 22 bp, Homo sapiens
agcaggtgtatataaggctgag

SEQ ID NO: 7421829 - DNA, 21 bp, Homo sapiens
agcaggtgtaaaggaggaaat

SEQ ID NO: 7421830 - DNA, 22 bp, Homo sapiens
agcaggtgtatcggtcacctac

SEQ ID NO: 7421831 - DNA, 22 bp, Homo sapiens
agcaggtgtatataaggctgag

SEQ ID NO: 7421832 - DNA, 22 bp, Homo sapiens
agcaggtgtatcggtcacctac

SEQ ID NO: 7421833 - DNA, 22 bp, Homo sapiens
agccaatgagacttttggagtg

SEQ ID NO: 7421834 - DNA, 22 bp, Homo sapiens
agccaatgagacttttggagtg

SEQ ID NO: 7421835 - DNA, 22 bp, Homo sapiens
acactgtgtggtctctctcgga

SEQ ID NO: 7421836 - DNA, 22 bp, Homo sapiens
acactgtgtgacttctgagact

SEQ ID NO: 7421837 - DNA, 22 bp, Homo sapiens
agccaatagcattatacagtga

SEQ ID NO: 7421838 - DNA, 22 bp, Homo sapiens
agccaatcatcctcagactctc

SEQ ID NO: 7421839 - DNA, 22 bp, Homo sapiens
agccaatctacaacaaaggata

SEQ ID NO: 7421840 - DNA, 22 bp, Homo sapiens
agccaataaatttacaactaga

SEQ ID NO: 7421841 - DNA, 20 bp, Homo sapiens
agccaatacagcaaaatttg

SEQ ID NO: 7421842 - DNA, 22 bp, Homo sapiens
agccaatacactgaagatctaa

SEQ ID NO: 7421843 - DNA, 22 bp, Homo sapiens
agccaaggtatcatgagaggca

SEQ ID NO: 7421844 - DNA, 22 bp, Homo sapiens
agccaaggtcgccccagggcaa

SEQ ID NO: 7421845 - DNA, 22 bp, Homo sapiens
agccaaggtcgccccagggcaa

SEQ ID NO: 7421846 - DNA, 22 bp, Homo sapiens
agccaaggtcgccccagggcaa

SEQ ID NO: 7421847 - DNA, 22 bp, Homo sapiens
agccaaggtcgccccagggcaa

SEQ ID NO: 7421848 - DNA, 22 bp, Homo sapiens
agccaaggtcgccccagggcaa

SEQ ID NO: 7421849 - DNA, 22 bp, Homo sapiens
agccaaggtatcatgagaggca

SEQ ID NO: 7421850 - DNA, 22 bp, Homo sapiens
agccaaggtatcatgagaggca

SEQ ID NO: 7421851 - DNA, 22 bp, Homo sapiens
agccaaggtatcatgagaggca

SEQ ID NO: 7421852 - DNA, 22 bp, Homo sapiens
agccaaggtatcatgagaggca

SEQ ID NO: 7421853 - DNA, 22 bp, Homo sapiens
agccaagggtcagctgcacaga

SEQ ID NO: 7421854 - DNA, 22 bp, Homo sapiens
agccaaggcagctagagctctg

SEQ ID NO: 7421855 - DNA, 22 bp, Homo sapiens
agccaaggcagctagagctctg

SEQ ID NO: 7421856 - DNA, 22 bp, Homo sapiens
agccaaggcagctagagctctg

SEQ ID NO: 7421857 - DNA, 22 bp, Homo sapiens
agccaaggcagctagagctctg

SEQ ID NO: 7421858 - DNA, 22 bp, Homo sapiens
agccaagggtcagctgcacaga

SEQ ID NO: 7421859 - DNA, 22 bp, Homo sapiens
agccaagggtcagctgcacaga

SEQ ID NO: 7421860 - DNA, 22 bp, Homo sapiens
agccaaggcagctagagctctg

SEQ ID NO: 7421861 - DNA, 22 bp, Homo sapiens
agccaagggtcagctgcacaga

SEQ ID NO: 7421862 - DNA, 22 bp, Homo sapiens
agccaaggcagctagagctctg

SEQ ID NO: 7421863 - DNA, 22 bp, Homo sapiens
agccaaggcagctagagctctg

SEQ ID NO: 7421864 - DNA, 22 bp, Homo sapiens
agccaaggcagctagagctctg

SEQ ID NO: 7421865 - DNA, 22 bp, Homo sapiens
agccaaggagtgcaggtggctt

SEQ ID NO: 7421866 - DNA, 22 bp, Homo sapiens
agccaaggagtgcaggtggctt

SEQ ID NO: 7421867 - DNA, 22 bp, Homo sapiens
agccaaggagtgcaggtggctt

SEQ ID NO: 7421868 - DNA, 22 bp, Homo sapiens
agccaaggagtgcaggtggctt

SEQ ID NO: 7421869 - DNA, 22 bp, Homo sapiens
agccaaggagtgcaggtggctt

SEQ ID NO: 7421870 - DNA, 18 bp, Homo sapiens
agccaaggaggaggagga

SEQ ID NO: 7421871 - DNA, 22 bp, Homo sapiens
agccaaggagtgcaggtggctt

SEQ ID NO: 7421872 - DNA, 22 bp, Homo sapiens
agccaaggagtgcaggtggctt

SEQ ID NO: 7421873 - DNA, 18 bp, Homo sapiens
agccaaggaggaggagga

SEQ ID NO: 7421874 - DNA, 18 bp, Homo sapiens
agccaaggaggaggagga

SEQ ID NO: 7421875 - DNA, 18 bp, Homo sapiens
agccaaggaggaggagga

SEQ ID NO: 7421876 - DNA, 18 bp, Homo sapiens
agccaaggaggaggagga

SEQ ID NO: 7421877 - DNA, 18 bp, Homo sapiens
agccaaggaggaggagga

SEQ ID NO: 7421878 - DNA, 22 bp, Homo sapiens
agccaaggactcagtggtaggc

SEQ ID NO: 7421879 - DNA, 22 bp, Homo sapiens
agccaaggactcagtggtaggc

SEQ ID NO: 7421880 - DNA, 22 bp, Homo sapiens
agccaaggactcagtggtaggc

SEQ ID NO: 7421881 - DNA, 22 bp, Homo sapiens
agcatttacctcaatgcatctg

SEQ ID NO: 7421882 - DNA, 22 bp, Homo sapiens
agccaaggacacggagcctcct

SEQ ID NO: 7421883 - DNA, 22 bp, Homo sapiens
agcatttaattacagtttaatt

SEQ ID NO: 7421884 - DNA, 22 bp, Homo sapiens
agcatttaattacagtttaatt

SEQ ID NO: 7421885 - DNA, 22 bp, Homo sapiens
agcatttacctcaatgcatctg

SEQ ID NO: 7421886 - DNA, 20 bp, Homo sapiens
agcatttacatcccttggtg

SEQ ID NO: 7421887 - DNA, 22 bp, Homo sapiens
acacccagcttttgaatgccct

SEQ ID NO: 7421888 - DNA, 22 bp, Homo sapiens
acacccagctgggccacctcca

SEQ ID NO: 7421889 - DNA, 22 bp, Homo sapiens
acacccaggaataaggactggg

SEQ ID NO: 7421890 - DNA, 22 bp, Homo sapiens
acacccaggaataaggactggg

SEQ ID NO: 7421891 - DNA, 22 bp, Homo sapiens
acacccagcttttgaatgccct

SEQ ID NO: 7421892 - DNA, 22 bp, Homo sapiens
acacccagcttttgaatgccct

SEQ ID NO: 7421893 - DNA, 22 bp, Homo sapiens
acacccagcttttgaatgccct

SEQ ID NO: 7421894 - DNA, 22 bp, Homo sapiens
acacccagctgggccacctcca

SEQ ID NO: 7421895 - DNA, 22 bp, Homo sapiens
acacccagattatgcacacaaa

SEQ ID NO: 7421896 - DNA, 22 bp, Homo sapiens
acacccagctgggccacctcca

SEQ ID NO: 7421897 - DNA, 22 bp, Homo sapiens
acacccagctgggccacctcca

SEQ ID NO: 7421898 - DNA, 22 bp, Homo sapiens
acacccagcttttgaatgccct

SEQ ID NO: 7421899 - DNA, 22 bp, Homo sapiens
acacccagctgggccacctcca

SEQ ID NO: 7421900 - DNA, 22 bp, Homo sapiens
acacccagctgggccacctcca

SEQ ID NO: 7421901 - DNA, 22 bp, Homo sapiens
agccaggaaccagctacagtct

SEQ ID NO: 7421902 - DNA, 22 bp, Homo sapiens
agccaggaaccagctacagtct

SEQ ID NO: 7421903 - DNA, 22 bp, Homo sapiens
agccaggaaccagctacagtct

SEQ ID NO: 7421904 - DNA, 22 bp, Homo sapiens
agccagctttcacaaatgaaga

SEQ ID NO: 7421905 - DNA, 22 bp, Homo sapiens
agccagctttcacaaatgaaga

SEQ ID NO: 7421906 - DNA, 22 bp, Homo sapiens
agccaggaaccagctacagtct

SEQ ID NO: 7421907 - DNA, 22 bp, Homo sapiens
agccaggaaccagctacagtct

SEQ ID NO: 7421908 - DNA, 22 bp, Homo sapiens
agccagctgttctggggcagca

SEQ ID NO: 7421909 - DNA, 22 bp, Homo sapiens
agccagctgttctggggcagca

SEQ ID NO: 7421910 - DNA, 22 bp, Homo sapiens
agccagcttctttacggtggca

SEQ ID NO: 7421911 - DNA, 22 bp, Homo sapiens
agccagcttctttacggtggca

SEQ ID NO: 7421912 - DNA, 22 bp, Homo sapiens
agccaggaagaaggtcacacca

SEQ ID NO: 7421913 - DNA, 22 bp, Homo sapiens
agccaggaagaaggtcacacca

SEQ ID NO: 7421914 - DNA, 22 bp, Homo sapiens
agccaggaagagaggcctcacc

SEQ ID NO: 7421915 - DNA, 22 bp, Homo sapiens
agccaggaagagaggcctcacc

SEQ ID NO: 7421916 - DNA, 22 bp, Homo sapiens
agccaggaagagaggcctcacc

SEQ ID NO: 7421917 - DNA, 22 bp, Homo sapiens
agccaggaagaaggtcacacca

SEQ ID NO: 7421918 - DNA, 22 bp, Homo sapiens
agccaggaagagaggcctcacc

SEQ ID NO: 7421919 - DNA, 22 bp, Homo sapiens
agccaggaagagaggcctcacc

SEQ ID NO: 7421920 - DNA, 22 bp, Homo sapiens
agccaggaagagaggcctcacc

SEQ ID NO: 7421921 - DNA, 22 bp, Homo sapiens
agccaggaagagaggcctcacc

SEQ ID NO: 7421922 - DNA, 22 bp, Homo sapiens
agccagctgtcctccctttcct

SEQ ID NO: 7421923 - DNA, 22 bp, Homo sapiens
agccagctgtggctatggctcc

SEQ ID NO: 7421924 - DNA, 22 bp, Homo sapiens
agccagctgtggctatggctcc

SEQ ID NO: 7421925 - DNA, 22 bp, Homo sapiens
agccagctgtactgcctgctca

SEQ ID NO: 7421926 - DNA, 22 bp, Homo sapiens
agccagctgtcctccctttcct

SEQ ID NO: 7421927 - DNA, 22 bp, Homo sapiens
agccagctgtactgcctgctca

SEQ ID NO: 7421928 - DNA, 22 bp, Homo sapiens
agccagctgtactgcctgctca

SEQ ID NO: 7421929 - DNA, 22 bp, Homo sapiens
agccagctggtgggtcagctgg

SEQ ID NO: 7421930 - DNA, 22 bp, Homo sapiens
agccagctgtgggctcaggcgg

SEQ ID NO: 7421931 - DNA, 22 bp, Homo sapiens
agccagctgtgggctcaggcgg

SEQ ID NO: 7421932 - DNA, 22 bp, Homo sapiens
agccagctgtgggctcaggcgg

SEQ ID NO: 7421933 - DNA, 22 bp, Homo sapiens
agccagctgtgtggtcaggcaa

SEQ ID NO: 7421934 - DNA, 22 bp, Homo sapiens
agccagctgttctggggcagca

SEQ ID NO: 7421935 - DNA, 22 bp, Homo sapiens
agccagctgtgtggtcaggcaa

SEQ ID NO: 7421936 - DNA, 22 bp, Homo sapiens
agccagctgtgtggtcaggcaa

SEQ ID NO: 7421937 - DNA, 19 bp, Homo sapiens
agccagagtggcccagggg

SEQ ID NO: 7421938 - DNA, 19 bp, Homo sapiens
agccagagtggcccagggg

SEQ ID NO: 7421939 - DNA, 19 bp, Homo sapiens
agccagagtggcccagggg

SEQ ID NO: 7421940 - DNA, 19 bp, Homo sapiens
agccagagtggcccagggg

SEQ ID NO: 7421941 - DNA, 19 bp, Homo sapiens
agccagagtggcccagggg

SEQ ID NO: 7421942 - DNA, 22 bp, Homo sapiens
agccagaggtcatgagcacagg

SEQ ID NO: 7421943 - DNA, 22 bp, Homo sapiens
agccagaggtcatgagcacagg

SEQ ID NO: 7421944 - DNA, 19 bp, Homo sapiens
agccagagtggcccagggg

SEQ ID NO: 7421945 - DNA, 22 bp, Homo sapiens
agccagctggagaccactgttt

SEQ ID NO: 7421946 - DNA, 22 bp, Homo sapiens
agccagctggagaccactgttt

SEQ ID NO: 7421947 - DNA, 22 bp, Homo sapiens
agccagctggtgggtcagctgg

SEQ ID NO: 7421948 - DNA, 22 bp, Homo sapiens
agccagctgctcgggggaaaca

SEQ ID NO: 7421949 - DNA, 22 bp, Homo sapiens
agccagctggagaccactgttt

SEQ ID NO: 7421950 - DNA, 22 bp, Homo sapiens
agccagaggtcatgagcacagg

SEQ ID NO: 7421951 - DNA, 22 bp, Homo sapiens
agccagagggatctttctaaga

SEQ ID NO: 7421952 - DNA, 22 bp, Homo sapiens
agccagaggtcatgagcacagg

SEQ ID NO: 7421953 - DNA, 22 bp, Homo sapiens
agccagagggatctttctaaga

SEQ ID NO: 7421954 - DNA, 22 bp, Homo sapiens
agccagaggtcatgagcacagg

SEQ ID NO: 7421955 - DNA, 22 bp, Homo sapiens
agccagaggtcatgagcacagg

SEQ ID NO: 7421956 - DNA, 22 bp, Homo sapiens
agccagaggtcatgagcacagg

SEQ ID NO: 7421957 - DNA, 22 bp, Homo sapiens
agccagaggtcatgagcacagg

SEQ ID NO: 7421958 - DNA, 22 bp, Homo sapiens
agccagaggccagcctgcctca

SEQ ID NO: 7421959 - DNA, 22 bp, Homo sapiens
agccagaggccagcctgcctca

SEQ ID NO: 7421960 - DNA, 22 bp, Homo sapiens
agccagaggccagcctgcctca

SEQ ID NO: 7421961 - DNA, 22 bp, Homo sapiens
agccagaggccagcctgcctca

SEQ ID NO: 7421962 - DNA, 22 bp, Homo sapiens
agccagaggccagcctgcctca

SEQ ID NO: 7421963 - DNA, 22 bp, Homo sapiens
acactgttgctggcacagacag

SEQ ID NO: 7421964 - DNA, 22 bp, Homo sapiens
acactgttctttgcactgagaa

SEQ ID NO: 7421965 - DNA, 20 bp, Homo sapiens
acactgttcttcacacattt

SEQ ID NO: 7421966 - DNA, 22 bp, Homo sapiens
acactgttctttgcactgagaa

SEQ ID NO: 7421967 - DNA, 20 bp, Homo sapiens
acactgttcttcacacattt

SEQ ID NO: 7421968 - DNA, 20 bp, Homo sapiens
acactgttcttcacacattt

SEQ ID NO: 7421969 - DNA, 22 bp, Homo sapiens
acactgttcctgaaattgttat

SEQ ID NO: 7421970 - DNA, 20 bp, Homo sapiens
acactgttcttcacacattt

SEQ ID NO: 7421971 - DNA, 20 bp, Homo sapiens
acactgttcttcacacattt

SEQ ID NO: 7421972 - DNA, 22 bp, Homo sapiens
acactgttcctgaaattgttat

SEQ ID NO: 7421973 - DNA, 22 bp, Homo sapiens
acactgttccacactaagaagg

SEQ ID NO: 7421974 - DNA, 22 bp, Homo sapiens
acactgttccacactaagaagg

SEQ ID NO: 7421975 - DNA, 22 bp, Homo sapiens
acactgttccacactaagaagg

SEQ ID NO: 7421976 - DNA, 22 bp, Homo sapiens
acactgttccacactaagaagg

SEQ ID NO: 7421977 - DNA, 22 bp, Homo sapiens
acactgtgtggtctctctcgga

SEQ ID NO: 7421978 - DNA, 14 bp, Homo sapiens
acactgtgtttaga

SEQ ID NO: 7421979 - DNA, 22 bp, Homo sapiens
acactgtgtttacatagagaat

SEQ ID NO: 7421980 - DNA, 22 bp, Homo sapiens
acactgtgtttacatagagaat

SEQ ID NO: 7421981 - DNA, 22 bp, Homo sapiens
acactgtgtttacatagagaat

SEQ ID NO: 7421982 - DNA, 22 bp, Homo sapiens
acacttagctgagggtgcagat

SEQ ID NO: 7421983 - DNA, 22 bp, Homo sapiens
acacttaagcatgaagtataaa

SEQ ID NO: 7421984 - DNA, 22 bp, Homo sapiens
acacttcaaagggtgacttgat

SEQ ID NO: 7421985 - DNA, 22 bp, Homo sapiens
acacttatttttgtccacttcc

SEQ ID NO: 7421986 - DNA, 22 bp, Homo sapiens
acacttatttttgtccacttcc

SEQ ID NO: 7421987 - DNA, 22 bp, Homo sapiens
acacttcaaagggtgacttgat

SEQ ID NO: 7421988 - DNA, 22 bp, Homo sapiens
acacttcaaagggtgacttgat

SEQ ID NO: 7421989 - DNA, 22 bp, Homo sapiens
acacttaagcatgaagtataaa

SEQ ID NO: 7421990 - DNA, 22 bp, Homo sapiens
acacttaacttctgagaataaa

SEQ ID NO: 7421991 - DNA, 22 bp, Homo sapiens
acacttaagcatgaagtataaa

SEQ ID NO: 7421992 - DNA, 22 bp, Homo sapiens
acactgttgcttacagttttgg

SEQ ID NO: 7421993 - DNA, 22 bp, Homo sapiens
acactgttgcttacagttttgg

SEQ ID NO: 7421994 - DNA, 22 bp, Homo sapiens
acactgttgctggcacagacag

SEQ ID NO: 7421995 - DNA, 22 bp, Homo sapiens
acactgttgctggcacagacag

SEQ ID NO: 7421996 - DNA, 22 bp, Homo sapiens
acactgttgctggcacagacag

SEQ ID NO: 7421997 - DNA, 22 bp, Homo sapiens
agccacagtctgatgcctgaga

SEQ ID NO: 7421998 - DNA, 22 bp, Homo sapiens
acacttcaaatggttggaaaat

SEQ ID NO: 7421999 - DNA, 22 bp, Homo sapiens
acacttcaaatggttggaaaat

SEQ ID NO: 7422000 - DNA, 23 bp, Homo sapiens
acacttcacccattgtgatagga

SEQ ID NO: 7422001 - DNA, 22 bp, Homo sapiens
agccacagtctgatgcctgaga

SEQ ID NO: 7422002 - DNA, 22 bp, Homo sapiens
agccacagtctgtagccagctt

SEQ ID NO: 7422003 - DNA, 22 bp, Homo sapiens
agccacagtctgtagccagctt

SEQ ID NO: 7422004 - DNA, 22 bp, Homo sapiens
agccacagtctgtagccagctt

SEQ ID NO: 7422005 - DNA, 22 bp, Homo sapiens
agccacagtctgtagccagctt

SEQ ID NO: 7422006 - DNA, 22 bp, Homo sapiens
agccagagattgagatgcaggc

SEQ ID NO: 7422007 - DNA, 22 bp, Homo sapiens
agccagagattgagatgcaggc

SEQ ID NO: 7422008 - DNA, 22 bp, Homo sapiens
agccagagattgagatgcaggc

SEQ ID NO: 7422009 - DNA, 22 bp, Homo sapiens
agccagagattgagatgcaggc

SEQ ID NO: 7422010 - DNA, 22 bp, Homo sapiens
agccagagatccatccctagga

SEQ ID NO: 7422011 - DNA, 22 bp, Homo sapiens
agccacagtctgtagccagctt

SEQ ID NO: 7422012 - DNA, 22 bp, Homo sapiens
agccagagctgatgtcattctc

SEQ ID NO: 7422013 - DNA, 22 bp, Homo sapiens
agccagagattgagatgcaggc

SEQ ID NO: 7422014 - DNA, 22 bp, Homo sapiens
agccagagcagggaattggaca

SEQ ID NO: 7422015 - DNA, 22 bp, Homo sapiens
agccagagattgagatgcaggc

SEQ ID NO: 7422016 - DNA, 22 bp, Homo sapiens
agccagagattgagatgcaggc

SEQ ID NO: 7422017 - DNA, 22 bp, Homo sapiens
agccagagattgagatgcaggc

SEQ ID NO: 7422018 - DNA, 22 bp, Homo sapiens
agccagagattgagatgcaggc

SEQ ID NO: 7422019 - DNA, 22 bp, Homo sapiens
agccagaggaagcctggccctc

SEQ ID NO: 7422020 - DNA, 22 bp, Homo sapiens
agccagaggaagcctggccctc

SEQ ID NO: 7422021 - DNA, 22 bp, Homo sapiens
agccagaggaagcctggccctc

SEQ ID NO: 7422022 - DNA, 22 bp, Homo sapiens
agccagaggaagcctggccctc

SEQ ID NO: 7422023 - DNA, 22 bp, Homo sapiens
agccagaggaagcctggccctc

SEQ ID NO: 7422024 - DNA, 22 bp, Homo sapiens
agccagaggaagcctggccctc

SEQ ID NO: 7422025 - DNA, 22 bp, Homo sapiens
agccagaggaacttgatgactg

SEQ ID NO: 7422026 - DNA, 22 bp, Homo sapiens
agccagaggaacttgatgactg

SEQ ID NO: 7422027 - DNA, 19 bp, Homo sapiens
agcaggccacagggccagc

SEQ ID NO: 7422028 - DNA, 22 bp, Homo sapiens
agcaggcttggtccccagcctc

SEQ ID NO: 7422029 - DNA, 19 bp, Homo sapiens
agcaggccacagggccagc

SEQ ID NO: 7422030 - DNA, 22 bp, Homo sapiens
agcaggcttggtccccagcctc

SEQ ID NO: 7422031 - DNA, 22 bp, Homo sapiens
agcaggcttggtccccagcctc

SEQ ID NO: 7422032 - DNA, 22 bp, Homo sapiens
agcaggcttgttatgtctgaga

SEQ ID NO: 7422033 - DNA, 22 bp, Homo sapiens
agcaggcttgttatgtctgaga

SEQ ID NO: 7422034 - DNA, 22 bp, Homo sapiens
agcaggcttggtccccagcctc

SEQ ID NO: 7422035 - DNA, 16 bp, Homo sapiens
acacagttttaaggca

SEQ ID NO: 7422036 - DNA, 22 bp, Homo sapiens
acacagtttttcagacagagat

SEQ ID NO: 7422037 - DNA, 22 bp, Homo sapiens
acacataagaaactacaaagag

SEQ ID NO: 7422038 - DNA, 19 bp, Homo sapiens
agcaggccacagggccagc

SEQ ID NO: 7422039 - DNA, 22 bp, Homo sapiens
acacagtttttcagacagagat

SEQ ID NO: 7422040 - DNA, 22 bp, Homo sapiens
acacataagaaactacaaagag

SEQ ID NO: 7422041 - DNA, 19 bp, Homo sapiens
agcaggccacagggccagc

SEQ ID NO: 7422042 - DNA, 22 bp, Homo sapiens
agcagggaagcctccagaacct

SEQ ID NO: 7422043 - DNA, 22 bp, Homo sapiens
agcagggaagcctccagaacct

SEQ ID NO: 7422044 - DNA, 22 bp, Homo sapiens
agcagggaagcctccagaacct

SEQ ID NO: 7422045 - DNA, 22 bp, Homo sapiens
agcagggaagcctccagaacct

SEQ ID NO: 7422046 - DNA, 22 bp, Homo sapiens
agcagggaagcctccagaacct

SEQ ID NO: 7422047 - DNA, 21 bp, Homo sapiens
agcaggctttggagtggggct

SEQ ID NO: 7422048 - DNA, 22 bp, Homo sapiens
agcaggctttccacagaaggag

SEQ ID NO: 7422049 - DNA, 22 bp, Homo sapiens
agcaggctttccacagaaggag

SEQ ID NO: 7422050 - DNA, 22 bp, Homo sapiens
agcaggctttccacagaaggag

SEQ ID NO: 7422051 - DNA, 21 bp, Homo sapiens
agcaggctttggagtggggct

SEQ ID NO: 7422052 - DNA, 21 bp, Homo sapiens
agcaggctttggagtggggct

SEQ ID NO: 7422053 - DNA, 22 bp, Homo sapiens
agcaggctttcaagagtcttct

SEQ ID NO: 7422054 - DNA, 22 bp, Homo sapiens
agcaggctttcaagagtcttct

SEQ ID NO: 7422055 - DNA, 22 bp, Homo sapiens
agcaggctttcaagagtcttct

SEQ ID NO: 7422056 - DNA, 22 bp, Homo sapiens
agcaggctttccacagaaggag

SEQ ID NO: 7422057 - DNA, 22 bp, Homo sapiens
agcaggctttccacagaaggag

SEQ ID NO: 7422058 - DNA, 22 bp, Homo sapiens
agcaggctttccacagaaggag

SEQ ID NO: 7422059 - DNA, 22 bp, Homo sapiens
agcaggctttccacagaaggag

SEQ ID NO: 7422060 - DNA, 22 bp, Homo sapiens
acacagttcatgcatgaggtct

SEQ ID NO: 7422061 - DNA, 22 bp, Homo sapiens
acacagttcgtgcttttctatt

SEQ ID NO: 7422062 - DNA, 22 bp, Homo sapiens
acacagttcgtgcttttctatt

SEQ ID NO: 7422063 - DNA, 22 bp, Homo sapiens
acacagttcaggatcaaatagc

SEQ ID NO: 7422064 - DNA, 22 bp, Homo sapiens
acacagttcaggatcaaatagc

SEQ ID NO: 7422065 - DNA, 22 bp, Homo sapiens
acacagttcaggatcaaatagc

SEQ ID NO: 7422066 - DNA, 22 bp, Homo sapiens
acacagttcgttgttttctact

SEQ ID NO: 7422067 - DNA, 22 bp, Homo sapiens
acacagttcgttgttttctact

SEQ ID NO: 7422068 - DNA, 22 bp, Homo sapiens
acacagttctcttcttgtaact

SEQ ID NO: 7422069 - DNA, 22 bp, Homo sapiens
acacagttcttagcaggtgtct

SEQ ID NO: 7422070 - DNA, 22 bp, Homo sapiens
acacagttcttagcaggtgtct

SEQ ID NO: 7422071 - DNA, 22 bp, Homo sapiens
acacagttcttagcaggtgtct

SEQ ID NO: 7422072 - DNA, 22 bp, Homo sapiens
acacagttctttcactgttggt

SEQ ID NO: 7422073 - DNA, 22 bp, Homo sapiens
acacagttctttcactgttggt

SEQ ID NO: 7422074 - DNA, 22 bp, Homo sapiens
acacagttctttcactgttggt

SEQ ID NO: 7422075 - DNA, 22 bp, Homo sapiens
acacagttcttagcaggtgtct

SEQ ID NO: 7422076 - DNA, 22 bp, Homo sapiens
acacagttggtggctcagtctg

SEQ ID NO: 7422077 - DNA, 22 bp, Homo sapiens
acacagtttaaacgattagtac

SEQ ID NO: 7422078 - DNA, 22 bp, Homo sapiens
acacagtttaaacgattagtac

SEQ ID NO: 7422079 - DNA, 22 bp, Homo sapiens
acacagtttatggtattctgtt

SEQ ID NO: 7422080 - DNA, 22 bp, Homo sapiens
acacagtttatggtattctgtt

SEQ ID NO: 7422081 - DNA, 22 bp, Homo sapiens
acacagtttatggtattctgtt

SEQ ID NO: 7422082 - DNA, 22 bp, Homo sapiens
acacagtttatggtattctgtt

SEQ ID NO: 7422083 - DNA, 16 bp, Homo sapiens
acacagttttaaggca

SEQ ID NO: 7422084 - DNA, 22 bp, Homo sapiens
acacagttggtggctcagtctg

SEQ ID NO: 7422085 - DNA, 22 bp, Homo sapiens
acacagttggtggctcagtctg

SEQ ID NO: 7422086 - DNA, 22 bp, Homo sapiens
acacagttgattgtcactcagg

SEQ ID NO: 7422087 - DNA, 22 bp, Homo sapiens
acacagttgattgtcactcagg

SEQ ID NO: 7422088 - DNA, 22 bp, Homo sapiens
acacagttgattgtcactcagg

SEQ ID NO: 7422089 - DNA, 22 bp, Homo sapiens
acacagttgattgtcactcagg

SEQ ID NO: 7422090 - DNA, 22 bp, Homo sapiens
acacagttctttcactgttggt

SEQ ID NO: 7422091 - DNA, 22 bp, Homo sapiens
acacatcatgccaagtttcacc

SEQ ID NO: 7422092 - DNA, 22 bp, Homo sapiens
acacatcatgccaagtttcacc

SEQ ID NO: 7422093 - DNA, 22 bp, Homo sapiens
acacatctatattgcatctgca

SEQ ID NO: 7422094 - DNA, 22 bp, Homo sapiens
acacatctatattgcatctgca

SEQ ID NO: 7422095 - DNA, 22 bp, Homo sapiens
acacatctatctctacacaagg

SEQ ID NO: 7422096 - DNA, 22 bp, Homo sapiens
acacatctatctctacacaagg

SEQ ID NO: 7422097 - DNA, 22 bp, Homo sapiens
acacatcctgaccaagttcagg

SEQ ID NO: 7422098 - DNA, 22 bp, Homo sapiens
acacatctatattgcatctgca

SEQ ID NO: 7422099 - DNA, 22 bp, Homo sapiens
acacatctatattgcatctgca

SEQ ID NO: 7422100 - DNA, 22 bp, Homo sapiens
acacatctcaggggacactctc

SEQ ID NO: 7422101 - DNA, 22 bp, Homo sapiens
acacatctccagccagcaggag

SEQ ID NO: 7422102 - DNA, 22 bp, Homo sapiens
acacatctccagccagcaggag

SEQ ID NO: 7422103 - DNA, 22 bp, Homo sapiens
agcaggtgagcacagccaggct

SEQ ID NO: 7422104 - DNA, 22 bp, Homo sapiens
agcaggtgagcacagccaggct

SEQ ID NO: 7422105 - DNA, 22 bp, Homo sapiens
acacatctcaggggacactctc

SEQ ID NO: 7422106 - DNA, 22 bp, Homo sapiens
acacatctatctctacacaagg

SEQ ID NO: 7422107 - DNA, 22 bp, Homo sapiens
acacatctatctctacacaagg

SEQ ID NO: 7422108 - DNA, 22 bp, Homo sapiens
acacatctatctctacacaagg

SEQ ID NO: 7422109 - DNA, 22 bp, Homo sapiens
acacatcagcctcagctttggg

SEQ ID NO: 7422110 - DNA, 22 bp, Homo sapiens
acacatcatgccaagtttcacc

SEQ ID NO: 7422111 - DNA, 22 bp, Homo sapiens
acacatcagcctcagctttggg

SEQ ID NO: 7422112 - DNA, 22 bp, Homo sapiens
acacatcagcctcagctttggg

SEQ ID NO: 7422113 - DNA, 22 bp, Homo sapiens
acacatcagaaatatgaatgag

SEQ ID NO: 7422114 - DNA, 22 bp, Homo sapiens
acacatcagaaatatgaatgag

SEQ ID NO: 7422115 - DNA, 22 bp, Homo sapiens
acacatcagaaatatgaatgag

SEQ ID NO: 7422116 - DNA, 22 bp, Homo sapiens
acacatcagaaatatgaatgag

SEQ ID NO: 7422117 - DNA, 22 bp, Homo sapiens
acacatatgtggcaactgtaga

SEQ ID NO: 7422118 - DNA, 22 bp, Homo sapiens
acacatattcatatgtacttac

SEQ ID NO: 7422119 - DNA, 22 bp, Homo sapiens
acacatattcatatgtacttac

SEQ ID NO: 7422120 - DNA, 22 bp, Homo sapiens
acacatattcatatgtacttac

SEQ ID NO: 7422121 - DNA, 22 bp, Homo sapiens
acacatatgtggcaactgtaga

SEQ ID NO: 7422122 - DNA, 22 bp, Homo sapiens
acacatatgtggcaactgtaga

SEQ ID NO: 7422123 - DNA, 22 bp, Homo sapiens
acacatatgtggcaactgtaga

SEQ ID NO: 7422124 - DNA, 22 bp, Homo sapiens
acacatatgtggcaactgtaga

SEQ ID NO: 7422125 - DNA, 22 bp, Homo sapiens
acacatatgtggcaactgtaga

SEQ ID NO: 7422126 - DNA, 22 bp, Homo sapiens
acacatatgtggcaactgtaga

SEQ ID NO: 7422127 - DNA, 22 bp, Homo sapiens
agcagggactgagccagtggga

SEQ ID NO: 7422128 - DNA, 22 bp, Homo sapiens
agcagggactgagccagtggga

SEQ ID NO: 7422129 - DNA, 22 bp, Homo sapiens
agcagggactgagccagtggga

SEQ ID NO: 7422130 - DNA, 22 bp, Homo sapiens
agcagggactgagccagtggga

SEQ ID NO: 7422131 - DNA, 22 bp, Homo sapiens
agcagggactgagccagtggga

SEQ ID NO: 7422132 - DNA, 22 bp, Homo sapiens
agcagggactacgtgaaagtga

SEQ ID NO: 7422133 - DNA, 22 bp, Homo sapiens
agcagggactacgtgaaagtga

SEQ ID NO: 7422134 - DNA, 22 bp, Homo sapiens
agcagggactgagccagtggga

SEQ ID NO: 7422135 - DNA, 22 bp, Homo sapiens
agcagggactgagccagtggga

SEQ ID NO: 7422136 - DNA, 22 bp, Homo sapiens
agcagggactgagccagtggga

SEQ ID NO: 7422137 - DNA, 22 bp, Homo sapiens
acacatatgtcattgaaaaatc

SEQ ID NO: 7422138 - DNA, 22 bp, Homo sapiens
acacatatgtcattgaaaaatc

SEQ ID NO: 7422139 - DNA, 22 bp, Homo sapiens
acacatatgtcattgaaaaatc

SEQ ID NO: 7422140 - DNA, 22 bp, Homo sapiens
agcagggagaccatctcttcct

SEQ ID NO: 7422141 - DNA, 22 bp, Homo sapiens
agcagggagaccatctcttcct

SEQ ID NO: 7422142 - DNA, 22 bp, Homo sapiens
acacatatgtcattgaaaaatc

SEQ ID NO: 7422143 - DNA, 22 bp, Homo sapiens
acacatatgtcattgaaaaatc

SEQ ID NO: 7422144 - DNA, 22 bp, Homo sapiens
agcagggaagcctccagaacct

SEQ ID NO: 7422145 - DNA, 22 bp, Homo sapiens
agcagggaagcctccagaacct

SEQ ID NO: 7422146 - DNA, 22 bp, Homo sapiens
agcagggaatagcggaaagaat

SEQ ID NO: 7422147 - DNA, 22 bp, Homo sapiens
agcagggaatagcggaaagaat

SEQ ID NO: 7422148 - DNA, 22 bp, Homo sapiens
agcagggaatagcggaaagaat

SEQ ID NO: 7422149 - DNA, 22 bp, Homo sapiens
agcagggacatggcatctctcc

SEQ ID NO: 7422150 - DNA, 22 bp, Homo sapiens
agcagggacatggcatctctcc

SEQ ID NO: 7422151 - DNA, 19 bp, Homo sapiens
agcagggacatggaacttt

SEQ ID NO: 7422152 - DNA, 19 bp, Homo sapiens
agcagggacatggaacttt

SEQ ID NO: 7422153 - DNA, 19 bp, Homo sapiens
agcagggacatggaacttt

SEQ ID NO: 7422154 - DNA, 22 bp, Homo sapiens
agcagggactacgtgaaagtga

SEQ ID NO: 7422155 - DNA, 22 bp, Homo sapiens
agcagggactacgtgaaagtga

SEQ ID NO: 7422156 - DNA, 22 bp, Homo sapiens
agcagggactacgtgaaagtga

SEQ ID NO: 7422157 - DNA, 22 bp, Homo sapiens
agcagggacatggcatctctcc

SEQ ID NO: 7422158 - DNA, 22 bp, Homo sapiens
agcagggacatggcatctctcc

SEQ ID NO: 7422159 - DNA, 22 bp, Homo sapiens
agcagggacatggcatctctcc

SEQ ID NO: 7422160 - DNA, 22 bp, Homo sapiens
acacacaactcattgtgtaata

SEQ ID NO: 7422161 - DNA, 22 bp, Homo sapiens
acacacaactcattgtgtaata

SEQ ID NO: 7422162 - DNA, 22 bp, Homo sapiens
acacacaactcattgtgtaata

SEQ ID NO: 7422163 - DNA, 22 bp, Homo sapiens
acacacaactcattgtgtaata

SEQ ID NO: 7422164 - DNA, 22 bp, Homo sapiens
acacacaactcattgtgtaata

SEQ ID NO: 7422165 - DNA, 22 bp, Homo sapiens
acacacacaagcaggttgtgga

SEQ ID NO: 7422166 - DNA, 22 bp, Homo sapiens
acacacacaagcaggttgtgga

SEQ ID NO: 7422167 - DNA, 22 bp, Homo sapiens
acacacaattagttttatgctt

SEQ ID NO: 7422168 - DNA, 22 bp, Homo sapiens
acacacaactcattgtgtaata

SEQ ID NO: 7422169 - DNA, 22 bp, Homo sapiens
acacacaattagttttatgctt

SEQ ID NO: 7422170 - DNA, 22 bp, Homo sapiens
acacacaattagttttatgctt

SEQ ID NO: 7422171 - DNA, 22 bp, Homo sapiens
acacacaattagttttatgctt

SEQ ID NO: 7422172 - DNA, 22 bp, Homo sapiens
acacaatttcctgtccatatgt

SEQ ID NO: 7422173 - DNA, 22 bp, Homo sapiens
acacaatttcataaacaccatg

SEQ ID NO: 7422174 - DNA, 22 bp, Homo sapiens
acacaatttcctgtccatatgt

SEQ ID NO: 7422175 - DNA, 22 bp, Homo sapiens
acacaatttcctgtccatatgt

SEQ ID NO: 7422176 - DNA, 22 bp, Homo sapiens
acacacaaatctattagtgaat

SEQ ID NO: 7422177 - DNA, 22 bp, Homo sapiens
acacaatttcctgtccatatgt

SEQ ID NO: 7422178 - DNA, 22 bp, Homo sapiens
acacacaaatctattagtgaat

SEQ ID NO: 7422179 - DNA, 22 bp, Homo sapiens
acacacaactcattgtgtaata

SEQ ID NO: 7422180 - DNA, 22 bp, Homo sapiens
acacacaactcattgtgtaata

SEQ ID NO: 7422181 - DNA, 22 bp, Homo sapiens
acacacaactcattgtgtaata

SEQ ID NO: 7422182 - DNA, 22 bp, Homo sapiens
acacacaaatctattagtgaat

SEQ ID NO: 7422183 - DNA, 22 bp, Homo sapiens
acacacaaatctattagtgaat

SEQ ID NO: 7422184 - DNA, 22 bp, Homo sapiens
acacaatgtgcaggacacctgt

SEQ ID NO: 7422185 - DNA, 22 bp, Homo sapiens
acacaatttcataaacaccatg

SEQ ID NO: 7422186 - DNA, 22 bp, Homo sapiens
acacaatttcataaacaccatg

SEQ ID NO: 7422187 - DNA, 22 bp, Homo sapiens
acacaatgtcatcataatgtca

SEQ ID NO: 7422188 - DNA, 22 bp, Homo sapiens
acacaatgtcatcataatgtca

SEQ ID NO: 7422189 - DNA, 22 bp, Homo sapiens
acacaatgtcatcataatgtca

SEQ ID NO: 7422190 - DNA, 19 bp, Homo sapiens
acacaatgacacatatata

SEQ ID NO: 7422191 - DNA, 19 bp, Homo sapiens
acacaatgacacatatata

SEQ ID NO: 7422192 - DNA, 19 bp, Homo sapiens
acacaatgacacatatata

SEQ ID NO: 7422193 - DNA, 22 bp, Homo sapiens
acacaatgattcacaagcagca

SEQ ID NO: 7422194 - DNA, 22 bp, Homo sapiens
acacaatgattcacaagcagca

SEQ ID NO: 7422195 - DNA, 22 bp, Homo sapiens
acacaatgcatatttttccaga

SEQ ID NO: 7422196 - DNA, 22 bp, Homo sapiens
acacaatggcgtgtgccacaga

SEQ ID NO: 7422197 - DNA, 22 bp, Homo sapiens
acacaatggcgtgtgccacaga

SEQ ID NO: 7422198 - DNA, 22 bp, Homo sapiens
acacaagtgaatattttaagga

SEQ ID NO: 7422199 - DNA, 22 bp, Homo sapiens
acacaagtgaatattttaagga

SEQ ID NO: 7422200 - DNA, 22 bp, Homo sapiens
acacaagtccctccatactctc

SEQ ID NO: 7422201 - DNA, 23 bp, Homo sapiens
acacaagggtaactgccagccat

SEQ ID NO: 7422202 - DNA, 22 bp, Homo sapiens
acacaatacagggctcaaaata

SEQ ID NO: 7422203 - DNA, 22 bp, Homo sapiens
acacaatacagggctcaaaata

SEQ ID NO: 7422204 - DNA, 22 bp, Homo sapiens
acacaataaatttatcctttga

SEQ ID NO: 7422205 - DNA, 22 bp, Homo sapiens
acacaataaatttatcctttga

SEQ ID NO: 7422206 - DNA, 22 bp, Homo sapiens
acacaataaatttatcctttga

SEQ ID NO: 7422207 - DNA, 23 bp, Homo sapiens
acacaatagagtactattcagcc

SEQ ID NO: 7422208 - DNA, 22 bp, Homo sapiens
acacaatacagggctcaaaata

SEQ ID NO: 7422209 - DNA, 22 bp, Homo sapiens
acacaatacagggctcaaaata

SEQ ID NO: 7422210 - DNA, 22 bp, Homo sapiens
acacaatacagggctcaaaata

SEQ ID NO: 7422211 - DNA, 22 bp, Homo sapiens
acacaatacagggctcaaaata

SEQ ID NO: 7422212 - DNA, 22 bp, Homo sapiens
acacaatacagggctcaaaata

SEQ ID NO: 7422213 - DNA, 19 bp, Homo sapiens
acacaatgacacatatata

SEQ ID NO: 7422214 - DNA, 19 bp, Homo sapiens
acacaatgacacatatata

SEQ ID NO: 7422215 - DNA, 23 bp, Homo sapiens
acacaatagagtactattcagcc

SEQ ID NO: 7422216 - DNA, 23 bp, Homo sapiens
acacaatagagtactattcagcc

SEQ ID NO: 7422217 - DNA, 22 bp, Homo sapiens
acacaagattgtgtattgaatt

SEQ ID NO: 7422218 - DNA, 22 bp, Homo sapiens
acacaagattgtgtattgaatt

SEQ ID NO: 7422219 - DNA, 22 bp, Homo sapiens
acacaagggcctatagtgtatt

SEQ ID NO: 7422220 - DNA, 22 bp, Homo sapiens
acacaagggcctatagtgtatt

SEQ ID NO: 7422221 - DNA, 22 bp, Homo sapiens
acacaagaataatgatgaaggt

SEQ ID NO: 7422222 - DNA, 22 bp, Homo sapiens
acacaagaataatgatgaaggt

SEQ ID NO: 7422223 - DNA, 22 bp, Homo sapiens
acacaagaataatgatgaaggt

SEQ ID NO: 7422224 - DNA, 22 bp, Homo sapiens
acacaagaataatgatgaaggt

SEQ ID NO: 7422225 - DNA, 22 bp, Homo sapiens
acacaagattgtgtattgaatt

SEQ ID NO: 7422226 - DNA, 22 bp, Homo sapiens
acacaagattgtgtattgaatt

SEQ ID NO: 7422227 - DNA, 22 bp, Homo sapiens
acacaagattgtgtattgaatt

SEQ ID NO: 7422228 - DNA, 22 bp, Homo sapiens
acacagtatcaaatttcatctt

SEQ ID NO: 7422229 - DNA, 22 bp, Homo sapiens
acacagtatcaaatttcatctt

SEQ ID NO: 7422230 - DNA, 22 bp, Homo sapiens
acacagtatcaaatttcatctt

SEQ ID NO: 7422231 - DNA, 22 bp, Homo sapiens
acacagtatcaaatttcatctt

SEQ ID NO: 7422232 - DNA, 22 bp, Homo sapiens
acacagtatcaaatttcatctt

SEQ ID NO: 7422233 - DNA, 19 bp, Homo sapiens
acacagggctagagttaca

SEQ ID NO: 7422234 - DNA, 19 bp, Homo sapiens
acacagggctagagttaca

SEQ ID NO: 7422235 - DNA, 22 bp, Homo sapiens
acacagtatgaaaagtctagtt

SEQ ID NO: 7422236 - DNA, 22 bp, Homo sapiens
acacagtatgaaaagtctagtt

SEQ ID NO: 7422237 - DNA, 22 bp, Homo sapiens
acacagtatcaaatttcatctt

SEQ ID NO: 7422238 - DNA, 22 bp, Homo sapiens
acacagtattacaataggtgct

SEQ ID NO: 7422239 - DNA, 22 bp, Homo sapiens
acacagtattacaataggtgct

SEQ ID NO: 7422240 - DNA, 22 bp, Homo sapiens
acacagtatgcatctagaaatt

SEQ ID NO: 7422241 - DNA, 22 bp, Homo sapiens
acacagtatgcatctagaaatt

SEQ ID NO: 7422242 - DNA, 22 bp, Homo sapiens
acacagtatgcatctagaaatt

SEQ ID NO: 7422243 - DNA, 22 bp, Homo sapiens
acacagtatgcatctagaaatt

SEQ ID NO: 7422244 - DNA, 22 bp, Homo sapiens
acacagtatgacattggcagag

SEQ ID NO: 7422245 - DNA, 22 bp, Homo sapiens
acacagtatgaaaagtctagtt

SEQ ID NO: 7422246 - DNA, 19 bp, Homo sapiens
acacagggctagagttaca

SEQ ID NO: 7422247 - DNA, 19 bp, Homo sapiens
acacagggctagagttaca

SEQ ID NO: 7422248 - DNA, 22 bp, Homo sapiens
acacagggcggaaagcatgaga

SEQ ID NO: 7422249 - DNA, 19 bp, Homo sapiens
acacagggctagagttaca

SEQ ID NO: 7422250 - DNA, 19 bp, Homo sapiens
acacagggctagagttaca

SEQ ID NO: 7422251 - DNA, 19 bp, Homo sapiens
acacagggctagagttaca

SEQ ID NO: 7422252 - DNA, 18 bp, Homo sapiens
acacacacacctgtgtat

SEQ ID NO: 7422253 - DNA, 22 bp, Homo sapiens
acacacacaagcaggttgtgga

SEQ ID NO: 7422254 - DNA, 22 bp, Homo sapiens
acacacacaagcaggttgtgga

SEQ ID NO: 7422255 - DNA, 18 bp, Homo sapiens
acacacacacctgtgtat

SEQ ID NO: 7422256 - DNA, 18 bp, Homo sapiens
acacacacacctgtgtat

SEQ ID NO: 7422257 - DNA, 18 bp, Homo sapiens
acacacacacctgtgtat

SEQ ID NO: 7422258 - DNA, 22 bp, Homo sapiens
acacacacaagcaggttgtgga

SEQ ID NO: 7422259 - DNA, 18 bp, Homo sapiens
acacacacacctgtgtat

SEQ ID NO: 7422260 - DNA, 22 bp, Homo sapiens
acacagtgtgtgcagtcggacg

SEQ ID NO: 7422261 - DNA, 22 bp, Homo sapiens
acacagttcaggatcaaatagc

SEQ ID NO: 7422262 - DNA, 22 bp, Homo sapiens
acacagtgtgtgcagtcggacg

SEQ ID NO: 7422263 - DNA, 22 bp, Homo sapiens
acacagtgtcttaggtagtgtc

SEQ ID NO: 7422264 - DNA, 22 bp, Homo sapiens
acacagtgtcttaggtagtgtc

SEQ ID NO: 7422265 - DNA, 22 bp, Homo sapiens
acacagtgtccttctacttgcc

SEQ ID NO: 7422266 - DNA, 22 bp, Homo sapiens
acacagtgtccttctacttgcc

SEQ ID NO: 7422267 - DNA, 22 bp, Homo sapiens
acacagtgtcagggcaggggcc

SEQ ID NO: 7422268 - DNA, 22 bp, Homo sapiens
acacagtgtcagggcaggggcc

SEQ ID NO: 7422269 - DNA, 22 bp, Homo sapiens
acacagtgtcagggcaggggcc

SEQ ID NO: 7422270 - DNA, 22 bp, Homo sapiens
acacagtggtgtttacaaaatt

SEQ ID NO: 7422271 - DNA, 22 bp, Homo sapiens
acacagtgtcagggcaggggcc

SEQ ID NO: 7422272 - DNA, 22 bp, Homo sapiens
acacagtgtcagggcaggggcc

SEQ ID NO: 7422273 - DNA, 22 bp, Homo sapiens
acacagtggtgtttacaaaatt

SEQ ID NO: 7422274 - DNA, 22 bp, Homo sapiens
acacagtggtgtttacaaaatt

SEQ ID NO: 7422275 - DNA, 22 bp, Homo sapiens
acacagtggtgtttacaaaatt

SEQ ID NO: 7422276 - DNA, 22 bp, Homo sapiens
acacagtggtgtttacaaaatt

SEQ ID NO: 7422277 - DNA, 22 bp, Homo sapiens
acacagtattgtgactataact

SEQ ID NO: 7422278 - DNA, 22 bp, Homo sapiens
acacagtattgtgactataact

SEQ ID NO: 7422279 - DNA, 22 bp, Homo sapiens
acacagtattgtgactataact

SEQ ID NO: 7422280 - DNA, 22 bp, Homo sapiens
acacagtattgtgactataact

SEQ ID NO: 7422281 - DNA, 22 bp, Homo sapiens
acacagtattgtgactataact

SEQ ID NO: 7422282 - DNA, 22 bp, Homo sapiens
acacagtattgtgactataact

SEQ ID NO: 7422283 - DNA, 22 bp, Homo sapiens
acacagtattgtgactataact

SEQ ID NO: 7422284 - DNA, 22 bp, Homo sapiens
acacagtattgtgactataact

SEQ ID NO: 7422285 - DNA, 22 bp, Homo sapiens
acacagtgccaaattgcagtta

SEQ ID NO: 7422286 - DNA, 22 bp, Homo sapiens
acacagtgccaaattgcagtta

SEQ ID NO: 7422287 - DNA, 22 bp, Homo sapiens
acacagtgccaaattgcagtta

SEQ ID NO: 7422288 - DNA, 20 bp, Homo sapiens
acacagtgacaggaaagaga

SEQ ID NO: 7422289 - DNA, 20 bp, Homo sapiens
acacagtgacaggaaagaga

SEQ ID NO: 7422290 - DNA, 18 bp, Homo sapiens
acacagtggatgcctggt

SEQ ID NO: 7422291 - DNA, 18 bp, Homo sapiens
acacagtggatgcctggt

SEQ ID NO: 7422292 - DNA, 18 bp, Homo sapiens
acacagtggatgcctggt

SEQ ID NO: 7422293 - DNA, 22 bp, Homo sapiens
acacagtggtgagtctggacct

SEQ ID NO: 7422294 - DNA, 22 bp, Homo sapiens
acacagtggtgagtctggacct

SEQ ID NO: 7422295 - DNA, 22 bp, Homo sapiens
actgtaaggtaaggataaaacc

SEQ ID NO: 7422296 - DNA, 19 bp, Homo sapiens
actgtaaggcatttttttc

SEQ ID NO: 7422297 - DNA, 22 bp, Homo sapiens
actggggagtggttttgggaag

SEQ ID NO: 7422298 - DNA, 22 bp, Homo sapiens
actgtaatattttaagatgtct

SEQ ID NO: 7422299 - DNA, 22 bp, Homo sapiens
actgtaatattttaagatgtct

SEQ ID NO: 7422300 - DNA, 22 bp, Homo sapiens
actgtaatattttaagatgtct

SEQ ID NO: 7422301 - DNA, 22 bp, Homo sapiens
actgtaatattttaagatgtct

SEQ ID NO: 7422302 - DNA, 22 bp, Homo sapiens
actgtaatatgaaggtcctatt

SEQ ID NO: 7422303 - DNA, 22 bp, Homo sapiens
actgtaatatgaaggtcctatt

SEQ ID NO: 7422304 - DNA, 22 bp, Homo sapiens
actgtaatatggttcttttgat

SEQ ID NO: 7422305 - DNA, 22 bp, Homo sapiens
actgtaatatggttcttttgat

SEQ ID NO: 7422306 - DNA, 22 bp, Homo sapiens
actgtaatatggttcttttgat

SEQ ID NO: 7422307 - DNA, 22 bp, Homo sapiens
actgtaattggattgtctgact

SEQ ID NO: 7422308 - DNA, 22 bp, Homo sapiens
actgtaattggattgtctgact

SEQ ID NO: 7422309 - DNA, 22 bp, Homo sapiens
actgtaattggattgtctgact

SEQ ID NO: 7422310 - DNA, 22 bp, Homo sapiens
actgtaattatctgaacgtgca

SEQ ID NO: 7422311 - DNA, 22 bp, Homo sapiens
actgtaattggattgtctgact

SEQ ID NO: 7422312 - DNA, 22 bp, Homo sapiens
actgtaatgttttaaagcagag

SEQ ID NO: 7422313 - DNA, 22 bp, Homo sapiens
actgtaatgttttaaagcagag

SEQ ID NO: 7422314 - DNA, 22 bp, Homo sapiens
actgtaatggtggatccatgtc

SEQ ID NO: 7422315 - DNA, 22 bp, Homo sapiens
actgtaatggtggatccatgtc

SEQ ID NO: 7422316 - DNA, 22 bp, Homo sapiens
actgtaatggtggatccatgtc

SEQ ID NO: 7422317 - DNA, 22 bp, Homo sapiens
actgtaatattttaagatgtct

SEQ ID NO: 7422318 - DNA, 22 bp, Homo sapiens
actgtaatggtggatccatgtc

SEQ ID NO: 7422319 - DNA, 22 bp, Homo sapiens
actgtacaaatattgcaaaata

SEQ ID NO: 7422320 - DNA, 22 bp, Homo sapiens
actgtacaaatattgcaaaata

SEQ ID NO: 7422321 - DNA, 22 bp, Homo sapiens
actgtacaaatattgcaaaata

SEQ ID NO: 7422322 - DNA, 22 bp, Homo sapiens
actgtacaacctctgcccctgt

SEQ ID NO: 7422323 - DNA, 22 bp, Homo sapiens
actgtacaacctctgcccctgt

SEQ ID NO: 7422324 - DNA, 22 bp, Homo sapiens
actgtacaactgctgagcagaa

SEQ ID NO: 7422325 - DNA, 22 bp, Homo sapiens
actgtacaactgctgagcagaa

SEQ ID NO: 7422326 - DNA, 22 bp, Homo sapiens
actgtacaactgctgagcagaa

SEQ ID NO: 7422327 - DNA, 22 bp, Homo sapiens
actgtacacagtggtgtactgt

SEQ ID NO: 7422328 - DNA, 22 bp, Homo sapiens
actgtacacagtggtgtactgt

SEQ ID NO: 7422329 - DNA, 22 bp, Homo sapiens
actgtacacacttctctgtctt

SEQ ID NO: 7422330 - DNA, 22 bp, Homo sapiens
actgtacacacttctctgtctt

SEQ ID NO: 7422331 - DNA, 22 bp, Homo sapiens
actgtacacacttctctgtctt

SEQ ID NO: 7422332 - DNA, 22 bp, Homo sapiens
actgtacaactgctgagcagaa

SEQ ID NO: 7422333 - DNA, 22 bp, Homo sapiens
actgtacacgtgtcatttacag

SEQ ID NO: 7422334 - DNA, 22 bp, Homo sapiens
actgtacacgtgtcatttacag

SEQ ID NO: 7422335 - DNA, 22 bp, Homo sapiens
actgtacacattcgtcaagact

SEQ ID NO: 7422336 - DNA, 22 bp, Homo sapiens
actgtacacattcgtcaagact

SEQ ID NO: 7422337 - DNA, 22 bp, Homo sapiens
actgtacacattcgtcaagact

SEQ ID NO: 7422338 - DNA, 22 bp, Homo sapiens
actgtacacattcgtcaagact

SEQ ID NO: 7422339 - DNA, 22 bp, Homo sapiens
actgtacacattcgtcaagact

SEQ ID NO: 7422340 - DNA, 22 bp, Homo sapiens
actgtacacattcgtcaagact

SEQ ID NO: 7422341 - DNA, 22 bp, Homo sapiens
actgtacacagtggtgtactgt

SEQ ID NO: 7422342 - DNA, 22 bp, Homo sapiens
actgtacacagtggtgtactgt

SEQ ID NO: 7422343 - DNA, 22 bp, Homo sapiens
actgtacatatggattctaaga

SEQ ID NO: 7422344 - DNA, 22 bp, Homo sapiens
actgtacatatggattctaaga

SEQ ID NO: 7422345 - DNA, 22 bp, Homo sapiens
actgtacacgtgtcatttacag

SEQ ID NO: 7422346 - DNA, 22 bp, Homo sapiens
actgtacatatggattctaaga

SEQ ID NO: 7422347 - DNA, 22 bp, Homo sapiens
actgtacatatggattctaaga

SEQ ID NO: 7422348 - DNA, 22 bp, Homo sapiens
actgtacatatggattctaaga

SEQ ID NO: 7422349 - DNA, 22 bp, Homo sapiens
actgtacatgcatcttgtctat

SEQ ID NO: 7422350 - DNA, 22 bp, Homo sapiens
actgtacatgcatcttgtctat

SEQ ID NO: 7422351 - DNA, 22 bp, Homo sapiens
actgtacatgcatcttgtctat

SEQ ID NO: 7422352 - DNA, 22 bp, Homo sapiens
actgtcatgcattatggcatgt

SEQ ID NO: 7422353 - DNA, 22 bp, Homo sapiens
actgtacatgcatcttgtctat

SEQ ID NO: 7422354 - DNA, 21 bp, Homo sapiens
actgtcatttgcttagggagg

SEQ ID NO: 7422355 - DNA, 22 bp, Homo sapiens
actgtcatgtgctaactgtcca

SEQ ID NO: 7422356 - DNA, 22 bp, Homo sapiens
actgtccattcactcatattca

SEQ ID NO: 7422357 - DNA, 22 bp, Homo sapiens
actgtccattcactcatattca

SEQ ID NO: 7422358 - DNA, 22 bp, Homo sapiens
actgtcccatttatgtagacat

SEQ ID NO: 7422359 - DNA, 22 bp, Homo sapiens
actgtccattcactcatattca

SEQ ID NO: 7422360 - DNA, 22 bp, Homo sapiens
actgtcctagaacctgcagctc

SEQ ID NO: 7422361 - DNA, 22 bp, Homo sapiens
actgtcctagaacctgcagctc

SEQ ID NO: 7422362 - DNA, 22 bp, Homo sapiens
actgtcccatttatgtagacat

SEQ ID NO: 7422363 - DNA, 22 bp, Homo sapiens
actgtccagaagatagaaatat

SEQ ID NO: 7422364 - DNA, 22 bp, Homo sapiens
actgtccagaagatagaaatat

SEQ ID NO: 7422365 - DNA, 22 bp, Homo sapiens
actgtccaagcatgcctggctt

SEQ ID NO: 7422366 - DNA, 22 bp, Homo sapiens
actgtccagaagatagaaatat

SEQ ID NO: 7422367 - DNA, 22 bp, Homo sapiens
actgtccataatattggtgaac

SEQ ID NO: 7422368 - DNA, 22 bp, Homo sapiens
actgtcctcgaagtacctgtgc

SEQ ID NO: 7422369 - DNA, 22 bp, Homo sapiens
actgtcctgaatactgcatgac

SEQ ID NO: 7422370 - DNA, 22 bp, Homo sapiens
actgtcctcagatattcttctg

SEQ ID NO: 7422371 - DNA, 22 bp, Homo sapiens
actgtcctcagatattcttctg

SEQ ID NO: 7422372 - DNA, 22 bp, Homo sapiens
actgtctaatcagattcacttg

SEQ ID NO: 7422373 - DNA, 22 bp, Homo sapiens
actgtctcctcatcatgcctgg

SEQ ID NO: 7422374 - DNA, 22 bp, Homo sapiens
actgtcctggagctcacactct

SEQ ID NO: 7422375 - DNA, 22 bp, Homo sapiens
actgtccttttaatgcagccgt

SEQ ID NO: 7422376 - DNA, 22 bp, Homo sapiens
actgtcgattatgatgagtcag

SEQ ID NO: 7422377 - DNA, 22 bp, Homo sapiens
actgtctctctagcagttcagg

SEQ ID NO: 7422378 - DNA, 18 bp, Homo sapiens
actgtctctgagagtggt

SEQ ID NO: 7422379 - DNA, 18 bp, Homo sapiens
actgtctctgagagtggt

SEQ ID NO: 7422380 - DNA, 18 bp, Homo sapiens
actgtctctgagagtggt

SEQ ID NO: 7422381 - DNA, 22 bp, Homo sapiens
actgtctgagtcaggagtcaca

SEQ ID NO: 7422382 - DNA, 22 bp, Homo sapiens
actgtctgagctgattgagcta

SEQ ID NO: 7422383 - DNA, 22 bp, Homo sapiens
actgtctgagctgattgagcta

SEQ ID NO: 7422384 - DNA, 23 bp, Homo sapiens
actgtctgatatgttttccatca

SEQ ID NO: 7422385 - DNA, 22 bp, Homo sapiens
aatagaatgtaatctaatacat

SEQ ID NO: 7422386 - DNA, 22 bp, Homo sapiens
aatagaatgtaatctaatacat

SEQ ID NO: 7422387 - DNA, 22 bp, Homo sapiens
aatagaacaataattgtaaact

SEQ ID NO: 7422388 - DNA, 23 bp, Homo sapiens
actgtctgatatgttttccatca

SEQ ID NO: 7422389 - DNA, 22 bp, Homo sapiens
aatagaatgtaatctaatacat

SEQ ID NO: 7422390 - DNA, 22 bp, Homo sapiens
aatagaatgtaatctaatacat

SEQ ID NO: 7422391 - DNA, 22 bp, Homo sapiens
aatagaatgtaatctaatacat

SEQ ID NO: 7422392 - DNA, 22 bp, Homo sapiens
aatagcagttaaaaatcagccc

SEQ ID NO: 7422393 - DNA, 22 bp, Homo sapiens
aatagcagttaaaaatcagccc

SEQ ID NO: 7422394 - DNA, 22 bp, Homo sapiens
aatagcagttaaaaatcagccc

SEQ ID NO: 7422395 - DNA, 22 bp, Homo sapiens
aatagcacttcctgaacacatt

SEQ ID NO: 7422396 - DNA, 22 bp, Homo sapiens
aatagcacttcctgaacacatt

SEQ ID NO: 7422397 - DNA, 19 bp, Homo sapiens
aatagcaggagcagttccc

SEQ ID NO: 7422398 - DNA, 22 bp, Homo sapiens
aatagcagaagactagtagaca

SEQ ID NO: 7422399 - DNA, 22 bp, Homo sapiens
aatagcatagagttaaaatgca

SEQ ID NO: 7422400 - DNA, 22 bp, Homo sapiens
aatagcataagatgtcaaatag

SEQ ID NO: 7422401 - DNA, 22 bp, Homo sapiens
aatagcataagatgtcaaatag

SEQ ID NO: 7422402 - DNA, 22 bp, Homo sapiens
aatagcataagatgtcaaatag

SEQ ID NO: 7422403 - DNA, 22 bp, Homo sapiens
aatagcatcttctgagacaaag

SEQ ID NO: 7422404 - DNA, 22 bp, Homo sapiens
aatagcatcttccctggtaacc

SEQ ID NO: 7422405 - DNA, 22 bp, Homo sapiens
aatagcatcctaaaacatactt

SEQ ID NO: 7422406 - DNA, 22 bp, Homo sapiens
aatagcatagagttaaaatgca

SEQ ID NO: 7422407 - DNA, 22 bp, Homo sapiens
aatagcatagagttaaaatgca

SEQ ID NO: 7422408 - DNA, 22 bp, Homo sapiens
aatagcatcctaaaacatactt

SEQ ID NO: 7422409 - DNA, 22 bp, Homo sapiens
aatagcatcctaaaacatactt

SEQ ID NO: 7422410 - DNA, 20 bp, Homo sapiens
aatagcacagctcaaacatt

SEQ ID NO: 7422411 - DNA, 22 bp, Homo sapiens
aatagcacctgaggtagtttgt

SEQ ID NO: 7422412 - DNA, 22 bp, Homo sapiens
aatagcaattacccttcaactc

SEQ ID NO: 7422413 - DNA, 22 bp, Homo sapiens
aatagcaattacccttcaactc

SEQ ID NO: 7422414 - DNA, 22 bp, Homo sapiens
aatagcaaagttatcaaattaa

SEQ ID NO: 7422415 - DNA, 22 bp, Homo sapiens
aatagcaattacccttcaactc

SEQ ID NO: 7422416 - DNA, 22 bp, Homo sapiens
aatagcaaatgctcatttgaaa

SEQ ID NO: 7422417 - DNA, 22 bp, Homo sapiens
aatagcaaatgctcatttgaaa

SEQ ID NO: 7422418 - DNA, 22 bp, Homo sapiens
aatagcaaatgctcatttgaaa

SEQ ID NO: 7422419 - DNA, 22 bp, Homo sapiens
aatagcaaatgctcatttgaaa

SEQ ID NO: 7422420 - DNA, 22 bp, Homo sapiens
aatagcaaatgctcatttgaaa

SEQ ID NO: 7422421 - DNA, 22 bp, Homo sapiens
aatagcaattacatttgcacca

SEQ ID NO: 7422422 - DNA, 22 bp, Homo sapiens
aatagcaattacatttgcacca

SEQ ID NO: 7422423 - DNA, 22 bp, Homo sapiens
aatagcaaagttatcaaattaa

SEQ ID NO: 7422424 - DNA, 22 bp, Homo sapiens
aatagcaaagttatcaaattaa

SEQ ID NO: 7422425 - DNA, 22 bp, Homo sapiens
aatagcaaagttatcaaattaa

SEQ ID NO: 7422426 - DNA, 22 bp, Homo sapiens
aatagaatttaaatgcagtggc

SEQ ID NO: 7422427 - DNA, 22 bp, Homo sapiens
aatagcaaacagacatgcacaa

SEQ ID NO: 7422428 - DNA, 22 bp, Homo sapiens
aatagcaaagttatcaaattaa

SEQ ID NO: 7422429 - DNA, 22 bp, Homo sapiens
aatagcaaagttatcaaattaa

SEQ ID NO: 7422430 - DNA, 22 bp, Homo sapiens
aatagcaaagttatcaaattaa

SEQ ID NO: 7422431 - DNA, 22 bp, Homo sapiens
aataatacatgagattaatgtt

SEQ ID NO: 7422432 - DNA, 22 bp, Homo sapiens
aataatacatgagattaatgtt

SEQ ID NO: 7422433 - DNA, 22 bp, Homo sapiens
aataatacatgagattaatgtt

SEQ ID NO: 7422434 - DNA, 22 bp, Homo sapiens
aataatacatgagattaatgtt

SEQ ID NO: 7422435 - DNA, 22 bp, Homo sapiens
aataatactgcatgtaaggtgc

SEQ ID NO: 7422436 - DNA, 22 bp, Homo sapiens
aataatactgcatgtaaggtgc

SEQ ID NO: 7422437 - DNA, 22 bp, Homo sapiens
aataatacttcgtaaagttgtt

SEQ ID NO: 7422438 - DNA, 22 bp, Homo sapiens
aataatacttcgtaaagttgtt

SEQ ID NO: 7422439 - DNA, 22 bp, Homo sapiens
aataatacttcgtaaagttgtt

SEQ ID NO: 7422440 - DNA, 22 bp, Homo sapiens
aataatacttcgtaaagttgtt

SEQ ID NO: 7422441 - DNA, 22 bp, Homo sapiens
aataatacatgagattaatgtt

SEQ ID NO: 7422442 - DNA, 22 bp, Homo sapiens
aataatacatgagattaatgtt

SEQ ID NO: 7422443 - DNA, 22 bp, Homo sapiens
aataatacatgagattaatgtt

SEQ ID NO: 7422444 - DNA, 22 bp, Homo sapiens
aataatacatgagattaatgtt

SEQ ID NO: 7422445 - DNA, 22 bp, Homo sapiens
aataatacatgagattaatgtt

SEQ ID NO: 7422446 - DNA, 22 bp, Homo sapiens
aataatacatgagattaatgtt

SEQ ID NO: 7422447 - DNA, 22 bp, Homo sapiens
aataatacatgagattaatgtt

SEQ ID NO: 7422448 - DNA, 22 bp, Homo sapiens
aataataagatactaagggagt

SEQ ID NO: 7422449 - DNA, 22 bp, Homo sapiens
aataataagatactaagggagt

SEQ ID NO: 7422450 - DNA, 22 bp, Homo sapiens
aataataagatactaagggagt

SEQ ID NO: 7422451 - DNA, 22 bp, Homo sapiens
aataatacttcgtaaagttgtt

SEQ ID NO: 7422452 - DNA, 22 bp, Homo sapiens
aataatacttcgtaaagttgtt

SEQ ID NO: 7422453 - DNA, 22 bp, Homo sapiens
aataatagcagagtttacaatc

SEQ ID NO: 7422454 - DNA, 22 bp, Homo sapiens
aataatagcagagtttacaatc

SEQ ID NO: 7422455 - DNA, 22 bp, Homo sapiens
aataatagcagagtttacaatc

SEQ ID NO: 7422456 - DNA, 22 bp, Homo sapiens
aataatagcagagtttacaatc

SEQ ID NO: 7422457 - DNA, 22 bp, Homo sapiens
aataatagcagagtttacaatc

SEQ ID NO: 7422458 - DNA, 22 bp, Homo sapiens
aataatagcagagtttacaatc

SEQ ID NO: 7422459 - DNA, 22 bp, Homo sapiens
aataatagcagagtttacaatc

SEQ ID NO: 7422460 - DNA, 22 bp, Homo sapiens
aataatagcagagtttacaatc

SEQ ID NO: 7422461 - DNA, 22 bp, Homo sapiens
aataatagcagagtttacaatc

SEQ ID NO: 7422462 - DNA, 22 bp, Homo sapiens
aataatagttgcaaagtgttta

SEQ ID NO: 7422463 - DNA, 22 bp, Homo sapiens
actggggaatggaactgggaat

SEQ ID NO: 7422464 - DNA, 22 bp, Homo sapiens
aataatagttgcaaagtgttta

SEQ ID NO: 7422465 - DNA, 22 bp, Homo sapiens
actggggaatggaactgggaat

SEQ ID NO: 7422466 - DNA, 22 bp, Homo sapiens
actggggaatggaactgggaat

SEQ ID NO: 7422467 - DNA, 22 bp, Homo sapiens
actggggagagtcatgccagca

SEQ ID NO: 7422468 - DNA, 22 bp, Homo sapiens
actggggactctggccttttga

SEQ ID NO: 7422469 - DNA, 22 bp, Homo sapiens
actggggagagtcatgccagca

SEQ ID NO: 7422470 - DNA, 22 bp, Homo sapiens
actgggcaataaattcagagaa

SEQ ID NO: 7422471 - DNA, 22 bp, Homo sapiens
actgggcaataaattcagagaa

SEQ ID NO: 7422472 - DNA, 22 bp, Homo sapiens
actgggcaccatcatgagatag

SEQ ID NO: 7422473 - DNA, 22 bp, Homo sapiens
actgggcaccatcatgagatag

SEQ ID NO: 7422474 - DNA, 22 bp, Homo sapiens
actgggcaccatcatgagatgg

SEQ ID NO: 7422475 - DNA, 22 bp, Homo sapiens
actgggcaccatcatgagatag

SEQ ID NO: 7422476 - DNA, 22 bp, Homo sapiens
actgggcaccatcatgagatgg

SEQ ID NO: 7422477 - DNA, 22 bp, Homo sapiens
actgggcaaggatatgatgggt

SEQ ID NO: 7422478 - DNA, 22 bp, Homo sapiens
actgggcaaggatatgatgggt

SEQ ID NO: 7422479 - DNA, 22 bp, Homo sapiens
actgggcaaggatatgatgggt

SEQ ID NO: 7422480 - DNA, 22 bp, Homo sapiens
actgggattacaggtgggagtc

SEQ ID NO: 7422481 - DNA, 22 bp, Homo sapiens
actgggagttctccatgtccct

SEQ ID NO: 7422482 - DNA, 22 bp, Homo sapiens
aataagttgcctgttgaatcat

SEQ ID NO: 7422483 - DNA, 22 bp, Homo sapiens
aataataagatactaagggagt

SEQ ID NO: 7422484 - DNA, 22 bp, Homo sapiens
aataagtacttggggataactt

SEQ ID NO: 7422485 - DNA, 22 bp, Homo sapiens
aataagtacttggggataactt

SEQ ID NO: 7422486 - DNA, 22 bp, Homo sapiens
aataagtgatgatgagtcactc

SEQ ID NO: 7422487 - DNA, 22 bp, Homo sapiens
aataagttgcctgttgaatcat

SEQ ID NO: 7422488 - DNA, 19 bp, Homo sapiens
aataagcttgggtaaaact

SEQ ID NO: 7422489 - DNA, 19 bp, Homo sapiens
aataagcttgggtaaaact

SEQ ID NO: 7422490 - DNA, 23 bp, Homo sapiens
aataaggccaaactatctggtct

SEQ ID NO: 7422491 - DNA, 22 bp, Homo sapiens
aataaggtgtgggtgctaatat

SEQ ID NO: 7422492 - DNA, 22 bp, Homo sapiens
aataaggtgtgggtgctaatat

SEQ ID NO: 7422493 - DNA, 22 bp, Homo sapiens
aataagccagcccatgtgaccc

SEQ ID NO: 7422494 - DNA, 22 bp, Homo sapiens
aataagctgctaggaacttagt

SEQ ID NO: 7422495 - DNA, 22 bp, Homo sapiens
actgggaggcatctggagctga

SEQ ID NO: 7422496 - DNA, 22 bp, Homo sapiens
actgggaggcatctggagctga

SEQ ID NO: 7422497 - DNA, 22 bp, Homo sapiens
actgggaggcatctggagctga

SEQ ID NO: 7422498 - DNA, 22 bp, Homo sapiens
actgggaggcatctggagctga

SEQ ID NO: 7422499 - DNA, 22 bp, Homo sapiens
actgggaggcaaagagcaagga

SEQ ID NO: 7422500 - DNA, 22 bp, Homo sapiens
actgggaggcaaagagcaagga

SEQ ID NO: 7422501 - DNA, 22 bp, Homo sapiens
actgggaggcaaagagcaagga

SEQ ID NO: 7422502 - DNA, 22 bp, Homo sapiens
actgggaggcaaagagcaagga

SEQ ID NO: 7422503 - DNA, 22 bp, Homo sapiens
actggctgatatggctaggaag

SEQ ID NO: 7422504 - DNA, 22 bp, Homo sapiens
actggctgagtttatgttcaca

SEQ ID NO: 7422505 - DNA, 22 bp, Homo sapiens
actggctgagtttatgttcaca

SEQ ID NO: 7422506 - DNA, 22 bp, Homo sapiens
actggctgatatggctaggaag

SEQ ID NO: 7422507 - DNA, 22 bp, Homo sapiens
actggctgatatggctaggaag

SEQ ID NO: 7422508 - DNA, 22 bp, Homo sapiens
actggctgatatggctaggaag

SEQ ID NO: 7422509 - DNA, 22 bp, Homo sapiens
actggctgatatggctaggaag

SEQ ID NO: 7422510 - DNA, 22 bp, Homo sapiens
actggctgagtttatgttcaca

SEQ ID NO: 7422511 - DNA, 22 bp, Homo sapiens
actggctgagtttatgttcaca

SEQ ID NO: 7422512 - DNA, 22 bp, Homo sapiens
actggctgagttgcttcagcaa

SEQ ID NO: 7422513 - DNA, 22 bp, Homo sapiens
actggctgagttgcttcagcaa

SEQ ID NO: 7422514 - DNA, 22 bp, Homo sapiens
aataaaatggtcagttttctca

SEQ ID NO: 7422515 - DNA, 22 bp, Homo sapiens
actgggagttctccatgtccct

SEQ ID NO: 7422516 - DNA, 22 bp, Homo sapiens
actgggagtcatgaggaaggag

SEQ ID NO: 7422517 - DNA, 22 bp, Homo sapiens
actgggagttctccatgtccct

SEQ ID NO: 7422518 - DNA, 22 bp, Homo sapiens
actgggagttctccatgtccct

SEQ ID NO: 7422519 - DNA, 22 bp, Homo sapiens
actgggagtcatgaggaaggag

SEQ ID NO: 7422520 - DNA, 22 bp, Homo sapiens
actgggagtcatgaggaaggag

SEQ ID NO: 7422521 - DNA, 22 bp, Homo sapiens
actgggagtcatgaggaaggag

SEQ ID NO: 7422522 - DNA, 22 bp, Homo sapiens
actgggagtcatgaggaaggag

SEQ ID NO: 7422523 - DNA, 22 bp, Homo sapiens
actgggagtcatgaggaaggag

SEQ ID NO: 7422524 - DNA, 22 bp, Homo sapiens
actgggagtcatgaggaaggag

SEQ ID NO: 7422525 - DNA, 22 bp, Homo sapiens
actgggagggtcttgaagaggg

SEQ ID NO: 7422526 - DNA, 22 bp, Homo sapiens
actgggagggtcttgaagaggg

SEQ ID NO: 7422527 - DNA, 22 bp, Homo sapiens
actgggagggtcttgaagaggg

SEQ ID NO: 7422528 - DNA, 22 bp, Homo sapiens
actgggagtcatgaggaaggag

SEQ ID NO: 7422529 - DNA, 22 bp, Homo sapiens
actgggagggtcttgaagaggg

SEQ ID NO: 7422530 - DNA, 22 bp, Homo sapiens
actgggagggtcttgaagaggg

SEQ ID NO: 7422531 - DNA, 22 bp, Homo sapiens
actgggagggtcttgaagaggg

SEQ ID NO: 7422532 - DNA, 22 bp, Homo sapiens
aagtttttgattctaagagaga

SEQ ID NO: 7422533 - DNA, 22 bp, Homo sapiens
aagtttttgattctaagagaga

SEQ ID NO: 7422534 - DNA, 22 bp, Homo sapiens
aagtttttgattctaagagaga

SEQ ID NO: 7422535 - DNA, 22 bp, Homo sapiens
aagtttttgattctaagagaga

SEQ ID NO: 7422536 - DNA, 22 bp, Homo sapiens
aagtttttcacattgctgttgt

SEQ ID NO: 7422537 - DNA, 22 bp, Homo sapiens
aagtttttcacattgctgttgt

SEQ ID NO: 7422538 - DNA, 22 bp, Homo sapiens
aagtttttcacattgctgttgt

SEQ ID NO: 7422539 - DNA, 20 bp, Homo sapiens
aagttttctccaaatacagt

SEQ ID NO: 7422540 - DNA, 20 bp, Homo sapiens
aagttttctccaaatacagt

SEQ ID NO: 7422541 - DNA, 22 bp, Homo sapiens
aagttttgaaatactgaagtgt

SEQ ID NO: 7422542 - DNA, 22 bp, Homo sapiens
aagttttgaaatactgaagtgt

SEQ ID NO: 7422543 - DNA, 22 bp, Homo sapiens
aagtttttcacattgctgttgt

SEQ ID NO: 7422544 - DNA, 22 bp, Homo sapiens
aagtttttcacattgctgttgt

SEQ ID NO: 7422545 - DNA, 22 bp, Homo sapiens
aagtttttggtagagaaaagta

SEQ ID NO: 7422546 - DNA, 22 bp, Homo sapiens
aagtttttggtagagaaaagta

SEQ ID NO: 7422547 - DNA, 21 bp, Homo sapiens
aataaaacagttggtgtcaat

SEQ ID NO: 7422548 - DNA, 22 bp, Homo sapiens
aagtttttggtagagaaaagta

SEQ ID NO: 7422549 - DNA, 22 bp, Homo sapiens
aagtttttggtagagaaaagta

SEQ ID NO: 7422550 - DNA, 22 bp, Homo sapiens
aagtttttggtagagaaaagta

SEQ ID NO: 7422551 - DNA, 22 bp, Homo sapiens
aagtttttgattctaagagaga

SEQ ID NO: 7422552 - DNA, 22 bp, Homo sapiens
aagtttttggtagagaaaagta

SEQ ID NO: 7422553 - DNA, 22 bp, Homo sapiens
aataaaatgaactggtagagtt

SEQ ID NO: 7422554 - DNA, 22 bp, Homo sapiens
aataaaatgaactggtagagtt

SEQ ID NO: 7422555 - DNA, 20 bp, Homo sapiens
aataaaagaagccttcaccc

SEQ ID NO: 7422556 - DNA, 20 bp, Homo sapiens
aataaaagaagccttcaccc

SEQ ID NO: 7422557 - DNA, 20 bp, Homo sapiens
aataaaagaagccttcaccc

SEQ ID NO: 7422558 - DNA, 21 bp, Homo sapiens
aataaaacagttggtgtcaat

SEQ ID NO: 7422559 - DNA, 21 bp, Homo sapiens
aataaaacagttggtgtcaat

SEQ ID NO: 7422560 - DNA, 20 bp, Homo sapiens
aataaaagaagccttcaccc

SEQ ID NO: 7422561 - DNA, 22 bp, Homo sapiens
aataaaatgaactggtagagtt

SEQ ID NO: 7422562 - DNA, 22 bp, Homo sapiens
aataaaatgaactggtagagtt

SEQ ID NO: 7422563 - DNA, 22 bp, Homo sapiens
aataaaatgaactggtagagtt

SEQ ID NO: 7422564 - DNA, 22 bp, Homo sapiens
aataaaatgaactggtagagtt

SEQ ID NO: 7422565 - DNA, 22 bp, Homo sapiens
aataaaatgaactggtagagtt

SEQ ID NO: 7422566 - DNA, 22 bp, Homo sapiens
aataaaatgaactggtagagtt

SEQ ID NO: 7422567 - DNA, 22 bp, Homo sapiens
aataaaatgaactggtagagtt

SEQ ID NO: 7422568 - DNA, 22 bp, Homo sapiens
aataaaatgaactggtagagtt

SEQ ID NO: 7422569 - DNA, 22 bp, Homo sapiens
actgcactccagcctgggtgac

SEQ ID NO: 7422570 - DNA, 22 bp, Homo sapiens
actgcagccttgaactctgggc

SEQ ID NO: 7422571 - DNA, 22 bp, Homo sapiens
actgcactccagcctgggtgac

SEQ ID NO: 7422572 - DNA, 22 bp, Homo sapiens
actgcactccagcctgggtgac

SEQ ID NO: 7422573 - DNA, 22 bp, Homo sapiens
actgcactccagcctgggtgac

SEQ ID NO: 7422574 - DNA, 22 bp, Homo sapiens
actgcactccagcctgggtgac

SEQ ID NO: 7422575 - DNA, 22 bp, Homo sapiens
aagttctaacatctacgtggaa

SEQ ID NO: 7422576 - DNA, 22 bp, Homo sapiens
aagttctaacaggaggtctctt

SEQ ID NO: 7422577 - DNA, 22 bp, Homo sapiens
actgcactccagcctgggtgac

SEQ ID NO: 7422578 - DNA, 22 bp, Homo sapiens
aagttctaaggtgcattattct

SEQ ID NO: 7422579 - DNA, 22 bp, Homo sapiens
aagttccttagccttagggctt

SEQ ID NO: 7422580 - DNA, 22 bp, Homo sapiens
aagttcctgttactccccagaa

SEQ ID NO: 7422581 - DNA, 22 bp, Homo sapiens
aagttcctgggtgatcctgatg

SEQ ID NO: 7422582 - DNA, 22 bp, Homo sapiens
aagttccttgaatgaagctagg

SEQ ID NO: 7422583 - DNA, 22 bp, Homo sapiens
aagttcctgggccaagtccagg

SEQ ID NO: 7422584 - DNA, 22 bp, Homo sapiens
aagttcctgggccaagtccagg

SEQ ID NO: 7422585 - DNA, 22 bp, Homo sapiens
aagttcctgggtgatcctgatg

SEQ ID NO: 7422586 - DNA, 18 bp, Homo sapiens
actgcaggagaggtgagg

SEQ ID NO: 7422587 - DNA, 18 bp, Homo sapiens
actgcaggagaggtgagg

SEQ ID NO: 7422588 - DNA, 18 bp, Homo sapiens
actgcaggagaggtgagg

SEQ ID NO: 7422589 - DNA, 22 bp, Homo sapiens
actgcaggatgtgctcctattg

SEQ ID NO: 7422590 - DNA, 22 bp, Homo sapiens
actgcaggatgtgctcctattg

SEQ ID NO: 7422591 - DNA, 22 bp, Homo sapiens
actgcaggccttggtgccagca

SEQ ID NO: 7422592 - DNA, 22 bp, Homo sapiens
actgcaggccttggtgccagca

SEQ ID NO: 7422593 - DNA, 22 bp, Homo sapiens
actgcaggccttggtgccagca

SEQ ID NO: 7422594 - DNA, 22 bp, Homo sapiens
actgcagctggtggtggctctg

SEQ ID NO: 7422595 - DNA, 22 bp, Homo sapiens
actgcagcctttgggctcataa

SEQ ID NO: 7422596 - DNA, 22 bp, Homo sapiens
actgcagctggtggtggctctg

SEQ ID NO: 7422597 - DNA, 22 bp, Homo sapiens
actgcagcctttgggctcataa

SEQ ID NO: 7422598 - DNA, 22 bp, Homo sapiens
actgcaggagacacagctgctg

SEQ ID NO: 7422599 - DNA, 22 bp, Homo sapiens
actgcagctggtggtggctctg

SEQ ID NO: 7422600 - DNA, 22 bp, Homo sapiens
actgcagctggtggtggctctg

SEQ ID NO: 7422601 - DNA, 22 bp, Homo sapiens
actgcagctggtggtggctctg

SEQ ID NO: 7422602 - DNA, 22 bp, Homo sapiens
actgcaggagacacagctgctg

SEQ ID NO: 7422603 - DNA, 22 bp, Homo sapiens
actgcaggagacacagctgctg

SEQ ID NO: 7422604 - DNA, 22 bp, Homo sapiens
actgcaggtggatggcacttta

SEQ ID NO: 7422605 - DNA, 22 bp, Homo sapiens
actgcagggcatcctggccaag

SEQ ID NO: 7422606 - DNA, 22 bp, Homo sapiens
actgcagtggcaggaacttatc

SEQ ID NO: 7422607 - DNA, 22 bp, Homo sapiens
actgcagtcatcatctccctgg

SEQ ID NO: 7422608 - DNA, 22 bp, Homo sapiens
actgcagtcatcatctccctgg

SEQ ID NO: 7422609 - DNA, 23 bp, Homo sapiens
actgcagtcttgatctcctgggc

SEQ ID NO: 7422610 - DNA, 22 bp, Homo sapiens
actgcagtggcaggaacttatc

SEQ ID NO: 7422611 - DNA, 22 bp, Homo sapiens
actgcagttggtgacaataacc

SEQ ID NO: 7422612 - DNA, 22 bp, Homo sapiens
actgcatagaggtccctgcgtc

SEQ ID NO: 7422613 - DNA, 22 bp, Homo sapiens
actgcatcgctcgcttaggtcc

SEQ ID NO: 7422614 - DNA, 22 bp, Homo sapiens
actgcagggcatcctggccaag

SEQ ID NO: 7422615 - DNA, 19 bp, Homo sapiens
actgcagggaggaggtgtg

SEQ ID NO: 7422616 - DNA, 19 bp, Homo sapiens
actgcagggaggaggtgtg

SEQ ID NO: 7422617 - DNA, 19 bp, Homo sapiens
actgcagggaggaggtgtg

SEQ ID NO: 7422618 - DNA, 22 bp, Homo sapiens
actgcaggccttggtgccagca

SEQ ID NO: 7422619 - DNA, 22 bp, Homo sapiens
actgcaggccttggtgccagca

SEQ ID NO: 7422620 - DNA, 22 bp, Homo sapiens
actgcatgtaaggcaatatgtt

SEQ ID NO: 7422621 - DNA, 22 bp, Homo sapiens
aagttttattggctatagcact

SEQ ID NO: 7422622 - DNA, 22 bp, Homo sapiens
aagttttattggctatagcact

SEQ ID NO: 7422623 - DNA, 22 bp, Homo sapiens
aagttttcctgtgtccaagatg

SEQ ID NO: 7422624 - DNA, 20 bp, Homo sapiens
aagttttctccaaatacagt

SEQ ID NO: 7422625 - DNA, 20 bp, Homo sapiens
aagttttctccaaatacagt

SEQ ID NO: 7422626 - DNA, 20 bp, Homo sapiens
aagttttctccaaatacagt

SEQ ID NO: 7422627 - DNA, 20 bp, Homo sapiens
aagttttctccaaatacagt

SEQ ID NO: 7422628 - DNA, 20 bp, Homo sapiens
aagttttctccaaatacagt

SEQ ID NO: 7422629 - DNA, 22 bp, Homo sapiens
actgcatgctttacatgacatg

SEQ ID NO: 7422630 - DNA, 22 bp, Homo sapiens
actgcatgctttacatgacatg

SEQ ID NO: 7422631 - DNA, 22 bp, Homo sapiens
actgcatgataataatagcaga

SEQ ID NO: 7422632 - DNA, 21 bp, Homo sapiens
actgcatctgaagtcccagga

SEQ ID NO: 7422633 - DNA, 22 bp, Homo sapiens
actgcatctgaactgtgaatgg

SEQ ID NO: 7422634 - DNA, 22 bp, Homo sapiens
actgcatctgaaacatgggtca

SEQ ID NO: 7422635 - DNA, 21 bp, Homo sapiens
actgcatctgaagtcccagga

SEQ ID NO: 7422636 - DNA, 18 bp, Homo sapiens
aagttccacaagagatct

SEQ ID NO: 7422637 - DNA, 22 bp, Homo sapiens
aagttccctttctttgccagga

SEQ ID NO: 7422638 - DNA, 22 bp, Homo sapiens
aagttcctaaagtcaggggtca

SEQ ID NO: 7422639 - DNA, 22 bp, Homo sapiens
aagttcctaaagtcaggggtca

SEQ ID NO: 7422640 - DNA, 22 bp, Homo sapiens
aagttcctatatccaaatacag

SEQ ID NO: 7422641 - DNA, 22 bp, Homo sapiens
aagttcctcttctctgcaggga

SEQ ID NO: 7422642 - DNA, 22 bp, Homo sapiens
aagttcctcaaataaaacatga

SEQ ID NO: 7422643 - DNA, 22 bp, Homo sapiens
aagttcctcaaataaaacatga

SEQ ID NO: 7422644 - DNA, 22 bp, Homo sapiens
aagttcctatatccaaatacag

SEQ ID NO: 7422645 - DNA, 22 bp, Homo sapiens
aagttcctgagctcatatagca

SEQ ID NO: 7422646 - DNA, 22 bp, Homo sapiens
aagttcctgagctcatatagca

SEQ ID NO: 7422647 - DNA, 22 bp, Homo sapiens
aagttcctcttctctgcaggga

SEQ ID NO: 7422648 - DNA, 22 bp, Homo sapiens
aagttcactaagaccatagaat

SEQ ID NO: 7422649 - DNA, 22 bp, Homo sapiens
aagttcacagaagattccaatt

SEQ ID NO: 7422650 - DNA, 22 bp, Homo sapiens
aagttcacagaagattccaatt

SEQ ID NO: 7422651 - DNA, 22 bp, Homo sapiens
aagttcagcctggttttaatgc

SEQ ID NO: 7422652 - DNA, 22 bp, Homo sapiens
aagttcaatggaaaagctttag

SEQ ID NO: 7422653 - DNA, 22 bp, Homo sapiens
aagttcacagaagattccaatt

SEQ ID NO: 7422654 - DNA, 22 bp, Homo sapiens
aagttcatcaaagagtaaatat

SEQ ID NO: 7422655 - DNA, 22 bp, Homo sapiens
aagttcatcaaagagtaaatat

SEQ ID NO: 7422656 - DNA, 22 bp, Homo sapiens
aagttcatcaaagagtaaatat

SEQ ID NO: 7422657 - DNA, 22 bp, Homo sapiens
aagttcatcaaagagtaaatat

SEQ ID NO: 7422658 - DNA, 22 bp, Homo sapiens
aagttcatggtaggttggaagg

SEQ ID NO: 7422659 - DNA, 22 bp, Homo sapiens
aagttcatcttacctagatttt

SEQ ID NO: 7422660 - DNA, 22 bp, Homo sapiens
aagttcatcaaagagtaaatat

SEQ ID NO: 7422661 - DNA, 22 bp, Homo sapiens
aagttcatcttacctagatttt

SEQ ID NO: 7422662 - DNA, 22 bp, Homo sapiens
aagttcaagtctcctgagtata

SEQ ID NO: 7422663 - DNA, 23 bp, Homo sapiens
aagttcaagtcacagcctgtctt

SEQ ID NO: 7422664 - DNA, 22 bp, Homo sapiens
aagttcaagtctcctgagtata

SEQ ID NO: 7422665 - DNA, 22 bp, Homo sapiens
aagttcaagtagtgttacatgg

SEQ ID NO: 7422666 - DNA, 22 bp, Homo sapiens
aagttcaagtagtgttacatgg

SEQ ID NO: 7422667 - DNA, 22 bp, Homo sapiens
aagttcaagtctcctgagtata

SEQ ID NO: 7422668 - DNA, 22 bp, Homo sapiens
aagttcaagtctgcatcttttt

SEQ ID NO: 7422669 - DNA, 22 bp, Homo sapiens
aagttcaagtctgcatcttttt

SEQ ID NO: 7422670 - DNA, 22 bp, Homo sapiens
aagttcaagtctgcatcttttt

SEQ ID NO: 7422671 - DNA, 22 bp, Homo sapiens
aagttcaagtgtaatctttatt

SEQ ID NO: 7422672 - DNA, 22 bp, Homo sapiens
aagttcaagtgtaatctttatt

SEQ ID NO: 7422673 - DNA, 22 bp, Homo sapiens
aagttcaatcagatgaaaaagc

SEQ ID NO: 7422674 - DNA, 22 bp, Homo sapiens
aagttcaatcagatgaaaaagc

SEQ ID NO: 7422675 - DNA, 22 bp, Homo sapiens
aagttcaatcagatgaaaaagc

SEQ ID NO: 7422676 - DNA, 22 bp, Homo sapiens
aagttcaagtgtaatctttatt

SEQ ID NO: 7422677 - DNA, 22 bp, Homo sapiens
aagttcaatcagatgaaaaagc

SEQ ID NO: 7422678 - DNA, 22 bp, Homo sapiens
aagttcaatcagatgaaaaagc

SEQ ID NO: 7422679 - DNA, 18 bp, Homo sapiens
actctttctgcccacagg

SEQ ID NO: 7422680 - DNA, 18 bp, Homo sapiens
actctttctgcccacagg

SEQ ID NO: 7422681 - DNA, 18 bp, Homo sapiens
actctttctgcccacagg

SEQ ID NO: 7422682 - DNA, 18 bp, Homo sapiens
actctttctgcccacagg

SEQ ID NO: 7422683 - DNA, 22 bp, Homo sapiens
actctttattgtttgtggctag

SEQ ID NO: 7422684 - DNA, 22 bp, Homo sapiens
actctttgtctgttgccgctta

SEQ ID NO: 7422685 - DNA, 22 bp, Homo sapiens
actctttgtctgttgccgctta

SEQ ID NO: 7422686 - DNA, 22 bp, Homo sapiens
actcttttataaagcatcttga

SEQ ID NO: 7422687 - DNA, 22 bp, Homo sapiens
actcttttataaagcatcttga

SEQ ID NO: 7422688 - DNA, 22 bp, Homo sapiens
actcttttatgcattccttcag

SEQ ID NO: 7422689 - DNA, 19 bp, Homo sapiens
actcttttccttttgaatc

SEQ ID NO: 7422690 - DNA, 19 bp, Homo sapiens
actcttttccttttgaatc

SEQ ID NO: 7422691 - DNA, 19 bp, Homo sapiens
actcttttccttttgaatc

SEQ ID NO: 7422692 - DNA, 22 bp, Homo sapiens
aagttcaaggtgatagtggcag

SEQ ID NO: 7422693 - DNA, 22 bp, Homo sapiens
aagttcaaggtgatagtggcag

SEQ ID NO: 7422694 - DNA, 22 bp, Homo sapiens
aagttcaaggctctagagttcc

SEQ ID NO: 7422695 - DNA, 22 bp, Homo sapiens
aagttcaaggcaggtcctgagg

SEQ ID NO: 7422696 - DNA, 22 bp, Homo sapiens
actgaaaatgaattagaaacag

SEQ ID NO: 7422697 - DNA, 22 bp, Homo sapiens
actgaaaatgaattagaaacag

SEQ ID NO: 7422698 - DNA, 22 bp, Homo sapiens
actgaaaatgaattagaaacag

SEQ ID NO: 7422699 - DNA, 22 bp, Homo sapiens
actgaaaaagacatcttggtaa

SEQ ID NO: 7422700 - DNA, 22 bp, Homo sapiens
actgaaaaagacatcttggtaa

SEQ ID NO: 7422701 - DNA, 22 bp, Homo sapiens
actgaaaaagacatcttggtaa

SEQ ID NO: 7422702 - DNA, 22 bp, Homo sapiens
actgaaaatgaattagaaacag

SEQ ID NO: 7422703 - DNA, 22 bp, Homo sapiens
actgaaaaagtatgattcactg

SEQ ID NO: 7422704 - DNA, 22 bp, Homo sapiens
actgaaaaagtatgattcactg

SEQ ID NO: 7422705 - DNA, 22 bp, Homo sapiens
actgaaaaagtatgattcactg

SEQ ID NO: 7422706 - DNA, 22 bp, Homo sapiens
actcttgtttgtagagcccacc

SEQ ID NO: 7422707 - DNA, 22 bp, Homo sapiens
actctttacttaaactctaagt

SEQ ID NO: 7422708 - DNA, 22 bp, Homo sapiens
actctttacttaaactctaagt

SEQ ID NO: 7422709 - DNA, 22 bp, Homo sapiens
actctttagaggtacatctctt

SEQ ID NO: 7422710 - DNA, 20 bp, Homo sapiens
actctttagaagggaaaaca

SEQ ID NO: 7422711 - DNA, 22 bp, Homo sapiens
actcttgattgatttagtcttt

SEQ ID NO: 7422712 - DNA, 22 bp, Homo sapiens
actcttggccactcttggtgtc

SEQ ID NO: 7422713 - DNA, 22 bp, Homo sapiens
actcttgactccatggtgttag

SEQ ID NO: 7422714 - DNA, 22 bp, Homo sapiens
actcttgactccatggtgttag

SEQ ID NO: 7422715 - DNA, 20 bp, Homo sapiens
actcttgagaaattctctgt

SEQ ID NO: 7422716 - DNA, 22 bp, Homo sapiens
actcttgaactgattaagaatg

SEQ ID NO: 7422717 - DNA, 22 bp, Homo sapiens
actcttgaactgattaagaatg

SEQ ID NO: 7422718 - DNA, 22 bp, Homo sapiens
actcttgaaaatagatccacat

SEQ ID NO: 7422719 - DNA, 22 bp, Homo sapiens
actcttgaaaatagatccacat

SEQ ID NO: 7422720 - DNA, 22 bp, Homo sapiens
actcttgaaggtggtgggagtg

SEQ ID NO: 7422721 - DNA, 22 bp, Homo sapiens
actcttgacgggtgaggatatg

SEQ ID NO: 7422722 - DNA, 22 bp, Homo sapiens
actcttgacgggtgaggatatg

SEQ ID NO: 7422723 - DNA, 22 bp, Homo sapiens
aagtgtttccgggagacttggt

SEQ ID NO: 7422724 - DNA, 22 bp, Homo sapiens
aagtgtttccattgtgcaggct

SEQ ID NO: 7422725 - DNA, 22 bp, Homo sapiens
aagtgtttcttggaatgttgcg

SEQ ID NO: 7422726 - DNA, 22 bp, Homo sapiens
aagtgtttcttggaatgttgcg

SEQ ID NO: 7422727 - DNA, 22 bp, Homo sapiens
aagtgtttcttggaatgttgcg

SEQ ID NO: 7422728 - DNA, 22 bp, Homo sapiens
aagtgtttcttggaatgttgcg

SEQ ID NO: 7422729 - DNA, 22 bp, Homo sapiens
aagtgtttggggatcattttaa

SEQ ID NO: 7422730 - DNA, 22 bp, Homo sapiens
aagtgtttggggatcattttaa

SEQ ID NO: 7422731 - DNA, 22 bp, Homo sapiens
actcttcttgctgctcattaat

SEQ ID NO: 7422732 - DNA, 18 bp, Homo sapiens
actctgggacctgttatt

SEQ ID NO: 7422733 - DNA, 18 bp, Homo sapiens
actctgggacctgttatt

SEQ ID NO: 7422734 - DNA, 22 bp, Homo sapiens
actcttcttgctgctcattaat

SEQ ID NO: 7422735 - DNA, 22 bp, Homo sapiens
actctggcttgaggaccaggtc

SEQ ID NO: 7422736 - DNA, 22 bp, Homo sapiens
actctgggaatcctcaccttcc

SEQ ID NO: 7422737 - DNA, 22 bp, Homo sapiens
aagtgtttacttaaagtcatgg

SEQ ID NO: 7422738 - DNA, 22 bp, Homo sapiens
aagtgtttacttaaagtcatgg

SEQ ID NO: 7422739 - DNA, 22 bp, Homo sapiens
aagtgtttaggtttgcagtcga

SEQ ID NO: 7422740 - DNA, 22 bp, Homo sapiens
aagtgtttatttataacgatct

SEQ ID NO: 7422741 - DNA, 22 bp, Homo sapiens
aagtgtttatttataacgatct

SEQ ID NO: 7422742 - DNA, 22 bp, Homo sapiens
aagtgtttatttataacgatct

SEQ ID NO: 7422743 - DNA, 22 bp, Homo sapiens
aagtgtttatttataacgatct

SEQ ID NO: 7422744 - DNA, 22 bp, Homo sapiens
aagtgtttatttataacgatct

SEQ ID NO: 7422745 - DNA, 22 bp, Homo sapiens
aagtgtttatggttattgttaa

SEQ ID NO: 7422746 - DNA, 22 bp, Homo sapiens
aagtgtttatggttattgttaa

SEQ ID NO: 7422747 - DNA, 22 bp, Homo sapiens
aagtgtttattgattggtctag

SEQ ID NO: 7422748 - DNA, 22 bp, Homo sapiens
aagtgtttatggttattgttaa

SEQ ID NO: 7422749 - DNA, 22 bp, Homo sapiens
aagtgtttaaattatttgcagg

SEQ ID NO: 7422750 - DNA, 22 bp, Homo sapiens
aagtgtttaaattatttgcagg

SEQ ID NO: 7422751 - DNA, 22 bp, Homo sapiens
aagtgtttaaattatttgcagg

SEQ ID NO: 7422752 - DNA, 22 bp, Homo sapiens
aagtgtttaaattatttgcagg

SEQ ID NO: 7422753 - DNA, 22 bp, Homo sapiens
aagtgtttaaattatttgcagg

SEQ ID NO: 7422754 - DNA, 22 bp, Homo sapiens
aagtgtttaaattatttgcagg

SEQ ID NO: 7422755 - DNA, 22 bp, Homo sapiens
aagtgtttaatggttttgatga

SEQ ID NO: 7422756 - DNA, 22 bp, Homo sapiens
aagtgtttaacggtgattgagc

SEQ ID NO: 7422757 - DNA, 22 bp, Homo sapiens
aagtgtttaacggtgattgagc

SEQ ID NO: 7422758 - DNA, 22 bp, Homo sapiens
aagtgtttaaattatttgcagg

SEQ ID NO: 7422759 - DNA, 22 bp, Homo sapiens
aagtgttatgtaggatttcaga

SEQ ID NO: 7422760 - DNA, 22 bp, Homo sapiens
aagtgttatgtaggatttcaga

SEQ ID NO: 7422761 - DNA, 22 bp, Homo sapiens
aagtgttatgagtcaaggagct

SEQ ID NO: 7422762 - DNA, 22 bp, Homo sapiens
aagtgttatgagtcaaggagct

SEQ ID NO: 7422763 - DNA, 22 bp, Homo sapiens
aagtgttacagaaacaaatgaa

SEQ ID NO: 7422764 - DNA, 22 bp, Homo sapiens
aagtgttagggtaaagttggta

SEQ ID NO: 7422765 - DNA, 22 bp, Homo sapiens
aagtgttagggtaaagttggta

SEQ ID NO: 7422766 - DNA, 22 bp, Homo sapiens
aagtgttaaagacttgaacact

SEQ ID NO: 7422767 - DNA, 22 bp, Homo sapiens
aagtgttacagaaacaaatgaa

SEQ ID NO: 7422768 - DNA, 22 bp, Homo sapiens
aagtgttacagaaacaaatgaa

SEQ ID NO: 7422769 - DNA, 22 bp, Homo sapiens
aagtgttaaagacttgaacact

SEQ ID NO: 7422770 - DNA, 22 bp, Homo sapiens
aagtgttaaaagattaaatgct

SEQ ID NO: 7422771 - DNA, 22 bp, Homo sapiens
aagtgttaaaagattaaatgct

SEQ ID NO: 7422772 - DNA, 22 bp, Homo sapiens
aagtgttaaaagattaaatgct

SEQ ID NO: 7422773 - DNA, 22 bp, Homo sapiens
aagtgttaaagacttgaacact

SEQ ID NO: 7422774 - DNA, 22 bp, Homo sapiens
aagtgttaaagacttgaacact

SEQ ID NO: 7422775 - DNA, 22 bp, Homo sapiens
aagtgtgttctctgataaactc

SEQ ID NO: 7422776 - DNA, 22 bp, Homo sapiens
aagtgtgtgggcaggcagtggt

SEQ ID NO: 7422777 - DNA, 22 bp, Homo sapiens
aagtgtgtgggcaggcagtggt

SEQ ID NO: 7422778 - DNA, 22 bp, Homo sapiens
aagtgtgtgggcaggcagtggt

SEQ ID NO: 7422779 - DNA, 22 bp, Homo sapiens
aagtgtgtgagcctgtcaggct

SEQ ID NO: 7422780 - DNA, 22 bp, Homo sapiens
aagtgtgtctggcggcccagtg

SEQ ID NO: 7422781 - DNA, 22 bp, Homo sapiens
aagtgtgtcttgggaagggagg

SEQ ID NO: 7422782 - DNA, 22 bp, Homo sapiens
aagtgtgtgagcctgtcaggct

SEQ ID NO: 7422783 - DNA, 22 bp, Homo sapiens
aagtgtgtgagcctgtcaggct

SEQ ID NO: 7422784 - DNA, 19 bp, Homo sapiens
aagtgtgttgagccaggat

SEQ ID NO: 7422785 - DNA, 19 bp, Homo sapiens
aagtgtgttgagccaggat

SEQ ID NO: 7422786 - DNA, 22 bp, Homo sapiens
aagtgtgtttccgtgattgagg

SEQ ID NO: 7422787 - DNA, 22 bp, Homo sapiens
aagtgtgttttcagtgtactta

SEQ ID NO: 7422788 - DNA, 22 bp, Homo sapiens
aagtgtgttttcagtgtactta

SEQ ID NO: 7422789 - DNA, 22 bp, Homo sapiens
aagtgtgttgactgaattgggg

SEQ ID NO: 7422790 - DNA, 22 bp, Homo sapiens
aagtgtgttgactgaattgggg

SEQ ID NO: 7422791 - DNA, 22 bp, Homo sapiens
aagtgtgtattgtttatgctgc

SEQ ID NO: 7422792 - DNA, 22 bp, Homo sapiens
aagtgtgtattgtttatgctgc

SEQ ID NO: 7422793 - DNA, 22 bp, Homo sapiens
aagtgtgtattgtttatgctgc

SEQ ID NO: 7422794 - DNA, 22 bp, Homo sapiens
aagtgtgtatttttcttcagtg

SEQ ID NO: 7422795 - DNA, 22 bp, Homo sapiens
aagtgtgtattgtttatgctgc

SEQ ID NO: 7422796 - DNA, 22 bp, Homo sapiens
aagtgtggtttaggcatctttt

SEQ ID NO: 7422797 - DNA, 22 bp, Homo sapiens
aagtgtggggtctcagagctga

SEQ ID NO: 7422798 - DNA, 22 bp, Homo sapiens
aagtgtggtttaggcatctttt

SEQ ID NO: 7422799 - DNA, 22 bp, Homo sapiens
aagtgtgtcttgggaagggagg

SEQ ID NO: 7422800 - DNA, 22 bp, Homo sapiens
aagtgtgtctggcggcccagtg

SEQ ID NO: 7422801 - DNA, 21 bp, Homo sapiens
aagtgtgtcccagcagccggg

SEQ ID NO: 7422802 - DNA, 22 bp, Homo sapiens
aagtgtgtatttttcttcagtg

SEQ ID NO: 7422803 - DNA, 22 bp, Homo sapiens
aagtgtgtatttttcttcagtg

SEQ ID NO: 7422804 - DNA, 22 bp, Homo sapiens
aagtgtgggactagggctccag

SEQ ID NO: 7422805 - DNA, 22 bp, Homo sapiens
aagtgtgggactagggctccag

SEQ ID NO: 7422806 - DNA, 22 bp, Homo sapiens
aagtgtggggtctcagagctga

SEQ ID NO: 7422807 - DNA, 22 bp, Homo sapiens
aagtgtggggtctcagagctga

SEQ ID NO: 7422808 - DNA, 22 bp, Homo sapiens
aagtgtgggaagtaggtggcga

SEQ ID NO: 7422809 - DNA, 22 bp, Homo sapiens
aagtgtgggaagtaggtggcga

SEQ ID NO: 7422810 - DNA, 22 bp, Homo sapiens
aagtgtgggaagtaggtggcga

SEQ ID NO: 7422811 - DNA, 22 bp, Homo sapiens
aagtgtcttttagccactttta

SEQ ID NO: 7422812 - DNA, 22 bp, Homo sapiens
aagtgtgaattttagagtcagg

SEQ ID NO: 7422813 - DNA, 22 bp, Homo sapiens
aagtgtctttatatttgagaaa

SEQ ID NO: 7422814 - DNA, 22 bp, Homo sapiens
aagtgtcttttagccactttta

SEQ ID NO: 7422815 - DNA, 22 bp, Homo sapiens
aagtgtgagacacacaaaatta

SEQ ID NO: 7422816 - DNA, 22 bp, Homo sapiens
aagtgtgagacacacaaaatta

SEQ ID NO: 7422817 - DNA, 22 bp, Homo sapiens
aagtgtgacactgtgttaatta

SEQ ID NO: 7422818 - DNA, 22 bp, Homo sapiens
aagtgtgagacacacaaaatta

SEQ ID NO: 7422819 - DNA, 22 bp, Homo sapiens
acctgcctatggagccacatgg

SEQ ID NO: 7422820 - DNA, 22 bp, Homo sapiens
acctgcctatggagccacatgg

SEQ ID NO: 7422821 - DNA, 22 bp, Homo sapiens
acctgcctatggagccacatgg

SEQ ID NO: 7422822 - DNA, 22 bp, Homo sapiens
acctgcctatggagccacatgg

SEQ ID NO: 7422823 - DNA, 22 bp, Homo sapiens
acctgcctatggagccacatgg

SEQ ID NO: 7422824 - DNA, 22 bp, Homo sapiens
acctgcctcagtgcagctggat

SEQ ID NO: 7422825 - DNA, 22 bp, Homo sapiens
acctgcctcagtgcagctggat

SEQ ID NO: 7422826 - DNA, 22 bp, Homo sapiens
acctgcctcagtgcagctggat

SEQ ID NO: 7422827 - DNA, 22 bp, Homo sapiens
acctgcctcagtgcagctggat

SEQ ID NO: 7422828 - DNA, 22 bp, Homo sapiens
acctgcctctaagcagcaggtg

SEQ ID NO: 7422829 - DNA, 22 bp, Homo sapiens
acctgcctctaagcagcaggtg

SEQ ID NO: 7422830 - DNA, 22 bp, Homo sapiens
acctgcctctaagcagcaggtg

SEQ ID NO: 7422831 - DNA, 22 bp, Homo sapiens
acctgcctctaagcagcaggtg

SEQ ID NO: 7422832 - DNA, 22 bp, Homo sapiens
aagtgtctgcaaaatgacagag

SEQ ID NO: 7422833 - DNA, 22 bp, Homo sapiens
aagtgtctgcaaaatgacagag

SEQ ID NO: 7422834 - DNA, 22 bp, Homo sapiens
aagtgtctgatggagcgaaatg

SEQ ID NO: 7422835 - DNA, 22 bp, Homo sapiens
aagtgtctgacacaaaatatgt

SEQ ID NO: 7422836 - DNA, 22 bp, Homo sapiens
aagtgtctgacacaaaatatgt

SEQ ID NO: 7422837 - DNA, 22 bp, Homo sapiens
aagtgtcttctgatggggtgtg

SEQ ID NO: 7422838 - DNA, 22 bp, Homo sapiens
aagtgtcttaactccttttggg

SEQ ID NO: 7422839 - DNA, 22 bp, Homo sapiens
aagtgtcttctgatggggtgtg

SEQ ID NO: 7422840 - DNA, 22 bp, Homo sapiens
aagtgtctgctggctctaccct

SEQ ID NO: 7422841 - DNA, 22 bp, Homo sapiens
aagtgtctgctggctctaccct

SEQ ID NO: 7422842 - DNA, 22 bp, Homo sapiens
aagtgtctgctggctctaccct

SEQ ID NO: 7422843 - DNA, 22 bp, Homo sapiens
aagtgtctgcaaaatgacagag

SEQ ID NO: 7422844 - DNA, 22 bp, Homo sapiens
aatgaataccgtttcactcagt

SEQ ID NO: 7422845 - DNA, 22 bp, Homo sapiens
aatgaagttctattcattttct

SEQ ID NO: 7422846 - DNA, 22 bp, Homo sapiens
aatgaataccgtttcactcagt

SEQ ID NO: 7422847 - DNA, 22 bp, Homo sapiens
aatgaataccgtttcactcagt

SEQ ID NO: 7422848 - DNA, 22 bp, Homo sapiens
aatgaataccgtttcactcagt

SEQ ID NO: 7422849 - DNA, 22 bp, Homo sapiens
aatgaataccgtttcactcagt

SEQ ID NO: 7422850 - DNA, 22 bp, Homo sapiens
aatgaataccgtttcactcagt

SEQ ID NO: 7422851 - DNA, 22 bp, Homo sapiens
aatgaataccgtttcactcagt

SEQ ID NO: 7422852 - DNA, 22 bp, Homo sapiens
aatgaataacaatcctctggag

SEQ ID NO: 7422853 - DNA, 22 bp, Homo sapiens
aatgaagttctattcattttct

SEQ ID NO: 7422854 - DNA, 22 bp, Homo sapiens
aatgaagttctattcattttct

SEQ ID NO: 7422855 - DNA, 22 bp, Homo sapiens
aatgaagttctattcattttct

SEQ ID NO: 7422856 - DNA, 20 bp, Homo sapiens
aatgaagttattaatgatgt

SEQ ID NO: 7422857 - DNA, 22 bp, Homo sapiens
aatgaagttctattcattttct

SEQ ID NO: 7422858 - DNA, 21 bp, Homo sapiens
aatgaagtggctattttgagg

SEQ ID NO: 7422859 - DNA, 21 bp, Homo sapiens
aatgaagtggctattttgagg

SEQ ID NO: 7422860 - DNA, 21 bp, Homo sapiens
aatgaagtggctattttgagg

SEQ ID NO: 7422861 - DNA, 21 bp, Homo sapiens
aatgaagtggctattttgagg

SEQ ID NO: 7422862 - DNA, 22 bp, Homo sapiens
aatgaagtgttatttagtttca

SEQ ID NO: 7422863 - DNA, 21 bp, Homo sapiens
aatgaagtggctattttgagg

SEQ ID NO: 7422864 - DNA, 22 bp, Homo sapiens
aatgaagtgttatttagtttca

SEQ ID NO: 7422865 - DNA, 22 bp, Homo sapiens
aatgaagtgttatttagtttca

SEQ ID NO: 7422866 - DNA, 22 bp, Homo sapiens
aatgaagtgttatttagtttca

SEQ ID NO: 7422867 - DNA, 22 bp, Homo sapiens
aatgaagtgttatttagtttca

SEQ ID NO: 7422868 - DNA, 22 bp, Homo sapiens
aatgaagtgtttagaagtttta

SEQ ID NO: 7422869 - DNA, 20 bp, Homo sapiens
aatgaagttattaatgatgt

SEQ ID NO: 7422870 - DNA, 20 bp, Homo sapiens
aatgaagttattaatgatgt

SEQ ID NO: 7422871 - DNA, 22 bp, Homo sapiens
aatgaagattatggtgattaag

SEQ ID NO: 7422872 - DNA, 22 bp, Homo sapiens
aatgaagataaaatgggatgga

SEQ ID NO: 7422873 - DNA, 22 bp, Homo sapiens
aatgaagataaaatgggatgga

SEQ ID NO: 7422874 - DNA, 22 bp, Homo sapiens
aatgaagacacatctttctcat

SEQ ID NO: 7422875 - DNA, 22 bp, Homo sapiens
aatgaagataaaatgggatgga

SEQ ID NO: 7422876 - DNA, 22 bp, Homo sapiens
aatgaagaaatggacatcttta

SEQ ID NO: 7422877 - DNA, 22 bp, Homo sapiens
aatgaagaaatggacatcttta

SEQ ID NO: 7422878 - DNA, 22 bp, Homo sapiens
aatgaagcaagctgctgtgttt

SEQ ID NO: 7422879 - DNA, 22 bp, Homo sapiens
aatgaagcaagctgctgtgttt

SEQ ID NO: 7422880 - DNA, 22 bp, Homo sapiens
aatgaagcagtccatctgctct

SEQ ID NO: 7422881 - DNA, 22 bp, Homo sapiens
aatgaagcagtccatctgctct

SEQ ID NO: 7422882 - DNA, 22 bp, Homo sapiens
aatgaagcagtccatctgctct

SEQ ID NO: 7422883 - DNA, 22 bp, Homo sapiens
aatgaagcagtccatctgctct

SEQ ID NO: 7422884 - DNA, 22 bp, Homo sapiens
aatgaagcagtccatctgctct

SEQ ID NO: 7422885 - DNA, 22 bp, Homo sapiens
aatgaagcagttttcatcaagt

SEQ ID NO: 7422886 - DNA, 22 bp, Homo sapiens
aatgaagccaggtagaagagaa

SEQ ID NO: 7422887 - DNA, 22 bp, Homo sapiens
aatgaagccaggtagaagagaa

SEQ ID NO: 7422888 - DNA, 22 bp, Homo sapiens
aatgaagccagctgggatgcga

SEQ ID NO: 7422889 - DNA, 22 bp, Homo sapiens
aatgaagccagctgggatgcga

SEQ ID NO: 7422890 - DNA, 22 bp, Homo sapiens
aatgaagcagttttcatcaagt

SEQ ID NO: 7422891 - DNA, 22 bp, Homo sapiens
aatgaagccactgaagacaatc

SEQ ID NO: 7422892 - DNA, 22 bp, Homo sapiens
aatgaagccactgaagacaatc

SEQ ID NO: 7422893 - DNA, 22 bp, Homo sapiens
aatgaagccactgaagacaatc

SEQ ID NO: 7422894 - DNA, 20 bp, Homo sapiens
aatgaatgaacgaatggatg

SEQ ID NO: 7422895 - DNA, 17 bp, Homo sapiens
aatgaatgaattctttg

SEQ ID NO: 7422896 - DNA, 17 bp, Homo sapiens
aatgaatgaattctttg

SEQ ID NO: 7422897 - DNA, 22 bp, Homo sapiens
aatgaatgggtttaatatttta

SEQ ID NO: 7422898 - DNA, 22 bp, Homo sapiens
aatgaatgggtttaatatttta

SEQ ID NO: 7422899 - DNA, 22 bp, Homo sapiens
agaagcagctttcaaggtgatt

SEQ ID NO: 7422900 - DNA, 22 bp, Homo sapiens
agaagcagctttcaaggtgatt

SEQ ID NO: 7422901 - DNA, 22 bp, Homo sapiens
aatgaatgggtttaatatttta

SEQ ID NO: 7422902 - DNA, 22 bp, Homo sapiens
agaagcagctttcaaggtgatt

SEQ ID NO: 7422903 - DNA, 22 bp, Homo sapiens
agaagcagctttcaaggtgatt

SEQ ID NO: 7422904 - DNA, 22 bp, Homo sapiens
agaagcagctttcaaggtgatt

SEQ ID NO: 7422905 - DNA, 22 bp, Homo sapiens
aatgaatgaaccacatataaca

SEQ ID NO: 7422906 - DNA, 22 bp, Homo sapiens
aatgaatgaaccacatataaca

SEQ ID NO: 7422907 - DNA, 22 bp, Homo sapiens
aatgaatgaaccacatataaca

SEQ ID NO: 7422908 - DNA, 22 bp, Homo sapiens
aatgaatgaaccacatataaca

SEQ ID NO: 7422909 - DNA, 22 bp, Homo sapiens
aatgaatgaaccacatataaca

SEQ ID NO: 7422910 - DNA, 22 bp, Homo sapiens
aatgaatgaaccacatataaca

SEQ ID NO: 7422911 - DNA, 22 bp, Homo sapiens
aatgaatgaaccacatataaca

SEQ ID NO: 7422912 - DNA, 22 bp, Homo sapiens
agaagcagctttcaaggtgatt

SEQ ID NO: 7422913 - DNA, 22 bp, Homo sapiens
agaagccaccagctgaggaaga

SEQ ID NO: 7422914 - DNA, 22 bp, Homo sapiens
agaagccaccagctgaggaaga

SEQ ID NO: 7422915 - DNA, 22 bp, Homo sapiens
agaagcagctttcaaggtgatt

SEQ ID NO: 7422916 - DNA, 22 bp, Homo sapiens
agaagcagctttcaaggtgatt

SEQ ID NO: 7422917 - DNA, 22 bp, Homo sapiens
agaagcagctttcaaggtgatt

SEQ ID NO: 7422918 - DNA, 22 bp, Homo sapiens
agaagcagctttcaaggtgatt

SEQ ID NO: 7422919 - DNA, 22 bp, Homo sapiens
agaagcagctttcaaggtgatt

SEQ ID NO: 7422920 - DNA, 22 bp, Homo sapiens
agaagccaccagctgaggaaga

SEQ ID NO: 7422921 - DNA, 18 bp, Homo sapiens
agaagccacgaggagtcc

SEQ ID NO: 7422922 - DNA, 18 bp, Homo sapiens
agaagccacgaggagtcc

SEQ ID NO: 7422923 - DNA, 18 bp, Homo sapiens
agaagccacgaggagtcc

SEQ ID NO: 7422924 - DNA, 22 bp, Homo sapiens
agaagccactgctcccagtgag

SEQ ID NO: 7422925 - DNA, 22 bp, Homo sapiens
agaagccactggaggttgagat

SEQ ID NO: 7422926 - DNA, 22 bp, Homo sapiens
agaagccagaggcagtgggtac

SEQ ID NO: 7422927 - DNA, 22 bp, Homo sapiens
agaagccactggaggttgagat

SEQ ID NO: 7422928 - DNA, 22 bp, Homo sapiens
agaagccagaatattcatggat

SEQ ID NO: 7422929 - DNA, 22 bp, Homo sapiens
agaagccactggaggttgagat

SEQ ID NO: 7422930 - DNA, 22 bp, Homo sapiens
agaagccactggaggttgagat

SEQ ID NO: 7422931 - DNA, 22 bp, Homo sapiens
agaagccagaatattcatggat

SEQ ID NO: 7422932 - DNA, 22 bp, Homo sapiens
agaagccactggaggttgagat

SEQ ID NO: 7422933 - DNA, 22 bp, Homo sapiens
agaagaaactgtcggggatatt

SEQ ID NO: 7422934 - DNA, 22 bp, Homo sapiens
agaagaaactgtcggggatatt

SEQ ID NO: 7422935 - DNA, 22 bp, Homo sapiens
agaagaaactgtcggggatatt

SEQ ID NO: 7422936 - DNA, 22 bp, Homo sapiens
agaagaaactgtcggggatatt

SEQ ID NO: 7422937 - DNA, 22 bp, Homo sapiens
agaacttttggagacttttagt

SEQ ID NO: 7422938 - DNA, 22 bp, Homo sapiens
agaacttaggaacaacagctta

SEQ ID NO: 7422939 - DNA, 22 bp, Homo sapiens
agaacttttggagacttttagt

SEQ ID NO: 7422940 - DNA, 22 bp, Homo sapiens
agaacttttggagacttttagt

SEQ ID NO: 7422941 - DNA, 22 bp, Homo sapiens
agaacttaattcagtgacttaa

SEQ ID NO: 7422942 - DNA, 20 bp, Homo sapiens
agaactgttgtttgggtcct

SEQ ID NO: 7422943 - DNA, 20 bp, Homo sapiens
agaactgttgtttgggtcct

SEQ ID NO: 7422944 - DNA, 22 bp, Homo sapiens
agaacttaattgtcacttttct

SEQ ID NO: 7422945 - DNA, 22 bp, Homo sapiens
agaacttacattatagagctgt

SEQ ID NO: 7422946 - DNA, 22 bp, Homo sapiens
agaacttaggaacaacagctta

SEQ ID NO: 7422947 - DNA, 22 bp, Homo sapiens
agaactgtccttggaggagagt

SEQ ID NO: 7422948 - DNA, 22 bp, Homo sapiens
agaactgtccttggaggagagt

SEQ ID NO: 7422949 - DNA, 22 bp, Homo sapiens
agaactgtgaagtatgtgaaat

SEQ ID NO: 7422950 - DNA, 22 bp, Homo sapiens
agaactgtgaagtatgtgaaat

SEQ ID NO: 7422951 - DNA, 22 bp, Homo sapiens
agaactgtgaagtatgtgaaat

SEQ ID NO: 7422952 - DNA, 22 bp, Homo sapiens
agaactgtgccaaaaattttgt

SEQ ID NO: 7422953 - DNA, 22 bp, Homo sapiens
agaagaaatgaggccgttctgc

SEQ ID NO: 7422954 - DNA, 22 bp, Homo sapiens
agaagaaatgaggccgttctgc

SEQ ID NO: 7422955 - DNA, 22 bp, Homo sapiens
aatgaactgtgttaactgaata

SEQ ID NO: 7422956 - DNA, 22 bp, Homo sapiens
aatgaactgtgttaactgaata

SEQ ID NO: 7422957 - DNA, 22 bp, Homo sapiens
aatgaagaaatggacatcttta

SEQ ID NO: 7422958 - DNA, 22 bp, Homo sapiens
aatgaagaaatggacatcttta

SEQ ID NO: 7422959 - DNA, 22 bp, Homo sapiens
aatgaagaaatggacatcttta

SEQ ID NO: 7422960 - DNA, 22 bp, Homo sapiens
aatgaagaaatggacatcttta

SEQ ID NO: 7422961 - DNA, 22 bp, Homo sapiens
agaagaaagattgaaggttcct

SEQ ID NO: 7422962 - DNA, 22 bp, Homo sapiens
agaagaaagattgaaggttcct

SEQ ID NO: 7422963 - DNA, 22 bp, Homo sapiens
agaagaaagattgaaggttcct

SEQ ID NO: 7422964 - DNA, 22 bp, Homo sapiens
agaagaaagattgaaggttcct

SEQ ID NO: 7422965 - DNA, 22 bp, Homo sapiens
agaagaaactgtcggggatatt

SEQ ID NO: 7422966 - DNA, 22 bp, Homo sapiens
agaagaaactgtcggggatatt

SEQ ID NO: 7422967 - DNA, 22 bp, Homo sapiens
agaagaaagattgaaggttcct

SEQ ID NO: 7422968 - DNA, 22 bp, Homo sapiens
agaagaaagattgaaggttcct

SEQ ID NO: 7422969 - DNA, 22 bp, Homo sapiens
agaagaaagattgaaggttcct

SEQ ID NO: 7422970 - DNA, 22 bp, Homo sapiens
agaagaaagattgaaggttcct

SEQ ID NO: 7422971 - DNA, 22 bp, Homo sapiens
agaacacactgggggaaacaag

SEQ ID NO: 7422972 - DNA, 22 bp, Homo sapiens
agaacacactgggggaaacaag

SEQ ID NO: 7422973 - DNA, 22 bp, Homo sapiens
agaacacactgggggaaacaag

SEQ ID NO: 7422974 - DNA, 22 bp, Homo sapiens
agaacacactgggggaaacaag

SEQ ID NO: 7422975 - DNA, 22 bp, Homo sapiens
agaacacacgtcagagtttcct

SEQ ID NO: 7422976 - DNA, 22 bp, Homo sapiens
agaacacacgtcagagtttcct

SEQ ID NO: 7422977 - DNA, 22 bp, Homo sapiens
agaacacacgtcagagtttcct

SEQ ID NO: 7422978 - DNA, 22 bp, Homo sapiens
agaacgtggaatgtggctcctt

SEQ ID NO: 7422979 - DNA, 22 bp, Homo sapiens
agaactatacattactcattga

SEQ ID NO: 7422980 - DNA, 22 bp, Homo sapiens
agaactattgcaataacaagaa

SEQ ID NO: 7422981 - DNA, 22 bp, Homo sapiens
agaactattgcaataacaagaa

SEQ ID NO: 7422982 - DNA, 22 bp, Homo sapiens
agaactatacattactcattga

SEQ ID NO: 7422983 - DNA, 22 bp, Homo sapiens
agaactattgcaataacaagaa

SEQ ID NO: 7422984 - DNA, 21 bp, Homo sapiens
agaactgattaaataagcagt

SEQ ID NO: 7422985 - DNA, 21 bp, Homo sapiens
agaactgattaaataagcagt

SEQ ID NO: 7422986 - DNA, 21 bp, Homo sapiens
agaactgattaaataagcagt

SEQ ID NO: 7422987 - DNA, 20 bp, Homo sapiens
agaactgaatcattttgggt

SEQ ID NO: 7422988 - DNA, 20 bp, Homo sapiens
agaactgaatcattttgggt

SEQ ID NO: 7422989 - DNA, 22 bp, Homo sapiens
agaactgcaattacttctgcac

SEQ ID NO: 7422990 - DNA, 22 bp, Homo sapiens
agaactgatttgaaggttgggg

SEQ ID NO: 7422991 - DNA, 22 bp, Homo sapiens
agaactgatttgaaggttgggg

SEQ ID NO: 7422992 - DNA, 18 bp, Homo sapiens
agaactgcacctctcctg

SEQ ID NO: 7422993 - DNA, 22 bp, Homo sapiens
agaactgctagctctccttctg

SEQ ID NO: 7422994 - DNA, 19 bp, Homo sapiens
agaactgggtccatggctt

SEQ ID NO: 7422995 - DNA, 22 bp, Homo sapiens
agaactctttatctgtggaatg

SEQ ID NO: 7422996 - DNA, 19 bp, Homo sapiens
agaactcagtatcttttct

SEQ ID NO: 7422997 - DNA, 22 bp, Homo sapiens
agaactctcgctggatcagact

SEQ ID NO: 7422998 - DNA, 22 bp, Homo sapiens
agaactctatattcatgaacaa

SEQ ID NO: 7422999 - DNA, 22 bp, Homo sapiens
agaactgtcacgagtgacaaag

SEQ ID NO: 7423000 - DNA, 22 bp, Homo sapiens
agaactgtccccagagagcact

SEQ ID NO: 7423001 - DNA, 22 bp, Homo sapiens
agaactgtccccagagagcact

SEQ ID NO: 7423002 - DNA, 22 bp, Homo sapiens
agaactgtcacgagtgacaaag

SEQ ID NO: 7423003 - DNA, 17 bp, Homo sapiens
agaactgtagtagctcc

SEQ ID NO: 7423004 - DNA, 19 bp, Homo sapiens
agaactgggtccatggctt

SEQ ID NO: 7423005 - DNA, 22 bp, Homo sapiens
agaactggtggtgatcagttat

SEQ ID NO: 7423006 - DNA, 22 bp, Homo sapiens
agaactggtggtgatcagttat

SEQ ID NO: 7423007 - DNA, 22 bp, Homo sapiens
agaaggaagccaggagggtgca

SEQ ID NO: 7423008 - DNA, 22 bp, Homo sapiens
agaaggaagccaggagggtgca

SEQ ID NO: 7423009 - DNA, 22 bp, Homo sapiens
agaaggaagccaggagggtgca

SEQ ID NO: 7423010 - DNA, 22 bp, Homo sapiens
agaaggaagccaggagggtgca

SEQ ID NO: 7423011 - DNA, 22 bp, Homo sapiens
agaaggaagccaggagggtgca

SEQ ID NO: 7423012 - DNA, 22 bp, Homo sapiens
agaaggaagccaggagggtgca

SEQ ID NO: 7423013 - DNA, 22 bp, Homo sapiens
agaaggaagccaggagggtgca

SEQ ID NO: 7423014 - DNA, 22 bp, Homo sapiens
agaaggaagccaggagggtgca

SEQ ID NO: 7423015 - DNA, 22 bp, Homo sapiens
agaaggaagccaggagggtgca

SEQ ID NO: 7423016 - DNA, 22 bp, Homo sapiens
agaaggaagccaggagggtgca

SEQ ID NO: 7423017 - DNA, 22 bp, Homo sapiens
agaaggaaggataactgcatta

SEQ ID NO: 7423018 - DNA, 22 bp, Homo sapiens
agaaggaaggataactgcatta

SEQ ID NO: 7423019 - DNA, 22 bp, Homo sapiens
agaaggaaggataactgcatta

SEQ ID NO: 7423020 - DNA, 22 bp, Homo sapiens
agaaggaaggaagcattctgtt

SEQ ID NO: 7423021 - DNA, 22 bp, Homo sapiens
agaaggaaggaagcattctgtt

SEQ ID NO: 7423022 - DNA, 22 bp, Homo sapiens
agaaggaaggaagcattctgtt

SEQ ID NO: 7423023 - DNA, 22 bp, Homo sapiens
agaaggaaggaagcattctgtt

SEQ ID NO: 7423024 - DNA, 22 bp, Homo sapiens
agaaggaaggaagcattctgtt

SEQ ID NO: 7423025 - DNA, 22 bp, Homo sapiens
agaaggaaggaagcattctgtt

SEQ ID NO: 7423026 - DNA, 22 bp, Homo sapiens
agaaggaaggaagcattctgtt

SEQ ID NO: 7423027 - DNA, 22 bp, Homo sapiens
agaaggaaggaagcattctgtt

SEQ ID NO: 7423028 - DNA, 22 bp, Homo sapiens
agaaggaaggaagcattctgtt

SEQ ID NO: 7423029 - DNA, 22 bp, Homo sapiens
agaaggaaggataactgcatta

SEQ ID NO: 7423030 - DNA, 22 bp, Homo sapiens
agaaggaaggataactgcatta

SEQ ID NO: 7423031 - DNA, 22 bp, Homo sapiens
agaaggaaggctgagtgctgat

SEQ ID NO: 7423032 - DNA, 22 bp, Homo sapiens
agaaggaaggctgagtgctgat

SEQ ID NO: 7423033 - DNA, 22 bp, Homo sapiens
agaaggaaggctgagtgctgat

SEQ ID NO: 7423034 - DNA, 22 bp, Homo sapiens
agaaggaaggctgagtgctgat

SEQ ID NO: 7423035 - DNA, 22 bp, Homo sapiens
agaaggaaggctgagtgctgat

SEQ ID NO: 7423036 - DNA, 22 bp, Homo sapiens
agaaggaaggctgagtgctgat

SEQ ID NO: 7423037 - DNA, 22 bp, Homo sapiens
agaaggaaggctgagtgctgat

SEQ ID NO: 7423038 - DNA, 22 bp, Homo sapiens
agaaggacccggtgggagatga

SEQ ID NO: 7423039 - DNA, 22 bp, Homo sapiens
aatgcacaaaaattgtatgtaa

SEQ ID NO: 7423040 - DNA, 22 bp, Homo sapiens
aatgcacaaaaattgtatgtaa

SEQ ID NO: 7423041 - DNA, 22 bp, Homo sapiens
aatgcacaaaaattgtatgtaa

SEQ ID NO: 7423042 - DNA, 22 bp, Homo sapiens
agaaggaaggctgagtgctgat

SEQ ID NO: 7423043 - DNA, 22 bp, Homo sapiens
agaaggaaggctgagtgctgat

SEQ ID NO: 7423044 - DNA, 22 bp, Homo sapiens
agaaggaaggctgagtgctgat

SEQ ID NO: 7423045 - DNA, 22 bp, Homo sapiens
agaaggaaggctgagtgctgat

SEQ ID NO: 7423046 - DNA, 22 bp, Homo sapiens
agaaggaaggctgagtgctgat

SEQ ID NO: 7423047 - DNA, 22 bp, Homo sapiens
agaagcttcaagatatttggta

SEQ ID NO: 7423048 - DNA, 22 bp, Homo sapiens
agaagctgttgcattcctggcg

SEQ ID NO: 7423049 - DNA, 22 bp, Homo sapiens
agaagcttcaagatatttggta

SEQ ID NO: 7423050 - DNA, 22 bp, Homo sapiens
agaagcttcaagatatttggta

SEQ ID NO: 7423051 - DNA, 22 bp, Homo sapiens
agaagccagtcgctctcccgca

SEQ ID NO: 7423052 - DNA, 22 bp, Homo sapiens
agaagctgttgcattcctggcg

SEQ ID NO: 7423053 - DNA, 22 bp, Homo sapiens
agaagctgttgcattcctggcg

SEQ ID NO: 7423054 - DNA, 22 bp, Homo sapiens
agaagcttgaaggagcagtgac

SEQ ID NO: 7423055 - DNA, 22 bp, Homo sapiens
agaagcttgaaggagcagtgac

SEQ ID NO: 7423056 - DNA, 22 bp, Homo sapiens
agaagcttccacggatgtgtct

SEQ ID NO: 7423057 - DNA, 22 bp, Homo sapiens
agaagcttcctacattgttctt

SEQ ID NO: 7423058 - DNA, 22 bp, Homo sapiens
agaagcttcctacattgttctt

SEQ ID NO: 7423059 - DNA, 22 bp, Homo sapiens
agaagcttcctacattgttctt

SEQ ID NO: 7423060 - DNA, 22 bp, Homo sapiens
agaagcttccacggatgtgtct

SEQ ID NO: 7423061 - DNA, 22 bp, Homo sapiens
agaagcttccacggatgtgtct

SEQ ID NO: 7423062 - DNA, 22 bp, Homo sapiens
agaagcttcctacattgttctt

SEQ ID NO: 7423063 - DNA, 22 bp, Homo sapiens
agaaggaaacagctgtgctttg

SEQ ID NO: 7423064 - DNA, 22 bp, Homo sapiens
agaaggaaacagctgtgctttg

SEQ ID NO: 7423065 - DNA, 22 bp, Homo sapiens
agaaggaaacagctgtgctttg

SEQ ID NO: 7423066 - DNA, 22 bp, Homo sapiens
agaaggaaacagctgtgctttg

SEQ ID NO: 7423067 - DNA, 22 bp, Homo sapiens
agaaggaaacagctgtgctttg

SEQ ID NO: 7423068 - DNA, 22 bp, Homo sapiens
agaaggaaaacctgtcttatgt

SEQ ID NO: 7423069 - DNA, 22 bp, Homo sapiens
agaaggaaaacctgtcttatgt

SEQ ID NO: 7423070 - DNA, 22 bp, Homo sapiens
agaaggaaaacctgtcttatgt

SEQ ID NO: 7423071 - DNA, 22 bp, Homo sapiens
agaaggaaaacctgtcttatgt

SEQ ID NO: 7423072 - DNA, 22 bp, Homo sapiens
agaaggaaaacctgtcttatgt

SEQ ID NO: 7423073 - DNA, 22 bp, Homo sapiens
agaaggaaaacctgtcttatgt

SEQ ID NO: 7423074 - DNA, 22 bp, Homo sapiens
agaagccagattgtagtgggac

SEQ ID NO: 7423075 - DNA, 22 bp, Homo sapiens
agaagccagattgtagtgggac

SEQ ID NO: 7423076 - DNA, 22 bp, Homo sapiens
agaagccagattgtagtgggac

SEQ ID NO: 7423077 - DNA, 22 bp, Homo sapiens
agaagccagaggcagtgggtac

SEQ ID NO: 7423078 - DNA, 22 bp, Homo sapiens
agaagccagaggcagtgggtac

SEQ ID NO: 7423079 - DNA, 22 bp, Homo sapiens
agaagccagattgtagtgggac

SEQ ID NO: 7423080 - DNA, 22 bp, Homo sapiens
agaagccagccttgcctccttt

SEQ ID NO: 7423081 - DNA, 22 bp, Homo sapiens
agaagccagccttgcctccttt

SEQ ID NO: 7423082 - DNA, 22 bp, Homo sapiens
agaagccagccttgcctccttt

SEQ ID NO: 7423083 - DNA, 22 bp, Homo sapiens
agaagccagcttcagctgcccg

SEQ ID NO: 7423084 - DNA, 22 bp, Homo sapiens
agaagccagcttcagctgcccg

SEQ ID NO: 7423085 - DNA, 22 bp, Homo sapiens
agaagccagcttcagctgcccg

SEQ ID NO: 7423086 - DNA, 22 bp, Homo sapiens
agaagccagtcgctctcccgca

SEQ ID NO: 7423087 - DNA, 22 bp, Homo sapiens
agaagccagtcgctctcccgca

SEQ ID NO: 7423088 - DNA, 22 bp, Homo sapiens
agaagccagcttcagctgcccg

SEQ ID NO: 7423089 - DNA, 22 bp, Homo sapiens
agaagccagccttgcctccttt

SEQ ID NO: 7423090 - DNA, 22 bp, Homo sapiens
agaagccagcttcagctgcccg

SEQ ID NO: 7423091 - DNA, 22 bp, Homo sapiens
agaagccagcttcagctgcccg

SEQ ID NO: 7423092 - DNA, 22 bp, Homo sapiens
aatgcattttattatatgtgac

SEQ ID NO: 7423093 - DNA, 22 bp, Homo sapiens
aatgcattttattatatgtgac

SEQ ID NO: 7423094 - DNA, 18 bp, Homo sapiens
aatgcatttatggagatg

SEQ ID NO: 7423095 - DNA, 18 bp, Homo sapiens
aatgcatttatggagatg

SEQ ID NO: 7423096 - DNA, 22 bp, Homo sapiens
aatgccaacttggatatacatt

SEQ ID NO: 7423097 - DNA, 22 bp, Homo sapiens
aatgccaatattcatttgtgtt

SEQ ID NO: 7423098 - DNA, 22 bp, Homo sapiens
aatgccaatattcatttgtgtt

SEQ ID NO: 7423099 - DNA, 22 bp, Homo sapiens
aatgccaatgggcagaactaga

SEQ ID NO: 7423100 - DNA, 23 bp, Homo sapiens
aatgccatattggatttcttcag

SEQ ID NO: 7423101 - DNA, 22 bp, Homo sapiens
aatgccagtgtgttgattccag

SEQ ID NO: 7423102 - DNA, 22 bp, Homo sapiens
aatgccatcagagaaaactctt

SEQ ID NO: 7423103 - DNA, 22 bp, Homo sapiens
aatgccatccctctgtcaccaa

SEQ ID NO: 7423104 - DNA, 22 bp, Homo sapiens
aatgccagtgtgttgattccag

SEQ ID NO: 7423105 - DNA, 21 bp, Homo sapiens
aatgccagtcccagggaatgc

SEQ ID NO: 7423106 - DNA, 22 bp, Homo sapiens
aatgccaatgggcagaactaga

SEQ ID NO: 7423107 - DNA, 22 bp, Homo sapiens
aatgccaatgggcagaactaga

SEQ ID NO: 7423108 - DNA, 22 bp, Homo sapiens
aatgccaatgggcagaactaga

SEQ ID NO: 7423109 - DNA, 22 bp, Homo sapiens
aatgcctggcgattagtgtagc

SEQ ID NO: 7423110 - DNA, 22 bp, Homo sapiens
aatgccttcaagtatctgagga

SEQ ID NO: 7423111 - DNA, 22 bp, Homo sapiens
aatgccttataggctgaaaatt

SEQ ID NO: 7423112 - DNA, 22 bp, Homo sapiens
aatgccttcccatttatacttt

SEQ ID NO: 7423113 - DNA, 22 bp, Homo sapiens
aatgccattttaggcatgtcct

SEQ ID NO: 7423114 - DNA, 22 bp, Homo sapiens
aatgccattgatttatatactt

SEQ ID NO: 7423115 - DNA, 22 bp, Homo sapiens
aatgccattccatcacacacct

SEQ ID NO: 7423116 - DNA, 22 bp, Homo sapiens
aatgccatctggtgatgtatta

SEQ ID NO: 7423117 - DNA, 22 bp, Homo sapiens
aatgcccccaggcctggaggag

SEQ ID NO: 7423118 - DNA, 22 bp, Homo sapiens
aatgcccccaggcctggaggag

SEQ ID NO: 7423119 - DNA, 19 bp, Homo sapiens
aatgcctcaaattgggaga

SEQ ID NO: 7423120 - DNA, 22 bp, Homo sapiens
aatgcattagctacatatgtct

SEQ ID NO: 7423121 - DNA, 22 bp, Homo sapiens
aatgcattagctacatatgtct

SEQ ID NO: 7423122 - DNA, 23 bp, Homo sapiens
aatgcattaatttgggagagtac

SEQ ID NO: 7423123 - DNA, 22 bp, Homo sapiens
aatgcattagctacatatgtct

SEQ ID NO: 7423124 - DNA, 21 bp, Homo sapiens
aatgcattaacataaagctga

SEQ ID NO: 7423125 - DNA, 21 bp, Homo sapiens
aatgcattaacataaagctga

SEQ ID NO: 7423126 - DNA, 21 bp, Homo sapiens
aatgcattaacataaagctga

SEQ ID NO: 7423127 - DNA, 21 bp, Homo sapiens
aatgcattaacataaagctga

SEQ ID NO: 7423128 - DNA, 22 bp, Homo sapiens
aatgcatgtttcctctcagcag

SEQ ID NO: 7423129 - DNA, 21 bp, Homo sapiens
aatgcattaacataaagctga

SEQ ID NO: 7423130 - DNA, 21 bp, Homo sapiens
aatgcattaacataaagctga

SEQ ID NO: 7423131 - DNA, 22 bp, Homo sapiens
aatgcattctcggtttgtgtgt

SEQ ID NO: 7423132 - DNA, 22 bp, Homo sapiens
aatgcattctcggtttgtgtgt

SEQ ID NO: 7423133 - DNA, 22 bp, Homo sapiens
aatgcattccactgagatttgt

SEQ ID NO: 7423134 - DNA, 22 bp, Homo sapiens
aatgcattagctacatatgtct

SEQ ID NO: 7423135 - DNA, 22 bp, Homo sapiens
aatgcattccactgagatttgt

SEQ ID NO: 7423136 - DNA, 22 bp, Homo sapiens
aatgcattccactgagatttgt

SEQ ID NO: 7423137 - DNA, 22 bp, Homo sapiens
aatgcattgattgctggaaata

SEQ ID NO: 7423138 - DNA, 22 bp, Homo sapiens
aatgcatgtttcctctcagcag

SEQ ID NO: 7423139 - DNA, 22 bp, Homo sapiens
aatgcattaaagttagagactt

SEQ ID NO: 7423140 - DNA, 22 bp, Homo sapiens
aatgcatgtttcctctcagcag

SEQ ID NO: 7423141 - DNA, 22 bp, Homo sapiens
aatgcattaaagttagagactt

SEQ ID NO: 7423142 - DNA, 22 bp, Homo sapiens
aatgcattaaagttagagactt

SEQ ID NO: 7423143 - DNA, 22 bp, Homo sapiens
aatgcatcagaaatgtgtataa

SEQ ID NO: 7423144 - DNA, 22 bp, Homo sapiens
aatgcatgtattcattgtggaa

SEQ ID NO: 7423145 - DNA, 22 bp, Homo sapiens
aatgcatatgtaggcaagcagt

SEQ ID NO: 7423146 - DNA, 19 bp, Homo sapiens
aatgcatggaagttggaga

SEQ ID NO: 7423147 - DNA, 19 bp, Homo sapiens
aatgcatggaagttggaga

SEQ ID NO: 7423148 - DNA, 22 bp, Homo sapiens
aatgcatccctgccaatgcttt

SEQ ID NO: 7423149 - DNA, 22 bp, Homo sapiens
aatgcataccatgtcatctttg

SEQ ID NO: 7423150 - DNA, 22 bp, Homo sapiens
aatgcataccatgtcatctttg

SEQ ID NO: 7423151 - DNA, 22 bp, Homo sapiens
aatgcataccatgtcatctttg

SEQ ID NO: 7423152 - DNA, 22 bp, Homo sapiens
aatgcatacgtgtttgtggcaa

SEQ ID NO: 7423153 - DNA, 22 bp, Homo sapiens
aatgcatacgtgtttgtggcaa

SEQ ID NO: 7423154 - DNA, 22 bp, Homo sapiens
aatgcatacgtgtttgtggcaa

SEQ ID NO: 7423155 - DNA, 22 bp, Homo sapiens
aatgcatacgtgtttgtggcaa

SEQ ID NO: 7423156 - DNA, 22 bp, Homo sapiens
aatgcacaaaaattgtatgtaa

SEQ ID NO: 7423157 - DNA, 22 bp, Homo sapiens
aatgcacaaaggtgtctattgc

SEQ ID NO: 7423158 - DNA, 22 bp, Homo sapiens
aatgcacaaaggtgtctattgc

SEQ ID NO: 7423159 - DNA, 22 bp, Homo sapiens
aatgcacaaaggtgtctattgc

SEQ ID NO: 7423160 - DNA, 22 bp, Homo sapiens
actttgttgatgaaatagtttt

SEQ ID NO: 7423161 - DNA, 22 bp, Homo sapiens
actttgttgatgaaatagtttt

SEQ ID NO: 7423162 - DNA, 22 bp, Homo sapiens
actttgttgatgaaatagtttt

SEQ ID NO: 7423163 - DNA, 22 bp, Homo sapiens
actttgttgatgaaatagtttt

SEQ ID NO: 7423164 - DNA, 22 bp, Homo sapiens
actttgttgatgaaatagtttt

SEQ ID NO: 7423165 - DNA, 22 bp, Homo sapiens
actttgttgaagaatatgttag

SEQ ID NO: 7423166 - DNA, 22 bp, Homo sapiens
actttgttgaagaatatgttag

SEQ ID NO: 7423167 - DNA, 22 bp, Homo sapiens
actttgttgaagaatatgttag

SEQ ID NO: 7423168 - DNA, 22 bp, Homo sapiens
actttgatagtttaatctagga

SEQ ID NO: 7423169 - DNA, 22 bp, Homo sapiens
actttgatcctttgaatatttg

SEQ ID NO: 7423170 - DNA, 22 bp, Homo sapiens
actttgacagcattttaattat

SEQ ID NO: 7423171 - DNA, 22 bp, Homo sapiens
actttgaaggggaacattttaa

SEQ ID NO: 7423172 - DNA, 22 bp, Homo sapiens
actttgcaaaaggaaatcacct

SEQ ID NO: 7423173 - DNA, 22 bp, Homo sapiens
actttgcaaaataatgctgatt

SEQ ID NO: 7423174 - DNA, 22 bp, Homo sapiens
actttgcaaaataatgctgatt

SEQ ID NO: 7423175 - DNA, 22 bp, Homo sapiens
actttgttctaatagtatctct

SEQ ID NO: 7423176 - DNA, 22 bp, Homo sapiens
acttttaaatgagtttcagttg

SEQ ID NO: 7423177 - DNA, 22 bp, Homo sapiens
acttttaaatgagtttcagttg

SEQ ID NO: 7423178 - DNA, 22 bp, Homo sapiens
acttttaaatgagtttcagttg

SEQ ID NO: 7423179 - DNA, 22 bp, Homo sapiens
acttttaaatgagtttcagttg

SEQ ID NO: 7423180 - DNA, 22 bp, Homo sapiens
acttttaaatgagtttcagttg

SEQ ID NO: 7423181 - DNA, 22 bp, Homo sapiens
acttttaaatgagtttcagttg

SEQ ID NO: 7423182 - DNA, 22 bp, Homo sapiens
acttttaaatgagtttcagttg

SEQ ID NO: 7423183 - DNA, 22 bp, Homo sapiens
acttttaaatgagtttcagttg

SEQ ID NO: 7423184 - DNA, 22 bp, Homo sapiens
acttttaaatgagtttcagttg

SEQ ID NO: 7423185 - DNA, 22 bp, Homo sapiens
actttgtttccatatttgtagc

SEQ ID NO: 7423186 - DNA, 22 bp, Homo sapiens
actttgttgttccttgtctaaa

SEQ ID NO: 7423187 - DNA, 22 bp, Homo sapiens
actttgtttggctattagagtc

SEQ ID NO: 7423188 - DNA, 22 bp, Homo sapiens
actttgtttggctattagagtc

SEQ ID NO: 7423189 - DNA, 22 bp, Homo sapiens
actttgttttcatgaaacagct

SEQ ID NO: 7423190 - DNA, 22 bp, Homo sapiens
actttgttttcatgaaacagct

SEQ ID NO: 7423191 - DNA, 22 bp, Homo sapiens
actttgttttatagcacataag

SEQ ID NO: 7423192 - DNA, 22 bp, Homo sapiens
actttgttttatagcacataag

SEQ ID NO: 7423193 - DNA, 22 bp, Homo sapiens
aatcaagagttgtgtaatattt

SEQ ID NO: 7423194 - DNA, 22 bp, Homo sapiens
aatcaagagttgtgtaatattt

SEQ ID NO: 7423195 - DNA, 22 bp, Homo sapiens
aatcaagtcaaccatcatgtgc

SEQ ID NO: 7423196 - DNA, 22 bp, Homo sapiens
aatcaagtattttccagtggca

SEQ ID NO: 7423197 - DNA, 22 bp, Homo sapiens
aatcaagtcaaccatcatgtgc

SEQ ID NO: 7423198 - DNA, 22 bp, Homo sapiens
aatcacaaacgaattgatggaa

SEQ ID NO: 7423199 - DNA, 22 bp, Homo sapiens
aatcacaaacgaattgatggaa

SEQ ID NO: 7423200 - DNA, 22 bp, Homo sapiens
aatcaatgttagtcatgaattt

SEQ ID NO: 7423201 - DNA, 22 bp, Homo sapiens
aatcaagagttgtgtaatattt

SEQ ID NO: 7423202 - DNA, 22 bp, Homo sapiens
aatcaagagttgtgtaatattt

SEQ ID NO: 7423203 - DNA, 22 bp, Homo sapiens
aatcaagagttgtgtaatattt

SEQ ID NO: 7423204 - DNA, 22 bp, Homo sapiens
acttttatgataatcaatgttc

SEQ ID NO: 7423205 - DNA, 22 bp, Homo sapiens
acttttcaaatgggaaactcag

SEQ ID NO: 7423206 - DNA, 22 bp, Homo sapiens
acttttaaggggccttgattta

SEQ ID NO: 7423207 - DNA, 22 bp, Homo sapiens
acttttatcaaggaagtgatct

SEQ ID NO: 7423208 - DNA, 22 bp, Homo sapiens
acttttatcaaggaagtgatct

SEQ ID NO: 7423209 - DNA, 22 bp, Homo sapiens
acttttatcaaggaagtgatct

SEQ ID NO: 7423210 - DNA, 22 bp, Homo sapiens
acttttatcaaggaagtgatct

SEQ ID NO: 7423211 - DNA, 22 bp, Homo sapiens
acttttatcaaggaagtgatct

SEQ ID NO: 7423212 - DNA, 22 bp, Homo sapiens
acttttaaggggccttgattta

SEQ ID NO: 7423213 - DNA, 22 bp, Homo sapiens
acttttaaggggccttgattta

SEQ ID NO: 7423214 - DNA, 22 bp, Homo sapiens
acttttaaggggccttgattta

SEQ ID NO: 7423215 - DNA, 22 bp, Homo sapiens
acttttaaggggccttgattta

SEQ ID NO: 7423216 - DNA, 22 bp, Homo sapiens
acttttatgataatcaatgttc

SEQ ID NO: 7423217 - DNA, 22 bp, Homo sapiens
acttttatgataatcaatgttc

SEQ ID NO: 7423218 - DNA, 22 bp, Homo sapiens
acttttatgataatcaatgttc

SEQ ID NO: 7423219 - DNA, 22 bp, Homo sapiens
acttttatgataatcaatgttc

SEQ ID NO: 7423220 - DNA, 22 bp, Homo sapiens
acttttatgataatcaatgttc

SEQ ID NO: 7423221 - DNA, 22 bp, Homo sapiens
acttttatcaaggaagtgatct

SEQ ID NO: 7423222 - DNA, 22 bp, Homo sapiens
acttttatcaaggaagtgatct

SEQ ID NO: 7423223 - DNA, 22 bp, Homo sapiens
acttttatgataatcaatgttc

SEQ ID NO: 7423224 - DNA, 22 bp, Homo sapiens
acttttatgataatcaatgttc

SEQ ID NO: 7423225 - DNA, 22 bp, Homo sapiens
aatagctttggtcaccatctgg

SEQ ID NO: 7423226 - DNA, 22 bp, Homo sapiens
aatagctttggtcaccatctgg

SEQ ID NO: 7423227 - DNA, 22 bp, Homo sapiens
aatagcttggacccattgcttt

SEQ ID NO: 7423228 - DNA, 22 bp, Homo sapiens
aatagctttctcatgacttcac

SEQ ID NO: 7423229 - DNA, 22 bp, Homo sapiens
aatagcttggacccattgcttt

SEQ ID NO: 7423230 - DNA, 22 bp, Homo sapiens
aatagcttgcctaatcctcatg

SEQ ID NO: 7423231 - DNA, 22 bp, Homo sapiens
aatagcttattgacagtgaatt

SEQ ID NO: 7423232 - DNA, 22 bp, Homo sapiens
aataggaaaatatttaacaaga

SEQ ID NO: 7423233 - DNA, 22 bp, Homo sapiens
aataggaaaatatttaacaaga

SEQ ID NO: 7423234 - DNA, 22 bp, Homo sapiens
aataggaagcaccaaattctcc

SEQ ID NO: 7423235 - DNA, 22 bp, Homo sapiens
aataggaaaatatttaacaaga

SEQ ID NO: 7423236 - DNA, 22 bp, Homo sapiens
aataggaaaatatttaacaaga

SEQ ID NO: 7423237 - DNA, 22 bp, Homo sapiens
aatagcttttgtatgatgaaat

SEQ ID NO: 7423238 - DNA, 22 bp, Homo sapiens
aataggaaaatatttaacaaga

SEQ ID NO: 7423239 - DNA, 22 bp, Homo sapiens
aataggaaaatatttaacaaga

SEQ ID NO: 7423240 - DNA, 22 bp, Homo sapiens
aataggaaaatatttaacaaga

SEQ ID NO: 7423241 - DNA, 22 bp, Homo sapiens
aatagcttttgtatgatgaaat

SEQ ID NO: 7423242 - DNA, 22 bp, Homo sapiens
aataggcagttggatatgcaag

SEQ ID NO: 7423243 - DNA, 22 bp, Homo sapiens
aataggcattacatttcctgca

SEQ ID NO: 7423244 - DNA, 22 bp, Homo sapiens
aataggcagttggatatgcaag

SEQ ID NO: 7423245 - DNA, 22 bp, Homo sapiens
aataggcagttggatatgcaag

SEQ ID NO: 7423246 - DNA, 22 bp, Homo sapiens
aataggctgagccatttcaagt

SEQ ID NO: 7423247 - DNA, 22 bp, Homo sapiens
aataggtagccagatatataaa

SEQ ID NO: 7423248 - DNA, 22 bp, Homo sapiens
aataggaagtcacatcaaggga

SEQ ID NO: 7423249 - DNA, 22 bp, Homo sapiens
aataggaagcaccaaattctcc

SEQ ID NO: 7423250 - DNA, 22 bp, Homo sapiens
aataggaagcaccaaattctcc

SEQ ID NO: 7423251 - DNA, 22 bp, Homo sapiens
aatagtaaaagatacagctaat

SEQ ID NO: 7423252 - DNA, 22 bp, Homo sapiens
aatagtacaatctacagacata

SEQ ID NO: 7423253 - DNA, 22 bp, Homo sapiens
aatagtacaatctacagacata

SEQ ID NO: 7423254 - DNA, 22 bp, Homo sapiens
actttgaaggggaacattttaa

SEQ ID NO: 7423255 - DNA, 22 bp, Homo sapiens
aataggtagccagatatataaa

SEQ ID NO: 7423256 - DNA, 22 bp, Homo sapiens
aataggtttaggaaagcgtttt

SEQ ID NO: 7423257 - DNA, 22 bp, Homo sapiens
aatagtaaaagatacagctaat

SEQ ID NO: 7423258 - DNA, 22 bp, Homo sapiens
aatagtaaaagatacagctaat

SEQ ID NO: 7423259 - DNA, 22 bp, Homo sapiens
aatagtaaaagatacagctaat

SEQ ID NO: 7423260 - DNA, 22 bp, Homo sapiens
aatagctgattaatgtactacc

SEQ ID NO: 7423261 - DNA, 22 bp, Homo sapiens
aatagctgattaatgtactacc

SEQ ID NO: 7423262 - DNA, 21 bp, Homo sapiens
aatagctgaggtcacccagcc

SEQ ID NO: 7423263 - DNA, 22 bp, Homo sapiens
aatagctcactgatttctcttt

SEQ ID NO: 7423264 - DNA, 20 bp, Homo sapiens
aatagctgagggcaagagta

SEQ ID NO: 7423265 - DNA, 20 bp, Homo sapiens
aatagctgagggcaagagta

SEQ ID NO: 7423266 - DNA, 22 bp, Homo sapiens
aatagctgattagcctacaata

SEQ ID NO: 7423267 - DNA, 17 bp, Homo sapiens
aatagctgctcagagag

SEQ ID NO: 7423268 - DNA, 22 bp, Homo sapiens
aatagctgggacctgaattagc

SEQ ID NO: 7423269 - DNA, 22 bp, Homo sapiens
aatagcttagtcctgattctgt

SEQ ID NO: 7423270 - DNA, 22 bp, Homo sapiens
aatagcttagtcctgattctgt

SEQ ID NO: 7423271 - DNA, 22 bp, Homo sapiens
aatagcttagtcctgattctgt

SEQ ID NO: 7423272 - DNA, 22 bp, Homo sapiens
aatagcttagtcctgattctgt

SEQ ID NO: 7423273 - DNA, 22 bp, Homo sapiens
aatagcttatgggatagatgtt

SEQ ID NO: 7423274 - DNA, 22 bp, Homo sapiens
aatagctgggaggcacattcat

SEQ ID NO: 7423275 - DNA, 17 bp, Homo sapiens
aatagctgctcagagag

SEQ ID NO: 7423276 - DNA, 22 bp, Homo sapiens
aatagctgggaggcacattcat

SEQ ID NO: 7423277 - DNA, 23 bp, Homo sapiens
aatagctggtaatgatagcacaa

SEQ ID NO: 7423278 - DNA, 23 bp, Homo sapiens
aatagctggtaatgatagcacaa

SEQ ID NO: 7423279 - DNA, 22 bp, Homo sapiens
aatagccaaagtgcatttatga

SEQ ID NO: 7423280 - DNA, 22 bp, Homo sapiens
aatagctcacggttagtgtagg

SEQ ID NO: 7423281 - DNA, 22 bp, Homo sapiens
aatagcatgttcatgataaaat

SEQ ID NO: 7423282 - DNA, 22 bp, Homo sapiens
aatagcatttttaagggaatca

SEQ ID NO: 7423283 - DNA, 22 bp, Homo sapiens
aatagcatgttcatgataaaat

SEQ ID NO: 7423284 - DNA, 22 bp, Homo sapiens
aatagcatgttcatgataaaat

SEQ ID NO: 7423285 - DNA, 22 bp, Homo sapiens
aatagcatgttcatgataaaat

SEQ ID NO: 7423286 - DNA, 22 bp, Homo sapiens
aatagcatgttcatgataaaat

SEQ ID NO: 7423287 - DNA, 22 bp, Homo sapiens
aatagcatgttcatgataaaat

SEQ ID NO: 7423288 - DNA, 22 bp, Homo sapiens
aatagcatgtaagtttaaaaga

SEQ ID NO: 7423289 - DNA, 22 bp, Homo sapiens
aatagcatgtaagtttaaaaga

SEQ ID NO: 7423290 - DNA, 22 bp, Homo sapiens
aatagcatgtaagtttaaaaga

SEQ ID NO: 7423291 - DNA, 22 bp, Homo sapiens
aatagcatgttcatgataaaat

SEQ ID NO: 7423292 - DNA, 22 bp, Homo sapiens
aatagcatgtaagtttaaaaga

SEQ ID NO: 7423293 - DNA, 22 bp, Homo sapiens
aatagcatgtaagtttaaaaga

SEQ ID NO: 7423294 - DNA, 22 bp, Homo sapiens
agaaaggattagtttggtataa

SEQ ID NO: 7423295 - DNA, 22 bp, Homo sapiens
agaaaggattagtttggtataa

SEQ ID NO: 7423296 - DNA, 22 bp, Homo sapiens
agaaaggattagtttggtataa

SEQ ID NO: 7423297 - DNA, 22 bp, Homo sapiens
agaaaggcaatattaactacac

SEQ ID NO: 7423298 - DNA, 22 bp, Homo sapiens
agaaaggcaatattaactacac

SEQ ID NO: 7423299 - DNA, 22 bp, Homo sapiens
agaaaggcagggatgaggattg

SEQ ID NO: 7423300 - DNA, 22 bp, Homo sapiens
agaaaggcagggatgaggattg

SEQ ID NO: 7423301 - DNA, 22 bp, Homo sapiens
agaaaggcaatattaactacac

SEQ ID NO: 7423302 - DNA, 22 bp, Homo sapiens
agaaaggaggaagaatgacctc

SEQ ID NO: 7423303 - DNA, 22 bp, Homo sapiens
agaaaggaggaagaatgacctc

SEQ ID NO: 7423304 - DNA, 22 bp, Homo sapiens
agaaaggaggaagaatgacctc

SEQ ID NO: 7423305 - DNA, 22 bp, Homo sapiens
agaaaggaggaagaatgacctc

SEQ ID NO: 7423306 - DNA, 22 bp, Homo sapiens
agaaaggaggaagaatgacctc

SEQ ID NO: 7423307 - DNA, 22 bp, Homo sapiens
agaaaggaggaagaatgacctc

SEQ ID NO: 7423308 - DNA, 22 bp, Homo sapiens
agaaaggaggaagaatgacctc

SEQ ID NO: 7423309 - DNA, 22 bp, Homo sapiens
agaaaggagcaccgtgggggat

SEQ ID NO: 7423310 - DNA, 22 bp, Homo sapiens
agaaaggagcaccgtgggggat

SEQ ID NO: 7423311 - DNA, 22 bp, Homo sapiens
agaaaggagcaccgtgggggat

SEQ ID NO: 7423312 - DNA, 22 bp, Homo sapiens
agaaaggagcaccgtgggggat

SEQ ID NO: 7423313 - DNA, 22 bp, Homo sapiens
agaaaggagaccagctctgccc

SEQ ID NO: 7423314 - DNA, 22 bp, Homo sapiens
agaaaggagaccagctctgccc

SEQ ID NO: 7423315 - DNA, 22 bp, Homo sapiens
agaaaggagaccagctctgccc

SEQ ID NO: 7423316 - DNA, 22 bp, Homo sapiens
agaaaggagaccagctctgccc

SEQ ID NO: 7423317 - DNA, 22 bp, Homo sapiens
agaaaggacatctccctttaag

SEQ ID NO: 7423318 - DNA, 22 bp, Homo sapiens
agaaaggacatctccctttaag

SEQ ID NO: 7423319 - DNA, 22 bp, Homo sapiens
agaaaggagaccagctctgccc

SEQ ID NO: 7423320 - DNA, 22 bp, Homo sapiens
agaaaggagaccagctctgccc

SEQ ID NO: 7423321 - DNA, 22 bp, Homo sapiens
agaaaggagaccagctctgccc

SEQ ID NO: 7423322 - DNA, 22 bp, Homo sapiens
agaaaggacatctccctttaag

SEQ ID NO: 7423323 - DNA, 22 bp, Homo sapiens
agaaaggacatctccctttaag

SEQ ID NO: 7423324 - DNA, 22 bp, Homo sapiens
agaaaggacatctccctttaag

SEQ ID NO: 7423325 - DNA, 22 bp, Homo sapiens
agaaactgacaggaaatgaatt

SEQ ID NO: 7423326 - DNA, 22 bp, Homo sapiens
agaaactgacaggaaatgaatt

SEQ ID NO: 7423327 - DNA, 22 bp, Homo sapiens
agaaactgaattatttctgagg

SEQ ID NO: 7423328 - DNA, 22 bp, Homo sapiens
agaaactgacaggaaatgaatt

SEQ ID NO: 7423329 - DNA, 22 bp, Homo sapiens
agaaactgacaggaaatgaatt

SEQ ID NO: 7423330 - DNA, 22 bp, Homo sapiens
agaaagctggagtcaagcagag

SEQ ID NO: 7423331 - DNA, 22 bp, Homo sapiens
agaaactgaattatttctgagg

SEQ ID NO: 7423332 - DNA, 22 bp, Homo sapiens
agaaactgaattatttctgagg

SEQ ID NO: 7423333 - DNA, 22 bp, Homo sapiens
agaaactgaattatttctgagg

SEQ ID NO: 7423334 - DNA, 22 bp, Homo sapiens
agaaactgaattatttctgagg

SEQ ID NO: 7423335 - DNA, 22 bp, Homo sapiens
aatcacatctcattcaacagcc

SEQ ID NO: 7423336 - DNA, 22 bp, Homo sapiens
aatcacatctcattcaacagcc

SEQ ID NO: 7423337 - DNA, 22 bp, Homo sapiens
aatcacatctcattcaacagcc

SEQ ID NO: 7423338 - DNA, 22 bp, Homo sapiens
aatcacatctcattcaacagcc

SEQ ID NO: 7423339 - DNA, 22 bp, Homo sapiens
agaaactgaacacaagagtcgg

SEQ ID NO: 7423340 - DNA, 22 bp, Homo sapiens
agaaagcttatgaatgggcaag

SEQ ID NO: 7423341 - DNA, 22 bp, Homo sapiens
agaaagcttatgaatgggcaag

SEQ ID NO: 7423342 - DNA, 22 bp, Homo sapiens
agaaagctggagtcaagcagag

SEQ ID NO: 7423343 - DNA, 22 bp, Homo sapiens
agaaaggaagggaggagtttat

SEQ ID NO: 7423344 - DNA, 22 bp, Homo sapiens
agaaaggaagggaggagtttat

SEQ ID NO: 7423345 - DNA, 22 bp, Homo sapiens
agaaaggaagggaggagtttat

SEQ ID NO: 7423346 - DNA, 22 bp, Homo sapiens
agaaaggaagggaggagtttat

SEQ ID NO: 7423347 - DNA, 22 bp, Homo sapiens
agaaagctggagtcaagcagag

SEQ ID NO: 7423348 - DNA, 22 bp, Homo sapiens
agaaagcttatgaatgggcaag

SEQ ID NO: 7423349 - DNA, 22 bp, Homo sapiens
agaaagcttatgaatgggcaag

SEQ ID NO: 7423350 - DNA, 22 bp, Homo sapiens
aatcacagttagtaagggagaa

SEQ ID NO: 7423351 - DNA, 22 bp, Homo sapiens
aatcacagtttcaagtaatgca

SEQ ID NO: 7423352 - DNA, 22 bp, Homo sapiens
aatcacagtttcaagtaatgca

SEQ ID NO: 7423353 - DNA, 22 bp, Homo sapiens
aatcacagttagtaagggagaa

SEQ ID NO: 7423354 - DNA, 22 bp, Homo sapiens
aatcacatcactgagaatgagg

SEQ ID NO: 7423355 - DNA, 22 bp, Homo sapiens
aatcacatagccatctctttga

SEQ ID NO: 7423356 - DNA, 22 bp, Homo sapiens
aatcacatagccatctctttga

SEQ ID NO: 7423357 - DNA, 22 bp, Homo sapiens
aatcacatcactgagaatgagg

SEQ ID NO: 7423358 - DNA, 22 bp, Homo sapiens
aatcacatcactgagaatgagg

SEQ ID NO: 7423359 - DNA, 22 bp, Homo sapiens
aatcacagccacaacctggggg

SEQ ID NO: 7423360 - DNA, 22 bp, Homo sapiens
aatcacaggcatagattgctcc

SEQ ID NO: 7423361 - DNA, 22 bp, Homo sapiens
aatcacagtgggtactagattg

SEQ ID NO: 7423362 - DNA, 22 bp, Homo sapiens
aatcacagtgggtactagattg

SEQ ID NO: 7423363 - DNA, 20 bp, Homo sapiens
aatcacagttaactctttct

SEQ ID NO: 7423364 - DNA, 20 bp, Homo sapiens
aatcacagttaactctttct

SEQ ID NO: 7423365 - DNA, 20 bp, Homo sapiens
aatcacagttaactctttct

SEQ ID NO: 7423366 - DNA, 22 bp, Homo sapiens
aatcacagccacaacctggggg

SEQ ID NO: 7423367 - DNA, 22 bp, Homo sapiens
aatcacagagtccagcagatga

SEQ ID NO: 7423368 - DNA, 22 bp, Homo sapiens
aatcacagagtccagcagatga

SEQ ID NO: 7423369 - DNA, 22 bp, Homo sapiens
aatcacagagtccagcagatga

SEQ ID NO: 7423370 - DNA, 22 bp, Homo sapiens
aatcacagagtccagcagatga

SEQ ID NO: 7423371 - DNA, 22 bp, Homo sapiens
aatcacagagtccagcagatga

SEQ ID NO: 7423372 - DNA, 22 bp, Homo sapiens
aatcacacaaaggcaacttttg

SEQ ID NO: 7423373 - DNA, 22 bp, Homo sapiens
aatcacaattacttttgcacca

SEQ ID NO: 7423374 - DNA, 22 bp, Homo sapiens
aatcacaattacttttgcacca

SEQ ID NO: 7423375 - DNA, 22 bp, Homo sapiens
aatcacaattacttttgcacca

SEQ ID NO: 7423376 - DNA, 22 bp, Homo sapiens
aatcacaattacttttgcacca

SEQ ID NO: 7423377 - DNA, 22 bp, Homo sapiens
aatcacaaatgcaagttgtcac

SEQ ID NO: 7423378 - DNA, 22 bp, Homo sapiens
aatcacaaatgcaagttgtcac

SEQ ID NO: 7423379 - DNA, 22 bp, Homo sapiens
aatcacaaatgcaagttgtcac

SEQ ID NO: 7423380 - DNA, 22 bp, Homo sapiens
aatcacaaatgcaagttgtcac

SEQ ID NO: 7423381 - DNA, 22 bp, Homo sapiens
aatcacaaatgcaagttgtcac

SEQ ID NO: 7423382 - DNA, 22 bp, Homo sapiens
aatcacaaatgcaagttgtcac

SEQ ID NO: 7423383 - DNA, 22 bp, Homo sapiens
aatcacaaatttagacagagct

SEQ ID NO: 7423384 - DNA, 22 bp, Homo sapiens
aatcacaaatttagacagagct

SEQ ID NO: 7423385 - DNA, 22 bp, Homo sapiens
aatcacaattacttttgcacca

SEQ ID NO: 7423386 - DNA, 22 bp, Homo sapiens
aatcacaattacttttgcacca

SEQ ID NO: 7423387 - DNA, 22 bp, Homo sapiens
aatcacaattacttttgcacca

SEQ ID NO: 7423388 - DNA, 22 bp, Homo sapiens
aatcacaaatttagacagagct

SEQ ID NO: 7423389 - DNA, 22 bp, Homo sapiens
aatcacaaatttagacagagct

SEQ ID NO: 7423390 - DNA, 22 bp, Homo sapiens
aatcggttgaacccaggaagtg

SEQ ID NO: 7423391 - DNA, 22 bp, Homo sapiens
aatcggttgaacccaggaagtg

SEQ ID NO: 7423392 - DNA, 22 bp, Homo sapiens
aatcgcttggtaattttaaaag

SEQ ID NO: 7423393 - DNA, 22 bp, Homo sapiens
aatcgcaattacttttgcacca

SEQ ID NO: 7423394 - DNA, 22 bp, Homo sapiens
aatcgcttggtaattttaaaag

SEQ ID NO: 7423395 - DNA, 22 bp, Homo sapiens
agaaagggatgaggtagctgct

SEQ ID NO: 7423396 - DNA, 22 bp, Homo sapiens
agaaagggatgaggtagctgct

SEQ ID NO: 7423397 - DNA, 22 bp, Homo sapiens
agaaagggatgaggtagctgct

SEQ ID NO: 7423398 - DNA, 22 bp, Homo sapiens
agaaagggatgaggtagctgct

SEQ ID NO: 7423399 - DNA, 22 bp, Homo sapiens
agaaagggatgaggtagctgct

SEQ ID NO: 7423400 - DNA, 22 bp, Homo sapiens
agaaagggatgaggtagctgct

SEQ ID NO: 7423401 - DNA, 22 bp, Homo sapiens
aatcctggctgcgttggccagc

SEQ ID NO: 7423402 - DNA, 22 bp, Homo sapiens
aatcctggcctagctgggctca

SEQ ID NO: 7423403 - DNA, 20 bp, Homo sapiens
aatcctgggacagaggcagg

SEQ ID NO: 7423404 - DNA, 20 bp, Homo sapiens
aatcctgggacagaggcagg

SEQ ID NO: 7423405 - DNA, 22 bp, Homo sapiens
agaaagggaactggcaaagcca

SEQ ID NO: 7423406 - DNA, 22 bp, Homo sapiens
agaaagggaactggcaaagcca

SEQ ID NO: 7423407 - DNA, 22 bp, Homo sapiens
agaaagggaactggcaaagcca

SEQ ID NO: 7423408 - DNA, 22 bp, Homo sapiens
agaaagggaactggcaaagcca

SEQ ID NO: 7423409 - DNA, 17 bp, Homo sapiens
agaaaggcagttcctct

SEQ ID NO: 7423410 - DNA, 17 bp, Homo sapiens
agaaaggcagttcctct

SEQ ID NO: 7423411 - DNA, 22 bp, Homo sapiens
agaaaggcagggatgaggattg

SEQ ID NO: 7423412 - DNA, 22 bp, Homo sapiens
agaaaggattagtttggtataa

SEQ ID NO: 7423413 - DNA, 22 bp, Homo sapiens
agaaagggagagccagcacacg

SEQ ID NO: 7423414 - DNA, 22 bp, Homo sapiens
agaaagggagcgtggatcaatt

SEQ ID NO: 7423415 - DNA, 22 bp, Homo sapiens
agaaagggagagccagcacacg

SEQ ID NO: 7423416 - DNA, 22 bp, Homo sapiens
agaaagggatgaggtagctgct

SEQ ID NO: 7423417 - DNA, 22 bp, Homo sapiens
aatctagtttcagactttgagt

SEQ ID NO: 7423418 - DNA, 23 bp, Homo sapiens
aatctatacttaggctggtaata

SEQ ID NO: 7423419 - DNA, 22 bp, Homo sapiens
aatctagattcggatcaaaggg

SEQ ID NO: 7423420 - DNA, 22 bp, Homo sapiens
aatctagattcggatcaaaggg

SEQ ID NO: 7423421 - DNA, 22 bp, Homo sapiens
aatctagagttcccagcataaa

SEQ ID NO: 7423422 - DNA, 22 bp, Homo sapiens
aatctagagttcccagcataaa

SEQ ID NO: 7423423 - DNA, 22 bp, Homo sapiens
aatctagagttcccagcataaa

SEQ ID NO: 7423424 - DNA, 22 bp, Homo sapiens
aatctagagttcccagcataaa

SEQ ID NO: 7423425 - DNA, 22 bp, Homo sapiens
aatctagagtgctaggtctgtg

SEQ ID NO: 7423426 - DNA, 22 bp, Homo sapiens
aatctagagtgctaggtctgtg

SEQ ID NO: 7423427 - DNA, 22 bp, Homo sapiens
aatctagagacaatttgaatat

SEQ ID NO: 7423428 - DNA, 22 bp, Homo sapiens
aatctagagacaatttgaatat

SEQ ID NO: 7423429 - DNA, 22 bp, Homo sapiens
aatctagagtgctaggtctgtg

SEQ ID NO: 7423430 - DNA, 22 bp, Homo sapiens
aatctagagaactgtggggcag

SEQ ID NO: 7423431 - DNA, 22 bp, Homo sapiens
aatctagaattttaggggtata

SEQ ID NO: 7423432 - DNA, 23 bp, Homo sapiens
aatctagaatgacctactcatct

SEQ ID NO: 7423433 - DNA, 23 bp, Homo sapiens
aatctagaatgacctactcatct

SEQ ID NO: 7423434 - DNA, 23 bp, Homo sapiens
aatctagaatgacctactcatct

SEQ ID NO: 7423435 - DNA, 22 bp, Homo sapiens
aatctacatttcagttttgccc

SEQ ID NO: 7423436 - DNA, 22 bp, Homo sapiens
aatctacatttcagttttgccc

SEQ ID NO: 7423437 - DNA, 19 bp, Homo sapiens
aatctagaaatatgtgttc

SEQ ID NO: 7423438 - DNA, 22 bp, Homo sapiens
aatctacatgcaatatttttag

SEQ ID NO: 7423439 - DNA, 22 bp, Homo sapiens
aatctacatgcaatatttttag

SEQ ID NO: 7423440 - DNA, 22 bp, Homo sapiens
aatctacatgcaatatttttag

SEQ ID NO: 7423441 - DNA, 22 bp, Homo sapiens
aatctacatgcaatatttttag

SEQ ID NO: 7423442 - DNA, 22 bp, Homo sapiens
aatctacatgcaatatttttag

SEQ ID NO: 7423443 - DNA, 22 bp, Homo sapiens
aatctacatgcaatatttttag

SEQ ID NO: 7423444 - DNA, 22 bp, Homo sapiens
aatctacatgcaatatttttag

SEQ ID NO: 7423445 - DNA, 22 bp, Homo sapiens
aatctacatagagatcaaatga

SEQ ID NO: 7423446 - DNA, 22 bp, Homo sapiens
aatctacatagagatcaaatga

SEQ ID NO: 7423447 - DNA, 22 bp, Homo sapiens
aatctacatagagatcaaatga

SEQ ID NO: 7423448 - DNA, 22 bp, Homo sapiens
aatctacatagagatcaaatga

SEQ ID NO: 7423449 - DNA, 22 bp, Homo sapiens
aatctaagccaccagtagtttc

SEQ ID NO: 7423450 - DNA, 22 bp, Homo sapiens
aatctaagccaccagtagtttc

SEQ ID NO: 7423451 - DNA, 22 bp, Homo sapiens
aatctaagccaccagtagtttc

SEQ ID NO: 7423452 - DNA, 22 bp, Homo sapiens
aatctaagccaccagtagtttc

SEQ ID NO: 7423453 - DNA, 22 bp, Homo sapiens
aatctaaggacttagcattgct

SEQ ID NO: 7423454 - DNA, 22 bp, Homo sapiens
accagaggcagtttcggctggt

SEQ ID NO: 7423455 - DNA, 22 bp, Homo sapiens
accagaggcagtttcggctggt

SEQ ID NO: 7423456 - DNA, 22 bp, Homo sapiens
accagaggctctgccacctcca

SEQ ID NO: 7423457 - DNA, 22 bp, Homo sapiens
accagaggctctgccacctcca

SEQ ID NO: 7423458 - DNA, 22 bp, Homo sapiens
accagaggctctgccacctcca

SEQ ID NO: 7423459 - DNA, 22 bp, Homo sapiens
accagaggctctgccacctcca

SEQ ID NO: 7423460 - DNA, 22 bp, Homo sapiens
accagaggctctgccacctcca

SEQ ID NO: 7423461 - DNA, 22 bp, Homo sapiens
accagaggaggaattaccttcc

SEQ ID NO: 7423462 - DNA, 22 bp, Homo sapiens
accagaggaggaattaccttcc

SEQ ID NO: 7423463 - DNA, 22 bp, Homo sapiens
accagaggaggaattaccttcc

SEQ ID NO: 7423464 - DNA, 22 bp, Homo sapiens
accagaggcagtttcggctggt

SEQ ID NO: 7423465 - DNA, 22 bp, Homo sapiens
accagaggcagtttcggctggt

SEQ ID NO: 7423466 - DNA, 22 bp, Homo sapiens
accagaggcagtttcggctggt

SEQ ID NO: 7423467 - DNA, 22 bp, Homo sapiens
accagaggaggaattaccttcc

SEQ ID NO: 7423468 - DNA, 22 bp, Homo sapiens
accagaggaggaattaccttcc

SEQ ID NO: 7423469 - DNA, 22 bp, Homo sapiens
accagagggagacttcctcttc

SEQ ID NO: 7423470 - DNA, 22 bp, Homo sapiens
accagagggagacttcctcttc

SEQ ID NO: 7423471 - DNA, 22 bp, Homo sapiens
accagagggagacttcctcttc

SEQ ID NO: 7423472 - DNA, 22 bp, Homo sapiens
accagagggagacttcctcttc

SEQ ID NO: 7423473 - DNA, 22 bp, Homo sapiens
accagagggcaaaccccagtgt

SEQ ID NO: 7423474 - DNA, 22 bp, Homo sapiens
accagagggcaaaccccagtgt

SEQ ID NO: 7423475 - DNA, 22 bp, Homo sapiens
accagagggagacttcctcttc

SEQ ID NO: 7423476 - DNA, 22 bp, Homo sapiens
accagagggcaaaccccagtgt

SEQ ID NO: 7423477 - DNA, 22 bp, Homo sapiens
accagagggcaaaccccagtgt

SEQ ID NO: 7423478 - DNA, 22 bp, Homo sapiens
accagagggcaaaccccagtgt

SEQ ID NO: 7423479 - DNA, 22 bp, Homo sapiens
accagagtaatgtgtggaaatt

SEQ ID NO: 7423480 - DNA, 22 bp, Homo sapiens
accagagtcaattattttgcca

SEQ ID NO: 7423481 - DNA, 22 bp, Homo sapiens
accagagttggaataattttga

SEQ ID NO: 7423482 - DNA, 22 bp, Homo sapiens
accagagcttacatgctagaaa

SEQ ID NO: 7423483 - DNA, 22 bp, Homo sapiens
accagagctggctctgagcacc

SEQ ID NO: 7423484 - DNA, 22 bp, Homo sapiens
accagagcttacatgctagaaa

SEQ ID NO: 7423485 - DNA, 22 bp, Homo sapiens
accagagctggctctgagcacc

SEQ ID NO: 7423486 - DNA, 22 bp, Homo sapiens
accagagctggctctgagcacc

SEQ ID NO: 7423487 - DNA, 22 bp, Homo sapiens
accagagctggctctgagcacc

SEQ ID NO: 7423488 - DNA, 22 bp, Homo sapiens
accagagctggctctgagcacc

SEQ ID NO: 7423489 - DNA, 20 bp, Homo sapiens
accagaggaaagagcagtga

SEQ ID NO: 7423490 - DNA, 20 bp, Homo sapiens
accagaggaaagagcagtga

SEQ ID NO: 7423491 - DNA, 20 bp, Homo sapiens
accagaggaaagagcagtga

SEQ ID NO: 7423492 - DNA, 20 bp, Homo sapiens
accagaggaaagagcagtga

SEQ ID NO: 7423493 - DNA, 22 bp, Homo sapiens
accagagcttacatgctagaaa

SEQ ID NO: 7423494 - DNA, 22 bp, Homo sapiens
accagagcttacatgctagaaa

SEQ ID NO: 7423495 - DNA, 20 bp, Homo sapiens
accagaggaaagagcagtga

SEQ ID NO: 7423496 - DNA, 20 bp, Homo sapiens
accagaggaaagagcagtga

SEQ ID NO: 7423497 - DNA, 22 bp, Homo sapiens
accagaggaagggaatctcaag

SEQ ID NO: 7423498 - DNA, 22 bp, Homo sapiens
accagaggaagggaatctcaag

SEQ ID NO: 7423499 - DNA, 22 bp, Homo sapiens
accagaggaagggaatctcaag

SEQ ID NO: 7423500 - DNA, 22 bp, Homo sapiens
accagaggaagggaatctcaag

SEQ ID NO: 7423501 - DNA, 22 bp, Homo sapiens
aaggggtgagcagaggcttcgc

SEQ ID NO: 7423502 - DNA, 22 bp, Homo sapiens
aaggggtgagcagaggcttcgc

SEQ ID NO: 7423503 - DNA, 19 bp, Homo sapiens
aaggggtgagggaagcaga

SEQ ID NO: 7423504 - DNA, 19 bp, Homo sapiens
aaggggtgagggaagcaga

SEQ ID NO: 7423505 - DNA, 19 bp, Homo sapiens
aaggggtgagggaagcaga

SEQ ID NO: 7423506 - DNA, 19 bp, Homo sapiens
aaggggtgagggaagcaga

SEQ ID NO: 7423507 - DNA, 22 bp, Homo sapiens
aaggggtgctgttggaaaccca

SEQ ID NO: 7423508 - DNA, 22 bp, Homo sapiens
aaggggtgctgttggaaaccca

SEQ ID NO: 7423509 - DNA, 22 bp, Homo sapiens
aaggggtgctgttggaaaccca

SEQ ID NO: 7423510 - DNA, 22 bp, Homo sapiens
aaggggtgctgttggaaaccca

SEQ ID NO: 7423511 - DNA, 22 bp, Homo sapiens
aaggggtgctgttggaaaccca

SEQ ID NO: 7423512 - DNA, 22 bp, Homo sapiens
aaggggtgcaagttaatcagca

SEQ ID NO: 7423513 - DNA, 22 bp, Homo sapiens
aaggggtgcaagttaatcagca

SEQ ID NO: 7423514 - DNA, 19 bp, Homo sapiens
aaggggtgagggaagcaga

SEQ ID NO: 7423515 - DNA, 19 bp, Homo sapiens
aaggggtgagggaagcaga

SEQ ID NO: 7423516 - DNA, 22 bp, Homo sapiens
aaggggggcacctgcatgcccg

SEQ ID NO: 7423517 - DNA, 22 bp, Homo sapiens
aaggggtcaagcggcagctaca

SEQ ID NO: 7423518 - DNA, 22 bp, Homo sapiens
aaggggtgagcagaggcttcgc

SEQ ID NO: 7423519 - DNA, 22 bp, Homo sapiens
aaggggtgagcagaggcttcgc

SEQ ID NO: 7423520 - DNA, 22 bp, Homo sapiens
aagggggcggcagccagtggaa

SEQ ID NO: 7423521 - DNA, 22 bp, Homo sapiens
aagggggcgaagacgtgattga

SEQ ID NO: 7423522 - DNA, 22 bp, Homo sapiens
aaggggaaaaagtgttaggagt

SEQ ID NO: 7423523 - DNA, 22 bp, Homo sapiens
aagggggcggcagccagtggaa

SEQ ID NO: 7423524 - DNA, 22 bp, Homo sapiens
aagggggcggcagccagtggaa

SEQ ID NO: 7423525 - DNA, 22 bp, Homo sapiens
aagggggcggcagccagtggaa

SEQ ID NO: 7423526 - DNA, 22 bp, Homo sapiens
accagcacctgataggcagtaa

SEQ ID NO: 7423527 - DNA, 22 bp, Homo sapiens
accagcaagattttgctttgca

SEQ ID NO: 7423528 - DNA, 22 bp, Homo sapiens
accagcacctgataggcagtaa

SEQ ID NO: 7423529 - DNA, 22 bp, Homo sapiens
accagcacctgataggcagtaa

SEQ ID NO: 7423530 - DNA, 22 bp, Homo sapiens
accagcaagattttgctttgca

SEQ ID NO: 7423531 - DNA, 22 bp, Homo sapiens
accagcacctgataggcagtaa

SEQ ID NO: 7423532 - DNA, 22 bp, Homo sapiens
aaggggaaaaagtgttaggagt

SEQ ID NO: 7423533 - DNA, 22 bp, Homo sapiens
aaggggaaaaagtgttaggagt

SEQ ID NO: 7423534 - DNA, 22 bp, Homo sapiens
accagcaagattttgctttgca

SEQ ID NO: 7423535 - DNA, 23 bp, Homo sapiens
accagcaaaaatgacagcccagg

SEQ ID NO: 7423536 - DNA, 22 bp, Homo sapiens
accagcaagattttgctttgca

SEQ ID NO: 7423537 - DNA, 22 bp, Homo sapiens
accagagttttattagttctaa

SEQ ID NO: 7423538 - DNA, 17 bp, Homo sapiens
accagagttttccatgc

SEQ ID NO: 7423539 - DNA, 22 bp, Homo sapiens
accagagttttattagttctaa

SEQ ID NO: 7423540 - DNA, 23 bp, Homo sapiens
accagcaaaaatgacagcccagg

SEQ ID NO: 7423541 - DNA, 23 bp, Homo sapiens
accagcaaaaatgacagcccagg

SEQ ID NO: 7423542 - DNA, 22 bp, Homo sapiens
aaggggaagagaccgcagagtc

SEQ ID NO: 7423543 - DNA, 22 bp, Homo sapiens
aaggggaaaaagtgttaggagt

SEQ ID NO: 7423544 - DNA, 22 bp, Homo sapiens
aaggggaagagaccgcagagtc

SEQ ID NO: 7423545 - DNA, 22 bp, Homo sapiens
aaggggaagagaccgcagagtc

SEQ ID NO: 7423546 - DNA, 22 bp, Homo sapiens
aaggggaagagaccgcagagtc

SEQ ID NO: 7423547 - DNA, 22 bp, Homo sapiens
aagggggcacagtcactgtaat

SEQ ID NO: 7423548 - DNA, 22 bp, Homo sapiens
aagggggccacacctggtgtga

SEQ ID NO: 7423549 - DNA, 22 bp, Homo sapiens
aagggggccacacctggtgtga

SEQ ID NO: 7423550 - DNA, 22 bp, Homo sapiens
aagggggccacacctggtgtga

SEQ ID NO: 7423551 - DNA, 22 bp, Homo sapiens
aagggggccacacctggtgtga

SEQ ID NO: 7423552 - DNA, 22 bp, Homo sapiens
aagggggcccagcactaagttg

SEQ ID NO: 7423553 - DNA, 22 bp, Homo sapiens
aagggggcccagcactaagttg

SEQ ID NO: 7423554 - DNA, 22 bp, Homo sapiens
aagggggcccagcactaagttg

SEQ ID NO: 7423555 - DNA, 22 bp, Homo sapiens
aagggggcgaagacgtgattga

SEQ ID NO: 7423556 - DNA, 22 bp, Homo sapiens
aagggtggtgtaggagatcaaa

SEQ ID NO: 7423557 - DNA, 22 bp, Homo sapiens
aagggtggtgtaggagatcaaa

SEQ ID NO: 7423558 - DNA, 22 bp, Homo sapiens
aagggttgaagataaataaggt

SEQ ID NO: 7423559 - DNA, 22 bp, Homo sapiens
aagggttgaagataaataaggt

SEQ ID NO: 7423560 - DNA, 22 bp, Homo sapiens
aagggttgaagataaataaggt

SEQ ID NO: 7423561 - DNA, 22 bp, Homo sapiens
aagggttgcaaggtcagaggaa

SEQ ID NO: 7423562 - DNA, 22 bp, Homo sapiens
aagggttgcaaggtcagaggaa

SEQ ID NO: 7423563 - DNA, 22 bp, Homo sapiens
aagggttgcaaggtcagaggaa

SEQ ID NO: 7423564 - DNA, 22 bp, Homo sapiens
aagggttgggactattatgact

SEQ ID NO: 7423565 - DNA, 22 bp, Homo sapiens
aagggttgggactattatgact

SEQ ID NO: 7423566 - DNA, 22 bp, Homo sapiens
aaggtaatccataatagttact

SEQ ID NO: 7423567 - DNA, 22 bp, Homo sapiens
aaggtaatatttttctctctaa

SEQ ID NO: 7423568 - DNA, 22 bp, Homo sapiens
aaggtaatcagcctttccacaa

SEQ ID NO: 7423569 - DNA, 22 bp, Homo sapiens
aaggtaatccataatagttact

SEQ ID NO: 7423570 - DNA, 22 bp, Homo sapiens
aaggtaatgaaacagcagctaa

SEQ ID NO: 7423571 - DNA, 22 bp, Homo sapiens
aagggtttgtctccctcaaggc

SEQ ID NO: 7423572 - DNA, 22 bp, Homo sapiens
aagggttggggaagagcaaatt

SEQ ID NO: 7423573 - DNA, 22 bp, Homo sapiens
aagggttggggaagagcaaatt

SEQ ID NO: 7423574 - DNA, 22 bp, Homo sapiens
aagggtttgtctccctcaaggc

SEQ ID NO: 7423575 - DNA, 20 bp, Homo sapiens
aaggtaagaaagccctgccc

SEQ ID NO: 7423576 - DNA, 22 bp, Homo sapiens
aaggtacaaagttatacagcgt

SEQ ID NO: 7423577 - DNA, 22 bp, Homo sapiens
aaggtacaccaaagttcaagtt

SEQ ID NO: 7423578 - DNA, 22 bp, Homo sapiens
aaggtacaccaaagttcaagtt

SEQ ID NO: 7423579 - DNA, 22 bp, Homo sapiens
aaggtacaaagtattatttaaa

SEQ ID NO: 7423580 - DNA, 22 bp, Homo sapiens
aaggtacagaaattaacaagga

SEQ ID NO: 7423581 - DNA, 22 bp, Homo sapiens
aaggtacagaaattaacaagga

SEQ ID NO: 7423582 - DNA, 22 bp, Homo sapiens
aaggtacagaaattaacaagga

SEQ ID NO: 7423583 - DNA, 22 bp, Homo sapiens
aaggtacagaaattaacaagga

SEQ ID NO: 7423584 - DNA, 22 bp, Homo sapiens
aaggtacaggcattgctgcagc

SEQ ID NO: 7423585 - DNA, 22 bp, Homo sapiens
aaggtacagggaaggagcaaga

SEQ ID NO: 7423586 - DNA, 22 bp, Homo sapiens
aaggtacagttttaagaataag

SEQ ID NO: 7423587 - DNA, 22 bp, Homo sapiens
aaggtacagttttaagaataag

SEQ ID NO: 7423588 - DNA, 22 bp, Homo sapiens
aaggtacagttttaagaataag

SEQ ID NO: 7423589 - DNA, 22 bp, Homo sapiens
aaggtacagttttaagaataag

SEQ ID NO: 7423590 - DNA, 22 bp, Homo sapiens
acccaggcagcaggagctaaag

SEQ ID NO: 7423591 - DNA, 22 bp, Homo sapiens
acccaggcagcaggagctaaag

SEQ ID NO: 7423592 - DNA, 22 bp, Homo sapiens
aagggtggtgtaggagatcaaa

SEQ ID NO: 7423593 - DNA, 22 bp, Homo sapiens
aagggtggtgtaggagatcaaa

SEQ ID NO: 7423594 - DNA, 22 bp, Homo sapiens
aagggtgggccctggcagccat

SEQ ID NO: 7423595 - DNA, 22 bp, Homo sapiens
aagggtgggccctggcagccat

SEQ ID NO: 7423596 - DNA, 22 bp, Homo sapiens
aagggtgggccctggcagccat

SEQ ID NO: 7423597 - DNA, 22 bp, Homo sapiens
aagggtgggccctggcagccat

SEQ ID NO: 7423598 - DNA, 22 bp, Homo sapiens
aagggtgggcaccgccaggtca

SEQ ID NO: 7423599 - DNA, 22 bp, Homo sapiens
aagggtgggcaccgccaggtca

SEQ ID NO: 7423600 - DNA, 22 bp, Homo sapiens
aagggtgggcaccgccaggtca

SEQ ID NO: 7423601 - DNA, 22 bp, Homo sapiens
aagggtgggccctggcagccat

SEQ ID NO: 7423602 - DNA, 22 bp, Homo sapiens
aagggtgggccctggcagccat

SEQ ID NO: 7423603 - DNA, 22 bp, Homo sapiens
aagggtggatttctgagctcta

SEQ ID NO: 7423604 - DNA, 22 bp, Homo sapiens
aagggtgctgctatcaggaagc

SEQ ID NO: 7423605 - DNA, 22 bp, Homo sapiens
aagggtgctgctatcaggaagc

SEQ ID NO: 7423606 - DNA, 22 bp, Homo sapiens
aagggtggatttctgagctcta

SEQ ID NO: 7423607 - DNA, 22 bp, Homo sapiens
aagggtggatttctgagctcta

SEQ ID NO: 7423608 - DNA, 22 bp, Homo sapiens
aagggtggatttctgagctcta

SEQ ID NO: 7423609 - DNA, 22 bp, Homo sapiens
aagggtgggcaccgccaggtca

SEQ ID NO: 7423610 - DNA, 22 bp, Homo sapiens
aagggtggatttctgagctcta

SEQ ID NO: 7423611 - DNA, 22 bp, Homo sapiens
aagggtgggcaccgccaggtca

SEQ ID NO: 7423612 - DNA, 22 bp, Homo sapiens
aagggtggatttctgagctcta

SEQ ID NO: 7423613 - DNA, 22 bp, Homo sapiens
aagggtgggcaccgccaggtca

SEQ ID NO: 7423614 - DNA, 22 bp, Homo sapiens
aagggtgggcaccgccaggtca

SEQ ID NO: 7423615 - DNA, 22 bp, Homo sapiens
aaggggtgggcattagagcagt

SEQ ID NO: 7423616 - DNA, 22 bp, Homo sapiens
aaggggtgggcattagagcagt

SEQ ID NO: 7423617 - DNA, 22 bp, Homo sapiens
aaggggtgggcattagagcagt

SEQ ID NO: 7423618 - DNA, 22 bp, Homo sapiens
aaggggtgggcattagagcagt

SEQ ID NO: 7423619 - DNA, 22 bp, Homo sapiens
aaggggtgggcattagagcagt

SEQ ID NO: 7423620 - DNA, 22 bp, Homo sapiens
aaggggtgggcattagagcagt

SEQ ID NO: 7423621 - DNA, 22 bp, Homo sapiens
aagggtccaaggctttgcgttt

SEQ ID NO: 7423622 - DNA, 22 bp, Homo sapiens
aagggtccagcacctcggctcc

SEQ ID NO: 7423623 - DNA, 22 bp, Homo sapiens
aaggggtgggcattagagcagt

SEQ ID NO: 7423624 - DNA, 19 bp, Homo sapiens
aagggtcacaagcagcaga

SEQ ID NO: 7423625 - DNA, 22 bp, Homo sapiens
aagggtgcgacctaggagtgag

SEQ ID NO: 7423626 - DNA, 22 bp, Homo sapiens
aagggtgctgctatcaggaagc

SEQ ID NO: 7423627 - DNA, 22 bp, Homo sapiens
aagggtgcgacctaggagtgag

SEQ ID NO: 7423628 - DNA, 22 bp, Homo sapiens
aagggtgcattgcgcggggctg

SEQ ID NO: 7423629 - DNA, 22 bp, Homo sapiens
aagggtgcccaggagatggact

SEQ ID NO: 7423630 - DNA, 22 bp, Homo sapiens
aagggtgcccaggagatggact

SEQ ID NO: 7423631 - DNA, 22 bp, Homo sapiens
aagggtgcgacctaggagtgag

SEQ ID NO: 7423632 - DNA, 22 bp, Homo sapiens
aagggtgaagggtggtggccta

SEQ ID NO: 7423633 - DNA, 22 bp, Homo sapiens
aagggtgcaaagcactctagct

SEQ ID NO: 7423634 - DNA, 23 bp, Homo sapiens
aagggtccatagctatcattaca

SEQ ID NO: 7423635 - DNA, 22 bp, Homo sapiens
aagggtcttagaggttcatttt

SEQ ID NO: 7423636 - DNA, 22 bp, Homo sapiens
aagggtgaagggtggtggccta

SEQ ID NO: 7423637 - DNA, 23 bp, Homo sapiens
acatttcatataaaagggatcag

SEQ ID NO: 7423638 - DNA, 22 bp, Homo sapiens
acatttcagtgagctattgaag

SEQ ID NO: 7423639 - DNA, 22 bp, Homo sapiens
acatttcagtgagctattgaag

SEQ ID NO: 7423640 - DNA, 22 bp, Homo sapiens
acatttcagtgagctattgaag

SEQ ID NO: 7423641 - DNA, 22 bp, Homo sapiens
acatttcagtgagctattgaag

SEQ ID NO: 7423642 - DNA, 22 bp, Homo sapiens
acatttcagtgagctattgaag

SEQ ID NO: 7423643 - DNA, 22 bp, Homo sapiens
acatttcagtgagctattgaag

SEQ ID NO: 7423644 - DNA, 22 bp, Homo sapiens
aagggctgcaatccaaaacact

SEQ ID NO: 7423645 - DNA, 22 bp, Homo sapiens
aagggctgatctcactttcttt

SEQ ID NO: 7423646 - DNA, 22 bp, Homo sapiens
aagggctgcaatccaaaacact

SEQ ID NO: 7423647 - DNA, 22 bp, Homo sapiens
aagggctggagactgggtcttc

SEQ ID NO: 7423648 - DNA, 22 bp, Homo sapiens
aagggctggagactgggtcttc

SEQ ID NO: 7423649 - DNA, 22 bp, Homo sapiens
aagggctggagactgggtcttc

SEQ ID NO: 7423650 - DNA, 22 bp, Homo sapiens
aagggctggagaggaaaggttg

SEQ ID NO: 7423651 - DNA, 22 bp, Homo sapiens
aagggctggagaggaaaggttg

SEQ ID NO: 7423652 - DNA, 22 bp, Homo sapiens
aagggctggagaggaaaggttg

SEQ ID NO: 7423653 - DNA, 22 bp, Homo sapiens
aagggctggagactgggtcttc

SEQ ID NO: 7423654 - DNA, 22 bp, Homo sapiens
acatttcagcgtgcatgacatg

SEQ ID NO: 7423655 - DNA, 22 bp, Homo sapiens
acatttcagcgtgcatgacatg

SEQ ID NO: 7423656 - DNA, 22 bp, Homo sapiens
acatttcagcgtgcatgacatg

SEQ ID NO: 7423657 - DNA, 22 bp, Homo sapiens
acatttcagcgtgcatgacatg

SEQ ID NO: 7423658 - DNA, 22 bp, Homo sapiens
acatttcagattcatgaagtga

SEQ ID NO: 7423659 - DNA, 22 bp, Homo sapiens
acatttcagattcatgaagtga

SEQ ID NO: 7423660 - DNA, 22 bp, Homo sapiens
acatttcagcgtgcatgacatg

SEQ ID NO: 7423661 - DNA, 22 bp, Homo sapiens
acatttcagcgtgcatgacatg

SEQ ID NO: 7423662 - DNA, 22 bp, Homo sapiens
acatttcagcgtgcatgacatg

SEQ ID NO: 7423663 - DNA, 22 bp, Homo sapiens
acatttcagtaagtgttaattt

SEQ ID NO: 7423664 - DNA, 22 bp, Homo sapiens
acatttcagtaagtgttaattt

SEQ ID NO: 7423665 - DNA, 22 bp, Homo sapiens
acatttcagtaagtgttaattt

SEQ ID NO: 7423666 - DNA, 22 bp, Homo sapiens
acatttcagtaagtgttaattt

SEQ ID NO: 7423667 - DNA, 22 bp, Homo sapiens
acatttcagtaagtgttaattt

SEQ ID NO: 7423668 - DNA, 22 bp, Homo sapiens
aagggctggccctgggaagagt

SEQ ID NO: 7423669 - DNA, 22 bp, Homo sapiens
aagggctggccctgggaagagt

SEQ ID NO: 7423670 - DNA, 22 bp, Homo sapiens
aagggctggccctgggaagagt

SEQ ID NO: 7423671 - DNA, 22 bp, Homo sapiens
aagggctggccacattctgggt

SEQ ID NO: 7423672 - DNA, 22 bp, Homo sapiens
aagggctggccctgggaagagt

SEQ ID NO: 7423673 - DNA, 18 bp, Homo sapiens
aagggctggcctttggag

SEQ ID NO: 7423674 - DNA, 18 bp, Homo sapiens
aagggctggcctttggag

SEQ ID NO: 7423675 - DNA, 22 bp, Homo sapiens
aagggctggccctgggaagagt

SEQ ID NO: 7423676 - DNA, 22 bp, Homo sapiens
aagggctggccctgggaagagt

SEQ ID NO: 7423677 - DNA, 22 bp, Homo sapiens
aagggctgggtctggttaaccc

SEQ ID NO: 7423678 - DNA, 19 bp, Homo sapiens
aagggctgggcacctcact

SEQ ID NO: 7423679 - DNA, 19 bp, Homo sapiens
aagggctgggcacctcact

SEQ ID NO: 7423680 - DNA, 19 bp, Homo sapiens
aagggctgggcacctcact

SEQ ID NO: 7423681 - DNA, 19 bp, Homo sapiens
aagggctgggcacctcact

SEQ ID NO: 7423682 - DNA, 19 bp, Homo sapiens
aagggctgggcacctcact

SEQ ID NO: 7423683 - DNA, 19 bp, Homo sapiens
aagggctgggcacctcact

SEQ ID NO: 7423684 - DNA, 19 bp, Homo sapiens
aagggctgggcacctcact

SEQ ID NO: 7423685 - DNA, 18 bp, Homo sapiens
aagggctggcctttggag

SEQ ID NO: 7423686 - DNA, 18 bp, Homo sapiens
aagggctggcctttggag

SEQ ID NO: 7423687 - DNA, 18 bp, Homo sapiens
aagggctggcctttggag

SEQ ID NO: 7423688 - DNA, 22 bp, Homo sapiens
aagggctggatctctctgagca

SEQ ID NO: 7423689 - DNA, 22 bp, Homo sapiens
aagggctggagaggaaaggttg

SEQ ID NO: 7423690 - DNA, 22 bp, Homo sapiens
aagggctggagaggaaaggttg

SEQ ID NO: 7423691 - DNA, 22 bp, Homo sapiens
aagggctggagaggaaaggttg

SEQ ID NO: 7423692 - DNA, 22 bp, Homo sapiens
aagggctggagaggaaaggttg

SEQ ID NO: 7423693 - DNA, 22 bp, Homo sapiens
aagggctggagaggaaaggttg

SEQ ID NO: 7423694 - DNA, 22 bp, Homo sapiens
aagggctggatctctctgagca

SEQ ID NO: 7423695 - DNA, 22 bp, Homo sapiens
aagggctggatctctctgagca

SEQ ID NO: 7423696 - DNA, 22 bp, Homo sapiens
aagggctggatctctctgagca

SEQ ID NO: 7423697 - DNA, 22 bp, Homo sapiens
aagggctggatctctctgagca

SEQ ID NO: 7423698 - DNA, 22 bp, Homo sapiens
aagggctggatctctctgagca

SEQ ID NO: 7423699 - DNA, 22 bp, Homo sapiens
aagggctggatctctctgagca

SEQ ID NO: 7423700 - DNA, 22 bp, Homo sapiens
aagggctggatctctctgagca

SEQ ID NO: 7423701 - DNA, 22 bp, Homo sapiens
aagggctggccacattctgggt

SEQ ID NO: 7423702 - DNA, 22 bp, Homo sapiens
aagggctggccacattctgggt

SEQ ID NO: 7423703 - DNA, 22 bp, Homo sapiens
aagggctggccacattctgggt

SEQ ID NO: 7423704 - DNA, 22 bp, Homo sapiens
aagggctggccacattctgggt

SEQ ID NO: 7423705 - DNA, 22 bp, Homo sapiens
aagggctggccacattctgggt

SEQ ID NO: 7423706 - DNA, 20 bp, Homo sapiens
aagggagaataatgattgta

SEQ ID NO: 7423707 - DNA, 20 bp, Homo sapiens
aagggagaataatgattgta

SEQ ID NO: 7423708 - DNA, 20 bp, Homo sapiens
aagggagaataatgattgta

SEQ ID NO: 7423709 - DNA, 22 bp, Homo sapiens
aagggagacagttgtgtgagga

SEQ ID NO: 7423710 - DNA, 22 bp, Homo sapiens
acatgcatgtgaatatggacac

SEQ ID NO: 7423711 - DNA, 22 bp, Homo sapiens
acatgcatgtgaatatggacac

SEQ ID NO: 7423712 - DNA, 22 bp, Homo sapiens
acatgcatgttgtgtagggggg

SEQ ID NO: 7423713 - DNA, 22 bp, Homo sapiens
acatgcatgtgaatatggacac

SEQ ID NO: 7423714 - DNA, 22 bp, Homo sapiens
aagggaggtaaagctatttaaa

SEQ ID NO: 7423715 - DNA, 22 bp, Homo sapiens
aagggaggtaaagctatttaaa

SEQ ID NO: 7423716 - DNA, 22 bp, Homo sapiens
acatgcatgttgtgtagggggg

SEQ ID NO: 7423717 - DNA, 22 bp, Homo sapiens
aagggaggtaaagctatttaaa

SEQ ID NO: 7423718 - DNA, 22 bp, Homo sapiens
aagggaggtaaagctatttaaa

SEQ ID NO: 7423719 - DNA, 20 bp, Homo sapiens
aagggagaataatgattgta

SEQ ID NO: 7423720 - DNA, 22 bp, Homo sapiens
aagggaggggatgtaagcctgg

SEQ ID NO: 7423721 - DNA, 22 bp, Homo sapiens
aagggatcataattgggttcaa

SEQ ID NO: 7423722 - DNA, 22 bp, Homo sapiens
aagggaggtaaagctatttaaa

SEQ ID NO: 7423723 - DNA, 22 bp, Homo sapiens
aagggaggtaaagctatttaaa

SEQ ID NO: 7423724 - DNA, 22 bp, Homo sapiens
aagggcacagggaaagagtgca

SEQ ID NO: 7423725 - DNA, 22 bp, Homo sapiens
aagggattgatcttgacacagt

SEQ ID NO: 7423726 - DNA, 22 bp, Homo sapiens
aagggattgatcttgacacagt

SEQ ID NO: 7423727 - DNA, 22 bp, Homo sapiens
aagggatgcaggaaagaaggtt

SEQ ID NO: 7423728 - DNA, 22 bp, Homo sapiens
aagggatgtaaacatgaataag

SEQ ID NO: 7423729 - DNA, 22 bp, Homo sapiens
aagggcacagggaaagagtgca

SEQ ID NO: 7423730 - DNA, 22 bp, Homo sapiens
aagggcacagggaaagagtgca

SEQ ID NO: 7423731 - DNA, 22 bp, Homo sapiens
aagggcagaaagggacgctttg

SEQ ID NO: 7423732 - DNA, 22 bp, Homo sapiens
aagggcagaaagggacgctttg

SEQ ID NO: 7423733 - DNA, 22 bp, Homo sapiens
aagggcagaaagggacgctttg

SEQ ID NO: 7423734 - DNA, 22 bp, Homo sapiens
aagggcagaatagagaagatgg

SEQ ID NO: 7423735 - DNA, 22 bp, Homo sapiens
aagggcagaaagggacgctttg

SEQ ID NO: 7423736 - DNA, 22 bp, Homo sapiens
aagggcagaaagggacgctttg

SEQ ID NO: 7423737 - DNA, 22 bp, Homo sapiens
aagggcagaatagagaagatgg

SEQ ID NO: 7423738 - DNA, 22 bp, Homo sapiens
aagggcagaatagagaagatgg

SEQ ID NO: 7423739 - DNA, 22 bp, Homo sapiens
aagggcagaatagagaagatgg

SEQ ID NO: 7423740 - DNA, 22 bp, Homo sapiens
aagggcagaatagagaagatgg

SEQ ID NO: 7423741 - DNA, 22 bp, Homo sapiens
aagggcagaatagagaagatgg

SEQ ID NO: 7423742 - DNA, 20 bp, Homo sapiens
aagggcagagggaacagact

SEQ ID NO: 7423743 - DNA, 20 bp, Homo sapiens
aagggcagagggaacagact

SEQ ID NO: 7423744 - DNA, 20 bp, Homo sapiens
aagggcagagggaacagact

SEQ ID NO: 7423745 - DNA, 20 bp, Homo sapiens
aagggcagagggaacagact

SEQ ID NO: 7423746 - DNA, 20 bp, Homo sapiens
aagggcagagggaacagact

SEQ ID NO: 7423747 - DNA, 20 bp, Homo sapiens
aagggcagagggaacagact

SEQ ID NO: 7423748 - DNA, 22 bp, Homo sapiens
aagggcagagggaatcccacat

SEQ ID NO: 7423749 - DNA, 22 bp, Homo sapiens
aagggcagagggaatcccacat

SEQ ID NO: 7423750 - DNA, 22 bp, Homo sapiens
aagggcagagggaatcccacat

SEQ ID NO: 7423751 - DNA, 22 bp, Homo sapiens
aagggcagagggaatcccacat

SEQ ID NO: 7423752 - DNA, 20 bp, Homo sapiens
aagggcagagggaacagact

SEQ ID NO: 7423753 - DNA, 20 bp, Homo sapiens
aagggcagagggaacagact

SEQ ID NO: 7423754 - DNA, 20 bp, Homo sapiens
aagggcagagggaacagact

SEQ ID NO: 7423755 - DNA, 20 bp, Homo sapiens
aagggcagagggaacagact

SEQ ID NO: 7423756 - DNA, 20 bp, Homo sapiens
aagggcagagggaacagact

SEQ ID NO: 7423757 - DNA, 20 bp, Homo sapiens
aagggcagagggaacagact

SEQ ID NO: 7423758 - DNA, 22 bp, Homo sapiens
aagggcagaatagagaagatgg

SEQ ID NO: 7423759 - DNA, 20 bp, Homo sapiens
aagggcagagggaacagact

SEQ ID NO: 7423760 - DNA, 22 bp, Homo sapiens
aagggcagaatagagaagatgg

SEQ ID NO: 7423761 - DNA, 22 bp, Homo sapiens
aagggcagaatagagaagatgg

SEQ ID NO: 7423762 - DNA, 22 bp, Homo sapiens
aagggcagaatagagaagatgg

SEQ ID NO: 7423763 - DNA, 22 bp, Homo sapiens
aagggcagaatagagaagatgg

SEQ ID NO: 7423764 - DNA, 22 bp, Homo sapiens
acatttcagatgtaatgtgatg

SEQ ID NO: 7423765 - DNA, 22 bp, Homo sapiens
acatttcagattcatgaagtga

SEQ ID NO: 7423766 - DNA, 22 bp, Homo sapiens
acatttcagattcatgaagtga

SEQ ID NO: 7423767 - DNA, 22 bp, Homo sapiens
acatttcagattcatgaagtga

SEQ ID NO: 7423768 - DNA, 22 bp, Homo sapiens
acatttcagattcatgaagtga

SEQ ID NO: 7423769 - DNA, 22 bp, Homo sapiens
acatttcagattcatgaagtga

SEQ ID NO: 7423770 - DNA, 22 bp, Homo sapiens
acatttcagatgtaatgtgatg

SEQ ID NO: 7423771 - DNA, 22 bp, Homo sapiens
acatttcagatgtaatgtgatg

SEQ ID NO: 7423772 - DNA, 22 bp, Homo sapiens
acatttcagatgtaatgtgatg

SEQ ID NO: 7423773 - DNA, 22 bp, Homo sapiens
acatttcagatgtaatgtgatg

SEQ ID NO: 7423774 - DNA, 22 bp, Homo sapiens
acatttcagatgtaatgtgatg

SEQ ID NO: 7423775 - DNA, 22 bp, Homo sapiens
acatttcagatgtaatgtgatg

SEQ ID NO: 7423776 - DNA, 22 bp, Homo sapiens
aagggcagagggaatcccacat

SEQ ID NO: 7423777 - DNA, 22 bp, Homo sapiens
acatttcagaatcacacagctt

SEQ ID NO: 7423778 - DNA, 22 bp, Homo sapiens
aagtcatctgaaactggcttat

SEQ ID NO: 7423779 - DNA, 22 bp, Homo sapiens
aagtcatcactcctctgaactt

SEQ ID NO: 7423780 - DNA, 22 bp, Homo sapiens
aagtccagtgatactggcagga

SEQ ID NO: 7423781 - DNA, 22 bp, Homo sapiens
aagtcatcttgagtctaagatt

SEQ ID NO: 7423782 - DNA, 22 bp, Homo sapiens
aagtccagtttttccaggtggt

SEQ ID NO: 7423783 - DNA, 22 bp, Homo sapiens
aagtccagtttttccaggtggt

SEQ ID NO: 7423784 - DNA, 22 bp, Homo sapiens
aagtccagtttttccaggtggt

SEQ ID NO: 7423785 - DNA, 22 bp, Homo sapiens
aagtccagtgatactggcagga

SEQ ID NO: 7423786 - DNA, 22 bp, Homo sapiens
aagtccatgatcaagatgtggc

SEQ ID NO: 7423787 - DNA, 22 bp, Homo sapiens
aagtcatcactcctctgaactt

SEQ ID NO: 7423788 - DNA, 22 bp, Homo sapiens
aagtcatagtcgggaaagacat

SEQ ID NO: 7423789 - DNA, 22 bp, Homo sapiens
aagtcagtgctagctaatggct

SEQ ID NO: 7423790 - DNA, 22 bp, Homo sapiens
aagtcatagtcgggaaagacat

SEQ ID NO: 7423791 - DNA, 22 bp, Homo sapiens
aagtcagtgctagctaatggct

SEQ ID NO: 7423792 - DNA, 22 bp, Homo sapiens
aagtatctcaaaaacagtaatc

SEQ ID NO: 7423793 - DNA, 22 bp, Homo sapiens
aagtatctgggagatttgcttt

SEQ ID NO: 7423794 - DNA, 22 bp, Homo sapiens
aagtatctcaaaaacagtaatc

SEQ ID NO: 7423795 - DNA, 22 bp, Homo sapiens
aagtatctcaaaaacagtaatc

SEQ ID NO: 7423796 - DNA, 22 bp, Homo sapiens
aagtatctcaaaaacagtaatc

SEQ ID NO: 7423797 - DNA, 22 bp, Homo sapiens
aagtatatactaaatgttaatc

SEQ ID NO: 7423798 - DNA, 22 bp, Homo sapiens
aagtatattttttgaagcatat

SEQ ID NO: 7423799 - DNA, 22 bp, Homo sapiens
aagtatcaaatggtagcatatg

SEQ ID NO: 7423800 - DNA, 22 bp, Homo sapiens
aagtatcaaatggtagcatatg

SEQ ID NO: 7423801 - DNA, 22 bp, Homo sapiens
aagtatcaaatggtagcatatg

SEQ ID NO: 7423802 - DNA, 22 bp, Homo sapiens
aagtatatttagctgagcttgt

SEQ ID NO: 7423803 - DNA, 22 bp, Homo sapiens
aagtatatttagctgagcttgt

SEQ ID NO: 7423804 - DNA, 22 bp, Homo sapiens
aagtatattttttgaagcatat

SEQ ID NO: 7423805 - DNA, 22 bp, Homo sapiens
aagtatattttttgaagcatat

SEQ ID NO: 7423806 - DNA, 22 bp, Homo sapiens
aagtatatactaaatgttaatc

SEQ ID NO: 7423807 - DNA, 22 bp, Homo sapiens
aagtatatactaaatgttaatc

SEQ ID NO: 7423808 - DNA, 22 bp, Homo sapiens
aagtatatactaaatgttaatc

SEQ ID NO: 7423809 - DNA, 22 bp, Homo sapiens
aagtatatactaaatgttaatc

SEQ ID NO: 7423810 - DNA, 22 bp, Homo sapiens
aagtatacttaggcataatggt

SEQ ID NO: 7423811 - DNA, 22 bp, Homo sapiens
aagtatacttaggcataatggt

SEQ ID NO: 7423812 - DNA, 22 bp, Homo sapiens
aagtataagctattcttcatga

SEQ ID NO: 7423813 - DNA, 22 bp, Homo sapiens
aagtataagctattcttcatga

SEQ ID NO: 7423814 - DNA, 22 bp, Homo sapiens
aagtataagctattcttcatga

SEQ ID NO: 7423815 - DNA, 22 bp, Homo sapiens
aagtataatcaaagcagggcta

SEQ ID NO: 7423816 - DNA, 22 bp, Homo sapiens
aagtatactgaaggtatccagg

SEQ ID NO: 7423817 - DNA, 22 bp, Homo sapiens
aagtatactgaaggtatccagg

SEQ ID NO: 7423818 - DNA, 22 bp, Homo sapiens
aagtatactgaaggtatccagg

SEQ ID NO: 7423819 - DNA, 22 bp, Homo sapiens
aagtatacttaaaagagttgat

SEQ ID NO: 7423820 - DNA, 22 bp, Homo sapiens
aagtagttggaaataagacaga

SEQ ID NO: 7423821 - DNA, 22 bp, Homo sapiens
aagtagttggaaataagacaga

SEQ ID NO: 7423822 - DNA, 22 bp, Homo sapiens
aagtataagctattcttcatga

SEQ ID NO: 7423823 - DNA, 22 bp, Homo sapiens
aagtaggtaccgcgcagcaggg

SEQ ID NO: 7423824 - DNA, 22 bp, Homo sapiens
aagtaggaatccgaatgagtag

SEQ ID NO: 7423825 - DNA, 22 bp, Homo sapiens
aagtagtgtgctccagcggtga

SEQ ID NO: 7423826 - DNA, 22 bp, Homo sapiens
aagtagtgtgctccagcggtga

SEQ ID NO: 7423827 - DNA, 22 bp, Homo sapiens
aagtagttagtccgcctgctct

SEQ ID NO: 7423828 - DNA, 22 bp, Homo sapiens
aagtagttaggaacattctctc

SEQ ID NO: 7423829 - DNA, 22 bp, Homo sapiens
aagtaggaatccgaatgagtag

SEQ ID NO: 7423830 - DNA, 22 bp, Homo sapiens
aagtagccaacaccctttccat

SEQ ID NO: 7423831 - DNA, 22 bp, Homo sapiens
aagtagccttatggttttccag

SEQ ID NO: 7423832 - DNA, 22 bp, Homo sapiens
aagtaggaatccgaatgagtag

SEQ ID NO: 7423833 - DNA, 22 bp, Homo sapiens
aagtaggaatccgaatgagtag

SEQ ID NO: 7423834 - DNA, 22 bp, Homo sapiens
aagtagcattttcaaaatgtat

SEQ ID NO: 7423835 - DNA, 22 bp, Homo sapiens
aagtagcattttcaaaatgtat

SEQ ID NO: 7423836 - DNA, 22 bp, Homo sapiens
aagtagcattccatggtataga

SEQ ID NO: 7423837 - DNA, 22 bp, Homo sapiens
aagtagcagggattacaggtgt

SEQ ID NO: 7423838 - DNA, 22 bp, Homo sapiens
aagtagcatcaaggaggatcca

SEQ ID NO: 7423839 - DNA, 22 bp, Homo sapiens
aagtagcaaggaagattatgat

SEQ ID NO: 7423840 - DNA, 21 bp, Homo sapiens
aagtagatcactgttctcttg

SEQ ID NO: 7423841 - DNA, 22 bp, Homo sapiens
aagtagatgatctttctgcata

SEQ ID NO: 7423842 - DNA, 22 bp, Homo sapiens
aagtagatgatctttctgcata

SEQ ID NO: 7423843 - DNA, 22 bp, Homo sapiens
aagtagcaaggaagattatgat

SEQ ID NO: 7423844 - DNA, 21 bp, Homo sapiens
aagtagatcactgttctcttg

SEQ ID NO: 7423845 - DNA, 23 bp, Homo sapiens
aagtagataacactgttctgaga

SEQ ID NO: 7423846 - DNA, 23 bp, Homo sapiens
aagtagatagctaaagttttgtt

SEQ ID NO: 7423847 - DNA, 22 bp, Homo sapiens
aagtagacttttgcatcaagga

SEQ ID NO: 7423848 - DNA, 22 bp, Homo sapiens
acctctggccaagactcgtgtt

SEQ ID NO: 7423849 - DNA, 22 bp, Homo sapiens
acctctggccaagactcgtgtt

SEQ ID NO: 7423850 - DNA, 22 bp, Homo sapiens
acctctggccaagactcgtgtt

SEQ ID NO: 7423851 - DNA, 22 bp, Homo sapiens
aagtccctttaatcagtgcctt

SEQ ID NO: 7423852 - DNA, 22 bp, Homo sapiens
aagtccctgtggggtggaggct

SEQ ID NO: 7423853 - DNA, 22 bp, Homo sapiens
aagtccctggttcctagcaaaa

SEQ ID NO: 7423854 - DNA, 22 bp, Homo sapiens
aagtccctttaatcagtgcctt

SEQ ID NO: 7423855 - DNA, 22 bp, Homo sapiens
aagtccctggttcctagcaaaa

SEQ ID NO: 7423856 - DNA, 20 bp, Homo sapiens
aagtccctaagtctctggcc

SEQ ID NO: 7423857 - DNA, 22 bp, Homo sapiens
aagtccctggtgctggctgcgc

SEQ ID NO: 7423858 - DNA, 22 bp, Homo sapiens
aagtccctggtgctggctgcgc

SEQ ID NO: 7423859 - DNA, 22 bp, Homo sapiens
aagtccctggttcctagcaaaa

SEQ ID NO: 7423860 - DNA, 22 bp, Homo sapiens
aagtccctggtgctggctgcgc

SEQ ID NO: 7423861 - DNA, 20 bp, Homo sapiens
aagtccctaagtctctggcc

SEQ ID NO: 7423862 - DNA, 20 bp, Homo sapiens
aagtccctaagtctctggcc

SEQ ID NO: 7423863 - DNA, 20 bp, Homo sapiens
aagtccctaagtctctggcc

SEQ ID NO: 7423864 - DNA, 22 bp, Homo sapiens
aagtcccatctgcctccatgta

SEQ ID NO: 7423865 - DNA, 22 bp, Homo sapiens
aagtcccatctgcctccatgta

SEQ ID NO: 7423866 - DNA, 22 bp, Homo sapiens
aagtcccatctgcctccatgta

SEQ ID NO: 7423867 - DNA, 17 bp, Homo sapiens
aagtcccagctaacaca

SEQ ID NO: 7423868 - DNA, 17 bp, Homo sapiens
aagtcccagctaacaca

SEQ ID NO: 7423869 - DNA, 17 bp, Homo sapiens
aagtcccagctaacaca

SEQ ID NO: 7423870 - DNA, 22 bp, Homo sapiens
aagtcccaatccctggcctgct

SEQ ID NO: 7423871 - DNA, 22 bp, Homo sapiens
aagtcccaatccctggcctgct

SEQ ID NO: 7423872 - DNA, 22 bp, Homo sapiens
aagtcccaaagtcactctgctt

SEQ ID NO: 7423873 - DNA, 22 bp, Homo sapiens
aagtcccaaagtcactctgctt

SEQ ID NO: 7423874 - DNA, 22 bp, Homo sapiens
aagtcccaaagtcactctgctt

SEQ ID NO: 7423875 - DNA, 20 bp, Homo sapiens
aagtcctgacctagtctaaa

SEQ ID NO: 7423876 - DNA, 22 bp, Homo sapiens
aagtcctgagaccagaaaatgg

SEQ ID NO: 7423877 - DNA, 22 bp, Homo sapiens
aagtcctgccacctataagcct

SEQ ID NO: 7423878 - DNA, 22 bp, Homo sapiens
aagtcctgccagcaaatgtata

SEQ ID NO: 7423879 - DNA, 22 bp, Homo sapiens
aagtcctggatattaaattgat

SEQ ID NO: 7423880 - DNA, 22 bp, Homo sapiens
aagtcctgggcatttgaacagg

SEQ ID NO: 7423881 - DNA, 22 bp, Homo sapiens
aagtcctgggtgagaactgtcc

SEQ ID NO: 7423882 - DNA, 22 bp, Homo sapiens
aagtcctgtgtgcttacacttg

SEQ ID NO: 7423883 - DNA, 22 bp, Homo sapiens
aagtcctgtgctagagacacct

SEQ ID NO: 7423884 - DNA, 22 bp, Homo sapiens
aagtcctgaaacttctttctga

SEQ ID NO: 7423885 - DNA, 22 bp, Homo sapiens
aagtcctgaagacacagaaaag

SEQ ID NO: 7423886 - DNA, 22 bp, Homo sapiens
aagtcctgaataggggccctgg

SEQ ID NO: 7423887 - DNA, 20 bp, Homo sapiens
aagtcctgacctagtctaaa

SEQ ID NO: 7423888 - DNA, 22 bp, Homo sapiens
aagtccctttaatcagtgcctt

SEQ ID NO: 7423889 - DNA, 22 bp, Homo sapiens
aagtcctaattttaggaggaga

SEQ ID NO: 7423890 - DNA, 22 bp, Homo sapiens
aagtcctcaattttctctgcta

SEQ ID NO: 7423891 - DNA, 22 bp, Homo sapiens
aagtcctcaattttctctgcta

SEQ ID NO: 7423892 - DNA, 22 bp, Homo sapiens
aagtcctgaaacttctttctga

SEQ ID NO: 7423893 - DNA, 22 bp, Homo sapiens
aagtccttctttatatgagagt

SEQ ID NO: 7423894 - DNA, 22 bp, Homo sapiens
aagtccttctttatatgagagt

SEQ ID NO: 7423895 - DNA, 22 bp, Homo sapiens
aagtccttctttatatgagagt

SEQ ID NO: 7423896 - DNA, 22 bp, Homo sapiens
aagtccttgaagaaacagttct

SEQ ID NO: 7423897 - DNA, 22 bp, Homo sapiens
aagtccttctttatatgagagt

SEQ ID NO: 7423898 - DNA, 22 bp, Homo sapiens
aagtccttgaagaaacagttct

SEQ ID NO: 7423899 - DNA, 22 bp, Homo sapiens
aagtccttggagaatagaaagg

SEQ ID NO: 7423900 - DNA, 22 bp, Homo sapiens
aagtccttggagaatagaaagg

SEQ ID NO: 7423901 - DNA, 18 bp, Homo sapiens
aagtccttcctttgcttt

SEQ ID NO: 7423902 - DNA, 18 bp, Homo sapiens
aagtccttcctttgcttt

SEQ ID NO: 7423903 - DNA, 22 bp, Homo sapiens
aagtccttcccaagcatgtacc

SEQ ID NO: 7423904 - DNA, 22 bp, Homo sapiens
aagtccttcccaagcatgtacc

SEQ ID NO: 7423905 - DNA, 22 bp, Homo sapiens
aagtcctgttcctcatacttcc

SEQ ID NO: 7423906 - DNA, 22 bp, Homo sapiens
acctgcccttaacactgtgtgc

SEQ ID NO: 7423907 - DNA, 22 bp, Homo sapiens
acctgcccttaacactgtgtgc

SEQ ID NO: 7423908 - DNA, 22 bp, Homo sapiens
acctgccctggaggaagatatt

SEQ ID NO: 7423909 - DNA, 22 bp, Homo sapiens
acctgcctagttggttctgccc

SEQ ID NO: 7423910 - DNA, 22 bp, Homo sapiens
acctgcctagttggttctgccc

SEQ ID NO: 7423911 - DNA, 22 bp, Homo sapiens
aagtcctttaatatcacatagt

SEQ ID NO: 7423912 - DNA, 22 bp, Homo sapiens
aagtcctttaatatcacatagt

SEQ ID NO: 7423913 - DNA, 22 bp, Homo sapiens
aagtccttgtatacagaatcaa

SEQ ID NO: 7423914 - DNA, 22 bp, Homo sapiens
acctgcctagttggttctgccc

SEQ ID NO: 7423915 - DNA, 22 bp, Homo sapiens
acctgcctatcagctgcctgct

SEQ ID NO: 7423916 - DNA, 22 bp, Homo sapiens
aagtccttgaagaaacagttct

SEQ ID NO: 7423917 - DNA, 22 bp, Homo sapiens
acctgcctagttggttctgccc

SEQ ID NO: 7423918 - DNA, 22 bp, Homo sapiens
acctgcctatcagctgcctgct

SEQ ID NO: 7423919 - DNA, 22 bp, Homo sapiens
acctgcctatcagctgcctgct

SEQ ID NO: 7423920 - DNA, 22 bp, Homo sapiens
acctgcctatcagctgcctgct

SEQ ID NO: 7423921 - DNA, 22 bp, Homo sapiens
acctgcctatcagctgcctgct

SEQ ID NO: 7423922 - DNA, 22 bp, Homo sapiens
acctgcctatcagctgcctgct

SEQ ID NO: 7423923 - DNA, 22 bp, Homo sapiens
acctgcctagttggttctgccc

SEQ ID NO: 7423924 - DNA, 22 bp, Homo sapiens
acctgcctatggagccacatgg

SEQ ID NO: 7423925 - DNA, 22 bp, Homo sapiens
acctgcctatggagccacatgg

SEQ ID NO: 7423926 - DNA, 22 bp, Homo sapiens
acctgcctatggagccacatgg

SEQ ID NO: 7423927 - DNA, 22 bp, Homo sapiens
acctgcctatggagccacatgg

SEQ ID NO: 7423928 - DNA, 22 bp, Homo sapiens
acctgcctatcagctgcctgct

SEQ ID NO: 7423929 - DNA, 22 bp, Homo sapiens
acctgcctatcagctgcctgct

SEQ ID NO: 7423930 - DNA, 22 bp, Homo sapiens
acctgcctatcagctgcctgct

SEQ ID NO: 7423931 - DNA, 22 bp, Homo sapiens
acccaggggcgaagctggccac

SEQ ID NO: 7423932 - DNA, 22 bp, Homo sapiens
acccaggggcgaagctggccac

SEQ ID NO: 7423933 - DNA, 22 bp, Homo sapiens
acccaggggcgaagctggccac

SEQ ID NO: 7423934 - DNA, 19 bp, Homo sapiens
acccaggggtttatgtgtg

SEQ ID NO: 7423935 - DNA, 19 bp, Homo sapiens
acccaggggtttatgtgtg

SEQ ID NO: 7423936 - DNA, 19 bp, Homo sapiens
acccaggggtttatgtgtg

SEQ ID NO: 7423937 - DNA, 22 bp, Homo sapiens
acccaggggcagccttgctgtg

SEQ ID NO: 7423938 - DNA, 22 bp, Homo sapiens
acccaggggcagccttgctgtg

SEQ ID NO: 7423939 - DNA, 22 bp, Homo sapiens
acccagggctcaagcgtaggca

SEQ ID NO: 7423940 - DNA, 22 bp, Homo sapiens
acccaggggcgaagctggccac

SEQ ID NO: 7423941 - DNA, 22 bp, Homo sapiens
acccagggtagaacctcagagc

SEQ ID NO: 7423942 - DNA, 22 bp, Homo sapiens
acccagggtagaacctcagagc

SEQ ID NO: 7423943 - DNA, 19 bp, Homo sapiens
acccaggggtttatgtgtg

SEQ ID NO: 7423944 - DNA, 22 bp, Homo sapiens
acccagggtagaacctcagagc

SEQ ID NO: 7423945 - DNA, 22 bp, Homo sapiens
aaggtggtcttactgatggtat

SEQ ID NO: 7423946 - DNA, 22 bp, Homo sapiens
acccagggtagaacctcagagc

SEQ ID NO: 7423947 - DNA, 22 bp, Homo sapiens
acccagggtagaacctcagagc

SEQ ID NO: 7423948 - DNA, 22 bp, Homo sapiens
acccagggtagaacctcagagc

SEQ ID NO: 7423949 - DNA, 22 bp, Homo sapiens
aaggtggtttgattatcccact

SEQ ID NO: 7423950 - DNA, 22 bp, Homo sapiens
aaggtggttcgctggtacccag

SEQ ID NO: 7423951 - DNA, 22 bp, Homo sapiens
aaggtggttgtaggctggtctg

SEQ ID NO: 7423952 - DNA, 22 bp, Homo sapiens
aaggtggttgtaggctggtctg

SEQ ID NO: 7423953 - DNA, 22 bp, Homo sapiens
aaggtggtgcttctgctcctct

SEQ ID NO: 7423954 - DNA, 22 bp, Homo sapiens
aaggtggtgagtacagttaggt

SEQ ID NO: 7423955 - DNA, 22 bp, Homo sapiens
acccagggcagccagcggggag

SEQ ID NO: 7423956 - DNA, 22 bp, Homo sapiens
acccagggcagccagcggggag

SEQ ID NO: 7423957 - DNA, 22 bp, Homo sapiens
acccagggcagccagcggggag

SEQ ID NO: 7423958 - DNA, 22 bp, Homo sapiens
acccagggagtgctcctgttct

SEQ ID NO: 7423959 - DNA, 22 bp, Homo sapiens
acccagggagtgctcctgttct

SEQ ID NO: 7423960 - DNA, 22 bp, Homo sapiens
acccagggagtgctcctgttct

SEQ ID NO: 7423961 - DNA, 22 bp, Homo sapiens
acccaggccattggcaagagtc

SEQ ID NO: 7423962 - DNA, 22 bp, Homo sapiens
acccaggccattggcaagagtc

SEQ ID NO: 7423963 - DNA, 22 bp, Homo sapiens
acccaggccattggcaagagtc

SEQ ID NO: 7423964 - DNA, 22 bp, Homo sapiens
acccaggccattggcaagagtc

SEQ ID NO: 7423965 - DNA, 22 bp, Homo sapiens
acccagggctcaagcgtaggca

SEQ ID NO: 7423966 - DNA, 22 bp, Homo sapiens
acccagggctcaagcgtaggca

SEQ ID NO: 7423967 - DNA, 22 bp, Homo sapiens
acccagggctcaagcgtaggca

SEQ ID NO: 7423968 - DNA, 22 bp, Homo sapiens
acccagggccacagcccgcagt

SEQ ID NO: 7423969 - DNA, 22 bp, Homo sapiens
acccagggccacagcccgcagt

SEQ ID NO: 7423970 - DNA, 22 bp, Homo sapiens
acccagggcagccagcggggag

SEQ ID NO: 7423971 - DNA, 22 bp, Homo sapiens
acccagggcagccagcggggag

SEQ ID NO: 7423972 - DNA, 22 bp, Homo sapiens
acccaggggcagccttgctgtg

SEQ ID NO: 7423973 - DNA, 22 bp, Homo sapiens
acccaggggcagccttgctgtg

SEQ ID NO: 7423974 - DNA, 22 bp, Homo sapiens
acccaggggcagccttgctgtg

SEQ ID NO: 7423975 - DNA, 21 bp, Homo sapiens
acccaggggaagcagaaactg

SEQ ID NO: 7423976 - DNA, 21 bp, Homo sapiens
acccaggggaagcagaaactg

SEQ ID NO: 7423977 - DNA, 21 bp, Homo sapiens
acccaggggaagcagaaactg

SEQ ID NO: 7423978 - DNA, 22 bp, Homo sapiens
acccagggcttaaggcggtgca

SEQ ID NO: 7423979 - DNA, 22 bp, Homo sapiens
acccagggcttaaggcggtgca

SEQ ID NO: 7423980 - DNA, 22 bp, Homo sapiens
acccagggcttaaggcggtgca

SEQ ID NO: 7423981 - DNA, 22 bp, Homo sapiens
acccagggcttaaggcggtgca

SEQ ID NO: 7423982 - DNA, 22 bp, Homo sapiens
acccagggcttaaggcggtgca

SEQ ID NO: 7423983 - DNA, 22 bp, Homo sapiens
acccagggctcaagcgtaggca

SEQ ID NO: 7423984 - DNA, 22 bp, Homo sapiens
acccagggctcaagcgtaggca

SEQ ID NO: 7423985 - DNA, 22 bp, Homo sapiens
acccagggctcaagcgtaggca

SEQ ID NO: 7423986 - DNA, 17 bp, Homo sapiens
acctattgatctgtcac

SEQ ID NO: 7423987 - DNA, 17 bp, Homo sapiens
acctattgatctgtcac

SEQ ID NO: 7423988 - DNA, 17 bp, Homo sapiens
acctattgatctgtcac

SEQ ID NO: 7423989 - DNA, 22 bp, Homo sapiens
acctatttatgcaattatgaaa

SEQ ID NO: 7423990 - DNA, 22 bp, Homo sapiens
acctatttatgcaattatgaaa

SEQ ID NO: 7423991 - DNA, 21 bp, Homo sapiens
acctcctggcatcctgttccc

SEQ ID NO: 7423992 - DNA, 20 bp, Homo sapiens
acctcctggaagcaggtgcc

SEQ ID NO: 7423993 - DNA, 20 bp, Homo sapiens
acctcctggaagcaggtgcc

SEQ ID NO: 7423994 - DNA, 22 bp, Homo sapiens
acctatcagccctgtggtttag

SEQ ID NO: 7423995 - DNA, 22 bp, Homo sapiens
aaggtgtcactgggacaggaaa

SEQ ID NO: 7423996 - DNA, 20 bp, Homo sapiens
acctagtacaatctgtttct

SEQ ID NO: 7423997 - DNA, 22 bp, Homo sapiens
aaggtgtcaccagattggcagg

SEQ ID NO: 7423998 - DNA, 22 bp, Homo sapiens
aaggtgtcaccagattggcagg

SEQ ID NO: 7423999 - DNA, 22 bp, Homo sapiens
acctcctggcctcaagcaatcc

SEQ ID NO: 7424000 - DNA, 22 bp, Homo sapiens
acctcctggcctcaagcaatcc

SEQ ID NO: 7424001 - DNA, 20 bp, Homo sapiens
acctcctggcgggcatcctc

SEQ ID NO: 7424002 - DNA, 20 bp, Homo sapiens
acctcctggcgggcatcctc

SEQ ID NO: 7424003 - DNA, 22 bp, Homo sapiens
acctcctggctgctcatggaac

SEQ ID NO: 7424004 - DNA, 22 bp, Homo sapiens
acctcctggctgctcatggaac

SEQ ID NO: 7424005 - DNA, 22 bp, Homo sapiens
acctcctggctgctcatggaac

SEQ ID NO: 7424006 - DNA, 22 bp, Homo sapiens
acctcctggtgcccaagtgttt

SEQ ID NO: 7424007 - DNA, 22 bp, Homo sapiens
acctctcaggtcttcctcatat

SEQ ID NO: 7424008 - DNA, 22 bp, Homo sapiens
acctctaaaaaattagaagcct

SEQ ID NO: 7424009 - DNA, 22 bp, Homo sapiens
acctcctggtgcccaagtgttt

SEQ ID NO: 7424010 - DNA, 22 bp, Homo sapiens
acctcctggtgcccaagtgttt

SEQ ID NO: 7424011 - DNA, 22 bp, Homo sapiens
acctcctggcttatcatggaca

SEQ ID NO: 7424012 - DNA, 22 bp, Homo sapiens
acctcctggcttatcatggaca

SEQ ID NO: 7424013 - DNA, 22 bp, Homo sapiens
acctcctggcttatcatggaca

SEQ ID NO: 7424014 - DNA, 22 bp, Homo sapiens
acctctcagggccttggtttcc

SEQ ID NO: 7424015 - DNA, 22 bp, Homo sapiens
acctctcaggtcttcctcatat

SEQ ID NO: 7424016 - DNA, 22 bp, Homo sapiens
acctctctgggcctgcttcctg

SEQ ID NO: 7424017 - DNA, 22 bp, Homo sapiens
acctctcaggtcttcctcatat

SEQ ID NO: 7424018 - DNA, 22 bp, Homo sapiens
acctctctgggcctgcttcctg

SEQ ID NO: 7424019 - DNA, 22 bp, Homo sapiens
acctctctgggcctgcttcctg

SEQ ID NO: 7424020 - DNA, 15 bp, Homo sapiens
acctctctcgctggc

SEQ ID NO: 7424021 - DNA, 22 bp, Homo sapiens
acctctcttgtagctgctggtg

SEQ ID NO: 7424022 - DNA, 22 bp, Homo sapiens
acctctcttgtagctgctggtg

SEQ ID NO: 7424023 - DNA, 22 bp, Homo sapiens
acctctgaagggccaagcaatg

SEQ ID NO: 7424024 - DNA, 22 bp, Homo sapiens
acctctgaacatttttaagact

SEQ ID NO: 7424025 - DNA, 22 bp, Homo sapiens
acctctgaaggtttacatttcc

SEQ ID NO: 7424026 - DNA, 19 bp, Homo sapiens
acctctgagaatgccagtc

SEQ ID NO: 7424027 - DNA, 20 bp, Homo sapiens
acctctgacccagagcaggc

SEQ ID NO: 7424028 - DNA, 20 bp, Homo sapiens
acctctgacccagagcaggc

SEQ ID NO: 7424029 - DNA, 22 bp, Homo sapiens
acctctgacctctgagagagaa

SEQ ID NO: 7424030 - DNA, 22 bp, Homo sapiens
acctctgacctctgagagagaa

SEQ ID NO: 7424031 - DNA, 22 bp, Homo sapiens
acctctgcaatgcaatgtcatg

SEQ ID NO: 7424032 - DNA, 22 bp, Homo sapiens
acctctgcaatgcaatgtcatg

SEQ ID NO: 7424033 - DNA, 22 bp, Homo sapiens
acctctgcaaccctggaatggg

SEQ ID NO: 7424034 - DNA, 22 bp, Homo sapiens
acctctgcaaccctggaatggg

SEQ ID NO: 7424035 - DNA, 22 bp, Homo sapiens
acctctgagccatggaaggtga

SEQ ID NO: 7424036 - DNA, 22 bp, Homo sapiens
acctctgagccatggaaggtga

SEQ ID NO: 7424037 - DNA, 19 bp, Homo sapiens
acctctgagaatgccagtc

SEQ ID NO: 7424038 - DNA, 22 bp, Homo sapiens
acctctgaggtgaggaggagct

SEQ ID NO: 7424039 - DNA, 22 bp, Homo sapiens
acctctgaggtgaggaggagct

SEQ ID NO: 7424040 - DNA, 22 bp, Homo sapiens
acctctggcaccccctggcttg

SEQ ID NO: 7424041 - DNA, 22 bp, Homo sapiens
acctctggcaccccctggcttg

SEQ ID NO: 7424042 - DNA, 22 bp, Homo sapiens
acctctggcaccccctggcttg

SEQ ID NO: 7424043 - DNA, 22 bp, Homo sapiens
acctctggacactgcatccttc

SEQ ID NO: 7424044 - DNA, 22 bp, Homo sapiens
acctctggacactgcatccttc

SEQ ID NO: 7424045 - DNA, 22 bp, Homo sapiens
acctctggacactgcatccttc

SEQ ID NO: 7424046 - DNA, 22 bp, Homo sapiens
acctctggacactgcatccttc

SEQ ID NO: 7424047 - DNA, 22 bp, Homo sapiens
acctctggacactgcatccttc

SEQ ID NO: 7424048 - DNA, 22 bp, Homo sapiens
acctctggacactgcatccttc

SEQ ID NO: 7424049 - DNA, 22 bp, Homo sapiens
acctctgctcaagacccctccg

SEQ ID NO: 7424050 - DNA, 22 bp, Homo sapiens
acctctgcttcccgggttcaag

SEQ ID NO: 7424051 - DNA, 22 bp, Homo sapiens
acctctgccactttctaactct

SEQ ID NO: 7424052 - DNA, 22 bp, Homo sapiens
acctctgccaagatgtgctccc

SEQ ID NO: 7424053 - DNA, 19 bp, Homo sapiens
acctctgcagagatgttta

SEQ ID NO: 7424054 - DNA, 19 bp, Homo sapiens
acctctgcagagatgttta

SEQ ID NO: 7424055 - DNA, 22 bp, Homo sapiens
acctctgcagtagggctgtgcc

SEQ ID NO: 7424056 - DNA, 20 bp, Homo sapiens
acctctgcatcaatcctttg

SEQ ID NO: 7424057 - DNA, 22 bp, Homo sapiens
aagctgtgtattacagaatatt

SEQ ID NO: 7424058 - DNA, 22 bp, Homo sapiens
aagctgtgtattacagaatatt

SEQ ID NO: 7424059 - DNA, 22 bp, Homo sapiens
aagctgtgtgactatttctgag

SEQ ID NO: 7424060 - DNA, 22 bp, Homo sapiens
aagctgtgtgactatttctgag

SEQ ID NO: 7424061 - DNA, 22 bp, Homo sapiens
aagctgtgtaagttgcttggtt

SEQ ID NO: 7424062 - DNA, 22 bp, Homo sapiens
aagctgtgtgcagatgatctca

SEQ ID NO: 7424063 - DNA, 22 bp, Homo sapiens
aagctgtgtgcagatgatctca

SEQ ID NO: 7424064 - DNA, 22 bp, Homo sapiens
aagctggatgtaggatccccct

SEQ ID NO: 7424065 - DNA, 22 bp, Homo sapiens
aagctgtgtgcagatgatctca

SEQ ID NO: 7424066 - DNA, 21 bp, Homo sapiens
aagctgtgttccactgatagc

SEQ ID NO: 7424067 - DNA, 22 bp, Homo sapiens
aagctgtgagctggatgctcca

SEQ ID NO: 7424068 - DNA, 22 bp, Homo sapiens
aagctgtgagctggatgctcca

SEQ ID NO: 7424069 - DNA, 22 bp, Homo sapiens
aagctgtgaaatctctagtgca

SEQ ID NO: 7424070 - DNA, 22 bp, Homo sapiens
aagctgtgaaatctctagtgca

SEQ ID NO: 7424071 - DNA, 22 bp, Homo sapiens
aagctgtgaaatctctagtgca

SEQ ID NO: 7424072 - DNA, 22 bp, Homo sapiens
aagctgtgaagagcaagtgagg

SEQ ID NO: 7424073 - DNA, 22 bp, Homo sapiens
aagctgtgcaggaactgcttgc

SEQ ID NO: 7424074 - DNA, 22 bp, Homo sapiens
aagctgtgcaggaactgcttgc

SEQ ID NO: 7424075 - DNA, 22 bp, Homo sapiens
aagctgtgcctttgcctagaat

SEQ ID NO: 7424076 - DNA, 22 bp, Homo sapiens
aagctgtgcctttgcctagaat

SEQ ID NO: 7424077 - DNA, 22 bp, Homo sapiens
aagctgtgcctttgcctagaat

SEQ ID NO: 7424078 - DNA, 22 bp, Homo sapiens
aagctgtggcttggaggaaaca

SEQ ID NO: 7424079 - DNA, 22 bp, Homo sapiens
acagctggacaggggagagttt

SEQ ID NO: 7424080 - DNA, 22 bp, Homo sapiens
acagctggacaggggagagttt

SEQ ID NO: 7424081 - DNA, 22 bp, Homo sapiens
acagctggacaggggagagttt

SEQ ID NO: 7424082 - DNA, 22 bp, Homo sapiens
acagctggagccctatggctgg

SEQ ID NO: 7424083 - DNA, 22 bp, Homo sapiens
acagctggacaggggagagttt

SEQ ID NO: 7424084 - DNA, 22 bp, Homo sapiens
acagctggacaggggagagttt

SEQ ID NO: 7424085 - DNA, 22 bp, Homo sapiens
acagctggagccctatggctgg

SEQ ID NO: 7424086 - DNA, 22 bp, Homo sapiens
acagctggaggccccattgtcc

SEQ ID NO: 7424087 - DNA, 22 bp, Homo sapiens
acagctggaggccccattgtcc

SEQ ID NO: 7424088 - DNA, 22 bp, Homo sapiens
acagctggaggccccattgtcc

SEQ ID NO: 7424089 - DNA, 22 bp, Homo sapiens
acagctggaggggctgcagagg

SEQ ID NO: 7424090 - DNA, 22 bp, Homo sapiens
acagctggaggccccattgtcc

SEQ ID NO: 7424091 - DNA, 22 bp, Homo sapiens
acagctggaggccccattgtcc

SEQ ID NO: 7424092 - DNA, 22 bp, Homo sapiens
acagctggaggggctgcagagg

SEQ ID NO: 7424093 - DNA, 22 bp, Homo sapiens
acagctggaggggctgcagagg

SEQ ID NO: 7424094 - DNA, 22 bp, Homo sapiens
acagctggaggggctgcagagg

SEQ ID NO: 7424095 - DNA, 22 bp, Homo sapiens
acagctggaggggctgcagagg

SEQ ID NO: 7424096 - DNA, 22 bp, Homo sapiens
acagctggaggggctgcagagg

SEQ ID NO: 7424097 - DNA, 22 bp, Homo sapiens
acagctggaggtctgtgagcac

SEQ ID NO: 7424098 - DNA, 22 bp, Homo sapiens
acagctggaggtctgtgagcac

SEQ ID NO: 7424099 - DNA, 22 bp, Homo sapiens
acagctggaggtctgtgagcac

SEQ ID NO: 7424100 - DNA, 22 bp, Homo sapiens
aagctggatgccttcctcccaa

SEQ ID NO: 7424101 - DNA, 22 bp, Homo sapiens
aagctggatgtaggatccccct

SEQ ID NO: 7424102 - DNA, 22 bp, Homo sapiens
aagctggatgccttcctcccaa

SEQ ID NO: 7424103 - DNA, 22 bp, Homo sapiens
aagctggatgtaggatccccct

SEQ ID NO: 7424104 - DNA, 22 bp, Homo sapiens
aagctggcaaacaagcatcatt

SEQ ID NO: 7424105 - DNA, 22 bp, Homo sapiens
aagctgtgaaatctctagtgca

SEQ ID NO: 7424106 - DNA, 22 bp, Homo sapiens
aagctggcaaacaagcatcatt

SEQ ID NO: 7424107 - DNA, 22 bp, Homo sapiens
aagctggaggctgagatcacca

SEQ ID NO: 7424108 - DNA, 22 bp, Homo sapiens
aagctggatgccttcctcccaa

SEQ ID NO: 7424109 - DNA, 22 bp, Homo sapiens
aagctggagtgcagtgcaatgg

SEQ ID NO: 7424110 - DNA, 22 bp, Homo sapiens
aagctggagtgcagtgcaatgg

SEQ ID NO: 7424111 - DNA, 22 bp, Homo sapiens
aagctggaggctgagatcacca

SEQ ID NO: 7424112 - DNA, 22 bp, Homo sapiens
aagctggaggctgagatcacca

SEQ ID NO: 7424113 - DNA, 22 bp, Homo sapiens
aagctggagagtttcacagatg

SEQ ID NO: 7424114 - DNA, 22 bp, Homo sapiens
aagctggaggctgagatcacca

SEQ ID NO: 7424115 - DNA, 22 bp, Homo sapiens
aagctggagagtttcacagatg

SEQ ID NO: 7424116 - DNA, 22 bp, Homo sapiens
aagctggagagtttcacagatg

SEQ ID NO: 7424117 - DNA, 22 bp, Homo sapiens
aagctggagagtttcacagatg

SEQ ID NO: 7424118 - DNA, 22 bp, Homo sapiens
acagctggagtgttggtgaggt

SEQ ID NO: 7424119 - DNA, 22 bp, Homo sapiens
acagctggagtgttggtgaggt

SEQ ID NO: 7424120 - DNA, 22 bp, Homo sapiens
acagctggagtgaggatggagt

SEQ ID NO: 7424121 - DNA, 22 bp, Homo sapiens
acagctggaggtctgtgagcac

SEQ ID NO: 7424122 - DNA, 22 bp, Homo sapiens
acagctggagtgaggatggagt

SEQ ID NO: 7424123 - DNA, 22 bp, Homo sapiens
aagcttgaatcaatggatatcc

SEQ ID NO: 7424124 - DNA, 22 bp, Homo sapiens
aagcttgatgcagagtcaggga

SEQ ID NO: 7424125 - DNA, 22 bp, Homo sapiens
aagcttgaggtcagtagatgtt

SEQ ID NO: 7424126 - DNA, 22 bp, Homo sapiens
aagcttgaggtcagtagatgtt

SEQ ID NO: 7424127 - DNA, 22 bp, Homo sapiens
aagcttcttagaatgcatgtgc

SEQ ID NO: 7424128 - DNA, 22 bp, Homo sapiens
aagcttgggaaccacggtaatc

SEQ ID NO: 7424129 - DNA, 21 bp, Homo sapiens
aagcttggctgatgttattgg

SEQ ID NO: 7424130 - DNA, 21 bp, Homo sapiens
aagcttggctgatgttattgg

SEQ ID NO: 7424131 - DNA, 22 bp, Homo sapiens
aagcttggaagtcttcctttca

SEQ ID NO: 7424132 - DNA, 22 bp, Homo sapiens
aagcttggaagtcttcctttca

SEQ ID NO: 7424133 - DNA, 22 bp, Homo sapiens
aagcttgattgtagtctagaca

SEQ ID NO: 7424134 - DNA, 22 bp, Homo sapiens
aagcttgattgtagtctagaca

SEQ ID NO: 7424135 - DNA, 22 bp, Homo sapiens
aagcttgcagggcataatttgc

SEQ ID NO: 7424136 - DNA, 22 bp, Homo sapiens
aagcttgcagggcataatttgc

SEQ ID NO: 7424137 - DNA, 22 bp, Homo sapiens
aaggaagaagggaagttactta

SEQ ID NO: 7424138 - DNA, 22 bp, Homo sapiens
aaggaagaagggaagttactta

SEQ ID NO: 7424139 - DNA, 22 bp, Homo sapiens
aaggaagaagggaagttactta

SEQ ID NO: 7424140 - DNA, 22 bp, Homo sapiens
aaggaagaagggaagttactta

SEQ ID NO: 7424141 - DNA, 22 bp, Homo sapiens
aaggaagaagggaagttactta

SEQ ID NO: 7424142 - DNA, 22 bp, Homo sapiens
aaggaagaagggaagttactta

SEQ ID NO: 7424143 - DNA, 22 bp, Homo sapiens
aagcttgggaaccacggtaatc

SEQ ID NO: 7424144 - DNA, 23 bp, Homo sapiens
aagcttccttgactggcccctag

SEQ ID NO: 7424145 - DNA, 21 bp, Homo sapiens
aagcttggctgatgttattgg

SEQ ID NO: 7424146 - DNA, 22 bp, Homo sapiens
aagcttgtactgtagtttgttg

SEQ ID NO: 7424147 - DNA, 22 bp, Homo sapiens
aagcttgtactgtagtttgttg

SEQ ID NO: 7424148 - DNA, 22 bp, Homo sapiens
aagcttgtactgtagtttgttg

SEQ ID NO: 7424149 - DNA, 22 bp, Homo sapiens
aagcttgtagagtttgacttcc

SEQ ID NO: 7424150 - DNA, 22 bp, Homo sapiens
aagcttgtagagtttgacttcc

SEQ ID NO: 7424151 - DNA, 22 bp, Homo sapiens
aagcttgtagagtttgacttcc

SEQ ID NO: 7424152 - DNA, 23 bp, Homo sapiens
aagcttgtcaccatttctttcag

SEQ ID NO: 7424153 - DNA, 23 bp, Homo sapiens
aagcttccttcacgtctcctggg

SEQ ID NO: 7424154 - DNA, 20 bp, Homo sapiens
aagcttccaggatctggtgt

SEQ ID NO: 7424155 - DNA, 22 bp, Homo sapiens
aagcttcctgaatgctcattta

SEQ ID NO: 7424156 - DNA, 21 bp, Homo sapiens
aagcttccctgctctccaggg

SEQ ID NO: 7424157 - DNA, 22 bp, Homo sapiens
aagcttcatttcaactcagggg

SEQ ID NO: 7424158 - DNA, 22 bp, Homo sapiens
aagcttcctgcatgggactgct

SEQ ID NO: 7424159 - DNA, 20 bp, Homo sapiens
aagcttccttgggcgcccgg

SEQ ID NO: 7424160 - DNA, 23 bp, Homo sapiens
aagcttccttgactggcccctag

SEQ ID NO: 7424161 - DNA, 22 bp, Homo sapiens
aagcttcttagaatgcatgtgc

SEQ ID NO: 7424162 - DNA, 22 bp, Homo sapiens
aagctgttctgaatcagtaagt

SEQ ID NO: 7424163 - DNA, 22 bp, Homo sapiens
aagctgttctgaatcagtaagt

SEQ ID NO: 7424164 - DNA, 22 bp, Homo sapiens
aagctgttctgaatcagtaagt

SEQ ID NO: 7424165 - DNA, 22 bp, Homo sapiens
aagctgttctctaagtttcatg

SEQ ID NO: 7424166 - DNA, 22 bp, Homo sapiens
aagctgttctccagtgactcag

SEQ ID NO: 7424167 - DNA, 22 bp, Homo sapiens
aagctgttctccagtgactcag

SEQ ID NO: 7424168 - DNA, 22 bp, Homo sapiens
aagctgttaatggcttgcagct

SEQ ID NO: 7424169 - DNA, 22 bp, Homo sapiens
aagctgttagggagtggtaggt

SEQ ID NO: 7424170 - DNA, 22 bp, Homo sapiens
aagctgttagggagtggtaggt

SEQ ID NO: 7424171 - DNA, 22 bp, Homo sapiens
aagctgttctccagtgactcag

SEQ ID NO: 7424172 - DNA, 22 bp, Homo sapiens
aagctgttatcttctggcggac

SEQ ID NO: 7424173 - DNA, 22 bp, Homo sapiens
aagctgttatcttctggcggac

SEQ ID NO: 7424174 - DNA, 22 bp, Homo sapiens
aagctgttgttcatcctgaatt

SEQ ID NO: 7424175 - DNA, 22 bp, Homo sapiens
aagctgttgccctgctctttct

SEQ ID NO: 7424176 - DNA, 22 bp, Homo sapiens
aagctgttgaagtaattcagcc

SEQ ID NO: 7424177 - DNA, 22 bp, Homo sapiens
aagctgtttgcagtggatggag

SEQ ID NO: 7424178 - DNA, 22 bp, Homo sapiens
aagctgttttggccttagttga

SEQ ID NO: 7424179 - DNA, 22 bp, Homo sapiens
aagctgttgttcatcctgaatt

SEQ ID NO: 7424180 - DNA, 22 bp, Homo sapiens
aagctgttgttcatcctgaatt

SEQ ID NO: 7424181 - DNA, 22 bp, Homo sapiens
aagctgtttgcagtggatggag

SEQ ID NO: 7424182 - DNA, 22 bp, Homo sapiens
aagcttcaggcccacccatgtc

SEQ ID NO: 7424183 - DNA, 22 bp, Homo sapiens
aagcttcaggcccacccatgtc

SEQ ID NO: 7424184 - DNA, 22 bp, Homo sapiens
aagcttcagtggactgtagtgt

SEQ ID NO: 7424185 - DNA, 22 bp, Homo sapiens
aagcttcagtggactgtagtgt

SEQ ID NO: 7424186 - DNA, 22 bp, Homo sapiens
aagcttcatctgatgccgaact

SEQ ID NO: 7424187 - DNA, 22 bp, Homo sapiens
aagcttcatatatgtgtgagtc

SEQ ID NO: 7424188 - DNA, 22 bp, Homo sapiens
aagcttcagttctggggcaatg

SEQ ID NO: 7424189 - DNA, 22 bp, Homo sapiens
aagcttcagtgtgagcatgtaa

SEQ ID NO: 7424190 - DNA, 22 bp, Homo sapiens
aagcttcagtgtgagcatgtaa

SEQ ID NO: 7424191 - DNA, 22 bp, Homo sapiens
aagctgtttttaggtggaggta

SEQ ID NO: 7424192 - DNA, 22 bp, Homo sapiens
aagcttcaatgagataattgtt

SEQ ID NO: 7424193 - DNA, 20 bp, Homo sapiens
aagcttcacttcatttgatc

SEQ ID NO: 7424194 - DNA, 22 bp, Homo sapiens
aagcttcacattgaacttgggt

SEQ ID NO: 7424195 - DNA, 22 bp, Homo sapiens
aagcttcacattgaacttgggt

SEQ ID NO: 7424196 - DNA, 23 bp, Homo sapiens
aaggatctctgagatcatggctt

SEQ ID NO: 7424197 - DNA, 22 bp, Homo sapiens
aaggatcatagtaaacattgat

SEQ ID NO: 7424198 - DNA, 22 bp, Homo sapiens
aaggatcatgtatatgtttaag

SEQ ID NO: 7424199 - DNA, 22 bp, Homo sapiens
aaggatcatgtatatgtttaag

SEQ ID NO: 7424200 - DNA, 22 bp, Homo sapiens
aaggagggaaagcagtgcttct

SEQ ID NO: 7424201 - DNA, 22 bp, Homo sapiens
aaggagggaaagcagtgcttct

SEQ ID NO: 7424202 - DNA, 22 bp, Homo sapiens
aaggaggccctctccttctgga

SEQ ID NO: 7424203 - DNA, 22 bp, Homo sapiens
aaggaggcctgcgagaaggggc

SEQ ID NO: 7424204 - DNA, 22 bp, Homo sapiens
aaggaggcctgcgagaaggggc

SEQ ID NO: 7424205 - DNA, 22 bp, Homo sapiens
aaggaggcctggcagatgaaga

SEQ ID NO: 7424206 - DNA, 22 bp, Homo sapiens
aaggaggcctggcagatgaaga

SEQ ID NO: 7424207 - DNA, 22 bp, Homo sapiens
aaggatgtcagtcattttggat

SEQ ID NO: 7424208 - DNA, 22 bp, Homo sapiens
aaggatgattggtaatgacact

SEQ ID NO: 7424209 - DNA, 22 bp, Homo sapiens
aaggatctgacagactatagaa

SEQ ID NO: 7424210 - DNA, 22 bp, Homo sapiens
aaggatctgacagactatagaa

SEQ ID NO: 7424211 - DNA, 22 bp, Homo sapiens
aaggatctgacagactatagaa

SEQ ID NO: 7424212 - DNA, 22 bp, Homo sapiens
aaggatgaacattaatacatca

SEQ ID NO: 7424213 - DNA, 22 bp, Homo sapiens
aaggcaaaagaggtgtcatcac

SEQ ID NO: 7424214 - DNA, 22 bp, Homo sapiens
aaggcaaatgtgttcttttagt

SEQ ID NO: 7424215 - DNA, 22 bp, Homo sapiens
aaggcaaatgtgttcttttagt

SEQ ID NO: 7424216 - DNA, 22 bp, Homo sapiens
aaggcaaatgtgttcttttagt

SEQ ID NO: 7424217 - DNA, 22 bp, Homo sapiens
aaggcaaatgtgttcttttagt

SEQ ID NO: 7424218 - DNA, 22 bp, Homo sapiens
aaggcaaatgtgttcttttagt

SEQ ID NO: 7424219 - DNA, 22 bp, Homo sapiens
aaggatttttggaatgagatgg

SEQ ID NO: 7424220 - DNA, 22 bp, Homo sapiens
aaggatttttggaatgagatgg

SEQ ID NO: 7424221 - DNA, 22 bp, Homo sapiens
aaggatttttgctaggaagaca

SEQ ID NO: 7424222 - DNA, 22 bp, Homo sapiens
aaggcaaaagaggtgtcatcac

SEQ ID NO: 7424223 - DNA, 22 bp, Homo sapiens
aaggcaaaagaggtgtcatcac

SEQ ID NO: 7424224 - DNA, 22 bp, Homo sapiens
aaggcaaaagaggtgtcatcac

SEQ ID NO: 7424225 - DNA, 22 bp, Homo sapiens
aaggcaaaagaggtgtcatcac

SEQ ID NO: 7424226 - DNA, 22 bp, Homo sapiens
aaggatttttggaatgagatgg

SEQ ID NO: 7424227 - DNA, 22 bp, Homo sapiens
aaggatgtttaagttttgcagt

SEQ ID NO: 7424228 - DNA, 22 bp, Homo sapiens
aaggatgtggcatttttcatat

SEQ ID NO: 7424229 - DNA, 22 bp, Homo sapiens
aaggatgttctagtttgctgag

SEQ ID NO: 7424230 - DNA, 22 bp, Homo sapiens
aaggatgtgactcagtcagcta

SEQ ID NO: 7424231 - DNA, 22 bp, Homo sapiens
aaggatgtggcatttttcatat

SEQ ID NO: 7424232 - DNA, 22 bp, Homo sapiens
aaggatgtggcatttttcatat

SEQ ID NO: 7424233 - DNA, 22 bp, Homo sapiens
aaggattccagttttacttgcc

SEQ ID NO: 7424234 - DNA, 22 bp, Homo sapiens
aaggattccagttttacttgcc

SEQ ID NO: 7424235 - DNA, 22 bp, Homo sapiens
aaggattggtctggaagcatga

SEQ ID NO: 7424236 - DNA, 22 bp, Homo sapiens
aaggattgtctggctatttatg

SEQ ID NO: 7424237 - DNA, 22 bp, Homo sapiens
aaggattgtctggctatttatg

SEQ ID NO: 7424238 - DNA, 20 bp, Homo sapiens
aaggattgttggaagcatcc

SEQ ID NO: 7424239 - DNA, 22 bp, Homo sapiens
aaggatttgtccaaagtcacac

SEQ ID NO: 7424240 - DNA, 22 bp, Homo sapiens
aaggatttgtccaaagtcacac

SEQ ID NO: 7424241 - DNA, 22 bp, Homo sapiens
aaggacaagtagtatttgcatc

SEQ ID NO: 7424242 - DNA, 22 bp, Homo sapiens
aaggacaagtagtatttgcatc

SEQ ID NO: 7424243 - DNA, 22 bp, Homo sapiens
aaggacaagtagtatttgcatc

SEQ ID NO: 7424244 - DNA, 22 bp, Homo sapiens
aaggacaatgaagacagccaca

SEQ ID NO: 7424245 - DNA, 22 bp, Homo sapiens
aaggacaatgaagacagccaca

SEQ ID NO: 7424246 - DNA, 19 bp, Homo sapiens
aaggacacaacagagatag

SEQ ID NO: 7424247 - DNA, 19 bp, Homo sapiens
aaggacacaacagagatag

SEQ ID NO: 7424248 - DNA, 22 bp, Homo sapiens
aaggacacaaaacagcagcagt

SEQ ID NO: 7424249 - DNA, 22 bp, Homo sapiens
aaggacaatgaagacagccaca

SEQ ID NO: 7424250 - DNA, 22 bp, Homo sapiens
aaggacacaaaacagcagcagt

SEQ ID NO: 7424251 - DNA, 22 bp, Homo sapiens
aaggacacctgcagagggacca

SEQ ID NO: 7424252 - DNA, 22 bp, Homo sapiens
aaggacacctgcagagggacca

SEQ ID NO: 7424253 - DNA, 18 bp, Homo sapiens
aaggacacagtccctgct

SEQ ID NO: 7424254 - DNA, 18 bp, Homo sapiens
aaggacacagtccctgct

SEQ ID NO: 7424255 - DNA, 22 bp, Homo sapiens
aaggacagaaacagattgctgg

SEQ ID NO: 7424256 - DNA, 22 bp, Homo sapiens
aaggacacggggctggctctgg

SEQ ID NO: 7424257 - DNA, 22 bp, Homo sapiens
aaggacagaaacagattgctgg

SEQ ID NO: 7424258 - DNA, 22 bp, Homo sapiens
aaggacagaaacagattgctgg

SEQ ID NO: 7424259 - DNA, 22 bp, Homo sapiens
aaggacagaaacagattgctgg

SEQ ID NO: 7424260 - DNA, 22 bp, Homo sapiens
aaggacagaaacagattgctgg

SEQ ID NO: 7424261 - DNA, 22 bp, Homo sapiens
aaggacagaaacagattgctgg

SEQ ID NO: 7424262 - DNA, 22 bp, Homo sapiens
aaggacaggagaaaacgggatc

SEQ ID NO: 7424263 - DNA, 22 bp, Homo sapiens
aaggacagagagccattccaga

SEQ ID NO: 7424264 - DNA, 22 bp, Homo sapiens
aaggacaggagaaaacgggatc

SEQ ID NO: 7424265 - DNA, 22 bp, Homo sapiens
aaggacaggcacagtggtggag

SEQ ID NO: 7424266 - DNA, 22 bp, Homo sapiens
aaggacaggcacagtggtggag

SEQ ID NO: 7424267 - DNA, 22 bp, Homo sapiens
aaggacaggcacagtggtggag

SEQ ID NO: 7424268 - DNA, 22 bp, Homo sapiens
aaggacaggcacagtggtggag

SEQ ID NO: 7424269 - DNA, 22 bp, Homo sapiens
aaggacaggagaaaacgggatc

SEQ ID NO: 7424270 - DNA, 22 bp, Homo sapiens
aaggacaggcacagtggtggag

SEQ ID NO: 7424271 - DNA, 22 bp, Homo sapiens
aaggacaggcacagtggtggag

SEQ ID NO: 7424272 - DNA, 22 bp, Homo sapiens
aaggacagagagccattccaga

SEQ ID NO: 7424273 - DNA, 22 bp, Homo sapiens
aaggacagaaacagattgctgg

SEQ ID NO: 7424274 - DNA, 22 bp, Homo sapiens
aaggacagagagccattccaga

SEQ ID NO: 7424275 - DNA, 22 bp, Homo sapiens
aaggacagagagccattccaga

SEQ ID NO: 7424276 - DNA, 22 bp, Homo sapiens
aaggacagagagccattccaga

SEQ ID NO: 7424277 - DNA, 22 bp, Homo sapiens
aaggacagagagccattccaga

SEQ ID NO: 7424278 - DNA, 22 bp, Homo sapiens
aaggacagagagccattccaga

SEQ ID NO: 7424279 - DNA, 22 bp, Homo sapiens
aaggaagggaaatagtgatgtc

SEQ ID NO: 7424280 - DNA, 22 bp, Homo sapiens
aaggaagggaaatagtgatgtc

SEQ ID NO: 7424281 - DNA, 22 bp, Homo sapiens
aaggaagggaaatagtgatgtc

SEQ ID NO: 7424282 - DNA, 22 bp, Homo sapiens
aaggaaggtactcagtgattct

SEQ ID NO: 7424283 - DNA, 22 bp, Homo sapiens
aaggaagggaaatagtgatgtc

SEQ ID NO: 7424284 - DNA, 22 bp, Homo sapiens
aaggaagggaaatagtgatgtc

SEQ ID NO: 7424285 - DNA, 22 bp, Homo sapiens
aaggaagggaaatagtgatgtc

SEQ ID NO: 7424286 - DNA, 22 bp, Homo sapiens
aaggaagggaaatagtgatgtc

SEQ ID NO: 7424287 - DNA, 22 bp, Homo sapiens
aaggaagggaaatagtgatgtc

SEQ ID NO: 7424288 - DNA, 22 bp, Homo sapiens
aaggaagggaaatagtgatgtc

SEQ ID NO: 7424289 - DNA, 22 bp, Homo sapiens
aaggaagggaaatagtgatgtc

SEQ ID NO: 7424290 - DNA, 22 bp, Homo sapiens
aaggaagggaaatagtgatgtc

SEQ ID NO: 7424291 - DNA, 22 bp, Homo sapiens
aaggaaggaattgatcatgcgc

SEQ ID NO: 7424292 - DNA, 22 bp, Homo sapiens
aaggaaggaattgatcatgcgc

SEQ ID NO: 7424293 - DNA, 22 bp, Homo sapiens
aaggaagggaaatagtgatgtc

SEQ ID NO: 7424294 - DNA, 22 bp, Homo sapiens
aaggaaggaattgatcatgcgc

SEQ ID NO: 7424295 - DNA, 22 bp, Homo sapiens
aaggaagctgttagacatgcat

SEQ ID NO: 7424296 - DNA, 22 bp, Homo sapiens
aaggaagctgttagacatgcat

SEQ ID NO: 7424297 - DNA, 22 bp, Homo sapiens
aaggaaggaattgatcatgcgc

SEQ ID NO: 7424298 - DNA, 22 bp, Homo sapiens
aaggaaggaattgatcatgcgc

SEQ ID NO: 7424299 - DNA, 22 bp, Homo sapiens
aaggaaggaattgatcatgcgc

SEQ ID NO: 7424300 - DNA, 22 bp, Homo sapiens
aaggaagatgctggcctgggga

SEQ ID NO: 7424301 - DNA, 22 bp, Homo sapiens
aaggaagatgctggcctgggga

SEQ ID NO: 7424302 - DNA, 22 bp, Homo sapiens
aaggaagatgctggcctgggga

SEQ ID NO: 7424303 - DNA, 22 bp, Homo sapiens
aaggaagatgctggcctgggga

SEQ ID NO: 7424304 - DNA, 22 bp, Homo sapiens
aaggaagaatcatcacgttggg

SEQ ID NO: 7424305 - DNA, 22 bp, Homo sapiens
aaggaagaatcatcacgttggg

SEQ ID NO: 7424306 - DNA, 22 bp, Homo sapiens
aaggaagatgaggtgctgctta

SEQ ID NO: 7424307 - DNA, 22 bp, Homo sapiens
aaggaagatgaggtgctgctta

SEQ ID NO: 7424308 - DNA, 22 bp, Homo sapiens
aaggaagaatcatcacgttggg

SEQ ID NO: 7424309 - DNA, 22 bp, Homo sapiens
aaggaagaatcatcacgttggg

SEQ ID NO: 7424310 - DNA, 22 bp, Homo sapiens
aaggaagaatcatcacgttggg

SEQ ID NO: 7424311 - DNA, 22 bp, Homo sapiens
aaggaagaatcatcacgttggg

SEQ ID NO: 7424312 - DNA, 22 bp, Homo sapiens
aaggaagatgctggcctgggga

SEQ ID NO: 7424313 - DNA, 22 bp, Homo sapiens
aaggaagatgctggcctgggga

SEQ ID NO: 7424314 - DNA, 22 bp, Homo sapiens
aaggaagatgctggcctgggga

SEQ ID NO: 7424315 - DNA, 22 bp, Homo sapiens
aaggaagatgctggcctgggga

SEQ ID NO: 7424316 - DNA, 22 bp, Homo sapiens
aaggaagcagcaatgcatgatt

SEQ ID NO: 7424317 - DNA, 22 bp, Homo sapiens
aaggaagcagcaatgcatgatt

SEQ ID NO: 7424318 - DNA, 22 bp, Homo sapiens
aaggaagcagcaatgcatgatt

SEQ ID NO: 7424319 - DNA, 22 bp, Homo sapiens
aaggaagcagcaatgcatgatt

SEQ ID NO: 7424320 - DNA, 22 bp, Homo sapiens
aaggaagccttgcctgaataca

SEQ ID NO: 7424321 - DNA, 22 bp, Homo sapiens
aaggaagccttgcctgaataca

SEQ ID NO: 7424322 - DNA, 22 bp, Homo sapiens
aaggaagcagccagagaccctc

SEQ ID NO: 7424323 - DNA, 22 bp, Homo sapiens
aaggaagcagccagagaccctc

SEQ ID NO: 7424324 - DNA, 22 bp, Homo sapiens
aaggaagcagcaatgcatgatt

SEQ ID NO: 7424325 - DNA, 22 bp, Homo sapiens
aaggaaggtactcagtgattct

SEQ ID NO: 7424326 - DNA, 22 bp, Homo sapiens
aaggaaggtactcagtgattct

SEQ ID NO: 7424327 - DNA, 22 bp, Homo sapiens
aaggaaggtactcagtgattct

SEQ ID NO: 7424328 - DNA, 22 bp, Homo sapiens
aaggaaggtactcagtgattct

SEQ ID NO: 7424329 - DNA, 22 bp, Homo sapiens
aaggaaggtactcagtgattct

SEQ ID NO: 7424330 - DNA, 22 bp, Homo sapiens
aaggaaggttcatagtcaaaga

SEQ ID NO: 7424331 - DNA, 22 bp, Homo sapiens
aaggaaggttcatagtcaaaga

SEQ ID NO: 7424332 - DNA, 22 bp, Homo sapiens
aaggaaggttcatagtcaaaga

SEQ ID NO: 7424333 - DNA, 22 bp, Homo sapiens
aaggaaggttcatagtcaaaga

SEQ ID NO: 7424334 - DNA, 20 bp, Homo sapiens
aaggaatatttgtatctggg

SEQ ID NO: 7424335 - DNA, 22 bp, Homo sapiens
aaggaagttaagtcttagaatg

SEQ ID NO: 7424336 - DNA, 22 bp, Homo sapiens
aaggaaggttcatagtcaaaga

SEQ ID NO: 7424337 - DNA, 22 bp, Homo sapiens
aaggaagttaagtcttagaatg

SEQ ID NO: 7424338 - DNA, 22 bp, Homo sapiens
aaggaagttttcttggttccta

SEQ ID NO: 7424339 - DNA, 22 bp, Homo sapiens
aaggaaggttcatagtcaaaga

SEQ ID NO: 7424340 - DNA, 21 bp, Homo sapiens
aaggaagtgactttagtggtt

SEQ ID NO: 7424341 - DNA, 22 bp, Homo sapiens
aaggaagtgattttcatgtcaa

SEQ ID NO: 7424342 - DNA, 22 bp, Homo sapiens
aaggaagtgattttcatgtcaa

SEQ ID NO: 7424343 - DNA, 21 bp, Homo sapiens
aaggaagtgactttagtggtt

SEQ ID NO: 7424344 - DNA, 22 bp, Homo sapiens
aaggaaggttcatagtcaaaga

SEQ ID NO: 7424345 - DNA, 21 bp, Homo sapiens
aaggaatgaatggatggatga

SEQ ID NO: 7424346 - DNA, 22 bp, Homo sapiens
aaggaatgctctaggagggcag

SEQ ID NO: 7424347 - DNA, 17 bp, Homo sapiens
aaggaatgtcagaagtt

SEQ ID NO: 7424348 - DNA, 19 bp, Homo sapiens
aaggaatggctttaagtag

SEQ ID NO: 7424349 - DNA, 22 bp, Homo sapiens
aaggaattccctttctgacaga

SEQ ID NO: 7424350 - DNA, 22 bp, Homo sapiens
aaggaattccctttctgacaga

SEQ ID NO: 7424351 - DNA, 16 bp, Homo sapiens
aaggaatgtcattctg

SEQ ID NO: 7424352 - DNA, 17 bp, Homo sapiens
aaggaatgtcagaagtt

SEQ ID NO: 7424353 - DNA, 17 bp, Homo sapiens
aaggaatgtcagaagtt

SEQ ID NO: 7424354 - DNA, 22 bp, Homo sapiens
aaggacaaagcagagctggatg

SEQ ID NO: 7424355 - DNA, 22 bp, Homo sapiens
aaggacaaagcagagctggatg

SEQ ID NO: 7424356 - DNA, 22 bp, Homo sapiens
aaggacaaagcagagctggatg

SEQ ID NO: 7424357 - DNA, 22 bp, Homo sapiens
aaggaatttgaggctgcagtga

SEQ ID NO: 7424358 - DNA, 22 bp, Homo sapiens
aaggacaaagcagagctggatg

SEQ ID NO: 7424359 - DNA, 22 bp, Homo sapiens
aaggaatttgaggctgcagtga

SEQ ID NO: 7424360 - DNA, 22 bp, Homo sapiens
aaggaatgctctaggagggcag

SEQ ID NO: 7424361 - DNA, 22 bp, Homo sapiens
acatctcaaattccaggctcca

SEQ ID NO: 7424362 - DNA, 22 bp, Homo sapiens
acatctcaaattccaggctcca

SEQ ID NO: 7424363 - DNA, 22 bp, Homo sapiens
acatctatgaacatttaagtag

SEQ ID NO: 7424364 - DNA, 22 bp, Homo sapiens
acatctcacttctttgaaggct

SEQ ID NO: 7424365 - DNA, 22 bp, Homo sapiens
acatctcacttctttgaaggct

SEQ ID NO: 7424366 - DNA, 22 bp, Homo sapiens
acatctatttttttctgtccat

SEQ ID NO: 7424367 - DNA, 22 bp, Homo sapiens
acatctatgaacatttaagtag

SEQ ID NO: 7424368 - DNA, 22 bp, Homo sapiens
acatctagaagatctgggagat

SEQ ID NO: 7424369 - DNA, 22 bp, Homo sapiens
acatcgtgtatcactgaacctt

SEQ ID NO: 7424370 - DNA, 22 bp, Homo sapiens
acatctaagccaattttgattt

SEQ ID NO: 7424371 - DNA, 22 bp, Homo sapiens
acatcgatggatagagcttgct

SEQ ID NO: 7424372 - DNA, 22 bp, Homo sapiens
acatcgatggtcagccgaggag

SEQ ID NO: 7424373 - DNA, 22 bp, Homo sapiens
acatctagaagatctgggagat

SEQ ID NO: 7424374 - DNA, 22 bp, Homo sapiens
acatccttggttgattaatcaa

SEQ ID NO: 7424375 - DNA, 22 bp, Homo sapiens
acatccttgattatgtaaggat

SEQ ID NO: 7424376 - DNA, 22 bp, Homo sapiens
acatccttgattatgtaaggat

SEQ ID NO: 7424377 - DNA, 22 bp, Homo sapiens
acatccttaaggttagggtttc

SEQ ID NO: 7424378 - DNA, 22 bp, Homo sapiens
acatccttgattatgtaaggat

SEQ ID NO: 7424379 - DNA, 22 bp, Homo sapiens
acatccttatataggccaatga

SEQ ID NO: 7424380 - DNA, 22 bp, Homo sapiens
acatcctcccgatctactggct

SEQ ID NO: 7424381 - DNA, 22 bp, Homo sapiens
acatcctcccgatctactggct

SEQ ID NO: 7424382 - DNA, 22 bp, Homo sapiens
acatcctcccgatctactggct

SEQ ID NO: 7424383 - DNA, 22 bp, Homo sapiens
acatcctcccgatctactggct

SEQ ID NO: 7424384 - DNA, 22 bp, Homo sapiens
acatccgcaggttataaagccc

SEQ ID NO: 7424385 - DNA, 22 bp, Homo sapiens
acatcccacagaaacatacata

SEQ ID NO: 7424386 - DNA, 22 bp, Homo sapiens
acatcccatgcgcatctggcaa

SEQ ID NO: 7424387 - DNA, 22 bp, Homo sapiens
acatccctcagtcagactgtaa

SEQ ID NO: 7424388 - DNA, 22 bp, Homo sapiens
acatccctcagtcagactgtaa

SEQ ID NO: 7424389 - DNA, 22 bp, Homo sapiens
acatcctcggggaaaggcactg

SEQ ID NO: 7424390 - DNA, 22 bp, Homo sapiens
acatcctcccgatctactggct

SEQ ID NO: 7424391 - DNA, 20 bp, Homo sapiens
acatcctggtgactagaact

SEQ ID NO: 7424392 - DNA, 20 bp, Homo sapiens
acatcctggtgactagaact

SEQ ID NO: 7424393 - DNA, 22 bp, Homo sapiens
acatcctgaagtcagtcatttg

SEQ ID NO: 7424394 - DNA, 22 bp, Homo sapiens
acatcctgaagtcagtcatttg

SEQ ID NO: 7424395 - DNA, 22 bp, Homo sapiens
acatcctgaagtcagtcatttg

SEQ ID NO: 7424396 - DNA, 22 bp, Homo sapiens
acatctcatgaatgataaatca

SEQ ID NO: 7424397 - DNA, 22 bp, Homo sapiens
acatctcagaactgagtaaccg

SEQ ID NO: 7424398 - DNA, 22 bp, Homo sapiens
acatctcatgaatgataaatca

SEQ ID NO: 7424399 - DNA, 22 bp, Homo sapiens
acatctcatgaatgataaatca

SEQ ID NO: 7424400 - DNA, 22 bp, Homo sapiens
acatgaaatgcagcctgtaacc

SEQ ID NO: 7424401 - DNA, 22 bp, Homo sapiens
acatgaaatgcagcctgtaacc

SEQ ID NO: 7424402 - DNA, 22 bp, Homo sapiens
acatctcacttctttgaaggct

SEQ ID NO: 7424403 - DNA, 22 bp, Homo sapiens
acatctcagaactgagtaaccg

SEQ ID NO: 7424404 - DNA, 22 bp, Homo sapiens
acatctcagaactgagtaaccg

SEQ ID NO: 7424405 - DNA, 22 bp, Homo sapiens
acatctcagaactgagtaaccg

SEQ ID NO: 7424406 - DNA, 22 bp, Homo sapiens
acatgaacattatatcagcaag

SEQ ID NO: 7424407 - DNA, 22 bp, Homo sapiens
acatgaacatgctcaaataact

SEQ ID NO: 7424408 - DNA, 22 bp, Homo sapiens
acatgaaattctagctgaaccc

SEQ ID NO: 7424409 - DNA, 22 bp, Homo sapiens
acatgaaatgcagcctgtaacc

SEQ ID NO: 7424410 - DNA, 22 bp, Homo sapiens
acatgaagtggtcagatcaaac

SEQ ID NO: 7424411 - DNA, 22 bp, Homo sapiens
acatgaagtggtcagatcaaac

SEQ ID NO: 7424412 - DNA, 22 bp, Homo sapiens
acatgaagcaagaaagatgcta

SEQ ID NO: 7424413 - DNA, 22 bp, Homo sapiens
acatgaagcaagaaagatgcta

SEQ ID NO: 7424414 - DNA, 22 bp, Homo sapiens
acatgaagcaagaaagatgcta

SEQ ID NO: 7424415 - DNA, 22 bp, Homo sapiens
acatgaatatatgaagttcaac

SEQ ID NO: 7424416 - DNA, 22 bp, Homo sapiens
acatgaagtggtcagatcaaac

SEQ ID NO: 7424417 - DNA, 22 bp, Homo sapiens
acatgaagtggtcagatcaaac

SEQ ID NO: 7424418 - DNA, 22 bp, Homo sapiens
acatgaatgaagactttacaat

SEQ ID NO: 7424419 - DNA, 22 bp, Homo sapiens
acatgaagtggtcagatcaaac

SEQ ID NO: 7424420 - DNA, 22 bp, Homo sapiens
acatgaatgcagccataacact

SEQ ID NO: 7424421 - DNA, 22 bp, Homo sapiens
acatgaatgaagactttacaat

SEQ ID NO: 7424422 - DNA, 22 bp, Homo sapiens
acatgacaaaatgcacaggatt

SEQ ID NO: 7424423 - DNA, 22 bp, Homo sapiens
acatgaatgcagccataacact

SEQ ID NO: 7424424 - DNA, 22 bp, Homo sapiens
acatgaatgcagccataacact

SEQ ID NO: 7424425 - DNA, 22 bp, Homo sapiens
acatgaatgcagccataacact

SEQ ID NO: 7424426 - DNA, 22 bp, Homo sapiens
acatgcatggggtaatggtatt

SEQ ID NO: 7424427 - DNA, 22 bp, Homo sapiens
acatgcatggtgttgggttgga

SEQ ID NO: 7424428 - DNA, 22 bp, Homo sapiens
acatgcatgtcatcagcccttt

SEQ ID NO: 7424429 - DNA, 22 bp, Homo sapiens
acatgcatgtcatcagcccttt

SEQ ID NO: 7424430 - DNA, 22 bp, Homo sapiens
acatgcatgtctatgggcaggt

SEQ ID NO: 7424431 - DNA, 22 bp, Homo sapiens
acatgcatgtctatgggcaggt

SEQ ID NO: 7424432 - DNA, 22 bp, Homo sapiens
acatgcatggtgttgggttgga

SEQ ID NO: 7424433 - DNA, 22 bp, Homo sapiens
acatgcatgtctatgggcaggt

SEQ ID NO: 7424434 - DNA, 22 bp, Homo sapiens
acatgcatgctttggtgggtgt

SEQ ID NO: 7424435 - DNA, 22 bp, Homo sapiens
acatgcatggacatgtatatat

SEQ ID NO: 7424436 - DNA, 22 bp, Homo sapiens
acatgcatggacatgtatatat

SEQ ID NO: 7424437 - DNA, 22 bp, Homo sapiens
acatgcatgctttggtgggtgt

SEQ ID NO: 7424438 - DNA, 22 bp, Homo sapiens
acatgcatggagggaaaatgtc

SEQ ID NO: 7424439 - DNA, 22 bp, Homo sapiens
acatgcatggagggaaaatgtc

SEQ ID NO: 7424440 - DNA, 22 bp, Homo sapiens
acatgcatggctgcttaaatta

SEQ ID NO: 7424441 - DNA, 22 bp, Homo sapiens
acatgcatggctgcttaaatta

SEQ ID NO: 7424442 - DNA, 22 bp, Homo sapiens
acatgcataggagaagtcttta

SEQ ID NO: 7424443 - DNA, 22 bp, Homo sapiens
acatgcatatacttaaatatgt

SEQ ID NO: 7424444 - DNA, 22 bp, Homo sapiens
acatgcatatacttaaatatgt

SEQ ID NO: 7424445 - DNA, 22 bp, Homo sapiens
acatgcatatacttaaatatgt

SEQ ID NO: 7424446 - DNA, 22 bp, Homo sapiens
acatgcatatacttaaatatgt

SEQ ID NO: 7424447 - DNA, 21 bp, Homo sapiens
acatgcatagagagatttctg

SEQ ID NO: 7424448 - DNA, 22 bp, Homo sapiens
acatgcatactgctgccaacgc

SEQ ID NO: 7424449 - DNA, 21 bp, Homo sapiens
acatgcatagagagatttctg

SEQ ID NO: 7424450 - DNA, 19 bp, Homo sapiens
acatgcatatggacagttg

SEQ ID NO: 7424451 - DNA, 19 bp, Homo sapiens
acatgcatatggacagttg

SEQ ID NO: 7424452 - DNA, 19 bp, Homo sapiens
acatgcatatggacagttg

SEQ ID NO: 7424453 - DNA, 22 bp, Homo sapiens
acatgcatctccaggctcattt

SEQ ID NO: 7424454 - DNA, 22 bp, Homo sapiens
acatgcatctctgggacacatg

SEQ ID NO: 7424455 - DNA, 22 bp, Homo sapiens
acatgcatgaaatccataaaca

SEQ ID NO: 7424456 - DNA, 22 bp, Homo sapiens
acatgacacaggcctggccaat

SEQ ID NO: 7424457 - DNA, 22 bp, Homo sapiens
acatgacacaggcctggccaat

SEQ ID NO: 7424458 - DNA, 22 bp, Homo sapiens
acatgacaaggtttataaggct

SEQ ID NO: 7424459 - DNA, 19 bp, Homo sapiens
acatgacaacaggggaggc

SEQ ID NO: 7424460 - DNA, 19 bp, Homo sapiens
acatgacaacaggggaggc

SEQ ID NO: 7424461 - DNA, 22 bp, Homo sapiens
acatgacaaaatgcacaggatt

SEQ ID NO: 7424462 - DNA, 22 bp, Homo sapiens
acatgacagtgactttataaga

SEQ ID NO: 7424463 - DNA, 22 bp, Homo sapiens
acatgacagtgactttataaga

SEQ ID NO: 7424464 - DNA, 22 bp, Homo sapiens
acatgacacaggcctggccaat

SEQ ID NO: 7424465 - DNA, 22 bp, Homo sapiens
acatgacacctctggctgggtg

SEQ ID NO: 7424466 - DNA, 22 bp, Homo sapiens
acatgacagtgcttagcaaact

SEQ ID NO: 7424467 - DNA, 22 bp, Homo sapiens
acatgacagtgcttagcaaact

SEQ ID NO: 7424468 - DNA, 22 bp, Homo sapiens
acatgacagtgcttagcaaact

SEQ ID NO: 7424469 - DNA, 22 bp, Homo sapiens
acatgacagggaatgaggtgaa

SEQ ID NO: 7424470 - DNA, 22 bp, Homo sapiens
acatgacagtgactttataaga

SEQ ID NO: 7424471 - DNA, 22 bp, Homo sapiens
acatgcatacacgtacatacct

SEQ ID NO: 7424472 - DNA, 22 bp, Homo sapiens
acatgcatacacgtacatacct

SEQ ID NO: 7424473 - DNA, 22 bp, Homo sapiens
acatgactataattacttaaat

SEQ ID NO: 7424474 - DNA, 17 bp, Homo sapiens
acatgactgcacaaagt

SEQ ID NO: 7424475 - DNA, 22 bp, Homo sapiens
acatgcatacgtgtgtttaaaa

SEQ ID NO: 7424476 - DNA, 22 bp, Homo sapiens
acatgcatacgtgtgtttaaaa

SEQ ID NO: 7424477 - DNA, 22 bp, Homo sapiens
acatgcatacgtgtgtttaaaa

SEQ ID NO: 7424478 - DNA, 22 bp, Homo sapiens
acatgcatactgctgccaacgc

SEQ ID NO: 7424479 - DNA, 22 bp, Homo sapiens
acatgacatagtagaaaagccc

SEQ ID NO: 7424480 - DNA, 22 bp, Homo sapiens
acatgacatagtagaaaagccc

SEQ ID NO: 7424481 - DNA, 22 bp, Homo sapiens
acatgacatagtagaaaagccc

SEQ ID NO: 7424482 - DNA, 22 bp, Homo sapiens
acatgacatagtagaaaagccc

SEQ ID NO: 7424483 - DNA, 22 bp, Homo sapiens
acatgacagtgcttagcaaact

SEQ ID NO: 7424484 - DNA, 22 bp, Homo sapiens
acatgacagtgcttagcaaact

SEQ ID NO: 7424485 - DNA, 22 bp, Homo sapiens
acatgacagtgcttagcaaact

SEQ ID NO: 7424486 - DNA, 22 bp, Homo sapiens
acatgacagtgcttagcaaact

SEQ ID NO: 7424487 - DNA, 22 bp, Homo sapiens
aaggccagattctctctagggg

SEQ ID NO: 7424488 - DNA, 22 bp, Homo sapiens
aaggccagattctctctagggg

SEQ ID NO: 7424489 - DNA, 22 bp, Homo sapiens
aaggccagattctctctagggg

SEQ ID NO: 7424490 - DNA, 22 bp, Homo sapiens
aaggccagattctctctagggg

SEQ ID NO: 7424491 - DNA, 22 bp, Homo sapiens
aaggccagattctctctagggg

SEQ ID NO: 7424492 - DNA, 22 bp, Homo sapiens
aaggccagcagtttgagaccag

SEQ ID NO: 7424493 - DNA, 22 bp, Homo sapiens
aaggccagagttgaactgctcc

SEQ ID NO: 7424494 - DNA, 22 bp, Homo sapiens
aaggccagagttgaactgctcc

SEQ ID NO: 7424495 - DNA, 22 bp, Homo sapiens
aaggccagagttgaactgctcc

SEQ ID NO: 7424496 - DNA, 22 bp, Homo sapiens
aaggccagagttgaactgctcc

SEQ ID NO: 7424497 - DNA, 22 bp, Homo sapiens
aaggccagagtactagaggctg

SEQ ID NO: 7424498 - DNA, 22 bp, Homo sapiens
aaggccagagttgaactgctcc

SEQ ID NO: 7424499 - DNA, 22 bp, Homo sapiens
aaggccagattcactttacaat

SEQ ID NO: 7424500 - DNA, 22 bp, Homo sapiens
aaggccagattcactttacaat

SEQ ID NO: 7424501 - DNA, 22 bp, Homo sapiens
aaggccagccctaatgatgctc

SEQ ID NO: 7424502 - DNA, 22 bp, Homo sapiens
aaggccagccctaatgatgctc

SEQ ID NO: 7424503 - DNA, 22 bp, Homo sapiens
aaggccagccctaatgatgctc

SEQ ID NO: 7424504 - DNA, 22 bp, Homo sapiens
aaggccagccctaatgatgctc

SEQ ID NO: 7424505 - DNA, 22 bp, Homo sapiens
aaggccagcctgagagctaaca

SEQ ID NO: 7424506 - DNA, 22 bp, Homo sapiens
aaggccagcctgagagctaaca

SEQ ID NO: 7424507 - DNA, 22 bp, Homo sapiens
aaggccagccctaatgatgctc

SEQ ID NO: 7424508 - DNA, 22 bp, Homo sapiens
aaggccagccctaatgatgctc

SEQ ID NO: 7424509 - DNA, 22 bp, Homo sapiens
acatccatttgtcagctcttga

SEQ ID NO: 7424510 - DNA, 22 bp, Homo sapiens
aaggccagcctgagagctaaca

SEQ ID NO: 7424511 - DNA, 22 bp, Homo sapiens
aaggccagccttggaaccctga

SEQ ID NO: 7424512 - DNA, 22 bp, Homo sapiens
acatccatttgtcagctcttga

SEQ ID NO: 7424513 - DNA, 22 bp, Homo sapiens
acatccattttgttcaaaagca

SEQ ID NO: 7424514 - DNA, 22 bp, Homo sapiens
acatccattttgttcaaaagca

SEQ ID NO: 7424515 - DNA, 22 bp, Homo sapiens
acatcccacagaaacatacata

SEQ ID NO: 7424516 - DNA, 22 bp, Homo sapiens
aaggcacattcctgaaaacaat

SEQ ID NO: 7424517 - DNA, 22 bp, Homo sapiens
aaggcacattcctgaaaacaat

SEQ ID NO: 7424518 - DNA, 22 bp, Homo sapiens
aaggcacattcctgaaaacaat

SEQ ID NO: 7424519 - DNA, 22 bp, Homo sapiens
aaggcacatattttagagtcac

SEQ ID NO: 7424520 - DNA, 22 bp, Homo sapiens
aaggcacatgacctaggcctgg

SEQ ID NO: 7424521 - DNA, 22 bp, Homo sapiens
aaggcacatgacctaggcctgg

SEQ ID NO: 7424522 - DNA, 22 bp, Homo sapiens
aaggcaccataggcaaatccag

SEQ ID NO: 7424523 - DNA, 22 bp, Homo sapiens
aaggcaccataggcaaatccag

SEQ ID NO: 7424524 - DNA, 22 bp, Homo sapiens
aaggcaccatgagatgctggtt

SEQ ID NO: 7424525 - DNA, 22 bp, Homo sapiens
aaggcatgtgtcctcagagaga

SEQ ID NO: 7424526 - DNA, 22 bp, Homo sapiens
aaggcattgagcagttacagta

SEQ ID NO: 7424527 - DNA, 22 bp, Homo sapiens
aaggcattcaagatggaagttg

SEQ ID NO: 7424528 - DNA, 22 bp, Homo sapiens
aaggccagagcagactggagtt

SEQ ID NO: 7424529 - DNA, 22 bp, Homo sapiens
aaggccagagcagactggagtt

SEQ ID NO: 7424530 - DNA, 22 bp, Homo sapiens
aaggccagagcagactggagtt

SEQ ID NO: 7424531 - DNA, 22 bp, Homo sapiens
aaggccagagtactagaggctg

SEQ ID NO: 7424532 - DNA, 22 bp, Homo sapiens
aaggccagagtactagaggctg

SEQ ID NO: 7424533 - DNA, 22 bp, Homo sapiens
aaggccagagcgtgtcctgcct

SEQ ID NO: 7424534 - DNA, 22 bp, Homo sapiens
aaggccagagcgtgtcctgcct

SEQ ID NO: 7424535 - DNA, 22 bp, Homo sapiens
aaggccagagcgtgtcctgcct

SEQ ID NO: 7424536 - DNA, 22 bp, Homo sapiens
aaggccagagcgtgtcctgcct

SEQ ID NO: 7424537 - DNA, 22 bp, Homo sapiens
aaggccagagtactagaggctg

SEQ ID NO: 7424538 - DNA, 22 bp, Homo sapiens
aaggccagagtactagaggctg

SEQ ID NO: 7424539 - DNA, 22 bp, Homo sapiens
aaggccagagtactagaggctg

SEQ ID NO: 7424540 - DNA, 22 bp, Homo sapiens
aaggccagagtactagaggctg

SEQ ID NO: 7424541 - DNA, 22 bp, Homo sapiens
aaggccagagtactagaggctg

SEQ ID NO: 7424542 - DNA, 22 bp, Homo sapiens
aaggccagagcagactggagtt

SEQ ID NO: 7424543 - DNA, 22 bp, Homo sapiens
aaggccagagcagactggagtt

SEQ ID NO: 7424544 - DNA, 22 bp, Homo sapiens
aaggccagagcagactggagtt

SEQ ID NO: 7424545 - DNA, 22 bp, Homo sapiens
aaggccagagcgtgtcctgcct

SEQ ID NO: 7424546 - DNA, 22 bp, Homo sapiens
aaggccagagcgtgtcctgcct

SEQ ID NO: 7424547 - DNA, 22 bp, Homo sapiens
aaggccagagcagactggagtt

SEQ ID NO: 7424548 - DNA, 22 bp, Homo sapiens
aaggccagagcgtgtcctgcct

SEQ ID NO: 7424549 - DNA, 22 bp, Homo sapiens
aaggcaaatgtgttcttttagt

SEQ ID NO: 7424550 - DNA, 22 bp, Homo sapiens
aaggcaactgtaaaacatgcac

SEQ ID NO: 7424551 - DNA, 22 bp, Homo sapiens
aaggcaactgtaaaacatgcac

SEQ ID NO: 7424552 - DNA, 22 bp, Homo sapiens
aaggcaactgtaaaacatgcac

SEQ ID NO: 7424553 - DNA, 22 bp, Homo sapiens
aaggcaagttttagttttctgg

SEQ ID NO: 7424554 - DNA, 22 bp, Homo sapiens
aaggcaaggcttccagctcccc

SEQ ID NO: 7424555 - DNA, 22 bp, Homo sapiens
aaggcaaggttcaccgtgctat

SEQ ID NO: 7424556 - DNA, 22 bp, Homo sapiens
aaggcaaggccaagccatcagt

SEQ ID NO: 7424557 - DNA, 22 bp, Homo sapiens
aaggcaaggccaagccatcagt

SEQ ID NO: 7424558 - DNA, 22 bp, Homo sapiens
aaggcaaggccaagccatcagt

SEQ ID NO: 7424559 - DNA, 22 bp, Homo sapiens
aaggcaatgaatactgtttttg

SEQ ID NO: 7424560 - DNA, 22 bp, Homo sapiens
aaggcaatattgagtttccctt

SEQ ID NO: 7424561 - DNA, 22 bp, Homo sapiens
aaggcaatgactgatttagaat

SEQ ID NO: 7424562 - DNA, 22 bp, Homo sapiens
aaggcaatgactgatttagaat

SEQ ID NO: 7424563 - DNA, 22 bp, Homo sapiens
aaggcaatatcaagagaattcg

SEQ ID NO: 7424564 - DNA, 22 bp, Homo sapiens
aaggcaatagtattaaactgga

SEQ ID NO: 7424565 - DNA, 22 bp, Homo sapiens
aaggcaagttttagttttctgg

SEQ ID NO: 7424566 - DNA, 22 bp, Homo sapiens
aaggcaatgagggagatagagt

SEQ ID NO: 7424567 - DNA, 22 bp, Homo sapiens
aaggcaatgagggagatagagt

SEQ ID NO: 7424568 - DNA, 22 bp, Homo sapiens
aaggcaatgctaagaggtttgg

SEQ ID NO: 7424569 - DNA, 22 bp, Homo sapiens
aaggcaatgagggagatagagt

SEQ ID NO: 7424570 - DNA, 22 bp, Homo sapiens
aaggcaatgtaaattacagctt

SEQ ID NO: 7424571 - DNA, 22 bp, Homo sapiens
aaggcaatggtttctgtgcctt

SEQ ID NO: 7424572 - DNA, 22 bp, Homo sapiens
aaggcaatggtttctgtgcctt

SEQ ID NO: 7424573 - DNA, 22 bp, Homo sapiens
aaggcaatgggatggatcatgt

SEQ ID NO: 7424574 - DNA, 22 bp, Homo sapiens
aaggcaatggcaagagaaagca

SEQ ID NO: 7424575 - DNA, 22 bp, Homo sapiens
aaggcaatggcaagagaaagca

SEQ ID NO: 7424576 - DNA, 22 bp, Homo sapiens
aaggcaattgattatttttcct

SEQ ID NO: 7424577 - DNA, 22 bp, Homo sapiens
aaggcaattgagaagaaacaga

SEQ ID NO: 7424578 - DNA, 22 bp, Homo sapiens
aaggcaattgagaagaaacaga

SEQ ID NO: 7424579 - DNA, 22 bp, Homo sapiens
aaggcaattgagaagaaacaga

SEQ ID NO: 7424580 - DNA, 22 bp, Homo sapiens
aaggcaatgttagcaacataat

SEQ ID NO: 7424581 - DNA, 22 bp, Homo sapiens
aaggcaatgttagcaacataat

SEQ ID NO: 7424582 - DNA, 22 bp, Homo sapiens
aaggcaatgttagcaacataat

SEQ ID NO: 7424583 - DNA, 22 bp, Homo sapiens
aaggcaatgtcatggctcttgc

SEQ ID NO: 7424584 - DNA, 22 bp, Homo sapiens
aaggcaatgtaaattacagctt

SEQ ID NO: 7424585 - DNA, 18 bp, Homo sapiens
aaggcacaggagaacatt

SEQ ID NO: 7424586 - DNA, 17 bp, Homo sapiens
aaggcacagggcactgg

SEQ ID NO: 7424587 - DNA, 18 bp, Homo sapiens
aaggcacaggagaacatt

SEQ ID NO: 7424588 - DNA, 18 bp, Homo sapiens
aaggcacaggagaacatt

SEQ ID NO: 7424589 - DNA, 18 bp, Homo sapiens
aaggcacaggagaacatt

SEQ ID NO: 7424590 - DNA, 18 bp, Homo sapiens
aaggcacaggagaacatt

SEQ ID NO: 7424591 - DNA, 22 bp, Homo sapiens
aaggcacagccacttgatcatc

SEQ ID NO: 7424592 - DNA, 22 bp, Homo sapiens
aaggcacatattgcagatcttg

SEQ ID NO: 7424593 - DNA, 22 bp, Homo sapiens
aaggcacatattgcagatcttg

SEQ ID NO: 7424594 - DNA, 22 bp, Homo sapiens
aaggcacatattgcagatcttg

SEQ ID NO: 7424595 - DNA, 17 bp, Homo sapiens
aaggcacagggcactgg

SEQ ID NO: 7424596 - DNA, 17 bp, Homo sapiens
aaggcacagggcactgg

SEQ ID NO: 7424597 - DNA, 17 bp, Homo sapiens
aaggcacagggcactgg

SEQ ID NO: 7424598 - DNA, 22 bp, Homo sapiens
aaggcacatattttagagtcac

SEQ ID NO: 7424599 - DNA, 22 bp, Homo sapiens
aaggcacatattttagagtcac

SEQ ID NO: 7424600 - DNA, 22 bp, Homo sapiens
aaggcacatattttagagtcac

SEQ ID NO: 7424601 - DNA, 22 bp, Homo sapiens
aaggcacatattttagagtcac

SEQ ID NO: 7424602 - DNA, 22 bp, Homo sapiens
aaggcacagccacttgatcatc

SEQ ID NO: 7424603 - DNA, 22 bp, Homo sapiens
aaggcacagaggcagggcactt

SEQ ID NO: 7424604 - DNA, 22 bp, Homo sapiens
aaggcacagaggcagggcactt

SEQ ID NO: 7424605 - DNA, 22 bp, Homo sapiens
aaggcacagaggcagggcactt

SEQ ID NO: 7424606 - DNA, 22 bp, Homo sapiens
aaggcacacagttagatagagc

SEQ ID NO: 7424607 - DNA, 22 bp, Homo sapiens
aaggcacacagttagatagagc

SEQ ID NO: 7424608 - DNA, 22 bp, Homo sapiens
aaggcacacagttagatagagc

SEQ ID NO: 7424609 - DNA, 22 bp, Homo sapiens
aaggcacacagttagatagagc

SEQ ID NO: 7424610 - DNA, 22 bp, Homo sapiens
aaggcacacagttagatagagc

SEQ ID NO: 7424611 - DNA, 22 bp, Homo sapiens
aaggcacagaggcagggcactt

SEQ ID NO: 7424612 - DNA, 22 bp, Homo sapiens
aaggcaattggcttgtataaga

SEQ ID NO: 7424613 - DNA, 22 bp, Homo sapiens
aaggcaattggcttgtataaga

SEQ ID NO: 7424614 - DNA, 22 bp, Homo sapiens
aaggcaattgcagtttttgcca

SEQ ID NO: 7424615 - DNA, 22 bp, Homo sapiens
aaggcaattggcttgtataaga

SEQ ID NO: 7424616 - DNA, 22 bp, Homo sapiens
aaggcaattggcttgtataaga

SEQ ID NO: 7424617 - DNA, 22 bp, Homo sapiens
aaggcaattggcttgtataaga

SEQ ID NO: 7424618 - DNA, 22 bp, Homo sapiens
aaggcaattggcttgtataaga

SEQ ID NO: 7424619 - DNA, 22 bp, Homo sapiens
aaggcaatttggaagaggcaga

SEQ ID NO: 7424620 - DNA, 22 bp, Homo sapiens
aaggcaatttcagggctctcta

SEQ ID NO: 7424621 - DNA, 22 bp, Homo sapiens
aaggcaatttcagggctctcta

SEQ ID NO: 7424622 - DNA, 22 bp, Homo sapiens
aaggcaatttgttgtgaggatt

SEQ ID NO: 7424623 - DNA, 22 bp, Homo sapiens
taacctgaggagaacagtgctt

SEQ ID NO: 7424624 - DNA, 22 bp, Homo sapiens
taacctgaggagaacagtgctt

SEQ ID NO: 7424625 - DNA, 23 bp, Homo sapiens
taacctgagttttttagatgcaa

SEQ ID NO: 7424626 - DNA, 23 bp, Homo sapiens
taacctgagttttttagatgcaa

SEQ ID NO: 7424627 - DNA, 22 bp, Homo sapiens
taacctggatgtgccaacgtga

SEQ ID NO: 7424628 - DNA, 23 bp, Homo sapiens
taacctgagattgcaagggagct

SEQ ID NO: 7424629 - DNA, 23 bp, Homo sapiens
taacctgagattgcaagggagct

SEQ ID NO: 7424630 - DNA, 22 bp, Homo sapiens
taacctgaggagaacagtgctt

SEQ ID NO: 7424631 - DNA, 22 bp, Homo sapiens
taacctgactgctctttagaat

SEQ ID NO: 7424632 - DNA, 22 bp, Homo sapiens
taacctgactgctctttagaat

SEQ ID NO: 7424633 - DNA, 22 bp, Homo sapiens
taacctgcaacagatctgtctt

SEQ ID NO: 7424634 - DNA, 22 bp, Homo sapiens
taacctgctgtgctggtcagtc

SEQ ID NO: 7424635 - DNA, 22 bp, Homo sapiens
taacctggggcctgaagaccat

SEQ ID NO: 7424636 - DNA, 22 bp, Homo sapiens
taacctttggtgaaatattaac

SEQ ID NO: 7424637 - DNA, 22 bp, Homo sapiens
taacctttgttcaatgtaagat

SEQ ID NO: 7424638 - DNA, 22 bp, Homo sapiens
taactactaattgatgataatg

SEQ ID NO: 7424639 - DNA, 22 bp, Homo sapiens
taactactaattgatgataatg

SEQ ID NO: 7424640 - DNA, 22 bp, Homo sapiens
taactacatttcactgcaatta

SEQ ID NO: 7424641 - DNA, 22 bp, Homo sapiens
taactacaagggcggtctctgt

SEQ ID NO: 7424642 - DNA, 22 bp, Homo sapiens
taactacatttcactgcaatta

SEQ ID NO: 7424643 - DNA, 22 bp, Homo sapiens
taactacatttcactgcaatta

SEQ ID NO: 7424644 - DNA, 23 bp, Homo sapiens
taactaggaatagtttaccctta

SEQ ID NO: 7424645 - DNA, 22 bp, Homo sapiens
taactagaagaatgcaccaaga

SEQ ID NO: 7424646 - DNA, 22 bp, Homo sapiens
taactagaatggctattttgag

SEQ ID NO: 7424647 - DNA, 22 bp, Homo sapiens
taactagaatggctattttgag

SEQ ID NO: 7424648 - DNA, 20 bp, Homo sapiens
taacggaagctgtaaaatct

SEQ ID NO: 7424649 - DNA, 22 bp, Homo sapiens
taacgagcagctgttttcaaat

SEQ ID NO: 7424650 - DNA, 22 bp, Homo sapiens
taactaactagtgttcaaaata

SEQ ID NO: 7424651 - DNA, 22 bp, Homo sapiens
taactaagtgactcaagtgatc

SEQ ID NO: 7424652 - DNA, 22 bp, Homo sapiens
taactacaagggcggtctctgt

SEQ ID NO: 7424653 - DNA, 22 bp, Homo sapiens
taactacaagggcggtctctgt

SEQ ID NO: 7424654 - DNA, 22 bp, Homo sapiens
taactgattcctttttgaaaat

SEQ ID NO: 7424655 - DNA, 22 bp, Homo sapiens
taactgatgttcccttactgta

SEQ ID NO: 7424656 - DNA, 22 bp, Homo sapiens
taactgatgttcccttactgta

SEQ ID NO: 7424657 - DNA, 22 bp, Homo sapiens
taactgatgtgaacttaccatt

SEQ ID NO: 7424658 - DNA, 22 bp, Homo sapiens
taactgatattgaaaaacatca

SEQ ID NO: 7424659 - DNA, 22 bp, Homo sapiens
taactgaatgtattacaacaga

SEQ ID NO: 7424660 - DNA, 22 bp, Homo sapiens
taactgaatgtattacaacaga

SEQ ID NO: 7424661 - DNA, 22 bp, Homo sapiens
taactgaatgtattacaacaga

SEQ ID NO: 7424662 - DNA, 22 bp, Homo sapiens
taactgaatgtattacaacaga

SEQ ID NO: 7424663 - DNA, 22 bp, Homo sapiens
taactgaacatctcaaatcaag

SEQ ID NO: 7424664 - DNA, 22 bp, Homo sapiens
taactgaacatctcaaatcaag

SEQ ID NO: 7424665 - DNA, 22 bp, Homo sapiens
taactgaacagcctaattcttt

SEQ ID NO: 7424666 - DNA, 22 bp, Homo sapiens
taactgaacagcctaattcttt

SEQ ID NO: 7424667 - DNA, 22 bp, Homo sapiens
taactgaacatctcaaatcaag

SEQ ID NO: 7424668 - DNA, 22 bp, Homo sapiens
taactgaatgtattacaacaga

SEQ ID NO: 7424669 - DNA, 22 bp, Homo sapiens
taactctttactatacatttat

SEQ ID NO: 7424670 - DNA, 22 bp, Homo sapiens
taactctttactatacatttat

SEQ ID NO: 7424671 - DNA, 19 bp, Homo sapiens
taactctttccttttcccc

SEQ ID NO: 7424672 - DNA, 22 bp, Homo sapiens
taactgaaaatccctcttctcc

SEQ ID NO: 7424673 - DNA, 22 bp, Homo sapiens
taactgaaaatccctcttctcc

SEQ ID NO: 7424674 - DNA, 22 bp, Homo sapiens
taactcatggagaggcggagtt

SEQ ID NO: 7424675 - DNA, 22 bp, Homo sapiens
taactcaactatctctgggtaa

SEQ ID NO: 7424676 - DNA, 22 bp, Homo sapiens
taactcactccaaaaaggcatt

SEQ ID NO: 7424677 - DNA, 22 bp, Homo sapiens
taactcactccaaaaaggcatt

SEQ ID NO: 7424678 - DNA, 22 bp, Homo sapiens
taactaggattacaagcgtgcg

SEQ ID NO: 7424679 - DNA, 22 bp, Homo sapiens
taactaggattacaagcgtgcg

SEQ ID NO: 7424680 - DNA, 22 bp, Homo sapiens
taactaggattacaagcgtgcg

SEQ ID NO: 7424681 - DNA, 22 bp, Homo sapiens
taactccacacccctcttggtg

SEQ ID NO: 7424682 - DNA, 22 bp, Homo sapiens
taactccatctctgtgtctgct

SEQ ID NO: 7424683 - DNA, 22 bp, Homo sapiens
taactcccaacatcatggctct

SEQ ID NO: 7424684 - DNA, 22 bp, Homo sapiens
taactctagtcccaggcatgaa

SEQ ID NO: 7424685 - DNA, 22 bp, Homo sapiens
taactctagtcccaggcatgaa

SEQ ID NO: 7424686 - DNA, 22 bp, Homo sapiens
taactctagtcccaggcatgaa

SEQ ID NO: 7424687 - DNA, 22 bp, Homo sapiens
taactctgaatcctcacagcag

SEQ ID NO: 7424688 - DNA, 22 bp, Homo sapiens
taaattgcataagtacaaatga

SEQ ID NO: 7424689 - DNA, 22 bp, Homo sapiens
taaattgcataagtacaaatga

SEQ ID NO: 7424690 - DNA, 23 bp, Homo sapiens
taaattgatggtatgggttaagc

SEQ ID NO: 7424691 - DNA, 22 bp, Homo sapiens
taaattgatcgtttgggatgaa

SEQ ID NO: 7424692 - DNA, 23 bp, Homo sapiens
taaattgatggtatgggttaagc

SEQ ID NO: 7424693 - DNA, 22 bp, Homo sapiens
taaattgagattattagggtaa

SEQ ID NO: 7424694 - DNA, 22 bp, Homo sapiens
taaattgagattattagggtaa

SEQ ID NO: 7424695 - DNA, 22 bp, Homo sapiens
taaatttacccaaggaacatgt

SEQ ID NO: 7424696 - DNA, 22 bp, Homo sapiens
taaattgttttctagaagttgt

SEQ ID NO: 7424697 - DNA, 22 bp, Homo sapiens
taaatttacccaaggaacatgt

SEQ ID NO: 7424698 - DNA, 22 bp, Homo sapiens
taaatttacccaaggaacatgt

SEQ ID NO: 7424699 - DNA, 22 bp, Homo sapiens
taaatttacccaaggaacatgt

SEQ ID NO: 7424700 - DNA, 22 bp, Homo sapiens
taaattgtggccatttgtgttt

SEQ ID NO: 7424701 - DNA, 22 bp, Homo sapiens
taaattgtgtgttgctagggga

SEQ ID NO: 7424702 - DNA, 22 bp, Homo sapiens
taaattgttttctagaagttgt

SEQ ID NO: 7424703 - DNA, 22 bp, Homo sapiens
taaattgaaaatctacagaaca

SEQ ID NO: 7424704 - DNA, 22 bp, Homo sapiens
taaattgaaaatctacagaaca

SEQ ID NO: 7424705 - DNA, 22 bp, Homo sapiens
taaattgaaaatctacagaaca

SEQ ID NO: 7424706 - DNA, 22 bp, Homo sapiens
taaattctgatcaagttccttc

SEQ ID NO: 7424707 - DNA, 22 bp, Homo sapiens
taaattctacaacttcaaagat

SEQ ID NO: 7424708 - DNA, 22 bp, Homo sapiens
taaattcccaactctgctcttc

SEQ ID NO: 7424709 - DNA, 22 bp, Homo sapiens
taaattcccaactctgctcttc

SEQ ID NO: 7424710 - DNA, 22 bp, Homo sapiens
taaattctacaacttcaaagat

SEQ ID NO: 7424711 - DNA, 22 bp, Homo sapiens
taaattctacaacttcaaagat

SEQ ID NO: 7424712 - DNA, 22 bp, Homo sapiens
taaattcagtgagtaatttctg

SEQ ID NO: 7424713 - DNA, 22 bp, Homo sapiens
taaattcagtgagtaatttctg

SEQ ID NO: 7424714 - DNA, 22 bp, Homo sapiens
taaattcagtgagtaatttctg

SEQ ID NO: 7424715 - DNA, 22 bp, Homo sapiens
taaattcactcctggtagacct

SEQ ID NO: 7424716 - DNA, 22 bp, Homo sapiens
taaattcactcctggtagacct

SEQ ID NO: 7424717 - DNA, 22 bp, Homo sapiens
taaattcagtgagtaatttctg

SEQ ID NO: 7424718 - DNA, 22 bp, Homo sapiens
taaattcagtgagtaatttctg

SEQ ID NO: 7424719 - DNA, 22 bp, Homo sapiens
taaattcagtgagtaatttctg

SEQ ID NO: 7424720 - DNA, 22 bp, Homo sapiens
taaattcccaactctgctcttc

SEQ ID NO: 7424721 - DNA, 22 bp, Homo sapiens
taaccaaagggcctaaggaatg

SEQ ID NO: 7424722 - DNA, 22 bp, Homo sapiens
taaccacattattatgggttct

SEQ ID NO: 7424723 - DNA, 22 bp, Homo sapiens
taaccaataaccaataagatac

SEQ ID NO: 7424724 - DNA, 22 bp, Homo sapiens
taaccaataaccaataagatac

SEQ ID NO: 7424725 - DNA, 22 bp, Homo sapiens
taaccatattcacactatgccc

SEQ ID NO: 7424726 - DNA, 22 bp, Homo sapiens
taaccatattttccattaagtt

SEQ ID NO: 7424727 - DNA, 22 bp, Homo sapiens
taaccagacagaaacagctaga

SEQ ID NO: 7424728 - DNA, 22 bp, Homo sapiens
taaccagcatgaaatctgcagc

SEQ ID NO: 7424729 - DNA, 22 bp, Homo sapiens
taacctgaacacacaataggga

SEQ ID NO: 7424730 - DNA, 22 bp, Homo sapiens
taacctctgagctccagcttct

SEQ ID NO: 7424731 - DNA, 22 bp, Homo sapiens
taacctgaacacacaataggga

SEQ ID NO: 7424732 - DNA, 22 bp, Homo sapiens
taacctctctgtgcctcagttt

SEQ ID NO: 7424733 - DNA, 17 bp, Homo sapiens
taacctctctgaacctg

SEQ ID NO: 7424734 - DNA, 22 bp, Homo sapiens
taacctctatttttataaaagt

SEQ ID NO: 7424735 - DNA, 22 bp, Homo sapiens
taacctacatgagaactttaaa

SEQ ID NO: 7424736 - DNA, 22 bp, Homo sapiens
taacccaataattggtggcctt

SEQ ID NO: 7424737 - DNA, 18 bp, Homo sapiens
taacccagagggtgactt

SEQ ID NO: 7424738 - DNA, 22 bp, Homo sapiens
taaccatattttccattaagtt

SEQ ID NO: 7424739 - DNA, 22 bp, Homo sapiens
taaccatgcatgtctctagttt

SEQ ID NO: 7424740 - DNA, 22 bp, Homo sapiens
taacccaaaggcaatgtctcga

SEQ ID NO: 7424741 - DNA, 22 bp, Homo sapiens
taacattaaaagagataattga

SEQ ID NO: 7424742 - DNA, 22 bp, Homo sapiens
taacattaaaagagataattga

SEQ ID NO: 7424743 - DNA, 22 bp, Homo sapiens
taacattaaaagagataattga

SEQ ID NO: 7424744 - DNA, 22 bp, Homo sapiens
taacattaaaagagataattga

SEQ ID NO: 7424745 - DNA, 22 bp, Homo sapiens
taacattacagacaccttgtgt

SEQ ID NO: 7424746 - DNA, 22 bp, Homo sapiens
taacattacggacatctgtcag

SEQ ID NO: 7424747 - DNA, 22 bp, Homo sapiens
taacattacagacaccttgtgt

SEQ ID NO: 7424748 - DNA, 22 bp, Homo sapiens
taacattacggacatctgtcag

SEQ ID NO: 7424749 - DNA, 22 bp, Homo sapiens
taaccaaagggcctaaggaatg

SEQ ID NO: 7424750 - DNA, 23 bp, Homo sapiens
taaatttcttgattcttatgtga

SEQ ID NO: 7424751 - DNA, 22 bp, Homo sapiens
taaatttttgttaacagcctct

SEQ ID NO: 7424752 - DNA, 22 bp, Homo sapiens
taaatttttgttaacagcctct

SEQ ID NO: 7424753 - DNA, 22 bp, Homo sapiens
taaatttttgttaacagcctct

SEQ ID NO: 7424754 - DNA, 22 bp, Homo sapiens
taaatttttgttaacagcctct

SEQ ID NO: 7424755 - DNA, 22 bp, Homo sapiens
taacattaaaagagataattga

SEQ ID NO: 7424756 - DNA, 22 bp, Homo sapiens
taacattaaaagagataattga

SEQ ID NO: 7424757 - DNA, 22 bp, Homo sapiens
taacattaaaagagataattga

SEQ ID NO: 7424758 - DNA, 23 bp, Homo sapiens
taaatttcttgattcttatgtga

SEQ ID NO: 7424759 - DNA, 23 bp, Homo sapiens
taaatttcttgattcttatgtga

SEQ ID NO: 7424760 - DNA, 22 bp, Homo sapiens
taaatttacccaaggaacatgt

SEQ ID NO: 7424761 - DNA, 22 bp, Homo sapiens
taaatttacccaaggaacatgt

SEQ ID NO: 7424762 - DNA, 22 bp, Homo sapiens
taaattatggctggcagagcag

SEQ ID NO: 7424763 - DNA, 22 bp, Homo sapiens
taaattatggctggcagagcag

SEQ ID NO: 7424764 - DNA, 22 bp, Homo sapiens
taaattatggctggcagagcag

SEQ ID NO: 7424765 - DNA, 22 bp, Homo sapiens
taaattatggctggcagagcag

SEQ ID NO: 7424766 - DNA, 22 bp, Homo sapiens
taaattatggctggcagagcag

SEQ ID NO: 7424767 - DNA, 22 bp, Homo sapiens
taaattatggctggcagagcag

SEQ ID NO: 7424768 - DNA, 22 bp, Homo sapiens
taaattatggctggcagagcag

SEQ ID NO: 7424769 - DNA, 22 bp, Homo sapiens
taaattagggactttagttaat

SEQ ID NO: 7424770 - DNA, 22 bp, Homo sapiens
taaattagggactttagttaat

SEQ ID NO: 7424771 - DNA, 20 bp, Homo sapiens
taaattagccttgaagatta

SEQ ID NO: 7424772 - DNA, 20 bp, Homo sapiens
taaattagccttgaagatta

SEQ ID NO: 7424773 - DNA, 20 bp, Homo sapiens
taaattagccttgaagatta

SEQ ID NO: 7424774 - DNA, 20 bp, Homo sapiens
taaattagccttgaagatta

SEQ ID NO: 7424775 - DNA, 20 bp, Homo sapiens
taaattagccttgaagatta

SEQ ID NO: 7424776 - DNA, 20 bp, Homo sapiens
taaattagccttgaagatta

SEQ ID NO: 7424777 - DNA, 22 bp, Homo sapiens
taaattagggactttagttaat

SEQ ID NO: 7424778 - DNA, 22 bp, Homo sapiens
taaattagggactttagttaat

SEQ ID NO: 7424779 - DNA, 22 bp, Homo sapiens
taaattagggactttagttaat

SEQ ID NO: 7424780 - DNA, 20 bp, Homo sapiens
taaattagccttgaagatta

SEQ ID NO: 7424781 - DNA, 22 bp, Homo sapiens
taaattcactcctggtagacct

SEQ ID NO: 7424782 - DNA, 22 bp, Homo sapiens
taaattcactcctggtagacct

SEQ ID NO: 7424783 - DNA, 22 bp, Homo sapiens
taaattcactcctggtagacct

SEQ ID NO: 7424784 - DNA, 22 bp, Homo sapiens
taaattcactcctggtagacct

SEQ ID NO: 7424785 - DNA, 22 bp, Homo sapiens
taaattatgttccatgtccttt

SEQ ID NO: 7424786 - DNA, 22 bp, Homo sapiens
taaattatgttccatgtccttt

SEQ ID NO: 7424787 - DNA, 22 bp, Homo sapiens
taaattatgttccatgtccttt

SEQ ID NO: 7424788 - DNA, 22 bp, Homo sapiens
taaattatgttccatgtccttt

SEQ ID NO: 7424789 - DNA, 22 bp, Homo sapiens
taaattatgtcacatgactctg

SEQ ID NO: 7424790 - DNA, 22 bp, Homo sapiens
taaattatgtcacatgactctg

SEQ ID NO: 7424791 - DNA, 22 bp, Homo sapiens
taaattatggctggcagagcag

SEQ ID NO: 7424792 - DNA, 22 bp, Homo sapiens
taaattatgtcacatgactctg

SEQ ID NO: 7424793 - DNA, 22 bp, Homo sapiens
taaattatgttccatgtccttt

SEQ ID NO: 7424794 - DNA, 22 bp, Homo sapiens
taaattatgttccatgtccttt

SEQ ID NO: 7424795 - DNA, 22 bp, Homo sapiens
taaattatgtcacatgactctg

SEQ ID NO: 7424796 - DNA, 22 bp, Homo sapiens
taaattatgtcacatgactctg

SEQ ID NO: 7424797 - DNA, 22 bp, Homo sapiens
taaagtgggcaaactctcatgg

SEQ ID NO: 7424798 - DNA, 23 bp, Homo sapiens
taaagtggcgctgttactgccag

SEQ ID NO: 7424799 - DNA, 22 bp, Homo sapiens
taaagtggaaggatccactaag

SEQ ID NO: 7424800 - DNA, 22 bp, Homo sapiens
taaagtgcttcctaacccagag

SEQ ID NO: 7424801 - DNA, 22 bp, Homo sapiens
taaagtggtggtgctaatgtat

SEQ ID NO: 7424802 - DNA, 22 bp, Homo sapiens
taaagtgcttcctaacccagag

SEQ ID NO: 7424803 - DNA, 22 bp, Homo sapiens
taaagtgcttcctaacccagag

SEQ ID NO: 7424804 - DNA, 22 bp, Homo sapiens
taaagtgcttcctaacccagag

SEQ ID NO: 7424805 - DNA, 22 bp, Homo sapiens
taaagtgcttatgataaccaag

SEQ ID NO: 7424806 - DNA, 22 bp, Homo sapiens
taaagtgcttcctaacccagag

SEQ ID NO: 7424807 - DNA, 22 bp, Homo sapiens
taaagtgcttatgataaccaag

SEQ ID NO: 7424808 - DNA, 22 bp, Homo sapiens
taaattaaagattggagaagga

SEQ ID NO: 7424809 - DNA, 22 bp, Homo sapiens
taaattaaagattggagaagga

SEQ ID NO: 7424810 - DNA, 22 bp, Homo sapiens
taaattaaagattggagaagga

SEQ ID NO: 7424811 - DNA, 22 bp, Homo sapiens
taaattaaagattggagaagga

SEQ ID NO: 7424812 - DNA, 22 bp, Homo sapiens
taaagtgtgcatggtcaaatat

SEQ ID NO: 7424813 - DNA, 22 bp, Homo sapiens
taaagtgtctgcctcagctcag

SEQ ID NO: 7424814 - DNA, 22 bp, Homo sapiens
taaagtgtctgcctcagctcag

SEQ ID NO: 7424815 - DNA, 22 bp, Homo sapiens
taaagtgtcctagctaggaggc

SEQ ID NO: 7424816 - DNA, 22 bp, Homo sapiens
taaagtgtatgccatctctcat

SEQ ID NO: 7424817 - DNA, 22 bp, Homo sapiens
taaagtgtatgccatctctcat

SEQ ID NO: 7424818 - DNA, 22 bp, Homo sapiens
taaattactcaatgcacataaa

SEQ ID NO: 7424819 - DNA, 22 bp, Homo sapiens
taaattactcaatgcacataaa

SEQ ID NO: 7424820 - DNA, 22 bp, Homo sapiens
taaattactcaatgcacataaa

SEQ ID NO: 7424821 - DNA, 22 bp, Homo sapiens
taaattactcaatgcacataaa

SEQ ID NO: 7424822 - DNA, 22 bp, Homo sapiens
taaattactcaatgcacataaa

SEQ ID NO: 7424823 - DNA, 22 bp, Homo sapiens
taaattagagccaggtaagttt

SEQ ID NO: 7424824 - DNA, 22 bp, Homo sapiens
taaattagagccaggtaagttt

SEQ ID NO: 7424825 - DNA, 22 bp, Homo sapiens
taaattagagccaggtaagttt

SEQ ID NO: 7424826 - DNA, 20 bp, Homo sapiens
taaattagccttgaagatta

SEQ ID NO: 7424827 - DNA, 20 bp, Homo sapiens
taaattagccttgaagatta

SEQ ID NO: 7424828 - DNA, 22 bp, Homo sapiens
taaattaaagattggagaagga

SEQ ID NO: 7424829 - DNA, 22 bp, Homo sapiens
taaattaaagattggagaagga

SEQ ID NO: 7424830 - DNA, 22 bp, Homo sapiens
taaattaaagattggagaagga

SEQ ID NO: 7424831 - DNA, 22 bp, Homo sapiens
taaattaccctttagggaattg

SEQ ID NO: 7424832 - DNA, 22 bp, Homo sapiens
taaattaccctttagggaattg

SEQ ID NO: 7424833 - DNA, 23 bp, Homo sapiens
taaattacctttccagtgcaggg

SEQ ID NO: 7424834 - DNA, 23 bp, Homo sapiens
taaattacctttccagtgcaggg

SEQ ID NO: 7424835 - DNA, 23 bp, Homo sapiens
taaattacctttccagtgcaggg

SEQ ID NO: 7424836 - DNA, 22 bp, Homo sapiens
taaaggtagtgtgacatattgt

SEQ ID NO: 7424837 - DNA, 22 bp, Homo sapiens
taaaggtagtgtgacatattgt

SEQ ID NO: 7424838 - DNA, 22 bp, Homo sapiens
taaaggtagtgtgacatattgt

SEQ ID NO: 7424839 - DNA, 22 bp, Homo sapiens
taaaggtagcatgaaactgcaa

SEQ ID NO: 7424840 - DNA, 22 bp, Homo sapiens
taaaggtaacatgaactgcttt

SEQ ID NO: 7424841 - DNA, 22 bp, Homo sapiens
taaaggtaacatgaactgcttt

SEQ ID NO: 7424842 - DNA, 22 bp, Homo sapiens
taaaggtacgaagtgagggatt

SEQ ID NO: 7424843 - DNA, 22 bp, Homo sapiens
taaaggtacgaagtgagggatt

SEQ ID NO: 7424844 - DNA, 22 bp, Homo sapiens
taaaggtagtgtgacatattgt

SEQ ID NO: 7424845 - DNA, 22 bp, Homo sapiens
taaaggtagcatgaaactgcaa

SEQ ID NO: 7424846 - DNA, 22 bp, Homo sapiens
taaaggtagtgtgacatattgt

SEQ ID NO: 7424847 - DNA, 22 bp, Homo sapiens
taaaggtagtgtgacatattgt

SEQ ID NO: 7424848 - DNA, 22 bp, Homo sapiens
taaaggttagtagcagggaaac

SEQ ID NO: 7424849 - DNA, 22 bp, Homo sapiens
taaaggttataaaggttagggg

SEQ ID NO: 7424850 - DNA, 22 bp, Homo sapiens
taaaggtatgtcttaatcaaac

SEQ ID NO: 7424851 - DNA, 22 bp, Homo sapiens
taaaggtatgtcttaatcaaac

SEQ ID NO: 7424852 - DNA, 22 bp, Homo sapiens
taaaggtatgtcttaatcaaac

SEQ ID NO: 7424853 - DNA, 22 bp, Homo sapiens
taaaggtatgtcttaatcaaac

SEQ ID NO: 7424854 - DNA, 22 bp, Homo sapiens
taaaggtatgtcttaatcaaac

SEQ ID NO: 7424855 - DNA, 22 bp, Homo sapiens
taaaggtagttttaaaggtgct

SEQ ID NO: 7424856 - DNA, 22 bp, Homo sapiens
taaaggtccaaagagggctacg

SEQ ID NO: 7424857 - DNA, 22 bp, Homo sapiens
taaaggttattgcactggagtt

SEQ ID NO: 7424858 - DNA, 22 bp, Homo sapiens
taaaggttgaaaactgactgcc

SEQ ID NO: 7424859 - DNA, 22 bp, Homo sapiens
taaaggttataaaggttagggg

SEQ ID NO: 7424860 - DNA, 22 bp, Homo sapiens
taaaggttagtagcagggaaac

SEQ ID NO: 7424861 - DNA, 22 bp, Homo sapiens
taaaggttattgcactggagtt

SEQ ID NO: 7424862 - DNA, 22 bp, Homo sapiens
taaaggtttattcaacaaaata

SEQ ID NO: 7424863 - DNA, 22 bp, Homo sapiens
taaaggtttattcaacaaaata

SEQ ID NO: 7424864 - DNA, 22 bp, Homo sapiens
taaaggtttattcaacaaaata

SEQ ID NO: 7424865 - DNA, 22 bp, Homo sapiens
taaagtaatccttcataaggag

SEQ ID NO: 7424866 - DNA, 22 bp, Homo sapiens
taaagtataagcattggagtat

SEQ ID NO: 7424867 - DNA, 22 bp, Homo sapiens
taaagtagcgcctaactaatgt

SEQ ID NO: 7424868 - DNA, 22 bp, Homo sapiens
taaagtagcgcctaactaatgt

SEQ ID NO: 7424869 - DNA, 22 bp, Homo sapiens
taaagtataagcattggagtat

SEQ ID NO: 7424870 - DNA, 22 bp, Homo sapiens
taaagtaatccttcataaggag

SEQ ID NO: 7424871 - DNA, 22 bp, Homo sapiens
taaagtaatccttcataaggag

SEQ ID NO: 7424872 - DNA, 22 bp, Homo sapiens
taaagtagcaagtttagactga

SEQ ID NO: 7424873 - DNA, 22 bp, Homo sapiens
taaagtatattttttctcaata

SEQ ID NO: 7424874 - DNA, 22 bp, Homo sapiens
taaagtatattttttctcaata

SEQ ID NO: 7424875 - DNA, 22 bp, Homo sapiens
taaagtatccagttattcttct

SEQ ID NO: 7424876 - DNA, 22 bp, Homo sapiens
taaagtatccagttattcttct

SEQ ID NO: 7424877 - DNA, 22 bp, Homo sapiens
taaagtatattttttctcaata

SEQ ID NO: 7424878 - DNA, 22 bp, Homo sapiens
taaagtatattttttctcaata

SEQ ID NO: 7424879 - DNA, 22 bp, Homo sapiens
taaagtatattttttctcaata

SEQ ID NO: 7424880 - DNA, 22 bp, Homo sapiens
taaagtatccagttattcttct

SEQ ID NO: 7424881 - DNA, 22 bp, Homo sapiens
taaagtatccagttattcttct

SEQ ID NO: 7424882 - DNA, 22 bp, Homo sapiens
taaagtcaaaatatgggtaggc

SEQ ID NO: 7424883 - DNA, 22 bp, Homo sapiens
taaagtcaaaatatgggtaggc

SEQ ID NO: 7424884 - DNA, 22 bp, Homo sapiens
taaagtcaaaatatgggtaggc

SEQ ID NO: 7424885 - DNA, 22 bp, Homo sapiens
taaagtcaaaatatgggtaggc

SEQ ID NO: 7424886 - DNA, 22 bp, Homo sapiens
taaagtcaaggtactgtttcac

SEQ ID NO: 7424887 - DNA, 22 bp, Homo sapiens
taaagtgcctcaggtcctgggt

SEQ ID NO: 7424888 - DNA, 22 bp, Homo sapiens
taaagtgcccagggaaagcggg

SEQ ID NO: 7424889 - DNA, 22 bp, Homo sapiens
taaagtgcccagggaaagcggg

SEQ ID NO: 7424890 - DNA, 22 bp, Homo sapiens
taaagtcaaggtactgtttcac

SEQ ID NO: 7424891 - DNA, 22 bp, Homo sapiens
taaagtcaaggtactgtttcac

SEQ ID NO: 7424892 - DNA, 22 bp, Homo sapiens
taaagtgctcataaaaatggat

SEQ ID NO: 7424893 - DNA, 22 bp, Homo sapiens
taaagtgctcataaaaatggat

SEQ ID NO: 7424894 - DNA, 23 bp, Homo sapiens
taaagtgctgatggtgagggagc

SEQ ID NO: 7424895 - DNA, 22 bp, Homo sapiens
taaagtgctcataaaaatggat

SEQ ID NO: 7424896 - DNA, 23 bp, Homo sapiens
taaagtgctgatggtgagggagc

SEQ ID NO: 7424897 - DNA, 23 bp, Homo sapiens
taaagtgctgatggtgagggagc

SEQ ID NO: 7424898 - DNA, 22 bp, Homo sapiens
taaagtgcgacccagtccccag

SEQ ID NO: 7424899 - DNA, 22 bp, Homo sapiens
taaagtgctcataaaaatggat

SEQ ID NO: 7424900 - DNA, 22 bp, Homo sapiens
taaagtgcgacccagtccccag

SEQ ID NO: 7424901 - DNA, 22 bp, Homo sapiens
taaagtgcctcaggtcctgggt

SEQ ID NO: 7424902 - DNA, 22 bp, Homo sapiens
taaagtgcgacccagtccccag

SEQ ID NO: 7424903 - DNA, 22 bp, Homo sapiens
taaagtgcgacccagtccccag

SEQ ID NO: 7424904 - DNA, 22 bp, Homo sapiens
taaagtgcctcaggtcctgggt

SEQ ID NO: 7424905 - DNA, 22 bp, Homo sapiens
taaagtgctgggattataggcc

SEQ ID NO: 7424906 - DNA, 22 bp, Homo sapiens
taaagtgcttatgataaccaag

SEQ ID NO: 7424907 - DNA, 22 bp, Homo sapiens
taaagtgcttatgataaccaag

SEQ ID NO: 7424908 - DNA, 22 bp, Homo sapiens
taaagtgctgggattataggcc

SEQ ID NO: 7424909 - DNA, 22 bp, Homo sapiens
taaagtgcttatgataaccaag

SEQ ID NO: 7424910 - DNA, 22 bp, Homo sapiens
taaagtgctgggattataggcc

SEQ ID NO: 7424911 - DNA, 22 bp, Homo sapiens
taaagtgctgggattataggcc

SEQ ID NO: 7424912 - DNA, 22 bp, Homo sapiens
taaagtgctgggattataggcc

SEQ ID NO: 7424913 - DNA, 22 bp, Homo sapiens
taaagtgctggatttgagtaaa

SEQ ID NO: 7424914 - DNA, 22 bp, Homo sapiens
taaagtgctggatttgagtaaa

SEQ ID NO: 7424915 - DNA, 22 bp, Homo sapiens
taaagtgctggatttgagtaaa

SEQ ID NO: 7424916 - DNA, 23 bp, Homo sapiens
taaagtgctgatggtgagggagc

SEQ ID NO: 7424917 - DNA, 23 bp, Homo sapiens
taaagtgctgatggtgagggagc

SEQ ID NO: 7424918 - DNA, 22 bp, Homo sapiens
taaagtgctggatttgagtaaa

SEQ ID NO: 7424919 - DNA, 22 bp, Homo sapiens
taaagtgctggatttgagtaaa

SEQ ID NO: 7424920 - DNA, 22 bp, Homo sapiens
taaagtgctggatttgagtaaa

SEQ ID NO: 7424921 - DNA, 22 bp, Homo sapiens
taaagtgctggatttgagtaaa

SEQ ID NO: 7424922 - DNA, 22 bp, Homo sapiens
gtttttatctaatagcagttat

SEQ ID NO: 7424923 - DNA, 22 bp, Homo sapiens
gtttttatctaatagcagttat

SEQ ID NO: 7424924 - DNA, 22 bp, Homo sapiens
gtttttatctaatagcagttat

SEQ ID NO: 7424925 - DNA, 22 bp, Homo sapiens
gtttttattgtgtaaatgtggg

SEQ ID NO: 7424926 - DNA, 22 bp, Homo sapiens
gtttttattgtgtaaatgtggg

SEQ ID NO: 7424927 - DNA, 22 bp, Homo sapiens
gtttttattgtgtaaatgtggg

SEQ ID NO: 7424928 - DNA, 22 bp, Homo sapiens
gtttttattgtgtaaatgtggg

SEQ ID NO: 7424929 - DNA, 22 bp, Homo sapiens
gtttttattgtgtaaatgtggg

SEQ ID NO: 7424930 - DNA, 22 bp, Homo sapiens
gtttttattgtgtaaatgtggg

SEQ ID NO: 7424931 - DNA, 22 bp, Homo sapiens
gtttttattgtgtaaatgtggg

SEQ ID NO: 7424932 - DNA, 22 bp, Homo sapiens
gtttttattgtgtaaatgtggg

SEQ ID NO: 7424933 - DNA, 22 bp, Homo sapiens
taaaagttttagttgtacataa

SEQ ID NO: 7424934 - DNA, 22 bp, Homo sapiens
taaaagttttagttgtacataa

SEQ ID NO: 7424935 - DNA, 22 bp, Homo sapiens
taaaagttttagttgtacataa

SEQ ID NO: 7424936 - DNA, 22 bp, Homo sapiens
taaaagttagctaggacaaagt

SEQ ID NO: 7424937 - DNA, 22 bp, Homo sapiens
taaaagttttagttgtacataa

SEQ ID NO: 7424938 - DNA, 22 bp, Homo sapiens
taaaagttttagttgtacataa

SEQ ID NO: 7424939 - DNA, 22 bp, Homo sapiens
taaaagttttagttgtacataa

SEQ ID NO: 7424940 - DNA, 22 bp, Homo sapiens
gtttttattgtgtaaatgtggg

SEQ ID NO: 7424941 - DNA, 22 bp, Homo sapiens
gtttttattgtgtaaatgtggg

SEQ ID NO: 7424942 - DNA, 22 bp, Homo sapiens
gtttttatatcctgtggagtgt

SEQ ID NO: 7424943 - DNA, 22 bp, Homo sapiens
gtttttatatcctgtggagtgt

SEQ ID NO: 7424944 - DNA, 22 bp, Homo sapiens
gtttttactaaggttgctaagt

SEQ ID NO: 7424945 - DNA, 22 bp, Homo sapiens
gtttttactaaggttgctaagt

SEQ ID NO: 7424946 - DNA, 22 bp, Homo sapiens
gtttttatatcctgtggagtgt

SEQ ID NO: 7424947 - DNA, 22 bp, Homo sapiens
gtttttatctaatagcagttat

SEQ ID NO: 7424948 - DNA, 22 bp, Homo sapiens
gtttttatctaatagcagttat

SEQ ID NO: 7424949 - DNA, 22 bp, Homo sapiens
gtttttactaaggttgctaagt

SEQ ID NO: 7424950 - DNA, 22 bp, Homo sapiens
gttttgttttgagtcaactcca

SEQ ID NO: 7424951 - DNA, 22 bp, Homo sapiens
gttttgttttgagtcaactcca

SEQ ID NO: 7424952 - DNA, 22 bp, Homo sapiens
gttttgttttgagtcaactcca

SEQ ID NO: 7424953 - DNA, 22 bp, Homo sapiens
gttttgttttgagtcaactcca

SEQ ID NO: 7424954 - DNA, 19 bp, Homo sapiens
gttttgtttgcagaactta

SEQ ID NO: 7424955 - DNA, 19 bp, Homo sapiens
gttttgtttgcagaactta

SEQ ID NO: 7424956 - DNA, 19 bp, Homo sapiens
gttttgtttgcagaactta

SEQ ID NO: 7424957 - DNA, 22 bp, Homo sapiens
gttttgttttgagtcaactcca

SEQ ID NO: 7424958 - DNA, 19 bp, Homo sapiens
gttttgtttgcagaactta

SEQ ID NO: 7424959 - DNA, 19 bp, Homo sapiens
gttttgtttgcagaactta

SEQ ID NO: 7424960 - DNA, 22 bp, Homo sapiens
taaaatagaggatgtcatgcta

SEQ ID NO: 7424961 - DNA, 22 bp, Homo sapiens
taaaatagaggatgtcatgcta

SEQ ID NO: 7424962 - DNA, 22 bp, Homo sapiens
taaaatagaggatgtcatgcta

SEQ ID NO: 7424963 - DNA, 22 bp, Homo sapiens
taaaagttttagttgtacataa

SEQ ID NO: 7424964 - DNA, 22 bp, Homo sapiens
taaaatagaggatgtcatgcta

SEQ ID NO: 7424965 - DNA, 22 bp, Homo sapiens
taaaatagaggatgtcatgcta

SEQ ID NO: 7424966 - DNA, 22 bp, Homo sapiens
taaaagttttagttgtacataa

SEQ ID NO: 7424967 - DNA, 22 bp, Homo sapiens
taaaagttttagttgtacataa

SEQ ID NO: 7424968 - DNA, 22 bp, Homo sapiens
taaaagttttagttgtacataa

SEQ ID NO: 7424969 - DNA, 22 bp, Homo sapiens
taaaatgatctctcatgttctt

SEQ ID NO: 7424970 - DNA, 22 bp, Homo sapiens
taaaatgatctctcatgttctt

SEQ ID NO: 7424971 - DNA, 22 bp, Homo sapiens
taaaatgatctctcatgttctt

SEQ ID NO: 7424972 - DNA, 22 bp, Homo sapiens
taaaatgatctctcatgttctt

SEQ ID NO: 7424973 - DNA, 22 bp, Homo sapiens
taaaatgcacagcagttgaaag

SEQ ID NO: 7424974 - DNA, 22 bp, Homo sapiens
taaaatgcacagcagttgaaag

SEQ ID NO: 7424975 - DNA, 19 bp, Homo sapiens
taaaatgtctgtggtcagt

SEQ ID NO: 7424976 - DNA, 19 bp, Homo sapiens
taaaatgtctgtggtcagt

SEQ ID NO: 7424977 - DNA, 19 bp, Homo sapiens
taaaatgtctgtggtcagt

SEQ ID NO: 7424978 - DNA, 22 bp, Homo sapiens
taaaatgtgtttctgtatggtt

SEQ ID NO: 7424979 - DNA, 22 bp, Homo sapiens
taaaatgtgtttctgtatggtt

SEQ ID NO: 7424980 - DNA, 19 bp, Homo sapiens
taaaatgtctgtggtcagt

SEQ ID NO: 7424981 - DNA, 19 bp, Homo sapiens
taaaatgtctgtggtcagt

SEQ ID NO: 7424982 - DNA, 22 bp, Homo sapiens
taaaatgtagcttctaggctgg

SEQ ID NO: 7424983 - DNA, 22 bp, Homo sapiens
taaaatgtagcttctaggctgg

SEQ ID NO: 7424984 - DNA, 19 bp, Homo sapiens
taaaatgtctgtggtcagt

SEQ ID NO: 7424985 - DNA, 19 bp, Homo sapiens
taaaatgtctgtggtcagt

SEQ ID NO: 7424986 - DNA, 19 bp, Homo sapiens
taaaatgtctgtggtcagt

SEQ ID NO: 7424987 - DNA, 22 bp, Homo sapiens
taaaatgtagcttctaggctgg

SEQ ID NO: 7424988 - DNA, 22 bp, Homo sapiens
taaaatgtagcttctaggctgg

SEQ ID NO: 7424989 - DNA, 22 bp, Homo sapiens
taaaatgtagcttctaggctgg

SEQ ID NO: 7424990 - DNA, 22 bp, Homo sapiens
taaaatggtaactttcatttgc

SEQ ID NO: 7424991 - DNA, 22 bp, Homo sapiens
taaaatgccagaccagttcacg

SEQ ID NO: 7424992 - DNA, 22 bp, Homo sapiens
taaaatgccagaccagttcacg

SEQ ID NO: 7424993 - DNA, 22 bp, Homo sapiens
taaaatgccagaccagttcacg

SEQ ID NO: 7424994 - DNA, 22 bp, Homo sapiens
taaaatgccagaccagttcacg

SEQ ID NO: 7424995 - DNA, 22 bp, Homo sapiens
taaaatgtgtttctgtatggtt

SEQ ID NO: 7424996 - DNA, 22 bp, Homo sapiens
taaaatgtgtttctgtatggtt

SEQ ID NO: 7424997 - DNA, 22 bp, Homo sapiens
taaaatgtgtttctgtatggtt

SEQ ID NO: 7424998 - DNA, 22 bp, Homo sapiens
taaaatgtgtttctgtatggtt

SEQ ID NO: 7424999 - DNA, 22 bp, Homo sapiens
taaaatgtgtttctgtatggtt

SEQ ID NO: 7425000 - DNA, 22 bp, Homo sapiens
taaaatgtgtttctgtatggtt

SEQ ID NO: 7425001 - DNA, 22 bp, Homo sapiens
taaaatgtttgcaagagaccag

SEQ ID NO: 7425002 - DNA, 22 bp, Homo sapiens
taaaatgtttgcaagagaccag

SEQ ID NO: 7425003 - DNA, 22 bp, Homo sapiens
taaaattgcggtgaatatttcc

SEQ ID NO: 7425004 - DNA, 22 bp, Homo sapiens
taaaattgcggtgaatatttcc

SEQ ID NO: 7425005 - DNA, 22 bp, Homo sapiens
taaaattgcggtgaatatttcc

SEQ ID NO: 7425006 - DNA, 22 bp, Homo sapiens
taaaattgcggtgaatatttcc

SEQ ID NO: 7425007 - DNA, 18 bp, Homo sapiens
taaaattcaaggcagggt

SEQ ID NO: 7425008 - DNA, 22 bp, Homo sapiens
taaaatgtttgcaagagaccag

SEQ ID NO: 7425009 - DNA, 22 bp, Homo sapiens
taaaatgtttgcaagagaccag

SEQ ID NO: 7425010 - DNA, 22 bp, Homo sapiens
taaaatgtttgcaagagaccag

SEQ ID NO: 7425011 - DNA, 22 bp, Homo sapiens
taaaatgtttgcaagagaccag

SEQ ID NO: 7425012 - DNA, 18 bp, Homo sapiens
taaaattcaaggcagggt

SEQ ID NO: 7425013 - DNA, 22 bp, Homo sapiens
taaaatttgtccctgagtgttg

SEQ ID NO: 7425014 - DNA, 22 bp, Homo sapiens
taaaatttgtccctgagtgttg

SEQ ID NO: 7425015 - DNA, 22 bp, Homo sapiens
taaaatttgtccctgagtgttg

SEQ ID NO: 7425016 - DNA, 22 bp, Homo sapiens
taaaatttgtccctgagtgttg

SEQ ID NO: 7425017 - DNA, 22 bp, Homo sapiens
taaaatttgtccctgagtgttg

SEQ ID NO: 7425018 - DNA, 22 bp, Homo sapiens
taaacaagaaacattttctgtt

SEQ ID NO: 7425019 - DNA, 22 bp, Homo sapiens
taaacaagaaacattttctgtt

SEQ ID NO: 7425020 - DNA, 22 bp, Homo sapiens
taaaatttgtccctgagtgttg

SEQ ID NO: 7425021 - DNA, 22 bp, Homo sapiens
taaaatttgtccctgagtgttg

SEQ ID NO: 7425022 - DNA, 22 bp, Homo sapiens
taaacaagctggactgataagt

SEQ ID NO: 7425023 - DNA, 22 bp, Homo sapiens
taaacaagaaacattttctgtt

SEQ ID NO: 7425024 - DNA, 22 bp, Homo sapiens
taaaatttgtccctgagtgttg

SEQ ID NO: 7425025 - DNA, 22 bp, Homo sapiens
taaaatttgtccctgagtgttg

SEQ ID NO: 7425026 - DNA, 22 bp, Homo sapiens
taaaatttgtccctgagtgttg

SEQ ID NO: 7425027 - DNA, 22 bp, Homo sapiens
taaaattgcggtgaatatttcc

SEQ ID NO: 7425028 - DNA, 22 bp, Homo sapiens
taaaattgcggtgaatatttcc

SEQ ID NO: 7425029 - DNA, 22 bp, Homo sapiens
taaacaattcctctctaggcat

SEQ ID NO: 7425030 - DNA, 22 bp, Homo sapiens
taaacactcacttcatagccat

SEQ ID NO: 7425031 - DNA, 22 bp, Homo sapiens
taaacaagggttactgagcatg

SEQ ID NO: 7425032 - DNA, 22 bp, Homo sapiens
taaacaagggttactgagcatg

SEQ ID NO: 7425033 - DNA, 22 bp, Homo sapiens
taaacaagggttactgagcatg

SEQ ID NO: 7425034 - DNA, 22 bp, Homo sapiens
taaacaagctggactgataagt

SEQ ID NO: 7425035 - DNA, 22 bp, Homo sapiens
taaacaagctggactgataagt

SEQ ID NO: 7425036 - DNA, 22 bp, Homo sapiens
taaacaagctgtctgatattct

SEQ ID NO: 7425037 - DNA, 22 bp, Homo sapiens
taaacaagctggactgataagt

SEQ ID NO: 7425038 - DNA, 22 bp, Homo sapiens
taaacaagctgtctgatattct

SEQ ID NO: 7425039 - DNA, 22 bp, Homo sapiens
taaacaagctgtctgatattct

SEQ ID NO: 7425040 - DNA, 22 bp, Homo sapiens
taaacaagctgtctgatattct

SEQ ID NO: 7425041 - DNA, 22 bp, Homo sapiens
taaacagaatgcgtaagaagtg

SEQ ID NO: 7425042 - DNA, 22 bp, Homo sapiens
taaacagaatgcgtaagaagtg

SEQ ID NO: 7425043 - DNA, 22 bp, Homo sapiens
taaacagaaagcagatgtactt

SEQ ID NO: 7425044 - DNA, 22 bp, Homo sapiens
taaacagaatgcgtaagaagtg

SEQ ID NO: 7425045 - DNA, 22 bp, Homo sapiens
taaacagaatgcgtaagaagtg

SEQ ID NO: 7425046 - DNA, 22 bp, Homo sapiens
taaacactgccttggtgggtca

SEQ ID NO: 7425047 - DNA, 22 bp, Homo sapiens
taaacagaaagcagatgtactt

SEQ ID NO: 7425048 - DNA, 22 bp, Homo sapiens
taaacagaaagcagatgtactt

SEQ ID NO: 7425049 - DNA, 22 bp, Homo sapiens
taaacagaaagcagatgtactt

SEQ ID NO: 7425050 - DNA, 22 bp, Homo sapiens
taaacagaaagcagatgtactt

SEQ ID NO: 7425051 - DNA, 22 bp, Homo sapiens
taaagggtaggttttactgtaa

SEQ ID NO: 7425052 - DNA, 22 bp, Homo sapiens
taaagggtaggttttactgtaa

SEQ ID NO: 7425053 - DNA, 22 bp, Homo sapiens
taaagggtaggttttactgtaa

SEQ ID NO: 7425054 - DNA, 22 bp, Homo sapiens
taaagggtaggttttactgtaa

SEQ ID NO: 7425055 - DNA, 22 bp, Homo sapiens
taaagggtaggttttactgtaa

SEQ ID NO: 7425056 - DNA, 22 bp, Homo sapiens
taaagggctaatgtgtgactgg

SEQ ID NO: 7425057 - DNA, 22 bp, Homo sapiens
taaaggcttttagtgatggtaa

SEQ ID NO: 7425058 - DNA, 22 bp, Homo sapiens
taaacagaattcaggcaagata

SEQ ID NO: 7425059 - DNA, 22 bp, Homo sapiens
taaacagaattcaggcaagata

SEQ ID NO: 7425060 - DNA, 22 bp, Homo sapiens
gtttccagctttctgatgcttg

SEQ ID NO: 7425061 - DNA, 22 bp, Homo sapiens
gtttccagctttctgatgcttg

SEQ ID NO: 7425062 - DNA, 22 bp, Homo sapiens
gtttccagcttgggcccgggga

SEQ ID NO: 7425063 - DNA, 22 bp, Homo sapiens
gtttccagcttgggcccgggga

SEQ ID NO: 7425064 - DNA, 22 bp, Homo sapiens
gtttccagctcttagcaaaggc

SEQ ID NO: 7425065 - DNA, 22 bp, Homo sapiens
gtttccagctcttagcaaaggc

SEQ ID NO: 7425066 - DNA, 22 bp, Homo sapiens
gtttccaggaagggttgggagg

SEQ ID NO: 7425067 - DNA, 22 bp, Homo sapiens
gtttccaggaagggttgggagg

SEQ ID NO: 7425068 - DNA, 22 bp, Homo sapiens
gtttccaggaggctacacctga

SEQ ID NO: 7425069 - DNA, 22 bp, Homo sapiens
gtttccaggaggctacacctga

SEQ ID NO: 7425070 - DNA, 22 bp, Homo sapiens
gtttccaggcactttttctgct

SEQ ID NO: 7425071 - DNA, 22 bp, Homo sapiens
gtttccaggcactttttctgct

SEQ ID NO: 7425072 - DNA, 22 bp, Homo sapiens
gtttccagagtgagggcacttg

SEQ ID NO: 7425073 - DNA, 22 bp, Homo sapiens
gtttccagagtgagggcacttg

SEQ ID NO: 7425074 - DNA, 22 bp, Homo sapiens
gtttccagagtgagggcacttg

SEQ ID NO: 7425075 - DNA, 22 bp, Homo sapiens
gtttccagccaatcccctcagg

SEQ ID NO: 7425076 - DNA, 22 bp, Homo sapiens
gtttccagagtgagggcacttg

SEQ ID NO: 7425077 - DNA, 22 bp, Homo sapiens
gtttccagagggaatatttgct

SEQ ID NO: 7425078 - DNA, 22 bp, Homo sapiens
gtttccagagggaatatttgct

SEQ ID NO: 7425079 - DNA, 22 bp, Homo sapiens
gtttccagcctagagatggtga

SEQ ID NO: 7425080 - DNA, 22 bp, Homo sapiens
gtttccagccaatcccctcagg

SEQ ID NO: 7425081 - DNA, 22 bp, Homo sapiens
gtttccagccctgcaggtttaa

SEQ ID NO: 7425082 - DNA, 22 bp, Homo sapiens
gtttccagccctgcaggtttaa

SEQ ID NO: 7425083 - DNA, 22 bp, Homo sapiens
gtttccagcctagagatggtga

SEQ ID NO: 7425084 - DNA, 22 bp, Homo sapiens
gtttccagcctcctgggtaaag

SEQ ID NO: 7425085 - DNA, 22 bp, Homo sapiens
gtttccagcctcctgggtaaag

SEQ ID NO: 7425086 - DNA, 22 bp, Homo sapiens
gtttccaagatgctgccatcag

SEQ ID NO: 7425087 - DNA, 22 bp, Homo sapiens
gtttccaagatgctgccatcag

SEQ ID NO: 7425088 - DNA, 22 bp, Homo sapiens
gtttccaagatgctgccatcag

SEQ ID NO: 7425089 - DNA, 22 bp, Homo sapiens
gtttccaagtctctcaacaccc

SEQ ID NO: 7425090 - DNA, 22 bp, Homo sapiens
gtttccaagtctctcaacaccc

SEQ ID NO: 7425091 - DNA, 22 bp, Homo sapiens
gtttccaactagtatgatcagg

SEQ ID NO: 7425092 - DNA, 22 bp, Homo sapiens
gtttccaactagtatgatcagg

SEQ ID NO: 7425093 - DNA, 22 bp, Homo sapiens
gtttccaactagtatgatcagg

SEQ ID NO: 7425094 - DNA, 22 bp, Homo sapiens
gtttccaagatgctgccatcag

SEQ ID NO: 7425095 - DNA, 22 bp, Homo sapiens
gtttccaactagtatgatcagg

SEQ ID NO: 7425096 - DNA, 21 bp, Homo sapiens
gtttccaacaaacctctgctt

SEQ ID NO: 7425097 - DNA, 21 bp, Homo sapiens
gtttccaacaaacctctgctt

SEQ ID NO: 7425098 - DNA, 20 bp, Homo sapiens
gtttccaaattgtgcatttt

SEQ ID NO: 7425099 - DNA, 22 bp, Homo sapiens
gtttccaaccccaccaaagtgc

SEQ ID NO: 7425100 - DNA, 21 bp, Homo sapiens
gtttccaacaaacctctgctt

SEQ ID NO: 7425101 - DNA, 22 bp, Homo sapiens
gtttccaaccccaccaaagtgc

SEQ ID NO: 7425102 - DNA, 22 bp, Homo sapiens
gtttccaagttttctttgagct

SEQ ID NO: 7425103 - DNA, 22 bp, Homo sapiens
gtttccaagttttctttgagct

SEQ ID NO: 7425104 - DNA, 22 bp, Homo sapiens
gtttccaagttttctttgagct

SEQ ID NO: 7425105 - DNA, 22 bp, Homo sapiens
gtttccaagtctctcaacaccc

SEQ ID NO: 7425106 - DNA, 22 bp, Homo sapiens
gtttccacgtctcagttccaaa

SEQ ID NO: 7425107 - DNA, 22 bp, Homo sapiens
gtttccacttatatggtaccta

SEQ ID NO: 7425108 - DNA, 22 bp, Homo sapiens
gtttccagagatcatttacata

SEQ ID NO: 7425109 - DNA, 22 bp, Homo sapiens
gtttccagagatcatttacata

SEQ ID NO: 7425110 - DNA, 22 bp, Homo sapiens
gtttccagagggaatatttgct

SEQ ID NO: 7425111 - DNA, 22 bp, Homo sapiens
gtttccaaccccaccaaagtgc

SEQ ID NO: 7425112 - DNA, 22 bp, Homo sapiens
gtttccacttgagaggactcct

SEQ ID NO: 7425113 - DNA, 22 bp, Homo sapiens
gtttccaggcgatatcagctgc

SEQ ID NO: 7425114 - DNA, 22 bp, Homo sapiens
gtttccaggctgggcagcgagc

SEQ ID NO: 7425115 - DNA, 22 bp, Homo sapiens
gtttccaggctgggcagcgagc

SEQ ID NO: 7425116 - DNA, 22 bp, Homo sapiens
gtttccaggctttggtatggtt

SEQ ID NO: 7425117 - DNA, 22 bp, Homo sapiens
gtttccaggctttggtatggtt

SEQ ID NO: 7425118 - DNA, 22 bp, Homo sapiens
gtttccaggctgggcagcgagc

SEQ ID NO: 7425119 - DNA, 22 bp, Homo sapiens
gtttccaggctttggtatggtt

SEQ ID NO: 7425120 - DNA, 22 bp, Homo sapiens
gtttccaggcgatatcagctgc

SEQ ID NO: 7425121 - DNA, 22 bp, Homo sapiens
gtttccaggcgatatcagctgc

SEQ ID NO: 7425122 - DNA, 22 bp, Homo sapiens
gtttccaggcccctccctagac

SEQ ID NO: 7425123 - DNA, 22 bp, Homo sapiens
gtttccaggcccctccctagac

SEQ ID NO: 7425124 - DNA, 22 bp, Homo sapiens
gtttccaggcccctccctagac

SEQ ID NO: 7425125 - DNA, 22 bp, Homo sapiens
gtttccaggcagggtgattctc

SEQ ID NO: 7425126 - DNA, 22 bp, Homo sapiens
gtttccaggcagggtgattctc

SEQ ID NO: 7425127 - DNA, 22 bp, Homo sapiens
gtttccatctccaggacataat

SEQ ID NO: 7425128 - DNA, 22 bp, Homo sapiens
gtttccatgaaaatgtttctgc

SEQ ID NO: 7425129 - DNA, 22 bp, Homo sapiens
gtttccatatttttagtgccaa

SEQ ID NO: 7425130 - DNA, 22 bp, Homo sapiens
gtttccatgaaaatgtttctgc

SEQ ID NO: 7425131 - DNA, 22 bp, Homo sapiens
gtttccaggctttggtatggtt

SEQ ID NO: 7425132 - DNA, 22 bp, Homo sapiens
gtttccagggctctcttcatga

SEQ ID NO: 7425133 - DNA, 22 bp, Homo sapiens
gtttccagggctctcttcatga

SEQ ID NO: 7425134 - DNA, 22 bp, Homo sapiens
gtttccagggctctcttcatga

SEQ ID NO: 7425135 - DNA, 22 bp, Homo sapiens
gtttccagtcaacttgtgtgtg

SEQ ID NO: 7425136 - DNA, 22 bp, Homo sapiens
gtttccagtcaacttgtgtgtg

SEQ ID NO: 7425137 - DNA, 22 bp, Homo sapiens
gtttcccaggctgtggggccct

SEQ ID NO: 7425138 - DNA, 22 bp, Homo sapiens
gtttcccaggctgtggggccct

SEQ ID NO: 7425139 - DNA, 22 bp, Homo sapiens
gtttcccagtctgcagagttct

SEQ ID NO: 7425140 - DNA, 22 bp, Homo sapiens
gtttcccagtctgcagagttct

SEQ ID NO: 7425141 - DNA, 22 bp, Homo sapiens
gttttcatgtctattgggcata

SEQ ID NO: 7425142 - DNA, 22 bp, Homo sapiens
gttttcatgtctattgggcata

SEQ ID NO: 7425143 - DNA, 21 bp, Homo sapiens
gttttcatgatagagtctgta

SEQ ID NO: 7425144 - DNA, 22 bp, Homo sapiens
gttttcatgtctattgggcata

SEQ ID NO: 7425145 - DNA, 22 bp, Homo sapiens
gttttcatgtctattgggcata

SEQ ID NO: 7425146 - DNA, 22 bp, Homo sapiens
gtttccatgggagaagacagtg

SEQ ID NO: 7425147 - DNA, 22 bp, Homo sapiens
gtttccatggctctgttaatgg

SEQ ID NO: 7425148 - DNA, 22 bp, Homo sapiens
gtttccatggctctgttaatgg

SEQ ID NO: 7425149 - DNA, 22 bp, Homo sapiens
gtttccatggaagcaaaggtgg

SEQ ID NO: 7425150 - DNA, 22 bp, Homo sapiens
gtttccatggaagcaaaggtgg

SEQ ID NO: 7425151 - DNA, 22 bp, Homo sapiens
gtttccatggctctgttaatgg

SEQ ID NO: 7425152 - DNA, 22 bp, Homo sapiens
gtttccatggtgtttcttgggt

SEQ ID NO: 7425153 - DNA, 22 bp, Homo sapiens
gtttccattgtcctatctatag

SEQ ID NO: 7425154 - DNA, 22 bp, Homo sapiens
gtttcccaaattgttcacaggg

SEQ ID NO: 7425155 - DNA, 22 bp, Homo sapiens
gtttcccaaattgttcacaggg

SEQ ID NO: 7425156 - DNA, 22 bp, Homo sapiens
gttttgaaatgaaagaaccaag

SEQ ID NO: 7425157 - DNA, 22 bp, Homo sapiens
gttttgaagaagaccttgaaac

SEQ ID NO: 7425158 - DNA, 22 bp, Homo sapiens
gttttgaagaagaccttgaaac

SEQ ID NO: 7425159 - DNA, 22 bp, Homo sapiens
gttttgaaatgaaagaaccaag

SEQ ID NO: 7425160 - DNA, 22 bp, Homo sapiens
gttttgaaatgaaagaaccaag

SEQ ID NO: 7425161 - DNA, 22 bp, Homo sapiens
gttttgaaatgaaagaaccaag

SEQ ID NO: 7425162 - DNA, 22 bp, Homo sapiens
gttttgaatactactagaactt

SEQ ID NO: 7425163 - DNA, 22 bp, Homo sapiens
gttttgaatactactagaactt

SEQ ID NO: 7425164 - DNA, 22 bp, Homo sapiens
gttttgaatcactgcgcttcac

SEQ ID NO: 7425165 - DNA, 21 bp, Homo sapiens
gttttctttgatagagggaag

SEQ ID NO: 7425166 - DNA, 21 bp, Homo sapiens
gttttctttgatagagggaag

SEQ ID NO: 7425167 - DNA, 21 bp, Homo sapiens
gttttctttgatagagggaag

SEQ ID NO: 7425168 - DNA, 22 bp, Homo sapiens
gttttctttgaatgcttctaga

SEQ ID NO: 7425169 - DNA, 22 bp, Homo sapiens
gttttctttgaatgcttctaga

SEQ ID NO: 7425170 - DNA, 22 bp, Homo sapiens
gttttctttgaatgcttctaga

SEQ ID NO: 7425171 - DNA, 21 bp, Homo sapiens
gttttctttgatagagggaag

SEQ ID NO: 7425172 - DNA, 21 bp, Homo sapiens
gttttctttgatagagggaag

SEQ ID NO: 7425173 - DNA, 21 bp, Homo sapiens
gttttctttgatagagggaag

SEQ ID NO: 7425174 - DNA, 21 bp, Homo sapiens
gttttctttgatagagggaag

SEQ ID NO: 7425175 - DNA, 21 bp, Homo sapiens
gttttctttgatagagggaag

SEQ ID NO: 7425176 - DNA, 21 bp, Homo sapiens
gttttctttgatagagggaag

SEQ ID NO: 7425177 - DNA, 21 bp, Homo sapiens
gttttctttgatagagggaag

SEQ ID NO: 7425178 - DNA, 22 bp, Homo sapiens
gttttctttgaatgcttctaga

SEQ ID NO: 7425179 - DNA, 22 bp, Homo sapiens
gttttctttgaatgcttctaga

SEQ ID NO: 7425180 - DNA, 22 bp, Homo sapiens
gttttctttgaatgcttctaga

SEQ ID NO: 7425181 - DNA, 22 bp, Homo sapiens
gttttctttgaatgcttctaga

SEQ ID NO: 7425182 - DNA, 22 bp, Homo sapiens
gttttctttgaatgcttctaga

SEQ ID NO: 7425183 - DNA, 22 bp, Homo sapiens
gttttctttgaatgcttctaga

SEQ ID NO: 7425184 - DNA, 22 bp, Homo sapiens
gttttctttgaatgcttctaga

SEQ ID NO: 7425185 - DNA, 22 bp, Homo sapiens
gttttcttcctgcaattggcat

SEQ ID NO: 7425186 - DNA, 22 bp, Homo sapiens
gttttcttcctgcaattggcat

SEQ ID NO: 7425187 - DNA, 22 bp, Homo sapiens
gttttcttcctgcaattggcat

SEQ ID NO: 7425188 - DNA, 22 bp, Homo sapiens
gttttcttcctgcaattggcat

SEQ ID NO: 7425189 - DNA, 22 bp, Homo sapiens
gttttcttcctgcaattggcat

SEQ ID NO: 7425190 - DNA, 22 bp, Homo sapiens
gttttcttcctgcaattggcat

SEQ ID NO: 7425191 - DNA, 22 bp, Homo sapiens
gttttcttcctgcaattggcat

SEQ ID NO: 7425192 - DNA, 22 bp, Homo sapiens
gttttcttcctgcaattggcat

SEQ ID NO: 7425193 - DNA, 22 bp, Homo sapiens
gttttccactggattgtttgga

SEQ ID NO: 7425194 - DNA, 22 bp, Homo sapiens
gttttcattactgctgtgattt

SEQ ID NO: 7425195 - DNA, 22 bp, Homo sapiens
gttttcattactgctgtgattt

SEQ ID NO: 7425196 - DNA, 22 bp, Homo sapiens
gttttcattactgctgtgattt

SEQ ID NO: 7425197 - DNA, 22 bp, Homo sapiens
gttttcattactgctgtgattt

SEQ ID NO: 7425198 - DNA, 22 bp, Homo sapiens
gttttcattactgctgtgattt

SEQ ID NO: 7425199 - DNA, 18 bp, Homo sapiens
gttttgaattgtcttaca

SEQ ID NO: 7425200 - DNA, 18 bp, Homo sapiens
gttttgaattgtcttaca

SEQ ID NO: 7425201 - DNA, 18 bp, Homo sapiens
gttttgaattgtcttaca

SEQ ID NO: 7425202 - DNA, 18 bp, Homo sapiens
gttttgaattgtcttaca

SEQ ID NO: 7425203 - DNA, 22 bp, Homo sapiens
gttttgatatatgcatacatta

SEQ ID NO: 7425204 - DNA, 22 bp, Homo sapiens
gttttgatatatgcatacatta

SEQ ID NO: 7425205 - DNA, 22 bp, Homo sapiens
gttttgcagagtgcaataaatc

SEQ ID NO: 7425206 - DNA, 21 bp, Homo sapiens
gttttgctggtatctggggat

SEQ ID NO: 7425207 - DNA, 21 bp, Homo sapiens
gttttgctggtatctggggat

SEQ ID NO: 7425208 - DNA, 22 bp, Homo sapiens
gttttgctcatttggtccaagg

SEQ ID NO: 7425209 - DNA, 22 bp, Homo sapiens
gttttgcagagtgcaataaatc

SEQ ID NO: 7425210 - DNA, 22 bp, Homo sapiens
gttttgctgactcccacaggaa

SEQ ID NO: 7425211 - DNA, 19 bp, Homo sapiens
gttttgcaggcagagggga

SEQ ID NO: 7425212 - DNA, 19 bp, Homo sapiens
gttttgcaggcagagggga

SEQ ID NO: 7425213 - DNA, 19 bp, Homo sapiens
gttttgcaggcagagggga

SEQ ID NO: 7425214 - DNA, 22 bp, Homo sapiens
gttttgcagagtgcaataaatc

SEQ ID NO: 7425215 - DNA, 22 bp, Homo sapiens
gttttgcagagtgcaataaatc

SEQ ID NO: 7425216 - DNA, 22 bp, Homo sapiens
gttttgttcatgaacattgggt

SEQ ID NO: 7425217 - DNA, 22 bp, Homo sapiens
gttttgttcatgaacattgggt

SEQ ID NO: 7425218 - DNA, 22 bp, Homo sapiens
gttttgttcatgaacattgggt

SEQ ID NO: 7425219 - DNA, 22 bp, Homo sapiens
gttttgttcttgtccagggaaa

SEQ ID NO: 7425220 - DNA, 22 bp, Homo sapiens
gttttgttcttgtccagggaaa

SEQ ID NO: 7425221 - DNA, 22 bp, Homo sapiens
gttttgttcttgtccagggaaa

SEQ ID NO: 7425222 - DNA, 22 bp, Homo sapiens
gttttgttgctgcagagctcaa

SEQ ID NO: 7425223 - DNA, 22 bp, Homo sapiens
gttttgttgctgcagagctcaa

SEQ ID NO: 7425224 - DNA, 22 bp, Homo sapiens
gttttgttgctgcagagctcaa

SEQ ID NO: 7425225 - DNA, 22 bp, Homo sapiens
gttttgtgaggcacccacaggt

SEQ ID NO: 7425226 - DNA, 22 bp, Homo sapiens
gttttggtaggactgtaaaaga

SEQ ID NO: 7425227 - DNA, 22 bp, Homo sapiens
gttttgtgaggcacccacaggt

SEQ ID NO: 7425228 - DNA, 18 bp, Homo sapiens
gttttgtggctagtagtg

SEQ ID NO: 7425229 - DNA, 22 bp, Homo sapiens
gttttggtaggaaaagctaata

SEQ ID NO: 7425230 - DNA, 22 bp, Homo sapiens
gttttggtaagaatagtcatcc

SEQ ID NO: 7425231 - DNA, 22 bp, Homo sapiens
gttttggtaggactgtaaaaga

SEQ ID NO: 7425232 - DNA, 22 bp, Homo sapiens
gttttgtgaggcacccacaggt

SEQ ID NO: 7425233 - DNA, 22 bp, Homo sapiens
gttttggtaagaatagtcatcc

SEQ ID NO: 7425234 - DNA, 22 bp, Homo sapiens
gttttggtaagaatagtcatcc

SEQ ID NO: 7425235 - DNA, 22 bp, Homo sapiens
gttttggctctggcatgtggaa

SEQ ID NO: 7425236 - DNA, 22 bp, Homo sapiens
gttttggctctggcatgtggaa

SEQ ID NO: 7425237 - DNA, 22 bp, Homo sapiens
gttttggagtcaggcttagatg

SEQ ID NO: 7425238 - DNA, 22 bp, Homo sapiens
gttttggcagccgtgttcacat

SEQ ID NO: 7425239 - DNA, 22 bp, Homo sapiens
gttttggcagccgtgttcacat

SEQ ID NO: 7425240 - DNA, 22 bp, Homo sapiens
gtttcatggagagctgaatatt

SEQ ID NO: 7425241 - DNA, 22 bp, Homo sapiens
gtttcatgccatttccagattg

SEQ ID NO: 7425242 - DNA, 22 bp, Homo sapiens
gtttcatggttgtttgatggca

SEQ ID NO: 7425243 - DNA, 22 bp, Homo sapiens
gtttcatggttgtttgatggca

SEQ ID NO: 7425244 - DNA, 22 bp, Homo sapiens
gtttcatggttgtttgatggca

SEQ ID NO: 7425245 - DNA, 22 bp, Homo sapiens
gtttcatgccatttccagattg

SEQ ID NO: 7425246 - DNA, 22 bp, Homo sapiens
gtttcatgccatttccagattg

SEQ ID NO: 7425247 - DNA, 18 bp, Homo sapiens
gtttcatgcatgtgaaac

SEQ ID NO: 7425248 - DNA, 20 bp, Homo sapiens
gtttccaaattgtgcatttt

SEQ ID NO: 7425249 - DNA, 20 bp, Homo sapiens
gtttccaaattgtgcatttt

SEQ ID NO: 7425250 - DNA, 22 bp, Homo sapiens
gtttcatttacatctgtaggta

SEQ ID NO: 7425251 - DNA, 22 bp, Homo sapiens
gtttcatttacatctgtaggta

SEQ ID NO: 7425252 - DNA, 22 bp, Homo sapiens
gtttcattcggcagctcataag

SEQ ID NO: 7425253 - DNA, 22 bp, Homo sapiens
gtttcattacctgacccatgag

SEQ ID NO: 7425254 - DNA, 22 bp, Homo sapiens
gtttcattacctgacccatgag

SEQ ID NO: 7425255 - DNA, 19 bp, Homo sapiens
gtttcattaagataggaaa

SEQ ID NO: 7425256 - DNA, 19 bp, Homo sapiens
gtttcattaagataggaaa

SEQ ID NO: 7425257 - DNA, 22 bp, Homo sapiens
gtttcatatatagtaactgaaa

SEQ ID NO: 7425258 - DNA, 22 bp, Homo sapiens
gtttcatatgcagttaacagca

SEQ ID NO: 7425259 - DNA, 22 bp, Homo sapiens
gtttcatatgcagttaacagca

SEQ ID NO: 7425260 - DNA, 22 bp, Homo sapiens
gtttcatatgcagttaacagca

SEQ ID NO: 7425261 - DNA, 22 bp, Homo sapiens
gtttcatgactgatgttgttga

SEQ ID NO: 7425262 - DNA, 18 bp, Homo sapiens
gtttcatgcatgtgaaac

SEQ ID NO: 7425263 - DNA, 22 bp, Homo sapiens
gtttcataggcatgtgacctat

SEQ ID NO: 7425264 - DNA, 22 bp, Homo sapiens
gtttcatataccaagcacttga

SEQ ID NO: 7425265 - DNA, 22 bp, Homo sapiens
gtttcatataccaagcacttga

SEQ ID NO: 7425266 - DNA, 22 bp, Homo sapiens
gtttcatatatagtaactgaaa

SEQ ID NO: 7425267 - DNA, 22 bp, Homo sapiens
gtttcatatatagtaactgaaa

SEQ ID NO: 7425268 - DNA, 22 bp, Homo sapiens
gtttcataattcaatcaaatga

SEQ ID NO: 7425269 - DNA, 22 bp, Homo sapiens
gtttcataattcaatcaaatga

SEQ ID NO: 7425270 - DNA, 22 bp, Homo sapiens
gtttcaggtttaggcacctgga

SEQ ID NO: 7425271 - DNA, 22 bp, Homo sapiens
gtttcatacagattattcatgg

SEQ ID NO: 7425272 - DNA, 22 bp, Homo sapiens
gtttcatacagattattcatgg

SEQ ID NO: 7425273 - DNA, 22 bp, Homo sapiens
gtttcatacagattattcatgg

SEQ ID NO: 7425274 - DNA, 22 bp, Homo sapiens
gtttcatagcatatacgtgtgt

SEQ ID NO: 7425275 - DNA, 22 bp, Homo sapiens
gtttcatagcatatacgtgtgt

SEQ ID NO: 7425276 - DNA, 22 bp, Homo sapiens
gtttcatagctacgattttggg

SEQ ID NO: 7425277 - DNA, 22 bp, Homo sapiens
gtttcataggcatgtgacctat

SEQ ID NO: 7425278 - DNA, 22 bp, Homo sapiens
gttgtacaaaatatcagtgagg

SEQ ID NO: 7425279 - DNA, 22 bp, Homo sapiens
gttgtacaaaatatcagtgagg

SEQ ID NO: 7425280 - DNA, 22 bp, Homo sapiens
gttgtacaattgtttcacatgc

SEQ ID NO: 7425281 - DNA, 22 bp, Homo sapiens
gttgtacaattgtttcacatgc

SEQ ID NO: 7425282 - DNA, 22 bp, Homo sapiens
gttgtacaattgtttcacatgc

SEQ ID NO: 7425283 - DNA, 22 bp, Homo sapiens
gttgtacagacatgaaacttgc

SEQ ID NO: 7425284 - DNA, 22 bp, Homo sapiens
gttgtacagacatgaaacttgc

SEQ ID NO: 7425285 - DNA, 22 bp, Homo sapiens
gttgtacagacatgaaacttgc

SEQ ID NO: 7425286 - DNA, 22 bp, Homo sapiens
gttgtacaattgtttcacatgc

SEQ ID NO: 7425287 - DNA, 22 bp, Homo sapiens
gttgtacagacatgaaacttgc

SEQ ID NO: 7425288 - DNA, 22 bp, Homo sapiens
gttgtacagcatccagtgcaga

SEQ ID NO: 7425289 - DNA, 22 bp, Homo sapiens
gttgtacagcatccagtgcaga

SEQ ID NO: 7425290 - DNA, 19 bp, Homo sapiens
gttgtaaatggaggtttct

SEQ ID NO: 7425291 - DNA, 22 bp, Homo sapiens
gttgtaagtttaatgtcaattg

SEQ ID NO: 7425292 - DNA, 22 bp, Homo sapiens
gttgtacaaaatatcagtgagg

SEQ ID NO: 7425293 - DNA, 22 bp, Homo sapiens
gttgtacaaaatatcagtgagg

SEQ ID NO: 7425294 - DNA, 22 bp, Homo sapiens
gttgtaaatacagcagataatt

SEQ ID NO: 7425295 - DNA, 22 bp, Homo sapiens
gttgtaaatacagtactgaaac

SEQ ID NO: 7425296 - DNA, 22 bp, Homo sapiens
gttggtggatgtgggcagagca

SEQ ID NO: 7425297 - DNA, 22 bp, Homo sapiens
gttggtggatgtgggcagagca

SEQ ID NO: 7425298 - DNA, 22 bp, Homo sapiens
gttggtggatgtgggcagagca

SEQ ID NO: 7425299 - DNA, 22 bp, Homo sapiens
gttgtaaatacagcagataatt

SEQ ID NO: 7425300 - DNA, 22 bp, Homo sapiens
gtttcagatatatttgtactta

SEQ ID NO: 7425301 - DNA, 22 bp, Homo sapiens
gtttcagatatatttgtactta

SEQ ID NO: 7425302 - DNA, 22 bp, Homo sapiens
gtttcagagttagtgctggctg

SEQ ID NO: 7425303 - DNA, 22 bp, Homo sapiens
gtttcagagttagtgctggctg

SEQ ID NO: 7425304 - DNA, 22 bp, Homo sapiens
gtttcagagttagtgctggctg

SEQ ID NO: 7425305 - DNA, 22 bp, Homo sapiens
gtttcagatttggtttcagaag

SEQ ID NO: 7425306 - DNA, 22 bp, Homo sapiens
gtttcagatttggtttcagaag

SEQ ID NO: 7425307 - DNA, 22 bp, Homo sapiens
gttgtacagcattccatatagg

SEQ ID NO: 7425308 - DNA, 22 bp, Homo sapiens
gttgtacagcatccagtgcaga

SEQ ID NO: 7425309 - DNA, 22 bp, Homo sapiens
gttgtacagcatccagtgcaga

SEQ ID NO: 7425310 - DNA, 22 bp, Homo sapiens
gttgtacagcatccagtgcaga

SEQ ID NO: 7425311 - DNA, 22 bp, Homo sapiens
gtttcagaaatgttctcctgct

SEQ ID NO: 7425312 - DNA, 22 bp, Homo sapiens
gtttcagaacaccccatttggg

SEQ ID NO: 7425313 - DNA, 22 bp, Homo sapiens
gtttcagaggtgttcattttca

SEQ ID NO: 7425314 - DNA, 22 bp, Homo sapiens
gtttcagaggtgttcattttca

SEQ ID NO: 7425315 - DNA, 22 bp, Homo sapiens
gtttcagactattctgtttctg

SEQ ID NO: 7425316 - DNA, 22 bp, Homo sapiens
gtttcagactattctgtttctg

SEQ ID NO: 7425317 - DNA, 22 bp, Homo sapiens
gtttcagagtagaacctcaagg

SEQ ID NO: 7425318 - DNA, 22 bp, Homo sapiens
gtttcagagtagaacctcaagg

SEQ ID NO: 7425319 - DNA, 22 bp, Homo sapiens
gtttcagagtagaacctcaagg

SEQ ID NO: 7425320 - DNA, 22 bp, Homo sapiens
gttgccaggggctgctgtcacc

SEQ ID NO: 7425321 - DNA, 22 bp, Homo sapiens
gttgccaggacagcgcggcccg

SEQ ID NO: 7425322 - DNA, 22 bp, Homo sapiens
gttgccagacttctgtggctcc

SEQ ID NO: 7425323 - DNA, 22 bp, Homo sapiens
gttgccagccctcagggactga

SEQ ID NO: 7425324 - DNA, 22 bp, Homo sapiens
gttgcattttaaatgcatgttg

SEQ ID NO: 7425325 - DNA, 22 bp, Homo sapiens
gttgccgtttgttctaccagac

SEQ ID NO: 7425326 - DNA, 22 bp, Homo sapiens
gttgcctaggctggtcttgaac

SEQ ID NO: 7425327 - DNA, 22 bp, Homo sapiens
gttgcctaggctggtcttgaac

SEQ ID NO: 7425328 - DNA, 22 bp, Homo sapiens
gttgccatctgagaagagcagc

SEQ ID NO: 7425329 - DNA, 22 bp, Homo sapiens
gttgcctaggctggtcttgaac

SEQ ID NO: 7425330 - DNA, 22 bp, Homo sapiens
gttgcctaggctggagtgcagt

SEQ ID NO: 7425331 - DNA, 22 bp, Homo sapiens
gttgcagatgtggaactcgtgc

SEQ ID NO: 7425332 - DNA, 22 bp, Homo sapiens
gttgcaggaagcacacacatgt

SEQ ID NO: 7425333 - DNA, 22 bp, Homo sapiens
gttgcagcatcactgctgagtg

SEQ ID NO: 7425334 - DNA, 22 bp, Homo sapiens
gttgcaggaagcacacacatgt

SEQ ID NO: 7425335 - DNA, 22 bp, Homo sapiens
gttgcaggaggatggctgcata

SEQ ID NO: 7425336 - DNA, 22 bp, Homo sapiens
gttgcaggaggatggctgcata

SEQ ID NO: 7425337 - DNA, 22 bp, Homo sapiens
gttgcaggaggatggctgcata

SEQ ID NO: 7425338 - DNA, 22 bp, Homo sapiens
gttgcaggatgattttataagg

SEQ ID NO: 7425339 - DNA, 22 bp, Homo sapiens
gttgcaggcattaattaaaact

SEQ ID NO: 7425340 - DNA, 22 bp, Homo sapiens
gttgcataaagccttcctcata

SEQ ID NO: 7425341 - DNA, 22 bp, Homo sapiens
gttgcataagaccacaaggagc

SEQ ID NO: 7425342 - DNA, 22 bp, Homo sapiens
gttgcaaactcctacttctcat

SEQ ID NO: 7425343 - DNA, 22 bp, Homo sapiens
gttgcaaatgggaagatggtta

SEQ ID NO: 7425344 - DNA, 22 bp, Homo sapiens
gttgatttagtgagtgagcagt

SEQ ID NO: 7425345 - DNA, 22 bp, Homo sapiens
gttgatttgaagagcagaaagt

SEQ ID NO: 7425346 - DNA, 22 bp, Homo sapiens
gttgagtgggttaggatgctga

SEQ ID NO: 7425347 - DNA, 22 bp, Homo sapiens
gttgatatttgcagagtgtacc

SEQ ID NO: 7425348 - DNA, 22 bp, Homo sapiens
gttgattccggggccatttcaa

SEQ ID NO: 7425349 - DNA, 22 bp, Homo sapiens
gttgattgattgattgactggt

SEQ ID NO: 7425350 - DNA, 22 bp, Homo sapiens
gttgatgaaaatgaattgcatg

SEQ ID NO: 7425351 - DNA, 22 bp, Homo sapiens
gttgcagacggggtgcactgaa

SEQ ID NO: 7425352 - DNA, 22 bp, Homo sapiens
gttgcagactcaagaaaataaa

SEQ ID NO: 7425353 - DNA, 22 bp, Homo sapiens
gttgcagatgtggaactcgtgc

SEQ ID NO: 7425354 - DNA, 22 bp, Homo sapiens
gttgcagatgtggaactcgtgc

SEQ ID NO: 7425355 - DNA, 22 bp, Homo sapiens
gttggggaaggtgggagaatgt

SEQ ID NO: 7425356 - DNA, 22 bp, Homo sapiens
gttggggaaggtgggagaatgt

SEQ ID NO: 7425357 - DNA, 22 bp, Homo sapiens
gttgggctgaagtgtgtgctta

SEQ ID NO: 7425358 - DNA, 22 bp, Homo sapiens
gttggggaaggtgggagaatgt

SEQ ID NO: 7425359 - DNA, 22 bp, Homo sapiens
gttggggaaggtgggagaatgt

SEQ ID NO: 7425360 - DNA, 22 bp, Homo sapiens
gttgggccccagaggtccaggc

SEQ ID NO: 7425361 - DNA, 22 bp, Homo sapiens
gttgggatgtcaggcctaggtg

SEQ ID NO: 7425362 - DNA, 22 bp, Homo sapiens
gttgggagcagcagaccaagag

SEQ ID NO: 7425363 - DNA, 22 bp, Homo sapiens
gttggtcaggatggtctcaaac

SEQ ID NO: 7425364 - DNA, 22 bp, Homo sapiens
gttggtcaaggacagaggttca

SEQ ID NO: 7425365 - DNA, 19 bp, Homo sapiens
gttggtcattctacacaac

SEQ ID NO: 7425366 - DNA, 22 bp, Homo sapiens
gttggtcatatcattgaagctt

SEQ ID NO: 7425367 - DNA, 22 bp, Homo sapiens
gttggggtaccttgaggctggg

SEQ ID NO: 7425368 - DNA, 22 bp, Homo sapiens
gttggggtaccttgaggctggg

SEQ ID NO: 7425369 - DNA, 22 bp, Homo sapiens
gttggggtaccttgaggctggg

SEQ ID NO: 7425370 - DNA, 22 bp, Homo sapiens
gttggggtccaatgaagcgagc

SEQ ID NO: 7425371 - DNA, 22 bp, Homo sapiens
gttgggttaaccaggatgtcaa

SEQ ID NO: 7425372 - DNA, 22 bp, Homo sapiens
gttgggttaaccaggatgtcaa

SEQ ID NO: 7425373 - DNA, 22 bp, Homo sapiens
gttgccttcactggtcttggca

SEQ ID NO: 7425374 - DNA, 22 bp, Homo sapiens
gttgccttctatgattctcagt

SEQ ID NO: 7425375 - DNA, 22 bp, Homo sapiens
gttgccttctatgattctcagt

SEQ ID NO: 7425376 - DNA, 23 bp, Homo sapiens
gttgcctttgcatcttcatccat

SEQ ID NO: 7425377 - DNA, 23 bp, Homo sapiens
gttgcctttgcatcttcatccat

SEQ ID NO: 7425378 - DNA, 22 bp, Homo sapiens
gttgctcaatgggaataagaat

SEQ ID NO: 7425379 - DNA, 22 bp, Homo sapiens
gttgctcaggcaggagtacagt

SEQ ID NO: 7425380 - DNA, 22 bp, Homo sapiens
gttgctcaggcaggagtacagt

SEQ ID NO: 7425381 - DNA, 22 bp, Homo sapiens
gttgctcaggcaggagtacagt

SEQ ID NO: 7425382 - DNA, 22 bp, Homo sapiens
gttgctcaggcaggagtacagt

SEQ ID NO: 7425383 - DNA, 22 bp, Homo sapiens
gttgctcaggcaggagtacagt

SEQ ID NO: 7425384 - DNA, 22 bp, Homo sapiens
gttgctctatgtgtgttctatg

SEQ ID NO: 7425385 - DNA, 22 bp, Homo sapiens
gttgggaaggcaagaagtagaa

SEQ ID NO: 7425386 - DNA, 22 bp, Homo sapiens
gttgggaaggtgaacatgatgc

SEQ ID NO: 7425387 - DNA, 22 bp, Homo sapiens
gttgggagcagcagaccaagag

SEQ ID NO: 7425388 - DNA, 22 bp, Homo sapiens
gttgggaagtgtagctccacct

SEQ ID NO: 7425389 - DNA, 22 bp, Homo sapiens
gttgggagcagcagaccaagag

SEQ ID NO: 7425390 - DNA, 22 bp, Homo sapiens
gttgggagcagcagaccaagag

SEQ ID NO: 7425391 - DNA, 22 bp, Homo sapiens
gttgggagcagcagaccaagag

SEQ ID NO: 7425392 - DNA, 22 bp, Homo sapiens
gttgggagcagcagaccaagag

SEQ ID NO: 7425393 - DNA, 22 bp, Homo sapiens
gttacaaaggactgggggccac

SEQ ID NO: 7425394 - DNA, 22 bp, Homo sapiens
gttacaaaggactgggggccac

SEQ ID NO: 7425395 - DNA, 22 bp, Homo sapiens
gttacaaaggactgggggccac

SEQ ID NO: 7425396 - DNA, 22 bp, Homo sapiens
gttacaaaggactgggggccac

SEQ ID NO: 7425397 - DNA, 22 bp, Homo sapiens
gttacaaaggactgggggccac

SEQ ID NO: 7425398 - DNA, 22 bp, Homo sapiens
gttacaaaggactgggggccac

SEQ ID NO: 7425399 - DNA, 22 bp, Homo sapiens
gttacaaaggactgggggccac

SEQ ID NO: 7425400 - DNA, 22 bp, Homo sapiens
gttacaaaggactgggggccac

SEQ ID NO: 7425401 - DNA, 22 bp, Homo sapiens
gttacaaaggactgggggccac

SEQ ID NO: 7425402 - DNA, 21 bp, Homo sapiens
gttcaagtgatcctcctgtct

SEQ ID NO: 7425403 - DNA, 22 bp, Homo sapiens
gttacaaaggtcataaaagtgt

SEQ ID NO: 7425404 - DNA, 22 bp, Homo sapiens
gttacaaaggtcataaaagtgt

SEQ ID NO: 7425405 - DNA, 22 bp, Homo sapiens
gttacaaaggtcataaaagtgt

SEQ ID NO: 7425406 - DNA, 22 bp, Homo sapiens
gttacaaaggtcataaaagtgt

SEQ ID NO: 7425407 - DNA, 22 bp, Homo sapiens
gttacaaaggtcataaaagtgt

SEQ ID NO: 7425408 - DNA, 22 bp, Homo sapiens
gttacaaaggtcataaaagtgt

SEQ ID NO: 7425409 - DNA, 22 bp, Homo sapiens
gttacaaaggtcataaaagtgt

SEQ ID NO: 7425410 - DNA, 21 bp, Homo sapiens
gttcaagttcctgctctgtga

SEQ ID NO: 7425411 - DNA, 22 bp, Homo sapiens
gttcaatttcagcatccattga

SEQ ID NO: 7425412 - DNA, 22 bp, Homo sapiens
gttcaatttcagcatccattga

SEQ ID NO: 7425413 - DNA, 22 bp, Homo sapiens
gttcacaaaattctggccagtg

SEQ ID NO: 7425414 - DNA, 22 bp, Homo sapiens
gttcacaaagtactgtatgcat

SEQ ID NO: 7425415 - DNA, 22 bp, Homo sapiens
gttcacaaagtactgtatgcat

SEQ ID NO: 7425416 - DNA, 22 bp, Homo sapiens
gttcacaaagtactgtatgcat

SEQ ID NO: 7425417 - DNA, 21 bp, Homo sapiens
gttcaatagctctttgaatgc

SEQ ID NO: 7425418 - DNA, 22 bp, Homo sapiens
gttcaattaagttacaaattta

SEQ ID NO: 7425419 - DNA, 21 bp, Homo sapiens
gttcaatagctctttgaatgc

SEQ ID NO: 7425420 - DNA, 21 bp, Homo sapiens
gttcaatagctctttgaatgc

SEQ ID NO: 7425421 - DNA, 22 bp, Homo sapiens
gttcaattaagttacaaattta

SEQ ID NO: 7425422 - DNA, 22 bp, Homo sapiens
gttcaattatacagtcagaggg

SEQ ID NO: 7425423 - DNA, 22 bp, Homo sapiens
gttcaatttagaaagcacagtt

SEQ ID NO: 7425424 - DNA, 22 bp, Homo sapiens
gttcacatgctctcatgctttt

SEQ ID NO: 7425425 - DNA, 22 bp, Homo sapiens
gttcacatggcattttcacatc

SEQ ID NO: 7425426 - DNA, 22 bp, Homo sapiens
gttcacatcctggctgtgccac

SEQ ID NO: 7425427 - DNA, 22 bp, Homo sapiens
gttcacatccttgtgaggattt

SEQ ID NO: 7425428 - DNA, 22 bp, Homo sapiens
gttcacatccttgtgaggattt

SEQ ID NO: 7425429 - DNA, 22 bp, Homo sapiens
gttcacatccttgtgaggattt

SEQ ID NO: 7425430 - DNA, 22 bp, Homo sapiens
gttcacatcacttcactgaacc

SEQ ID NO: 7425431 - DNA, 22 bp, Homo sapiens
gttcacatcacttcactgaacc

SEQ ID NO: 7425432 - DNA, 22 bp, Homo sapiens
gttcacatcccagaaagagcat

SEQ ID NO: 7425433 - DNA, 22 bp, Homo sapiens
gttcacatcctgctttttccct

SEQ ID NO: 7425434 - DNA, 22 bp, Homo sapiens
gttcacattaactcaccggtgc

SEQ ID NO: 7425435 - DNA, 20 bp, Homo sapiens
gttcactgagcttaaatgtt

SEQ ID NO: 7425436 - DNA, 20 bp, Homo sapiens
gttcactgagcttaaatgtt

SEQ ID NO: 7425437 - DNA, 22 bp, Homo sapiens
gttcactgctttcttagtactc

SEQ ID NO: 7425438 - DNA, 22 bp, Homo sapiens
gttcactgctttcttagtactc

SEQ ID NO: 7425439 - DNA, 22 bp, Homo sapiens
gttcactggctgtgtgactctg

SEQ ID NO: 7425440 - DNA, 22 bp, Homo sapiens
gttcactggctgtgtgactctg

SEQ ID NO: 7425441 - DNA, 22 bp, Homo sapiens
gttcacatggcattttcacatc

SEQ ID NO: 7425442 - DNA, 22 bp, Homo sapiens
gttcacatggcattttcacatc

SEQ ID NO: 7425443 - DNA, 22 bp, Homo sapiens
gttcacatggcattttcacatc

SEQ ID NO: 7425444 - DNA, 22 bp, Homo sapiens
gttcacatgtggtcatgctgtc

SEQ ID NO: 7425445 - DNA, 22 bp, Homo sapiens
gttcacatgtggtcatgctgtc

SEQ ID NO: 7425446 - DNA, 22 bp, Homo sapiens
gttcacatgtgttatcttcttt

SEQ ID NO: 7425447 - DNA, 22 bp, Homo sapiens
gttcagagacacttattggaaa

SEQ ID NO: 7425448 - DNA, 21 bp, Homo sapiens
gttcagagattattgagtcat

SEQ ID NO: 7425449 - DNA, 21 bp, Homo sapiens
gttcagagattattgagtcat

SEQ ID NO: 7425450 - DNA, 22 bp, Homo sapiens
gttcagagaaagagacacctta

SEQ ID NO: 7425451 - DNA, 22 bp, Homo sapiens
gttcagagaaagagacacctta

SEQ ID NO: 7425452 - DNA, 22 bp, Homo sapiens
gttcagaaattaggagaataaa

SEQ ID NO: 7425453 - DNA, 22 bp, Homo sapiens
gttcactgtactggtgatggtt

SEQ ID NO: 7425454 - DNA, 22 bp, Homo sapiens
gttcagaaaacattggaataca

SEQ ID NO: 7425455 - DNA, 22 bp, Homo sapiens
gttcactggctgtgtgactctg

SEQ ID NO: 7425456 - DNA, 22 bp, Homo sapiens
gttcactgggtttgatttcctt

SEQ ID NO: 7425457 - DNA, 22 bp, Homo sapiens
gttcactgtactggtgatggtt

SEQ ID NO: 7425458 - DNA, 22 bp, Homo sapiens
gttcactgtactggtgatggtt

SEQ ID NO: 7425459 - DNA, 22 bp, Homo sapiens
gttcactgtactggtgatggtt

SEQ ID NO: 7425460 - DNA, 22 bp, Homo sapiens
gttcagatttgactggtttctc

SEQ ID NO: 7425461 - DNA, 22 bp, Homo sapiens
gttcagatttgactggtttctc

SEQ ID NO: 7425462 - DNA, 22 bp, Homo sapiens
gttcagatttgactggtttctc

SEQ ID NO: 7425463 - DNA, 22 bp, Homo sapiens
gttcagagtgggaatgatcact

SEQ ID NO: 7425464 - DNA, 22 bp, Homo sapiens
gttcagagtattaattgattta

SEQ ID NO: 7425465 - DNA, 22 bp, Homo sapiens
gttcagcaatagatctagaggc

SEQ ID NO: 7425466 - DNA, 22 bp, Homo sapiens
gttcagcaatagatctagaggc

SEQ ID NO: 7425467 - DNA, 22 bp, Homo sapiens
gttcagcagcagtgattttgtg

SEQ ID NO: 7425468 - DNA, 22 bp, Homo sapiens
gttcagcacaggtgctcagaca

SEQ ID NO: 7425469 - DNA, 22 bp, Homo sapiens
gttcagctaggaatggagatgc

SEQ ID NO: 7425470 - DNA, 22 bp, Homo sapiens
gttcagctcaagcaataatttt

SEQ ID NO: 7425471 - DNA, 22 bp, Homo sapiens
gttcagggagggacagatgaag

SEQ ID NO: 7425472 - DNA, 22 bp, Homo sapiens
gttgaggtgatgccagccctgc

SEQ ID NO: 7425473 - DNA, 22 bp, Homo sapiens
gttgaggtgatgccagccctgc

SEQ ID NO: 7425474 - DNA, 22 bp, Homo sapiens
gttgaggtgatgccagccctgc

SEQ ID NO: 7425475 - DNA, 22 bp, Homo sapiens
gttgaggtgatgccagccctgc

SEQ ID NO: 7425476 - DNA, 22 bp, Homo sapiens
gttgaggtgatgccagccctgc

SEQ ID NO: 7425477 - DNA, 22 bp, Homo sapiens
gttgagtacctgctttatgtca

SEQ ID NO: 7425478 - DNA, 22 bp, Homo sapiens
gttgagtgggttaggatgctga

SEQ ID NO: 7425479 - DNA, 22 bp, Homo sapiens
gttgagtgggttaggatgctga

SEQ ID NO: 7425480 - DNA, 22 bp, Homo sapiens
gttcattttactgtaaatagca

SEQ ID NO: 7425481 - DNA, 22 bp, Homo sapiens
gttgaggaggcactcactgtca

SEQ ID NO: 7425482 - DNA, 22 bp, Homo sapiens
gttgaggtgatgccagccctgc

SEQ ID NO: 7425483 - DNA, 22 bp, Homo sapiens
gttgaggtgatgccagccctgc

SEQ ID NO: 7425484 - DNA, 22 bp, Homo sapiens
gttgaggaggttcagggtggtt

SEQ ID NO: 7425485 - DNA, 22 bp, Homo sapiens
gttcatttatgatgtaacatgt

SEQ ID NO: 7425486 - DNA, 22 bp, Homo sapiens
gttcatttatgatgtaacatgt

SEQ ID NO: 7425487 - DNA, 22 bp, Homo sapiens
gttcatttatgatgtaacatgt

SEQ ID NO: 7425488 - DNA, 22 bp, Homo sapiens
gttcatttatgatgtaacatgt

SEQ ID NO: 7425489 - DNA, 22 bp, Homo sapiens
gttcatttatgatgtaacatgt

SEQ ID NO: 7425490 - DNA, 22 bp, Homo sapiens
gttgaggagcaagcatgtgtct

SEQ ID NO: 7425491 - DNA, 22 bp, Homo sapiens
gttcatgctaccctttcctaat

SEQ ID NO: 7425492 - DNA, 22 bp, Homo sapiens
gttcatgagctcttaactgaga

SEQ ID NO: 7425493 - DNA, 20 bp, Homo sapiens
gttcatgtctcaaatagaaa

SEQ ID NO: 7425494 - DNA, 19 bp, Homo sapiens
gttcatgtgaggaaggaac

SEQ ID NO: 7425495 - DNA, 20 bp, Homo sapiens
gttcatgtctcaaatagaaa

SEQ ID NO: 7425496 - DNA, 22 bp, Homo sapiens
gttcatgtttgtgtattgctca

SEQ ID NO: 7425497 - DNA, 22 bp, Homo sapiens
gttcatgtggtttttaaaggat

SEQ ID NO: 7425498 - DNA, 22 bp, Homo sapiens
gttcatgtggaaatttaaaaca

SEQ ID NO: 7425499 - DNA, 22 bp, Homo sapiens
gttcatgtggaaatttaaaaca

SEQ ID NO: 7425500 - DNA, 19 bp, Homo sapiens
gttcattgttcaggaaaat

SEQ ID NO: 7425501 - DNA, 22 bp, Homo sapiens
gttcatttaggaaaggaagagt

SEQ ID NO: 7425502 - DNA, 22 bp, Homo sapiens
gttcattgttaacgtgtccact

SEQ ID NO: 7425503 - DNA, 22 bp, Homo sapiens
gttcatttatgatgtaacatgt

SEQ ID NO: 7425504 - DNA, 22 bp, Homo sapiens
gttcatttaggaaaggaagagt

SEQ ID NO: 7425505 - DNA, 22 bp, Homo sapiens
gttcatttaggaaaggaagagt

SEQ ID NO: 7425506 - DNA, 22 bp, Homo sapiens
gttcattcatcaaatatttact

SEQ ID NO: 7425507 - DNA, 22 bp, Homo sapiens
gttcattctgaaaagcagcttg

SEQ ID NO: 7425508 - DNA, 22 bp, Homo sapiens
gttcattcatcaaatatttact

SEQ ID NO: 7425509 - DNA, 22 bp, Homo sapiens
gttcatcctgacttggattagt

SEQ ID NO: 7425510 - DNA, 22 bp, Homo sapiens
gttcatcctgacttggattagt

SEQ ID NO: 7425511 - DNA, 22 bp, Homo sapiens
gttcatccatgtcagcgtatat

SEQ ID NO: 7425512 - DNA, 22 bp, Homo sapiens
gttcatccatgtcagcgtatat

SEQ ID NO: 7425513 - DNA, 22 bp, Homo sapiens
gttcatccatattatagcatgt

SEQ ID NO: 7425514 - DNA, 22 bp, Homo sapiens
gttcatccatattatagcatgt

SEQ ID NO: 7425515 - DNA, 22 bp, Homo sapiens
gttcatcactcagagacctccc

SEQ ID NO: 7425516 - DNA, 22 bp, Homo sapiens
gttcatatttaactaagatagg

SEQ ID NO: 7425517 - DNA, 22 bp, Homo sapiens
gttcatatttaactaagatagg

SEQ ID NO: 7425518 - DNA, 22 bp, Homo sapiens
gttcatatttaactaagatagg

SEQ ID NO: 7425519 - DNA, 22 bp, Homo sapiens
gttcatatttaactaagatagg

SEQ ID NO: 7425520 - DNA, 22 bp, Homo sapiens
gttcataatttgaaggaatagg

SEQ ID NO: 7425521 - DNA, 22 bp, Homo sapiens
gttcataatttgaaggaatagg

SEQ ID NO: 7425522 - DNA, 22 bp, Homo sapiens
gttcataatttgaaggaatagg

SEQ ID NO: 7425523 - DNA, 22 bp, Homo sapiens
gttcagttttggggctgttaca

SEQ ID NO: 7425524 - DNA, 22 bp, Homo sapiens
gttcatattactttgagtgcag

SEQ ID NO: 7425525 - DNA, 22 bp, Homo sapiens
gttcatattactttgagtgcag

SEQ ID NO: 7425526 - DNA, 22 bp, Homo sapiens
gttcatattctaagtaactggc

SEQ ID NO: 7425527 - DNA, 22 bp, Homo sapiens
gttcagtttggggtatttgaag

SEQ ID NO: 7425528 - DNA, 22 bp, Homo sapiens
gttcagtttggggtatttgaag

SEQ ID NO: 7425529 - DNA, 22 bp, Homo sapiens
gttcagtttggggtatttgaag

SEQ ID NO: 7425530 - DNA, 22 bp, Homo sapiens
gttcagtttgagattaccatgg

SEQ ID NO: 7425531 - DNA, 22 bp, Homo sapiens
gttcagttttggggctgttaca

SEQ ID NO: 7425532 - DNA, 22 bp, Homo sapiens
gttcagttttggggctgttaca

SEQ ID NO: 7425533 - DNA, 22 bp, Homo sapiens
gttcagtttggggtatttgaag

SEQ ID NO: 7425534 - DNA, 22 bp, Homo sapiens
gttcagttttgaaatgttaatt

SEQ ID NO: 7425535 - DNA, 22 bp, Homo sapiens
gttcagttttgaaatgttaatt

SEQ ID NO: 7425536 - DNA, 22 bp, Homo sapiens
gttcagttttgaaatgttaatt

SEQ ID NO: 7425537 - DNA, 22 bp, Homo sapiens
gttcagtacctctaaactttgt

SEQ ID NO: 7425538 - DNA, 22 bp, Homo sapiens
gttcagtattaatgagatgatt

SEQ ID NO: 7425539 - DNA, 22 bp, Homo sapiens
gttcagtcacgtgcccaagttc

SEQ ID NO: 7425540 - DNA, 22 bp, Homo sapiens
gttcagtgattctcggtgttca

SEQ ID NO: 7425541 - DNA, 22 bp, Homo sapiens
gttcagtgccagttctaagact

SEQ ID NO: 7425542 - DNA, 22 bp, Homo sapiens
gttcagtggggccttgggggac

SEQ ID NO: 7425543 - DNA, 22 bp, Homo sapiens
gttcagtgccagttctaagact

SEQ ID NO: 7425544 - DNA, 22 bp, Homo sapiens
gttcagtggggccttgggggac

SEQ ID NO: 7425545 - DNA, 22 bp, Homo sapiens
gttcagtggtgtatccccagtg

SEQ ID NO: 7425546 - DNA, 22 bp, Homo sapiens
gttcagtgtctctctattttat

SEQ ID NO: 7425547 - DNA, 22 bp, Homo sapiens
gttcagttatttctgaagatat

SEQ ID NO: 7425548 - DNA, 22 bp, Homo sapiens
gttcagttatgtgacctcaaaa

SEQ ID NO: 7425549 - DNA, 22 bp, Homo sapiens
gttcagttatttctgaagatat

SEQ ID NO: 7425550 - DNA, 22 bp, Homo sapiens
gttcagtttgacaacctttata

SEQ ID NO: 7425551 - DNA, 22 bp, Homo sapiens
gttcagttatttctgaagatat

SEQ ID NO: 7425552 - DNA, 22 bp, Homo sapiens
gttcagttatgtgacctcaaaa

SEQ ID NO: 7425553 - DNA, 22 bp, Homo sapiens
gttcagtttgagattaccatgg

SEQ ID NO: 7425554 - DNA, 22 bp, Homo sapiens
gttcagtttgagattaccatgg

SEQ ID NO: 7425555 - DNA, 22 bp, Homo sapiens
gttcagtttgagattaccatgg

SEQ ID NO: 7425556 - DNA, 22 bp, Homo sapiens
gttcagtttgacaacctttata

SEQ ID NO: 7425557 - DNA, 22 bp, Homo sapiens
gttcagtttgacaacctttata

SEQ ID NO: 7425558 - DNA, 22 bp, Homo sapiens
gttcagtttgacaacctttata

SEQ ID NO: 7425559 - DNA, 22 bp, Homo sapiens
gttcagtgtttacatgattgtt

SEQ ID NO: 7425560 - DNA, 22 bp, Homo sapiens
gttcagtgtttacatgattgtt

SEQ ID NO: 7425561 - DNA, 22 bp, Homo sapiens
gttcagtgtttgatttctgctg

SEQ ID NO: 7425562 - DNA, 22 bp, Homo sapiens
gttcagtgtttttattgacagg

SEQ ID NO: 7425563 - DNA, 22 bp, Homo sapiens
gttcagtgtttttattgacagg

SEQ ID NO: 7425564 - DNA, 22 bp, Homo sapiens
gtgtggctgtttagtgactttc

SEQ ID NO: 7425565 - DNA, 22 bp, Homo sapiens
gtgtggctgattgacatggtca

SEQ ID NO: 7425566 - DNA, 18 bp, Homo sapiens
gtgtggctgagatgaggc

SEQ ID NO: 7425567 - DNA, 22 bp, Homo sapiens
gtgtggctgaaatcaaggcagg

SEQ ID NO: 7425568 - DNA, 22 bp, Homo sapiens
gtgtggctagaagtgtcttgtt

SEQ ID NO: 7425569 - DNA, 22 bp, Homo sapiens
gtgtggctacctcagaggagca

SEQ ID NO: 7425570 - DNA, 22 bp, Homo sapiens
gtgtgcctcccattagggtgta

SEQ ID NO: 7425571 - DNA, 22 bp, Homo sapiens
gtgtgcctcgccaagctgtcgg

SEQ ID NO: 7425572 - DNA, 22 bp, Homo sapiens
gtgtgcctcccattagggtgta

SEQ ID NO: 7425573 - DNA, 22 bp, Homo sapiens
gtgtgcccttgttcagcagagt

SEQ ID NO: 7425574 - DNA, 22 bp, Homo sapiens
gtgtgccctggctccagcacca

SEQ ID NO: 7425575 - DNA, 22 bp, Homo sapiens
gtgtgcccaggtaaagcatttc

SEQ ID NO: 7425576 - DNA, 22 bp, Homo sapiens
gtgtgcccgggggaagcaggtg

SEQ ID NO: 7425577 - DNA, 22 bp, Homo sapiens
gtgtggctacctcagaggagca

SEQ ID NO: 7425578 - DNA, 22 bp, Homo sapiens
gtgtggccttgggagaggtctg

SEQ ID NO: 7425579 - DNA, 22 bp, Homo sapiens
gtgtggcctcaacgggatgcaa

SEQ ID NO: 7425580 - DNA, 22 bp, Homo sapiens
gtgtggccttgggagaggtctg

SEQ ID NO: 7425581 - DNA, 22 bp, Homo sapiens
gtgtggccttgggagaggtctg

SEQ ID NO: 7425582 - DNA, 22 bp, Homo sapiens
gtgtggccttgggagaggtctg

SEQ ID NO: 7425583 - DNA, 23 bp, Homo sapiens
gtgtgcctttatcttctgtactc

SEQ ID NO: 7425584 - DNA, 22 bp, Homo sapiens
gtgtggcctcaacgggatgcaa

SEQ ID NO: 7425585 - DNA, 22 bp, Homo sapiens
gtgtggcttgggtgaggcgcct

SEQ ID NO: 7425586 - DNA, 22 bp, Homo sapiens
gtgtggctgtttagtgactttc

SEQ ID NO: 7425587 - DNA, 22 bp, Homo sapiens
gtgtgggaaggctaggatgctg

SEQ ID NO: 7425588 - DNA, 22 bp, Homo sapiens
gtgtgggaaggctaggatgctg

SEQ ID NO: 7425589 - DNA, 22 bp, Homo sapiens
gtgtgggaaggctaggatgctg

SEQ ID NO: 7425590 - DNA, 22 bp, Homo sapiens
gtgtgggaaggctaggatgctg

SEQ ID NO: 7425591 - DNA, 22 bp, Homo sapiens
gtgtgggacgggtgagtggcca

SEQ ID NO: 7425592 - DNA, 22 bp, Homo sapiens
gtgtgggacgggtgagtggcca

SEQ ID NO: 7425593 - DNA, 22 bp, Homo sapiens
gtgtgggacgggtgagtggcca

SEQ ID NO: 7425594 - DNA, 22 bp, Homo sapiens
gtgtgggaatggcggtcgtgca

SEQ ID NO: 7425595 - DNA, 22 bp, Homo sapiens
gtgtgggaatggcggtcgtgca

SEQ ID NO: 7425596 - DNA, 22 bp, Homo sapiens
gtgtgggaatggcggtcgtgca

SEQ ID NO: 7425597 - DNA, 22 bp, Homo sapiens
gtgtgggaatggcggtcgtgca

SEQ ID NO: 7425598 - DNA, 22 bp, Homo sapiens
gtgtgggaatggcggtcgtgca

SEQ ID NO: 7425599 - DNA, 22 bp, Homo sapiens
gtgtgggaaggctaggatgctg

SEQ ID NO: 7425600 - DNA, 22 bp, Homo sapiens
gtgtgggaatggcggtcgtgca

SEQ ID NO: 7425601 - DNA, 22 bp, Homo sapiens
gtgtgggaatggcggtcgtgca

SEQ ID NO: 7425602 - DNA, 22 bp, Homo sapiens
gttaagaacttgttgaaggtct

SEQ ID NO: 7425603 - DNA, 22 bp, Homo sapiens
gttaactttttacagaaatgaa

SEQ ID NO: 7425604 - DNA, 22 bp, Homo sapiens
gtgtgggacgggtgagtggcca

SEQ ID NO: 7425605 - DNA, 22 bp, Homo sapiens
gtgtgggacgggtgagtggcca

SEQ ID NO: 7425606 - DNA, 22 bp, Homo sapiens
gttaagaagctagagatgaaca

SEQ ID NO: 7425607 - DNA, 22 bp, Homo sapiens
gttaagaagctagagatgaaca

SEQ ID NO: 7425608 - DNA, 22 bp, Homo sapiens
gttaagaatcaagacttatctt

SEQ ID NO: 7425609 - DNA, 22 bp, Homo sapiens
gttaagaacttgttgaaggtct

SEQ ID NO: 7425610 - DNA, 22 bp, Homo sapiens
gttaagaagctagagatgaaca

SEQ ID NO: 7425611 - DNA, 22 bp, Homo sapiens
gttaagaatcaagacttatctt

SEQ ID NO: 7425612 - DNA, 22 bp, Homo sapiens
gttaagaatcaagacttatctt

SEQ ID NO: 7425613 - DNA, 22 bp, Homo sapiens
gttaagaatgcattatgcatat

SEQ ID NO: 7425614 - DNA, 22 bp, Homo sapiens
gttaagaatgcattatgcatat

SEQ ID NO: 7425615 - DNA, 22 bp, Homo sapiens
gttaagaattcgttctcatgtt

SEQ ID NO: 7425616 - DNA, 20 bp, Homo sapiens
gttaagccatgccagacttc

SEQ ID NO: 7425617 - DNA, 22 bp, Homo sapiens
gttaagcctgaatcacattaat

SEQ ID NO: 7425618 - DNA, 22 bp, Homo sapiens
gttaagaattcgttctcatgtt

SEQ ID NO: 7425619 - DNA, 22 bp, Homo sapiens
gttaagaatgcattatgcatat

SEQ ID NO: 7425620 - DNA, 22 bp, Homo sapiens
gttacaaagcacttcaagtgaa

SEQ ID NO: 7425621 - DNA, 22 bp, Homo sapiens
gttacaaagcacttcaagtgaa

SEQ ID NO: 7425622 - DNA, 22 bp, Homo sapiens
gttacaaaggaagcttcactgc

SEQ ID NO: 7425623 - DNA, 22 bp, Homo sapiens
gttacaaaggaagcttcactgc

SEQ ID NO: 7425624 - DNA, 22 bp, Homo sapiens
gttacaaagcacttcaagtgaa

SEQ ID NO: 7425625 - DNA, 22 bp, Homo sapiens
gttacaaagcacttcaagtgaa

SEQ ID NO: 7425626 - DNA, 22 bp, Homo sapiens
gttacaaagcacttcaagtgaa

SEQ ID NO: 7425627 - DNA, 22 bp, Homo sapiens
gttacaaagcacttcaagtgaa

SEQ ID NO: 7425628 - DNA, 22 bp, Homo sapiens
gttacaaagcacttcaagtgaa

SEQ ID NO: 7425629 - DNA, 22 bp, Homo sapiens
gttacaaagcacttcaagtgaa

SEQ ID NO: 7425630 - DNA, 22 bp, Homo sapiens
gttacaaaggaagcttcactgc

SEQ ID NO: 7425631 - DNA, 22 bp, Homo sapiens
gttacaaaggaagcttcactgc

SEQ ID NO: 7425632 - DNA, 22 bp, Homo sapiens
gttacaaaggaagcttcactgc

SEQ ID NO: 7425633 - DNA, 22 bp, Homo sapiens
gttacaaaggaagcttcactgc

SEQ ID NO: 7425634 - DNA, 22 bp, Homo sapiens
gttacaaaggaagcttcactgc

SEQ ID NO: 7425635 - DNA, 22 bp, Homo sapiens
gttacaaaggaagcttcactgc

SEQ ID NO: 7425636 - DNA, 22 bp, Homo sapiens
gttacaaaggaagcttcactgc

SEQ ID NO: 7425637 - DNA, 22 bp, Homo sapiens
gttacaaaggaagcttcactgc

SEQ ID NO: 7425638 - DNA, 22 bp, Homo sapiens
gttacaaaggaagcttcactgc

SEQ ID NO: 7425639 - DNA, 18 bp, Homo sapiens
gttaattttgaagttcat

SEQ ID NO: 7425640 - DNA, 18 bp, Homo sapiens
gttaattttgaagttcat

SEQ ID NO: 7425641 - DNA, 22 bp, Homo sapiens
gttaatttgcagctttcgagct

SEQ ID NO: 7425642 - DNA, 22 bp, Homo sapiens
gttaatttgcagctttcgagct

SEQ ID NO: 7425643 - DNA, 22 bp, Homo sapiens
gttaatttgcagctttcgagct

SEQ ID NO: 7425644 - DNA, 22 bp, Homo sapiens
gttacaaactcaggtgccaaaa

SEQ ID NO: 7425645 - DNA, 22 bp, Homo sapiens
gttacaaactcaggtgccaaaa

SEQ ID NO: 7425646 - DNA, 18 bp, Homo sapiens
gttaattttgaagttcat

SEQ ID NO: 7425647 - DNA, 18 bp, Homo sapiens
gttaattttgaagttcat

SEQ ID NO: 7425648 - DNA, 22 bp, Homo sapiens
gttacaaactcaggtgccaaaa

SEQ ID NO: 7425649 - DNA, 22 bp, Homo sapiens
gttacaaactcaggtgccaaaa

SEQ ID NO: 7425650 - DNA, 22 bp, Homo sapiens
gttacaaactcaggtgccaaaa

SEQ ID NO: 7425651 - DNA, 22 bp, Homo sapiens
gttacaaactcaggtgccaaaa

SEQ ID NO: 7425652 - DNA, 22 bp, Homo sapiens
gttacaaactcaggtgccaaaa

SEQ ID NO: 7425653 - DNA, 22 bp, Homo sapiens
gttacaaactcaggtgccaaaa

SEQ ID NO: 7425654 - DNA, 22 bp, Homo sapiens
gttacaaactcaggtgccaaaa

SEQ ID NO: 7425655 - DNA, 22 bp, Homo sapiens
gttacaaactcaggtgccaaaa

SEQ ID NO: 7425656 - DNA, 22 bp, Homo sapiens
gttacaaagcacttcaagtgaa

SEQ ID NO: 7425657 - DNA, 22 bp, Homo sapiens
gttacaaagcacttcaagtgaa

SEQ ID NO: 7425658 - DNA, 22 bp, Homo sapiens
gttacaaagcacttcaagtgaa

SEQ ID NO: 7425659 - DNA, 22 bp, Homo sapiens
gttacaaactcaggtgccaaaa

SEQ ID NO: 7425660 - DNA, 22 bp, Homo sapiens
gttacaaactcaggtgccaaaa

SEQ ID NO: 7425661 - DNA, 22 bp, Homo sapiens
gttaatttagtagagtccagat

SEQ ID NO: 7425662 - DNA, 22 bp, Homo sapiens
gttaatttagtagagtccagat

SEQ ID NO: 7425663 - DNA, 22 bp, Homo sapiens
gttaatgttatctgaagacagt

SEQ ID NO: 7425664 - DNA, 22 bp, Homo sapiens
gttaatgttatctgaagacagt

SEQ ID NO: 7425665 - DNA, 22 bp, Homo sapiens
gttaatttagtagagtccagat

SEQ ID NO: 7425666 - DNA, 22 bp, Homo sapiens
gttaatgtgtctgacacaatgg

SEQ ID NO: 7425667 - DNA, 22 bp, Homo sapiens
gttaatgtgatataaagtattt

SEQ ID NO: 7425668 - DNA, 22 bp, Homo sapiens
gttaatgtggtagtgcatatct

SEQ ID NO: 7425669 - DNA, 22 bp, Homo sapiens
gttaatgtgtctgacacaatgg

SEQ ID NO: 7425670 - DNA, 22 bp, Homo sapiens
gttaatgtgtctgacacaatgg

SEQ ID NO: 7425671 - DNA, 22 bp, Homo sapiens
gttaatgccattaggaaattta

SEQ ID NO: 7425672 - DNA, 22 bp, Homo sapiens
gttaatatttacctgtcaagaa

SEQ ID NO: 7425673 - DNA, 22 bp, Homo sapiens
gttaatacaaccatgatcttct

SEQ ID NO: 7425674 - DNA, 22 bp, Homo sapiens
gttaatacaaccatgatcttct

SEQ ID NO: 7425675 - DNA, 22 bp, Homo sapiens
gttaatgcctacatattaagca

SEQ ID NO: 7425676 - DNA, 22 bp, Homo sapiens
gttaatgcaaagcagagggcaa

SEQ ID NO: 7425677 - DNA, 22 bp, Homo sapiens
gttaatgtcactttatgtggct

SEQ ID NO: 7425678 - DNA, 22 bp, Homo sapiens
gttaatgtcttcctattctaca

SEQ ID NO: 7425679 - DNA, 22 bp, Homo sapiens
gttaaggatcttgagatgagga

SEQ ID NO: 7425680 - DNA, 22 bp, Homo sapiens
gttaaggctgagcaggacactg

SEQ ID NO: 7425681 - DNA, 22 bp, Homo sapiens
gttaaggctgagcaggacactg

SEQ ID NO: 7425682 - DNA, 22 bp, Homo sapiens
gttaaggctgagcaggacactg

SEQ ID NO: 7425683 - DNA, 22 bp, Homo sapiens
gttaaggctgagcaggacactg

SEQ ID NO: 7425684 - DNA, 22 bp, Homo sapiens
gttaagtgagggcttttgagtc

SEQ ID NO: 7425685 - DNA, 22 bp, Homo sapiens
gttaagtgaatgtcatgtcagg

SEQ ID NO: 7425686 - DNA, 22 bp, Homo sapiens
gttaagtgaatgtcatgtcagg

SEQ ID NO: 7425687 - DNA, 22 bp, Homo sapiens
gttaagtaaactatgatttatc

SEQ ID NO: 7425688 - DNA, 22 bp, Homo sapiens
gttaagtaaactatgatttatc

SEQ ID NO: 7425689 - DNA, 23 bp, Homo sapiens
gttaataatgaacactttctccc

SEQ ID NO: 7425690 - DNA, 22 bp, Homo sapiens
gttaataaaggtatagaatcag

SEQ ID NO: 7425691 - DNA, 23 bp, Homo sapiens
gttaataatgaacactttctccc

SEQ ID NO: 7425692 - DNA, 22 bp, Homo sapiens
gttaatacaaccatgatcttct

SEQ ID NO: 7425693 - DNA, 22 bp, Homo sapiens
gttaataaaggtatagaatcag

SEQ ID NO: 7425694 - DNA, 22 bp, Homo sapiens
gttaagtgggaccagtgtcctt

SEQ ID NO: 7425695 - DNA, 22 bp, Homo sapiens
gttaataaaggtatagaatcag

SEQ ID NO: 7425696 - DNA, 22 bp, Homo sapiens
gttaataaaggtatagaatcag

SEQ ID NO: 7425697 - DNA, 22 bp, Homo sapiens
gttaataaaggtatagaatcag

SEQ ID NO: 7425698 - DNA, 22 bp, Homo sapiens
gttaataaaggtatagaatcag

SEQ ID NO: 7425699 - DNA, 22 bp, Homo sapiens
gttaataaaggtatagaatcag

SEQ ID NO: 7425700 - DNA, 22 bp, Homo sapiens
gtgctcctggccacatgaagct

SEQ ID NO: 7425701 - DNA, 22 bp, Homo sapiens
gtgctcctggccacatgaagct

SEQ ID NO: 7425702 - DNA, 22 bp, Homo sapiens
gtgctcctggccacatgaagct

SEQ ID NO: 7425703 - DNA, 22 bp, Homo sapiens
gtgctcctcacagtgtggccct

SEQ ID NO: 7425704 - DNA, 22 bp, Homo sapiens
gtgctcctggccacatgaagct

SEQ ID NO: 7425705 - DNA, 22 bp, Homo sapiens
gtgctccctccttcctcaagga

SEQ ID NO: 7425706 - DNA, 22 bp, Homo sapiens
gtgctccctccttcctcaagga

SEQ ID NO: 7425707 - DNA, 22 bp, Homo sapiens
gtgctctccagccccacgtgga

SEQ ID NO: 7425708 - DNA, 22 bp, Homo sapiens
gtgctctaggaccttagaagtg

SEQ ID NO: 7425709 - DNA, 22 bp, Homo sapiens
gtgctctcctggctgccctgac

SEQ ID NO: 7425710 - DNA, 22 bp, Homo sapiens
gtgctctgagtttgcatgtcag

SEQ ID NO: 7425711 - DNA, 22 bp, Homo sapiens
gtgctctgagtttgcatgtcag

SEQ ID NO: 7425712 - DNA, 22 bp, Homo sapiens
gtgctctgagtttgcatgtcag

SEQ ID NO: 7425713 - DNA, 22 bp, Homo sapiens
gtgctctgagtttgcatgtcag

SEQ ID NO: 7425714 - DNA, 22 bp, Homo sapiens
gtgctctgcctggggtcatggc

SEQ ID NO: 7425715 - DNA, 22 bp, Homo sapiens
gtgctctgcctggggtcatggc

SEQ ID NO: 7425716 - DNA, 22 bp, Homo sapiens
gtgctctgatctgtctgacatc

SEQ ID NO: 7425717 - DNA, 22 bp, Homo sapiens
gtgctctgcctggggtcatggc

SEQ ID NO: 7425718 - DNA, 22 bp, Homo sapiens
gtgctctgagtttgcatgtcag

SEQ ID NO: 7425719 - DNA, 22 bp, Homo sapiens
gtgctctgatctgtctgacatc

SEQ ID NO: 7425720 - DNA, 22 bp, Homo sapiens
gtgctctggccaagcgcgtgcg

SEQ ID NO: 7425721 - DNA, 22 bp, Homo sapiens
gtgctctggccaagcgcgtgcg

SEQ ID NO: 7425722 - DNA, 23 bp, Homo sapiens
gtgctctgcggtctgctagtctg

SEQ ID NO: 7425723 - DNA, 23 bp, Homo sapiens
gtgctctgcggtctgctagtctg

SEQ ID NO: 7425724 - DNA, 23 bp, Homo sapiens
gtgctctgcggtctgctagtctg

SEQ ID NO: 7425725 - DNA, 23 bp, Homo sapiens
gtgctctgcggtctgctagtctg

SEQ ID NO: 7425726 - DNA, 23 bp, Homo sapiens
gtgctctgcggtctgctagtctg

SEQ ID NO: 7425727 - DNA, 22 bp, Homo sapiens
gtgctctgcctggggtcatggc

SEQ ID NO: 7425728 - DNA, 22 bp, Homo sapiens
gtgctccaggataggctgacct

SEQ ID NO: 7425729 - DNA, 19 bp, Homo sapiens
gtgctccagggcaaggagt

SEQ ID NO: 7425730 - DNA, 22 bp, Homo sapiens
gtgctccaggtcgctcagagag

SEQ ID NO: 7425731 - DNA, 22 bp, Homo sapiens
gtgctccaggtcgctcagagag

SEQ ID NO: 7425732 - DNA, 22 bp, Homo sapiens
gtgctccaggtcgctcagagag

SEQ ID NO: 7425733 - DNA, 22 bp, Homo sapiens
gtgctccatggcctgtgtccat

SEQ ID NO: 7425734 - DNA, 22 bp, Homo sapiens
gtgctccatggcctgtgtccat

SEQ ID NO: 7425735 - DNA, 22 bp, Homo sapiens
gtgctccaggtcgctcagagag

SEQ ID NO: 7425736 - DNA, 22 bp, Homo sapiens
gtgctccatggcctgtgtccat

SEQ ID NO: 7425737 - DNA, 22 bp, Homo sapiens
gtgctccaacattagtgtgctt

SEQ ID NO: 7425738 - DNA, 22 bp, Homo sapiens
gtgctccaacattagtgtgctt

SEQ ID NO: 7425739 - DNA, 22 bp, Homo sapiens
gtgctcatgtcctttcactgca

SEQ ID NO: 7425740 - DNA, 22 bp, Homo sapiens
gtgctcatgtcctttcactgca

SEQ ID NO: 7425741 - DNA, 22 bp, Homo sapiens
gtgctcattttgtaatgtaact

SEQ ID NO: 7425742 - DNA, 19 bp, Homo sapiens
gtgctccagggcaaggagt

SEQ ID NO: 7425743 - DNA, 22 bp, Homo sapiens
gtgctccaggataggctgacct

SEQ ID NO: 7425744 - DNA, 22 bp, Homo sapiens
gtgctccctccttcctcaagga

SEQ ID NO: 7425745 - DNA, 22 bp, Homo sapiens
gtgctccctccttcctcaagga

SEQ ID NO: 7425746 - DNA, 22 bp, Homo sapiens
gtgctccctccttcctcaagga

SEQ ID NO: 7425747 - DNA, 22 bp, Homo sapiens
gtgctccctccttcctcaagga

SEQ ID NO: 7425748 - DNA, 22 bp, Homo sapiens
gtgctccctccttcctcaagga

SEQ ID NO: 7425749 - DNA, 22 bp, Homo sapiens
gtgctccctccttcctcaagga

SEQ ID NO: 7425750 - DNA, 22 bp, Homo sapiens
gtgctccctccttcctcaagga

SEQ ID NO: 7425751 - DNA, 22 bp, Homo sapiens
gtgctccctccttcctcaagga

SEQ ID NO: 7425752 - DNA, 22 bp, Homo sapiens
gtgctccctccttcctcaagga

SEQ ID NO: 7425753 - DNA, 22 bp, Homo sapiens
gtgctccctccttcctcaagga

SEQ ID NO: 7425754 - DNA, 22 bp, Homo sapiens
gtgctcagcccggatgagatca

SEQ ID NO: 7425755 - DNA, 22 bp, Homo sapiens
gtgctcagcccggatgagatca

SEQ ID NO: 7425756 - DNA, 22 bp, Homo sapiens
gtgctcaggaccaaatgaacca

SEQ ID NO: 7425757 - DNA, 22 bp, Homo sapiens
gtgctcaggaccaaatgaacca

SEQ ID NO: 7425758 - DNA, 22 bp, Homo sapiens
gtgctcactgtgagacgtcctg

SEQ ID NO: 7425759 - DNA, 22 bp, Homo sapiens
gtgctcaggaagctgttcctgc

SEQ ID NO: 7425760 - DNA, 22 bp, Homo sapiens
gtgctcactccccacagtgccc

SEQ ID NO: 7425761 - DNA, 22 bp, Homo sapiens
gtgctcactccccacagtgccc

SEQ ID NO: 7425762 - DNA, 22 bp, Homo sapiens
gtgctatgattggacagaatag

SEQ ID NO: 7425763 - DNA, 22 bp, Homo sapiens
gtgctcagaaacttgctcattt

SEQ ID NO: 7425764 - DNA, 22 bp, Homo sapiens
gtgctcagggcctggctgggga

SEQ ID NO: 7425765 - DNA, 22 bp, Homo sapiens
gtgctcagggcctggctgggga

SEQ ID NO: 7425766 - DNA, 22 bp, Homo sapiens
gtgctcaggggcaatcctggga

SEQ ID NO: 7425767 - DNA, 22 bp, Homo sapiens
gtgctcatagatgatgctcttt

SEQ ID NO: 7425768 - DNA, 22 bp, Homo sapiens
gtgctcatcgtggagcctgagg

SEQ ID NO: 7425769 - DNA, 22 bp, Homo sapiens
gtgctcaggggcaatcctggga

SEQ ID NO: 7425770 - DNA, 22 bp, Homo sapiens
gtgctcaggttcccatgagtgc

SEQ ID NO: 7425771 - DNA, 22 bp, Homo sapiens
gtgtgcatgcatagacaccaca

SEQ ID NO: 7425772 - DNA, 22 bp, Homo sapiens
gtgtgcatcttttctgcttgat

SEQ ID NO: 7425773 - DNA, 22 bp, Homo sapiens
gtgtgcatatgtgtggctctcc

SEQ ID NO: 7425774 - DNA, 22 bp, Homo sapiens
gtgtgcatatgtgtggctctcc

SEQ ID NO: 7425775 - DNA, 22 bp, Homo sapiens
gtgtgcatagtcgtgcatgcat

SEQ ID NO: 7425776 - DNA, 18 bp, Homo sapiens
gtgtgcagttgcaggggt

SEQ ID NO: 7425777 - DNA, 18 bp, Homo sapiens
gtgtgcagttgcaggggt

SEQ ID NO: 7425778 - DNA, 18 bp, Homo sapiens
gtgtgcagttgcaggggt

SEQ ID NO: 7425779 - DNA, 22 bp, Homo sapiens
gtgctgaaatggacctcaggaa

SEQ ID NO: 7425780 - DNA, 21 bp, Homo sapiens
gtgctctgggcagcagagggc

SEQ ID NO: 7425781 - DNA, 21 bp, Homo sapiens
gtgctctgggcagcagagggc

SEQ ID NO: 7425782 - DNA, 21 bp, Homo sapiens
gtgctctgggcagcagagggc

SEQ ID NO: 7425783 - DNA, 22 bp, Homo sapiens
gtgctctggctggtctcccggt

SEQ ID NO: 7425784 - DNA, 21 bp, Homo sapiens
gtgctctgggcagcagagggc

SEQ ID NO: 7425785 - DNA, 22 bp, Homo sapiens
gtgctctggctggtctcccggt

SEQ ID NO: 7425786 - DNA, 22 bp, Homo sapiens
gtgctctggctggtctcccggt

SEQ ID NO: 7425787 - DNA, 22 bp, Homo sapiens
gtgctctgggctgcctgacatg

SEQ ID NO: 7425788 - DNA, 22 bp, Homo sapiens
gtgctctgggctgcctgacatg

SEQ ID NO: 7425789 - DNA, 22 bp, Homo sapiens
gtgctctgggctgcctgacatg

SEQ ID NO: 7425790 - DNA, 22 bp, Homo sapiens
gtgctctgggctgcctgacatg

SEQ ID NO: 7425791 - DNA, 22 bp, Homo sapiens
gtgctctgggctgcctgacatg

SEQ ID NO: 7425792 - DNA, 22 bp, Homo sapiens
gtgctctgtgtattaggatgtc

SEQ ID NO: 7425793 - DNA, 22 bp, Homo sapiens
gtgctctgtggattgagttgaa

SEQ ID NO: 7425794 - DNA, 22 bp, Homo sapiens
gtgctctgtggattgagttgaa

SEQ ID NO: 7425795 - DNA, 22 bp, Homo sapiens
gtgctctgggctgcctgacatg

SEQ ID NO: 7425796 - DNA, 22 bp, Homo sapiens
gtgctctgtggattgagttgaa

SEQ ID NO: 7425797 - DNA, 22 bp, Homo sapiens
gtgctctgtggattgagttgaa

SEQ ID NO: 7425798 - DNA, 23 bp, Homo sapiens
gtgctcttcagttttagggtcat

SEQ ID NO: 7425799 - DNA, 22 bp, Homo sapiens
gtgctctgtgtattaggatgtc

SEQ ID NO: 7425800 - DNA, 22 bp, Homo sapiens
gtgctctgtggattgagttgaa

SEQ ID NO: 7425801 - DNA, 22 bp, Homo sapiens
gtgctctgtgtattaggatgtc

SEQ ID NO: 7425802 - DNA, 22 bp, Homo sapiens
gtgtgcatgtatatacttttat

SEQ ID NO: 7425803 - DNA, 22 bp, Homo sapiens
gtgtgcatgtggaagcatgtat

SEQ ID NO: 7425804 - DNA, 22 bp, Homo sapiens
gtgtgcatgtggaagcatgtat

SEQ ID NO: 7425805 - DNA, 22 bp, Homo sapiens
gtgtgccaacaaaagacagtgc

SEQ ID NO: 7425806 - DNA, 19 bp, Homo sapiens
gtgtgcattgtcgcatcat

SEQ ID NO: 7425807 - DNA, 23 bp, Homo sapiens
gtgtgccaagcactgtgccagga

SEQ ID NO: 7425808 - DNA, 23 bp, Homo sapiens
gtgtgccaagcactgtgccagga

SEQ ID NO: 7425809 - DNA, 22 bp, Homo sapiens
gtgtgccaacaaaagacagtgc

SEQ ID NO: 7425810 - DNA, 22 bp, Homo sapiens
gtgtgccaagagatagttgctg

SEQ ID NO: 7425811 - DNA, 22 bp, Homo sapiens
gtgtgccaccactgacaggatt

SEQ ID NO: 7425812 - DNA, 23 bp, Homo sapiens
gtgtgccaagcactgtgccagga

SEQ ID NO: 7425813 - DNA, 22 bp, Homo sapiens
gtgtgccaccactgacaggatt

SEQ ID NO: 7425814 - DNA, 22 bp, Homo sapiens
gtgtgccaccactgacaggatt

SEQ ID NO: 7425815 - DNA, 22 bp, Homo sapiens
gtgtgccaccactgacaggatt

SEQ ID NO: 7425816 - DNA, 22 bp, Homo sapiens
gtgtgccaccactgacaggatt

SEQ ID NO: 7425817 - DNA, 22 bp, Homo sapiens
gtgtgccaccagtcaaggtgaa

SEQ ID NO: 7425818 - DNA, 22 bp, Homo sapiens
gtgtgccaccagtcaaggtgaa

SEQ ID NO: 7425819 - DNA, 22 bp, Homo sapiens
gtgtgccactgcctgaggaccc

SEQ ID NO: 7425820 - DNA, 22 bp, Homo sapiens
gtgtgccaccagtcaaggtgaa

SEQ ID NO: 7425821 - DNA, 22 bp, Homo sapiens
gtgtgccactgcctgaggaccc

SEQ ID NO: 7425822 - DNA, 22 bp, Homo sapiens
gtgtgccagacatgatgctatg

SEQ ID NO: 7425823 - DNA, 22 bp, Homo sapiens
gtgtgccagacatgatgctatg

SEQ ID NO: 7425824 - DNA, 22 bp, Homo sapiens
gtgtgccaggaactggctgctg

SEQ ID NO: 7425825 - DNA, 22 bp, Homo sapiens
gtgtgccagtcctgactcctga

SEQ ID NO: 7425826 - DNA, 22 bp, Homo sapiens
tacaaagatagtgttagagtaa

SEQ ID NO: 7425827 - DNA, 22 bp, Homo sapiens
tacaaagatagtgttagagtaa

SEQ ID NO: 7425828 - DNA, 22 bp, Homo sapiens
tacaaagatagtgttagagtaa

SEQ ID NO: 7425829 - DNA, 22 bp, Homo sapiens
tacaaagatagtgttagagtaa

SEQ ID NO: 7425830 - DNA, 22 bp, Homo sapiens
tacaaagatagtgttagagtaa

SEQ ID NO: 7425831 - DNA, 22 bp, Homo sapiens
tacaaagatagtgttagagtaa

SEQ ID NO: 7425832 - DNA, 22 bp, Homo sapiens
tacaaagatagtgttagagtaa

SEQ ID NO: 7425833 - DNA, 22 bp, Homo sapiens
tacaaagatagtgttagagtaa

SEQ ID NO: 7425834 - DNA, 22 bp, Homo sapiens
tacaaagatagtgttagagtaa

SEQ ID NO: 7425835 - DNA, 22 bp, Homo sapiens
tacaaagatagtgttagagtaa

SEQ ID NO: 7425836 - DNA, 22 bp, Homo sapiens
tacaaagataaaatctcaccat

SEQ ID NO: 7425837 - DNA, 22 bp, Homo sapiens
tacaaagagtttggtctctaga

SEQ ID NO: 7425838 - DNA, 22 bp, Homo sapiens
tacaaagataaaatctcaccat

SEQ ID NO: 7425839 - DNA, 22 bp, Homo sapiens
tacaaagataaaatctcaccat

SEQ ID NO: 7425840 - DNA, 22 bp, Homo sapiens
tacaaagataaaatctcaccat

SEQ ID NO: 7425841 - DNA, 22 bp, Homo sapiens
tacaaagatagtgttagagtaa

SEQ ID NO: 7425842 - DNA, 22 bp, Homo sapiens
tacaaagatggaaggttatgtt

SEQ ID NO: 7425843 - DNA, 22 bp, Homo sapiens
tacaaagatggaaggttatgtt

SEQ ID NO: 7425844 - DNA, 22 bp, Homo sapiens
tacaaagatggaaggttatgtt

SEQ ID NO: 7425845 - DNA, 22 bp, Homo sapiens
tacaaagatagtgttagagtaa

SEQ ID NO: 7425846 - DNA, 22 bp, Homo sapiens
tacaaagatggaaggttatgtt

SEQ ID NO: 7425847 - DNA, 22 bp, Homo sapiens
tacaaagcaaatcatctaagag

SEQ ID NO: 7425848 - DNA, 22 bp, Homo sapiens
tacaaagcctggtagatatctg

SEQ ID NO: 7425849 - DNA, 22 bp, Homo sapiens
tacaaagcctggtagatatctg

SEQ ID NO: 7425850 - DNA, 22 bp, Homo sapiens
tacaaagctgtatagcctggtc

SEQ ID NO: 7425851 - DNA, 22 bp, Homo sapiens
tacaaagcctggtagatatctg

SEQ ID NO: 7425852 - DNA, 22 bp, Homo sapiens
tacaaagcttgtactgtgtgac

SEQ ID NO: 7425853 - DNA, 22 bp, Homo sapiens
tacaaagctgtatagcctggtc

SEQ ID NO: 7425854 - DNA, 22 bp, Homo sapiens
tacaaagcttgtactgtgtgac

SEQ ID NO: 7425855 - DNA, 22 bp, Homo sapiens
tacaaaggaaacttcttttccc

SEQ ID NO: 7425856 - DNA, 22 bp, Homo sapiens
tacaaaggacagcagaaaaata

SEQ ID NO: 7425857 - DNA, 22 bp, Homo sapiens
tacaaaggaaacttcttttccc

SEQ ID NO: 7425858 - DNA, 22 bp, Homo sapiens
tacaaaggagaatagggtagca

SEQ ID NO: 7425859 - DNA, 22 bp, Homo sapiens
tacaaaggacagcagaaaaata

SEQ ID NO: 7425860 - DNA, 19 bp, Homo sapiens
tacaaaggaggatgtaaaa

SEQ ID NO: 7425861 - DNA, 19 bp, Homo sapiens
tacaaaggaggatgtaaaa

SEQ ID NO: 7425862 - DNA, 22 bp, Homo sapiens
tacaaaggagataaattggagg

SEQ ID NO: 7425863 - DNA, 22 bp, Homo sapiens
tacaaaggagataaattggagg

SEQ ID NO: 7425864 - DNA, 22 bp, Homo sapiens
tacaaaggagactctgtattta

SEQ ID NO: 7425865 - DNA, 22 bp, Homo sapiens
tacaaaggagactctgtattta

SEQ ID NO: 7425866 - DNA, 22 bp, Homo sapiens
tacaaaggagactctgtattta

SEQ ID NO: 7425867 - DNA, 22 bp, Homo sapiens
tacaaaggagactctgtattta

SEQ ID NO: 7425868 - DNA, 22 bp, Homo sapiens
tacaaagtcaccagcttcttgc

SEQ ID NO: 7425869 - DNA, 22 bp, Homo sapiens
tacaaagtcaccagcttcttgc

SEQ ID NO: 7425870 - DNA, 22 bp, Homo sapiens
tacaaagtcacattgaaatgaa

SEQ ID NO: 7425871 - DNA, 22 bp, Homo sapiens
tacaaagtcacattgaaatgaa

SEQ ID NO: 7425872 - DNA, 22 bp, Homo sapiens
tacaaagtcacattgaaatgaa

SEQ ID NO: 7425873 - DNA, 22 bp, Homo sapiens
tacaaagtagaaattcagtaaa

SEQ ID NO: 7425874 - DNA, 22 bp, Homo sapiens
tacaaagtagaaattcagtaaa

SEQ ID NO: 7425875 - DNA, 22 bp, Homo sapiens
tacaaagtatatttctagctgt

SEQ ID NO: 7425876 - DNA, 22 bp, Homo sapiens
tacaaagtatatttctagctgt

SEQ ID NO: 7425877 - DNA, 22 bp, Homo sapiens
tacaaagtaatgtataatatcg

SEQ ID NO: 7425878 - DNA, 22 bp, Homo sapiens
tacaaagtaatgtataatatcg

SEQ ID NO: 7425879 - DNA, 22 bp, Homo sapiens
tacaaagtaatgtataatatcg

SEQ ID NO: 7425880 - DNA, 22 bp, Homo sapiens
tacaaagtagaaattcagtaaa

SEQ ID NO: 7425881 - DNA, 22 bp, Homo sapiens
tacaaagtaatgtataatatcg

SEQ ID NO: 7425882 - DNA, 22 bp, Homo sapiens
tacaaaggcttaaagagatttc

SEQ ID NO: 7425883 - DNA, 22 bp, Homo sapiens
tacaaaggcttaaagagatttc

SEQ ID NO: 7425884 - DNA, 21 bp, Homo sapiens
tacaaagggaaattctggctc

SEQ ID NO: 7425885 - DNA, 22 bp, Homo sapiens
tacaaagggaatattggcttta

SEQ ID NO: 7425886 - DNA, 22 bp, Homo sapiens
tacaaagggaatattggcttta

SEQ ID NO: 7425887 - DNA, 22 bp, Homo sapiens
tacaaagtaatgtataatatcg

SEQ ID NO: 7425888 - DNA, 22 bp, Homo sapiens
tacaaagtaatgtataatatcg

SEQ ID NO: 7425889 - DNA, 22 bp, Homo sapiens
tacaaagtaatgtataatatcg

SEQ ID NO: 7425890 - DNA, 22 bp, Homo sapiens
tacaaagtaatgtataatatcg

SEQ ID NO: 7425891 - DNA, 22 bp, Homo sapiens
tacaaagggggaagagattctg

SEQ ID NO: 7425892 - DNA, 22 bp, Homo sapiens
tacaaaggcttaaagagatttc

SEQ ID NO: 7425893 - DNA, 22 bp, Homo sapiens
tacaaaggcggtttttctgggc

SEQ ID NO: 7425894 - DNA, 22 bp, Homo sapiens
tacaaaggagtagagaaggctt

SEQ ID NO: 7425895 - DNA, 22 bp, Homo sapiens
tacaaaggaggtgcatagaaca

SEQ ID NO: 7425896 - DNA, 22 bp, Homo sapiens
tacaaaggaggtgcatagaaca

SEQ ID NO: 7425897 - DNA, 22 bp, Homo sapiens
tacaaaggagtagagaaggctt

SEQ ID NO: 7425898 - DNA, 22 bp, Homo sapiens
tacaaaggaggtgcatagaaca

SEQ ID NO: 7425899 - DNA, 22 bp, Homo sapiens
tacaaacttgttttaagtaagt

SEQ ID NO: 7425900 - DNA, 22 bp, Homo sapiens
tacaaacttgttttaagtaagt

SEQ ID NO: 7425901 - DNA, 22 bp, Homo sapiens
tacaaacttgttttaagtaagt

SEQ ID NO: 7425902 - DNA, 22 bp, Homo sapiens
tacaaactgttattattattgt

SEQ ID NO: 7425903 - DNA, 20 bp, Homo sapiens
tacaaagaatgaggttcagg

SEQ ID NO: 7425904 - DNA, 22 bp, Homo sapiens
tacaaacttgttttaagtaagt

SEQ ID NO: 7425905 - DNA, 22 bp, Homo sapiens
tacaaacttgttttaagtaagt

SEQ ID NO: 7425906 - DNA, 20 bp, Homo sapiens
tacaaagaatgaggttcagg

SEQ ID NO: 7425907 - DNA, 20 bp, Homo sapiens
tacaaagaatgaggttcagg

SEQ ID NO: 7425908 - DNA, 20 bp, Homo sapiens
tacaaagaatgaggttcagg

SEQ ID NO: 7425909 - DNA, 20 bp, Homo sapiens
tacaaagaatgaggttcagg

SEQ ID NO: 7425910 - DNA, 20 bp, Homo sapiens
tacaaagaatgaggttcagg

SEQ ID NO: 7425911 - DNA, 20 bp, Homo sapiens
tacaaagaatgaggttcagg

SEQ ID NO: 7425912 - DNA, 20 bp, Homo sapiens
tacaaagagcccctctcttc

SEQ ID NO: 7425913 - DNA, 20 bp, Homo sapiens
tacaaagaatgaggttcagg

SEQ ID NO: 7425914 - DNA, 20 bp, Homo sapiens
tacaaagagcccctctcttc

SEQ ID NO: 7425915 - DNA, 20 bp, Homo sapiens
tacaaagagcccctctcttc

SEQ ID NO: 7425916 - DNA, 20 bp, Homo sapiens
tacaaagaatgaggttcagg

SEQ ID NO: 7425917 - DNA, 22 bp, Homo sapiens
tacaaagaggcagctccatttt

SEQ ID NO: 7425918 - DNA, 22 bp, Homo sapiens
tacaaagaggcagctccatttt

SEQ ID NO: 7425919 - DNA, 22 bp, Homo sapiens
tacaaagaggcagctccatttt

SEQ ID NO: 7425920 - DNA, 20 bp, Homo sapiens
tacaaagagcccctctcttc

SEQ ID NO: 7425921 - DNA, 20 bp, Homo sapiens
tacaaagagcccctctcttc

SEQ ID NO: 7425922 - DNA, 22 bp, Homo sapiens
tacaaagaggcagctccatttt

SEQ ID NO: 7425923 - DNA, 22 bp, Homo sapiens
tacaaagaggtaattgcatata

SEQ ID NO: 7425924 - DNA, 22 bp, Homo sapiens
tacaaagaggtaattgcatata

SEQ ID NO: 7425925 - DNA, 22 bp, Homo sapiens
tacaaagaggtaattgcatata

SEQ ID NO: 7425926 - DNA, 22 bp, Homo sapiens
tacaaagaggtaattgcatata

SEQ ID NO: 7425927 - DNA, 22 bp, Homo sapiens
tacaaagaggtaattgcatata

SEQ ID NO: 7425928 - DNA, 22 bp, Homo sapiens
tacaaagaggtaattgcatata

SEQ ID NO: 7425929 - DNA, 22 bp, Homo sapiens
tacaaagaggtaattgcatata

SEQ ID NO: 7425930 - DNA, 22 bp, Homo sapiens
tacaaagaggtaattgcatata

SEQ ID NO: 7425931 - DNA, 22 bp, Homo sapiens
tacaaagaggcagctccatttt

SEQ ID NO: 7425932 - DNA, 22 bp, Homo sapiens
tacaaagaggcagctccatttt

SEQ ID NO: 7425933 - DNA, 22 bp, Homo sapiens
tacaaagagtttggtctctaga

SEQ ID NO: 7425934 - DNA, 22 bp, Homo sapiens
tacaaagagtttggtctctaga

SEQ ID NO: 7425935 - DNA, 22 bp, Homo sapiens
tacaaagagtttggtctctaga

SEQ ID NO: 7425936 - DNA, 22 bp, Homo sapiens
tacaaagagtttggtctctaga

SEQ ID NO: 7425937 - DNA, 22 bp, Homo sapiens
tacaaagagtttggtctctaga

SEQ ID NO: 7425938 - DNA, 22 bp, Homo sapiens
tacaaagagtttggtctctaga

SEQ ID NO: 7425939 - DNA, 22 bp, Homo sapiens
tacaaagagtttggtctctaga

SEQ ID NO: 7425940 - DNA, 22 bp, Homo sapiens
tacaaagaggtaattgcatata

SEQ ID NO: 7425941 - DNA, 22 bp, Homo sapiens
tacaaactctttatatttcata

SEQ ID NO: 7425942 - DNA, 22 bp, Homo sapiens
tacaaactctttatatttcata

SEQ ID NO: 7425943 - DNA, 22 bp, Homo sapiens
tacaaactgtccagcccagagg

SEQ ID NO: 7425944 - DNA, 22 bp, Homo sapiens
tacaaactgtccagcccagagg

SEQ ID NO: 7425945 - DNA, 22 bp, Homo sapiens
tacaaactctttatatttcata

SEQ ID NO: 7425946 - DNA, 22 bp, Homo sapiens
tacaaactgttattattattgt

SEQ ID NO: 7425947 - DNA, 22 bp, Homo sapiens
tacaaactgttattattattgt

SEQ ID NO: 7425948 - DNA, 22 bp, Homo sapiens
tacaaactgttattattattgt

SEQ ID NO: 7425949 - DNA, 22 bp, Homo sapiens
tacaaactgttattattattgt

SEQ ID NO: 7425950 - DNA, 22 bp, Homo sapiens
tacaaactgttattattattgt

SEQ ID NO: 7425951 - DNA, 22 bp, Homo sapiens
tacaaactgttattattattgt

SEQ ID NO: 7425952 - DNA, 22 bp, Homo sapiens
tacaaactgttattattattgt

SEQ ID NO: 7425953 - DNA, 18 bp, Homo sapiens
tacaaactccttgaaggc

SEQ ID NO: 7425954 - DNA, 18 bp, Homo sapiens
tacaaactccttgaaggc

SEQ ID NO: 7425955 - DNA, 18 bp, Homo sapiens
tacaaactccttgaaggc

SEQ ID NO: 7425956 - DNA, 22 bp, Homo sapiens
tacaaactctttatatttcata

SEQ ID NO: 7425957 - DNA, 22 bp, Homo sapiens
tacaaactctttatatttcata

SEQ ID NO: 7425958 - DNA, 22 bp, Homo sapiens
tacaaactctttatatttcata

SEQ ID NO: 7425959 - DNA, 22 bp, Homo sapiens
tacaaactctttatatttcata

SEQ ID NO: 7425960 - DNA, 22 bp, Homo sapiens
tacaaaaaattgatactgacga

SEQ ID NO: 7425961 - DNA, 22 bp, Homo sapiens
tacaaaaaattgatactgacga

SEQ ID NO: 7425962 - DNA, 22 bp, Homo sapiens
tacaaactccgaagtttgtacc

SEQ ID NO: 7425963 - DNA, 22 bp, Homo sapiens
tacaaactccgaagtttgtacc

SEQ ID NO: 7425964 - DNA, 22 bp, Homo sapiens
tacaaaaaattgatactgacga

SEQ ID NO: 7425965 - DNA, 22 bp, Homo sapiens
tacaaaaaattgatactgacga

SEQ ID NO: 7425966 - DNA, 22 bp, Homo sapiens
tacaaaaaattgatactgacga

SEQ ID NO: 7425967 - DNA, 22 bp, Homo sapiens
tacaaaaaattgatactgacga

SEQ ID NO: 7425968 - DNA, 22 bp, Homo sapiens
tacaaaaaattgatactgacga

SEQ ID NO: 7425969 - DNA, 22 bp, Homo sapiens
tacaaaaaattgatactgacga

SEQ ID NO: 7425970 - DNA, 22 bp, Homo sapiens
tacaaaaaattgatactgacga

SEQ ID NO: 7425971 - DNA, 22 bp, Homo sapiens
tacaaaaaattgatactgacga

SEQ ID NO: 7425972 - DNA, 22 bp, Homo sapiens
taattatgtatgcaagctcagt

SEQ ID NO: 7425973 - DNA, 23 bp, Homo sapiens
taattatggaataatttgcaacg

SEQ ID NO: 7425974 - DNA, 22 bp, Homo sapiens
taattattatgacaacaattgc

SEQ ID NO: 7425975 - DNA, 22 bp, Homo sapiens
taattattatgacaacaattgc

SEQ ID NO: 7425976 - DNA, 22 bp, Homo sapiens
taattattatgacaacaattgc

SEQ ID NO: 7425977 - DNA, 22 bp, Homo sapiens
tacaaaaaattgatactgacga

SEQ ID NO: 7425978 - DNA, 22 bp, Homo sapiens
tacaaaaaattgatactgacga

SEQ ID NO: 7425979 - DNA, 22 bp, Homo sapiens
taattatagccgctattttgct

SEQ ID NO: 7425980 - DNA, 22 bp, Homo sapiens
taattatagccgctattttgct

SEQ ID NO: 7425981 - DNA, 22 bp, Homo sapiens
taattatagccgctattttgct

SEQ ID NO: 7425982 - DNA, 22 bp, Homo sapiens
taattatagccgctattttgct

SEQ ID NO: 7425983 - DNA, 23 bp, Homo sapiens
taattatggaataatttgcaacg

SEQ ID NO: 7425984 - DNA, 23 bp, Homo sapiens
taattatggaataatttgcaacg

SEQ ID NO: 7425985 - DNA, 22 bp, Homo sapiens
taatagctgtgggaaataaaag

SEQ ID NO: 7425986 - DNA, 22 bp, Homo sapiens
taatagctgttattgttataac

SEQ ID NO: 7425987 - DNA, 22 bp, Homo sapiens
taatagctgttattgttataac

SEQ ID NO: 7425988 - DNA, 22 bp, Homo sapiens
taatagctgtgggaaataaaag

SEQ ID NO: 7425989 - DNA, 22 bp, Homo sapiens
taatggatttcgaacctctagc

SEQ ID NO: 7425990 - DNA, 22 bp, Homo sapiens
taatggcagagtcatgctttct

SEQ ID NO: 7425991 - DNA, 22 bp, Homo sapiens
taatagcttttatgcagtctgt

SEQ ID NO: 7425992 - DNA, 22 bp, Homo sapiens
taatggcagagtcatgctttct

SEQ ID NO: 7425993 - DNA, 22 bp, Homo sapiens
taatggcattgattacatgaaa

SEQ ID NO: 7425994 - DNA, 22 bp, Homo sapiens
taatggcattgattacatgaaa

SEQ ID NO: 7425995 - DNA, 22 bp, Homo sapiens
taatggcattgattacatgaaa

SEQ ID NO: 7425996 - DNA, 22 bp, Homo sapiens
taatagaatagtggaaacattg

SEQ ID NO: 7425997 - DNA, 22 bp, Homo sapiens
taatagaatagtggaaacattg

SEQ ID NO: 7425998 - DNA, 22 bp, Homo sapiens
taatagcattatcatcaaaact

SEQ ID NO: 7425999 - DNA, 22 bp, Homo sapiens
taatagcattatcatcaaaact

SEQ ID NO: 7426000 - DNA, 22 bp, Homo sapiens
taatagaatagtggaaacattg

SEQ ID NO: 7426001 - DNA, 22 bp, Homo sapiens
taatagaatagtggaaacattg

SEQ ID NO: 7426002 - DNA, 22 bp, Homo sapiens
taatagcattatcatcaaaact

SEQ ID NO: 7426003 - DNA, 22 bp, Homo sapiens
taatagcattatcatcaaaact

SEQ ID NO: 7426004 - DNA, 22 bp, Homo sapiens
taatagcattatcatcaaaact

SEQ ID NO: 7426005 - DNA, 22 bp, Homo sapiens
taatgtttccagtctatgatgg

SEQ ID NO: 7426006 - DNA, 22 bp, Homo sapiens
taatgtttccagtctatgatgg

SEQ ID NO: 7426007 - DNA, 22 bp, Homo sapiens
taatgtttccagtctatgatgg

SEQ ID NO: 7426008 - DNA, 22 bp, Homo sapiens
taatgtttccagtctatgatgg

SEQ ID NO: 7426009 - DNA, 22 bp, Homo sapiens
taatggtatttcaagacttgcc

SEQ ID NO: 7426010 - DNA, 22 bp, Homo sapiens
taatgtaaacacagagacagaa

SEQ ID NO: 7426011 - DNA, 22 bp, Homo sapiens
taatggtatttcaagacttgcc

SEQ ID NO: 7426012 - DNA, 22 bp, Homo sapiens
taatggtatttgttgaaaaact

SEQ ID NO: 7426013 - DNA, 22 bp, Homo sapiens
taatggctgggataaaggaatg

SEQ ID NO: 7426014 - DNA, 22 bp, Homo sapiens
taatggctaaaattcagaagaa

SEQ ID NO: 7426015 - DNA, 22 bp, Homo sapiens
taatggctttagtggatggcat

SEQ ID NO: 7426016 - DNA, 16 bp, Homo sapiens
taatggccaagaattt

SEQ ID NO: 7426017 - DNA, 22 bp, Homo sapiens
taatggctaaaattcagaagaa

SEQ ID NO: 7426018 - DNA, 22 bp, Homo sapiens
taatagaatagtggaaacattg

SEQ ID NO: 7426019 - DNA, 22 bp, Homo sapiens
taatagaatagtggaaacattg

SEQ ID NO: 7426020 - DNA, 22 bp, Homo sapiens
taatagaatagtggaaacattg

SEQ ID NO: 7426021 - DNA, 22 bp, Homo sapiens
taatagaatagtggaaacattg

SEQ ID NO: 7426022 - DNA, 22 bp, Homo sapiens
taatagaatagtggaaacattg

SEQ ID NO: 7426023 - DNA, 22 bp, Homo sapiens
taatagaatagtggaaacattg

SEQ ID NO: 7426024 - DNA, 22 bp, Homo sapiens
taatacttttgccttgtattca

SEQ ID NO: 7426025 - DNA, 22 bp, Homo sapiens
taatacttttgccttgtattca

SEQ ID NO: 7426026 - DNA, 22 bp, Homo sapiens
taatagaaaggtattttttgca

SEQ ID NO: 7426027 - DNA, 22 bp, Homo sapiens
taatagaaaggtattttttgca

SEQ ID NO: 7426028 - DNA, 22 bp, Homo sapiens
taatagaaaggtattttttgca

SEQ ID NO: 7426029 - DNA, 22 bp, Homo sapiens
taatagaaaggtattttttgca

SEQ ID NO: 7426030 - DNA, 22 bp, Homo sapiens
taatacttttgccttgtattca

SEQ ID NO: 7426031 - DNA, 22 bp, Homo sapiens
taatacttttgccttgtattca

SEQ ID NO: 7426032 - DNA, 22 bp, Homo sapiens
taatacttgtcataaaggcatt

SEQ ID NO: 7426033 - DNA, 22 bp, Homo sapiens
taatacttgtcataaaggcatt

SEQ ID NO: 7426034 - DNA, 22 bp, Homo sapiens
taatacttgctttggatgtatg

SEQ ID NO: 7426035 - DNA, 22 bp, Homo sapiens
taatacttgtcataaaggcatt

SEQ ID NO: 7426036 - DNA, 22 bp, Homo sapiens
taatacttaccttgcagagtct

SEQ ID NO: 7426037 - DNA, 22 bp, Homo sapiens
taatacttaccttgcagagtct

SEQ ID NO: 7426038 - DNA, 19 bp, Homo sapiens
taatactggctgtagctgg

SEQ ID NO: 7426039 - DNA, 19 bp, Homo sapiens
taatactggctgtagctgg

SEQ ID NO: 7426040 - DNA, 22 bp, Homo sapiens
taatactgctgtgcttgagttg

SEQ ID NO: 7426041 - DNA, 22 bp, Homo sapiens
taatactgctgtgcttgagttg

SEQ ID NO: 7426042 - DNA, 23 bp, Homo sapiens
taatactgcttcagaggcttaga

SEQ ID NO: 7426043 - DNA, 23 bp, Homo sapiens
taatactgcttcagaggcttaga

SEQ ID NO: 7426044 - DNA, 22 bp, Homo sapiens
taatactgagccaccaggtagg

SEQ ID NO: 7426045 - DNA, 22 bp, Homo sapiens
taatactgagccaccaggtagg

SEQ ID NO: 7426046 - DNA, 22 bp, Homo sapiens
taatactgatgtctgagcccca

SEQ ID NO: 7426047 - DNA, 22 bp, Homo sapiens
taatactgatgtctgagcccca

SEQ ID NO: 7426048 - DNA, 22 bp, Homo sapiens
taatactgctgtgcttgagttg

SEQ ID NO: 7426049 - DNA, 22 bp, Homo sapiens
taatactgggaaatacttgggt

SEQ ID NO: 7426050 - DNA, 22 bp, Homo sapiens
taatactgggaaatacttgggt

SEQ ID NO: 7426051 - DNA, 22 bp, Homo sapiens
taatactgggaaatacttgggt

SEQ ID NO: 7426052 - DNA, 22 bp, Homo sapiens
taatactgtatactgcaaattt

SEQ ID NO: 7426053 - DNA, 22 bp, Homo sapiens
taatactgtatactgcaaattt

SEQ ID NO: 7426054 - DNA, 22 bp, Homo sapiens
taatactgtaacttggtgggtc

SEQ ID NO: 7426055 - DNA, 22 bp, Homo sapiens
taatactgtaacttggtgggtc

SEQ ID NO: 7426056 - DNA, 22 bp, Homo sapiens
taatactgtaacttggtgggtc

SEQ ID NO: 7426057 - DNA, 22 bp, Homo sapiens
taatactgtatactgcaaattt

SEQ ID NO: 7426058 - DNA, 22 bp, Homo sapiens
taatactgtgcttcattttcct

SEQ ID NO: 7426059 - DNA, 22 bp, Homo sapiens
taatactgtgcttcattttcct

SEQ ID NO: 7426060 - DNA, 22 bp, Homo sapiens
taatactgtgcttcattttcct

SEQ ID NO: 7426061 - DNA, 22 bp, Homo sapiens
taattatacaaaaaggcatgca

SEQ ID NO: 7426062 - DNA, 22 bp, Homo sapiens
taattatacaaaaaggcatgca

SEQ ID NO: 7426063 - DNA, 22 bp, Homo sapiens
taattatacaaaaaggcatgca

SEQ ID NO: 7426064 - DNA, 22 bp, Homo sapiens
taattatacaaaaaggcatgca

SEQ ID NO: 7426065 - DNA, 22 bp, Homo sapiens
taattataacatgctttctggc

SEQ ID NO: 7426066 - DNA, 22 bp, Homo sapiens
taattataacatgctttctggc

SEQ ID NO: 7426067 - DNA, 22 bp, Homo sapiens
taattataacatgctttctggc

SEQ ID NO: 7426068 - DNA, 22 bp, Homo sapiens
taattataacagttacatctta

SEQ ID NO: 7426069 - DNA, 22 bp, Homo sapiens
taattataacagttacatctta

SEQ ID NO: 7426070 - DNA, 22 bp, Homo sapiens
taattatagccgctattttgct

SEQ ID NO: 7426071 - DNA, 22 bp, Homo sapiens
taattatagccgctattttgct

SEQ ID NO: 7426072 - DNA, 22 bp, Homo sapiens
taattatagcattggagtggcc

SEQ ID NO: 7426073 - DNA, 22 bp, Homo sapiens
taattatagccgctattttgct

SEQ ID NO: 7426074 - DNA, 22 bp, Homo sapiens
taattatacaaaaaggcatgca

SEQ ID NO: 7426075 - DNA, 22 bp, Homo sapiens
taattatacaaaaaggcatgca

SEQ ID NO: 7426076 - DNA, 22 bp, Homo sapiens
taattatagcattggagtggcc

SEQ ID NO: 7426077 - DNA, 22 bp, Homo sapiens
taattataaactgcagtaggta

SEQ ID NO: 7426078 - DNA, 22 bp, Homo sapiens
taattataaactgcagtaggta

SEQ ID NO: 7426079 - DNA, 23 bp, Homo sapiens
taattagatgttgattcctgaga

SEQ ID NO: 7426080 - DNA, 23 bp, Homo sapiens
taattagatgttgattcctgaga

SEQ ID NO: 7426081 - DNA, 22 bp, Homo sapiens
taattataacagttacatctta

SEQ ID NO: 7426082 - DNA, 22 bp, Homo sapiens
taattataacagttacatctta

SEQ ID NO: 7426083 - DNA, 22 bp, Homo sapiens
taattataacagttacatctta

SEQ ID NO: 7426084 - DNA, 22 bp, Homo sapiens
taattataacagttacatctta

SEQ ID NO: 7426085 - DNA, 22 bp, Homo sapiens
taattataacagttacatctta

SEQ ID NO: 7426086 - DNA, 22 bp, Homo sapiens
taattataacagttacatctta

SEQ ID NO: 7426087 - DNA, 22 bp, Homo sapiens
taatgtttccagtctatgatgg

SEQ ID NO: 7426088 - DNA, 22 bp, Homo sapiens
taatgtttccagtctatgatgg

SEQ ID NO: 7426089 - DNA, 22 bp, Homo sapiens
taatgtttttctcaacattgct

SEQ ID NO: 7426090 - DNA, 22 bp, Homo sapiens
taatgtttttctcaacattgct

SEQ ID NO: 7426091 - DNA, 22 bp, Homo sapiens
taatgtttttctcaacattgct

SEQ ID NO: 7426092 - DNA, 22 bp, Homo sapiens
taatgtttgggaaggtgctttg

SEQ ID NO: 7426093 - DNA, 22 bp, Homo sapiens
taatgtttttctcaacattgct

SEQ ID NO: 7426094 - DNA, 22 bp, Homo sapiens
taattacaaagcaagcacaggg

SEQ ID NO: 7426095 - DNA, 22 bp, Homo sapiens
taattacaaagcaagcacaggg

SEQ ID NO: 7426096 - DNA, 22 bp, Homo sapiens
taattaacatacaaaacagctg

SEQ ID NO: 7426097 - DNA, 22 bp, Homo sapiens
taattacaaagcaagcacaggg

SEQ ID NO: 7426098 - DNA, 22 bp, Homo sapiens
taattacaaagcaagcacaggg

SEQ ID NO: 7426099 - DNA, 22 bp, Homo sapiens
taattacaaagcaagcacaggg

SEQ ID NO: 7426100 - DNA, 22 bp, Homo sapiens
taattacaaagcaagcacaggg

SEQ ID NO: 7426101 - DNA, 22 bp, Homo sapiens
taattacaaagcaagcacaggg

SEQ ID NO: 7426102 - DNA, 22 bp, Homo sapiens
taattactaagggctgcatacc

SEQ ID NO: 7426103 - DNA, 22 bp, Homo sapiens
taattactaagggctgcatacc

SEQ ID NO: 7426104 - DNA, 22 bp, Homo sapiens
taattactggaaatttcaaata

SEQ ID NO: 7426105 - DNA, 22 bp, Homo sapiens
taattagagtttggtaaacaat

SEQ ID NO: 7426106 - DNA, 22 bp, Homo sapiens
taattagagtttggtaaacaat

SEQ ID NO: 7426107 - DNA, 22 bp, Homo sapiens
taattagagtcacaagtaacca

SEQ ID NO: 7426108 - DNA, 22 bp, Homo sapiens
taattacaggtccaaaacaatc

SEQ ID NO: 7426109 - DNA, 22 bp, Homo sapiens
taattacaggtccaaaacaatc

SEQ ID NO: 7426110 - DNA, 22 bp, Homo sapiens
taattacaggtccaaaacaatc

SEQ ID NO: 7426111 - DNA, 22 bp, Homo sapiens
taattacaggtccaaaacaatc

SEQ ID NO: 7426112 - DNA, 22 bp, Homo sapiens
taattacaggtccaaaacaatc

SEQ ID NO: 7426113 - DNA, 22 bp, Homo sapiens
taattacaggtccaaaacaatc

SEQ ID NO: 7426114 - DNA, 22 bp, Homo sapiens
taattacaggtccaaaacaatc

SEQ ID NO: 7426115 - DNA, 22 bp, Homo sapiens
taattacaggtccaaaacaatc

SEQ ID NO: 7426116 - DNA, 22 bp, Homo sapiens
taattacaggtccaaaacaatc

SEQ ID NO: 7426117 - DNA, 22 bp, Homo sapiens
taattacaggtccaaaacaatc

SEQ ID NO: 7426118 - DNA, 22 bp, Homo sapiens
taattacagaggtttgccagtt

SEQ ID NO: 7426119 - DNA, 22 bp, Homo sapiens
taattacagaggtttgccagtt

SEQ ID NO: 7426120 - DNA, 22 bp, Homo sapiens
taattacagaggtttgccagtt

SEQ ID NO: 7426121 - DNA, 22 bp, Homo sapiens
taattacagaggtttgccagtt

SEQ ID NO: 7426122 - DNA, 22 bp, Homo sapiens
taattacagaggtttgccagtt

SEQ ID NO: 7426123 - DNA, 22 bp, Homo sapiens
taattacaaagcaagcacaggg

SEQ ID NO: 7426124 - DNA, 22 bp, Homo sapiens
taattacaaagcaagcacaggg

SEQ ID NO: 7426125 - DNA, 22 bp, Homo sapiens
taatacatcattcatctaagga

SEQ ID NO: 7426126 - DNA, 22 bp, Homo sapiens
taatacatcattcatctaagga

SEQ ID NO: 7426127 - DNA, 22 bp, Homo sapiens
taatacatcattcatctaagga

SEQ ID NO: 7426128 - DNA, 22 bp, Homo sapiens
taatacatcattcatctaagga

SEQ ID NO: 7426129 - DNA, 22 bp, Homo sapiens
taatacatcattcatctaagga

SEQ ID NO: 7426130 - DNA, 22 bp, Homo sapiens
taatacatcattcatctaagga

SEQ ID NO: 7426131 - DNA, 22 bp, Homo sapiens
taatacatcattcatctaagga

SEQ ID NO: 7426132 - DNA, 22 bp, Homo sapiens
taatacatcattcatctaagga

SEQ ID NO: 7426133 - DNA, 22 bp, Homo sapiens
taatacatgtattccagagagt

SEQ ID NO: 7426134 - DNA, 22 bp, Homo sapiens
taatacatgtattccagagagt

SEQ ID NO: 7426135 - DNA, 22 bp, Homo sapiens
taatacatgtattccagagagt

SEQ ID NO: 7426136 - DNA, 22 bp, Homo sapiens
taatacatgtattccagagagt

SEQ ID NO: 7426137 - DNA, 22 bp, Homo sapiens
taatacatgtattccagagagt

SEQ ID NO: 7426138 - DNA, 22 bp, Homo sapiens
taatacattacctaacctctct

SEQ ID NO: 7426139 - DNA, 22 bp, Homo sapiens
taatacattacctaacctctct

SEQ ID NO: 7426140 - DNA, 22 bp, Homo sapiens
taatacattacctaacctctct

SEQ ID NO: 7426141 - DNA, 22 bp, Homo sapiens
taatacattacctaacctctct

SEQ ID NO: 7426142 - DNA, 22 bp, Homo sapiens
taatacctactggtcattgcaa

SEQ ID NO: 7426143 - DNA, 22 bp, Homo sapiens
taatacctactggtcattgcaa

SEQ ID NO: 7426144 - DNA, 22 bp, Homo sapiens
taatacattacctaacctctct

SEQ ID NO: 7426145 - DNA, 22 bp, Homo sapiens
taatacattacctaacctctct

SEQ ID NO: 7426146 - DNA, 22 bp, Homo sapiens
taataccactgtgctcattata

SEQ ID NO: 7426147 - DNA, 22 bp, Homo sapiens
taataccactgtgctcattata

SEQ ID NO: 7426148 - DNA, 22 bp, Homo sapiens
taatacctggccttgatacagt

SEQ ID NO: 7426149 - DNA, 22 bp, Homo sapiens
taatacctagagatgatacaaa

SEQ ID NO: 7426150 - DNA, 22 bp, Homo sapiens
taatactgaaaggagtatcagc

SEQ ID NO: 7426151 - DNA, 22 bp, Homo sapiens
taatactgaaaggagtatcagc

SEQ ID NO: 7426152 - DNA, 22 bp, Homo sapiens
taataccttgatctctcttgtc

SEQ ID NO: 7426153 - DNA, 22 bp, Homo sapiens
taatactgaaagggaaatgtcc

SEQ ID NO: 7426154 - DNA, 22 bp, Homo sapiens
taatactgaaagggaaatgtcc

SEQ ID NO: 7426155 - DNA, 22 bp, Homo sapiens
taatactgaaagggaaatgtcc

SEQ ID NO: 7426156 - DNA, 22 bp, Homo sapiens
taatactgaaaggagtatcagc

SEQ ID NO: 7426157 - DNA, 21 bp, Homo sapiens
taatactgaaagtgacatctg

SEQ ID NO: 7426158 - DNA, 21 bp, Homo sapiens
taatactgaaagtgacatctg

SEQ ID NO: 7426159 - DNA, 21 bp, Homo sapiens
taatactgaaagtgacatctg

SEQ ID NO: 7426160 - DNA, 22 bp, Homo sapiens
taatactgaaggtaaaatttct

SEQ ID NO: 7426161 - DNA, 22 bp, Homo sapiens
taatactgaaggtaaaatttct

SEQ ID NO: 7426162 - DNA, 22 bp, Homo sapiens
taatactgactaaagatatcaa

SEQ ID NO: 7426163 - DNA, 22 bp, Homo sapiens
taatactgactaaagatatcaa

SEQ ID NO: 7426164 - DNA, 22 bp, Homo sapiens
taatactgactaaagatatcaa

SEQ ID NO: 7426165 - DNA, 22 bp, Homo sapiens
taatactgactaaagatatcaa

SEQ ID NO: 7426166 - DNA, 22 bp, Homo sapiens
taagtggcagagcttgttctca

SEQ ID NO: 7426167 - DNA, 22 bp, Homo sapiens
taagtgcatgattgaacttggc

SEQ ID NO: 7426168 - DNA, 22 bp, Homo sapiens
taagtgtccctattgtgatttt

SEQ ID NO: 7426169 - DNA, 22 bp, Homo sapiens
taagtgtccctattgtgatttt

SEQ ID NO: 7426170 - DNA, 22 bp, Homo sapiens
taagtgtctctcgaattatgct

SEQ ID NO: 7426171 - DNA, 22 bp, Homo sapiens
taagtggtaccaagctcagtga

SEQ ID NO: 7426172 - DNA, 22 bp, Homo sapiens
taagtggttgcttgttttcatt

SEQ ID NO: 7426173 - DNA, 22 bp, Homo sapiens
taataagcgtagaaggtatatc

SEQ ID NO: 7426174 - DNA, 22 bp, Homo sapiens
taataatagcagtagctgccac

SEQ ID NO: 7426175 - DNA, 22 bp, Homo sapiens
taataagtctgttgtttaattg

SEQ ID NO: 7426176 - DNA, 22 bp, Homo sapiens
taataagtctgttgtttaattg

SEQ ID NO: 7426177 - DNA, 22 bp, Homo sapiens
taagtgttattattctcacttt

SEQ ID NO: 7426178 - DNA, 22 bp, Homo sapiens
taagtgtctctcgaattatgct

SEQ ID NO: 7426179 - DNA, 22 bp, Homo sapiens
taagtgttgatctgagtgctaa

SEQ ID NO: 7426180 - DNA, 22 bp, Homo sapiens
taagtgttgatctgagtgctaa

SEQ ID NO: 7426181 - DNA, 22 bp, Homo sapiens
taagtgttattattctcacttt

SEQ ID NO: 7426182 - DNA, 22 bp, Homo sapiens
taatacagatacaaaggaggac

SEQ ID NO: 7426183 - DNA, 22 bp, Homo sapiens
taatacagggcactttgagtga

SEQ ID NO: 7426184 - DNA, 22 bp, Homo sapiens
taataatagcagtagctgccac

SEQ ID NO: 7426185 - DNA, 22 bp, Homo sapiens
taataattaacagtgatgggtc

SEQ ID NO: 7426186 - DNA, 22 bp, Homo sapiens
taataattaacagtgatgggtc

SEQ ID NO: 7426187 - DNA, 22 bp, Homo sapiens
taataatagcagtagctgccac

SEQ ID NO: 7426188 - DNA, 22 bp, Homo sapiens
taataatagcagtagctgccac

SEQ ID NO: 7426189 - DNA, 22 bp, Homo sapiens
taataatagcagtagctgccac

SEQ ID NO: 7426190 - DNA, 22 bp, Homo sapiens
taataatagcagtagctgccac

SEQ ID NO: 7426191 - DNA, 22 bp, Homo sapiens
taatacagtagcttttacacag

SEQ ID NO: 7426192 - DNA, 22 bp, Homo sapiens
taatacatcattcatctaagga

SEQ ID NO: 7426193 - DNA, 22 bp, Homo sapiens
taatacatcattcatctaagga

SEQ ID NO: 7426194 - DNA, 22 bp, Homo sapiens
taatacatcattcatctaagga

SEQ ID NO: 7426195 - DNA, 22 bp, Homo sapiens
taatacatcattcatctaagga

SEQ ID NO: 7426196 - DNA, 22 bp, Homo sapiens
taatacagtttccaagccagct

SEQ ID NO: 7426197 - DNA, 22 bp, Homo sapiens
taatacagtttccaagccagct

SEQ ID NO: 7426198 - DNA, 22 bp, Homo sapiens
taagtaaatttataatgtgatt

SEQ ID NO: 7426199 - DNA, 22 bp, Homo sapiens
taagtaaatttataatgtgatt

SEQ ID NO: 7426200 - DNA, 22 bp, Homo sapiens
taagtaaatttataatgtgatt

SEQ ID NO: 7426201 - DNA, 22 bp, Homo sapiens
taagtaaatttataatgtgatt

SEQ ID NO: 7426202 - DNA, 22 bp, Homo sapiens
taagtaaaacattcaagaagtc

SEQ ID NO: 7426203 - DNA, 22 bp, Homo sapiens
taagtaaaacattcaagaagtc

SEQ ID NO: 7426204 - DNA, 22 bp, Homo sapiens
taagtaaatttataatgtgatt

SEQ ID NO: 7426205 - DNA, 22 bp, Homo sapiens
taagtaaatttataatgtgatt

SEQ ID NO: 7426206 - DNA, 22 bp, Homo sapiens
taagtaaatttataatgtgatt

SEQ ID NO: 7426207 - DNA, 22 bp, Homo sapiens
taagtaaatttataatgtgatt

SEQ ID NO: 7426208 - DNA, 22 bp, Homo sapiens
taagtaaaacattcaagaagtc

SEQ ID NO: 7426209 - DNA, 22 bp, Homo sapiens
taaggtttgtggggagcaaaag

SEQ ID NO: 7426210 - DNA, 22 bp, Homo sapiens
taaggttttgagaccagaacgt

SEQ ID NO: 7426211 - DNA, 22 bp, Homo sapiens
taagtaaaacattcaagaagtc

SEQ ID NO: 7426212 - DNA, 22 bp, Homo sapiens
taagtaaaacattcaagaagtc

SEQ ID NO: 7426213 - DNA, 22 bp, Homo sapiens
taagtaaaacattcaagaagtc

SEQ ID NO: 7426214 - DNA, 22 bp, Homo sapiens
taaggtttggctgtctcttggt

SEQ ID NO: 7426215 - DNA, 22 bp, Homo sapiens
taaggtttgtggggagcaaaag

SEQ ID NO: 7426216 - DNA, 22 bp, Homo sapiens
taaggtttggctgtctcttggt

SEQ ID NO: 7426217 - DNA, 22 bp, Homo sapiens
taagtaattgcagcaatttgcc

SEQ ID NO: 7426218 - DNA, 22 bp, Homo sapiens
taagtaattgcagcaatttgcc

SEQ ID NO: 7426219 - DNA, 22 bp, Homo sapiens
taagtaattgcagcaatttgcc

SEQ ID NO: 7426220 - DNA, 22 bp, Homo sapiens
taagtaaatttataatgtgatt

SEQ ID NO: 7426221 - DNA, 22 bp, Homo sapiens
taagtacaaatgtatacataag

SEQ ID NO: 7426222 - DNA, 22 bp, Homo sapiens
taagtacaaatgtatacataag

SEQ ID NO: 7426223 - DNA, 22 bp, Homo sapiens
taagtacaaatgtatacataag

SEQ ID NO: 7426224 - DNA, 22 bp, Homo sapiens
taagtacaaatgtatacataag

SEQ ID NO: 7426225 - DNA, 22 bp, Homo sapiens
taagtaatttgtgcagagatac

SEQ ID NO: 7426226 - DNA, 22 bp, Homo sapiens
taagtaatttgtgcagagatac

SEQ ID NO: 7426227 - DNA, 22 bp, Homo sapiens
taagtaatttgtgcagagatac

SEQ ID NO: 7426228 - DNA, 22 bp, Homo sapiens
taagtaatttgtgcagagatac

SEQ ID NO: 7426229 - DNA, 19 bp, Homo sapiens
taagtactttacaagtact

SEQ ID NO: 7426230 - DNA, 22 bp, Homo sapiens
taagtagactgttgaacttggt

SEQ ID NO: 7426231 - DNA, 22 bp, Homo sapiens
taagtactaatattagtaactc

SEQ ID NO: 7426232 - DNA, 22 bp, Homo sapiens
taagtacatttgggaccacctg

SEQ ID NO: 7426233 - DNA, 22 bp, Homo sapiens
taagtacatttgggaccacctg

SEQ ID NO: 7426234 - DNA, 22 bp, Homo sapiens
taagtacaaatgtatacataag

SEQ ID NO: 7426235 - DNA, 22 bp, Homo sapiens
taagtacaaatgtatacataag

SEQ ID NO: 7426236 - DNA, 22 bp, Homo sapiens
taagtacaaatgtatacataag

SEQ ID NO: 7426237 - DNA, 22 bp, Homo sapiens
taagtacaaatgtatacataag

SEQ ID NO: 7426238 - DNA, 22 bp, Homo sapiens
taagtacaaatgtatacataag

SEQ ID NO: 7426239 - DNA, 22 bp, Homo sapiens
taagtacagaatgaggagatgt

SEQ ID NO: 7426240 - DNA, 22 bp, Homo sapiens
taagtacagaatgaggagatgt

SEQ ID NO: 7426241 - DNA, 22 bp, Homo sapiens
taagtacagaatgaggagatgt

SEQ ID NO: 7426242 - DNA, 22 bp, Homo sapiens
taagtaactgcataattaaatt

SEQ ID NO: 7426243 - DNA, 22 bp, Homo sapiens
taagtgaattgtccgaggacac

SEQ ID NO: 7426244 - DNA, 20 bp, Homo sapiens
taagtgagaacatgtggtat

SEQ ID NO: 7426245 - DNA, 22 bp, Homo sapiens
taagtgagctagcagaagtgac

SEQ ID NO: 7426246 - DNA, 22 bp, Homo sapiens
taagtgagctagcagaagtgac

SEQ ID NO: 7426247 - DNA, 22 bp, Homo sapiens
taagtgagctagcagaagtgac

SEQ ID NO: 7426248 - DNA, 22 bp, Homo sapiens
taagtgaatactaaggatggag

SEQ ID NO: 7426249 - DNA, 22 bp, Homo sapiens
taagtgaatattttcttctgta

SEQ ID NO: 7426250 - DNA, 22 bp, Homo sapiens
taagtgaatattttcttctgta

SEQ ID NO: 7426251 - DNA, 22 bp, Homo sapiens
taagtgaatccttgagaagaaa

SEQ ID NO: 7426252 - DNA, 22 bp, Homo sapiens
taagtgaatattttcttctgta

SEQ ID NO: 7426253 - DNA, 22 bp, Homo sapiens
taagtagctcttggaatatata

SEQ ID NO: 7426254 - DNA, 22 bp, Homo sapiens
taagtagcctacaagtatattt

SEQ ID NO: 7426255 - DNA, 22 bp, Homo sapiens
taagtagctcttggaatatata

SEQ ID NO: 7426256 - DNA, 22 bp, Homo sapiens
taagtagtagggccagaatttg

SEQ ID NO: 7426257 - DNA, 22 bp, Homo sapiens
taagtagactgttgaacttggt

SEQ ID NO: 7426258 - DNA, 22 bp, Homo sapiens
taagtagatgcaaaatggagtt

SEQ ID NO: 7426259 - DNA, 22 bp, Homo sapiens
taagtagatgcaaaatggagtt

SEQ ID NO: 7426260 - DNA, 17 bp, Homo sapiens
taagtgattatctcata

SEQ ID NO: 7426261 - DNA, 17 bp, Homo sapiens
taagtgattatctcata

SEQ ID NO: 7426262 - DNA, 23 bp, Homo sapiens
taagtgattagaatttgctgtca

SEQ ID NO: 7426263 - DNA, 22 bp, Homo sapiens
taagtgatgatagtacctagaa

SEQ ID NO: 7426264 - DNA, 22 bp, Homo sapiens
taagtgatgtcttggttaatga

SEQ ID NO: 7426265 - DNA, 23 bp, Homo sapiens
taagtgattagaatttgctgtca

SEQ ID NO: 7426266 - DNA, 23 bp, Homo sapiens
taagtgataaagagtagagatgg

SEQ ID NO: 7426267 - DNA, 22 bp, Homo sapiens
taagtgatgaaagcagatgtct

SEQ ID NO: 7426268 - DNA, 22 bp, Homo sapiens
taagtgatgaaagcagatgtct

SEQ ID NO: 7426269 - DNA, 22 bp, Homo sapiens
taagtgatgaagacctgtttgg

SEQ ID NO: 7426270 - DNA, 22 bp, Homo sapiens
taagtgatgagcacagtaatta

SEQ ID NO: 7426271 - DNA, 22 bp, Homo sapiens
taagtgatgagcacagtaatta

SEQ ID NO: 7426272 - DNA, 22 bp, Homo sapiens
taagtgcaatgttttacttaaa

SEQ ID NO: 7426273 - DNA, 22 bp, Homo sapiens
taagtgcaatgttttacttaaa

SEQ ID NO: 7426274 - DNA, 22 bp, Homo sapiens
taagtgcaatgttttacttaaa

SEQ ID NO: 7426275 - DNA, 22 bp, Homo sapiens
taagtgcatgattgaacttggc

SEQ ID NO: 7426276 - DNA, 22 bp, Homo sapiens
taagtgcatctgatctttcatg

SEQ ID NO: 7426277 - DNA, 22 bp, Homo sapiens
taagtgcatctgatctttcatg

SEQ ID NO: 7426278 - DNA, 21 bp, Homo sapiens
taagtgcaaagagacagatac

SEQ ID NO: 7426279 - DNA, 21 bp, Homo sapiens
taagtgcaaagagacagatac

SEQ ID NO: 7426280 - DNA, 22 bp, Homo sapiens
taagtgatttgtagtatactat

SEQ ID NO: 7426281 - DNA, 22 bp, Homo sapiens
taagtgatttgtagtatactat

SEQ ID NO: 7426282 - DNA, 22 bp, Homo sapiens
taagtgatttataaggagatat

SEQ ID NO: 7426283 - DNA, 22 bp, Homo sapiens
taagtgatttataaggagatat

SEQ ID NO: 7426284 - DNA, 23 bp, Homo sapiens
taagtgattccaagtttcaggga

SEQ ID NO: 7426285 - DNA, 22 bp, Homo sapiens
taaggccaaactattatagttc

SEQ ID NO: 7426286 - DNA, 22 bp, Homo sapiens
taaggccaaactattatagttc

SEQ ID NO: 7426287 - DNA, 19 bp, Homo sapiens
taaggccaaaagtaagtgt

SEQ ID NO: 7426288 - DNA, 23 bp, Homo sapiens
taaggcattttttctgtatcagt

SEQ ID NO: 7426289 - DNA, 23 bp, Homo sapiens
taaggcattttttctgtatcagt

SEQ ID NO: 7426290 - DNA, 19 bp, Homo sapiens
taaggccaaaagtaagtgt

SEQ ID NO: 7426291 - DNA, 19 bp, Homo sapiens
taaggccaaaagtaagtgt

SEQ ID NO: 7426292 - DNA, 22 bp, Homo sapiens
taaggccaagttcatatacaac

SEQ ID NO: 7426293 - DNA, 22 bp, Homo sapiens
taaggccaagttcatatacaac

SEQ ID NO: 7426294 - DNA, 21 bp, Homo sapiens
taaggccaagtctatttctgt

SEQ ID NO: 7426295 - DNA, 22 bp, Homo sapiens
taaggccaaggggccatagtct

SEQ ID NO: 7426296 - DNA, 22 bp, Homo sapiens
taaggcattatagagacagcct

SEQ ID NO: 7426297 - DNA, 22 bp, Homo sapiens
taaggcattagagtgaaagcaa

SEQ ID NO: 7426298 - DNA, 22 bp, Homo sapiens
taaggcattatagagacagcct

SEQ ID NO: 7426299 - DNA, 22 bp, Homo sapiens
taaggcattatagagacagcct

SEQ ID NO: 7426300 - DNA, 22 bp, Homo sapiens
taaggcattagagtgaaagcaa

SEQ ID NO: 7426301 - DNA, 22 bp, Homo sapiens
taaggcattagagtgaaagcaa

SEQ ID NO: 7426302 - DNA, 22 bp, Homo sapiens
taaggcatgagtttatttcata

SEQ ID NO: 7426303 - DNA, 22 bp, Homo sapiens
taaggcatgctagcagtatgaa

SEQ ID NO: 7426304 - DNA, 22 bp, Homo sapiens
taaggcatgctagcagtatgaa

SEQ ID NO: 7426305 - DNA, 18 bp, Homo sapiens
taaggcattcttatgtga

SEQ ID NO: 7426306 - DNA, 22 bp, Homo sapiens
taaggcattctcatgctgtgaa

SEQ ID NO: 7426307 - DNA, 22 bp, Homo sapiens
taaggcattctcatgctgtgaa

SEQ ID NO: 7426308 - DNA, 22 bp, Homo sapiens
taaggcattctcatgctgtgaa

SEQ ID NO: 7426309 - DNA, 18 bp, Homo sapiens
taaggcattcttatgtga

SEQ ID NO: 7426310 - DNA, 18 bp, Homo sapiens
taaggcattcttatgtga

SEQ ID NO: 7426311 - DNA, 18 bp, Homo sapiens
taaggcattcttatgtga

SEQ ID NO: 7426312 - DNA, 23 bp, Homo sapiens
taaggcattttttctgtatcagt

SEQ ID NO: 7426313 - DNA, 22 bp, Homo sapiens
taaggcagtagtgtctgtaggg

SEQ ID NO: 7426314 - DNA, 22 bp, Homo sapiens
taaggcagtagtgtctgtaggg

SEQ ID NO: 7426315 - DNA, 22 bp, Homo sapiens
taaggcagtgaaactattctgt

SEQ ID NO: 7426316 - DNA, 22 bp, Homo sapiens
taaggcagtgaaactattctgt

SEQ ID NO: 7426317 - DNA, 22 bp, Homo sapiens
taaggcagtgaaactattctgt

SEQ ID NO: 7426318 - DNA, 22 bp, Homo sapiens
taaggcagtgagaagaaacagg

SEQ ID NO: 7426319 - DNA, 22 bp, Homo sapiens
taaggcagtgagaagaaacagg

SEQ ID NO: 7426320 - DNA, 22 bp, Homo sapiens
taaggcagtgagaagaaacagg

SEQ ID NO: 7426321 - DNA, 22 bp, Homo sapiens
taaggcagtgagaagaaacagg

SEQ ID NO: 7426322 - DNA, 22 bp, Homo sapiens
taaggcagttttgcctgagata

SEQ ID NO: 7426323 - DNA, 22 bp, Homo sapiens
taaggcagttttgcctgagata

SEQ ID NO: 7426324 - DNA, 22 bp, Homo sapiens
taaggcagttttgcctgagata

SEQ ID NO: 7426325 - DNA, 22 bp, Homo sapiens
taaggcataaggccagaggcta

SEQ ID NO: 7426326 - DNA, 22 bp, Homo sapiens
taaggcataaggaagatttgga

SEQ ID NO: 7426327 - DNA, 22 bp, Homo sapiens
taaggcataaggaagatttgga

SEQ ID NO: 7426328 - DNA, 20 bp, Homo sapiens
taaggcatcaagtttgggta

SEQ ID NO: 7426329 - DNA, 22 bp, Homo sapiens
taaggcataaggccagaggcta

SEQ ID NO: 7426330 - DNA, 22 bp, Homo sapiens
taaggcataaggccagaggcta

SEQ ID NO: 7426331 - DNA, 20 bp, Homo sapiens
taaggcatcaagtttgggta

SEQ ID NO: 7426332 - DNA, 22 bp, Homo sapiens
taaggcatgagtttatttcata

SEQ ID NO: 7426333 - DNA, 22 bp, Homo sapiens
taaggcatgagtttatttcata

SEQ ID NO: 7426334 - DNA, 22 bp, Homo sapiens
taaggcatgagtttatttcata

SEQ ID NO: 7426335 - DNA, 22 bp, Homo sapiens
taaggcaagaaactcctgtgta

SEQ ID NO: 7426336 - DNA, 22 bp, Homo sapiens
taaggcaaagtgatttcttaaa

SEQ ID NO: 7426337 - DNA, 22 bp, Homo sapiens
taaggcaaagtgatttcttaaa

SEQ ID NO: 7426338 - DNA, 22 bp, Homo sapiens
taaggcaaaggggaagttatca

SEQ ID NO: 7426339 - DNA, 22 bp, Homo sapiens
taaggcaaaggggaagttatca

SEQ ID NO: 7426340 - DNA, 22 bp, Homo sapiens
taaggcaaagtgatttcttaaa

SEQ ID NO: 7426341 - DNA, 22 bp, Homo sapiens
taaggcaaacaggaaagcaggc

SEQ ID NO: 7426342 - DNA, 22 bp, Homo sapiens
taactggtagattttaaatcgg

SEQ ID NO: 7426343 - DNA, 22 bp, Homo sapiens
taaggattcaggcaggccatac

SEQ ID NO: 7426344 - DNA, 22 bp, Homo sapiens
taaggcaaagaaccatagtaat

SEQ ID NO: 7426345 - DNA, 22 bp, Homo sapiens
taaggcaaagaaccatagtaat

SEQ ID NO: 7426346 - DNA, 22 bp, Homo sapiens
taactgcatttttggttggagc

SEQ ID NO: 7426347 - DNA, 22 bp, Homo sapiens
taactgcctactgtgcaaatat

SEQ ID NO: 7426348 - DNA, 22 bp, Homo sapiens
taactggtactctggtagcctg

SEQ ID NO: 7426349 - DNA, 22 bp, Homo sapiens
taactggcttaaattttatcaa

SEQ ID NO: 7426350 - DNA, 22 bp, Homo sapiens
taactgcaccatcaaattagag

SEQ ID NO: 7426351 - DNA, 22 bp, Homo sapiens
taactgcactgacagtgagtga

SEQ ID NO: 7426352 - DNA, 22 bp, Homo sapiens
taactgcagaggaaatgcatct

SEQ ID NO: 7426353 - DNA, 22 bp, Homo sapiens
taactgcaacctccatcttgtg

SEQ ID NO: 7426354 - DNA, 22 bp, Homo sapiens
taactgcaacctccatcttgtg

SEQ ID NO: 7426355 - DNA, 22 bp, Homo sapiens
taactgcaggtcatcctcgcat

SEQ ID NO: 7426356 - DNA, 22 bp, Homo sapiens
taactgcaggtcatcctcgcat

SEQ ID NO: 7426357 - DNA, 22 bp, Homo sapiens
taactgccagcagcgatgaaca

SEQ ID NO: 7426358 - DNA, 22 bp, Homo sapiens
taactgattcctttttgaaaat

SEQ ID NO: 7426359 - DNA, 22 bp, Homo sapiens
taaggcaagagcagggtctttg

SEQ ID NO: 7426360 - DNA, 22 bp, Homo sapiens
taaggcaatggcattcttgaca

SEQ ID NO: 7426361 - DNA, 22 bp, Homo sapiens
taaggcaagagcagggtctttg

SEQ ID NO: 7426362 - DNA, 22 bp, Homo sapiens
taaggcaagaaactcctgtgta

SEQ ID NO: 7426363 - DNA, 22 bp, Homo sapiens
taaggcaagagcagggtctttg

SEQ ID NO: 7426364 - DNA, 22 bp, Homo sapiens
taaggcaggactggatagctat

SEQ ID NO: 7426365 - DNA, 22 bp, Homo sapiens
taaggcaggactggatagctat

SEQ ID NO: 7426366 - DNA, 22 bp, Homo sapiens
taaggcaagtttttagtggaca

SEQ ID NO: 7426367 - DNA, 22 bp, Homo sapiens
taaggcaatggcattcttgaca

SEQ ID NO: 7426368 - DNA, 22 bp, Homo sapiens
taaggcaggtatggtaccaggc

SEQ ID NO: 7426369 - DNA, 22 bp, Homo sapiens
taaggcaggtatggtaccaggc

SEQ ID NO: 7426370 - DNA, 22 bp, Homo sapiens
taaggcaggtagatgactacgg

SEQ ID NO: 7426371 - DNA, 22 bp, Homo sapiens
taaggcaggtatggtaccaggc

SEQ ID NO: 7426372 - DNA, 22 bp, Homo sapiens
taaggcaggtatggtaccaggc

SEQ ID NO: 7426373 - DNA, 22 bp, Homo sapiens
taaggcaggtagatgactacgg

SEQ ID NO: 7426374 - DNA, 22 bp, Homo sapiens
taaggcaggctttcatccagag

SEQ ID NO: 7426375 - DNA, 22 bp, Homo sapiens
taaggcaggctttcatccagag

SEQ ID NO: 7426376 - DNA, 22 bp, Homo sapiens
taaggcaggctttcatccagag

SEQ ID NO: 7426377 - DNA, 22 bp, Homo sapiens
taaggcaggtagatgactacgg

SEQ ID NO: 7426378 - DNA, 22 bp, Homo sapiens
taaggcaggtagatgactacgg

SEQ ID NO: 7426379 - DNA, 22 bp, Homo sapiens
taaggcccgtgagtttcatatc

SEQ ID NO: 7426380 - DNA, 22 bp, Homo sapiens
taaggccattatggtgggcccg

SEQ ID NO: 7426381 - DNA, 22 bp, Homo sapiens
taaggccttgaaaggatgtcct

SEQ ID NO: 7426382 - DNA, 22 bp, Homo sapiens
taaggccttgaaaggatgtcct

SEQ ID NO: 7426383 - DNA, 22 bp, Homo sapiens
taaggccttgaaaggatgtcct

SEQ ID NO: 7426384 - DNA, 22 bp, Homo sapiens
taaggctactgtcagcttcagg

SEQ ID NO: 7426385 - DNA, 22 bp, Homo sapiens
taaggctactgtcagcttcagg

SEQ ID NO: 7426386 - DNA, 22 bp, Homo sapiens
taaggctagcaagatgagaata

SEQ ID NO: 7426387 - DNA, 22 bp, Homo sapiens
taaggctagcaagatgagaata

SEQ ID NO: 7426388 - DNA, 22 bp, Homo sapiens
taaggctagcaagatgagaata

SEQ ID NO: 7426389 - DNA, 22 bp, Homo sapiens
taaggctaggaattctctgaag

SEQ ID NO: 7426390 - DNA, 22 bp, Homo sapiens
taaggctaggaattctctgaag

SEQ ID NO: 7426391 - DNA, 22 bp, Homo sapiens
taaggctagtgcctgactgggt

SEQ ID NO: 7426392 - DNA, 22 bp, Homo sapiens
taaggctagtgcctgactgggt

SEQ ID NO: 7426393 - DNA, 22 bp, Homo sapiens
taaggctatctgagtttatgtg

SEQ ID NO: 7426394 - DNA, 22 bp, Homo sapiens
taaggctatctgagtttatgtg

SEQ ID NO: 7426395 - DNA, 22 bp, Homo sapiens
taaggctatcttttgagtgtgt

SEQ ID NO: 7426396 - DNA, 22 bp, Homo sapiens
taaggctatcttttgagtgtgt

SEQ ID NO: 7426397 - DNA, 22 bp, Homo sapiens
taaggccaccgttatagaacca

SEQ ID NO: 7426398 - DNA, 22 bp, Homo sapiens
taaggccaccgttatagaacca

SEQ ID NO: 7426399 - DNA, 22 bp, Homo sapiens
taaggccaattacatatgttca

SEQ ID NO: 7426400 - DNA, 22 bp, Homo sapiens
taaggccaattaacaaccaggg

SEQ ID NO: 7426401 - DNA, 22 bp, Homo sapiens
taaggccaccgttatagaacca

SEQ ID NO: 7426402 - DNA, 22 bp, Homo sapiens
taaggccagcatgaatgcagca

SEQ ID NO: 7426403 - DNA, 22 bp, Homo sapiens
taaggccagccagcaaatctgt

SEQ ID NO: 7426404 - DNA, 22 bp, Homo sapiens
taaggccaggctgtggtcggca

SEQ ID NO: 7426405 - DNA, 22 bp, Homo sapiens
taaggcttcagcattcaaaaca

SEQ ID NO: 7426406 - DNA, 22 bp, Homo sapiens
taaggcttcttggaatactgca

SEQ ID NO: 7426407 - DNA, 22 bp, Homo sapiens
taaggcttatgatcagaaggtt

SEQ ID NO: 7426408 - DNA, 22 bp, Homo sapiens
taaggcttatgatcagaaggtt

SEQ ID NO: 7426409 - DNA, 22 bp, Homo sapiens
taaggcttcttggaatactgca

SEQ ID NO: 7426410 - DNA, 22 bp, Homo sapiens
taaggcttggacttctccaacc

SEQ ID NO: 7426411 - DNA, 22 bp, Homo sapiens
taaggctttatttttacaatgc

SEQ ID NO: 7426412 - DNA, 22 bp, Homo sapiens
taaggctttccttgtcatcttt

SEQ ID NO: 7426413 - DNA, 22 bp, Homo sapiens
taaggcttttaaaggttcacca

SEQ ID NO: 7426414 - DNA, 22 bp, Homo sapiens
taaggctttgtagtgattgctt

SEQ ID NO: 7426415 - DNA, 22 bp, Homo sapiens
taaggcttttgttcagcgtggg

SEQ ID NO: 7426416 - DNA, 22 bp, Homo sapiens
taagggaacagcttcaaactca

SEQ ID NO: 7426417 - DNA, 22 bp, Homo sapiens
taagggaacagcttcaaactca

SEQ ID NO: 7426418 - DNA, 22 bp, Homo sapiens
taaggcttggggaaaagtgagg

SEQ ID NO: 7426419 - DNA, 22 bp, Homo sapiens
taaggctttctaaatatgcaga

SEQ ID NO: 7426420 - DNA, 22 bp, Homo sapiens
taaggctttctaaatatgcaga

SEQ ID NO: 7426421 - DNA, 22 bp, Homo sapiens
taaggctttggtcaccatggag

SEQ ID NO: 7426422 - DNA, 22 bp, Homo sapiens
taaggcttagaagctatctgct

SEQ ID NO: 7426423 - DNA, 22 bp, Homo sapiens
taaggcttagaagctatctgct

SEQ ID NO: 7426424 - DNA, 22 bp, Homo sapiens
taaggcttatatacttagacat

SEQ ID NO: 7426425 - DNA, 22 bp, Homo sapiens
taaggcttatatacttagacat

SEQ ID NO: 7426426 - DNA, 22 bp, Homo sapiens
taaggcttatgatcagaaggtt

SEQ ID NO: 7426427 - DNA, 20 bp, Homo sapiens
taaggctgttttgtattcct

SEQ ID NO: 7426428 - DNA, 22 bp, Homo sapiens
taaggctgtccaaaattttgac

SEQ ID NO: 7426429 - DNA, 22 bp, Homo sapiens
taaggctgttaggaggattaaa

SEQ ID NO: 7426430 - DNA, 22 bp, Homo sapiens
taaggctgttaggaggattaaa

SEQ ID NO: 7426431 - DNA, 22 bp, Homo sapiens
taaggctcatgtaattagagat

SEQ ID NO: 7426432 - DNA, 19 bp, Homo sapiens
taaggctgaaggaggaggg

SEQ ID NO: 7426433 - DNA, 22 bp, Homo sapiens
taaggctgggaattgctgagct

SEQ ID NO: 7426434 - DNA, 22 bp, Homo sapiens
taaggctgggaattgctgagct

SEQ ID NO: 7426435 - DNA, 22 bp, Homo sapiens
taaggctgggaattgctgagct

SEQ ID NO: 7426436 - DNA, 22 bp, Homo sapiens
taagggttcagaatgcagtggt

SEQ ID NO: 7426437 - DNA, 22 bp, Homo sapiens
taagggttcagaatgcagtggt

SEQ ID NO: 7426438 - DNA, 22 bp, Homo sapiens
taagggttcagaatgcagtggt

SEQ ID NO: 7426439 - DNA, 22 bp, Homo sapiens
taagggttcagaatgcagtggt

SEQ ID NO: 7426440 - DNA, 22 bp, Homo sapiens
taagggctcctgtcctggcttg

SEQ ID NO: 7426441 - DNA, 22 bp, Homo sapiens
taagggggaactcagttcagaa

SEQ ID NO: 7426442 - DNA, 22 bp, Homo sapiens
taagggggaagatcatatttta

SEQ ID NO: 7426443 - DNA, 22 bp, Homo sapiens
taagggggcacttactctcagg

SEQ ID NO: 7426444 - DNA, 22 bp, Homo sapiens
taagggttcagaatgcagtggt

SEQ ID NO: 7426445 - DNA, 22 bp, Homo sapiens
taagggttcagaatgcagtggt

SEQ ID NO: 7426446 - DNA, 22 bp, Homo sapiens
taagggttcagaatgcagtggt

SEQ ID NO: 7426447 - DNA, 21 bp, Homo sapiens
taagggcaggaattgggcttt

SEQ ID NO: 7426448 - DNA, 21 bp, Homo sapiens
taagggcaggaattgggcttt

SEQ ID NO: 7426449 - DNA, 22 bp, Homo sapiens
taagggcaggttccaaaagggt

SEQ ID NO: 7426450 - DNA, 22 bp, Homo sapiens
taagggctctatcctactgttt

SEQ ID NO: 7426451 - DNA, 22 bp, Homo sapiens
taagggctgaacatttgtgtcc

SEQ ID NO: 7426452 - DNA, 22 bp, Homo sapiens
taaggggcccagaccgggcgcc

SEQ ID NO: 7426453 - DNA, 17 bp, Homo sapiens
taagggggaaacggagc

SEQ ID NO: 7426454 - DNA, 22 bp, Homo sapiens
taaggtcatggtgaataataag

SEQ ID NO: 7426455 - DNA, 22 bp, Homo sapiens
taaggtctttggtcactggtag

SEQ ID NO: 7426456 - DNA, 22 bp, Homo sapiens
taaggtctttggtcactggtag

SEQ ID NO: 7426457 - DNA, 22 bp, Homo sapiens
taaggtgaaaacacaagttgct

SEQ ID NO: 7426458 - DNA, 22 bp, Homo sapiens
taaggtgtggtagtttagttct

SEQ ID NO: 7426459 - DNA, 22 bp, Homo sapiens
taaggtttaacgccctgtctcg

SEQ ID NO: 7426460 - DNA, 22 bp, Homo sapiens
taaggtttctagtttctaaact

SEQ ID NO: 7426461 - DNA, 22 bp, Homo sapiens
taaggtttctagtttctaaact

SEQ ID NO: 7426462 - DNA, 19 bp, Homo sapiens
taaggtttaccagcaaaat

SEQ ID NO: 7426463 - DNA, 22 bp, Homo sapiens
taaggtttaacgccctgtctcg

SEQ ID NO: 7426464 - DNA, 22 bp, Homo sapiens
taaggtttcttcagatactagt

SEQ ID NO: 7426465 - DNA, 22 bp, Homo sapiens
taaggtttctagtttctaaact

SEQ ID NO: 7426466 - DNA, 22 bp, Homo sapiens
taaggtttgaagaagactgagc

SEQ ID NO: 7426467 - DNA, 22 bp, Homo sapiens
taaggtttgcttatcttcgcct

SEQ ID NO: 7426468 - DNA, 22 bp, Homo sapiens
tacagatttggggagtaaagtt

SEQ ID NO: 7426469 - DNA, 22 bp, Homo sapiens
tacagatttggggagtaaagtt

SEQ ID NO: 7426470 - DNA, 22 bp, Homo sapiens
tacagatttggggagtaaagtt

SEQ ID NO: 7426471 - DNA, 22 bp, Homo sapiens
tacagatttggggagtaaagtt

SEQ ID NO: 7426472 - DNA, 22 bp, Homo sapiens
tacagattgaggtttttaatat

SEQ ID NO: 7426473 - DNA, 22 bp, Homo sapiens
tacagattgaggtttttaatat

SEQ ID NO: 7426474 - DNA, 22 bp, Homo sapiens
tacagattgaggtttttaatat

SEQ ID NO: 7426475 - DNA, 18 bp, Homo sapiens
tacagattatagatacat

SEQ ID NO: 7426476 - DNA, 22 bp, Homo sapiens
tacagattgaggtttttaatat

SEQ ID NO: 7426477 - DNA, 18 bp, Homo sapiens
tacagattatagatacat

SEQ ID NO: 7426478 - DNA, 18 bp, Homo sapiens
tacagattatagatacat

SEQ ID NO: 7426479 - DNA, 18 bp, Homo sapiens
tacagattatagatacat

SEQ ID NO: 7426480 - DNA, 22 bp, Homo sapiens
tacagatattgtacagttatag

SEQ ID NO: 7426481 - DNA, 22 bp, Homo sapiens
tacagatattgtacagttatag

SEQ ID NO: 7426482 - DNA, 22 bp, Homo sapiens
tacagatatgttccatgcatcg

SEQ ID NO: 7426483 - DNA, 22 bp, Homo sapiens
tacagatattgtacagttatag

SEQ ID NO: 7426484 - DNA, 22 bp, Homo sapiens
tacagatattgtacagttatag

SEQ ID NO: 7426485 - DNA, 22 bp, Homo sapiens
tacagatatttctcttcaacaa

SEQ ID NO: 7426486 - DNA, 21 bp, Homo sapiens
tacagatgaggagaccaaggc

SEQ ID NO: 7426487 - DNA, 22 bp, Homo sapiens
tacagatatagagatttataga

SEQ ID NO: 7426488 - DNA, 22 bp, Homo sapiens
tacagatatagagatttataga

SEQ ID NO: 7426489 - DNA, 22 bp, Homo sapiens
tacagatatagagatttataga

SEQ ID NO: 7426490 - DNA, 22 bp, Homo sapiens
tacagatatagagatttataga

SEQ ID NO: 7426491 - DNA, 22 bp, Homo sapiens
tacagatatagagatttataga

SEQ ID NO: 7426492 - DNA, 22 bp, Homo sapiens
tacagataggaggaatctgaaa

SEQ ID NO: 7426493 - DNA, 22 bp, Homo sapiens
tacagataggaggaatctgaaa

SEQ ID NO: 7426494 - DNA, 22 bp, Homo sapiens
tacagataggaggaatctgaaa

SEQ ID NO: 7426495 - DNA, 22 bp, Homo sapiens
tacagatatagagatttataga

SEQ ID NO: 7426496 - DNA, 22 bp, Homo sapiens
tacagatatagagatttataga

SEQ ID NO: 7426497 - DNA, 22 bp, Homo sapiens
tacagatatagagatttataga

SEQ ID NO: 7426498 - DNA, 22 bp, Homo sapiens
tacagatatgtatgcacttttt

SEQ ID NO: 7426499 - DNA, 22 bp, Homo sapiens
tacagatatgttccatgcatcg

SEQ ID NO: 7426500 - DNA, 22 bp, Homo sapiens
tacagatatgtatgcacttttt

SEQ ID NO: 7426501 - DNA, 22 bp, Homo sapiens
tacagatatgtatgcacttttt

SEQ ID NO: 7426502 - DNA, 22 bp, Homo sapiens
tacagattttgtgaagaagtgt

SEQ ID NO: 7426503 - DNA, 22 bp, Homo sapiens
tacagatttggggagtaaagtt

SEQ ID NO: 7426504 - DNA, 22 bp, Homo sapiens
tacagattttgtgaagaagtgt

SEQ ID NO: 7426505 - DNA, 22 bp, Homo sapiens
tacagattttgtgaagaagtgt

SEQ ID NO: 7426506 - DNA, 22 bp, Homo sapiens
tacagcaaagaaaccctcagtc

SEQ ID NO: 7426507 - DNA, 22 bp, Homo sapiens
tacagattttgtgaagaagtgt

SEQ ID NO: 7426508 - DNA, 22 bp, Homo sapiens
tacagcaaagaaaccctcagtc

SEQ ID NO: 7426509 - DNA, 22 bp, Homo sapiens
tacagcaaagaaaccctcagtc

SEQ ID NO: 7426510 - DNA, 22 bp, Homo sapiens
tacagcaaagaaaccctcagtc

SEQ ID NO: 7426511 - DNA, 21 bp, Homo sapiens
tacagcaacggaggttttcta

SEQ ID NO: 7426512 - DNA, 21 bp, Homo sapiens
tacagcaacggaggttttcta

SEQ ID NO: 7426513 - DNA, 22 bp, Homo sapiens
tacagcaataatgacaccgctc

SEQ ID NO: 7426514 - DNA, 22 bp, Homo sapiens
tacagcaataatgacaccgctc

SEQ ID NO: 7426515 - DNA, 22 bp, Homo sapiens
tacagcaataatgacaccgctc

SEQ ID NO: 7426516 - DNA, 22 bp, Homo sapiens
tacagcaataatgacaccgctc

SEQ ID NO: 7426517 - DNA, 22 bp, Homo sapiens
tacagcaataatgacaccgctc

SEQ ID NO: 7426518 - DNA, 23 bp, Homo sapiens
tacagcaaggacaacataggtgg

SEQ ID NO: 7426519 - DNA, 23 bp, Homo sapiens
tacagcaaggacaacataggtgg

SEQ ID NO: 7426520 - DNA, 22 bp, Homo sapiens
tacagcaagacagaccgctcaa

SEQ ID NO: 7426521 - DNA, 23 bp, Homo sapiens
tacagcaaggacaacataggtgg

SEQ ID NO: 7426522 - DNA, 21 bp, Homo sapiens
tacagcaacggaggttttcta

SEQ ID NO: 7426523 - DNA, 22 bp, Homo sapiens
tacagcaagacagaccgctcaa

SEQ ID NO: 7426524 - DNA, 22 bp, Homo sapiens
tacagcaagacagaccgctcaa

SEQ ID NO: 7426525 - DNA, 22 bp, Homo sapiens
tacagcaatgcctgaaatagta

SEQ ID NO: 7426526 - DNA, 22 bp, Homo sapiens
tacagcaatgcctgaaatagta

SEQ ID NO: 7426527 - DNA, 22 bp, Homo sapiens
tacagcaatgctacaagatgac

SEQ ID NO: 7426528 - DNA, 22 bp, Homo sapiens
tacagcaatgctacaagatgac

SEQ ID NO: 7426529 - DNA, 22 bp, Homo sapiens
tacagcaatgctacaagatgac

SEQ ID NO: 7426530 - DNA, 22 bp, Homo sapiens
tacagcaatgctacaagatgac

SEQ ID NO: 7426531 - DNA, 22 bp, Homo sapiens
tacagcaatgcctgaaatagta

SEQ ID NO: 7426532 - DNA, 22 bp, Homo sapiens
tacagcaataatgacaccgctc

SEQ ID NO: 7426533 - DNA, 22 bp, Homo sapiens
tacagcaatgcctgaaatagta

SEQ ID NO: 7426534 - DNA, 22 bp, Homo sapiens
tacagcaatgcctgaaatagta

SEQ ID NO: 7426535 - DNA, 22 bp, Homo sapiens
tacagcaatgcctgaaatagta

SEQ ID NO: 7426536 - DNA, 22 bp, Homo sapiens
tacagcacaaagggcctttacc

SEQ ID NO: 7426537 - DNA, 22 bp, Homo sapiens
tacagcaatggttctaagagtc

SEQ ID NO: 7426538 - DNA, 22 bp, Homo sapiens
tacagcaatggttctaagagtc

SEQ ID NO: 7426539 - DNA, 22 bp, Homo sapiens
tacagcaatggttctaagagtc

SEQ ID NO: 7426540 - DNA, 22 bp, Homo sapiens
tacagcaatggttctaagagtc

SEQ ID NO: 7426541 - DNA, 22 bp, Homo sapiens
tacagcaatggttctaagagtc

SEQ ID NO: 7426542 - DNA, 22 bp, Homo sapiens
tacagcaatgctacaagatgac

SEQ ID NO: 7426543 - DNA, 22 bp, Homo sapiens
tacagcaatgctacaagatgac

SEQ ID NO: 7426544 - DNA, 22 bp, Homo sapiens
tacagcaatgctacaagatgac

SEQ ID NO: 7426545 - DNA, 22 bp, Homo sapiens
tacagagtggttgtccaactct

SEQ ID NO: 7426546 - DNA, 22 bp, Homo sapiens
tacagagtgttattacagaatc

SEQ ID NO: 7426547 - DNA, 22 bp, Homo sapiens
tacagagtgttattacagaatc

SEQ ID NO: 7426548 - DNA, 22 bp, Homo sapiens
tacagagttttcctgccaagaa

SEQ ID NO: 7426549 - DNA, 22 bp, Homo sapiens
tacagagtatttttaatatggt

SEQ ID NO: 7426550 - DNA, 22 bp, Homo sapiens
tacagaataaagcgtgaagctt

SEQ ID NO: 7426551 - DNA, 22 bp, Homo sapiens
tacagaagttggttttagttta

SEQ ID NO: 7426552 - DNA, 22 bp, Homo sapiens
tacagaagttggttttagttta

SEQ ID NO: 7426553 - DNA, 17 bp, Homo sapiens
tacagaaggcaccacaa

SEQ ID NO: 7426554 - DNA, 17 bp, Homo sapiens
tacagaaggcaccacaa

SEQ ID NO: 7426555 - DNA, 17 bp, Homo sapiens
tacagaaggcaccacaa

SEQ ID NO: 7426556 - DNA, 22 bp, Homo sapiens
tacagaagtaaataccaaaagc

SEQ ID NO: 7426557 - DNA, 22 bp, Homo sapiens
tacagaagtaaataccaaaagc

SEQ ID NO: 7426558 - DNA, 22 bp, Homo sapiens
tacagaagtaaataccaaaagc

SEQ ID NO: 7426559 - DNA, 22 bp, Homo sapiens
tacagaagtaaataccaaaagc

SEQ ID NO: 7426560 - DNA, 22 bp, Homo sapiens
tacagatacagatctagataca

SEQ ID NO: 7426561 - DNA, 22 bp, Homo sapiens
tacagatacagatctagataca

SEQ ID NO: 7426562 - DNA, 22 bp, Homo sapiens
tacagataactgaatgcagact

SEQ ID NO: 7426563 - DNA, 22 bp, Homo sapiens
tacagataactgaatgcagact

SEQ ID NO: 7426564 - DNA, 22 bp, Homo sapiens
tacagatacagatctagataca

SEQ ID NO: 7426565 - DNA, 22 bp, Homo sapiens
tacagatacagatctagataca

SEQ ID NO: 7426566 - DNA, 22 bp, Homo sapiens
tacagatacagatctagataca

SEQ ID NO: 7426567 - DNA, 22 bp, Homo sapiens
tacagatacagatctagataca

SEQ ID NO: 7426568 - DNA, 22 bp, Homo sapiens
tacagatacagatctagataca

SEQ ID NO: 7426569 - DNA, 22 bp, Homo sapiens
tacagataaaaatgctgttctt

SEQ ID NO: 7426570 - DNA, 22 bp, Homo sapiens
tacagagttttcctgccaagaa

SEQ ID NO: 7426571 - DNA, 22 bp, Homo sapiens
tacagataaattttaagtagaa

SEQ ID NO: 7426572 - DNA, 22 bp, Homo sapiens
tacagataaattttaagtagaa

SEQ ID NO: 7426573 - DNA, 22 bp, Homo sapiens
tacagataactgaatgcagact

SEQ ID NO: 7426574 - DNA, 22 bp, Homo sapiens
tacagataactgaatgcagact

SEQ ID NO: 7426575 - DNA, 22 bp, Homo sapiens
tacagataactgaatgcagact

SEQ ID NO: 7426576 - DNA, 22 bp, Homo sapiens
tacagataactgaatgcagact

SEQ ID NO: 7426577 - DNA, 22 bp, Homo sapiens
tacagaagcttttgaaaagatg

SEQ ID NO: 7426578 - DNA, 22 bp, Homo sapiens
tacagaagcttttgaaaagatg

SEQ ID NO: 7426579 - DNA, 22 bp, Homo sapiens
tacagaagcttttgaaaagatg

SEQ ID NO: 7426580 - DNA, 23 bp, Homo sapiens
tacagaaggagtagtcactaaga

SEQ ID NO: 7426581 - DNA, 22 bp, Homo sapiens
tacagaaggaagtttagctaaa

SEQ ID NO: 7426582 - DNA, 22 bp, Homo sapiens
tacagaaggaagtttagctaaa

SEQ ID NO: 7426583 - DNA, 22 bp, Homo sapiens
tacagaaggaagtttagctaaa

SEQ ID NO: 7426584 - DNA, 23 bp, Homo sapiens
tacagaaggagtagtcactaaga

SEQ ID NO: 7426585 - DNA, 23 bp, Homo sapiens
tacagaaggagtagtcactaaga

SEQ ID NO: 7426586 - DNA, 23 bp, Homo sapiens
tacagaaggagtagtcactaaga

SEQ ID NO: 7426587 - DNA, 22 bp, Homo sapiens
tacagaagctgagacactgaga

SEQ ID NO: 7426588 - DNA, 18 bp, Homo sapiens
tacagaactggagtagaa

SEQ ID NO: 7426589 - DNA, 18 bp, Homo sapiens
tacagaactggagtagaa

SEQ ID NO: 7426590 - DNA, 22 bp, Homo sapiens
tacagaagctgagacactgaga

SEQ ID NO: 7426591 - DNA, 22 bp, Homo sapiens
tacagaagctgagacactgaga

SEQ ID NO: 7426592 - DNA, 22 bp, Homo sapiens
tacagaagctgagacactgaga

SEQ ID NO: 7426593 - DNA, 22 bp, Homo sapiens
tacagaaattgccaccagctct

SEQ ID NO: 7426594 - DNA, 22 bp, Homo sapiens
tacagaaattgccaccagctct

SEQ ID NO: 7426595 - DNA, 22 bp, Homo sapiens
tacagaaattgccaccagctct

SEQ ID NO: 7426596 - DNA, 22 bp, Homo sapiens
tacagaactgaagtagtgaaaa

SEQ ID NO: 7426597 - DNA, 22 bp, Homo sapiens
tacagaactgaagtagtgaaaa

SEQ ID NO: 7426598 - DNA, 22 bp, Homo sapiens
tacagaaatactggggggttct

SEQ ID NO: 7426599 - DNA, 22 bp, Homo sapiens
tacagaaatactggggggttct

SEQ ID NO: 7426600 - DNA, 22 bp, Homo sapiens
tacagaaatacagtcaggccta

SEQ ID NO: 7426601 - DNA, 22 bp, Homo sapiens
tacagaaatacagtcaggccta

SEQ ID NO: 7426602 - DNA, 22 bp, Homo sapiens
tacagaaatacagtcaggccta

SEQ ID NO: 7426603 - DNA, 22 bp, Homo sapiens
tacagaaatacagtcaggccta

SEQ ID NO: 7426604 - DNA, 22 bp, Homo sapiens
tacagaaatcacatcgctttga

SEQ ID NO: 7426605 - DNA, 22 bp, Homo sapiens
tacagaaatcacatcgctttga

SEQ ID NO: 7426606 - DNA, 22 bp, Homo sapiens
tacagaaatcacatcgctttga

SEQ ID NO: 7426607 - DNA, 22 bp, Homo sapiens
tacagaaatcacatcgctttga

SEQ ID NO: 7426608 - DNA, 22 bp, Homo sapiens
tacagaaatcacatcgctttga

SEQ ID NO: 7426609 - DNA, 22 bp, Homo sapiens
tacagaaatcacatcgctttga

SEQ ID NO: 7426610 - DNA, 22 bp, Homo sapiens
tacagaaatactggggggttct

SEQ ID NO: 7426611 - DNA, 22 bp, Homo sapiens
tacagaaattgccaccagctct

SEQ ID NO: 7426612 - DNA, 22 bp, Homo sapiens
tacagaaattgccaccagctct

SEQ ID NO: 7426613 - DNA, 22 bp, Homo sapiens
tacagaaattgccaccagctct

SEQ ID NO: 7426614 - DNA, 22 bp, Homo sapiens
tacagaaattgccaccagctct

SEQ ID NO: 7426615 - DNA, 22 bp, Homo sapiens
tacagaaattgccaccagctct

SEQ ID NO: 7426616 - DNA, 22 bp, Homo sapiens
tacagaaatcacatcgctttga

SEQ ID NO: 7426617 - DNA, 22 bp, Homo sapiens
tacagaaatcacatcgctttga

SEQ ID NO: 7426618 - DNA, 22 bp, Homo sapiens
tacagaaatcacatcgctttga

SEQ ID NO: 7426619 - DNA, 22 bp, Homo sapiens
tacagaaatcacatcgctttga

SEQ ID NO: 7426620 - DNA, 22 bp, Homo sapiens
tacactgaagtgtcttggtata

SEQ ID NO: 7426621 - DNA, 22 bp, Homo sapiens
tacactcttaggaattggttat

SEQ ID NO: 7426622 - DNA, 22 bp, Homo sapiens
tacactcttaggaattggttat

SEQ ID NO: 7426623 - DNA, 22 bp, Homo sapiens
tacactgaaagagaggattgaa

SEQ ID NO: 7426624 - DNA, 22 bp, Homo sapiens
tacactcttaggaattggttat

SEQ ID NO: 7426625 - DNA, 22 bp, Homo sapiens
tacactcttaggaattggttat

SEQ ID NO: 7426626 - DNA, 22 bp, Homo sapiens
tacactctaattctttggtcct

SEQ ID NO: 7426627 - DNA, 21 bp, Homo sapiens
tacactcatcctctcccaagg

SEQ ID NO: 7426628 - DNA, 22 bp, Homo sapiens
tacactctaattctttggtcct

SEQ ID NO: 7426629 - DNA, 21 bp, Homo sapiens
tacactcatcctctcccaagg

SEQ ID NO: 7426630 - DNA, 22 bp, Homo sapiens
tacactcacccagcttggggcc

SEQ ID NO: 7426631 - DNA, 22 bp, Homo sapiens
tacaacataacgggcattcagt

SEQ ID NO: 7426632 - DNA, 22 bp, Homo sapiens
tacaacataacgggcattcagt

SEQ ID NO: 7426633 - DNA, 22 bp, Homo sapiens
tacactattttactgatacaaa

SEQ ID NO: 7426634 - DNA, 22 bp, Homo sapiens
tacactattttactgatacaaa

SEQ ID NO: 7426635 - DNA, 22 bp, Homo sapiens
tacactattttactgatacaaa

SEQ ID NO: 7426636 - DNA, 22 bp, Homo sapiens
tacaacagtaatcaaggttttt

SEQ ID NO: 7426637 - DNA, 22 bp, Homo sapiens
tacaacagttcatgaaatgaaa

SEQ ID NO: 7426638 - DNA, 22 bp, Homo sapiens
tacaacagttcatgaaatgaaa

SEQ ID NO: 7426639 - DNA, 22 bp, Homo sapiens
tacactgagcaggaagaagtgg

SEQ ID NO: 7426640 - DNA, 22 bp, Homo sapiens
tacacttttcaatgtagtctgt

SEQ ID NO: 7426641 - DNA, 22 bp, Homo sapiens
tacactttttactacagattct

SEQ ID NO: 7426642 - DNA, 22 bp, Homo sapiens
tacacttttctggttactcttg

SEQ ID NO: 7426643 - DNA, 22 bp, Homo sapiens
tacactttttactacagattct

SEQ ID NO: 7426644 - DNA, 22 bp, Homo sapiens
tacacttttctggttactcttg

SEQ ID NO: 7426645 - DNA, 22 bp, Homo sapiens
tacacttttctggttactcttg

SEQ ID NO: 7426646 - DNA, 22 bp, Homo sapiens
tacacttttctggttactcttg

SEQ ID NO: 7426647 - DNA, 22 bp, Homo sapiens
tacactttttactacagattct

SEQ ID NO: 7426648 - DNA, 22 bp, Homo sapiens
tacactttttactacagattct

SEQ ID NO: 7426649 - DNA, 22 bp, Homo sapiens
tacactttttactacagattct

SEQ ID NO: 7426650 - DNA, 22 bp, Homo sapiens
tacactttttactacagattct

SEQ ID NO: 7426651 - DNA, 22 bp, Homo sapiens
tacagaaaaacatctggagccg

SEQ ID NO: 7426652 - DNA, 22 bp, Homo sapiens
tacagaaaaacatctggagccg

SEQ ID NO: 7426653 - DNA, 22 bp, Homo sapiens
tacagaaaaacatctggagccg

SEQ ID NO: 7426654 - DNA, 22 bp, Homo sapiens
tacagaaaaacatctggagccg

SEQ ID NO: 7426655 - DNA, 22 bp, Homo sapiens
tacagaaaaacatctggagccg

SEQ ID NO: 7426656 - DNA, 22 bp, Homo sapiens
tacagaaaaacatctggagccg

SEQ ID NO: 7426657 - DNA, 22 bp, Homo sapiens
tacagaaaaacatctggagccg

SEQ ID NO: 7426658 - DNA, 20 bp, Homo sapiens
tacagaaacaggacttttgg

SEQ ID NO: 7426659 - DNA, 20 bp, Homo sapiens
tacagaaacaggacttttgg

SEQ ID NO: 7426660 - DNA, 20 bp, Homo sapiens
tacagaaacaggacttttgg

SEQ ID NO: 7426661 - DNA, 20 bp, Homo sapiens
tacagaaacaggacttttgg

SEQ ID NO: 7426662 - DNA, 22 bp, Homo sapiens
tacagaaagacctctcgggaaa

SEQ ID NO: 7426663 - DNA, 22 bp, Homo sapiens
tacagaaagacctctcgggaaa

SEQ ID NO: 7426664 - DNA, 20 bp, Homo sapiens
tacagaaacaggacttttgg

SEQ ID NO: 7426665 - DNA, 22 bp, Homo sapiens
tacagaaagacctctcgggaaa

SEQ ID NO: 7426666 - DNA, 20 bp, Homo sapiens
tacagaaacaggacttttgg

SEQ ID NO: 7426667 - DNA, 20 bp, Homo sapiens
tacagaaacaggacttttgg

SEQ ID NO: 7426668 - DNA, 20 bp, Homo sapiens
tacagaaacaggacttttgg

SEQ ID NO: 7426669 - DNA, 22 bp, Homo sapiens
tacagaaagggatgattgatct

SEQ ID NO: 7426670 - DNA, 22 bp, Homo sapiens
tacagaaagggatgattgatct

SEQ ID NO: 7426671 - DNA, 22 bp, Homo sapiens
tacagaaagggatgattgatct

SEQ ID NO: 7426672 - DNA, 22 bp, Homo sapiens
tacagaaagggatgattgatct

SEQ ID NO: 7426673 - DNA, 22 bp, Homo sapiens
tacagaaagggatgattgatct

SEQ ID NO: 7426674 - DNA, 22 bp, Homo sapiens
tacagaaagggatgattgatct

SEQ ID NO: 7426675 - DNA, 22 bp, Homo sapiens
tacagaaagacctctcgggaaa

SEQ ID NO: 7426676 - DNA, 22 bp, Homo sapiens
tacagaaagacctctcgggaaa

SEQ ID NO: 7426677 - DNA, 22 bp, Homo sapiens
tacagaaagggatgattgatct

SEQ ID NO: 7426678 - DNA, 22 bp, Homo sapiens
tacagaaagggatgattgatct

SEQ ID NO: 7426679 - DNA, 22 bp, Homo sapiens
tacagaaagggatgattgatct

SEQ ID NO: 7426680 - DNA, 22 bp, Homo sapiens
tacagaaagggatgattgatct

SEQ ID NO: 7426681 - DNA, 22 bp, Homo sapiens
tacagaaagggatgattgatct

SEQ ID NO: 7426682 - DNA, 22 bp, Homo sapiens
tacagaaaaactggcattgaag

SEQ ID NO: 7426683 - DNA, 22 bp, Homo sapiens
tacagaaaaactggcattgaag

SEQ ID NO: 7426684 - DNA, 22 bp, Homo sapiens
tacagaaaaactggcattgaag

SEQ ID NO: 7426685 - DNA, 22 bp, Homo sapiens
tacagaaaaactggcattgaag

SEQ ID NO: 7426686 - DNA, 22 bp, Homo sapiens
tacagaaaaacttggaggcttt

SEQ ID NO: 7426687 - DNA, 22 bp, Homo sapiens
tacagaaaaacttggaggcttt

SEQ ID NO: 7426688 - DNA, 22 bp, Homo sapiens
tacagaaaaacttggaggcttt

SEQ ID NO: 7426689 - DNA, 22 bp, Homo sapiens
tacagaaaaacttggaggcttt

SEQ ID NO: 7426690 - DNA, 22 bp, Homo sapiens
tacagaaaaactggcattgaag

SEQ ID NO: 7426691 - DNA, 22 bp, Homo sapiens
tacagaaaaactggcattgaag

SEQ ID NO: 7426692 - DNA, 22 bp, Homo sapiens
tacagaaacagcgtggttagaa

SEQ ID NO: 7426693 - DNA, 22 bp, Homo sapiens
tacagaaacagcgtggttagaa

SEQ ID NO: 7426694 - DNA, 22 bp, Homo sapiens
tacagaaaaacttggaggcttt

SEQ ID NO: 7426695 - DNA, 20 bp, Homo sapiens
tacagaaacaggacttttgg

SEQ ID NO: 7426696 - DNA, 20 bp, Homo sapiens
tacagaaacaggacttttgg

SEQ ID NO: 7426697 - DNA, 20 bp, Homo sapiens
tacagaaacaggacttttgg

SEQ ID NO: 7426698 - DNA, 20 bp, Homo sapiens
tacagaaacaggacttttgg

SEQ ID NO: 7426699 - DNA, 20 bp, Homo sapiens
tacagaaacaggacttttgg

SEQ ID NO: 7426700 - DNA, 20 bp, Homo sapiens
tacagaaacaggacttttgg

SEQ ID NO: 7426701 - DNA, 22 bp, Homo sapiens
tacagaaacagcgtggttagaa

SEQ ID NO: 7426702 - DNA, 22 bp, Homo sapiens
tacagaaacagcgtggttagaa

SEQ ID NO: 7426703 - DNA, 22 bp, Homo sapiens
tacaaagtcccattgccatgga

SEQ ID NO: 7426704 - DNA, 22 bp, Homo sapiens
tacaaagtcccattgccatgga

SEQ ID NO: 7426705 - DNA, 22 bp, Homo sapiens
tacaaagtcccattgccatgga

SEQ ID NO: 7426706 - DNA, 22 bp, Homo sapiens
tacaaagtgaaataattctgag

SEQ ID NO: 7426707 - DNA, 22 bp, Homo sapiens
tacaaagtcagaataacaggtg

SEQ ID NO: 7426708 - DNA, 22 bp, Homo sapiens
tacaaagtcagaataacaggtg

SEQ ID NO: 7426709 - DNA, 22 bp, Homo sapiens
tacaaagtgaaataattctgag

SEQ ID NO: 7426710 - DNA, 22 bp, Homo sapiens
tacaaagtgaaataattctgag

SEQ ID NO: 7426711 - DNA, 22 bp, Homo sapiens
tacaaagtgagcaacctctttt

SEQ ID NO: 7426712 - DNA, 22 bp, Homo sapiens
tacaaagtgagcaacctctttt

SEQ ID NO: 7426713 - DNA, 22 bp, Homo sapiens
tacaaagtgctttagaaatgaa

SEQ ID NO: 7426714 - DNA, 22 bp, Homo sapiens
tacaaagtgctttagaaatgaa

SEQ ID NO: 7426715 - DNA, 22 bp, Homo sapiens
tacaaagtgattttggaattga

SEQ ID NO: 7426716 - DNA, 22 bp, Homo sapiens
tacaaagtgagcaacctctttt

SEQ ID NO: 7426717 - DNA, 22 bp, Homo sapiens
tacaaagtgctttagaaatgaa

SEQ ID NO: 7426718 - DNA, 22 bp, Homo sapiens
tacaaagtgctttagaaatgaa

SEQ ID NO: 7426719 - DNA, 22 bp, Homo sapiens
tacaaagtgctttagaaatgaa

SEQ ID NO: 7426720 - DNA, 22 bp, Homo sapiens
tacaaagtgctttagaaatgaa

SEQ ID NO: 7426721 - DNA, 22 bp, Homo sapiens
tacaaagtgagcaacctctttt

SEQ ID NO: 7426722 - DNA, 22 bp, Homo sapiens
tacaaagtgtgcccatgctgag

SEQ ID NO: 7426723 - DNA, 22 bp, Homo sapiens
tacaaagtgggaaacgaaggtt

SEQ ID NO: 7426724 - DNA, 22 bp, Homo sapiens
tacaaagtttgagaatgctttc

SEQ ID NO: 7426725 - DNA, 22 bp, Homo sapiens
tacaaagtgtgcccatgctgag

SEQ ID NO: 7426726 - DNA, 22 bp, Homo sapiens
tacaaagtttgagaatgctttc

SEQ ID NO: 7426727 - DNA, 22 bp, Homo sapiens
tacaaagtttgagaatgctttc

SEQ ID NO: 7426728 - DNA, 22 bp, Homo sapiens
tacaaagtttgagaatgctttc

SEQ ID NO: 7426729 - DNA, 22 bp, Homo sapiens
tacaaagttttcttggattgag

SEQ ID NO: 7426730 - DNA, 22 bp, Homo sapiens
tacaaatcagatcatgagttta

SEQ ID NO: 7426731 - DNA, 22 bp, Homo sapiens
tacaaagtttggggtcctcaaa

SEQ ID NO: 7426732 - DNA, 22 bp, Homo sapiens
tacaacagacaggaataagatt

SEQ ID NO: 7426733 - DNA, 22 bp, Homo sapiens
tacaacagacaggaataagatt

SEQ ID NO: 7426734 - DNA, 22 bp, Homo sapiens
tacaacagacaggaataagatt

SEQ ID NO: 7426735 - DNA, 22 bp, Homo sapiens
tacaacagacaggaataagatt

SEQ ID NO: 7426736 - DNA, 22 bp, Homo sapiens
tacaacagaagtgtttatttag

SEQ ID NO: 7426737 - DNA, 22 bp, Homo sapiens
tacaacagaagtgtttatttag

SEQ ID NO: 7426738 - DNA, 22 bp, Homo sapiens
tacaacactggttcgacatgtg

SEQ ID NO: 7426739 - DNA, 22 bp, Homo sapiens
tacaacactgttcagcctcttc

SEQ ID NO: 7426740 - DNA, 22 bp, Homo sapiens
tacaacaatttccacattagaa

SEQ ID NO: 7426741 - DNA, 21 bp, Homo sapiens
tacaacaggttttatttcgat

SEQ ID NO: 7426742 - DNA, 21 bp, Homo sapiens
tacaacaggttttatttcgat

SEQ ID NO: 7426743 - DNA, 22 bp, Homo sapiens
tacaacaggaatttcaactttg

SEQ ID NO: 7426744 - DNA, 22 bp, Homo sapiens
tacaacaggaatttcaactttg

SEQ ID NO: 7426745 - DNA, 22 bp, Homo sapiens
tacaacagacctagatgaatga

SEQ ID NO: 7426746 - DNA, 20 bp, Homo sapiens
tacaacaagtagagacatac

SEQ ID NO: 7426747 - DNA, 20 bp, Homo sapiens
tacaacaagtagagacatac

SEQ ID NO: 7426748 - DNA, 20 bp, Homo sapiens
tacaacaagtagagacatac

SEQ ID NO: 7426749 - DNA, 20 bp, Homo sapiens
tacaacaagtagagacatac

SEQ ID NO: 7426750 - DNA, 20 bp, Homo sapiens
tacaacaagtagagacatac

SEQ ID NO: 7426751 - DNA, 22 bp, Homo sapiens
tacaaatcagatcatgagttta

SEQ ID NO: 7426752 - DNA, 22 bp, Homo sapiens
tacaaatcagatcatgagttta

SEQ ID NO: 7426753 - DNA, 22 bp, Homo sapiens
tacaaatcagatcatgagttta

SEQ ID NO: 7426754 - DNA, 22 bp, Homo sapiens
tacaaatccaagacccatacaa

SEQ ID NO: 7426755 - DNA, 22 bp, Homo sapiens
tacaacaatttccacattagaa

SEQ ID NO: 7426756 - DNA, 22 bp, Homo sapiens
tacaacaatttccacattagaa

SEQ ID NO: 7426757 - DNA, 20 bp, Homo sapiens
tacaacaagtagagacatac

SEQ ID NO: 7426758 - DNA, 22 bp, Homo sapiens
tacaacaatttccacattagaa

SEQ ID NO: 7426759 - DNA, 22 bp, Homo sapiens
tacaacaatttccacattagaa

SEQ ID NO: 7426760 - DNA, 22 bp, Homo sapiens
tacaacaatttccacattagaa

SEQ ID NO: 7426761 - DNA, 22 bp, Homo sapiens
tacaacaatttccacattagaa

SEQ ID NO: 7426762 - DNA, 22 bp, Homo sapiens
tacaacaatttccacattagaa

SEQ ID NO: 7426763 - DNA, 22 bp, Homo sapiens
tacatttggatgtgcttaagtg

SEQ ID NO: 7426764 - DNA, 22 bp, Homo sapiens
tacatttggatgtgcttaagtg

SEQ ID NO: 7426765 - DNA, 22 bp, Homo sapiens
tacatttggatgtgcttaagtg

SEQ ID NO: 7426766 - DNA, 22 bp, Homo sapiens
tacatttgggacaataagagaa

SEQ ID NO: 7426767 - DNA, 22 bp, Homo sapiens
tacatttgggacaataagagaa

SEQ ID NO: 7426768 - DNA, 22 bp, Homo sapiens
tacatttgctttgattttcagc

SEQ ID NO: 7426769 - DNA, 22 bp, Homo sapiens
tacatttgctttgattttcagc

SEQ ID NO: 7426770 - DNA, 22 bp, Homo sapiens
tacatttgctttgattttcagc

SEQ ID NO: 7426771 - DNA, 22 bp, Homo sapiens
tacatttgcctccaccaaaggt

SEQ ID NO: 7426772 - DNA, 22 bp, Homo sapiens
tacatttgatttccactcatct

SEQ ID NO: 7426773 - DNA, 22 bp, Homo sapiens
tacatttgatttccactcatct

SEQ ID NO: 7426774 - DNA, 22 bp, Homo sapiens
tacatttgctttgattttcagc

SEQ ID NO: 7426775 - DNA, 22 bp, Homo sapiens
tacatttgctttgattttcagc

SEQ ID NO: 7426776 - DNA, 22 bp, Homo sapiens
tacatttgcctccaccaaaggt

SEQ ID NO: 7426777 - DNA, 21 bp, Homo sapiens
tacatttgagagctataagct

SEQ ID NO: 7426778 - DNA, 21 bp, Homo sapiens
tacatttgagagctataagct

SEQ ID NO: 7426779 - DNA, 22 bp, Homo sapiens
tacatttccttgactcctcaac

SEQ ID NO: 7426780 - DNA, 22 bp, Homo sapiens
tacatttccttgactcctcaac

SEQ ID NO: 7426781 - DNA, 22 bp, Homo sapiens
tacatttgattctctcctccaa

SEQ ID NO: 7426782 - DNA, 22 bp, Homo sapiens
tacatttgattctctcctccaa

SEQ ID NO: 7426783 - DNA, 21 bp, Homo sapiens
tacatttgagagctataagct

SEQ ID NO: 7426784 - DNA, 21 bp, Homo sapiens
tacatttgagagctataagct

SEQ ID NO: 7426785 - DNA, 22 bp, Homo sapiens
tacattgaggcagtagctggag

SEQ ID NO: 7426786 - DNA, 22 bp, Homo sapiens
tacattgagtattatttagcca

SEQ ID NO: 7426787 - DNA, 22 bp, Homo sapiens
tacattgaattttttagcatgt

SEQ ID NO: 7426788 - DNA, 22 bp, Homo sapiens
tacattgaattttttagcatgt

SEQ ID NO: 7426789 - DNA, 21 bp, Homo sapiens
tacattgactacaaataaagc

SEQ ID NO: 7426790 - DNA, 21 bp, Homo sapiens
tacattgactacaaataaagc

SEQ ID NO: 7426791 - DNA, 21 bp, Homo sapiens
tacattgactacaaataaagc

SEQ ID NO: 7426792 - DNA, 21 bp, Homo sapiens
tacattgactacaaataaagc

SEQ ID NO: 7426793 - DNA, 22 bp, Homo sapiens
tacattgagcacgtactatgtg

SEQ ID NO: 7426794 - DNA, 22 bp, Homo sapiens
tacattgacttggattgttaga

SEQ ID NO: 7426795 - DNA, 22 bp, Homo sapiens
tacattgactgtgtgcatcaca

SEQ ID NO: 7426796 - DNA, 22 bp, Homo sapiens
tacattgacttggattgttaga

SEQ ID NO: 7426797 - DNA, 22 bp, Homo sapiens
tacattctggtggagaaagtaa

SEQ ID NO: 7426798 - DNA, 22 bp, Homo sapiens
tacattctggtggagaaagtaa

SEQ ID NO: 7426799 - DNA, 22 bp, Homo sapiens
tacattctggtggagaaagtaa

SEQ ID NO: 7426800 - DNA, 22 bp, Homo sapiens
tacattctggtggagaaagtaa

SEQ ID NO: 7426801 - DNA, 22 bp, Homo sapiens
tacattctggtggagaaagtaa

SEQ ID NO: 7426802 - DNA, 23 bp, Homo sapiens
tacattctgtatttttatagagt

SEQ ID NO: 7426803 - DNA, 23 bp, Homo sapiens
tacattctgtatttttatagagt

SEQ ID NO: 7426804 - DNA, 23 bp, Homo sapiens
tacattctgtatttttatagagt

SEQ ID NO: 7426805 - DNA, 23 bp, Homo sapiens
tacattctgtatttttatagagt

SEQ ID NO: 7426806 - DNA, 23 bp, Homo sapiens
tacattctgtatttttatagagt

SEQ ID NO: 7426807 - DNA, 23 bp, Homo sapiens
tacattctgtatttttatagagt

SEQ ID NO: 7426808 - DNA, 22 bp, Homo sapiens
tacattgaaagtcatttaatcc

SEQ ID NO: 7426809 - DNA, 22 bp, Homo sapiens
tacattgaaagtcatttaatcc

SEQ ID NO: 7426810 - DNA, 22 bp, Homo sapiens
tacattgaaagtcatttaatcc

SEQ ID NO: 7426811 - DNA, 22 bp, Homo sapiens
tacattgaaagtcatttaatcc

SEQ ID NO: 7426812 - DNA, 22 bp, Homo sapiens
tacattgaaatcaatggatgtg

SEQ ID NO: 7426813 - DNA, 22 bp, Homo sapiens
tacattgaaagtcatttaatcc

SEQ ID NO: 7426814 - DNA, 22 bp, Homo sapiens
tacattctatatctgttacatc

SEQ ID NO: 7426815 - DNA, 22 bp, Homo sapiens
tacattctcttcccattgtctc

SEQ ID NO: 7426816 - DNA, 22 bp, Homo sapiens
tacattctatatctgttacatc

SEQ ID NO: 7426817 - DNA, 22 bp, Homo sapiens
tacattctatatctgttacatc

SEQ ID NO: 7426818 - DNA, 22 bp, Homo sapiens
tacattctatatctgttacatc

SEQ ID NO: 7426819 - DNA, 22 bp, Homo sapiens
tacattctatatctgttacatc

SEQ ID NO: 7426820 - DNA, 22 bp, Homo sapiens
tacattctatatctgttacatc

SEQ ID NO: 7426821 - DNA, 22 bp, Homo sapiens
tacattctactttttcactccc

SEQ ID NO: 7426822 - DNA, 22 bp, Homo sapiens
tacattccttcgtttagagatt

SEQ ID NO: 7426823 - DNA, 22 bp, Homo sapiens
tacattcctgggctccacccta

SEQ ID NO: 7426824 - DNA, 22 bp, Homo sapiens
tacattctactttttcactccc

SEQ ID NO: 7426825 - DNA, 22 bp, Homo sapiens
tacattctactttttcactccc

SEQ ID NO: 7426826 - DNA, 22 bp, Homo sapiens
tacattctggaaaggcacagac

SEQ ID NO: 7426827 - DNA, 22 bp, Homo sapiens
tacattctggaaaggcacagac

SEQ ID NO: 7426828 - DNA, 22 bp, Homo sapiens
tacattctcttcccattgtctc

SEQ ID NO: 7426829 - DNA, 22 bp, Homo sapiens
tacattctcttcccattgtctc

SEQ ID NO: 7426830 - DNA, 22 bp, Homo sapiens
tacattctgaaataaatggttt

SEQ ID NO: 7426831 - DNA, 22 bp, Homo sapiens
tacattctgaaataaatggttt

SEQ ID NO: 7426832 - DNA, 22 bp, Homo sapiens
tacattctgaaataaatggttt

SEQ ID NO: 7426833 - DNA, 22 bp, Homo sapiens
tacattctgaaataaatggttt

SEQ ID NO: 7426834 - DNA, 22 bp, Homo sapiens
tacatcattttggagatgagca

SEQ ID NO: 7426835 - DNA, 22 bp, Homo sapiens
tacatccaaagttgaggtgcct

SEQ ID NO: 7426836 - DNA, 22 bp, Homo sapiens
tacatccaaatgaattagaatt

SEQ ID NO: 7426837 - DNA, 22 bp, Homo sapiens
tacatccaaatgaattagaatt

SEQ ID NO: 7426838 - DNA, 22 bp, Homo sapiens
tacatcattttggagatgagca

SEQ ID NO: 7426839 - DNA, 22 bp, Homo sapiens
tacatcattttggagatgagca

SEQ ID NO: 7426840 - DNA, 22 bp, Homo sapiens
tacatcattttggagatgagca

SEQ ID NO: 7426841 - DNA, 22 bp, Homo sapiens
tacatcatgtaagcagaatcat

SEQ ID NO: 7426842 - DNA, 22 bp, Homo sapiens
tacatcatgtaagcagaatcat

SEQ ID NO: 7426843 - DNA, 22 bp, Homo sapiens
tacatctagccttacaattatt

SEQ ID NO: 7426844 - DNA, 22 bp, Homo sapiens
tacatctagccttacaattatt

SEQ ID NO: 7426845 - DNA, 22 bp, Homo sapiens
tacatctagccttacaattatt

SEQ ID NO: 7426846 - DNA, 22 bp, Homo sapiens
tacatccaaagttgaggtgcct

SEQ ID NO: 7426847 - DNA, 22 bp, Homo sapiens
tacatctagccttacaattatt

SEQ ID NO: 7426848 - DNA, 22 bp, Homo sapiens
tacatctagccttacaattatt

SEQ ID NO: 7426849 - DNA, 22 bp, Homo sapiens
tacatctagccttacaattatt

SEQ ID NO: 7426850 - DNA, 22 bp, Homo sapiens
tacatctatactgatctacatt

SEQ ID NO: 7426851 - DNA, 22 bp, Homo sapiens
tacatctatactgatctacatt

SEQ ID NO: 7426852 - DNA, 22 bp, Homo sapiens
tacatctatactgatctacatt

SEQ ID NO: 7426853 - DNA, 22 bp, Homo sapiens
tacatctatactgatctacatt

SEQ ID NO: 7426854 - DNA, 22 bp, Homo sapiens
tacatctatactgatctacatt

SEQ ID NO: 7426855 - DNA, 22 bp, Homo sapiens
tacatctatctagatgctcaga

SEQ ID NO: 7426856 - DNA, 18 bp, Homo sapiens
tacatctatatagtgttt

SEQ ID NO: 7426857 - DNA, 22 bp, Homo sapiens
tacatctatttgacagatacag

SEQ ID NO: 7426858 - DNA, 22 bp, Homo sapiens
tacatctatctagatgctcaga

SEQ ID NO: 7426859 - DNA, 22 bp, Homo sapiens
tacatctatctagatgctcaga

SEQ ID NO: 7426860 - DNA, 22 bp, Homo sapiens
tacatctcatctgtgctctccg

SEQ ID NO: 7426861 - DNA, 22 bp, Homo sapiens
tacatctcatctgtgctctccg

SEQ ID NO: 7426862 - DNA, 20 bp, Homo sapiens
tacatctctcagatgtctaa

SEQ ID NO: 7426863 - DNA, 20 bp, Homo sapiens
tacatctctcagatgtctaa

SEQ ID NO: 7426864 - DNA, 22 bp, Homo sapiens
tacatctttgtctatgaccagc

SEQ ID NO: 7426865 - DNA, 22 bp, Homo sapiens
tacatctttgtctatgaccagc

SEQ ID NO: 7426866 - DNA, 22 bp, Homo sapiens
tacatctttgtctatgaccagc

SEQ ID NO: 7426867 - DNA, 22 bp, Homo sapiens
tacatctgtctggctttccatt

SEQ ID NO: 7426868 - DNA, 22 bp, Homo sapiens
tacatctgtctggctttccatt

SEQ ID NO: 7426869 - DNA, 22 bp, Homo sapiens
tacatgaaataggattctggag

SEQ ID NO: 7426870 - DNA, 22 bp, Homo sapiens
tacatgaacaaaatagcagaaa

SEQ ID NO: 7426871 - DNA, 22 bp, Homo sapiens
tacatgaacaaaatagcagaaa

SEQ ID NO: 7426872 - DNA, 22 bp, Homo sapiens
tacattcccccaattaccaatg

SEQ ID NO: 7426873 - DNA, 22 bp, Homo sapiens
tacattcctgttagcatctaag

SEQ ID NO: 7426874 - DNA, 22 bp, Homo sapiens
tacatagctcctagtgatgcat

SEQ ID NO: 7426875 - DNA, 22 bp, Homo sapiens
tacatagtattcacattgtttt

SEQ ID NO: 7426876 - DNA, 22 bp, Homo sapiens
tacatagtattcacattgtttt

SEQ ID NO: 7426877 - DNA, 22 bp, Homo sapiens
tacatagctcctagtgatgcat

SEQ ID NO: 7426878 - DNA, 22 bp, Homo sapiens
tacatagctcctagtgatgcat

SEQ ID NO: 7426879 - DNA, 22 bp, Homo sapiens
tacatagctcctagtgatgcat

SEQ ID NO: 7426880 - DNA, 22 bp, Homo sapiens
tacatagcaaggaaatgacaga

SEQ ID NO: 7426881 - DNA, 22 bp, Homo sapiens
tacatagcaaggaaatgacaga

SEQ ID NO: 7426882 - DNA, 22 bp, Homo sapiens
tacatagttccatttacaggaa

SEQ ID NO: 7426883 - DNA, 22 bp, Homo sapiens
tacatagtgaacatttacagag

SEQ ID NO: 7426884 - DNA, 22 bp, Homo sapiens
tacatagtgaacatttacagag

SEQ ID NO: 7426885 - DNA, 22 bp, Homo sapiens
tacatagtgaacatttacagag

SEQ ID NO: 7426886 - DNA, 22 bp, Homo sapiens
tacatagtgaacatttacagag

SEQ ID NO: 7426887 - DNA, 22 bp, Homo sapiens
tacatatactgagtgatttgct

SEQ ID NO: 7426888 - DNA, 22 bp, Homo sapiens
tacatatactgagtgatttgct

SEQ ID NO: 7426889 - DNA, 22 bp, Homo sapiens
tacatatactgagtgatttgct

SEQ ID NO: 7426890 - DNA, 22 bp, Homo sapiens
tacatatactgagtgatttgct

SEQ ID NO: 7426891 - DNA, 22 bp, Homo sapiens
tacatatactgagtgatttgct

SEQ ID NO: 7426892 - DNA, 22 bp, Homo sapiens
tacatatactgagtgatttgct

SEQ ID NO: 7426893 - DNA, 22 bp, Homo sapiens
tacatatagacagttactctag

SEQ ID NO: 7426894 - DNA, 22 bp, Homo sapiens
tacatatagacagttactctag

SEQ ID NO: 7426895 - DNA, 22 bp, Homo sapiens
tacatatagacagttactctag

SEQ ID NO: 7426896 - DNA, 22 bp, Homo sapiens
tacatatagacagttactctag

SEQ ID NO: 7426897 - DNA, 22 bp, Homo sapiens
tacatatactgagtgatttgct

SEQ ID NO: 7426898 - DNA, 22 bp, Homo sapiens
tacatatactgagtgatttgct

SEQ ID NO: 7426899 - DNA, 22 bp, Homo sapiens
tacatcatggcttcatgctgca

SEQ ID NO: 7426900 - DNA, 22 bp, Homo sapiens
tacatcatggtgagcaggaggc

SEQ ID NO: 7426901 - DNA, 22 bp, Homo sapiens
tacatcatggtgagcaggaggc

SEQ ID NO: 7426902 - DNA, 22 bp, Homo sapiens
tacatcatgtaagcagaatcat

SEQ ID NO: 7426903 - DNA, 22 bp, Homo sapiens
tacatcatgtaagcagaatcat

SEQ ID NO: 7426904 - DNA, 22 bp, Homo sapiens
tacatcatgtaagcagaatcat

SEQ ID NO: 7426905 - DNA, 22 bp, Homo sapiens
tacatatagacagttactctag

SEQ ID NO: 7426906 - DNA, 22 bp, Homo sapiens
tacatcatggcttcatgctgca

SEQ ID NO: 7426907 - DNA, 22 bp, Homo sapiens
tacatatagacagttactctag

SEQ ID NO: 7426908 - DNA, 22 bp, Homo sapiens
tacatatagacagttactctag

SEQ ID NO: 7426909 - DNA, 22 bp, Homo sapiens
tacatactttttcttgcaagca

SEQ ID NO: 7426910 - DNA, 22 bp, Homo sapiens
tacatagaacatgtttaatgtc

SEQ ID NO: 7426911 - DNA, 22 bp, Homo sapiens
tacatagaatatttcacttaaa

SEQ ID NO: 7426912 - DNA, 22 bp, Homo sapiens
tacatagagggtaatagcatca

SEQ ID NO: 7426913 - DNA, 22 bp, Homo sapiens
tacatagagggtaatagcatca

SEQ ID NO: 7426914 - DNA, 22 bp, Homo sapiens
tacatagagggtaatagcatca

SEQ ID NO: 7426915 - DNA, 22 bp, Homo sapiens
tacatagagggtaatagcatca

SEQ ID NO: 7426916 - DNA, 22 bp, Homo sapiens
tacatagattttgaaactggac

SEQ ID NO: 7426917 - DNA, 21 bp, Homo sapiens
tacatagaggtgatatctgtt

SEQ ID NO: 7426918 - DNA, 22 bp, Homo sapiens
tacatagattttgaaactggac

SEQ ID NO: 7426919 - DNA, 22 bp, Homo sapiens
tacatactccataatgacagca

SEQ ID NO: 7426920 - DNA, 22 bp, Homo sapiens
tacatacattacctcatttagt

SEQ ID NO: 7426921 - DNA, 19 bp, Homo sapiens
tacatacttattctaaaag

SEQ ID NO: 7426922 - DNA, 22 bp, Homo sapiens
tacatactccataatgacagca

SEQ ID NO: 7426923 - DNA, 22 bp, Homo sapiens
tacatacattacctcatttagt

SEQ ID NO: 7426924 - DNA, 22 bp, Homo sapiens
tacatacattacctcatttagt

SEQ ID NO: 7426925 - DNA, 22 bp, Homo sapiens
tacatacattacctcatttagt

SEQ ID NO: 7426926 - DNA, 22 bp, Homo sapiens
tacatacattacctcatttagt

SEQ ID NO: 7426927 - DNA, 22 bp, Homo sapiens
tacatacattacctcatttagt

SEQ ID NO: 7426928 - DNA, 22 bp, Homo sapiens
tacatacattacctcatttagt

SEQ ID NO: 7426929 - DNA, 22 bp, Homo sapiens
tacatacatgtatgtgtgtatt

SEQ ID NO: 7426930 - DNA, 22 bp, Homo sapiens
tacatacatgtatgtgtgtatt

SEQ ID NO: 7426931 - DNA, 22 bp, Homo sapiens
tacatacattacctcatttagt

SEQ ID NO: 7426932 - DNA, 22 bp, Homo sapiens
tacatacattacctcatttagt

SEQ ID NO: 7426933 - DNA, 22 bp, Homo sapiens
tacatacattacctcatttagt

SEQ ID NO: 7426934 - DNA, 22 bp, Homo sapiens
tacatacattacctcatttagt

SEQ ID NO: 7426935 - DNA, 22 bp, Homo sapiens
tacatacatgtatgtgtgtatt

SEQ ID NO: 7426936 - DNA, 22 bp, Homo sapiens
tacatacatgtatgtgtgtatt

SEQ ID NO: 7426937 - DNA, 22 bp, Homo sapiens
tacatacatgtatgtgtgtatt

SEQ ID NO: 7426938 - DNA, 22 bp, Homo sapiens
tacatacatggtggaatggtta

SEQ ID NO: 7426939 - DNA, 22 bp, Homo sapiens
tacatacatggtggaatggtta

SEQ ID NO: 7426940 - DNA, 22 bp, Homo sapiens
tacagtaatctggacatgattt

SEQ ID NO: 7426941 - DNA, 22 bp, Homo sapiens
tacagtaatctggacatgattt

SEQ ID NO: 7426942 - DNA, 22 bp, Homo sapiens
tacagtaatctggacatgattt

SEQ ID NO: 7426943 - DNA, 22 bp, Homo sapiens
tacagtaataaaatgagctaca

SEQ ID NO: 7426944 - DNA, 22 bp, Homo sapiens
tacagtaataaaatgagctaca

SEQ ID NO: 7426945 - DNA, 22 bp, Homo sapiens
tacagtacacaggtaccaagct

SEQ ID NO: 7426946 - DNA, 22 bp, Homo sapiens
tacagtaatgtgtccctgcagg

SEQ ID NO: 7426947 - DNA, 22 bp, Homo sapiens
tacagtaatctggacatgattt

SEQ ID NO: 7426948 - DNA, 22 bp, Homo sapiens
tacagtaatctggacatgattt

SEQ ID NO: 7426949 - DNA, 22 bp, Homo sapiens
tacagtaatctggacatgattt

SEQ ID NO: 7426950 - DNA, 22 bp, Homo sapiens
tacagtaatctggacatgattt

SEQ ID NO: 7426951 - DNA, 21 bp, Homo sapiens
tacagtaagttgggtggtcct

SEQ ID NO: 7426952 - DNA, 21 bp, Homo sapiens
tacagtaagttgggtggtcct

SEQ ID NO: 7426953 - DNA, 22 bp, Homo sapiens
tacagtaagatgaaatagcaat

SEQ ID NO: 7426954 - DNA, 22 bp, Homo sapiens
tacagtaagatgaaatagcaat

SEQ ID NO: 7426955 - DNA, 22 bp, Homo sapiens
tacagtaataaaatgagctaca

SEQ ID NO: 7426956 - DNA, 22 bp, Homo sapiens
tacagtaataaaatgagctaca

SEQ ID NO: 7426957 - DNA, 22 bp, Homo sapiens
tacagtaataaaatgagctaca

SEQ ID NO: 7426958 - DNA, 22 bp, Homo sapiens
tacagtaataaaatgagctaca

SEQ ID NO: 7426959 - DNA, 22 bp, Homo sapiens
tacagtaccagaaatgctaaga

SEQ ID NO: 7426960 - DNA, 22 bp, Homo sapiens
tacagtaccagaaatgctaaga

SEQ ID NO: 7426961 - DNA, 22 bp, Homo sapiens
tacagtaccagaaatgctaaga

SEQ ID NO: 7426962 - DNA, 22 bp, Homo sapiens
tacagtaccctgatgaactaaa

SEQ ID NO: 7426963 - DNA, 22 bp, Homo sapiens
tacagtacagtctagactctgg

SEQ ID NO: 7426964 - DNA, 22 bp, Homo sapiens
tacagtacagtctagactctgg

SEQ ID NO: 7426965 - DNA, 22 bp, Homo sapiens
tacagtacacaggtaccaagct

SEQ ID NO: 7426966 - DNA, 22 bp, Homo sapiens
tacagtacctgccacgttgttg

SEQ ID NO: 7426967 - DNA, 22 bp, Homo sapiens
tacagtagaatcttatagccca

SEQ ID NO: 7426968 - DNA, 22 bp, Homo sapiens
tacagtacctgccacgttgttg

SEQ ID NO: 7426969 - DNA, 22 bp, Homo sapiens
tacagtagaatcttatagccca

SEQ ID NO: 7426970 - DNA, 22 bp, Homo sapiens
tacagtagaatcttatagccca

SEQ ID NO: 7426971 - DNA, 22 bp, Homo sapiens
tacagtagctgaggttctcagg

SEQ ID NO: 7426972 - DNA, 22 bp, Homo sapiens
tacagtagctactcaataacta

SEQ ID NO: 7426973 - DNA, 22 bp, Homo sapiens
tacagtagctgaggttctcagg

SEQ ID NO: 7426974 - DNA, 22 bp, Homo sapiens
tacagtagacaggaccacaggc

SEQ ID NO: 7426975 - DNA, 22 bp, Homo sapiens
tacagtagacaggaccacaggc

SEQ ID NO: 7426976 - DNA, 22 bp, Homo sapiens
tacagtagctactcaataacta

SEQ ID NO: 7426977 - DNA, 22 bp, Homo sapiens
tacagtagctactcaataacta

SEQ ID NO: 7426978 - DNA, 22 bp, Homo sapiens
tacagtagacaatgttagtatg

SEQ ID NO: 7426979 - DNA, 22 bp, Homo sapiens
tacagtagaatttttagtaact

SEQ ID NO: 7426980 - DNA, 22 bp, Homo sapiens
tacagtagacaatgttagtatg

SEQ ID NO: 7426981 - DNA, 22 bp, Homo sapiens
tacagtagacaatgttagtatg

SEQ ID NO: 7426982 - DNA, 22 bp, Homo sapiens
tacagtagacaatgttagtatg

SEQ ID NO: 7426983 - DNA, 22 bp, Homo sapiens
tacagtagaatgcggtgccagt

SEQ ID NO: 7426984 - DNA, 22 bp, Homo sapiens
tacagtagaatgcggtgccagt

SEQ ID NO: 7426985 - DNA, 22 bp, Homo sapiens
tacagtaccctgatgaactaaa

SEQ ID NO: 7426986 - DNA, 22 bp, Homo sapiens
tacagtagaatttttagtaact

SEQ ID NO: 7426987 - DNA, 22 bp, Homo sapiens
tacaggagcacaaaagagttga

SEQ ID NO: 7426988 - DNA, 22 bp, Homo sapiens
tacaggagcacaaaagagttga

SEQ ID NO: 7426989 - DNA, 22 bp, Homo sapiens
tacaggagcatggggaagggat

SEQ ID NO: 7426990 - DNA, 22 bp, Homo sapiens
tacaggagcatggggaagggat

SEQ ID NO: 7426991 - DNA, 22 bp, Homo sapiens
tacaggagctgctctgtgatac

SEQ ID NO: 7426992 - DNA, 22 bp, Homo sapiens
tacaggagctgctctgtgatac

SEQ ID NO: 7426993 - DNA, 22 bp, Homo sapiens
tacagcacggtgcatttactac

SEQ ID NO: 7426994 - DNA, 22 bp, Homo sapiens
tacagcacagcaaagaggacgg

SEQ ID NO: 7426995 - DNA, 22 bp, Homo sapiens
tacagcacattgtgatggcact

SEQ ID NO: 7426996 - DNA, 22 bp, Homo sapiens
tacagcactctggggagcatga

SEQ ID NO: 7426997 - DNA, 22 bp, Homo sapiens
tacagcactctggggagcatga

SEQ ID NO: 7426998 - DNA, 17 bp, Homo sapiens
tacaggagagcaggaac

SEQ ID NO: 7426999 - DNA, 17 bp, Homo sapiens
tacaggagagcaggaac

SEQ ID NO: 7427000 - DNA, 22 bp, Homo sapiens
tacaggcactgaaatgcttatt

SEQ ID NO: 7427001 - DNA, 19 bp, Homo sapiens
tacaggatcctcatacagt

SEQ ID NO: 7427002 - DNA, 22 bp, Homo sapiens
tacaggcactgaaatgcttatt

SEQ ID NO: 7427003 - DNA, 19 bp, Homo sapiens
tacaggcagtttctacaat

SEQ ID NO: 7427004 - DNA, 19 bp, Homo sapiens
tacaggcagtttctacaat

SEQ ID NO: 7427005 - DNA, 22 bp, Homo sapiens
tacaggcactgaaatgcttatt

SEQ ID NO: 7427006 - DNA, 19 bp, Homo sapiens
tacaggcagtttctacaat

SEQ ID NO: 7427007 - DNA, 19 bp, Homo sapiens
tacaggcagtttctacaat

SEQ ID NO: 7427008 - DNA, 19 bp, Homo sapiens
tacaggcagtttctacaat

SEQ ID NO: 7427009 - DNA, 22 bp, Homo sapiens
tacaggaggattatcaaaggat

SEQ ID NO: 7427010 - DNA, 22 bp, Homo sapiens
tacaggaggattatcaaaggat

SEQ ID NO: 7427011 - DNA, 22 bp, Homo sapiens
tacaggaggattatcaaaggat

SEQ ID NO: 7427012 - DNA, 19 bp, Homo sapiens
tacaggaggcctgcaatct

SEQ ID NO: 7427013 - DNA, 19 bp, Homo sapiens
tacaggaggcctgcaatct

SEQ ID NO: 7427014 - DNA, 20 bp, Homo sapiens
tacaggagtgagtgggtggg

SEQ ID NO: 7427015 - DNA, 20 bp, Homo sapiens
tacaggagtgagtgggtggg

SEQ ID NO: 7427016 - DNA, 22 bp, Homo sapiens
tacaggcccatagtccctgctt

SEQ ID NO: 7427017 - DNA, 22 bp, Homo sapiens
tacaggcatgtagcatggtgat

SEQ ID NO: 7427018 - DNA, 22 bp, Homo sapiens
tacaggcatgtagcatggtgat

SEQ ID NO: 7427019 - DNA, 22 bp, Homo sapiens
tacaggcatgtagcatggtgat

SEQ ID NO: 7427020 - DNA, 22 bp, Homo sapiens
tacaggcatgaatgaaatctgt

SEQ ID NO: 7427021 - DNA, 22 bp, Homo sapiens
tacaggcatgtagcatggtgat

SEQ ID NO: 7427022 - DNA, 19 bp, Homo sapiens
tacaggcagtttctacaat

SEQ ID NO: 7427023 - DNA, 22 bp, Homo sapiens
tacaggcatgaatgaaatctgt

SEQ ID NO: 7427024 - DNA, 22 bp, Homo sapiens
tacaggcatgaatgaaatctgt

SEQ ID NO: 7427025 - DNA, 22 bp, Homo sapiens
tacagggaatgggacataaatc

SEQ ID NO: 7427026 - DNA, 22 bp, Homo sapiens
tacaggctgcagggctagaggg

SEQ ID NO: 7427027 - DNA, 22 bp, Homo sapiens
tacaggctgcagggctagaggg

SEQ ID NO: 7427028 - DNA, 22 bp, Homo sapiens
tacaggctagggagagtgactg

SEQ ID NO: 7427029 - DNA, 20 bp, Homo sapiens
tacaggctctgagagatgat

SEQ ID NO: 7427030 - DNA, 22 bp, Homo sapiens
tacaggcccatagtccctgctt

SEQ ID NO: 7427031 - DNA, 22 bp, Homo sapiens
tacaggcccatagtccctgctt

SEQ ID NO: 7427032 - DNA, 22 bp, Homo sapiens
tacaggcccatagtccctgctt

SEQ ID NO: 7427033 - DNA, 22 bp, Homo sapiens
tacaggctagggagagtgactg

SEQ ID NO: 7427034 - DNA, 22 bp, Homo sapiens
tacagtaagatgaaatagcaat

SEQ ID NO: 7427035 - DNA, 22 bp, Homo sapiens
tacagtaagatgaaatagcaat

SEQ ID NO: 7427036 - DNA, 22 bp, Homo sapiens
tacagtaagatgaaatagcaat

SEQ ID NO: 7427037 - DNA, 22 bp, Homo sapiens
tacagtaagatgaaatagcaat

SEQ ID NO: 7427038 - DNA, 22 bp, Homo sapiens
tacagtaactggaattcttctt

SEQ ID NO: 7427039 - DNA, 22 bp, Homo sapiens
tacagtaagatgaaatagcaat

SEQ ID NO: 7427040 - DNA, 22 bp, Homo sapiens
tacagtaagatgaaatagcaat

SEQ ID NO: 7427041 - DNA, 22 bp, Homo sapiens
tacagtaagatgaaatagcaat

SEQ ID NO: 7427042 - DNA, 22 bp, Homo sapiens
tacagggaccaataataactat

SEQ ID NO: 7427043 - DNA, 22 bp, Homo sapiens
tacagggactcccgcagagata

SEQ ID NO: 7427044 - DNA, 22 bp, Homo sapiens
tacagggaccaataataactat

SEQ ID NO: 7427045 - DNA, 22 bp, Homo sapiens
tacagggacatggaacaggctc

SEQ ID NO: 7427046 - DNA, 22 bp, Homo sapiens
tacagggacatggaacaggctc

SEQ ID NO: 7427047 - DNA, 22 bp, Homo sapiens
tacagtaactggaattcttctt

SEQ ID NO: 7427048 - DNA, 22 bp, Homo sapiens
tacagtaaccttatttgtcatt

SEQ ID NO: 7427049 - DNA, 22 bp, Homo sapiens
tacagggactcccgcagagata

SEQ ID NO: 7427050 - DNA, 22 bp, Homo sapiens
tacagggactcccgcagagata

SEQ ID NO: 7427051 - DNA, 22 bp, Homo sapiens
tacagggactcccgcagagata

SEQ ID NO: 7427052 - DNA, 22 bp, Homo sapiens
tataatttggggaaagtggtgt

SEQ ID NO: 7427053 - DNA, 22 bp, Homo sapiens
tataatttatcatgtcacagtt

SEQ ID NO: 7427054 - DNA, 22 bp, Homo sapiens
tataatttggggaaagtggtgt

SEQ ID NO: 7427055 - DNA, 22 bp, Homo sapiens
tataatttggggaaagtggtgt

SEQ ID NO: 7427056 - DNA, 22 bp, Homo sapiens
tataatttggggaaagtggtgt

SEQ ID NO: 7427057 - DNA, 22 bp, Homo sapiens
tataatttggggaaagtggtgt

SEQ ID NO: 7427058 - DNA, 22 bp, Homo sapiens
tataattttaagtggtaaatta

SEQ ID NO: 7427059 - DNA, 22 bp, Homo sapiens
tataatttggggaaagtggtgt

SEQ ID NO: 7427060 - DNA, 22 bp, Homo sapiens
tataatttggggaaagtggtgt

SEQ ID NO: 7427061 - DNA, 22 bp, Homo sapiens
tataattttaagtggtaaatta

SEQ ID NO: 7427062 - DNA, 22 bp, Homo sapiens
tataattttaagtggtaaatta

SEQ ID NO: 7427063 - DNA, 22 bp, Homo sapiens
tataattttaagtggtaaatta

SEQ ID NO: 7427064 - DNA, 22 bp, Homo sapiens
tatacaagtaatgctgaatgat

SEQ ID NO: 7427065 - DNA, 22 bp, Homo sapiens
tatacaagtaatgctgaatgat

SEQ ID NO: 7427066 - DNA, 22 bp, Homo sapiens
tatacaagtaatgctgaatgat

SEQ ID NO: 7427067 - DNA, 22 bp, Homo sapiens
tatacaagtgagaagaagagtt

SEQ ID NO: 7427068 - DNA, 22 bp, Homo sapiens
tatacaagtaatgctgaatgat

SEQ ID NO: 7427069 - DNA, 22 bp, Homo sapiens
tatacaagtgagaagaagagtt

SEQ ID NO: 7427070 - DNA, 22 bp, Homo sapiens
tatacaatgagtacattctggg

SEQ ID NO: 7427071 - DNA, 22 bp, Homo sapiens
tatacaatgagtacattctggg

SEQ ID NO: 7427072 - DNA, 22 bp, Homo sapiens
tatacaatgagtacattctggg

SEQ ID NO: 7427073 - DNA, 22 bp, Homo sapiens
tatacaagtgagaagaagagtt

SEQ ID NO: 7427074 - DNA, 22 bp, Homo sapiens
tatacaatgagtacattctggg

SEQ ID NO: 7427075 - DNA, 22 bp, Homo sapiens
tatacaatgagtacattctggg

SEQ ID NO: 7427076 - DNA, 22 bp, Homo sapiens
tataattttagaagagatggaa

SEQ ID NO: 7427077 - DNA, 22 bp, Homo sapiens
tataatttttctgtggccagtt

SEQ ID NO: 7427078 - DNA, 22 bp, Homo sapiens
tatacaagaggtgagatgagca

SEQ ID NO: 7427079 - DNA, 22 bp, Homo sapiens
tatacaagaggtgagatgagca

SEQ ID NO: 7427080 - DNA, 22 bp, Homo sapiens
tatacaagaggtgagatgagca

SEQ ID NO: 7427081 - DNA, 22 bp, Homo sapiens
tatacaatgagtacattctggg

SEQ ID NO: 7427082 - DNA, 22 bp, Homo sapiens
tatacaatgagtacattctggg

SEQ ID NO: 7427083 - DNA, 22 bp, Homo sapiens
tatacaatggctgaatcatcca

SEQ ID NO: 7427084 - DNA, 22 bp, Homo sapiens
tatacaatgagtacattctggg

SEQ ID NO: 7427085 - DNA, 22 bp, Homo sapiens
tatacaatggctgaatcatcca

SEQ ID NO: 7427086 - DNA, 22 bp, Homo sapiens
tatacaatggctgaatcatcca

SEQ ID NO: 7427087 - DNA, 22 bp, Homo sapiens
tatacaatggctgaatcatcca

SEQ ID NO: 7427088 - DNA, 22 bp, Homo sapiens
tatacaatggctgaatcatcca

SEQ ID NO: 7427089 - DNA, 22 bp, Homo sapiens
tatacaatggctgaatcatcca

SEQ ID NO: 7427090 - DNA, 22 bp, Homo sapiens
tatacaatggctgaatcatcca

SEQ ID NO: 7427091 - DNA, 22 bp, Homo sapiens
tatacaatggctgaatcatcca

SEQ ID NO: 7427092 - DNA, 22 bp, Homo sapiens
tatacaatggctgaatcatcca

SEQ ID NO: 7427093 - DNA, 22 bp, Homo sapiens
tatacaatggctgaatcatcca

SEQ ID NO: 7427094 - DNA, 22 bp, Homo sapiens
tatacacaaacaaggggttaag

SEQ ID NO: 7427095 - DNA, 22 bp, Homo sapiens
tatacaatggctgaatcatcca

SEQ ID NO: 7427096 - DNA, 22 bp, Homo sapiens
tatacacaaggtgtgcatttgt

SEQ ID NO: 7427097 - DNA, 22 bp, Homo sapiens
tatacacaaggtgtgcatttgt

SEQ ID NO: 7427098 - DNA, 22 bp, Homo sapiens
tatacacaaggtgtgcatttgt

SEQ ID NO: 7427099 - DNA, 22 bp, Homo sapiens
tatacacaaggtgtgcatttgt

SEQ ID NO: 7427100 - DNA, 22 bp, Homo sapiens
tatacacaaggtgtgcatttgt

SEQ ID NO: 7427101 - DNA, 22 bp, Homo sapiens
tatacacacatgctccggcctt

SEQ ID NO: 7427102 - DNA, 22 bp, Homo sapiens
tatacacacatgctccggcctt

SEQ ID NO: 7427103 - DNA, 22 bp, Homo sapiens
tatacacaaggtgtgcatttgt

SEQ ID NO: 7427104 - DNA, 22 bp, Homo sapiens
tatacacacctccaaagcagga

SEQ ID NO: 7427105 - DNA, 22 bp, Homo sapiens
tatacacacctccaaagcagga

SEQ ID NO: 7427106 - DNA, 22 bp, Homo sapiens
tatacacacatgctccggcctt

SEQ ID NO: 7427107 - DNA, 22 bp, Homo sapiens
tatacacacctccaaagcagga

SEQ ID NO: 7427108 - DNA, 22 bp, Homo sapiens
tatacacacctccaaagcagga

SEQ ID NO: 7427109 - DNA, 22 bp, Homo sapiens
tatacacacctccaaagcagga

SEQ ID NO: 7427110 - DNA, 22 bp, Homo sapiens
tatacacacctccaaagcagga

SEQ ID NO: 7427111 - DNA, 22 bp, Homo sapiens
tatacacacctccaaagcagga

SEQ ID NO: 7427112 - DNA, 23 bp, Homo sapiens
tatacacatgtggcagtatagtg

SEQ ID NO: 7427113 - DNA, 23 bp, Homo sapiens
tatacacatgtggcagtatagtg

SEQ ID NO: 7427114 - DNA, 23 bp, Homo sapiens
tatacacatgtggcagtatagtg

SEQ ID NO: 7427115 - DNA, 23 bp, Homo sapiens
tatacacatgtggcagtatagtg

SEQ ID NO: 7427116 - DNA, 23 bp, Homo sapiens
tatacacatgtggcagtatagtg

SEQ ID NO: 7427117 - DNA, 22 bp, Homo sapiens
tatacacatcctccaaagatag

SEQ ID NO: 7427118 - DNA, 22 bp, Homo sapiens
tatacacatcctccaaagatag

SEQ ID NO: 7427119 - DNA, 22 bp, Homo sapiens
tatacacatcctccaaagatag

SEQ ID NO: 7427120 - DNA, 22 bp, Homo sapiens
tatacacatcctccaaagatag

SEQ ID NO: 7427121 - DNA, 22 bp, Homo sapiens
tatacacatcctccaaagatag

SEQ ID NO: 7427122 - DNA, 22 bp, Homo sapiens
tatacacatcctccaaagatag

SEQ ID NO: 7427123 - DNA, 22 bp, Homo sapiens
tatacacatcctccaaagatag

SEQ ID NO: 7427124 - DNA, 22 bp, Homo sapiens
tatacacatatcttctaggcct

SEQ ID NO: 7427125 - DNA, 22 bp, Homo sapiens
tatacacatcctccaaagatag

SEQ ID NO: 7427126 - DNA, 22 bp, Homo sapiens
tatacacatcctccaaagatag

SEQ ID NO: 7427127 - DNA, 22 bp, Homo sapiens
tatacacatcctccaaagatag

SEQ ID NO: 7427128 - DNA, 22 bp, Homo sapiens
tatacacatcctccaaagatag

SEQ ID NO: 7427129 - DNA, 22 bp, Homo sapiens
tatacacatatcttctaggcct

SEQ ID NO: 7427130 - DNA, 22 bp, Homo sapiens
tatacacatatcttctaggcct

SEQ ID NO: 7427131 - DNA, 22 bp, Homo sapiens
tatacacatatcttctaggcct

SEQ ID NO: 7427132 - DNA, 22 bp, Homo sapiens
tatacacatatacgtttgtgtg

SEQ ID NO: 7427133 - DNA, 17 bp, Homo sapiens
tatacacagacagactg

SEQ ID NO: 7427134 - DNA, 17 bp, Homo sapiens
tatacacagacagactg

SEQ ID NO: 7427135 - DNA, 22 bp, Homo sapiens
tatacacacctccaaagcagga

SEQ ID NO: 7427136 - DNA, 22 bp, Homo sapiens
tatacacacctccaaagcagga

SEQ ID NO: 7427137 - DNA, 22 bp, Homo sapiens
tatacacacctccaaagcagga

SEQ ID NO: 7427138 - DNA, 17 bp, Homo sapiens
tatacacagacagactg

SEQ ID NO: 7427139 - DNA, 17 bp, Homo sapiens
tatacacagacagactg

SEQ ID NO: 7427140 - DNA, 17 bp, Homo sapiens
tatacacagacagactg

SEQ ID NO: 7427141 - DNA, 22 bp, Homo sapiens
tatacacaggaatctgtgaaaa

SEQ ID NO: 7427142 - DNA, 22 bp, Homo sapiens
tatacacaggaatctgtgaaaa

SEQ ID NO: 7427143 - DNA, 22 bp, Homo sapiens
tatacacaggaatctgtgaaaa

SEQ ID NO: 7427144 - DNA, 22 bp, Homo sapiens
tatacacatatacgtttgtgtg

SEQ ID NO: 7427145 - DNA, 22 bp, Homo sapiens
tatacacatatcttctaggcct

SEQ ID NO: 7427146 - DNA, 22 bp, Homo sapiens
tatacacatatcttctaggcct

SEQ ID NO: 7427147 - DNA, 22 bp, Homo sapiens
tatacacatttttacctatagt

SEQ ID NO: 7427148 - DNA, 22 bp, Homo sapiens
tatacacatttttacctatagt

SEQ ID NO: 7427149 - DNA, 22 bp, Homo sapiens
tatacacatttttacctatagt

SEQ ID NO: 7427150 - DNA, 22 bp, Homo sapiens
tatacacattacagtttcagga

SEQ ID NO: 7427151 - DNA, 22 bp, Homo sapiens
tatacacatttttacctatagt

SEQ ID NO: 7427152 - DNA, 22 bp, Homo sapiens
tatacacatttttacctatagt

SEQ ID NO: 7427153 - DNA, 22 bp, Homo sapiens
tatacacatttttacctatagt

SEQ ID NO: 7427154 - DNA, 22 bp, Homo sapiens
tatacacatttttacctatagt

SEQ ID NO: 7427155 - DNA, 22 bp, Homo sapiens
tatacacatttttacctatagt

SEQ ID NO: 7427156 - DNA, 22 bp, Homo sapiens
tatacacatttttacctatagt

SEQ ID NO: 7427157 - DNA, 22 bp, Homo sapiens
tatacacatttttacctatagt

SEQ ID NO: 7427158 - DNA, 22 bp, Homo sapiens
tatacacatttttacctatagt

SEQ ID NO: 7427159 - DNA, 22 bp, Homo sapiens
tatacagaacattaagaactgt

SEQ ID NO: 7427160 - DNA, 22 bp, Homo sapiens
tatacagaacattaagaactgt

SEQ ID NO: 7427161 - DNA, 22 bp, Homo sapiens
tatacagaacattaagaactgt

SEQ ID NO: 7427162 - DNA, 22 bp, Homo sapiens
tatacagaacattaagaactgt

SEQ ID NO: 7427163 - DNA, 22 bp, Homo sapiens
tatacagaaagaattcaagtct

SEQ ID NO: 7427164 - DNA, 22 bp, Homo sapiens
tatacagaaagaattcaagtct

SEQ ID NO: 7427165 - DNA, 22 bp, Homo sapiens
tatacagaaagaattcaagtct

SEQ ID NO: 7427166 - DNA, 22 bp, Homo sapiens
tatacagaaagaattcaagtct

SEQ ID NO: 7427167 - DNA, 22 bp, Homo sapiens
tatacactgatataaggagtaa

SEQ ID NO: 7427168 - DNA, 22 bp, Homo sapiens
tatacactgttgttgggagtct

SEQ ID NO: 7427169 - DNA, 22 bp, Homo sapiens
tatacacattacagtttcagga

SEQ ID NO: 7427170 - DNA, 22 bp, Homo sapiens
tatacacattacagtttcagga

SEQ ID NO: 7427171 - DNA, 22 bp, Homo sapiens
tatacacattacagtttcagga

SEQ ID NO: 7427172 - DNA, 22 bp, Homo sapiens
tatacacattacagtttcagga

SEQ ID NO: 7427173 - DNA, 22 bp, Homo sapiens
tatacacatgtgtgtattcata

SEQ ID NO: 7427174 - DNA, 22 bp, Homo sapiens
tatacacatgtgtgtattcata

SEQ ID NO: 7427175 - DNA, 22 bp, Homo sapiens
tatacacatgtgtgtattcata

SEQ ID NO: 7427176 - DNA, 22 bp, Homo sapiens
tatacacatgtgtgtattcata

SEQ ID NO: 7427177 - DNA, 23 bp, Homo sapiens
tatacacatgtggcagtatagtg

SEQ ID NO: 7427178 - DNA, 23 bp, Homo sapiens
tatacacatgtggcagtatagtg

SEQ ID NO: 7427179 - DNA, 23 bp, Homo sapiens
tatacacatgtggcagtatagtg

SEQ ID NO: 7427180 - DNA, 23 bp, Homo sapiens
tatacacatgtggcagtatagtg

SEQ ID NO: 7427181 - DNA, 23 bp, Homo sapiens
tatacacatgtggcagtatagtg

SEQ ID NO: 7427182 - DNA, 22 bp, Homo sapiens
tatacacatgtgtgtattcata

SEQ ID NO: 7427183 - DNA, 22 bp, Homo sapiens
tatacacatgtgtgtattcata

SEQ ID NO: 7427184 - DNA, 22 bp, Homo sapiens
tatacacatgtgtgtattcata

SEQ ID NO: 7427185 - DNA, 22 bp, Homo sapiens
tatacacatgtgtgtattcata

SEQ ID NO: 7427186 - DNA, 22 bp, Homo sapiens
tatacacatgtgtgtattcata

SEQ ID NO: 7427187 - DNA, 22 bp, Homo sapiens
tataaattattaggctgctaaa

SEQ ID NO: 7427188 - DNA, 22 bp, Homo sapiens
tataaattattaggctgctaaa

SEQ ID NO: 7427189 - DNA, 22 bp, Homo sapiens
tataaattattaggctgctaaa

SEQ ID NO: 7427190 - DNA, 22 bp, Homo sapiens
tataaattattaggctgctaaa

SEQ ID NO: 7427191 - DNA, 22 bp, Homo sapiens
tataaattattaggctgctaaa

SEQ ID NO: 7427192 - DNA, 20 bp, Homo sapiens
tataaattcagagctttggt

SEQ ID NO: 7427193 - DNA, 20 bp, Homo sapiens
tataaattcagagctttggt

SEQ ID NO: 7427194 - DNA, 20 bp, Homo sapiens
tataaattcagagctttggt

SEQ ID NO: 7427195 - DNA, 22 bp, Homo sapiens
tataaattattaggctgctaaa

SEQ ID NO: 7427196 - DNA, 20 bp, Homo sapiens
tataaattcagagctttggt

SEQ ID NO: 7427197 - DNA, 20 bp, Homo sapiens
tataaattcagagctttggt

SEQ ID NO: 7427198 - DNA, 20 bp, Homo sapiens
tataaattcagagctttggt

SEQ ID NO: 7427199 - DNA, 20 bp, Homo sapiens
tataaattcagagctttggt

SEQ ID NO: 7427200 - DNA, 20 bp, Homo sapiens
tataaattcagagctttggt

SEQ ID NO: 7427201 - DNA, 20 bp, Homo sapiens
tataaattcagagctttggt

SEQ ID NO: 7427202 - DNA, 20 bp, Homo sapiens
tataaattcagagctttggt

SEQ ID NO: 7427203 - DNA, 20 bp, Homo sapiens
tataaattcagagctttggt

SEQ ID NO: 7427204 - DNA, 20 bp, Homo sapiens
tataaattcagagctttggt

SEQ ID NO: 7427205 - DNA, 20 bp, Homo sapiens
tataaattcagagctttggt

SEQ ID NO: 7427206 - DNA, 22 bp, Homo sapiens
tataacaccatgttctacagat

SEQ ID NO: 7427207 - DNA, 21 bp, Homo sapiens
tataacacacttcagcttctc

SEQ ID NO: 7427208 - DNA, 21 bp, Homo sapiens
tataacacacttcagcttctc

SEQ ID NO: 7427209 - DNA, 22 bp, Homo sapiens
tataatttatcatgtcacagtt

SEQ ID NO: 7427210 - DNA, 22 bp, Homo sapiens
tataatttatcatgtcacagtt

SEQ ID NO: 7427211 - DNA, 22 bp, Homo sapiens
tataatttatcatgtcacagtt

SEQ ID NO: 7427212 - DNA, 22 bp, Homo sapiens
tataactacttgaagagttcag

SEQ ID NO: 7427213 - DNA, 22 bp, Homo sapiens
tataactgagaagatacatagt

SEQ ID NO: 7427214 - DNA, 22 bp, Homo sapiens
tataacctggattctggcacta

SEQ ID NO: 7427215 - DNA, 18 bp, Homo sapiens
tataacctctgttactca

SEQ ID NO: 7427216 - DNA, 22 bp, Homo sapiens
tataacctggattctggcacta

SEQ ID NO: 7427217 - DNA, 22 bp, Homo sapiens
tataacaggaagtattcaaaca

SEQ ID NO: 7427218 - DNA, 22 bp, Homo sapiens
tataacaggaagtattcaaaca

SEQ ID NO: 7427219 - DNA, 20 bp, Homo sapiens
tataacagtgttgggtgtgt

SEQ ID NO: 7427220 - DNA, 22 bp, Homo sapiens
tataacagtttaggtggtgtca

SEQ ID NO: 7427221 - DNA, 22 bp, Homo sapiens
tataacactcagaaagaatcat

SEQ ID NO: 7427222 - DNA, 22 bp, Homo sapiens
tataacaggaagtattcaaaca

SEQ ID NO: 7427223 - DNA, 22 bp, Homo sapiens
tataacactcagaaagaatcat

SEQ ID NO: 7427224 - DNA, 22 bp, Homo sapiens
tataacactcagaaagaatcat

SEQ ID NO: 7427225 - DNA, 22 bp, Homo sapiens
tataaatgcacttttgaaatat

SEQ ID NO: 7427226 - DNA, 22 bp, Homo sapiens
tataaatgcacttttgaaatat

SEQ ID NO: 7427227 - DNA, 22 bp, Homo sapiens
tataaatgcacttttgaaatat

SEQ ID NO: 7427228 - DNA, 22 bp, Homo sapiens
tataaatgcacttttgaaatat

SEQ ID NO: 7427229 - DNA, 22 bp, Homo sapiens
tataaatctttgttcctagaat

SEQ ID NO: 7427230 - DNA, 22 bp, Homo sapiens
tataaatctttgttcctagaat

SEQ ID NO: 7427231 - DNA, 22 bp, Homo sapiens
tataaatgcacttttgaaatat

SEQ ID NO: 7427232 - DNA, 22 bp, Homo sapiens
tataaatgcacttttgaaatat

SEQ ID NO: 7427233 - DNA, 22 bp, Homo sapiens
tataaatgcacttttgaaatat

SEQ ID NO: 7427234 - DNA, 22 bp, Homo sapiens
tataaatgcacttttgaaatat

SEQ ID NO: 7427235 - DNA, 22 bp, Homo sapiens
tataaatgcacttttgaaatat

SEQ ID NO: 7427236 - DNA, 22 bp, Homo sapiens
tataaagtttcgaaagatgtat

SEQ ID NO: 7427237 - DNA, 22 bp, Homo sapiens
tataaagtttcgaaagatgtat

SEQ ID NO: 7427238 - DNA, 22 bp, Homo sapiens
tataaagtttcgaaagatgtat

SEQ ID NO: 7427239 - DNA, 22 bp, Homo sapiens
tataaagtttcgaaagatgtat

SEQ ID NO: 7427240 - DNA, 22 bp, Homo sapiens
tataaagtttcgaaagatgtat

SEQ ID NO: 7427241 - DNA, 22 bp, Homo sapiens
tataaagtttcgaaagatgtat

SEQ ID NO: 7427242 - DNA, 22 bp, Homo sapiens
tataaagtttcgaaagatgtat

SEQ ID NO: 7427243 - DNA, 22 bp, Homo sapiens
tataaagtttcgaaagatgtat

SEQ ID NO: 7427244 - DNA, 22 bp, Homo sapiens
taggtgtcttgtgtatggtaca

SEQ ID NO: 7427245 - DNA, 22 bp, Homo sapiens
taggtgtctttctgtccttgtt

SEQ ID NO: 7427246 - DNA, 22 bp, Homo sapiens
tataaatgcacttttgaaatat

SEQ ID NO: 7427247 - DNA, 22 bp, Homo sapiens
tataaatgcacttttgaaatat

SEQ ID NO: 7427248 - DNA, 22 bp, Homo sapiens
tataaatgcacttttgaaatat

SEQ ID NO: 7427249 - DNA, 22 bp, Homo sapiens
tataaatgccaggactttagat

SEQ ID NO: 7427250 - DNA, 22 bp, Homo sapiens
tataaatgccaggactttagat

SEQ ID NO: 7427251 - DNA, 22 bp, Homo sapiens
tataaatgccaggactttagat

SEQ ID NO: 7427252 - DNA, 22 bp, Homo sapiens
tataaatgccaggactttagat

SEQ ID NO: 7427253 - DNA, 22 bp, Homo sapiens
tataaattattaggctgctaaa

SEQ ID NO: 7427254 - DNA, 22 bp, Homo sapiens
tataaattattaggctgctaaa

SEQ ID NO: 7427255 - DNA, 22 bp, Homo sapiens
tataaattaatgtgcccatgag

SEQ ID NO: 7427256 - DNA, 22 bp, Homo sapiens
tataaattaatgtgcccatgag

SEQ ID NO: 7427257 - DNA, 22 bp, Homo sapiens
tataaattattaggctgctaaa

SEQ ID NO: 7427258 - DNA, 22 bp, Homo sapiens
tataaattattaggctgctaaa

SEQ ID NO: 7427259 - DNA, 22 bp, Homo sapiens
tataaattattaggctgctaaa

SEQ ID NO: 7427260 - DNA, 22 bp, Homo sapiens
tataaattattaggctgctaaa

SEQ ID NO: 7427261 - DNA, 22 bp, Homo sapiens
tataaattaatgtgcccatgag

SEQ ID NO: 7427262 - DNA, 22 bp, Homo sapiens
tataaattaatgtgcccatgag

SEQ ID NO: 7427263 - DNA, 22 bp, Homo sapiens
tataaattaatgtgcccatgag

SEQ ID NO: 7427264 - DNA, 22 bp, Homo sapiens
tataaatgccaggactttagat

SEQ ID NO: 7427265 - DNA, 22 bp, Homo sapiens
tataaattaatgtgcccatgag

SEQ ID NO: 7427266 - DNA, 22 bp, Homo sapiens
tataaattaatgtgcccatgag

SEQ ID NO: 7427267 - DNA, 22 bp, Homo sapiens
tataaattaatgtgcccatgag

SEQ ID NO: 7427268 - DNA, 22 bp, Homo sapiens
taggggtgtttcgagagaggtt

SEQ ID NO: 7427269 - DNA, 22 bp, Homo sapiens
taggggtgtttcgagagaggtt

SEQ ID NO: 7427270 - DNA, 22 bp, Homo sapiens
taggggtgtttcgagagaggtt

SEQ ID NO: 7427271 - DNA, 21 bp, Homo sapiens
taggtatttctatcatgtctc

SEQ ID NO: 7427272 - DNA, 21 bp, Homo sapiens
taggtatttctatcatgtctc

SEQ ID NO: 7427273 - DNA, 21 bp, Homo sapiens
taggtatttctatcatgtctc

SEQ ID NO: 7427274 - DNA, 22 bp, Homo sapiens
taggggtgggatccaggaatta

SEQ ID NO: 7427275 - DNA, 22 bp, Homo sapiens
taggggtgggatccaggaatta

SEQ ID NO: 7427276 - DNA, 22 bp, Homo sapiens
taggggtgggatccaggaatta

SEQ ID NO: 7427277 - DNA, 22 bp, Homo sapiens
taggggtggagctaagagtccc

SEQ ID NO: 7427278 - DNA, 22 bp, Homo sapiens
taggggtgaggccaggcatcag

SEQ ID NO: 7427279 - DNA, 22 bp, Homo sapiens
taggggtgaggccaggcatcag

SEQ ID NO: 7427280 - DNA, 22 bp, Homo sapiens
taggggtgaggccaggcatcag

SEQ ID NO: 7427281 - DNA, 22 bp, Homo sapiens
taggggtgaggccaggcatcag

SEQ ID NO: 7427282 - DNA, 22 bp, Homo sapiens
taggtctctcttcttgatggga

SEQ ID NO: 7427283 - DNA, 22 bp, Homo sapiens
taggtctcctggcctagagatt

SEQ ID NO: 7427284 - DNA, 22 bp, Homo sapiens
taggtctctcttcttgatggga

SEQ ID NO: 7427285 - DNA, 22 bp, Homo sapiens
taggtctgatttccattcagtc

SEQ ID NO: 7427286 - DNA, 22 bp, Homo sapiens
taggtccctctttagctggttc

SEQ ID NO: 7427287 - DNA, 22 bp, Homo sapiens
taggtccctctttagctggttc

SEQ ID NO: 7427288 - DNA, 22 bp, Homo sapiens
taggtcccttctgtcctggtct

SEQ ID NO: 7427289 - DNA, 22 bp, Homo sapiens
taggtcctcatggggcagagat

SEQ ID NO: 7427290 - DNA, 22 bp, Homo sapiens
taggtcccagcatcttctgagc

SEQ ID NO: 7427291 - DNA, 22 bp, Homo sapiens
taggtcccagcatcttctgagc

SEQ ID NO: 7427292 - DNA, 20 bp, Homo sapiens
taggtccaatgctcgtcttc

SEQ ID NO: 7427293 - DNA, 22 bp, Homo sapiens
taggtccacaagatcaatgcag

SEQ ID NO: 7427294 - DNA, 22 bp, Homo sapiens
taggtccacagatttggtttct

SEQ ID NO: 7427295 - DNA, 22 bp, Homo sapiens
taggtccagcacggtgtagctt

SEQ ID NO: 7427296 - DNA, 22 bp, Homo sapiens
taggtctgtaaatgagagagac

SEQ ID NO: 7427297 - DNA, 22 bp, Homo sapiens
taggtctgtaaatgagagagac

SEQ ID NO: 7427298 - DNA, 22 bp, Homo sapiens
taggtgagtttggggaagatag

SEQ ID NO: 7427299 - DNA, 22 bp, Homo sapiens
taggtgaggttacaagagttca

SEQ ID NO: 7427300 - DNA, 22 bp, Homo sapiens
taggtgagggagcattgtgaga

SEQ ID NO: 7427301 - DNA, 20 bp, Homo sapiens
taggtgagggcagatagagg

SEQ ID NO: 7427302 - DNA, 22 bp, Homo sapiens
taggtgagtttggggaagatag

SEQ ID NO: 7427303 - DNA, 22 bp, Homo sapiens
taggtgctggataaagaatggt

SEQ ID NO: 7427304 - DNA, 22 bp, Homo sapiens
taggtgcctcggagaaaggacc

SEQ ID NO: 7427305 - DNA, 22 bp, Homo sapiens
taggtgggtgacttccatgggg

SEQ ID NO: 7427306 - DNA, 22 bp, Homo sapiens
taggtggttgtctgctttccta

SEQ ID NO: 7427307 - DNA, 22 bp, Homo sapiens
taggtgtctgctcttatttaac

SEQ ID NO: 7427308 - DNA, 22 bp, Homo sapiens
taggtgtctgctcttatttaac

SEQ ID NO: 7427309 - DNA, 22 bp, Homo sapiens
taggtgtcaggcctcctccagc

SEQ ID NO: 7427310 - DNA, 22 bp, Homo sapiens
tatagcactgcaatatttccct

SEQ ID NO: 7427311 - DNA, 22 bp, Homo sapiens
tatagcagcatgatttatagtc

SEQ ID NO: 7427312 - DNA, 22 bp, Homo sapiens
tatagcagtataacatgtttac

SEQ ID NO: 7427313 - DNA, 22 bp, Homo sapiens
tatagcactgcaatatttccct

SEQ ID NO: 7427314 - DNA, 21 bp, Homo sapiens
tatagcagcatgatttataat

SEQ ID NO: 7427315 - DNA, 22 bp, Homo sapiens
tatagcacacagtttataaaag

SEQ ID NO: 7427316 - DNA, 22 bp, Homo sapiens
tatagcaattcagaatacatgt

SEQ ID NO: 7427317 - DNA, 22 bp, Homo sapiens
tatagcaattcagaatacatgt

SEQ ID NO: 7427318 - DNA, 22 bp, Homo sapiens
tatagcaattcagaatacatgt

SEQ ID NO: 7427319 - DNA, 22 bp, Homo sapiens
tatagcttcaaatgctatagct

SEQ ID NO: 7427320 - DNA, 22 bp, Homo sapiens
tataggaaacatacgtgactag

SEQ ID NO: 7427321 - DNA, 22 bp, Homo sapiens
tataggaaaggagtggtcacaa

SEQ ID NO: 7427322 - DNA, 22 bp, Homo sapiens
tatagctttgctgagaaaaaga

SEQ ID NO: 7427323 - DNA, 22 bp, Homo sapiens
tataggaaacatacgtgactag

SEQ ID NO: 7427324 - DNA, 22 bp, Homo sapiens
tataggaatgacgtcatttcct

SEQ ID NO: 7427325 - DNA, 22 bp, Homo sapiens
tataggaagtgtagtgcttgga

SEQ ID NO: 7427326 - DNA, 19 bp, Homo sapiens
tataggaagtgtggttaag

SEQ ID NO: 7427327 - DNA, 22 bp, Homo sapiens
tataggaataaagtggggtata

SEQ ID NO: 7427328 - DNA, 21 bp, Homo sapiens
tataggaatcagtcacatctg

SEQ ID NO: 7427329 - DNA, 22 bp, Homo sapiens
tataggaagtaattgttgcctg

SEQ ID NO: 7427330 - DNA, 22 bp, Homo sapiens
tataggaaggcagattttagct

SEQ ID NO: 7427331 - DNA, 22 bp, Homo sapiens
tataggaaggcagattttagct

SEQ ID NO: 7427332 - DNA, 22 bp, Homo sapiens
tataggaagtattcaaagactg

SEQ ID NO: 7427333 - DNA, 22 bp, Homo sapiens
tataggaaataggtcttctgtg

SEQ ID NO: 7427334 - DNA, 22 bp, Homo sapiens
tataggaaaggagtggtcacaa

SEQ ID NO: 7427335 - DNA, 22 bp, Homo sapiens
tataggaaataggtcttctgtg

SEQ ID NO: 7427336 - DNA, 22 bp, Homo sapiens
tataggaaatttatctcctggg

SEQ ID NO: 7427337 - DNA, 22 bp, Homo sapiens
tataggaaataggtcttctgtg

SEQ ID NO: 7427338 - DNA, 22 bp, Homo sapiens
tataggaaggcagattttagct

SEQ ID NO: 7427339 - DNA, 22 bp, Homo sapiens
tataggaacagctagcacagaa

SEQ ID NO: 7427340 - DNA, 22 bp, Homo sapiens
tataggaaatttatctcctggg

SEQ ID NO: 7427341 - DNA, 22 bp, Homo sapiens
tataggaaatttatctcctggg

SEQ ID NO: 7427342 - DNA, 22 bp, Homo sapiens
tatagtgtctctagatcaaaga

SEQ ID NO: 7427343 - DNA, 21 bp, Homo sapiens
tatagtgtggatatgctgatg

SEQ ID NO: 7427344 - DNA, 21 bp, Homo sapiens
tatagtgtggatatgctgatg

SEQ ID NO: 7427345 - DNA, 21 bp, Homo sapiens
tatagtcacttgagcattatc

SEQ ID NO: 7427346 - DNA, 22 bp, Homo sapiens
tatagtagagagagaatctttt

SEQ ID NO: 7427347 - DNA, 22 bp, Homo sapiens
tatagtatacttaaagtctatt

SEQ ID NO: 7427348 - DNA, 22 bp, Homo sapiens
tatagtatacttaaagtctatt

SEQ ID NO: 7427349 - DNA, 22 bp, Homo sapiens
tatagtacatggaatcttcata

SEQ ID NO: 7427350 - DNA, 22 bp, Homo sapiens
tatagtacatggaatcttcata

SEQ ID NO: 7427351 - DNA, 22 bp, Homo sapiens
tatagtacatggaatcttcata

SEQ ID NO: 7427352 - DNA, 22 bp, Homo sapiens
tatatatgagcatgtgaggaca

SEQ ID NO: 7427353 - DNA, 22 bp, Homo sapiens
tatatatgagcatgtgaggaca

SEQ ID NO: 7427354 - DNA, 22 bp, Homo sapiens
tatatatgggggaagctggatg

SEQ ID NO: 7427355 - DNA, 22 bp, Homo sapiens
tatagtttcatgagctttttaa

SEQ ID NO: 7427356 - DNA, 22 bp, Homo sapiens
tatagttagtttcataatcatg

SEQ ID NO: 7427357 - DNA, 22 bp, Homo sapiens
tatagttagtttcataatcatg

SEQ ID NO: 7427358 - DNA, 22 bp, Homo sapiens
tatagttagtttcataatcatg

SEQ ID NO: 7427359 - DNA, 22 bp, Homo sapiens
tatagttccatctgctctattt

SEQ ID NO: 7427360 - DNA, 22 bp, Homo sapiens
tatagtttcatgagctttttaa

SEQ ID NO: 7427361 - DNA, 22 bp, Homo sapiens
tataggtacttggaaaataagg

SEQ ID NO: 7427362 - DNA, 21 bp, Homo sapiens
tataggcttccatatgaaggg

SEQ ID NO: 7427363 - DNA, 22 bp, Homo sapiens
tataggcagatctgagaatatt

SEQ ID NO: 7427364 - DNA, 22 bp, Homo sapiens
tataggcagatctgagaatatt

SEQ ID NO: 7427365 - DNA, 22 bp, Homo sapiens
tataggctgatggcttcctgag

SEQ ID NO: 7427366 - DNA, 22 bp, Homo sapiens
tatagtaaaattttcatttatg

SEQ ID NO: 7427367 - DNA, 22 bp, Homo sapiens
tatagtaaaattttcatttatg

SEQ ID NO: 7427368 - DNA, 22 bp, Homo sapiens
tataggtgaataaatgagttta

SEQ ID NO: 7427369 - DNA, 22 bp, Homo sapiens
tataggtgaataaatgagttta

SEQ ID NO: 7427370 - DNA, 22 bp, Homo sapiens
tataggtatgtcgagaaatgaa

SEQ ID NO: 7427371 - DNA, 22 bp, Homo sapiens
tataggtacttggaaaataagg

SEQ ID NO: 7427372 - DNA, 22 bp, Homo sapiens
tataggtacttggaaaataagg

SEQ ID NO: 7427373 - DNA, 22 bp, Homo sapiens
tatagtaaaattttcatttatg

SEQ ID NO: 7427374 - DNA, 22 bp, Homo sapiens
tatagtaaaattttcatttatg

SEQ ID NO: 7427375 - DNA, 22 bp, Homo sapiens
tatagtaaaattttcatttatg

SEQ ID NO: 7427376 - DNA, 22 bp, Homo sapiens
tatagtacacttaggtacttca

SEQ ID NO: 7427377 - DNA, 22 bp, Homo sapiens
tatagtaaaattttcatttatg

SEQ ID NO: 7427378 - DNA, 22 bp, Homo sapiens
tatatcatggagattaacattc

SEQ ID NO: 7427379 - DNA, 22 bp, Homo sapiens
tatatccataggctgtgcctag

SEQ ID NO: 7427380 - DNA, 22 bp, Homo sapiens
tatatccagaaaatcagttcat

SEQ ID NO: 7427381 - DNA, 22 bp, Homo sapiens
tatatcatggagattaacattc

SEQ ID NO: 7427382 - DNA, 22 bp, Homo sapiens
tatatcatggagattaacattc

SEQ ID NO: 7427383 - DNA, 22 bp, Homo sapiens
tatatcatggagattaacattc

SEQ ID NO: 7427384 - DNA, 22 bp, Homo sapiens
tatatctaagtgtatgtaagag

SEQ ID NO: 7427385 - DNA, 22 bp, Homo sapiens
tatatctaagtgtatgtaagag

SEQ ID NO: 7427386 - DNA, 22 bp, Homo sapiens
tatatccatttgtctgctaatt

SEQ ID NO: 7427387 - DNA, 22 bp, Homo sapiens
tatatccatttgtctgctaatt

SEQ ID NO: 7427388 - DNA, 22 bp, Homo sapiens
tatatgacagtatcattttaaa

SEQ ID NO: 7427389 - DNA, 22 bp, Homo sapiens
tatatgacagtatcattttaaa

SEQ ID NO: 7427390 - DNA, 22 bp, Homo sapiens
tatatcttatatgtgcaggtac

SEQ ID NO: 7427391 - DNA, 22 bp, Homo sapiens
tatatcttatatgtgcaggtac

SEQ ID NO: 7427392 - DNA, 22 bp, Homo sapiens
tatatctaggaaccctgagatt

SEQ ID NO: 7427393 - DNA, 22 bp, Homo sapiens
tatatcagcaaagcatttaaaa

SEQ ID NO: 7427394 - DNA, 22 bp, Homo sapiens
tatatcatggagattaacattc

SEQ ID NO: 7427395 - DNA, 22 bp, Homo sapiens
tatatcagagttaaaagaatgt

SEQ ID NO: 7427396 - DNA, 22 bp, Homo sapiens
tatatcagcaaagcatttaaaa

SEQ ID NO: 7427397 - DNA, 19 bp, Homo sapiens
tatatattttggggttgtg

SEQ ID NO: 7427398 - DNA, 19 bp, Homo sapiens
tatatattttggggttgtg

SEQ ID NO: 7427399 - DNA, 22 bp, Homo sapiens
tatatcaccaaaaacagttctg

SEQ ID NO: 7427400 - DNA, 19 bp, Homo sapiens
tatatattttggggttgtg

SEQ ID NO: 7427401 - DNA, 22 bp, Homo sapiens
tatatcaccaaaaacagttctg

SEQ ID NO: 7427402 - DNA, 19 bp, Homo sapiens
tatatattttggggttgtg

SEQ ID NO: 7427403 - DNA, 19 bp, Homo sapiens
tatatattttggggttgtg

SEQ ID NO: 7427404 - DNA, 22 bp, Homo sapiens
tatatattcttaagtagtgtag

SEQ ID NO: 7427405 - DNA, 22 bp, Homo sapiens
tatatattcttaagtagtgtag

SEQ ID NO: 7427406 - DNA, 22 bp, Homo sapiens
tatatattcttaagtagtgtag

SEQ ID NO: 7427407 - DNA, 22 bp, Homo sapiens
tatatattcttaagtagtgtag

SEQ ID NO: 7427408 - DNA, 22 bp, Homo sapiens
tatatattcttaagtagtgtag

SEQ ID NO: 7427409 - DNA, 22 bp, Homo sapiens
tatatattcttaagtagtgtag

SEQ ID NO: 7427410 - DNA, 22 bp, Homo sapiens
tatatattcttaagtagtgtag

SEQ ID NO: 7427411 - DNA, 22 bp, Homo sapiens
tatatattcttaagtagtgtag

SEQ ID NO: 7427412 - DNA, 22 bp, Homo sapiens
tatatatgggggaagctggatg

SEQ ID NO: 7427413 - DNA, 22 bp, Homo sapiens
tatccaaagtggcatattatag

SEQ ID NO: 7427414 - DNA, 22 bp, Homo sapiens
tatccaaagtggcatattatag

SEQ ID NO: 7427415 - DNA, 22 bp, Homo sapiens
tatccaaagtggcatattatag

SEQ ID NO: 7427416 - DNA, 20 bp, Homo sapiens
tatatgacatcatgatctta

SEQ ID NO: 7427417 - DNA, 22 bp, Homo sapiens
tatatgactgtattatgctttt

SEQ ID NO: 7427418 - DNA, 22 bp, Homo sapiens
tatccaattcaccattgatggg

SEQ ID NO: 7427419 - DNA, 22 bp, Homo sapiens
tatccaaagtttctcagaaact

SEQ ID NO: 7427420 - DNA, 22 bp, Homo sapiens
tatccaaagtttctcagaaact

SEQ ID NO: 7427421 - DNA, 22 bp, Homo sapiens
tatccacactgggatgttttga

SEQ ID NO: 7427422 - DNA, 22 bp, Homo sapiens
tatccacactcaaggggagggg

SEQ ID NO: 7427423 - DNA, 22 bp, Homo sapiens
tatcccaggaggccacctgtca

SEQ ID NO: 7427424 - DNA, 22 bp, Homo sapiens
tatcccaggaggccacctgtca

SEQ ID NO: 7427425 - DNA, 22 bp, Homo sapiens
tatccattatgttggctagtct

SEQ ID NO: 7427426 - DNA, 22 bp, Homo sapiens
tatccattatgttggctagtct

SEQ ID NO: 7427427 - DNA, 22 bp, Homo sapiens
tatccatttattttctaggcaa

SEQ ID NO: 7427428 - DNA, 22 bp, Homo sapiens
tatccatttattttctaggcaa

SEQ ID NO: 7427429 - DNA, 22 bp, Homo sapiens
tatccattaggtctatggtcaa

SEQ ID NO: 7427430 - DNA, 22 bp, Homo sapiens
tatccattaggtctatggtcaa

SEQ ID NO: 7427431 - DNA, 22 bp, Homo sapiens
tatccatgcctttgtgccttag

SEQ ID NO: 7427432 - DNA, 22 bp, Homo sapiens
tatccatggccaatcaaataca

SEQ ID NO: 7427433 - DNA, 22 bp, Homo sapiens
tatccatagtttatagatcaag

SEQ ID NO: 7427434 - DNA, 22 bp, Homo sapiens
tatccatattcagactgtgaat

SEQ ID NO: 7427435 - DNA, 22 bp, Homo sapiens
tatccatattaagatgcctctg

SEQ ID NO: 7427436 - DNA, 22 bp, Homo sapiens
tatccagggagttttagggctt

SEQ ID NO: 7427437 - DNA, 22 bp, Homo sapiens
tatccagtgtgaactcctctac

SEQ ID NO: 7427438 - DNA, 23 bp, Homo sapiens
tatccagtagggcccagagctga

SEQ ID NO: 7427439 - DNA, 22 bp, Homo sapiens
tatccataccactacttccctt

SEQ ID NO: 7427440 - DNA, 22 bp, Homo sapiens
tatgacattgctttttagaact

SEQ ID NO: 7427441 - DNA, 22 bp, Homo sapiens
tatgacattatgtattacatgt

SEQ ID NO: 7427442 - DNA, 22 bp, Homo sapiens
tatgacattgctttttagaact

SEQ ID NO: 7427443 - DNA, 22 bp, Homo sapiens
tatgacatcagaagactttaaa

SEQ ID NO: 7427444 - DNA, 22 bp, Homo sapiens
tatgacatgtgatctcaagagg

SEQ ID NO: 7427445 - DNA, 22 bp, Homo sapiens
tatgacattataaaggattatt

SEQ ID NO: 7427446 - DNA, 22 bp, Homo sapiens
tatgacattatgtattacatgt

SEQ ID NO: 7427447 - DNA, 22 bp, Homo sapiens
tatgacaccattttggtcagtg

SEQ ID NO: 7427448 - DNA, 22 bp, Homo sapiens
tatgacaccattttggtcagtg

SEQ ID NO: 7427449 - DNA, 22 bp, Homo sapiens
tatgacaatgtgggcctaaggg

SEQ ID NO: 7427450 - DNA, 22 bp, Homo sapiens
tatgacaatgtgggcctaaggg

SEQ ID NO: 7427451 - DNA, 22 bp, Homo sapiens
tatgacagcaaatatccatgag

SEQ ID NO: 7427452 - DNA, 19 bp, Homo sapiens
tatgacagctggagggctc

SEQ ID NO: 7427453 - DNA, 22 bp, Homo sapiens
tatgacagcaaatatccatgag

SEQ ID NO: 7427454 - DNA, 22 bp, Homo sapiens
tatgacaggcatgagatcctaa

SEQ ID NO: 7427455 - DNA, 19 bp, Homo sapiens
tatgacagctggagggctc

SEQ ID NO: 7427456 - DNA, 22 bp, Homo sapiens
tatgacatcagaagactttaaa

SEQ ID NO: 7427457 - DNA, 22 bp, Homo sapiens
tatgacagtgaaaaaaatcaga

SEQ ID NO: 7427458 - DNA, 22 bp, Homo sapiens
tatgacatttctctgatttgtg

SEQ ID NO: 7427459 - DNA, 22 bp, Homo sapiens
tatgacatttctctgatttgtg

SEQ ID NO: 7427460 - DNA, 22 bp, Homo sapiens
tatgacattttcccagatttat

SEQ ID NO: 7427461 - DNA, 22 bp, Homo sapiens
tatgacattttcccagatttat

SEQ ID NO: 7427462 - DNA, 22 bp, Homo sapiens
tatgacatttctctgatttgtg

SEQ ID NO: 7427463 - DNA, 22 bp, Homo sapiens
tatgacattgctttttagaact

SEQ ID NO: 7427464 - DNA, 22 bp, Homo sapiens
tatgacattgctttttagaact

SEQ ID NO: 7427465 - DNA, 22 bp, Homo sapiens
tatgacattttgccagcattgc

SEQ ID NO: 7427466 - DNA, 22 bp, Homo sapiens
tatgacattttgccagcattgc

SEQ ID NO: 7427467 - DNA, 22 bp, Homo sapiens
tatgactatagggcttagtgtt

SEQ ID NO: 7427468 - DNA, 22 bp, Homo sapiens
tatgactttggaaaaattactt

SEQ ID NO: 7427469 - DNA, 22 bp, Homo sapiens
tatgagaaaataaatatctgtt

SEQ ID NO: 7427470 - DNA, 22 bp, Homo sapiens
tatgagaaaataaatatctgtt

SEQ ID NO: 7427471 - DNA, 22 bp, Homo sapiens
tatgagaaaataaatatctgtt

SEQ ID NO: 7427472 - DNA, 21 bp, Homo sapiens
tatgagaaaactgaggtgcat

SEQ ID NO: 7427473 - DNA, 22 bp, Homo sapiens
tatgagaaaataaatatctgtt

SEQ ID NO: 7427474 - DNA, 22 bp, Homo sapiens
tatgagaaaggagaatgacttt

SEQ ID NO: 7427475 - DNA, 22 bp, Homo sapiens
tatgagaaaggagaatgacttt

SEQ ID NO: 7427476 - DNA, 22 bp, Homo sapiens
tatgagaaaggagaatgacttt

SEQ ID NO: 7427477 - DNA, 22 bp, Homo sapiens
tatgagaaaggagaatgacttt

SEQ ID NO: 7427478 - DNA, 22 bp, Homo sapiens
tatgagaaaggagaatgacttt

SEQ ID NO: 7427479 - DNA, 22 bp, Homo sapiens
tatgagaaattatacctaggtt

SEQ ID NO: 7427480 - DNA, 22 bp, Homo sapiens
tatgagaaagtcgtatgtctcc

SEQ ID NO: 7427481 - DNA, 22 bp, Homo sapiens
tatgagaactgacagagtgcca

SEQ ID NO: 7427482 - DNA, 22 bp, Homo sapiens
tatgagaacaagaacaatctcc

SEQ ID NO: 7427483 - DNA, 22 bp, Homo sapiens
tatgagaacaagaacaatctcc

SEQ ID NO: 7427484 - DNA, 22 bp, Homo sapiens
tatgagaacaagaacaatctcc

SEQ ID NO: 7427485 - DNA, 22 bp, Homo sapiens
tatgagaaattgctgatatttg

SEQ ID NO: 7427486 - DNA, 22 bp, Homo sapiens
tatgagaataatctggtaaata

SEQ ID NO: 7427487 - DNA, 18 bp, Homo sapiens
tatgagaagattagcaat

SEQ ID NO: 7427488 - DNA, 22 bp, Homo sapiens
tatctaaatggaatattccaga

SEQ ID NO: 7427489 - DNA, 22 bp, Homo sapiens
tatctaagaattccagagaaag

SEQ ID NO: 7427490 - DNA, 22 bp, Homo sapiens
tatctaagaattccagagaaag

SEQ ID NO: 7427491 - DNA, 22 bp, Homo sapiens
tatctacaggtgtcaggtaaga

SEQ ID NO: 7427492 - DNA, 22 bp, Homo sapiens
tatctaataaatctgataagta

SEQ ID NO: 7427493 - DNA, 22 bp, Homo sapiens
tatctaagagagtcaatattta

SEQ ID NO: 7427494 - DNA, 22 bp, Homo sapiens
tatctaagaattccagagaaag

SEQ ID NO: 7427495 - DNA, 22 bp, Homo sapiens
tatctaagagagtcaatattta

SEQ ID NO: 7427496 - DNA, 22 bp, Homo sapiens
tatctaaggtatatgaggaatc

SEQ ID NO: 7427497 - DNA, 20 bp, Homo sapiens
tatctaaatgcttacattac

SEQ ID NO: 7427498 - DNA, 20 bp, Homo sapiens
tatctaaatgcttacattac

SEQ ID NO: 7427499 - DNA, 20 bp, Homo sapiens
tatctaaatgcttacattac

SEQ ID NO: 7427500 - DNA, 22 bp, Homo sapiens
tatctaaaggatttaatttagt

SEQ ID NO: 7427501 - DNA, 22 bp, Homo sapiens
tatctaaaggatttaatttagt

SEQ ID NO: 7427502 - DNA, 22 bp, Homo sapiens
tatctaaaggatttaatttagt

SEQ ID NO: 7427503 - DNA, 22 bp, Homo sapiens
tatctaaaggatttaatttagt

SEQ ID NO: 7427504 - DNA, 22 bp, Homo sapiens
tatccgtgatgtttataaacca

SEQ ID NO: 7427505 - DNA, 22 bp, Homo sapiens
tatccccacctctgttaaggac

SEQ ID NO: 7427506 - DNA, 22 bp, Homo sapiens
tatcccatgcctcattaaagtt

SEQ ID NO: 7427507 - DNA, 22 bp, Homo sapiens
tatcccatgcctcattaaagtt

SEQ ID NO: 7427508 - DNA, 22 bp, Homo sapiens
tatcccatgagccagctgcagc

SEQ ID NO: 7427509 - DNA, 22 bp, Homo sapiens
tatcctactccttcacaccttg

SEQ ID NO: 7427510 - DNA, 22 bp, Homo sapiens
tatccgtgatgtttataaacca

SEQ ID NO: 7427511 - DNA, 23 bp, Homo sapiens
tatcctaaaggcaacaggaagtc

SEQ ID NO: 7427512 - DNA, 22 bp, Homo sapiens
tatctaaaggatttaatttagt

SEQ ID NO: 7427513 - DNA, 22 bp, Homo sapiens
tatctaaaggatttaatttagt

SEQ ID NO: 7427514 - DNA, 22 bp, Homo sapiens
tatctaaaggatttaatttagt

SEQ ID NO: 7427515 - DNA, 22 bp, Homo sapiens
tatcctgttttgcacaattata

SEQ ID NO: 7427516 - DNA, 22 bp, Homo sapiens
tatcctggagaatctgatagga

SEQ ID NO: 7427517 - DNA, 22 bp, Homo sapiens
tatctacagttaatatgtcatc

SEQ ID NO: 7427518 - DNA, 22 bp, Homo sapiens
tatctacagttaatatgtcatc

SEQ ID NO: 7427519 - DNA, 22 bp, Homo sapiens
tatctacagttaatatgtcatc

SEQ ID NO: 7427520 - DNA, 22 bp, Homo sapiens
tatctacagttaatatgtcatc

SEQ ID NO: 7427521 - DNA, 22 bp, Homo sapiens
tatctacatgtaggtatgtatg

SEQ ID NO: 7427522 - DNA, 22 bp, Homo sapiens
tatctacagttaatatgtcatc

SEQ ID NO: 7427523 - DNA, 21 bp, Homo sapiens
tatctacagtgtccattcagt

SEQ ID NO: 7427524 - DNA, 22 bp, Homo sapiens
tatctacaggtgtcaggtaaga

SEQ ID NO: 7427525 - DNA, 22 bp, Homo sapiens
tatctacaggtgtcaggtaaga

SEQ ID NO: 7427526 - DNA, 22 bp, Homo sapiens
tatctacatgtaggtatgtatg

SEQ ID NO: 7427527 - DNA, 22 bp, Homo sapiens
tatctacattcttgtatcttct

SEQ ID NO: 7427528 - DNA, 22 bp, Homo sapiens
tatctacattcttgtatcttct

SEQ ID NO: 7427529 - DNA, 22 bp, Homo sapiens
tatctacattcttgtatcttct

SEQ ID NO: 7427530 - DNA, 22 bp, Homo sapiens
tatctactcctctttcagatgc

SEQ ID NO: 7427531 - DNA, 21 bp, Homo sapiens
tatctactggtgtctttcaga

SEQ ID NO: 7427532 - DNA, 21 bp, Homo sapiens
tatctactggtgtctttcaga

SEQ ID NO: 7427533 - DNA, 23 bp, Homo sapiens
tatctactttgcaattcagtacc

SEQ ID NO: 7427534 - DNA, 22 bp, Homo sapiens
tatctagaaacagagttttact

SEQ ID NO: 7427535 - DNA, 22 bp, Homo sapiens
tatctagaaacagagttttact

SEQ ID NO: 7427536 - DNA, 22 bp, Homo sapiens
tatctagaaatttcttttgttg

SEQ ID NO: 7427537 - DNA, 22 bp, Homo sapiens
tatctagaactccagaatgtag

SEQ ID NO: 7427538 - DNA, 22 bp, Homo sapiens
tatctagaactccagaatgtag

SEQ ID NO: 7427539 - DNA, 22 bp, Homo sapiens
tatctagaactccagaatgtag

SEQ ID NO: 7427540 - DNA, 22 bp, Homo sapiens
tatctagagtcctgctgagaac

SEQ ID NO: 7427541 - DNA, 22 bp, Homo sapiens
tatctagagcctggaagtcttg

SEQ ID NO: 7427542 - DNA, 22 bp, Homo sapiens
tatctagagcagtggttctcaa

SEQ ID NO: 7427543 - DNA, 22 bp, Homo sapiens
tatctagataccaagaagcaca

SEQ ID NO: 7427544 - DNA, 16 bp, Homo sapiens
tatctagagttgaggt

SEQ ID NO: 7427545 - DNA, 22 bp, Homo sapiens
tatctagataccaagaagcaca

SEQ ID NO: 7427546 - DNA, 22 bp, Homo sapiens
tatctagatagtttagccatct

SEQ ID NO: 7427547 - DNA, 19 bp, Homo sapiens
tatgacaagtactagttct

SEQ ID NO: 7427548 - DNA, 22 bp, Homo sapiens
tatctagatatttggataaatg

SEQ ID NO: 7427549 - DNA, 19 bp, Homo sapiens
tatgacaagtactagttct

SEQ ID NO: 7427550 - DNA, 22 bp, Homo sapiens
tattctctccccaatcttgctt

SEQ ID NO: 7427551 - DNA, 22 bp, Homo sapiens
tattctctccccaatcttgctt

SEQ ID NO: 7427552 - DNA, 22 bp, Homo sapiens
tattctccccggatcagggcaa

SEQ ID NO: 7427553 - DNA, 22 bp, Homo sapiens
tattctccccggatcagggcaa

SEQ ID NO: 7427554 - DNA, 22 bp, Homo sapiens
tattctcattagtctgtattcc

SEQ ID NO: 7427555 - DNA, 22 bp, Homo sapiens
tattctcattagtctgtattcc

SEQ ID NO: 7427556 - DNA, 22 bp, Homo sapiens
tattctcattagtctgtattcc

SEQ ID NO: 7427557 - DNA, 22 bp, Homo sapiens
tattctcattagtctgtattcc

SEQ ID NO: 7427558 - DNA, 22 bp, Homo sapiens
tattctcatcatcactggagct

SEQ ID NO: 7427559 - DNA, 22 bp, Homo sapiens
tattctcagtgctataagtaga

SEQ ID NO: 7427560 - DNA, 22 bp, Homo sapiens
tattctcagtgctataagtaga

SEQ ID NO: 7427561 - DNA, 22 bp, Homo sapiens
tattctcatcatcactggagct

SEQ ID NO: 7427562 - DNA, 22 bp, Homo sapiens
tattctcatcatcactggagct

SEQ ID NO: 7427563 - DNA, 22 bp, Homo sapiens
tattctcagtgctataagtaga

SEQ ID NO: 7427564 - DNA, 22 bp, Homo sapiens
tattctcagtgctataagtaga

SEQ ID NO: 7427565 - DNA, 22 bp, Homo sapiens
tattctcagcaacacacatgga

SEQ ID NO: 7427566 - DNA, 22 bp, Homo sapiens
tattctcagcaacacacatgga

SEQ ID NO: 7427567 - DNA, 22 bp, Homo sapiens
tattctactagcattgttcact

SEQ ID NO: 7427568 - DNA, 22 bp, Homo sapiens
tattctactagcattgttcact

SEQ ID NO: 7427569 - DNA, 22 bp, Homo sapiens
tattctcagcaacacacatgga

SEQ ID NO: 7427570 - DNA, 22 bp, Homo sapiens
tattctagaagtccaccagtct

SEQ ID NO: 7427571 - DNA, 22 bp, Homo sapiens
tattctagaagtccaccagtct

SEQ ID NO: 7427572 - DNA, 22 bp, Homo sapiens
tattctagtaccctgaaaacct

SEQ ID NO: 7427573 - DNA, 22 bp, Homo sapiens
tattctgatttcaagtgagagt

SEQ ID NO: 7427574 - DNA, 22 bp, Homo sapiens
tattctgagctgtctcaggttg

SEQ ID NO: 7427575 - DNA, 22 bp, Homo sapiens
tattctctgcagctgaatgttt

SEQ ID NO: 7427576 - DNA, 22 bp, Homo sapiens
tattctctgcagctgaatgttt

SEQ ID NO: 7427577 - DNA, 22 bp, Homo sapiens
tattctgctaagtgatttctac

SEQ ID NO: 7427578 - DNA, 22 bp, Homo sapiens
tattctgggtaccaaacttcaa

SEQ ID NO: 7427579 - DNA, 22 bp, Homo sapiens
tattctgatttcaagtgagagt

SEQ ID NO: 7427580 - DNA, 22 bp, Homo sapiens
tattctgcatgaaaataaacag

SEQ ID NO: 7427581 - DNA, 22 bp, Homo sapiens
tattctggtttccggatctcta

SEQ ID NO: 7427582 - DNA, 22 bp, Homo sapiens
tattctgtgtgatatgtaaatg

SEQ ID NO: 7427583 - DNA, 22 bp, Homo sapiens
tattctgtgtgatatgtaaatg

SEQ ID NO: 7427584 - DNA, 22 bp, Homo sapiens
tattctgtgtgatatgtaaatg

SEQ ID NO: 7427585 - DNA, 22 bp, Homo sapiens
tattctgtgtgatatgtaaatg

SEQ ID NO: 7427586 - DNA, 19 bp, Homo sapiens
tattctgttaacctttgtc

SEQ ID NO: 7427587 - DNA, 22 bp, Homo sapiens
tattcttaattgctgagctgaa

SEQ ID NO: 7427588 - DNA, 22 bp, Homo sapiens
tattcttactctcgactgcatt

SEQ ID NO: 7427589 - DNA, 22 bp, Homo sapiens
tattcttactctcgactgcatt

SEQ ID NO: 7427590 - DNA, 22 bp, Homo sapiens
tattcttgtaccttaaatgatt

SEQ ID NO: 7427591 - DNA, 22 bp, Homo sapiens
tattcttgtaccttaaatgatt

SEQ ID NO: 7427592 - DNA, 22 bp, Homo sapiens
tattcttgactgcttactatgt

SEQ ID NO: 7427593 - DNA, 22 bp, Homo sapiens
tattcttgtcttttccagaaat

SEQ ID NO: 7427594 - DNA, 22 bp, Homo sapiens
tattgaaatccattacgttctt

SEQ ID NO: 7427595 - DNA, 22 bp, Homo sapiens
tattgaaatccattacgttctt

SEQ ID NO: 7427596 - DNA, 22 bp, Homo sapiens
tattgaaatccattacgttctt

SEQ ID NO: 7427597 - DNA, 22 bp, Homo sapiens
tattcttgtatactacaatctt

SEQ ID NO: 7427598 - DNA, 22 bp, Homo sapiens
tattgaaatgaatgacagtgat

SEQ ID NO: 7427599 - DNA, 22 bp, Homo sapiens
tattgaaatgaatgacagtgat

SEQ ID NO: 7427600 - DNA, 22 bp, Homo sapiens
tattgaaatccattacgttctt

SEQ ID NO: 7427601 - DNA, 22 bp, Homo sapiens
tattgaaatccattacgttctt

SEQ ID NO: 7427602 - DNA, 22 bp, Homo sapiens
tattgaaattcttcatgtcctc

SEQ ID NO: 7427603 - DNA, 22 bp, Homo sapiens
tattgaaattcttcatgtcctc

SEQ ID NO: 7427604 - DNA, 22 bp, Homo sapiens
tattgaaattcttcatgtcctc

SEQ ID NO: 7427605 - DNA, 22 bp, Homo sapiens
tattgaaattcttcatgtcctc

SEQ ID NO: 7427606 - DNA, 22 bp, Homo sapiens
tattgaagattttgtggttgct

SEQ ID NO: 7427607 - DNA, 22 bp, Homo sapiens
tattgaagagataagtgacaga

SEQ ID NO: 7427608 - DNA, 22 bp, Homo sapiens
tattgacaataggcaactgagg

SEQ ID NO: 7427609 - DNA, 22 bp, Homo sapiens
tattgacaataggcaactgagg

SEQ ID NO: 7427610 - DNA, 22 bp, Homo sapiens
tattgaattagaccctaaaatg

SEQ ID NO: 7427611 - DNA, 22 bp, Homo sapiens
tattgaattagaccctaaaatg

SEQ ID NO: 7427612 - DNA, 22 bp, Homo sapiens
tattgaattagaccctaaaatg

SEQ ID NO: 7427613 - DNA, 22 bp, Homo sapiens
tattgacaatttgtgaaactat

SEQ ID NO: 7427614 - DNA, 22 bp, Homo sapiens
tattgacaataggcaactgagg

SEQ ID NO: 7427615 - DNA, 22 bp, Homo sapiens
tattgacaatttgtgaaactat

SEQ ID NO: 7427616 - DNA, 22 bp, Homo sapiens
tattgacaatttgtgaaactat

SEQ ID NO: 7427617 - DNA, 22 bp, Homo sapiens
tattgacaatttgtgaaactat

SEQ ID NO: 7427618 - DNA, 22 bp, Homo sapiens
tattaggtagattttactgatt

SEQ ID NO: 7427619 - DNA, 22 bp, Homo sapiens
tattattaaatggcagaatttt

SEQ ID NO: 7427620 - DNA, 22 bp, Homo sapiens
tattattaaatggcagaatttt

SEQ ID NO: 7427621 - DNA, 22 bp, Homo sapiens
tattattaaatggcagaatttt

SEQ ID NO: 7427622 - DNA, 22 bp, Homo sapiens
tattattatattggatgagact

SEQ ID NO: 7427623 - DNA, 22 bp, Homo sapiens
tattattaaatggcagaatttt

SEQ ID NO: 7427624 - DNA, 22 bp, Homo sapiens
tattattatagttattgggaag

SEQ ID NO: 7427625 - DNA, 22 bp, Homo sapiens
tattattatagttattgggaag

SEQ ID NO: 7427626 - DNA, 23 bp, Homo sapiens
tattagggccaggactggcaaat

SEQ ID NO: 7427627 - DNA, 22 bp, Homo sapiens
tattaggtagattttactgatt

SEQ ID NO: 7427628 - DNA, 20 bp, Homo sapiens
tattaggaaggaggaaggaa

SEQ ID NO: 7427629 - DNA, 21 bp, Homo sapiens
tattagcttctggtgctgttt

SEQ ID NO: 7427630 - DNA, 22 bp, Homo sapiens
tattagcttgtttggcaggatg

SEQ ID NO: 7427631 - DNA, 22 bp, Homo sapiens
tattattgcaagtatataaagt

SEQ ID NO: 7427632 - DNA, 22 bp, Homo sapiens
tattattgcaagtatataaagt

SEQ ID NO: 7427633 - DNA, 19 bp, Homo sapiens
tattatttgtagcaaggcc

SEQ ID NO: 7427634 - DNA, 19 bp, Homo sapiens
tattatttgtagcaaggcc

SEQ ID NO: 7427635 - DNA, 22 bp, Homo sapiens
tattattgcaagtatataaagt

SEQ ID NO: 7427636 - DNA, 22 bp, Homo sapiens
tattattgactattcagaatgt

SEQ ID NO: 7427637 - DNA, 22 bp, Homo sapiens
tattattgacatttacttggtg

SEQ ID NO: 7427638 - DNA, 22 bp, Homo sapiens
tattattgactattcagaatgt

SEQ ID NO: 7427639 - DNA, 22 bp, Homo sapiens
tattattgacatttacttggtg

SEQ ID NO: 7427640 - DNA, 22 bp, Homo sapiens
tattattgaatcagttctttga

SEQ ID NO: 7427641 - DNA, 22 bp, Homo sapiens
tattattatgcatagcatgaaa

SEQ ID NO: 7427642 - DNA, 22 bp, Homo sapiens
tattattatgcatagcatgaaa

SEQ ID NO: 7427643 - DNA, 22 bp, Homo sapiens
tattattatgcatagcatgaaa

SEQ ID NO: 7427644 - DNA, 22 bp, Homo sapiens
tattattatctttgaatgggac

SEQ ID NO: 7427645 - DNA, 22 bp, Homo sapiens
tattattatattggatgagact

SEQ ID NO: 7427646 - DNA, 22 bp, Homo sapiens
tattattatattggatgagact

SEQ ID NO: 7427647 - DNA, 22 bp, Homo sapiens
tattattgaatcagttctttga

SEQ ID NO: 7427648 - DNA, 22 bp, Homo sapiens
tattattgaatcagttctttga

SEQ ID NO: 7427649 - DNA, 22 bp, Homo sapiens
tattattatgcatagcatgaaa

SEQ ID NO: 7427650 - DNA, 22 bp, Homo sapiens
tattattatgcatagcatgaaa

SEQ ID NO: 7427651 - DNA, 19 bp, Homo sapiens
tattatttgtagcaaggcc

SEQ ID NO: 7427652 - DNA, 22 bp, Homo sapiens
tattattttagcactgaggatt

SEQ ID NO: 7427653 - DNA, 22 bp, Homo sapiens
tattattttagcactgaggatt

SEQ ID NO: 7427654 - DNA, 22 bp, Homo sapiens
tattattttagcactgaggatt

SEQ ID NO: 7427655 - DNA, 22 bp, Homo sapiens
tattattttagcactgaggatt

SEQ ID NO: 7427656 - DNA, 22 bp, Homo sapiens
tattatttttattcgagggaaa

SEQ ID NO: 7427657 - DNA, 22 bp, Homo sapiens
tattattttagcactgaggatt

SEQ ID NO: 7427658 - DNA, 22 bp, Homo sapiens
tattcaaagtaccttcattgcc

SEQ ID NO: 7427659 - DNA, 22 bp, Homo sapiens
tattcaaagtaccttcattgcc

SEQ ID NO: 7427660 - DNA, 22 bp, Homo sapiens
tattcaaagtaccttcattgcc

SEQ ID NO: 7427661 - DNA, 22 bp, Homo sapiens
tattcaaagtaccttcattgcc

SEQ ID NO: 7427662 - DNA, 22 bp, Homo sapiens
tattcaaagtaccttcattgcc

SEQ ID NO: 7427663 - DNA, 22 bp, Homo sapiens
tattcaaagtaccttcattgcc

SEQ ID NO: 7427664 - DNA, 22 bp, Homo sapiens
tattcaaagtaccttcattgcc

SEQ ID NO: 7427665 - DNA, 22 bp, Homo sapiens
tattcaaagtaccttcattgcc

SEQ ID NO: 7427666 - DNA, 22 bp, Homo sapiens
tattcatgggaggtcacaactt

SEQ ID NO: 7427667 - DNA, 22 bp, Homo sapiens
tattccttggcaaaaaatatat

SEQ ID NO: 7427668 - DNA, 22 bp, Homo sapiens
tattccttggcaaaaaatatat

SEQ ID NO: 7427669 - DNA, 22 bp, Homo sapiens
tattcctgttccccatcaccac

SEQ ID NO: 7427670 - DNA, 22 bp, Homo sapiens
tattcctgttccccatcaccac

SEQ ID NO: 7427671 - DNA, 22 bp, Homo sapiens
tattcctgtcaagatcttacaa

SEQ ID NO: 7427672 - DNA, 22 bp, Homo sapiens
tattccttggcaaaaaatatat

SEQ ID NO: 7427673 - DNA, 22 bp, Homo sapiens
tattccttggcaaaaaatatat

SEQ ID NO: 7427674 - DNA, 22 bp, Homo sapiens
tattctacagtgttagtgttag

SEQ ID NO: 7427675 - DNA, 22 bp, Homo sapiens
tattctacagtgttagtgttag

SEQ ID NO: 7427676 - DNA, 22 bp, Homo sapiens
tattccaaaatcccaaactgcc

SEQ ID NO: 7427677 - DNA, 22 bp, Homo sapiens
tattccaaaatcccaaactgcc

SEQ ID NO: 7427678 - DNA, 22 bp, Homo sapiens
tattccaaaatcccaaactgcc

SEQ ID NO: 7427679 - DNA, 22 bp, Homo sapiens
tattccaactgtcatagtcata

SEQ ID NO: 7427680 - DNA, 22 bp, Homo sapiens
tattccaaaggtagggattact

SEQ ID NO: 7427681 - DNA, 22 bp, Homo sapiens
tattccaactgtcatagtcata

SEQ ID NO: 7427682 - DNA, 22 bp, Homo sapiens
tattccaaaatagttaagcact

SEQ ID NO: 7427683 - DNA, 22 bp, Homo sapiens
tattccaaaatagttaagcact

SEQ ID NO: 7427684 - DNA, 22 bp, Homo sapiens
tattcattatgaccaaatctag

SEQ ID NO: 7427685 - DNA, 22 bp, Homo sapiens
tattcattatgaccaaatctag

SEQ ID NO: 7427686 - DNA, 22 bp, Homo sapiens
tattcattatgaccaaatctag

SEQ ID NO: 7427687 - DNA, 22 bp, Homo sapiens
tattcattatgaccaaatctag

SEQ ID NO: 7427688 - DNA, 22 bp, Homo sapiens
tattcattatgaccaaatctag

SEQ ID NO: 7427689 - DNA, 22 bp, Homo sapiens
tattcatgtcggctgaaaaagc

SEQ ID NO: 7427690 - DNA, 22 bp, Homo sapiens
tattcatgggggtccaggtacc

SEQ ID NO: 7427691 - DNA, 22 bp, Homo sapiens
tattcatgtcggctgaaaaagc

SEQ ID NO: 7427692 - DNA, 22 bp, Homo sapiens
tatttatcaaggtaggagaata

SEQ ID NO: 7427693 - DNA, 22 bp, Homo sapiens
tatttatcgagtgtctactatg

SEQ ID NO: 7427694 - DNA, 22 bp, Homo sapiens
tatttatcgagtgtctactatg

SEQ ID NO: 7427695 - DNA, 22 bp, Homo sapiens
tatttatcgagtgtctactatg

SEQ ID NO: 7427696 - DNA, 22 bp, Homo sapiens
tatttatgtatgtggatgtgtt

SEQ ID NO: 7427697 - DNA, 22 bp, Homo sapiens
tatttatgtctctgcagagaat

SEQ ID NO: 7427698 - DNA, 21 bp, Homo sapiens
tatttattaatttgtaaggct

SEQ ID NO: 7427699 - DNA, 21 bp, Homo sapiens
tatttattaatttgtaaggct

SEQ ID NO: 7427700 - DNA, 21 bp, Homo sapiens
tatttattaatttgtaaggct

SEQ ID NO: 7427701 - DNA, 21 bp, Homo sapiens
tatttattaatttgtaaggct

SEQ ID NO: 7427702 - DNA, 21 bp, Homo sapiens
tatttattaatttgtaaggct

SEQ ID NO: 7427703 - DNA, 21 bp, Homo sapiens
tatttattaatttgtaaggct

SEQ ID NO: 7427704 - DNA, 21 bp, Homo sapiens
tatttattaatttgtaaggct

SEQ ID NO: 7427705 - DNA, 21 bp, Homo sapiens
tatttattaatttgtaaggct

SEQ ID NO: 7427706 - DNA, 22 bp, Homo sapiens
tatttataccaggtgatcggag

SEQ ID NO: 7427707 - DNA, 22 bp, Homo sapiens
tatttataccaggtgatcggag

SEQ ID NO: 7427708 - DNA, 22 bp, Homo sapiens
tatttataccaggtgatcggag

SEQ ID NO: 7427709 - DNA, 22 bp, Homo sapiens
tatttataatctgccaaagaga

SEQ ID NO: 7427710 - DNA, 22 bp, Homo sapiens
tatttataatctgccaaagaga

SEQ ID NO: 7427711 - DNA, 22 bp, Homo sapiens
tatttataatctgccaaagaga

SEQ ID NO: 7427712 - DNA, 22 bp, Homo sapiens
tatttataatctgccaaagaga

SEQ ID NO: 7427713 - DNA, 22 bp, Homo sapiens
tatttatattctgccttctgct

SEQ ID NO: 7427714 - DNA, 22 bp, Homo sapiens
tatttatattctgccttctgct

SEQ ID NO: 7427715 - DNA, 22 bp, Homo sapiens
tatttatattctgccttctgct

SEQ ID NO: 7427716 - DNA, 22 bp, Homo sapiens
tatttatattctgccttctgct

SEQ ID NO: 7427717 - DNA, 22 bp, Homo sapiens
tatttatcaaggtaggagaata

SEQ ID NO: 7427718 - DNA, 22 bp, Homo sapiens
tatttatattctgccttctgct

SEQ ID NO: 7427719 - DNA, 22 bp, Homo sapiens
tatttatcaaggtaggagaata

SEQ ID NO: 7427720 - DNA, 20 bp, Homo sapiens
tatttacaacttagagcctc

SEQ ID NO: 7427721 - DNA, 20 bp, Homo sapiens
tatttacaacttagagcctc

SEQ ID NO: 7427722 - DNA, 20 bp, Homo sapiens
tatttacaacttagagcctc

SEQ ID NO: 7427723 - DNA, 20 bp, Homo sapiens
tatttacaacttagagcctc

SEQ ID NO: 7427724 - DNA, 20 bp, Homo sapiens
tatttacaacttagagcctc

SEQ ID NO: 7427725 - DNA, 22 bp, Homo sapiens
tatttaatttgctcattgtgat

SEQ ID NO: 7427726 - DNA, 22 bp, Homo sapiens
tatttaatttgctcattgtgat

SEQ ID NO: 7427727 - DNA, 22 bp, Homo sapiens
tatttaattagtgattgtagag

SEQ ID NO: 7427728 - DNA, 22 bp, Homo sapiens
tatttataatctgccaaagaga

SEQ ID NO: 7427729 - DNA, 22 bp, Homo sapiens
tatttataatctgccaaagaga

SEQ ID NO: 7427730 - DNA, 22 bp, Homo sapiens
tatttataatctgccaaagaga

SEQ ID NO: 7427731 - DNA, 22 bp, Homo sapiens
tatttataatctgccaaagaga

SEQ ID NO: 7427732 - DNA, 22 bp, Homo sapiens
tatttataatctgccaaagaga

SEQ ID NO: 7427733 - DNA, 22 bp, Homo sapiens
tatttataatctgccaaagaga

SEQ ID NO: 7427734 - DNA, 22 bp, Homo sapiens
tatttataacagtgagaacggg

SEQ ID NO: 7427735 - DNA, 20 bp, Homo sapiens
tatttacaacttagagcctc

SEQ ID NO: 7427736 - DNA, 22 bp, Homo sapiens
tatttataacagtgagaacggg

SEQ ID NO: 7427737 - DNA, 22 bp, Homo sapiens
tattgacagtgactattggtag

SEQ ID NO: 7427738 - DNA, 22 bp, Homo sapiens
tattgacatttttatagcttga

SEQ ID NO: 7427739 - DNA, 22 bp, Homo sapiens
tattgacatttttatagcttga

SEQ ID NO: 7427740 - DNA, 22 bp, Homo sapiens
tattgacagtgactattggtag

SEQ ID NO: 7427741 - DNA, 22 bp, Homo sapiens
tatttaattagtgattgtagag

SEQ ID NO: 7427742 - DNA, 22 bp, Homo sapiens
tatttaattagtgattgtagag

SEQ ID NO: 7427743 - DNA, 22 bp, Homo sapiens
tatttaattagtgattgtagag

SEQ ID NO: 7427744 - DNA, 22 bp, Homo sapiens
tattgacaggtgcctgcagaca

SEQ ID NO: 7427745 - DNA, 22 bp, Homo sapiens
tattgacaggtgcctgcagaca

SEQ ID NO: 7427746 - DNA, 22 bp, Homo sapiens
tattgacaggtgcctgcagaca

SEQ ID NO: 7427747 - DNA, 22 bp, Homo sapiens
tattgacagatgcattatgttg

SEQ ID NO: 7427748 - DNA, 22 bp, Homo sapiens
tattgacagatgcattatgttg

SEQ ID NO: 7427749 - DNA, 22 bp, Homo sapiens
tattgacagagggtcagaagag

SEQ ID NO: 7427750 - DNA, 22 bp, Homo sapiens
tattgacagagggtcagaagag

SEQ ID NO: 7427751 - DNA, 22 bp, Homo sapiens
tattgacactttttgtgtagcc

SEQ ID NO: 7427752 - DNA, 22 bp, Homo sapiens
tattgacactttttgtgtagcc

SEQ ID NO: 7427753 - DNA, 19 bp, Homo sapiens
tatttcaaagtgccgtcta

SEQ ID NO: 7427754 - DNA, 22 bp, Homo sapiens
tatttattggacagtgttgctg

SEQ ID NO: 7427755 - DNA, 22 bp, Homo sapiens
tatttattggacagtgttgctg

SEQ ID NO: 7427756 - DNA, 22 bp, Homo sapiens
tatttctaagctgtaagtctga

SEQ ID NO: 7427757 - DNA, 22 bp, Homo sapiens
tatttctaagctgtaagtctga

SEQ ID NO: 7427758 - DNA, 22 bp, Homo sapiens
tatttcaacgtatgaaaagctg

SEQ ID NO: 7427759 - DNA, 22 bp, Homo sapiens
tatttcaacgtatgaaaagctg

SEQ ID NO: 7427760 - DNA, 22 bp, Homo sapiens
tatttcaacgtatgaaaagctg

SEQ ID NO: 7427761 - DNA, 22 bp, Homo sapiens
tatttcaacgtatgaaaagctg

SEQ ID NO: 7427762 - DNA, 22 bp, Homo sapiens
tatttctcagcattttacatcc

SEQ ID NO: 7427763 - DNA, 22 bp, Homo sapiens
tatttctcagcattttacatcc

SEQ ID NO: 7427764 - DNA, 22 bp, Homo sapiens
tatttctcagcattttacatcc

SEQ ID NO: 7427765 - DNA, 22 bp, Homo sapiens
tatttctattccccaggcaagt

SEQ ID NO: 7427766 - DNA, 22 bp, Homo sapiens
tatttctattccccaggcaagt

SEQ ID NO: 7427767 - DNA, 22 bp, Homo sapiens
tatttctattccccaggcaagt

SEQ ID NO: 7427768 - DNA, 22 bp, Homo sapiens
tatttctattccccaggcaagt

SEQ ID NO: 7427769 - DNA, 22 bp, Homo sapiens
tatttctattccccaggcaagt

SEQ ID NO: 7427770 - DNA, 22 bp, Homo sapiens
tatttctgaatccaaaaggtca

SEQ ID NO: 7427771 - DNA, 22 bp, Homo sapiens
tatttctgaatccaaaaggtca

SEQ ID NO: 7427772 - DNA, 22 bp, Homo sapiens
tatttctcttcaaaattgatgt

SEQ ID NO: 7427773 - DNA, 22 bp, Homo sapiens
tatttctcttcaaaattgatgt

SEQ ID NO: 7427774 - DNA, 22 bp, Homo sapiens
tatttctcttcaaaattgatgt

SEQ ID NO: 7427775 - DNA, 22 bp, Homo sapiens
tatttctgaatccaaaaggtca

SEQ ID NO: 7427776 - DNA, 22 bp, Homo sapiens
tatttctgagaaccaacttacc

SEQ ID NO: 7427777 - DNA, 22 bp, Homo sapiens
tatttctgagaaccaacttacc

SEQ ID NO: 7427778 - DNA, 22 bp, Homo sapiens
tatttctctcacggttgcctgg

SEQ ID NO: 7427779 - DNA, 22 bp, Homo sapiens
tatttctcagcattttacatcc

SEQ ID NO: 7427780 - DNA, 22 bp, Homo sapiens
tatttctcagcattttacatcc

SEQ ID NO: 7427781 - DNA, 22 bp, Homo sapiens
tatttctcttcaaaattgatgt

SEQ ID NO: 7427782 - DNA, 22 bp, Homo sapiens
tatttctctcacggttgcctgg

SEQ ID NO: 7427783 - DNA, 22 bp, Homo sapiens
tatttattggacagtgttgctg

SEQ ID NO: 7427784 - DNA, 22 bp, Homo sapiens
tatttattggacagtgttgctg

SEQ ID NO: 7427785 - DNA, 22 bp, Homo sapiens
tatttattggacagtgttgctg

SEQ ID NO: 7427786 - DNA, 22 bp, Homo sapiens
tatttattggacagtgttgctg

SEQ ID NO: 7427787 - DNA, 22 bp, Homo sapiens
tatttattggacagtgttgctg

SEQ ID NO: 7427788 - DNA, 22 bp, Homo sapiens
tatttattctttgtactgcctt

SEQ ID NO: 7427789 - DNA, 22 bp, Homo sapiens
tatttattctttgtactgcctt

SEQ ID NO: 7427790 - DNA, 22 bp, Homo sapiens
tatttattctttgtactgcctt

SEQ ID NO: 7427791 - DNA, 22 bp, Homo sapiens
tatttattggacagtgttgctg

SEQ ID NO: 7427792 - DNA, 22 bp, Homo sapiens
tatttattctttgtactgcctt

SEQ ID NO: 7427793 - DNA, 22 bp, Homo sapiens
tatttattggacagtgttgctg

SEQ ID NO: 7427794 - DNA, 22 bp, Homo sapiens
tatttattggacagtgttgctg

SEQ ID NO: 7427795 - DNA, 22 bp, Homo sapiens
tatttattcattcagcaagcat

SEQ ID NO: 7427796 - DNA, 22 bp, Homo sapiens
tatttattcattcagcaagcat

SEQ ID NO: 7427797 - DNA, 22 bp, Homo sapiens
tatttattctttgtactgcctt

SEQ ID NO: 7427798 - DNA, 22 bp, Homo sapiens
tatttattctttgtactgcctt

SEQ ID NO: 7427799 - DNA, 22 bp, Homo sapiens
tatttattctttgtactgcctt

SEQ ID NO: 7427800 - DNA, 22 bp, Homo sapiens
tatttattctttgtactgcctt

SEQ ID NO: 7427801 - DNA, 22 bp, Homo sapiens
tatttattctttgtactgcctt

SEQ ID NO: 7427802 - DNA, 22 bp, Homo sapiens
tatttattcattcagcaagcat

SEQ ID NO: 7427803 - DNA, 22 bp, Homo sapiens
tatttattcattcagcaagcat

SEQ ID NO: 7427804 - DNA, 22 bp, Homo sapiens
tatttattcattcagcaagcat

SEQ ID NO: 7427805 - DNA, 22 bp, Homo sapiens
tatttattcattcagcaagcat

SEQ ID NO: 7427806 - DNA, 22 bp, Homo sapiens
tatttattcattcagcaagcat

SEQ ID NO: 7427807 - DNA, 22 bp, Homo sapiens
tatttattcattcagcaagcat

SEQ ID NO: 7427808 - DNA, 21 bp, Homo sapiens
tatttattaatttgtaaggct

SEQ ID NO: 7427809 - DNA, 22 bp, Homo sapiens
tatttattcattcagcaagcat

SEQ ID NO: 7427810 - DNA, 22 bp, Homo sapiens
tattagcagttgtatgtgtctg

SEQ ID NO: 7427811 - DNA, 22 bp, Homo sapiens
tattagcctggatctgtgactg

SEQ ID NO: 7427812 - DNA, 22 bp, Homo sapiens
tattagctccagtactgttgcc

SEQ ID NO: 7427813 - DNA, 22 bp, Homo sapiens
tattagcttctggttttgttct

SEQ ID NO: 7427814 - DNA, 22 bp, Homo sapiens
tattagcttctggttttgttct

SEQ ID NO: 7427815 - DNA, 23 bp, Homo sapiens
tattagcaattcccacagagcag

SEQ ID NO: 7427816 - DNA, 22 bp, Homo sapiens
tattagcacaaagcaaggtatt

SEQ ID NO: 7427817 - DNA, 22 bp, Homo sapiens
tattagcacaaagcaaggtatt

SEQ ID NO: 7427818 - DNA, 22 bp, Homo sapiens
tattagcaacagagctcttgtt

SEQ ID NO: 7427819 - DNA, 22 bp, Homo sapiens
tattactcttagtggaaggtga

SEQ ID NO: 7427820 - DNA, 22 bp, Homo sapiens
tattagattaactttaatgtct

SEQ ID NO: 7427821 - DNA, 22 bp, Homo sapiens
tattagatttgtttctgtagat

SEQ ID NO: 7427822 - DNA, 22 bp, Homo sapiens
tattagattaactttaatgtct

SEQ ID NO: 7427823 - DNA, 22 bp, Homo sapiens
tattagaaaggctattgcatag

SEQ ID NO: 7427824 - DNA, 22 bp, Homo sapiens
tattagaaaggctattgcatag

SEQ ID NO: 7427825 - DNA, 22 bp, Homo sapiens
tattagaaaggctattgcatag

SEQ ID NO: 7427826 - DNA, 22 bp, Homo sapiens
tattagaaaggctattgcatag

SEQ ID NO: 7427827 - DNA, 22 bp, Homo sapiens
tattagaaagcttaatatcgtg

SEQ ID NO: 7427828 - DNA, 22 bp, Homo sapiens
tattagaggaaccaaggtggag

SEQ ID NO: 7427829 - DNA, 22 bp, Homo sapiens
tattagaaaggctattgcatag

SEQ ID NO: 7427830 - DNA, 22 bp, Homo sapiens
tattagaaagcttaatatcgtg

SEQ ID NO: 7427831 - DNA, 22 bp, Homo sapiens
tattactgttacttcacactgt

SEQ ID NO: 7427832 - DNA, 22 bp, Homo sapiens
tattactgaggttttatggagt

SEQ ID NO: 7427833 - DNA, 22 bp, Homo sapiens
tattactgtcaatatcacagaa

SEQ ID NO: 7427834 - DNA, 22 bp, Homo sapiens
tattactgaggttttatggagt

SEQ ID NO: 7427835 - DNA, 22 bp, Homo sapiens
tattactctgccatcaccagta

SEQ ID NO: 7427836 - DNA, 22 bp, Homo sapiens
tattactctgccatcaccagta

SEQ ID NO: 7427837 - DNA, 22 bp, Homo sapiens
tattactaccatctgctactat

SEQ ID NO: 7427838 - DNA, 22 bp, Homo sapiens
tattacatccacttttattgca

SEQ ID NO: 7427839 - DNA, 22 bp, Homo sapiens
tattacagttcgagtttctagg

SEQ ID NO: 7427840 - DNA, 22 bp, Homo sapiens
tattacagttcgagtttctagg

SEQ ID NO: 7427841 - DNA, 22 bp, Homo sapiens
tattacagctttgattatctgg

SEQ ID NO: 7427842 - DNA, 22 bp, Homo sapiens
tattacagggctagttatgagt

SEQ ID NO: 7427843 - DNA, 22 bp, Homo sapiens
tattacagggctagttatgagt

SEQ ID NO: 7427844 - DNA, 22 bp, Homo sapiens
tattacagggctagttatgagt

SEQ ID NO: 7427845 - DNA, 22 bp, Homo sapiens
tattacatccacttttattgca

SEQ ID NO: 7427846 - DNA, 22 bp, Homo sapiens
tattacatccacttttattgca

SEQ ID NO: 7427847 - DNA, 22 bp, Homo sapiens
tattacatccacttttattgca

SEQ ID NO: 7427848 - DNA, 22 bp, Homo sapiens
tattacagttcgagtttctagg

SEQ ID NO: 7427849 - DNA, 22 bp, Homo sapiens
tattacatccacttttattgca

SEQ ID NO: 7427850 - DNA, 22 bp, Homo sapiens
tattacagggctagttatgagt

SEQ ID NO: 7427851 - DNA, 22 bp, Homo sapiens
tattacagggctagttatgagt

SEQ ID NO: 7427852 - DNA, 22 bp, Homo sapiens
tattacagctttgattatctgg

SEQ ID NO: 7427853 - DNA, 22 bp, Homo sapiens
tattacagctttgattatctgg

SEQ ID NO: 7427854 - DNA, 22 bp, Homo sapiens
tattacagaatcaggcataact

SEQ ID NO: 7427855 - DNA, 22 bp, Homo sapiens
tattacagctttgattatctgg

SEQ ID NO: 7427856 - DNA, 22 bp, Homo sapiens
tattacagctttgattatctgg

SEQ ID NO: 7427857 - DNA, 22 bp, Homo sapiens
tattacagaatcaggcataact

SEQ ID NO: 7427858 - DNA, 22 bp, Homo sapiens
tattacactttcttcttcaagc

SEQ ID NO: 7427859 - DNA, 22 bp, Homo sapiens
tattacagaatcaggcataact

SEQ ID NO: 7427860 - DNA, 22 bp, Homo sapiens
tattacactttcttcttcaagc

SEQ ID NO: 7427861 - DNA, 19 bp, Homo sapiens
tatgtgtgcatttgtgcat

SEQ ID NO: 7427862 - DNA, 22 bp, Homo sapiens
tatgtgtgctttttccatgcat

SEQ ID NO: 7427863 - DNA, 22 bp, Homo sapiens
tatgtgtggcagctgggagtgt

SEQ ID NO: 7427864 - DNA, 22 bp, Homo sapiens
tatgtgtggagccagcctggag

SEQ ID NO: 7427865 - DNA, 22 bp, Homo sapiens
tatgtgtggcagctgggagtgt

SEQ ID NO: 7427866 - DNA, 22 bp, Homo sapiens
tatgtgtgctttttccatgcat

SEQ ID NO: 7427867 - DNA, 19 bp, Homo sapiens
tatgtgtgcatttgtgcat

SEQ ID NO: 7427868 - DNA, 19 bp, Homo sapiens
tatgtgtgcatttgtgcat

SEQ ID NO: 7427869 - DNA, 22 bp, Homo sapiens
tatgtcttgcatttttcaaact

SEQ ID NO: 7427870 - DNA, 22 bp, Homo sapiens
tatgtcttgtgtttgctaatct

SEQ ID NO: 7427871 - DNA, 22 bp, Homo sapiens
tatgtcttgtgtttgctaatct

SEQ ID NO: 7427872 - DNA, 22 bp, Homo sapiens
tatgtcttgtgtttgctaatct

SEQ ID NO: 7427873 - DNA, 22 bp, Homo sapiens
tatgtcttgtgtttgctaatct

SEQ ID NO: 7427874 - DNA, 22 bp, Homo sapiens
tatgtcttcgtcacctatctca

SEQ ID NO: 7427875 - DNA, 22 bp, Homo sapiens
tatgtcttcgtcacctatctca

SEQ ID NO: 7427876 - DNA, 22 bp, Homo sapiens
tatgtcttccctagcaggcaga

SEQ ID NO: 7427877 - DNA, 22 bp, Homo sapiens
tatgtcttgaaatgagaagcca

SEQ ID NO: 7427878 - DNA, 22 bp, Homo sapiens
tatgtcttcgtcacctatctca

SEQ ID NO: 7427879 - DNA, 22 bp, Homo sapiens
tatgtcttagaacaaaacagtg

SEQ ID NO: 7427880 - DNA, 22 bp, Homo sapiens
tatgtcttactacagcaattaa

SEQ ID NO: 7427881 - DNA, 22 bp, Homo sapiens
tatgtcttaatccttccttagg

SEQ ID NO: 7427882 - DNA, 22 bp, Homo sapiens
tatgtcttactacagcaattaa

SEQ ID NO: 7427883 - DNA, 22 bp, Homo sapiens
tatgtcttactacagcaattaa

SEQ ID NO: 7427884 - DNA, 22 bp, Homo sapiens
tatgtcttaatccttccttagg

SEQ ID NO: 7427885 - DNA, 22 bp, Homo sapiens
tatgtcttaatccttccttagg

SEQ ID NO: 7427886 - DNA, 22 bp, Homo sapiens
tatgtcttaatccttccttagg

SEQ ID NO: 7427887 - DNA, 22 bp, Homo sapiens
tatgtcttaactctagaaaggt

SEQ ID NO: 7427888 - DNA, 22 bp, Homo sapiens
tatgtctggcatgttgtaatta

SEQ ID NO: 7427889 - DNA, 22 bp, Homo sapiens
tatgtcttttccaatgctgtct

SEQ ID NO: 7427890 - DNA, 22 bp, Homo sapiens
tatgtctttgtcccactcccag

SEQ ID NO: 7427891 - DNA, 22 bp, Homo sapiens
tatgtcttttccaatgctgtct

SEQ ID NO: 7427892 - DNA, 22 bp, Homo sapiens
tatgtctttgtccatgtgcagt

SEQ ID NO: 7427893 - DNA, 22 bp, Homo sapiens
tatgtctttgtcccactcccag

SEQ ID NO: 7427894 - DNA, 22 bp, Homo sapiens
tatgtctttgtccatgtgcagt

SEQ ID NO: 7427895 - DNA, 22 bp, Homo sapiens
tatgtctttgtccatgtgcagt

SEQ ID NO: 7427896 - DNA, 22 bp, Homo sapiens
tatgtctttattctctgatgcg

SEQ ID NO: 7427897 - DNA, 22 bp, Homo sapiens
tatgtctttagtatcttttgga

SEQ ID NO: 7427898 - DNA, 22 bp, Homo sapiens
tatgtcttccctagcaggcaga

SEQ ID NO: 7427899 - DNA, 22 bp, Homo sapiens
tatgtctttagtatcttttgga

SEQ ID NO: 7427900 - DNA, 22 bp, Homo sapiens
tatgtcttttgcttgcaaatag

SEQ ID NO: 7427901 - DNA, 22 bp, Homo sapiens
tatgtcttttgcttgcaaatag

SEQ ID NO: 7427902 - DNA, 22 bp, Homo sapiens
tatgtcttttgcttgcaaatag

SEQ ID NO: 7427903 - DNA, 22 bp, Homo sapiens
tatgtctttttctcactatagt

SEQ ID NO: 7427904 - DNA, 22 bp, Homo sapiens
tatgtgaagagattaaaaaata

SEQ ID NO: 7427905 - DNA, 22 bp, Homo sapiens
tatgtgaagagattaaaaaata

SEQ ID NO: 7427906 - DNA, 22 bp, Homo sapiens
tatgtgaatacagcagtggatg

SEQ ID NO: 7427907 - DNA, 22 bp, Homo sapiens
tatgtgaatacagcagtggatg

SEQ ID NO: 7427908 - DNA, 22 bp, Homo sapiens
tatgtgacaaaagtaaactgca

SEQ ID NO: 7427909 - DNA, 22 bp, Homo sapiens
tatgtgaatacagcagtggatg

SEQ ID NO: 7427910 - DNA, 22 bp, Homo sapiens
tatgtgtctgtcgtgcataaat

SEQ ID NO: 7427911 - DNA, 22 bp, Homo sapiens
tatgtgtctgtcgtgcataaat

SEQ ID NO: 7427912 - DNA, 22 bp, Homo sapiens
tatgtgtgcatgtatacattaa

SEQ ID NO: 7427913 - DNA, 19 bp, Homo sapiens
tatgtgtgcatttgtgcat

SEQ ID NO: 7427914 - DNA, 20 bp, Homo sapiens
tatgtgcagtttggtttatc

SEQ ID NO: 7427915 - DNA, 22 bp, Homo sapiens
tatgtgcatatgcatacacaca

SEQ ID NO: 7427916 - DNA, 22 bp, Homo sapiens
tatgtgcagtttgctcttaaca

SEQ ID NO: 7427917 - DNA, 22 bp, Homo sapiens
tatgtgcaaattaattgctaga

SEQ ID NO: 7427918 - DNA, 22 bp, Homo sapiens
tatgtgcaaattaattgctaga

SEQ ID NO: 7427919 - DNA, 22 bp, Homo sapiens
tatgtgcaaattaattgctaga

SEQ ID NO: 7427920 - DNA, 22 bp, Homo sapiens
tatgtgcaaattaattgctaga

SEQ ID NO: 7427921 - DNA, 22 bp, Homo sapiens
tatgtgcacattagagagatgg

SEQ ID NO: 7427922 - DNA, 22 bp, Homo sapiens
tatgtgcacatacaagtgtgct

SEQ ID NO: 7427923 - DNA, 22 bp, Homo sapiens
tatgtgcacagagactgtagca

SEQ ID NO: 7427924 - DNA, 22 bp, Homo sapiens
tatgtgcagcacttgccattac

SEQ ID NO: 7427925 - DNA, 22 bp, Homo sapiens
tatgtgcactttgggtctggga

SEQ ID NO: 7427926 - DNA, 22 bp, Homo sapiens
tatgtgcacattagagagatgg

SEQ ID NO: 7427927 - DNA, 22 bp, Homo sapiens
tatgtgcagcacttgccattac

SEQ ID NO: 7427928 - DNA, 22 bp, Homo sapiens
tatgtgcaggggcaggagctca

SEQ ID NO: 7427929 - DNA, 22 bp, Homo sapiens
tatgtgcagtttgctcttaaca

SEQ ID NO: 7427930 - DNA, 22 bp, Homo sapiens
tatgtgatagagttactttata

SEQ ID NO: 7427931 - DNA, 22 bp, Homo sapiens
tatgtgacttgacaaagcttcc

SEQ ID NO: 7427932 - DNA, 22 bp, Homo sapiens
tatgtgatagagttactttata

SEQ ID NO: 7427933 - DNA, 22 bp, Homo sapiens
tatgtgacatatctcagtttga

SEQ ID NO: 7427934 - DNA, 22 bp, Homo sapiens
tatgtgacatatctcagtttga

SEQ ID NO: 7427935 - DNA, 20 bp, Homo sapiens
tatgtgattttctcatcaat

SEQ ID NO: 7427936 - DNA, 22 bp, Homo sapiens
tatgtgcaaaatgctagactag

SEQ ID NO: 7427937 - DNA, 22 bp, Homo sapiens
tatgtgatataggctatttgat

SEQ ID NO: 7427938 - DNA, 22 bp, Homo sapiens
tatgtgatataggctatttgat

SEQ ID NO: 7427939 - DNA, 22 bp, Homo sapiens
tatgtgatataggctatttgat

SEQ ID NO: 7427940 - DNA, 22 bp, Homo sapiens
tatgagataaatggtgccccct

SEQ ID NO: 7427941 - DNA, 22 bp, Homo sapiens
tatgagaatctgcagtatgctt

SEQ ID NO: 7427942 - DNA, 22 bp, Homo sapiens
tatgagataatagatgtgtaaa

SEQ ID NO: 7427943 - DNA, 22 bp, Homo sapiens
tatgagatactacagattgtga

SEQ ID NO: 7427944 - DNA, 22 bp, Homo sapiens
tatgagatattcccagcgtcta

SEQ ID NO: 7427945 - DNA, 21 bp, Homo sapiens
tatgagatatacttattcttt

SEQ ID NO: 7427946 - DNA, 20 bp, Homo sapiens
tatgagatttgacctcaaca

SEQ ID NO: 7427947 - DNA, 22 bp, Homo sapiens
tatgagatcccttttcctagag

SEQ ID NO: 7427948 - DNA, 22 bp, Homo sapiens
tatgagcagacagtggttttac

SEQ ID NO: 7427949 - DNA, 22 bp, Homo sapiens
tatgagcaagagtttgtgaagg

SEQ ID NO: 7427950 - DNA, 22 bp, Homo sapiens
tatgagatttggattcagtgaa

SEQ ID NO: 7427951 - DNA, 22 bp, Homo sapiens
tatgagcaagagtttgtgaagg

SEQ ID NO: 7427952 - DNA, 22 bp, Homo sapiens
tatgtacaagcacacatgtgac

SEQ ID NO: 7427953 - DNA, 22 bp, Homo sapiens
tatgtacaagcacacatgtgac

SEQ ID NO: 7427954 - DNA, 22 bp, Homo sapiens
tatgagttcagttatcttaagt

SEQ ID NO: 7427955 - DNA, 22 bp, Homo sapiens
tatgagtggcgtagaggtaggg

SEQ ID NO: 7427956 - DNA, 22 bp, Homo sapiens
tatgagtgtgaagtgagaatag

SEQ ID NO: 7427957 - DNA, 22 bp, Homo sapiens
tatgagtacaaggactctgtct

SEQ ID NO: 7427958 - DNA, 20 bp, Homo sapiens
tatgagtattactttcagga

SEQ ID NO: 7427959 - DNA, 20 bp, Homo sapiens
tatgagtattactttcagga

SEQ ID NO: 7427960 - DNA, 22 bp, Homo sapiens
tatgaggtaggtattatactta

SEQ ID NO: 7427961 - DNA, 22 bp, Homo sapiens
tatgaggtaggtattatactta

SEQ ID NO: 7427962 - DNA, 22 bp, Homo sapiens
tatgaggtaggtattatactta

SEQ ID NO: 7427963 - DNA, 22 bp, Homo sapiens
tatgaggtattacaggaaatat

SEQ ID NO: 7427964 - DNA, 22 bp, Homo sapiens
tatgaggttttggatctgtgtt

SEQ ID NO: 7427965 - DNA, 22 bp, Homo sapiens
tatgaggtaggtattatactta

SEQ ID NO: 7427966 - DNA, 19 bp, Homo sapiens
tatgagctgacaaaggcct

SEQ ID NO: 7427967 - DNA, 22 bp, Homo sapiens
tatgagctttggaatgagaaac

SEQ ID NO: 7427968 - DNA, 22 bp, Homo sapiens
tatgaggcacttcattagctgg

SEQ ID NO: 7427969 - DNA, 22 bp, Homo sapiens
tatgaggcacttcattagctgg

SEQ ID NO: 7427970 - DNA, 17 bp, Homo sapiens
tatgaggcagtttgtga

SEQ ID NO: 7427971 - DNA, 22 bp, Homo sapiens
tatgaggctaagatgttcagtg

SEQ ID NO: 7427972 - DNA, 22 bp, Homo sapiens
tatgaggctaagatgttcagtg

SEQ ID NO: 7427973 - DNA, 22 bp, Homo sapiens
tatgtacaagcacacatgtgac

SEQ ID NO: 7427974 - DNA, 22 bp, Homo sapiens
tatgtacaagcacacatgtgac

SEQ ID NO: 7427975 - DNA, 22 bp, Homo sapiens
tatgtacaagcacacatgtgac

SEQ ID NO: 7427976 - DNA, 22 bp, Homo sapiens
tatgtacaagcacacatgtgac

SEQ ID NO: 7427977 - DNA, 22 bp, Homo sapiens
tatgtacaagcacacatgtgac

SEQ ID NO: 7427978 - DNA, 22 bp, Homo sapiens
tatgtacaagcacacatgtgac

SEQ ID NO: 7427979 - DNA, 22 bp, Homo sapiens
tatgtacaagcacacatgtgac

SEQ ID NO: 7427980 - DNA, 22 bp, Homo sapiens
tatgtacaagcacacatgtgac

SEQ ID NO: 7427981 - DNA, 22 bp, Homo sapiens
tatgtacaatcagcagttcata

SEQ ID NO: 7427982 - DNA, 22 bp, Homo sapiens
tatgtacaatcagcagttcata

SEQ ID NO: 7427983 - DNA, 22 bp, Homo sapiens
tatgtacaatcagcagttcata

SEQ ID NO: 7427984 - DNA, 22 bp, Homo sapiens
tatgtacaatcagcagttcata

SEQ ID NO: 7427985 - DNA, 22 bp, Homo sapiens
tatgtacaatcagcagttcata

SEQ ID NO: 7427986 - DNA, 22 bp, Homo sapiens
tatgtacaatcagcagttcata

SEQ ID NO: 7427987 - DNA, 22 bp, Homo sapiens
tatgtacaatcagcagttcata

SEQ ID NO: 7427988 - DNA, 22 bp, Homo sapiens
tatgtacaatcagcagttcata

SEQ ID NO: 7427989 - DNA, 22 bp, Homo sapiens
tatgtacaatcagcagttcata

SEQ ID NO: 7427990 - DNA, 22 bp, Homo sapiens
tatgtacaatcagcagttcata

SEQ ID NO: 7427991 - DNA, 22 bp, Homo sapiens
tatgtacaatcagcagttcata

SEQ ID NO: 7427992 - DNA, 22 bp, Homo sapiens
tatgtacaatcagcagttcata

SEQ ID NO: 7427993 - DNA, 22 bp, Homo sapiens
tatgtacaatttgttgtatgtc

SEQ ID NO: 7427994 - DNA, 22 bp, Homo sapiens
tatgtacaatttgttgtatgtc

SEQ ID NO: 7427995 - DNA, 22 bp, Homo sapiens
tatgtacaatttgttgtatgtc

SEQ ID NO: 7427996 - DNA, 22 bp, Homo sapiens
tatgtacaatttgttgtatgtc

SEQ ID NO: 7427997 - DNA, 22 bp, Homo sapiens
tatgtacaatcagcagttcata

SEQ ID NO: 7427998 - DNA, 22 bp, Homo sapiens
tatgtacaatcagcagttcata

SEQ ID NO: 7427999 - DNA, 22 bp, Homo sapiens
tatgtacaatttgttgtatgtc

SEQ ID NO: 7428000 - DNA, 22 bp, Homo sapiens
tatgtacaatttgttgtatgtc

SEQ ID NO: 7428001 - DNA, 22 bp, Homo sapiens
tatgtacaatttgttgtatgtc

SEQ ID NO: 7428002 - DNA, 22 bp, Homo sapiens
tatgtacacacacatgcatgta

SEQ ID NO: 7428003 - DNA, 22 bp, Homo sapiens
tatgtacacacacatgcatgta

SEQ ID NO: 7428004 - DNA, 22 bp, Homo sapiens
tatgtacacacacatgcatgta

SEQ ID NO: 7428005 - DNA, 22 bp, Homo sapiens
tatgtacacacacatgcatgta

SEQ ID NO: 7428006 - DNA, 22 bp, Homo sapiens
tatgtacacacacatgcatgta

SEQ ID NO: 7428007 - DNA, 22 bp, Homo sapiens
tatgtacacacacatgcatgta

SEQ ID NO: 7428008 - DNA, 22 bp, Homo sapiens
tatgtacacacacatgcatgta

SEQ ID NO: 7428009 - DNA, 22 bp, Homo sapiens
tatgtacacacacatgcatgta

SEQ ID NO: 7428010 - DNA, 22 bp, Homo sapiens
tatgtacaccaaggattgaaaa

SEQ ID NO: 7428011 - DNA, 22 bp, Homo sapiens
tatgtacaccaaggattgaaaa

SEQ ID NO: 7428012 - DNA, 22 bp, Homo sapiens
tatgtacaccaaggattgaaaa

SEQ ID NO: 7428013 - DNA, 22 bp, Homo sapiens
tatgtacaccaaggattgaaaa

SEQ ID NO: 7428014 - DNA, 22 bp, Homo sapiens
tatgtacaccaaggattgaaaa

SEQ ID NO: 7428015 - DNA, 22 bp, Homo sapiens
tatgtacacatacacttgtaat

SEQ ID NO: 7428016 - DNA, 22 bp, Homo sapiens
tatgtacacatacacttgtaat

SEQ ID NO: 7428017 - DNA, 22 bp, Homo sapiens
tatgtacacatacacttgtaat

SEQ ID NO: 7428018 - DNA, 22 bp, Homo sapiens
tatgtacacatacacttgtaat

SEQ ID NO: 7428019 - DNA, 22 bp, Homo sapiens
tatgtacacatacacttgtaat

SEQ ID NO: 7428020 - DNA, 22 bp, Homo sapiens
tatgtacacatacacttgtaat

SEQ ID NO: 7428021 - DNA, 22 bp, Homo sapiens
tatgtacacatacacttgtaat

SEQ ID NO: 7428022 - DNA, 22 bp, Homo sapiens
tatgtacacatacacttgtaat

SEQ ID NO: 7428023 - DNA, 22 bp, Homo sapiens
tatgtacacacacatgcatgta

SEQ ID NO: 7428024 - DNA, 22 bp, Homo sapiens
tatgtacacatacacttgtaat

SEQ ID NO: 7428025 - DNA, 22 bp, Homo sapiens
tatgtacacatacacttgtaat

SEQ ID NO: 7428026 - DNA, 22 bp, Homo sapiens
tatgtacacttaagtttgagaa

SEQ ID NO: 7428027 - DNA, 22 bp, Homo sapiens
tatgtacacttaagtttgagaa

SEQ ID NO: 7428028 - DNA, 22 bp, Homo sapiens
tatgtacacttaagtttgagaa

SEQ ID NO: 7428029 - DNA, 22 bp, Homo sapiens
tatgtacagggatagaacttga

SEQ ID NO: 7428030 - DNA, 22 bp, Homo sapiens
tatgtacagggatagaacttga

SEQ ID NO: 7428031 - DNA, 22 bp, Homo sapiens
tatgtacagggatagaacttga

SEQ ID NO: 7428032 - DNA, 22 bp, Homo sapiens
tatgtacagggatagaacttga

SEQ ID NO: 7428033 - DNA, 22 bp, Homo sapiens
tatgtacagggatagaacttga

SEQ ID NO: 7428034 - DNA, 22 bp, Homo sapiens
tatgtacagggatagaacttga

SEQ ID NO: 7428035 - DNA, 22 bp, Homo sapiens
tatgtacagggatagaacttga

SEQ ID NO: 7428036 - DNA, 22 bp, Homo sapiens
tatgtacacggtggctctgaag

SEQ ID NO: 7428037 - DNA, 22 bp, Homo sapiens
tatgtacacggtggctctgaag

SEQ ID NO: 7428038 - DNA, 22 bp, Homo sapiens
tatgtacaccggggaaggtggg

SEQ ID NO: 7428039 - DNA, 22 bp, Homo sapiens
tatgtacaccggggaaggtggg

SEQ ID NO: 7428040 - DNA, 22 bp, Homo sapiens
tatgtacaccggggaaggtggg

SEQ ID NO: 7428041 - DNA, 22 bp, Homo sapiens
tatgtacacggtggctctgaag

SEQ ID NO: 7428042 - DNA, 22 bp, Homo sapiens
tatgtacaccggggaaggtggg

SEQ ID NO: 7428043 - DNA, 22 bp, Homo sapiens
tatgtacaccggggaaggtggg

SEQ ID NO: 7428044 - DNA, 22 bp, Homo sapiens
tatgtacaccaaggattgaaaa

SEQ ID NO: 7428045 - DNA, 22 bp, Homo sapiens
tatgtacaccaaggattgaaaa

SEQ ID NO: 7428046 - DNA, 22 bp, Homo sapiens
tatgtacaccggggaaggtggg

SEQ ID NO: 7428047 - DNA, 22 bp, Homo sapiens
tatgtacaccggggaaggtggg

SEQ ID NO: 7428048 - DNA, 22 bp, Homo sapiens
tatgtacataacatgaaatgca

SEQ ID NO: 7428049 - DNA, 22 bp, Homo sapiens
tatgtacataacatgaaatgca

SEQ ID NO: 7428050 - DNA, 22 bp, Homo sapiens
tatgtacataacatgaaatgca

SEQ ID NO: 7428051 - DNA, 22 bp, Homo sapiens
tatgtacatacatgtgcatacg

SEQ ID NO: 7428052 - DNA, 22 bp, Homo sapiens
tatgtacatacatgtgcatacg

SEQ ID NO: 7428053 - DNA, 22 bp, Homo sapiens
tatgtacatacatgtgcatacg

SEQ ID NO: 7428054 - DNA, 22 bp, Homo sapiens
tatgtacataacatgaaatgca

SEQ ID NO: 7428055 - DNA, 22 bp, Homo sapiens
tatgtcctgctactctctcatg

SEQ ID NO: 7428056 - DNA, 22 bp, Homo sapiens
tatgtcctgctactctctcatg

SEQ ID NO: 7428057 - DNA, 22 bp, Homo sapiens
tatgtctagacccaagaatatg

SEQ ID NO: 7428058 - DNA, 22 bp, Homo sapiens
tatgtctgaatcttatttaaat

SEQ ID NO: 7428059 - DNA, 22 bp, Homo sapiens
tatgtctctgaaccttagcaag

SEQ ID NO: 7428060 - DNA, 22 bp, Homo sapiens
tatgtctgaatcttatttaaat

SEQ ID NO: 7428061 - DNA, 22 bp, Homo sapiens
tatgtctcatggaagggcatta

SEQ ID NO: 7428062 - DNA, 22 bp, Homo sapiens
tatgtctctgaaccttagcaag

SEQ ID NO: 7428063 - DNA, 22 bp, Homo sapiens
tatgtacagtccttaacttaaa

SEQ ID NO: 7428064 - DNA, 22 bp, Homo sapiens
tatgtacagtccttaacttaaa

SEQ ID NO: 7428065 - DNA, 22 bp, Homo sapiens
tatgtacagtccttaacttaaa

SEQ ID NO: 7428066 - DNA, 22 bp, Homo sapiens
tatgtacataacatgaaatgca

SEQ ID NO: 7428067 - DNA, 22 bp, Homo sapiens
tatgtacataacatgaaatgca

SEQ ID NO: 7428068 - DNA, 22 bp, Homo sapiens
tatgtacataacatgaaatgca

SEQ ID NO: 7428069 - DNA, 22 bp, Homo sapiens
tatgtacataacatgaaatgca

SEQ ID NO: 7428070 - DNA, 22 bp, Homo sapiens
tatgtacagtccttaacttaaa

SEQ ID NO: 7428071 - DNA, 22 bp, Homo sapiens
tatgtacagtccttaacttaaa

SEQ ID NO: 7428072 - DNA, 22 bp, Homo sapiens
tatgtacagtccttaacttaaa

SEQ ID NO: 7428073 - DNA, 22 bp, Homo sapiens
tatgtacagtccttaacttaaa

SEQ ID NO: 7428074 - DNA, 22 bp, Homo sapiens
tatgtacagtccttaacttaaa

SEQ ID NO: 7428075 - DNA, 22 bp, Homo sapiens
tatgtacagtccttaacttaaa

SEQ ID NO: 7428076 - DNA, 22 bp, Homo sapiens
tatgtacagtccttaacttaaa

SEQ ID NO: 7428077 - DNA, 22 bp, Homo sapiens
tatgtacagggatagaacttga

SEQ ID NO: 7428078 - DNA, 22 bp, Homo sapiens
tatgtacagggatagaacttga

SEQ ID NO: 7428079 - DNA, 19 bp, Homo sapiens
tagaatgcccacttaaaaa

SEQ ID NO: 7428080 - DNA, 19 bp, Homo sapiens
tagaatgcccacttaaaaa

SEQ ID NO: 7428081 - DNA, 21 bp, Homo sapiens
tagaatgctattgtcttttct

SEQ ID NO: 7428082 - DNA, 22 bp, Homo sapiens
tagaatgtagtgcttcaagatt

SEQ ID NO: 7428083 - DNA, 22 bp, Homo sapiens
tagaatgtagtgcttcaagatt

SEQ ID NO: 7428084 - DNA, 22 bp, Homo sapiens
tagaatgtagtgcttcaagatt

SEQ ID NO: 7428085 - DNA, 22 bp, Homo sapiens
tagaatgtagtgcttcaagatt

SEQ ID NO: 7428086 - DNA, 22 bp, Homo sapiens
tagaatgtagtgcttcaagatt

SEQ ID NO: 7428087 - DNA, 22 bp, Homo sapiens
tagaatgtagtgcttcaagatt

SEQ ID NO: 7428088 - DNA, 22 bp, Homo sapiens
tagaatgagaaagtgtagcagg

SEQ ID NO: 7428089 - DNA, 22 bp, Homo sapiens
tagaatgagaaagtgtagcagg

SEQ ID NO: 7428090 - DNA, 22 bp, Homo sapiens
tagaatgacctcctcttagctt

SEQ ID NO: 7428091 - DNA, 22 bp, Homo sapiens
tagaatctttaaaattcatagt

SEQ ID NO: 7428092 - DNA, 22 bp, Homo sapiens
tagaatctttaaaattcatagt

SEQ ID NO: 7428093 - DNA, 20 bp, Homo sapiens
tagaatctgttctgattcat

SEQ ID NO: 7428094 - DNA, 22 bp, Homo sapiens
tagaaatggagaacagattaat

SEQ ID NO: 7428095 - DNA, 22 bp, Homo sapiens
tagaaatggagaacagattaat

SEQ ID NO: 7428096 - DNA, 22 bp, Homo sapiens
tagaatgtgcctggaatacagt

SEQ ID NO: 7428097 - DNA, 22 bp, Homo sapiens
tagaatgtgcaaatgtgcacac

SEQ ID NO: 7428098 - DNA, 22 bp, Homo sapiens
tagaatgtgcaaatgtgcacac

SEQ ID NO: 7428099 - DNA, 22 bp, Homo sapiens
tagaatgtgcaaatgtgcacac

SEQ ID NO: 7428100 - DNA, 23 bp, Homo sapiens
tagaatgtcattcaatgatatgg

SEQ ID NO: 7428101 - DNA, 23 bp, Homo sapiens
tagaatgtcattcaatgatatgg

SEQ ID NO: 7428102 - DNA, 22 bp, Homo sapiens
tagaatgtggaggtaacagact

SEQ ID NO: 7428103 - DNA, 22 bp, Homo sapiens
tagaatgtggaggtaacagact

SEQ ID NO: 7428104 - DNA, 22 bp, Homo sapiens
tagaatgtggaggtaacagact

SEQ ID NO: 7428105 - DNA, 22 bp, Homo sapiens
tagaatgtggaggtaacagact

SEQ ID NO: 7428106 - DNA, 22 bp, Homo sapiens
tagaatgtggaggtaacagact

SEQ ID NO: 7428107 - DNA, 22 bp, Homo sapiens
tagaatgtgcctggaatacagt

SEQ ID NO: 7428108 - DNA, 22 bp, Homo sapiens
tagaatgtgcctggaatacagt

SEQ ID NO: 7428109 - DNA, 22 bp, Homo sapiens
tagaatgtggaggtaacagact

SEQ ID NO: 7428110 - DNA, 22 bp, Homo sapiens
tagaatgttcacctttaaatga

SEQ ID NO: 7428111 - DNA, 22 bp, Homo sapiens
tagaatgttcacctttaaatga

SEQ ID NO: 7428112 - DNA, 22 bp, Homo sapiens
tagaatgttaagaatatgtata

SEQ ID NO: 7428113 - DNA, 22 bp, Homo sapiens
tagaattatgccttgctgtcca

SEQ ID NO: 7428114 - DNA, 22 bp, Homo sapiens
tagaatgttaagaatatgtata

SEQ ID NO: 7428115 - DNA, 22 bp, Homo sapiens
tagaatgtggaggtaacagact

SEQ ID NO: 7428116 - DNA, 22 bp, Homo sapiens
tagaatgttaagaatatgtata

SEQ ID NO: 7428117 - DNA, 22 bp, Homo sapiens
tagaatgttaagaatatgtata

SEQ ID NO: 7428118 - DNA, 22 bp, Homo sapiens
tagaatgttaagaatatgtata

SEQ ID NO: 7428119 - DNA, 23 bp, Homo sapiens
tagaattcaatctgttccacatc

SEQ ID NO: 7428120 - DNA, 23 bp, Homo sapiens
tagaattcaatctgttccacatc

SEQ ID NO: 7428121 - DNA, 22 bp, Homo sapiens
tagaattcatgttactgttagc

SEQ ID NO: 7428122 - DNA, 22 bp, Homo sapiens
tagacaaactgatacttggcga

SEQ ID NO: 7428123 - DNA, 22 bp, Homo sapiens
tagacaaactgatacttggcga

SEQ ID NO: 7428124 - DNA, 22 bp, Homo sapiens
tagacaaactgatacttggcga

SEQ ID NO: 7428125 - DNA, 22 bp, Homo sapiens
tagacaatatttgaaagtagtg

SEQ ID NO: 7428126 - DNA, 22 bp, Homo sapiens
tagacaatatttgaaagtagtg

SEQ ID NO: 7428127 - DNA, 22 bp, Homo sapiens
tagacaaactgatacttggcga

SEQ ID NO: 7428128 - DNA, 22 bp, Homo sapiens
tagacaaaagggggcagatatg

SEQ ID NO: 7428129 - DNA, 22 bp, Homo sapiens
tagacaaaagggggcagatatg

SEQ ID NO: 7428130 - DNA, 22 bp, Homo sapiens
tagaattttctgctttgatagt

SEQ ID NO: 7428131 - DNA, 22 bp, Homo sapiens
tagacaaaagggggcagatatg

SEQ ID NO: 7428132 - DNA, 22 bp, Homo sapiens
tagacaaaagggggcagatatg

SEQ ID NO: 7428133 - DNA, 22 bp, Homo sapiens
tagacaaaagggggcagatatg

SEQ ID NO: 7428134 - DNA, 22 bp, Homo sapiens
tagaatttcatgtatgttgggg

SEQ ID NO: 7428135 - DNA, 22 bp, Homo sapiens
tagaatttcatgtatgttgggg

SEQ ID NO: 7428136 - DNA, 22 bp, Homo sapiens
tagaattttctgctttgatagt

SEQ ID NO: 7428137 - DNA, 22 bp, Homo sapiens
tagaattttctgctttgatagt

SEQ ID NO: 7428138 - DNA, 22 bp, Homo sapiens
tagaattttctgctttgatagt

SEQ ID NO: 7428139 - DNA, 22 bp, Homo sapiens
tagaattttctgctttgatagt

SEQ ID NO: 7428140 - DNA, 22 bp, Homo sapiens
tagaattttctgctttgatagt

SEQ ID NO: 7428141 - DNA, 22 bp, Homo sapiens
tagaattttctgctttgatagt

SEQ ID NO: 7428142 - DNA, 22 bp, Homo sapiens
tagacaatatttgaaagtagtg

SEQ ID NO: 7428143 - DNA, 22 bp, Homo sapiens
tagacaactggagatagtctga

SEQ ID NO: 7428144 - DNA, 22 bp, Homo sapiens
tagacaatatttgaaagtagtg

SEQ ID NO: 7428145 - DNA, 22 bp, Homo sapiens
tagacaatatttgaaagtagtg

SEQ ID NO: 7428146 - DNA, 22 bp, Homo sapiens
tagacaatatttgaaagtagtg

SEQ ID NO: 7428147 - DNA, 22 bp, Homo sapiens
tagacaatatttgaaagtagtg

SEQ ID NO: 7428148 - DNA, 22 bp, Homo sapiens
tagacaatctcagcaaacacac

SEQ ID NO: 7428149 - DNA, 22 bp, Homo sapiens
tagacaatgccatcttgtggtt

SEQ ID NO: 7428150 - DNA, 22 bp, Homo sapiens
tagacacaaatctcagtgacac

SEQ ID NO: 7428151 - DNA, 22 bp, Homo sapiens
tagacacaaatctcagtgacac

SEQ ID NO: 7428152 - DNA, 22 bp, Homo sapiens
tagacacaaatctcagtgacac

SEQ ID NO: 7428153 - DNA, 22 bp, Homo sapiens
tagacacaggggaatgtgaggt

SEQ ID NO: 7428154 - DNA, 22 bp, Homo sapiens
tagacacatacccttgcccaaa

SEQ ID NO: 7428155 - DNA, 22 bp, Homo sapiens
tagacacatcaaggatcagttt

SEQ ID NO: 7428156 - DNA, 22 bp, Homo sapiens
tagacacatacccttgcccaaa

SEQ ID NO: 7428157 - DNA, 22 bp, Homo sapiens
tagacacaagagaagggtataa

SEQ ID NO: 7428158 - DNA, 22 bp, Homo sapiens
tagacacaggggaatgtgaggt

SEQ ID NO: 7428159 - DNA, 22 bp, Homo sapiens
tagacacaggggaatgtgaggt

SEQ ID NO: 7428160 - DNA, 22 bp, Homo sapiens
tagagggaagactgctagattt

SEQ ID NO: 7428161 - DNA, 22 bp, Homo sapiens
tagagggaaggaagaatggatt

SEQ ID NO: 7428162 - DNA, 22 bp, Homo sapiens
tagagggaaggaagaatggatt

SEQ ID NO: 7428163 - DNA, 22 bp, Homo sapiens
tagagggaagactgctagattt

SEQ ID NO: 7428164 - DNA, 22 bp, Homo sapiens
tagagggaaggaagaatggatt

SEQ ID NO: 7428165 - DNA, 22 bp, Homo sapiens
tagagggcaggagtgtcctact

SEQ ID NO: 7428166 - DNA, 22 bp, Homo sapiens
tagagggcaggagtgtcctact

SEQ ID NO: 7428167 - DNA, 22 bp, Homo sapiens
tagaggggaaaatgcgtattaa

SEQ ID NO: 7428168 - DNA, 22 bp, Homo sapiens
tagaggggaaaatgcgtattaa

SEQ ID NO: 7428169 - DNA, 22 bp, Homo sapiens
tagaggggaaaatgcgtattaa

SEQ ID NO: 7428170 - DNA, 22 bp, Homo sapiens
tagagggccagctggacagcga

SEQ ID NO: 7428171 - DNA, 22 bp, Homo sapiens
tagagggccagctggacagcga

SEQ ID NO: 7428172 - DNA, 22 bp, Homo sapiens
tagagggccagctggacagcga

SEQ ID NO: 7428173 - DNA, 22 bp, Homo sapiens
tagagggccagctggacagcga

SEQ ID NO: 7428174 - DNA, 22 bp, Homo sapiens
tagaggctgggaattattttca

SEQ ID NO: 7428175 - DNA, 22 bp, Homo sapiens
tagaggctcttcattgcagtag

SEQ ID NO: 7428176 - DNA, 22 bp, Homo sapiens
tagaggctcttcattgcagtag

SEQ ID NO: 7428177 - DNA, 22 bp, Homo sapiens
tagaggctcttcattgcagtag

SEQ ID NO: 7428178 - DNA, 22 bp, Homo sapiens
tagaggcttctactgctcactt

SEQ ID NO: 7428179 - DNA, 22 bp, Homo sapiens
tagaggctgggaattattttca

SEQ ID NO: 7428180 - DNA, 22 bp, Homo sapiens
tagaggctgggaattattttca

SEQ ID NO: 7428181 - DNA, 22 bp, Homo sapiens
tagaggctttcagcggtaggtc

SEQ ID NO: 7428182 - DNA, 22 bp, Homo sapiens
tagaggcttctactgctcactt

SEQ ID NO: 7428183 - DNA, 22 bp, Homo sapiens
tagaggctttcagcggtaggtc

SEQ ID NO: 7428184 - DNA, 22 bp, Homo sapiens
tagaggctttcagcggtaggtc

SEQ ID NO: 7428185 - DNA, 22 bp, Homo sapiens
tagagggaagactgctagattt

SEQ ID NO: 7428186 - DNA, 22 bp, Homo sapiens
tagaggcattgcttaatttcag

SEQ ID NO: 7428187 - DNA, 22 bp, Homo sapiens
tagaggcattaatgaataaaca

SEQ ID NO: 7428188 - DNA, 22 bp, Homo sapiens
tagaggcattaatgaataaaca

SEQ ID NO: 7428189 - DNA, 22 bp, Homo sapiens
tagaggcattaatgaataaaca

SEQ ID NO: 7428190 - DNA, 22 bp, Homo sapiens
tagaggcataagagggaagcag

SEQ ID NO: 7428191 - DNA, 22 bp, Homo sapiens
tagaggcataagagggaagcag

SEQ ID NO: 7428192 - DNA, 22 bp, Homo sapiens
tagaggcataagagggaagcag

SEQ ID NO: 7428193 - DNA, 22 bp, Homo sapiens
tagaggcataagagggaagcag

SEQ ID NO: 7428194 - DNA, 22 bp, Homo sapiens
tagaggccgaatgctgagctgg

SEQ ID NO: 7428195 - DNA, 22 bp, Homo sapiens
tagaggccgaatgctgagctgg

SEQ ID NO: 7428196 - DNA, 22 bp, Homo sapiens
tagaggccgaatgctgagctgg

SEQ ID NO: 7428197 - DNA, 22 bp, Homo sapiens
tagaggccaaaatacccggcga

SEQ ID NO: 7428198 - DNA, 22 bp, Homo sapiens
tagaggctactagaggcacctg

SEQ ID NO: 7428199 - DNA, 22 bp, Homo sapiens
tagaggcctgaaagaatgatca

SEQ ID NO: 7428200 - DNA, 22 bp, Homo sapiens
tagaggctcctgtgtgtaggtt

SEQ ID NO: 7428201 - DNA, 22 bp, Homo sapiens
tagaggctactagaggcacctg

SEQ ID NO: 7428202 - DNA, 22 bp, Homo sapiens
tagaggctactagaggcacctg

SEQ ID NO: 7428203 - DNA, 22 bp, Homo sapiens
tagaggctcttcattgcagtag

SEQ ID NO: 7428204 - DNA, 22 bp, Homo sapiens
tagaggctcctgtgtgtaggtt

SEQ ID NO: 7428205 - DNA, 22 bp, Homo sapiens
tagaggctcctgtgtgtaggtt

SEQ ID NO: 7428206 - DNA, 22 bp, Homo sapiens
tagaggctcctgtgtgtaggtt

SEQ ID NO: 7428207 - DNA, 22 bp, Homo sapiens
tagacagatttaaaggaatgga

SEQ ID NO: 7428208 - DNA, 22 bp, Homo sapiens
tagaggcagaagaaattgacaa

SEQ ID NO: 7428209 - DNA, 22 bp, Homo sapiens
tagacagatttaaaggaatgga

SEQ ID NO: 7428210 - DNA, 21 bp, Homo sapiens
tagaggcaggagggactgcag

SEQ ID NO: 7428211 - DNA, 21 bp, Homo sapiens
tagaggcaggagggactgcag

SEQ ID NO: 7428212 - DNA, 22 bp, Homo sapiens
tagaggcataagagggaagcag

SEQ ID NO: 7428213 - DNA, 21 bp, Homo sapiens
tagaggcaggagggactgcag

SEQ ID NO: 7428214 - DNA, 22 bp, Homo sapiens
tagacactgtatgagctgggtg

SEQ ID NO: 7428215 - DNA, 22 bp, Homo sapiens
tagacacatcttcatccacaat

SEQ ID NO: 7428216 - DNA, 22 bp, Homo sapiens
tagacactttagaagtaagggt

SEQ ID NO: 7428217 - DNA, 22 bp, Homo sapiens
tagacactgtatgagctgggtg

SEQ ID NO: 7428218 - DNA, 22 bp, Homo sapiens
tagacactttagaagtaagggt

SEQ ID NO: 7428219 - DNA, 22 bp, Homo sapiens
tagacagaatccagcccacgcc

SEQ ID NO: 7428220 - DNA, 22 bp, Homo sapiens
tagacactttagaagtaagggt

SEQ ID NO: 7428221 - DNA, 22 bp, Homo sapiens
tagacagagtgaagacaagtgg

SEQ ID NO: 7428222 - DNA, 22 bp, Homo sapiens
tagacagagtgaagacaagtgg

SEQ ID NO: 7428223 - DNA, 22 bp, Homo sapiens
tagacagatgttttctggctgt

SEQ ID NO: 7428224 - DNA, 22 bp, Homo sapiens
tagacacatcttcatccacaat

SEQ ID NO: 7428225 - DNA, 22 bp, Homo sapiens
tagacactagggatttagtact

SEQ ID NO: 7428226 - DNA, 22 bp, Homo sapiens
tagacactagggatttagtact

SEQ ID NO: 7428227 - DNA, 22 bp, Homo sapiens
tagacacatcttcatccacaat

SEQ ID NO: 7428228 - DNA, 23 bp, Homo sapiens
tagacactcctttgtctgtcctt

SEQ ID NO: 7428229 - DNA, 22 bp, Homo sapiens
tagacactagggatttagtact

SEQ ID NO: 7428230 - DNA, 22 bp, Homo sapiens
tagacactgtatgagctgggtg

SEQ ID NO: 7428231 - DNA, 23 bp, Homo sapiens
tagacactcctttgtctgtcctt

SEQ ID NO: 7428232 - DNA, 22 bp, Homo sapiens
tagacacatcaaggatcagttt

SEQ ID NO: 7428233 - DNA, 22 bp, Homo sapiens
tagacacatcttcatccacaat

SEQ ID NO: 7428234 - DNA, 22 bp, Homo sapiens
tagacacatcttcatccacaat

SEQ ID NO: 7428235 - DNA, 21 bp, Homo sapiens
tagaaagtcaaagctatcagc

SEQ ID NO: 7428236 - DNA, 21 bp, Homo sapiens
tagaaagtcaaagctatcagc

SEQ ID NO: 7428237 - DNA, 21 bp, Homo sapiens
tagaaagtcaaagctatcagc

SEQ ID NO: 7428238 - DNA, 22 bp, Homo sapiens
tagaaagtcaaaacactgtgtt

SEQ ID NO: 7428239 - DNA, 22 bp, Homo sapiens
tagaaagtcatgaattacacca

SEQ ID NO: 7428240 - DNA, 21 bp, Homo sapiens
tagaaagtcaaagctatcagc

SEQ ID NO: 7428241 - DNA, 22 bp, Homo sapiens
tagaaagtcatgaattacacca

SEQ ID NO: 7428242 - DNA, 22 bp, Homo sapiens
tagaaagtgaaggttaattaat

SEQ ID NO: 7428243 - DNA, 22 bp, Homo sapiens
tagaaagtcatgaattacacca

SEQ ID NO: 7428244 - DNA, 22 bp, Homo sapiens
tagaaagtagggaaggtaggat

SEQ ID NO: 7428245 - DNA, 22 bp, Homo sapiens
tagaaagtagccacttacagag

SEQ ID NO: 7428246 - DNA, 22 bp, Homo sapiens
tagaaagtagccacttacagag

SEQ ID NO: 7428247 - DNA, 22 bp, Homo sapiens
tagaaagtcaaaacactgtgtt

SEQ ID NO: 7428248 - DNA, 22 bp, Homo sapiens
tagaaagtagggaaggtaggat

SEQ ID NO: 7428249 - DNA, 22 bp, Homo sapiens
tagaaagtcaaaacactgtgtt

SEQ ID NO: 7428250 - DNA, 22 bp, Homo sapiens
tagaaagtcaaaacactgtgtt

SEQ ID NO: 7428251 - DNA, 22 bp, Homo sapiens
tagaaagtactaaatttaactg

SEQ ID NO: 7428252 - DNA, 22 bp, Homo sapiens
tagaaagtagccacttacagag

SEQ ID NO: 7428253 - DNA, 22 bp, Homo sapiens
tagaaagtactaaatttaactg

SEQ ID NO: 7428254 - DNA, 22 bp, Homo sapiens
tagaaagtactaaatttaactg
